United States Patent 11,078,247 (RNA ENCODING A THERAPEUTIC PROTEIN) - sequence listing, part 20

SEQ ID NO: 35772 - RNA, 3081 nt, Artificial Sequence
  derived and/or modified sequence opt1 from RNF111__Homo_sapiens__XP_006720638
augcacguguucagccugaucgacggcuccagcgggcucgccguccugcgccugucccucaaguuccccaugagccaguggaccccggaguacaacgagcuguacacccugaagguggacaugaaguccgagauccccagcgacgcccccaagacgcaggagucccucaagggcauccugcugcaccccgagccgaucggggcggccaagagcuuccccgccggcguggagaugaucaacuccaaggucgggaacgaguucagccaccucugcgacgacucccagaagcaggagaaggagaugaacggcaaccagcaggagcaggagaagucccugguggugcggaagaagcgcaagucccagcaggccggccccagcuacguccagaacugcgugaaggagaaccaggggauccugggccuccggcagcaccuggggacccccuccgacgaggacaacgacagcuccuucagcgacugccuguccagcccgagcuccagccuccacuucggcgacuccgacaccgugaccagcgacgaggacaaggaggucuccgugcgccacagccagacgauccugaacgccaagucccggagccacuccgcgcgcagccacaaguggccccggaccgagaccgaguccgugagcgggcugcucaugaagcgccccugccugcacggcuccagccugcggcgccuccccugccggaagcgcuucgucaagaacaacuccagccagcggacccagaagcagaaggagcgcauccugaugcagcggaagaagcgcgaggugcuggcccggcgcaaguacgcccuccugccguccagcuccagcagcuccgagaacgaccugagcuccgagagcuccagcuccagcuccacggagggcgaggaggaccucuucgugagcgccuccgagaaccaccagaacaaccccgcgguccccagcggguccaucgacgaggacgugguggucaucgaggccagcuccacgccccaggugaccgccaacgaggagaucaacgugaccagcaccgacagcgaggucgagaucgugaccgugggcgagagcuaccggagccgcuccacccuggggcacagccggucccacuggagccagggcuccagcucccacgccagccgcccgcaggagccccgcaaccggucccgcaucagcaccgucauccagccccugcggcagaacgccgcggagguggucgaccucacgguggacgaggacgagcccaccguggucccgaccaccuccgcccgcauggagagccaggccacguccgccagcaucaacaacuccaaccccagcaccuccgagcaggccagcgacaccgcguccgccgugaccagcagccagcccuccacggugagcgagaccuccgccacccugaccagcaacuccacgaccggcaccagcaucggggacgacucccggcgcaccacgagcuccgccgucaccgagaccgggcccccggccaugccccggcugcccagcugcugcccccagcacuccccgugcggcggcagcucccagaaccaccacgcgcucgggcacccccacaccagcugcuuccagcagcacggccaccacuuccagcaccaccaccaccaccaccacacgccccacccggccgugcccgugucccccagcuucuccgaccccgccugcccggucgagcgcccgccccaggugcaggcccccugcggcgccaacagcuccagcgggaccagcuaccacgagcagcaggcgcugcccguggaccuguccaacagcggcauccggucccacgggagcggcuccuuccacggggccagcgccuucgaccccugcugccccgucuccagcucccgcgccgcgaucuucggccaccaggccgccgccgccgcgcccagccagccgcucuccagcaucgacggcuacggguccagcaugguggcccagccccagccccagcccccgccccagcccucccugagcuccugccggcacuacaugcccccgcccuacgccagccugacccgcccccuccaccaccaggccuccgccugcccccacagccacggcaacccgccgccccagacccagcccccgccccagguggacuacgucaucccccaccccgugcacgcguuccacagccagaucuccagccacgccaccucccaccccguggcgcccccgccgcccacgcaccuggccagcaccgccgcccccaucccccagcaccucccgcccacccaccagcccaucucccaccacauccccgccaccgccccgcccgcccagcggcugcacccccacgaggucaugcagcgcauggaggugcagcggcgccggaugaugcagcaccccacggggcuguucguguucugcgucagccgccgggcgcacgagcggcccccgccccacccccaccgcaugcaccccaacuacggccacgggcaccacauccacgugccccagaccauguccagccacccccgccaggcccccgagcgcuccgccugggagcugggcaucgaggccggcgugaccgccgcgaccuacacgccgggggcccuccacccccaccuggcccacuaccacgcgcccccgcggcugcaccaccuccagcugggcgcccugccccugaugguccccgacauggccggguacccccacauccgcuacaucagcuccggccucgacggcaccagcuuccgggggccguuccgcggcaacuucgaggagcugauccaccuggaggagcggcucgggaacgugaaccgcggcgccucccaggggaccaucgagcggugcaccuacccccacaaguacaagaaggugacgaccgacugguucagccagcgcaagcugcacugcaagcaggacggcgaggagggcaccgaggaggacaccgaggagaagugcacgaucugccuguccauccucgaggagggggaggacguccggcgccugcccugcaugcaccuguuccaccaggugugcguggaccaguggcucaucaccaacaagaagugccccaucugccgggucgacaucgaggcccagcugccgagcgaguccuga

SEQ ID NO: 35773 - RNA, 1896 nt, Artificial Sequence
  derived and/or modified sequence opt1 from RNF112__Homo_sapiens__NP_009079
augccccgcccggcccugagcgugaccuccuucugccaccggcucggcaagcgcgagcggaagcagagcuucauggggaacuccggcaacagcuggucccacacccccuuccccaagcuggagcuggggcucggcccccagccgauggcgccccgcgagcugcccacgugcagcaucugccuggagcggcuccgcgaccccaucucccuggacugcgggcacgacuucugcauccggugcuucagcacccaccgccugccgggcugcgagccgcccugcugccccgagugccggaagaucugcaagcagaagcgcggccuccggucccugggggagaagaugaagcugcucccccagcgcccccugccgcccgcccugcaggagaccugccccguccgggccgagccccuccugcuggugcgcaucaacgccagcggcgggcucauccugcggaugggcgccaucaaccgcugccugaagcacccccucgcccgggacacccccgugugccugcuggcgguccucggggagcagcacuccggcaagagcuuccugcugaaccaccuccugcagggccugccggggcucgaguccggcgagggcgggcgcccccggggcggggaggccagccugcagggcugccgcuggggcgccaacgggcuggcccgggggaucuggauguggucccaccccuuccuccugggcaaggagggcaagaagguggcgguguuccuggucgacacgggggacgccaugagccccgagcucucccgcgagacccgcaucaagcugugcgcccugaccaccaugcucagcuccuaccagauccugagcacgagccaggagcugaaggacaccgaccucgacuaccuggagauguucgugcacguggccgaggucaugggcaagcacuacgggauggugccgauccagcaccuggaccuccuggugcgggacuccagccaccccaacaaggccggccaggggcacgucggcaacaucuuccagcgccuguccggccgguaccccaaggugcaggagcuccugcaggggaagcgcgcgcggugcugccugcugcccgccccgggccgccggcgcaugaaccaggggcacgccagccccggcgacaccgacgacgacuuccggcaccuccugggggccuacguguccgacguccugagcgccgcgccccagcacgccaagucccgcugccagggcuacuggaacgagggccgggccguggcccgcggggaccggcgccuccugaccggccagcagcuggcccaggagaucaagaaccucagcggguggaugggccggacgggcccgggguucaccucccccgacgagauggcggcccagcugcacgaccugcgcaagguggaggccgccaagcgggaguucgaggaguacguccgccagcaggacguggccaccaagcggaucuucagcgcgcuccgcgugcugcccgacaccaugcgcaaccugcucuccacgcagaaggacgccauccuggcccggcacggcgucgcccugcucugcaaggggcgcgaccagacccuggaggcgcuggaggccgagcuccaggccaccgccaaggccuucauggacagcuacaccaugcgguucugcggccaccuggcggccgucgggggcgccgugggcgccgggcugaugggccucgccgggggcguggugggggcgggcauggccgccgccgcccuggcggccgaggccggcauggucgccgcgggggccgccgugggcgccacgggggccgcgguggucggcgggggcgugggcgccgggcuggccgccaccgugggcugcauggagaaggaggaggacgagcgccuccuggagggggaccgggagccccugcuccaggaggaguga

SEQ ID NO: 35774 - RNA, 687 nt, Artificial Sequence
  derived and/or modified sequence opt1 from RNF114__Homo_sapiens__NP_061153
auggccgcccagcagcgcgacugcggcggggcggcccagcuggccgggcccgccgccgaggcggacccgcucgggcgguucacgugccccgugugccuggaggucuacgagaagcccguccaggugcccugcggccacguguucugcagcgccugccugcaggagugccucaagccgaagaagcccgugugcggggugugccgcuccgcccuggcccccggcguccgggcgguggagcuggagcgccagaucgagagcaccgagaccuccugccacggcugccggaagaacuucuuccucagcaagauccgcucccacguggcgaccugcagcaaguaccagaacuacaucauggagggggucaaggccaccaucaaggacgccucccugcagccccggaacgugccgaaccgcuacaccuuccccugccccuacugccccgagaagaacuucgaccaggagggccugguggagcacugcaagcuguuccacagcacggacaccaaguccgucgugugcccgaucugcgccagcaugcccuggggcgaccccaacuaccgguccgccaacuuccgcgagcacauccagcggcgccaccgguucagcuacgacaccuucguggacuacgacgucgacgaggaggacaugaugaaccaggugcuccagcgcuccaucaucgaccaguga

SEQ ID NO: 35775 - RNA, 3945 nt, Artificial Sequence
  derived and/or modified sequence opt1 from RNF123__Homo_sapiens__NP_071347
auggccagcaagggcgccgggauguccuucagccgcaaguccuaccggcugaccagcgacgcggagaagucccgcgugaccggcaucguccaggagaagcuccugaacgacuaccugaaccggaucuucagcuccagcgagcacgcgcccccggccgccacgucccgcaagccccucaacuuccagaaccugcccgagcaccuggaccagcuccuccagguggacaacgaggaggaggagagccagggccagguggaggggcggcuggggcccuccaccgucgugcucgaccacaccggcggcuucgaggggcugcugcucguggacgacgaccugcugggcgucaucgggcacagcaacuucggcaccauccgcuccacgaccugcguguacaaggggaaguggcucuacgaggugcugaucagcucccagggccugaugcagaucggcuggugcaccaucagcugccgguucaaccaggaggagggggucggcgacacccacaacuccuacgccuacgacgggaaccgcgugcggaaguggaacgugacgaccaccaacuacggcaaggccugggccgccggcgacaucgucagcugccucaucgaccuggacgacgggacccuguccuucugccucaacggcgugagccuggggacggccuucgagaaccugagccgcggccucgggauggcguacuucccggccaucucccugagcuucaaggaguccguggccuucaacuucggcagccggccccugcgcuaccccgucgccggcuaccggccccuccaggacccgcccuccgccgaccuggugcgcgcgcagcggcugcucgggugcuuccgcgccgugcugagcgucgagcuggaccccguggagggccggcuccuggacaaggaguccagcaaguggcgccugcgggggcagcccaccgugcuccugacccuggcccacaucuuccaccacuucgccccgcuccugcgcaaggucuaccugguggaggccgugcucauguccuuccugcugggcaucgucgagaaggggacccccacgcaggcgcagagcgugguccaccaggugcucgaccugcuguggcuguucauggaggacuacgaggugcaggacugccugaagcagcugaugaugucccugcuccggcuguaccgcuucagccccaucguccccgaccugggccuccagauccacuaccugcgccugaccaucgccauccuccggcacgagaagucccgcaaguuccugcugagcaacgugcuguucgacgugcugcgguccgucguguucuucuacaucaagagcccgcugcgcguggaggaggccggccuccaggagcugauccccaccaccugguggccccacugcuccagccgggaggggaaggaguccacggagaugaaggaggagaccgccgaggagcgccugcggcgccgggccuacgagcgcggcugccagcggcuccgcaagcggaucgaggucguggaggagcuccaggugcagauccugaagcuccugcuggacaacaaggacgacaacgggggcgaggcgagccgcuacaucuuccucaccaaguuccggaaguuccugcaggagaacgccagcgggcgcggcaacaugcccaugcugugcccgcccgaguacauggucugcuuccuccaccggcugaucuccgcccugcgcuacuacugggacgaguacaaggccagcaacccccacgccuccuucagcgaggaggcguacaucccgccccagguguucuacaacggcaagguggacuacuucgaccuccagcggcucgggggccugcugucccaccuccgcaagacccugaaggacgaccuggccagcaaggccaacaucgucaucgacccccuggagcugcaguccacggccauggacgaccucgacgaggacgaggagcccgcgcccgccauggcccagcgcccgaugcaggcccuggccgucgggggcccccugccccucccgcggcccggcuggcugagcucccccacccuggggcgcgcgaaccgguuccucagcaccgccgccgugucccugaugacgccccgccggccgcugagcaccuccgagaaggugaaggugcgcacccucagcguggagcagcggacccgcgaggacaucgagggcucccacuggaacgaggggcugcugcucggccggccgcccgaggagcccgagcagccccugaccgagaacagccugcucgagguccuggacggggccgugaugauguacaaccuguccgugcaccagcagcucggcaagauggucggcgugagcgacgacgugaacgaguacgccauggcgcugcgcgacacggaggacaagcugcggcgcugccccaagcggcgcaaggacauccucgccgagcugaccaagagccagaaggucuucuccgagaagcuggaccaccucagccggcgccuggccugggugcacgccaccguguacucccaggagaagaugcuggacaucuacuggcuccugcgggucugccugcgcaccaucgagcacggggaccggacgggcagccucuucgccuucaugcccgaguucuaccuguccguggcgaucaacagcuacuccgcccugaagaacuacuucgggcccgugcacagcauggaggagcucccgggcuacgaggagacccugacccgccuggccgccauccucgcgaagcacuucgccgacgcccggaucgucgggaccgacauccgcgacucccugaugcaggcccuggccagcuacgugugcuacccccacucccuccgcgcgguggagcggauccccgaggagcagcgcaucgccaugguccggaaccugcuggcccccuacgagcagcgcccgugggcccagaccaacuggauccucgugcggcuguggcgcggcugcggcuucggguaccgguacacgcgccugccccaccuccugaagaccaagcuggaggacgccaaccuccccagccugcagaagcccugcccguccacccugcuccagcagcacauggcggaccugcugcagcagggccccgacguggcccccagcuuccucaacuccguccugaaccagcugaacugggccuucagcgaguucaucgggaugauccaggagauccagcaggccgccgagcggcucgagcgcaacuucguggacucccggcagcugaaggugugcgcgaccugcuucgaccugagcgucucccugcuccgcgugcuggagaugacgaucacccuggugcccgagaucuuccucgacuggacccggccgaccagcgagaugcugcugcgccggcucgcccagcugcugaaccagguccucaaccgcgugacggccgagcggaaccuguucgaccgcguggucacccugcggcuccccggccuggagagcguggaccacuaccccauccugguggccgucaccgggauccucgugcagcugcugguccgcggcccggcguccgagcgcgagcaggccaccagcgugcuccuggccgaccccugcuuccagcugcgguccaucugcuaccuccugggccagcccgagcccccggcccccgggacggcccugcccgcgcccgaccgcaagcgguucagccuccaguccuacgccgacuacaucagcgccgacgagcuggcccagguggagcagaugcuggcccaccucaccuccgcgagcgcccaggccgccgccgcgucccugccgaccagcgaggaggaccugugccccaucugcuacgcccaccccaucuccgccgucuuccagcccugcggccacaagagcugcaaggccugcaucaaccagcaccucaugaacaacaaggacugcuucuucugcaagaccacgaucguguccguggaggacugggagaagggggccaacaccagcaccaccuccagcgcggccuga

SEQ ID NO: 35776 - RNA, 699 nt, Artificial Sequence
  derived and/or modified sequence opt1 from RNF125__Homo_sapiens__NP_060301
augggcagcgugcuguccaccgacagcgggaaguccgcccccgccagcgcgaccgcccgcgcccucgagcggcgccgggacccggagcugcccgucacguccuucgacugcgccgugugccuggaggugcuccaccagcccguccgcacccggugcggccacguguucugccgcagcugcaucgccaccucccugaagaacaacaaguggaccugccccuacugccgggcguaccugccgagcgagggggugcccgccacggacgucgccaagcgcaugaaguccgaguacaagaacugcgccgagugcgacacccucgugugccugagcgagaugcgggcgcacauccggaccugccagaaguacaucgacaaguacggcccccugcaggagcucgaggagaccgccgcccgcugcgugugccccuucugccagcgcgagcuguacgaggacucccugcucgaccacugcaucacgcaccaccggagcgagcgccggccggucuucugcccccugugccgccugauccccgacgagaaccccuccagcuucuccgggagccucauccggcaccuccaggugucccacacccuguucuacgacgacuucaucgacuucaacaucaucgaggaggcccugauccgccgggugcuggaccgcagccugcucgaguacgucaaccacuccaacaccaccuga

SEQ ID NO: 35777 - RNA, 1209 nt, Artificial Sequence
  derived and/or modified sequence opt1 from RNF128__Homo_sapiens__NP_078815
augaaccaggagaaccgcagcuccuucuucuggcugcucgugaucuucaccuuccugcugaagaucaccgccagcuucuccaugagcgccuacgucacggugaccuacuacaacgagaccuccaacuacaccgcgaucgagacgugcgagugcggcguguacgggcucgccagccccgucgccaacgccaugggcgugguggggaucccgaagaacaacaacuaccaggccugcgaccacaacaccgaguucuccaacaccaagaagcccuggaucgcgcugaucgagcggggcaacugcaccuucagcgagaagauccagacggccgggcgccggaacgccgacgccgucgugaucuacaacgcgcccgagaccggcaaccagaccauccagauggccaacuucggcgccguggacaucgucgccaucaugaucgggaaccugaagggcaccaagauccuccaguccauccagcgcgggauccaggugacgauggugaucgaggucggcaagaagcacgggcccugggugaaccacuacagcaucuucuucguguccgucagcuucuucaucaucaccgccgcgaccgugggcuacuucaucuucuacuccgcccggcgccugcggaacgcccgcgcccagagccggaagcagcgccagcugaaggccgacgcgaagaaggccaucggccggcuccagcugcgcacccugaagcagggggacaaggagaucggcccggacggggacuccugcgccgugugcaucgagcucuacaagcccaacgaccugguccggauccugacgugcaaccacaucuuccacaagaccugcguggaccccuggcuccuggagcaccggaccugccccaugugcaagugcgacauccugaaggcccucggcaucgagguggacgucgaggacggcagcgugucccuccaggugccggucagcaacgagaucuccaacagcgccagcucccacgaggaggacaaccgcagcgagaccgcguccagcggguacgccuccgugcagggcacggacgagccgccccuggaggagcacguccagagcaccaacgagucccugcagcuggugaaccacgaggccaacagcguggccgucgacgugaucccccacguggacaaccccaccuucgaggaggacgagacccccaaccaggagacggccguccgcgagaucaaguccuga

SEQ ID NO: 35778 - RNA, 1260 nt, Artificial Sequence
  derived and/or modified sequence opt1 from RNF130__Homo_sapiens__NP_060904
augagcugcgccggccgcgccgggcccgcgcggcuggccgcccucgcccugcugaccugcucccucuggccggcccgcgcggacaacgccagccaggaguacuacaccgcccugaucaacgugacgguccaggagcccggccgcggggcgccccugaccuuccggaucgaccggggccgcuacgggcucgacucccccaaggccgaggugcggggccaggugcuggccccgcugccccuccacggcgucgccgaccaccuggggugcgacccccagacccgcuucuucgugcccccgaacaucaagcaguggaucgcccugcuccagcggggcaacugcaccuucaaggagaagaucagccgcgccgcguuccacaacgccguggccgucgugaucuacaacaacaaguccaaggaggagcccgugacgaugacccaccccgggaccggcgacaucaucgccgucaugaucaccgagcugcgggggaaggacauccugagcuaccucgagaagaacaucuccgugcagaugacgaucgccgugggcacccgcaugcccccgaagaacuucagccggggcucccuggucuucgugagcaucuccuucaucgugcugaugaucaucagcuccgcguggcucaucuucuacuucauccagaagauccgcuacaccaacgcccgggaccgcaaccagcggcgccugggggacgccgccaagaaggccaucagcaagcugaccacgcggaccgucaagaagggcgacaaggagaccgaccccgacuucgaccacugcgcggugugcaucgaguccuacaagcagaacgacgugguccgcauccuccccugcaagcacguguuccacaagagcugcguggaccccuggcuguccgagcacugcacgugcccgaugugcaagcugaacauccucaaggcccuggggaucguccccaaccugcccugcaccgacaacguggccuucgacauggagcggcucacccgcacccaggccgugaaccgccggagcgcccugggcgaccuggcgggcgacaacucccucgggcuggagccccugcgcaccagcggcaucagcccgcucccccaggacggggagcugacgccccggaccggcgagaucaacaucgccgucaccaaggagugguucaucaucgccuccuucgggcugcucagcgcccugacccugugcuacaugaucauccgcgcgacggccucccucaacgccaacgagguggagugguucuga

SEQ ID NO: 35779 - RNA, 861 nt, Artificial Sequence
  derived and/or modified sequence opt1 from RNF135__Homo_sapiens__NP_001171921
auggccggccuggggcucggcagcgccgugcccgucuggcuggcggaggacgaccuggggugcaucaucugccagggccuccuggacuggccggccacccugcccugcgggcacuccuucugccgccacugccucgaggcccuguggggcgcccgggacgcccgccggugggcgugcccgaccugccgccagggcgccgcccagcagccccaccuccggaagaacacgcugcugcaggaccuggccgacaaguaccgccgggcggcccgcgagauccaggccgggagcgaccccgcccacugccccugccccggcuccagcucccucagcuccgccgcggcccggccccgccggcgcccggagcugcagcggguggccguggagaaguccaucaccgaggucgcccaggagcugaccgagcucguggagcaccugguggacaucguccgcagccugcagaaccagcggccccucagcgaguccgggcccgacaacgagcugagcauccugggcaaggccuucuccagcgggguggaccucuccauggcgagccccaagcuggugaccuccgacacggccgccggcaagauccgcgacauccugcacgaccucgaggagauccaggagaagcugcaggagagcgucaccuggaaggaggccccggaggcccagaugcagggcucccugcucccccggcuggagugcagcgggaccaucaccgcggccagcaucucccaggcccaggagaacagcuggaagccccgccugcccccgcacgcccacugccucacgcgggccacccugcacuccggcgagcugcucgggcugcugagcggccccuccauccagccccucaccuga

SEQ ID NO: 35780 - RNA, 738 nt, Artificial Sequence
  derived and/or modified sequence opt1 from RNF138__Homo_sapiens__NP_057355
auggccgaggaccugagcgccgcgaccuccuacaccgaggacgacuucuacugccccgugugccaggagguccucaagacgccggugcgcaccaccgccugccagcacguguucugccggaagugcuuccugaccgccaugcgcgagagcggcgcccacugcccccugugccgggggaacgucacgcgccgggagcgcgccugccccgagcgggcgcucgaccuggagaacaucaugcgcaaguucuccggcagcugccggugcugcgccaagcagaucaaguucuaccgcaugcggcaccacuacaaguccugcaagaaguaccaggacgaguacggggugagcuccaucauccccaacuuccagaucagccaggacuccgugggcaacagcaaccgcuccgagaccagcaccuccgacaacaccgagacguaccaggagaacaccagcuccagcgggcacccgaccuucaagugcccccugugccaggaguccaacuucacccggcagcgccuccuggaccacugcaacagcaaccaccuguuccagaucguccccgugacgugccccaucugcgugucccucccguggggcgaccccagccagaucacccggaacuucgucagccaccugaaccagcgccaccaguucgacuacggcgaguucgugaaccugcagcucgacgaggagacccaguaccagaccgccguggaggaguccuuccaggucaacaucuga

SEQ ID NO: 35781 - RNA, 1995 nt, Artificial Sequence
  derived and/or modified sequence opt1 from RNF139__Homo_sapiens__NP_009149
auggccgccguggggcccccgcagcagcagguccgcauggcgcaccagcaggucugggccgcccuggagguggcccuccgggugcccugccuguacaucaucgacgccaucuucaacagcuaccccgacuccagccagucccgcuucugcaucgugcugcagaucuuccuccggcuguucggcguguucgcgagcuccaucguccugauccucagccagcgcucccuguucaaguucuacaccuacagcuccgccuuccugcucgccgccaccagcgugcuggugaacuacuacgcgucccugcacaucgacuucuacggcgccuacaacacgagcgccuucgggaucgagcuccugccccggaagggcccgucccuguggauggcccucaucguccugcagcugaccuucgggaucggcuacgugacccuccugcagauccacagcaucuacucccagcugaucauccucgaccugcuggugcccgucaucggccucaucaccgagcugccccugcacauccgcgagacgcuccuguucaccagcucccugauccucacccugaacaccguguucgugcuggccgucaagcucaagugguucuacuacagcacgcgguacguguaccugcuggugcgccacauguaccggaucuacgggcuccagcugcugauggaggacaccuggaagcgcauccgguuccccgacauccuccgcgucuucuggcugacccgggugaccgcgcaggccacggugcugauguacauccuccgcauggccaacgagaccgacuccuucuucaucagcugggacgacuucugggaccugaucugcaaccugaucaucagcggcugcgacuccacccucaccguccuggggaugagcgccgugaucuccagcguggcccacuaccugggccucgggauccuggcguucaucggcuccacggaggaggacgaccggcgccugggcuucgucgccccggugcuguucuucauccucgcccugcagaccgggcugagcggccuccggcccgaggagcgccugauccggcugucccgcaacaugugccuccugcugaccgccguccuccacuucauccacgggaugaccgaccccgugcugaugagccuguccgccagccacguguccagcuuccggcgccacuuccccguccucuucguguccgcgugccuguucauccugccggugcuccugagcuacguccuguggcaccacuacgcccucaacacguggcuguucgccgugaccgccuucugcguggagcugugccucaaggucaucgugucccugaccguguacacccuguucaugaucgacggcuacuacaacguccucugggagaagcuggacgacuacguguacuacgugcgcagcacgggcuccaucaucgaguucaucuucggggucgugauguucggcaacggggccuacaccaugauguucgagagcggcuccaagauccgggcguucaugaugugccugcacgccuacuucaacaucuaccuccaggccaagaacggguggaagaccuucaugaaccgccggaccgccgugaagaagaucaacagccugcccgagaucaagggcagccgccugcaggagaucaacgacgucugcgcgaucugcuaccacgaguucacgaccuccgcccggaucacccccugcaaccacuacuuccacgcccucugccugcgcaaguggcuguacauccaggacacgugccccaugugccaccagaagguguacaucgaggacgacaucaaggacaacagcaacguguccaacaacaacggcuucaucccgcccaacgagacccccgaggaggccguccgggaggccgcggccgagagcgaccgcgagcucaacgaggacgacuccaccgacugcgacgacgacgugcagcgggagcgcaacggggugauccagcacaccggcgccgccgccgaggaguucaacgacgacaccgacuga

SEQ ID NO: 35782 - RNA, 879 nt, Artificial Sequence
  derived and/or modified sequence opt1 from RNF144A__Homo_sapiens__XP_005246259
augaccaccacgcgcuaccggcccaccugggaccuggcccucgacccgcuggugagcugcaagcugugccucggcgaguaccccgucgagcagaugaccaccaucgcccagugccagugcaucuucugcacgcugugccugaagcaguacguggagcuccugaucaaggaggggcuggagaccgcgaucuccugccccgacgccgccugccccaagcagggccaccuccaggagaacgagaucgagugcaugguggccgccgagaucaugcagcgcuacaagaagcugcaguucgagcgggagguccuguucgacccgugccgcaccuggugccccgcgagcaccugccaggccgugugccagcuccaggacguggggcugcagacgccccagcccguccagugcaaggccugccggauggaguucugcuccaccugcaaggccagcuggcacccgggccaggggugccccgagaccaugcccaucaccuuccugcccggcgagacguccgcggccuucaagauggaggaggacgacgccccgaucaagcgcugccccaagugcaagguguacaucgagcgggacgagggcugcgcccagaugaugugcaagaacugcaagcacgccuucugcugguacugccucgagagccuggacgacgacuuccugcucauccacuacgacaaggggcccugccgcaacaagcugggccacucccgggcgagcgugaucuggcaccgcacccaggucguggggaucuucgccggcuucgggcugcuccugcugguggccucccccuuccuccugcuggccaccccguucguccucugcugcaagugcaagugcagcaagggcgacgacgacccccugcccaccuga

SEQ ID NO: 35783 - RNA, 912 nt, Artificial Sequence
  derived and/or modified sequence opt1 from RNF144B__Homo_sapiens__XP_005249041
augggcagcgccgggcgccugcacuaccucgccaugaccgcggagaaccccaccccgggcgaccuggcccccgcgccccugaucacgugcaagcucugccugugcgagcagucccuggacaagaugaccacccuccaggagugccagugcaucuucugcaccgccugccugaagcaguacaugcagcuggccauccgggaggggugcggcagccccaucacgugcccggacauggugugccucaaccacgggacccugcaggaggccgagaucgccugccugguccccguggaccaguuccagcucuaccagcgccugaaguucgagcgggaggugcaccuggaccccuaccgcaccuggugccccgucgccgacugccagaccgugugcccgguggccuccagcgaccccggccagcccguccucguggagugccccuccugccaccugaaguucugcagcugcugcaaggacgcguggcacgccgagguguccugccgggacagccagccgaucguccugcccacggagcaccgcgcccucuucggcaccgacgccgaggcccccaucaagcagugccccgugugccggguguacaucgagcgcaacgaggggugcgcgcagaugaugugcaagaacugcaagcacaccuucugcugguacugccugcagaaccuggacaacgacaucuuccuccggcacuacgacaagggcccgugccgcaacaagcuggggcacucccgggccagcgucauguggaaccgcacccagguggugggcauccuggucgggcucggcaucaucgcccuggugacgagcccccugcuccugcuggccucccccugcaucaucugcugcgugugcaaguccugccggggcaagaagaagaagcacgaccccagcaccaccuga

SEQ ID NO: 35784 - RNA, 1080 nt, Artificial Sequence
  derived and/or modified sequence opt1 from RNF146__Homo_sapiens__NP_001229778
augauggccggcugcggggagaucgaccacagcaucaacaugcugcccaccaaccgcaaggccaacgaguccugcagcaacaccgcgccgucccucacggugcccgagugcgccaucugccugcagaccugcguccaccccgugagccugcccugcaagcacguguucugcuaccucugcgucaagggcgccuccuggcuggggaagcggugcgcccugugccgccaggagaucccggaggacuuccucgacaagcccacccugcugagccccgaggagcucaaggccgcgucccggggcaacggggaguacgccugguacuacgagggccgcaacggcugguggcaguacgacgagcggaccagccgcgagcuggaggacgccuucuccaaggggaagaagaacacggagaugcugaucgccggcuuccucuacguggcggaccuggagaacauggugcaguaccggcgcaacgagcacgggcggcgccggaagaucaagcgcgacaucaucgacauccccaagaagggcgucgccgggcugcggcucgacugcgacgccaacaccgugaaccuggcccgcgagagcuccgccgacggcgcggacagcguguccgcccagagcggcgccuccguccagccgcuggugagcuccgugcggccccucaccagcgucgacgggcagcugaccucccccgccacgcccagcccggacgccagcaccucccuggaggacagcuucgcgcaccuccagcuguccggcgacaacaccgccgagcgcagccaccgcggggagggcgaggaggaccacgagucccccagcuccggccgggugcccgcccccgacaccagcaucgaggagacggaguccgacgccagcuccgacagcgaggacguguccgccgucguggcgcagcacagccugacccagcagcggcuccugguguccaacgccaaccagaccgucccggaccgcagcgaccgguccgggaccgaccgcagcguggccggcgggggcacgguguccgucagcgugcgcagccggcgccccgacgggcagugcaccgugaccgaggucuga

SEQ ID NO: 35785 - RNA, 1203 nt, Artificial Sequence
  derived and/or modified sequence opt1 from RNF149__Homo_sapiens__NP_775918
auggccuggcgccggcgcgaggccagcgugggcgcgcgcgggguccuggcccucgcccugcuggcccucgcccugugcgugcccggcgcgcgggggcgggcccuggagugguucuccgccguggucaacaucgaguacguggacccgcagaccaaccucaccguguggagcgucuccgagagcggccgcuucggggacuccagccccaaggagggcgcccacggccuggugggggugcccugggcgcccggcggggaccuggagggcugcgccccggacacgcgguucuucguccccgagcccgggggccgcggcgccgcccccuggguggcccucguggcgcgcgggggcugcaccuucaaggacaagguccugguggccgcccggcggaacgccuccgccgugguccuguacaacgaggagcgcuacgggaacaucacccucccgaugagccacgcgggcaccggcaacaucguggugaucaugaucuccuaccccaaggggcgggagauccuggagcugguccagaagggcauccccgugacgaugaccaucggggugggcacccgccacguccaggaguucaucagcgggcaguccgugguguucgucgccaucgccuucaucaccaugaugaucaucagccucgccuggcugaucuucuacuacauccagcgguuccuguacacgggcucccagaucggcagccagucccaccgcaaggagaccaagaaggugaucgggcagcuccugcugcacaccgucaagcacggcgagaaggggaucgacguggacgccgagaacugcgcggugugcaucgagaacuucaaggucaaggacaucauccggauccuccccugcaagcacaucuuccaccgcaucugcaucgacccguggcugcuggaccaccggaccugccccaugugcaagcucgacgugaucaaggcccugggcuacuggggcgagcccggggacgugcaggagaugcccgccccggagagcccgcccggccgcgaccccgccgccaaccugucccucgcgcugcccgacgacgacgggagcgacgacuccagcccgcccagcgccucccccgccgagagcgagccccagugcgaccccuccuucaagggcgacgccggggagaacacggcgcugcucgaggccggccggagcgacucccgccacgggggccccaucagcuga

SEQ ID NO: 35786 - RNA, 1047 nt, Artificial Sequence
  derived and/or modified sequence opt1 from RNF14__Homo_sapiens__XP_005268598
augcaguuccugaaggaggagacccucgccuaccugaacaucgugagccccuucgagcugaagaucggcucccagaagaagguccagcgccggaccgcccaggcgagcccgaacacggagcucgacuucgggggcgccgccggguccgacguggaccaggaggagaucguggacgagcgcgccguccaggacguggagagccuguccaaccugauccaggagauccucgacuucgaccaggcccagcagaucaagugcuucaacagcaagcuguuccugugcuccaucugcuucugcgagaagcucggcagcgagugcauguacuuccuggagugccggcacguguacugcaaggcgugccugaaggacuacuucgagauccagauccgcgacgggcagguccagugccucaacugccccgagcccaagugccccuccguggccaccccgggccaggugaaggagcuggucgaggccgagcuguucgcccgguacgaccgccuccugcugcagagcucccucgaccugauggcggacgugguguacugcccccggcccugcugccagcugcccgucaugcaggagccgggcugcaccauggggaucugcagcuccugcaacuucgccuucugcacccucugccgccugacguaccacggcgugagccccugcaaggugaccgccgagaagcugauggaccuccggaacgaguaccugcaggccgacgaggccaacaagcgccugcucgaccagcgguacgggaagcgcgucauccagaaggcgcuggaggagauggaguccaaggaguggcuggagaagaacagcaaguccugccccugcugcggcacccccaucgagaagcucgacgggugcaacaagaugaccugcacgggcugcaugcaguacuucugcuggaucugcaugggcagccugucccgggccaacccguacaagcacuucaacgaccccgggagccccugcuucaaccgccuguucuacgccguggacguggacgacgacaucugggaggacgaggucgaggacuga

SEQ ID NO: 35787 - RNA, 1317 nt, Artificial Sequence
  derived and/or modified sequence opt1 from RNF150__Homo_sapiens__NP_065775
auggccaugagccugauccaggccugcugcucccucgcgcugagcaccuggcugcucuccuucugcuucgugcaccuccugugccuggacuucaccguggccgagaaggaggagugguacacggccuucgugaacaucaccuacgccgagcccgccccggaccccggcgcgggggccgccggcgggggcggggccgagcugcacaccgagaagaccgagugcggccgcuacggcgagcacagccccaagcaggacgcgcgcggggagguggucauggccuccagcgcccacgaccgccuggccugcgaccccaacacgaaguucgccgcgccgacccggggcaagaacuggaucgcccucauccccaaggggaacugcaccuaccgcgacaagauccggaacgccuuccugcagaacgccuccgccguggugaucuucaacgucggcagcaacaccaacgagacgaucaccaugccccacgcggggguggaggacaucguggccaucaugauccccgagccgaagggcaaggagaucgucucccugcucgagcgcaacaucaccgugaccauguacaucacgaucggcacccggaaccugcagaaguacgugagccgcaccuccgucguguucgugagcaucuccuucaucguccugaugaucaucagccucgccuggcugguguucuacuacauccagcgguuccgcuacgccaacgcccgggaccgcaaccagcggcgccugggggacgcggccaagaaggccaucuccaagcuccagauccggaccaucaagaagggcgacaaggagacggagagcgacuucgacaacugcgccgugugcaucgagggguacaagcccaacgacgucgugcgcauccugcccugccggcaccuguuccacaaguccugcguggaccccuggcuccuggaccaccggaccugcccgaugugcaagaugaacauccugaaggcccucggcaucccgcccaacgcggacugcauggacgaccugcccaccgacuucgagggcagccugggcgggccgcccaccaaccagaucacgggggccuccgacaccaccgucaacgagagcagcgugacccucgaccccgccgugcggacggucggcgcccuccaggugguccaggacaccgaccccaucccccaggagggggacgugaucuucaccaccaacuccgagcaggagcccgcggugagcuccgacagcgacaucucccugaucauggccauggaggucggccugagcgacguggagcuguccacggaccaggacugcgaggaggucaagagcuga

SEQ ID NO: 35788 - RNA, 612 nt, Artificial Sequence
  derived and/or modified sequence opt1 from RNF152__Homo_sapiens__NP_775828
auggagacccugagccaggacucccuccuggagugccagaucugcuucaacuacuacagcccccgccggcgcccgaagcugcucgacugcaagcacacgugcugcuccgugugccugcagcagaugcggaccagccagaaggacguccgcugccccuggugccggggcgugaccaagcugccgcccggguucuccgugagccagcuccccgacgaccccgagguccuggccgugaucgccaucccccacaccuccgagcacacccccguguucaucaagcugccgagcaacggcugcuacaugcucccccugcccaucuccaaggagcgcgcccugcuccccggggacaugggcugccggcugcugccggggagccagcagaaguccgucacgguggugaccauccccgccgagcagcagccccuccagggcggcgcgccccaggaggccgucgaggaggagcaggaccgccgcgggguggucaagagcuccaccuggagcggcgugugcaccgugauccugguggccugcguccugguguuccuccuggggaucgugcugcacaacauguccugcaucagcaagcgguucacggucaucuccugcggcuga

SEQ ID NO: 35789 - RNA, 2040 nt, Artificial Sequence
  derived and/or modified sequence opt1 from RNF157__Homo_sapiens__NP_443148
augggcgcccugaccagccgccagcacgccgggguggaggaggucgacauccccuccaacagcguguaccgguacccgcccaaguccggcagcuacuucgcgucccacuucaucaugggcggggagaaguucgacagcacccaccccgagggguaccucuucggcgagaacuccgaccugaacuuccugggcaaccgccccguggucuucccguacgccgccccgccgccccaggagcccgugaagacgcuccggagccuggugaacauccgcaaggacacccugcggcucgucaagugcgccgaggaggugaagucccccggggaggaggccagcaaggcgaaggugcacuacaacgucgaguucaccuucgacaccgacgcccgcguggccaucacgaucuacuaccaggccaccgaggaguuccagaacggcaucgcguccuacauccccaaggacaacagccugcaguccgagaccgugcaguacaagcgcggggucugccagcaguucugccugcccagccacaccguggaccccuccgagugggccgaggaggagcucggcuucgaccuggaccgggagguguacccccuggucgugcacgccguggucgacgagggggacgaguacuucggccacugccacgugcuccugggcacguucgagaagcacaccgacgggaccuucugcgugaagccccugaagcagaagcaggucguggacggcgugagcuaccuccugcaggagaucuacgggaucgagaacaaguacaacacccaggacuccaaggucgccgaggacgaggugagcgacaacuccgccgagugcgucgugugccugagcgacgugcgggacacgcucauccugcccugccgccaccugugccucugcaacacgugcgcggacacccugcgguaccaggccaacaacugcccgaucugccgccugcccuuccgggcccuccugcagauccgcgccaugcggaagaagcugggcccccucagccccaccuccuucaacccgaucaucagcucccagaccagcgacuccgaggagcaccccagcuccgagaacaucccgcccggcuacgaggucgugagccugcuggaggcccucaacgggccccugacccccucccccgcggugcccccgcugcacguccucggcgacgggcaccugagcggcaugcugcccuccuacgggagcgacggccaccucccgcccgugcgcaccaucagcccccuggaccggcuguccgacuccagcucccagggccucaagcugaagaagucccugagcaagagcaccagccagaacuccagcgugcuccacgaggaggaggacgagcacuccugcagcgaguccgagacgcagcugagccagcgccccuccguccagcaccugggggaggagugcggcgugacccccgagagcgagaaccucacccuguccagcuccggggccaucgaccagagcuccugcaccggcacgccgcugagcuccaccaucagcucccccgaggggcccgccagcagcucccucgcccagagcgugauguccauggccagcucccagaucagcaccgacaccgucuccagcauguccggcagcuacaucgcgcccggcacggaggaggagggggaggcccuguccagcccgcagcccgccucccgggcccccagcgaggagggcgaggggcugcccgccgaguccccggacagcaacuucgcgggccugcccgccggggagcaggacgccgagggcaacgacgugaucgaggaggaggacggcucccccacccaggaggggcagcggaccugcgccuuccucggcauggagugcgacaacaacaacgacuucgacaucgcgagcgugaaggcccuggacaacaagcugugcuccgaggucugccuccccggggccuggcaggccgacgacaacgccgugagccgcaacgcgcagcgccgccggcugagcuccagcucccuggaggacagcgagacccgcccgugcguguggggcccccucgccgucuga

SEQ ID NO: 35790 - RNA, 1053 nt, Artificial Sequence
  derived and/or modified sequence opt1 from RNF167__Homo_sapiens__NP_056343
augcaccccgccgccuucccccugcccguggucguggccgccgugcucuggggcgccgcccccacccgcgggcugauccgggccaccagcgaccacaacgcguccauggacuucgccgaccugcccgcccucuucggcgccacgcugagccaggaggggcugcagggcuuccucgucgaggcgcacccggacaacgccugcucccccaucgccccgccgccgcccgcccccgugaacgggagcguguucaucgcccugcugcgccgguucgacugcaacuucgaccucaagguccugaacgcgcagaaggccggcuacggcgccgccguggugcacaacgucaacuccaacgagcugcucaacaugguguggaacagcgaggagauccagcagcagaucuggauccccuccguguucaucggggagcgcagcuccgaguaccugcgggcccuguucgucuacgagaagggcgcgcgcgugcuccuggugcccgacaacaccuucccccugggguacuaccucauccccuucaccggcaucgucgggcugcuggugcucgccaugggcgccgugaugaucgcccggugcauccagcaccgcaagcggcugcagcgcaaccggcugaccaaggagcagcucaagcagauccccacgcacgacuaccagaagggcgaccaguacgacgucugcgccaucugccuggacgaguacgaggacggggacaagcugcgcgugcuccccugcgcgcacgccuaccacagccggugcguggaccccuggcugacccagacccgcaagaccugccccaucugcaagcagcccguccaccggggcccgggggacgaggaccaggaggaggagacgcagggccaggaggagggcgacgagggggagccccgcgaccaccccgccuccgagcggacgccccugcucggcagcuccccgacccugcccaccagcuucgggucccuggcccccgcgccccucguguucccgggccccagcaccgacccgccccuguccccgcccagcucccccgugauccuggucuga

SEQ ID NO: 35791 - RNA, 1716 nt, Artificial Sequence
  derived and/or modified sequence opt1 from RNF168__Homo_sapiens__NP_689830
auggcccugcccaaggacgccaucccgagccucuccgagugccagugcggcaucugcauggagauccugguggagcccgucacccugcccugcaaccacacccucugcaagcccugcuuccagagcacgguggagaaggcgucccugugcugcccguucugccgccggcgcgugagcuccuggacccgguaccacacccgccggaacagccuggucaacguggagcucuggaccaucauccagaagcacuacccccgcgagugcaagcugcgggccuccgggcaggagagcgaggagguggccgacgacuaccagcccguccgccugcucuccaagcccggcgagcugcggcgcgaguacgaggaggagaucagcaagguggccgccgagcggcgcgcguccgaggaggaggagaacaaggccagcgaggaguacauccagcggcugcucgccgaggaggaggaggaggagaagcgccaggccgagaagcggcgccgggcgauggaggagcagcugaaguccgacgaggagcuggcccgcaagcucagcaucgacaucaacaacuucugcgagggguccaucagcgccuccccgcugaacagccggaaguccgaccccgugacgcccaagagcgagaagaaguccaagaacaagcagcgcaacaccggcgacauccagaaguaccugacccccaagagccaguucgggagcgccucccacagcgaggccguccaggaggugcggaaggacuccgugagcaaggacaucgacuccagcgaccgcaaguccccgaccggccaggacacggagaucgaggacaugcccacccucagcccccagaucucccugggcgucggggagcagggcgcggacagcuccaucgagagccccaugccguggcugugcgccugcggggccgagugguaccacgagggcaacgugaagacccgccccuccaaccacgggaaggagcucugcgugcugagccacgagcggcccaagacccgcguccccuacuccaaggagacggccgugaugccgugcggccggaccgagagcggcugcgcccccaccuccggggugacccagacgaacggcaacaacaccggggagaccgagaacgaggagagcugccugcucaucagcaaggagaucuccaagcgcaagaaccaggagagcuccuucgaggcggucaaggaccccugcuucagcgccaagcggcgcaaggugucccccgagagcuccccggaccaggaggagaccgagaucaacuucacgcagaagcugaucgaccuggagcaccuccuguucgagcggcacaagcaggaggagcaggaccgccugcucgcccugcagcugcagaaggagguggacaaggagcagaugguccccaaccggcagaagggcagccccgacgaguaccaccuccgcgccaccuccagcccgcccgacaaggugcugaacggccagcggaagaaccccaaggacgggaacuucaagcgccagacccacaccaagcaccccacgccggagcggggcucccgcgacaagaaccgccaggugagccugaagaugcagcucaagcaguccgucaaccggcggaagaugcccaacagcacccgcgaccacugcaagguguccaagagcgcccacucccugcagcccagcaucagccagaaguccgucuuccagauguuccagcggugcaccaaguga

SEQ ID NO: 35792 - RNA, 777 nt, Artificial Sequence
  derived and/or modified sequence opt1 from RNF170__Homo_sapiens__NP_001153695
auggccaaguaccagggcgaggugcagagccugaagcucgacgacgacuccgucaucgagggggugagcgaccaggugcuggucgccgugguggucuccuucgcgcugaucgccacccucguguacgcccuguuccgcaacgugcaccagaacauccaccccgagaaccaggagcugguccgggugcuccgcgagcagcugcagaccgagcaggacgccccggccgcgacgcggcagcaguucuacaccgacauguacugccccaucugccugcaccaggccagcuuccccguggagaccaacugcggccaccucuucugcggggccugcaucaucgccuacuggcgcuacggcuccuggcugggggcgaucagcugccccaucugccggcagaccgucacgcugcuccugaccguguucggcgaggacgaccagucccaggacgugcugcgccuccaccaggacaucaacgacuacaaccggcgcuucagcggccagccgcgguccaucauggagcgcaucauggaccugcccacccugcuccggcacgccuuccgcgagauguucagcgucgggggccuguucuggauguuccggauccgcaucauccugugccucaugggggccuucuucuaccugaucagcccccuggacuucgugcccgaggcccucuucggcauccugggguuccuggacgacuucuucgugaucuuccuccugcugaucuacaucuccaucauguaccgggaggucaucacccagcgccucacgcgguga

SEQ ID NO: 35793 - RNA, 1779 nt, Artificial Sequence
  derived and/or modified sequence opt1 from RNF180__Homo_sapiens__NP_001107033
augaagcgcagcaaggagcugaucaccaagaaccacucccaggaggagaccagcauccuccggugcuggaagugccgcaagugcaucgccuccagcggcugcuucauggaguaccuggagaaccaggugaucaaggacaaggacgacuccgucgacgcccagaacaucugccacguguggcacaugaacguggaggcgcugcccgaguggaucagcugccucauccagaaggcccaguggacggucgggaagcugaacugcccguucugcggcgcccggcucgggggcuucaacuucguguccacccccaagugcagcugcgggcagcuggccgccgugcaccuguccaagagccgcaccgacuaccagcccacccaggcgggccggcugaugcgccccuccgucaaguaccucagccacccgcgggugcaguccggcugcgacaaggaggcccugcugaccgggggcgggagcgagaaccgcaaccaccggcuccugaacauggcccgcaacaacaacgaccccggccggcugacggaggcccucugccuggaggugcgccccaccuacuucgagaugaagaacgagaagcugcucuccaaggcgagcgagcccaaguaccagcuguucgucccgcagcuggugaccgggcggugcgccacgcgcgccuuccaccggaagucccacagccucgaccugaacaucuccgagaagcugacccuccugcccacccuguacgagauccacagcaagaccacggccuacagccgccucaacgagacccagcccaucgaccuguccggccugccccuccagagcuccaagaacagcuacuccuuccagaacccgagcuccuucgaccccagcaugcugcugcagcgguucuccguggcgccccacgagacccagacccagcgcggcggggaguuccagugcggccucgaggccgccagcgucuacuccgaccacacgaacaccaacaaccugaccuuccugauggaccuccccagcgccgggcgguccaugccggaggccagcgaccaggaggagcaccugagcccccuggacuuccuccacagcgccaacuucucccugggcagcaucaaccagcgccugaacaagcgggagcgcuccaagcucaagaaccugcgccggaagcagcgccggcgcgagcgguggcugcagaagcagggcaaguacagcggggugggccuccuggaccacaugacccugaacaacgagaugagcacggacgaggacaacgaguacgcggaggagaaggacuccuacaucugcgccgugugccucgacgucuacuucaaccccuacaugugcuaccccugccaccacaucuucugcgagccgugccugcgcacccuggccaaggacaaccccagcuccacccccugcccccugugccggaccaucaucagccgcguguucuuccagacggagcucaacaacgccaccaagaccuucuucaccaaggaguaccugaagaucaagcaguccuuccagaaguccaacuccgccaaguggccgcugcccagcugccggaaggcguuccaccucuucgggggcuuccgccggcacgccgcccccgugacgcgccggcaguucccccacggggcccaccgcauggacuaccugcacuucgaggacgacucccggggcuggugguucgacauggacauggucaucaucuacaucuacagcgugaacugggugaucggcuucaucgucuucugcuuccugugcuacuucuucuucccguucuga

SEQ ID NO: 35794 - RNA, 744 nt, Artificial Sequence
  derived and/or modified sequence opt1 from RNF182__Homo_sapiens__NP_001158506
auggccagccagcccccggaggacaccgccgagucccaggccagcgacgagcuggagugcaagaucugcuacaaccgcuacaaccucaagcagcggaagcccaaggugcuggagugcugccaccgcgucugcgccaagugccuguacaagaucaucgacuucggcgacagcccccagggggugaucgugugccccuucugccgguucgagaccugccucccggacgacgaggucuccucccugcccgacgacaacaacauccuggugaaccucacgugcggcgggaagggcaagaagugccugcccgagaaccccaccgagcugcuccugaccccgaagcgccuggccagccucgugucccccagccacaccuccagcaacugccuggucaucacgaucauggaggugcagcgggaguccagccccucccugagcuccacccccguggucgaguucuaccgcccggccagcuucgacuccgugaccaccgugagccacaacuggacggucuggaacugcaccucccuccuguuccagaccagcauccgggugcugguguggcuccuggggcugcucuacuucagcucccugccccugggcaucuaccuccuggucagcaagaaggugacccugggcguggucuucgugucccucgugcccagcucccuggucauccugaugguguacggguucugccagugcgugugccacgaguuccucgacugcauggcgcccccgagcuga

SEQ ID NO: 35795 - RNA, 2517 nt, Artificial Sequence
  derived and/or modified sequence opt1 from RNF19A__Homo_sapiens__XP_005250910
augcaggagcaggagaucggcuucaucagcaaguacaacgaggggcugugcgugaacaccgaccccgucuccauccucaccagcauccuggacaugucccugcaccgccagaugggcagcgaccgggaccuccaguccagcgccuccagcgugucccugccgagcgugaagaaggcccccaagaagcgccggaucuccaucgggagccuguuccgccggaagaaggacaacaagcgcaagucccgggagcucaacggcggggucgacggcaucgcgagcaucgaguccauccacagcgagaugugcacggacaagaacuccaucuucagcaccaacaccuccagcgacaacggccugaccagcaucuccaagcagaucggggacuucaucgagugcccccugugccuccugcgccacagcaaggaccgguuccccgacaucaugacgugccaccaccgcuccugcguggacugccugcggcaguaccuccgcaucgagaucagcgagucccgggugaacaucagcugcccggagugcaccgagcgcuucaacccccacgacauccggcugauccuguccgacgacguccucauggagaaguacgaggaguucaugcugcgccgguggcugguggccgaccccgacugccgcuggugccccgccccggacugcggcuacgccgugaucgccuucgggugcgcgagcugccccaagcugaccugcggccgggaggggugcggcaccgaguucugcuaccacugcaagcagaucuggcaccccaaccagacgugcgacgccgcccgccaggagcgggcccagucccuccgccugcgcaccauccggagcuccagcaucuccuacagccaggaguccggcgcggccgccgacgacaucaagcccugcccgcgcugcgccgccuacaucaucaagaugaacgacgggagcugcaaccacaugaccugcgcggucugcggcugcgaguucugcuggcucugcaugaaggagaucuccgaccugcacuaccugagccccuccgggugcaccuucuggggcaagaagcccuggagccggaagaagaagauccucuggcagcugggcacgcuggugggggcccccgugggcaucgcccucaucgccgggaucgccaucccggcgaugaucaucggcauccccgucuacguggggcgcaagauccacaaccgguacgagggcaaggacgugagcaagcacaagcgcaaccuggccaucgccggcggggucacccuguccgugaucgugagccccgucguggccgccgugaccgucggcaucggggugcccaucaugcucgcguacguguacggcgucgugccgaucucccugugccggagcgggggcugcggcgucuccgccgggaacggcaagggggugcgcaucgaguucgacgacgagaacgacaucaacgugggcgggaccaacacggccgucgacaccaccagcguggccgaggcccggcacaaccccuccaucggcgagggcagcgucgggggccugaccgggucccucagcgcguccggcagccacauggaccgcaucggcgccauccgggacaaccuguccgagacggccagcaccauggcccuggcgggggccuccaucaccggcagccucuccgggagcgccauggugaacugcuucaaccgccuggaggugcaggccgacgugcagaaggagcgguacagccuguccggcgagagcgggaccgucucccucggcacggugagcgacaacgccuccaccaaggcgauggccggcagcauccugaacuccuacaucccccuggacaaggaggggaacagcauggaggugcaggucgacaucgaguccaagcccagcaaguuccgccacaacuccggcagcuccagcguggacgacggguccgccacccggagccacgccggcggguccagcuccggccucccggagggcaagagcagcgccaccaagugguccaaggaggcgacggccgggaagaaguccaagagcggcaagcugcgcaagaaggggaacaugaagaucaacgagacccgggaggacauggacgcccagcugcucgagcagcagagcaccaacuccagcgaguucgaggcccccucccugagcgacuccaugcccagcguggccgacucccacagcucccacuucagcgaguucuccugcagcgaccuggaguccaugaagaccagcugcucccacggcagcagcgacuaccacacgcgcuucgcgaccgucaacauccuccccgagguggagaacgaccggcuggagaacuccccgcaccagugcagcaucuccguggucacccagaccgccagcugcuccgaggugagccagcugaaccacaucgccgaggagcacgggaacaacggcaucaagcccaacguggaccuguacuucggcgacgcccucaaggagacgaacaacaaccacucccaccagaccauggagcugaaggucgcgauccagaccgagaucuga

SEQ ID NO: 35796 - RNA, 2049 nt, Artificial Sequence
  derived and/or modified sequence opt1 from RNF207__Homo_sapiens__XP_011539741
augcccgaggaggccagcccggccggccaccccgaggacacccgccgggggaucccccgcgugggcguccggcgcgggcggcgcggccacgggcggggccgcccccgggcggagugggagccgucccccggcgccgggcugaacuuccagggccgccuccugcuggggcgggccaccgcccgcugccuccgggcccgccccggcgcggcccugcgggcccuggacgggggccgcgaggcccggcgcacgggcagcucccagcagagcgggcccgcggacgugggcuccuaccuccgggcccccgggggcccggagcugcccggcugccccgagcacccgcccgccggggugcccgccgucccccgcgccgugcgggcgccggugagcuccggccuguucccccgccuccugugccgccugcccgccuggccccgggaccgccggccgccccaccuccccgccguccccgacguggagaccaccuacuucugcaacacgugcgggcagccgcugugcgcccgcugccgggacgagacccaccgcgcccggauguucgcgcgccacgacaucguggcccugggccagcggagccgcgacgucccccagaagugcacccuccacgccgagcccuaccugcuguucuccaccgacaagaagcuccugcugugcauccggugcuuccgcgacaugcagaaggagagccgggcccacugcguggaccucgaguccgccuacgugcaggggugcgagcgccuggagcaggcgguccuggccgugaaggcccuccagaccgccacgcgggaggccaucgcgcugcugcaggccaugguggaggagguccgccacagcgccgccgaggaggaggacgcgauccacgcccucuucggcuccaugcaggaccggcuggccgagcgcaaggcccugcuccugcaggccgugcagagccaguacgaggagaaggacaaggcguucaaggagcagcugucccaccucgccacccugcugcccacccuccaggugcaccuggucaucugcagcuccuuccugagccucgccaacaaggccgaguuccuggaccugggcuacgagcucauggagcggcugcaggggaucgugacccgcccgcaccaccuccgccccauccaguccagcaagaucgccagcgaccaccgggcggaguucgcccgcugccuggagccccugcugcuccugggcccgcggcgcguggccgccgccgcguccggggccaacacgcuggccggcgggcugggccccaaggcccucaccggcccccacugccccagcccggucgggaagauguccggcagccccgugcagaagcccacccugcaccgguccaucagcaccaaggugcugcucgcggagggggagaacacgcccuucgccgagcacugccgccacuacgaggacuccuaccggcaccuccaggccgagaugcagagccugaaggaccagguccaggagcugcaccgcgaccugaccaagcaccacucccugaucaaggccgagaucaugggcgacgugcuccacaagagccugcagcuggacguccagaucgccuccgagcacgcgagccucgaggggaugcgggugguguuccaggagaucugggaggaggccuaccagcgcgucgccaacgagcaggagaucuacgaggcccagcugcacgaccugcuccagcugcggcaggagaacgccuaccugaccaccaucacgaagcagaucaccccguacgugcgcuccaucgcgaaggugaaggagcggcucgagccccgcuuccaggcccccgucgacgagcagagcgagucccugcagaacacccacgacgacagccggaacaacgccgccuccgcccgcaacaaccccggcagcgugccggagaagcgggagaagaccuccgagcccaagggcaacagcugggcgcccaacgggcugagcgaggagccccuccugaagaacauggaccaccaccgcuccaagcagaagaacggcggggacgugccgacguggcgggagcaccccaccuga

SEQ ID NO: 35797 - RNA, 2928 nt, Artificial Sequence
  derived and/or modified sequence opt1 from RNF20__Homo_sapiens__NP_062538
augagcggcaucgggaacaagcgcgccgccggcgagcccgggaccuccaugccgcccgagaagaaggcggccguggaggacagcggcaccacggucgagaccaucaagcucgggggcguguccagcaccgaggagcuggacauccggacccugcagacgaagaaccgcaagcuggccgagaugcucgaccagcggcaggccaucgaggacgagcugcgcgagcacaucgagaagcuggagcggcgccaggccaccgacgacgcgucccuccugaucgugaaccgguacuggagccaguucgacgagaacauccgcaucauccugaagcgguacgaccucgagcagggccugggggaccugcucaccgagcgcaaggcccuggucgugcccgagcccgagccggacuccgacagcaaccaggagcggaaggacgaccgcgagcggggcgaggggcaggagcccgccuucuccuuccuggccacccucgcgagcuccagcuccgaggagauggagagccagcugcaggagcgcguggaguccagccggcgcgccgucucccagaucgugacgguguacgacaagcugcaggagaaggucgagcuccugagccggaagcugaacuccggcgacaaccucaucguggaggaggccgugcaggagcugaacagcuuccuggcccaggagaacaugcgccuccaggagcugaccgaccugcuccaggagaagcaccggaccaugagccaggaguucuccaagcugcagagcaaggucgagaccgccgagucccgcgugagcgugcuggaguccaugaucgacgaccuccagugggacaucgacaagauccggaagcgcgagcagcgccugaaccggcaccuggcggagguccucgagcgcgugaacagcaagggguacaagguguacggcgccggcuccagccuguacgggggcacgaucaccaucaacgcccggaaguucgaggagaugaacgccgagcuggaggagaacaaggagcucgcccagaaccgccugugcgagcuggagaagcuccggcaggacuucgaggaggucaccacccagaacgagaagcugaagguggagcugcgcuccgcgguggagcaggucgugaaggagacgcccgaguaccggugcaugcagagccaguucuccgugcucuacaacgagagccugcagcugaaggcccaccucgacgaggcccgcacccugcugcacgggacccggggcacccaccagcaccaggucgagcucaucgagcgcgacgaggugucccugcacaagaagcugcggacggaggucauccagcuggaggacacccucgcccaggugcgcaaggaguacgagaugcugcggaucgaguucgagcagacccuggccgcgaacgagcaggccggccccaucaaccgcgagaugcggcaccucaucagcucccugcagaaccacaaccaccagcugaagggggaggugcuccgcuacaagcggaagcugcgcgaggcccagagcgaccugaacaagacccggcuccgcuccggcagcgcccugcugcagucccagagcagcacggaggacccgaaggacgagcccgccgagcucaagcccgacuccgaggaccugagcucccagagcuccgcgagcaaggccucccaggaggacgccaacgagaucaagagcaagcgcgacgaggaggagcgggagcgcgagcggcgcgagaaggagcgggagcgcgagcgggagcgcgagaaggagaaggagcgggagcgcgagaagcagaagcugaaggaguccgagaaggagcgggacagcgccaaggacaaggagaaggggaagcacgacgacggccgcaagaaggaggcggagaucaucaagcagcucaagaucgagcugaagaaggcccaggagucccagaaggagaugaagcugcuccuggacauguaccggagcgcccccaaggagcagcgcgacaagguccagcugauggccgccgagaagaaguccaaggcggagcucgaggaccugcggcagcgccugaaggaccucgaggacaaggagaagaaggagaacaagaagauggccgacgaggacgcccugcggaagauccgcgccguggaggagcagaucgaguaccugcagaagaagcucgccauggcgaagcaggaggaggaggcccugcugagcgagauggacgugaccgggcaggccuucgaggacaugcaggagcagaacauccggcucaugcagcagcugcgcgagaaggacgacgccaacuucaagcugauguccgagcggaucaagagcaaccagauccacaagcuccugaaggaggagaaggaggagcuggccgaccagguccucacccugaagacccagguggacgcgcagcuccaggugguccgcaagcuggaggagaaggagcaccuccugcaguccaacaucggcacgggcgagaaggagcuggggcugcgcacccaggcccuggagaugaacaagcggaaggccauggaggccgcgcagcucgccgacgaccugaaggcccagcuggagcucgcccagaagaagcugcacgacuuccaggacgagaucguggagaacagcgugaccaaggagaaggacauguucaacuucaagcgcgcccaggaggacaucagccggcugcgccggaagcucgagaccacgaagaagccggacaacguccccaagugcgacgagauccugauggaggagaucaaggacuacaaggcgcgccugaccugccccugcugcaacaugcggaagaaggacgccgugcucaccaagugcuuccacguguucugcuucgagugcgucaagacccgcuacgacacgcggcagcgcaagugccccaagugcaacgccgccuucggcgccaacgacuuccaccggaucuacaucggguga

SEQ ID NO: 35798 - RNA, 15624 nt, Artificial Sequence
  derived and/or modified sequence opt1 from RNF213__Homo_sapiens__NP_001243000
auggagugccccagcugccagcacgugagcaaggaggagacccccaaguucugcagccagugcggcgagcgccugccgcccgccgcccccaucgcggacuccgagaacaacaacagcaccauggccuccgccagcgagggggagauggagugcggccaggagcugaaggaggagggcgggcccugccuguuccccggguccgacagcuggcaggagaaccccgaggagcccugcuccaaggccagcuggaccgugcaggaguccaagaagaagaagcggaagaagaagaagaagggcaacaagagcgccuccagcgagcuggcgucccugccgcugagccccgccucccccugccaccugacccugcugagcaaccccuggccgcaggacaccgcccugccccacucccaggcccagcagagcggccccaccgggcagcccagccagccgcccggcaccgcgaccacgccccuggagggggacggccuguccgcccccaccgaggugggggacagcccgcugcaggcccaggcccucggcgaggccggcguggcgaccggguccgaggcccagagcagcccccaguuccaggaccacaccgagggcgaggaccaggacgccagcauccccuccgggggccgcggccugagccaggaggggaccgggccgcccaccuccgccggggagggccacagccggaccgaggacgccgcgcaggagcugcuccugcccgaguccaagggcgggagcuccgagcccggcaccgagcugcagaccaccgagcagcaggccggggccagcgccuccauggccguggacgcgguggccgagcccgccaacgccgugaagggcgccgggaaggagaugaaggagaagacccagcgcaugaagcagccgcccgcgaccacgccgcccuucaagacccacugccaggaggccgagaccaagaccaaggacgagauggccgccgcggaggagaaggugggcaagaacgagcagggggagcccgaggaccucaagaagcccgagggcaagaaccggagcgccgccgccgugaagaacgagaaggagcagaagaaccaggaggccgacgugcaggaggucaaggcguccacccugagccccggcgggggcgugaccguguucuuccacgccaucaucucccugcacuuccccuucaaccccgaccuccacaaggucuucauccgcgggggcgaggaguucggggagagcaagugggacagcaacaucugcgagcugcacuacacgcgggaccugggccacgaccgcgugcucguggagggcaucgucugcaucuccaagaagcaccuggacaaguacauccccuacaaguacgugaucuacaacggggagagcuucgaguacgaguucaucuacaagcaccagcagaagaagggcgaguacgugaaccggugccuguucaucaaguccagccuccugggguccggcgacuggcaccaguacuacgacaucgucuacaugaagccccacggccgccugcagaaggugaugaaccacaucaccgacgggccgcggaaggaccucgugaagggcaagcagaucgccgccgcccugaugcuggacagcaccuucuccauccuccagaccugggacacgaucaaccugaacagcuucuucacccaguucgagcaguucugcuucguccugcagcagcccaugaucuacgaggggcaggcgcagcucuggaccgaccugcaguaccgcgagaaggaggugaagcgguaccuguggcagcaccucaagaagcacguggucccccugcccgacggcaaguccaccgacuuccugccgguggacugccccguccgcagcaagcucaagacggggcugaucgugcuguucguggucgagaagaucgagcuccugcuggagggcucccucgacuggcugugccaccuccugaccagcgacgccuccagccccgacgaguuccaccgggaccucucccacauccugggcaucccccagagcuggcgccuguaccucgugaaccugugccagcggugcauggacacccgcaccuacacguggcugggggcccucccggugcugcacugcugcauggagcuggcgccccggcacaaggacgccuggcgccagcccgaggacaccugggcggcccucgagggccuguccuucagccccuuccgggagcagaugcuggacaccagcucccuccugcaguucaugcgcgagaagcagcaccuccugagcaucgacgagccgcuguuccgcuccugguucagccugcucccccugucccaccuggucauguacauggagaacuucaucgagcaccucgggcgguuccccgcccacauccuggacugccugagcggcaucuacuaccgccuccccgggcuggagcagguccugaacacccaggacgugcaggacguccagaacgugcagaacauccucgagaugcugcugcggcuccuggacaccuaccgcgacaagaucccggaggaggcccugucccccagcuaccucacggugugccugaagcugcacgaggcgaucugcuccagcaccaagcuccugaaguucuacgagcugcccgcccucuccgccgagaucgucugccggaugauccgccugcugagccucguggacuccgccggccagcgggacgagaccggcaacaacagcgugcagaccgucuuccaggggacgcuggccgcgaccaagcgcuggcugcgggagguguucaccaagaacaugcucaccuccagcggcgccuccuucacguacgugaaggagaucgaggucuggcgccggcugguggagauccaguucccggccgagcacggguggaaggagagccugcucggcgacauggaguggcgccugaccaaggaggagccccugucccagaucaccgccuacugcaacagcugcugggacaccaaggggcucgaggacagcguggccaagacguucgagaagugcaucaucgaggcggucuccagcgccugccagucccagaccagcauccugcagggcuucuccuacagcgaccugcggaaguucggcaucgugcucuccgccgugaucaccaagagcuggccccgcaccgccgacaacuucgacgacauccugaagcaccuccugacgcuggccgacgucaagcacguguuccggcugugcgggaccgacgagaagauccucgcgaacgugaccgaggacgccaagcgccugaucgccgucgccgacuccgugcugaccaagguggucggcgaccuccugagcgggacgauccuggugggccagcucgagcugaucaucaagcacaagaaccaguuccuggacaucuggcagcuccgggagaagucccugagcccccaggacgagcagugcgcgguggaggaggcccuggacuggcgccgggaggagcuccugcugcucaagaaggagaagcgcugcgucgacucccugcugaagaugugcgggaacgugaagcaccucauccagguggacuucggcguccuggccgugcgccacagccaggaccuguccagcaagcggcucaacgacaccgugaccguccgccuguccaccagcuccaacagccagcgggccacgcacuaccaccugagcucccaggugcaggagauggccggcaagaucgaccuccugcgcgacagccacaucuuccagcuguucuggcgggaggcggccgagccgcucuccgagcccaaggaggaccaggaggccgccgagcugcugagcgagcccgaggaggaguccgagcgccacauccucgagcuggaggagguguacgacuaccuguaccagcccagcuaccggaaguucaucaagcuccaccaggaccugaaguccggggaggucacccuggccgagaucgacgugaucuucaaggacuucgugaacaaguacaccgaccuggacagcgagcucaagaucaugugcaccgucgaccaccaggaccagcgcgacuggaucaaggaccggguggagcagaucaaggaguaccaccaccuccaccaggcggugcacgccgccaaggucauccuccaggugaaggagucccucggccugaacggggacuucagcgugcugaacacgcuccugaacuucaccgacaacuucgacgacuuccgccgggagacccuggaccagaucaaccaggagcucauccaggccaagaagcugcugcaggacaucuccgaggcccgcugcaagggccuccaggcgcugagccugcggaaggaguucaucugcuggguccgcgaggcccucggcgggaucaacgagcugaagguguucgucgaccuggccuccaucagcgccggcgagaacgacaucgacguggaccggguggccugcuuccacgacgcgguccagggguacgccucccuccuguucaagcuggacccgagcguggacuucuccgccuucaugaagcaccucaagaagcuguggaaggcccuggacaaggaccaguaccucccccgcaagcugugcgacagcgcgcggaaccuggaguggcucaagaccgugaacgagucccacggcagcgucgagcgcagcucccugacgcuggccaccgccaucaaccagcgggggaucuacgugauccaggcccccaagggcggccagaagaucagccccgacaccgugcuccaccugauccugccggagucccccgggagccacgaggagucccgcgaguacagccucgaggaggucaaggagcugcugaacaagcucaugcugauguccggcaagaaggaccggaacaacaccgagguggagcgcuucagcgagguguucugcuccguccagcgccugagccaggccuucaucgaccuccacuccgcggggaacaugcuguuccggacguggaucgccauggccuacugcagccccaagcagggcgugucccugcagauggacuucgggcucgaccuggugaccgagcugaaggagggcggcgacgucaccgagcuccuggccgcccugugccgccagauggagcacuuccucgacagcuggaagcgguucgugacccagaagcgcauggagcacuucuaccugaacuucuacaccgcggagcagcugguguaccucuccacggagcugcggaagcagcccccgagcgacgccgcccugaccaugcucuccuucaucaagagcaacugcacccugcgcgacguccugcgggccuccguggggugcggcagcgaggccgcgcgcuaccggaugcgccgggugauggaggagcucccccugaugcugcucagcgaguucucccuggucgacaagcugcgcaucaucauggagcagagcaugcggugccuccccgccuuccugcccgacugccuggaccucgagacccuggggcacugccuggcccaccucgccggcaugggcggcucccccguggagcgcugccugccccggggccuccagguggggcagcccaaccucgucgugugcggccacagcgaggugcugcccgcggcccuggccgucuacaugcagacgccgucccagccccuccccaccuacgacgaggugcugcugugcacccccgccaccacguucgaggagguggcccuccugcugcgccggugccucacccuggggagccugggccacaaggucuacucccuccuguucgcggaccagcugagcuacgagguggcccgccaggccgaggagcuguuccacaaccugugcacccagcagcaccgggaggacuaccagcuggugauggucugcgacggcgacugggagcacugcuaccucccguccgccuucagccagcacaagguguucgugacgccccaggcgccccuggaggcgauccaggccuaccuggccgggcacuaccgcgucccgaagcagacgcucuccgccgccgcgguguucaacgaccgccugugcgugggcaucgucgccagcgagcgggccggggugggcaagucccuguacgugaagcgccuccacgacaagaugaagaugcagcugaacgucaagaacgugccccugaagaccauccggcucaucgacccccagguggacgagagccgcguccugggggcccugcugcccuuccucgacgcgcaguaccagaaggugccggugcuguuccaccuggacgucaccuccagcgugcagaccggcaucuggguguuccucuucaagcugcugauccuccaguaccugauggacaucaacggcaagauguggcugcggaaccccugccaccucuacaucgucgagauccuggagcgccggacguccgugcccagccgcuccagcagcgcccugcggacccgcgucccccaguucuccuuccucgacaucuucccgaaggugaccugccggccgcccaaggaggugaucgacauggagcugagcgcccugcgcuccgacaccgagcccgggauggaccucugggaguucugcagcgagacguuccagcggccguaccaguaccugcgccgguucaaccagaaccaggaccuggacaccuuccaguaccaggagggcuccgucgaggggacccccgaggagugccuccagcacuuccuguuccacugcggcgugaucaaccccagcugguccgagcugcgcaacuucgcccgguuccucaacuaccagcugcgcgacugcgaggccagccuguucugcaaccccuccuucaucggggacacccuccggggcuucaagaaguucguggucacguucaugaucuucauggcgcgcgacuucgccaccccgagccugcacaccuccgaccagagccccggcaagcacauggugaccauggacggggugcgggaggaggaccuggcccccuucucccuccgcaagcgcugggagagcgagccccacccguacgucuucuucaacgacgaccacacgaccaugaccuucaucggcuuccaccuccagcccaacaucaacggguccguggacgccaucagccaccugaccggcaaggugaucaagcgggacgucaugacgcgcgaccucuaccaggggcugcugcuccagcgggugcccuucaacguggacuucgacaagcugccccgccacaagaagcuggagcggcucugccugacccugggcaucccgcaggccaccgaccccgacaagaccuacgagcucacgaccgacaacaugcugaagauccuggcgaucgagaugcgcuuccggugcggcauccccgucaucaucaugggggagaccggcugcgggaagacccgccucaucaaguuccuguccgaccugcggcgcggcgggaccaacgccgacacgaucaagcucgugaaggugcacggcggcaccaccgccgacaugaucuacagccggguccgcgaggccgagaacguggccuucgcgaacaaggaccagcaccagcuggacaccauccuguucuucgacgaggccaacacgaccgaggccaucagcugcaucaaggaggugcucugcgaccacauggucgacgggcagccccuggccgaggacuccggccugcacaucaucgccgcgugcaacccguaccggaagcacagcgaggagaugaucugccgccucgaguccgccgggcugggcuaccgggugagcauggaggagaccgccgaccgccugggcuccaucccccuccggcagcugguguaccgcguccacgcccugcccccgagccucaucccccuggugugggacuucgggcagcuguccgacguggcggagaagcucuacauccagcagaucguccagcggcugguggagagcaucucccuggacgagaacggcacccgcgugaucacggagguccucugcgccagccagggguucaugcgcaagaccgaggacgagugcuccuucgugagccugcgggacguggagcgcugcgucaagguguuccggugguuccacgagcacuccgccaugcugcucgcccagcugaacgccuuccugagcaaguccagcguguccaagaaccacaccgagcgcgaccccguccucuggagccugaugcuggcgaucggcgugugcuaccacgccucccucgagaagaaggacagcuaccggaaggccaucgcccgcuucuuccccaagccguacgacgacagccggcugcugcucgacgagaucacccgcgcccaggaccuguuccuggacggggugccccuccggaagacgaucgcgaagaaccuggcccugaaggagaacgucuucaugaugguggugugcaucgagcucaagaucccccuguuccuggucggcaagcccggcuccagcaagucccucgccaagaccaucguggccgacgccaugcaggggccggcggccuacagcgaccuguuccgcucccugaagcagguccaccucgucagcuuccagugcagcccccacagcacgccccagggcaucaucuccaccuuccggcagugcgcccgcuuccagcaggggaaggaccugcagcaguacgugagcguggucgugcuggacgaggugggccucgccgaggacucccccaagaugccgcugaagacgcugcacccccuccuggaggacgggugcaucgaggacgaccccgcgccccacaagaaggucggcuucgugggcaucagcaacugggcccuggacccggccaagaugaaccgggggaucuucgucucccgcggcagccccaacgagaccgagcucaucgaguccgccaaggggaucugcagcuccgacauccuggugcaggaccgggugcagggcuacuucgccagcuucgcgaaggccuacgagaccgucugcaagcgccaggacaaggaguucuucgggcugcgggacuacuacucccugaucaagaugguguucgccgccgccaaggcgagcaaccgcaagcccagcccccaggacaucgcccaggccgugcuccggaacuucuccggcaaggacgacauccaggcccuggacaucuuccuggccaaccucccggaggcgaagugcagcgaggaggucucccccaugcagcugaucaagcagaacaucuucggccccagccagaaggugcccgggggcgagcaggaggacgccgagucccgcuaccugcucgugcugaccaagaacuacgucgcccugcagauccuccagcagacguucuucgagggggaccagcagccggagaucaucuucggcagcggguuccccaaggaccaggaguacacccagcugugccggaacaucaaccgcgugaagaucugcauggagaccggcaagauggugcugcuccugaaccugcagaaccucuacgagucccuguacgacgcccugaaccaguacuacguccaccucggcgggcagaaguacguggaccugggccuggggacccaccgcgugaagugccggguccaccccaacuuccgccucaucgugaucgaggagaaggacguggucuacaagcacuucccgaucccccugaucaaccggcuggagaagcacuaccucgacaucaacacggugcuggagaaguggcagaaguccaucguggaggagcugugcgcgugggucgagaaguucaucaacgugaaggcccaccacuuccagaagcgccacaaguacucccccagcgacguguucaucggcuaccacuccgacgccugcgccagcgucgugcuccaggugaucgagcggcagggcccccgcgcccugaccgaggagcugcaccagaaggucuccgaggaggccaaguccauccuccugaacugcgccaccccggacgccguggugcggcuguccgccuacagccucgggggcuucgccgcggaguggcugucccaggaguacuuccaccgccagcggcacaacagcuucgccgacuuccugcaggcccaccuccacaccgccgaccuggagcgccacgccaucuucacggagaucaccaccuucucccggcugcucaccagccacgacugcgagauccuggagagcgaggucacggggcgcgcgcccaagcccacccugcucuggcugcagcaguucgacaccgaguacuccuuccugaaggaggugcggaacugccucaccaacacggccaagugcaagauccugaucuuccagaccgacuucgaggacggcauccgcagcgcccagcugaucgccuccgccaaguacagcgugaucaacgagaucaacaagauccgggagaacgaggaccgcaucuucgucuacuucaucaccaagcucucccggguggggcgcggcaccgcguacgugggcuuccacgggggccuguggcagagcguccacaucgacgaccugcggcgcuccacgcucauggugagcgacgugacccgccugcagcacgucaccaucucccagcuguucgcccccggggaccucccggagcugggccuggagcaccgggccgaggacgggcacgaggaggccauggagaccgaggcgagcaccuccggcgagguggccgagguggccgaggaggccauggagacggagagcuccgagaaggucggcaaggagaccagcgagcucgggggcuccgacgugagcauccuggacaccacccgccugcuccgguccugcgugcagagcgccgucgggaugcugcgcgaccagaacgaguccugcacgcggaacaugcgccggguggugcugcuccugggccugcucaacgaggacgacgcgugccacgccagcuuccugcgcgucagcaagaugcggcuguccguguuccucaagaagcaggaggagagccaguuccacccccuggaguggcuggcccgcgaggccugcaaccaggacgcccuccaggaggcggggaccuuccggcacacccuguggaagcgcgugcagggcgccgucacgccccugcucgccuccaugaucagcuucaucgaccgggacggcaaccuggagcugcucacgcgccccgacaccccgcccugggcccgggaccuguggauguucaucuucuccgacaccaugcugcucaacaucccccuggugaugaacaacgagcgccacaagggggagauggccuacaucgucgugcagaaccacaugaaccugagcgagaacgcguccaacaacgugcccuucagcuggaagaucaaggacuaccucgaggagcuguggguccaggcccaguacaucaccgacgccgagggccugccgaagaaguucguggacaucuuccagcagacgccccucgggcgguuccuggcccagcugcacggcgagccccagcaggagcuccugcagugcuaccugaaggacuucauccuccugaccaugcgcguguccaccgaggaggagcugaaguuccugcagauggcgcucuggagcugcacccggaagcugaaggccgccuccgaggcccccgaggaggaggucagccugccgugggugcaccucgccuaccagcgcuuccggucccgccugcagaacuucagccgcauccugacgaucuacccccaggugcuccacucccugauggaggcgcgguggaaccacgagcuggccggcugcgagaugacccucgacgccuucgccgccauggcgugcaccgagaugcugacccgcaacacgcugaagcccagcccccaggccuggcuccagcuggucaagaaccuguccaugccgcucgagcugaucugcagcgacgagcacaugcagggguccggcagccuggcccaggccgugauccgggaggugcgcgcccaguggagccggaucuucuccaccgcccuguucgucgagcacgugcugcuggggaccgagagccgcgugcccgagcuccagggccuggucaccgagcacguguuccugcucgacaagugccugcgggagaacuccgacgugaagacgcacgggcccuucgaggccgucaugcgcacccugugcgagugcaaggagaccgccagcaagacccucucccgguucggcauccagcccugcagcaucugccugggcgacgccaaggacccggugugccugcccugcgaccacgugcacugccuccgcugccugcgggccugguucgcguccgagcagaugaucugccccuacugccugacggcccucccggacgaguucagccccgccgucucccaggcccaccgcgaggcgaucgagaagcacgcccgguuccgccagaugugcaacagcuucuucguggaccugguguccaccaucugcuucaaggacaacgccccgcccgagaaggaggucaucgagagccugcucucccugcuguucgugcagaaggggcggcuccgcgacgccgcccagcggcacugcgagcacaccaagagccugucccccuucaacgacguggucgacaagacccccgugauccgcagcgugauccugaagcuccugcugaaguacuccuuccacgacgucaaggacuacauccaggaguaccucacgcugcugaagaagaaggcguucaucaccgaggacaagaccgagcucuacaugcuguucaucaacugccuggaggacagcauccucgagaagaccagcgccuacucccggaacgacgagcugaaccaccuggaggaggagggccgcuuccucaaggccuacagccccgccucccgcgggcgggagcccgccaacgaggcgagcguggaguaccugcaggagguggcccgcauccggcugugccucgaccgcgccgccgacuuccuguccgagccggagggcgggcccgagauggccaaggagaagcagugcuaccugcagcaggucaagcaguucugcauccggguggagaacgacuggcaccgcguguaccucguccggaagcugagcucccagcgcggcauggaguucgugcagggccugagcaagcccgggcggccccaccaguggguguucccgaaggacgucgugaagcagcagggccuccgccaggaccaccccgggcagauggaccgguaccugguguacggcgacgaguacaaggcgcugcgcgacgccgucgccaaggccgugcucgagugcaagccccuggggaucaagacggcgcugaaggccugcaagacgccccagucccagcagagcgccuacuuccuccugacccuguuccgggagguggccauccucuaccgcucccacaacgccagccugcacccgacccccgagcagugcgaggcggucuccaaguucaucggcgagugcaagauccuguccccgcccgacaucucccgguucgccaccagccucguggacaacuccgugccgcugcugcgcgccggccccagcgacuccaaccucgacgggacggucaccgagauggccauccacgccgcggccgugcugcugugcggccagaacgagcuccuggagccccugaagaaccucgccuucagccccgccaccauggcccacgcguuccugccgaccaugcccgaggaccugcucgcccaggcccggcgcuggaaggggcuggagcgggugcacugguacacgugccccaacggccaccccugcagcgucggggagugcggccgcccgauggagcaguccaucugcaucgacugccacgcccccaucggcgggaucgaccacaagccccgggacggcuuccaccuggugaaggacaaggcggaccgcacccagaccgggcacguccucggcaacccgcagcgccgggacguggugaccugcgaccgcggccugccgcccgucguguuccugcucauccggcugcugacgcaccucgcccugcugcugggggccagccaguccagccaggcccucaucaacaucaucaagcccccggugcgcgaccccaagggcuuccugcagcagcacauccugaaggaccucgagcagcuggccaagaugcuggggcacuccgcggacgagaccaucggcgucgugcaccucgugcugcggcgccugcuccaggagcagcaccagcugagcucccggcgccugcucaacuucgacaccgagcugagcaccaaggagaugcggaacaacugggagaaggagaucgccgccgucaucucccccgagcuggagcaccucgacaagacgcugcccaccaugaacaaccugaucagccaggacaagcgcaucuccagcaacccgguggccaagaucaucuacggggaccccgugaccuuccucccccaccucccccggaaguccgucgugcacugcagcaagaucugguccugccgcaagcggaucaccguggaguaccugcagcacaucgucgagcagaagaacggcaaggagcgcgugccgauccucuggcacuuccugcagaaggaggccgagcugcggcucgugaaguuccugcccgagauccuggcgcuccagcgcgaccuggucaagcaguuccagaacgugcagcaggucgaguacagcuccauccggggcuuccugagcaagcacuccagcgacgggcuccgccagcugcugcacaaccggaucacggucuuccucagcaccuggaacaagcugcgccgcucccuggagaccaacggcgagaucaaccuccccaaggacuacugcagcaccgaccuggaccuggacacggaguucgagauccuccugccccggcgccgggggcugggccucugcgccaccgcccugguguccuaccugauccgccuccacaacgagaucguguacgccgucgagaagcugagcaaggagaacaacuccuacagcguggacgccgcggaggugaccgagcugcacgucaucuccuacgagguggagcgggaccucaccccgcugauccugagcaacugccaguaccagguggaggaggggcgcgagacgguccaggaguucgaccucgagaagauccagcggcagaucgugucccgcuuccugcagggcaagccccggcugagccucaagggcauccccacccugguguaccgccacgacuggaacuacgagcaccuguucauggacaucaagaacaagauggcccaggacucccuccccagcuccgucaucagcgccaucuccgggcagcugcagagcuacuccgacgccugcgaggugcugagcguggucgaggugacccucggcuuccuguccaccgccgggggcgacccgaacaugcagcugaacguguacacgcaggacauccuccagaugggggaccagaccauccacguccugaaggcgcugaaccggugccagcucaagcacaccaucgcccuguggcaguuccugagcgcccacaagagcgagcagcuccugcgccugcacaaggagcccuucggcgagaucuccagccgguacaaggccgaccucucccccgagaacgcgaagcugcugagcaccuuccucaaccagacgggccuggacgccuuccugcucgagcugcacgagaugaucauccugaagcucaagaacccccagacccagaccgaggagcgcuuccggccgcaguggucccugcgcgacacccuggugagcuacaugcagacgaaggaguccgagauccuccccgagauggccagccaguuccccgaggagauccugcuggccuccugcgugagcgucuggaagaccgccgcggugcucaaguggaaccgggagaugcgcuga

SEQ ID NO: 35799 - RNA, 2112 nt, Artificial Sequence
  derived and/or modified sequence opt1 from RNF214__Homo_sapiens__NP_997226
auggccgccagcgagguggcgggcgucguggccaacgcccccuccccgcccgagagcuccagccugugcgccuccaagagcgacgaggggcuccccgacggccuguccaccaaggacagcgcccagaagcagaagaacagcccccugcucuccguguccagccagaccaucacgaaggagaacaaccgcaacguccaccuggagcacuccgagcagaacccggggagcuccgcgggcgacaccagcgccgcccaccagguggugcugggggagaaccucaucgccaccgcgcugugccuguccggcagcggcucccagagcgaccucaaggacgucgccagcaccgccggggaggagggcgacacgucccugcgggagagccugcaccccgugacccgcucccucaaggccgggugccacaccaagcagcuggccagccggaacugcuccgaggagaaguccccgcagaccuccauccugaaggagggcaaccgcgacacgagccucgacuuccggcccguggucucccccgcgaacgggguggagggcgugcgcgucgaccaggacgacgaccaggacagcuccagccugaagcugucccagaacaucgccgugcagaccgacuucaagaccgccgacagcgaggugaacaccgaccaggacaucgagaagaaccucgacaagaugaugacggagcggacccugcugaaggagcgcuaccaggagguccucgacaagcagcgccagguggagaaccagcuccaggugcagcugaagcagcugcagcagcggcgggaggaggagaugaagaaccaccaggagauccugaaggccauccaggacgucaccaucaagcgcgaggagaccaagaagaagaucgagaaggagaagaaggaguuccugcagaaggagcaggaccucaaggccgagaucgagaagcugugcgagaagggccggcgcgaggugugggagauggagcuggaccggcucaagaaccaggacggggagaucaaccgcaacaucauggaggagaccgagcgggccuggaaggccgagauccugagccuggagagccgcaaggagcuccuggugcugaagcucgaggaggccgagaaggaggccgagcugcaccugaccuaccucaaguccaccccgcccacccuggagacgguccggagcaagcaggagugggagacccgccugaacggcgugcggaucaugaagaagaacgugcgcgaccaguucaacucccacauccagcucguccgcaacggggccaagcugagcagccugccccagauccccacccccacccucccgccgccgcccuccgagacggacuucaugcuccagguguuccagcccagccccucccuggcgccccggaugcccuucagcaucggccaggucaccaugcccauggugaugcccuccgccgacccccgcagccuguccuuccccauccugaaccccgcccugagccagcccucccagccgagcagcccccugcccggcucccacgggcggaacuccccgggccucgggagccuggugagcccccacggcccccacaugcccccggccgccuccaucccgccgccgcccgggcugggcggcgucaaggcguccgccgagacgccccgcccccagcccguggacaagcucgagaagauccuggagaagcugcucacccgguucccccagugcaacaaggcccagaugaccaacauccugcagcagaucaagaccgcccgcaccaccauggcggggcugacgauggaggagcucauccagcugguggccgcccggcuggccgagcacgagcgcgucgccgcgagcacccagccccucggccggauccgcgcccuguuccccgcgccccuggcccagaucagcacccccauguuccuccccuccgcccaggugagcuaccccgggcgguccagccacgcccccgcgaccugcaagcugugccugaugugccagaagcucgugcagccguccgagcugcaccccauggccugcacgcacguccugcacaaggagugcaucaaguucugggcccagaccaacaccaacgacacgugccccuucugccccacccucaaguga

SEQ ID NO: 35800 - RNA, 2601 nt, Artificial Sequence
  derived and/or modified sequence opt1 from RNF216__Homo_sapiens__NP_996999
auggaggagggcaacaacaacgaggaggugauccaccugaacaacuuccacugccaccgcgggcaggaguggaucaaccuccgggacggccccaucaccaucagcgacuccagcgacgaggagcgcaucccgaugcuggucacccccgcgccccagcagcacgaggaggaggaccuggacgacgacgugauccucacggaggacgacuccgaggacgacuacggggaguuccuggaccuggggcccccggggaucagcgaguucaccaagcccuccggccagaccgagcgggagcccaagcccggcccgagccacaaccaggccgccaacgacaucgugaacccccgcuccgagcagaaggucaucauccucgaggaggggagccugcuguacaccgaguccgacccccucgagacgcagaaccagagcuccgaggacagcgagaccgagcugcuguccaaccucggcgagagcgccgcccuggccgacgaccaggccaucgaggaggacugcuggcuggaccaccccuacuuccagucccucaaccagcagccgcgggagaucaccaaccagguggugccccaggagcgccagcccgaggcggagcuggggcggcuccuguuccagcacgaguuccccggcccggccuucccccgccccgagccccagcagggcggcaucagcggcccguccagcccccagcccgcccacccccugggggaguucgaggaccagcagcuggccuccgacgacgaggagccgggccccgcguuccccaugcaggagagccaggagcccaaccucgagaacaucugggggcaggaggccgccgaggucgaccaggagcugguggagcugcucgugaaggagaccgaggcccgguucccggacgucgccaacggcuucaucgaggagaucauccacuucaagaacuacuacgaccugaacgugcugugcaacuuccuccuggagaaccccgacuaccccaagcgcgaggaccggaucaucaucaacccgagcuccagccugcucgcgucccaggacgagacgaagcugcccaagaucgacuucuucgacuacagcaagcugacgccccucgaccagcgcugcuucauccaggccgccgaccugcugauggccgacuucaaggugcucuccagccaggacaucaagugggcccugcacgagcugaagggccacuacgcgaucacccggaaggcccucuccgacgccaucaagaaguggcaggagcugagccccgagaccuccgggaagcgcaagaagcggaagcagaugaaccaguacagcuacaucgacuucaaguucgagcagggcgacaucaagaucgagaagcgcauguucuuccuggagaacaagcggcgccacugccgguccuacgaccgccgggcccuccugccggccguccagcaggagcaggaguucuacgagcagaagaucaaggagauggcggagcacgaggacuuccugcucgcccugcagaugaacgaggagcaguaccagaaggacgggcagcugaucgagugccgcugcugcuacggcgaguuccccuucgaggagcucacccagugcgccgacgcccaccuguucugcaaggagugccugauccgcuacgcccaggaggcgguguucgggagcggcaagcuggagcucuccugcauggagggcagcugcacgugcuccuuccccaccagcgagcuggagaaggugcugccccagaccauccucuacaaguacuacgagcggaaggccgaggaggaggucgccgccgcguacgccgacgagcuggugcgcugcccguccugcagcuuccccgcccugcucgacuccgacgugaagcgguucagcugccccaacccccacugccgcaaggagaccugccggaagugccaggggcuguggaaggagcacaacggccugaccugcgaggagcucgccgagaaggacgacaucaaguaccgcaccagcaucgaggagaagaugaccgccgcgcggauccgcaagugccacaagugcgggacgggccugaucaaguccgaggggugcaaccggaugagcugccgcugcggcgcccagaugugcuaccugugccgggucuccaucaacggcuacgaccacuucugccagcacccgcgcagccccggggcccccugccaggagugcucccggugcagccucuggaccgaccccaccgaggacgacgagaagcugaucgaggagauccagaaggaggccgaggaggagcagaagcgcaagaacggcgagaacaccuucaagcggaucgggccgccccuggagaagcccguggagaaggugcagcgcgucgaggcccucccccggccggugccccagaaccugccccagccccagaugccgcccuacgcguucgcccacccgcccuucccccugccgcccgugcgccccgucuucaacaacuucccccucaacaugggccccauccccgccccguacgugccgccccugcccaacguccgggugaacuacgacuucgggcccauccacaugccccuggagcacaaccuccccaugcacuucggcccccagccgcgccaccgcuucuga

SEQ ID NO: 35801 - RNA, 447 nt, Artificial Sequence
  derived and/or modified sequence opt1 from RNF24__Homo_sapiens__NP_001127809
augagcuccgacuucccccacuacaacuuccgcaugccgaacaucggcuuccagaaccugccccucaacaucuacaucguggucuucgggaccgccaucuucguguucauccugagccuccuguucugcugcuaccugauccggcugcgccaccaggcccacaaggaguucuacgcguacaagcaggucauccucaaggagaaggugaaggagcugaaccugcacgagcucugcgccgugugccuggaggacuucaagccccgggacgagcugggcaucugccccugcaagcacgccuuccaccgcaagugccucaucaaguggcuggaggugcggaaggucugcccgcugugcaacaugcccgugcuccagcuggcccagcugcacuccaagcaggaccgcgggccgccccagggcccccuccccggggccgagaacaucguguga

SEQ ID NO: 35802 - RNA, 864 nt, Artificial Sequence
  derived and/or modified sequence opt1 from RNF2__Homo_sapiens__XP_005245470
augugccccaucugccuggacaugcucaagaacaccaugaccacgaaggagugccugcaccgcuucugcgccgacugcaucaucaccgcccugcggagcggcaacaaggagugcccgaccugccgcaagaagcucguguccaagcggagccugcgccccgaccccaacuucgacgcgcugaucuccaagaucuaccccagccgggacgaguacgaggcccaccaggagcgcguccucgcccggaucaacaagcacaacaaccagcaggcccugucccacagcaucgaggaggggcugaagauccaggccaugaaccgccuccagcggggcaagaagcagcagaucgagaacggguccggcgcggaggacaacggggacagcucccacugcagcaacgccuccacccacagcaaccaggaggccggcccguccaacaagcgcacgaagaccagcgacgacuccggccuggagcuggacaacaacaacgccgcgauggccaucgaccccgugauggacggggccagcgagaucgagcucguguuccggccccaccccacccugauggagaaggacgacuccgcccagacccgcuacaucaagacgagcggcaacgccaccgucgaccaccuguccaaguaccucgcggugcggcuggcccuggaggagcuccgcagcaagggggagagcaaccagaugaaccuggacaccgccuccgagaagcaguacaccaucuacaucgccacggccagcggccaguucaccgugcugaacggguccuucagccucgagcuggucuccgagaaguacuggaaggugaacaagccgauggagcuguacuacgcgcccaccaaggagcacaaguga

SEQ ID NO: 35803 - RNA, 3219 nt, Artificial Sequence
  derived and/or modified sequence opt1 from RNF31__Homo_sapiens__NP_060469
augcccggcgaggaggaggagcgcgccuuccugguggcccgggaggagcucgcgagcgcccugcgccgggacuccgggcaggccuucagccuggagcagcuccgcccgcugcuggccuccagccucccccuggccgcgcgguaccugcagcucgacgccgcccgccugguccggugcaacgcccacggcgagccccgcaacuaccugaacacccucuccaccgcgcugaacauccuggagaaguacgggcggaaccuccugagcccccagcgcccgcgguacuggcgcggcgugaaguucaacaaccccguguuccgguccacggucgacgccgugcagggcgggcgcgacgugcugcggcucuacggcuacaccgaggagcagcccgacgggcugagcuuccccgagggccaggaggagccggacgagcaccaggucgccaccgugacccuggaggugcuccugcugcgcacggagcucucccugcugcuccagaacacccacccccggcagcaggcccuggagcagcugcucgaggacaaggucgaggacgacaugcugcagcugagcgaguucgacccccuccugcgcgagaucgcccccgggccgcugaccacccccuccgugcccggcagcacgcccgggccgugcuuccucugcggcuccgcgcccggcacccugcacugccccagcugcaagcaggcccugugccccgccugcgaccaccucuuccacgggcacccgucccgggcccaccaccuccgccagacccugcccggcgugcugcaggggacccaccugagccccucccugcccgccagcgcgcagccgcggccccaguccacgagccuccuggcccugggcgacagcucccucagcucccccaaccccgccagcgcccaccucccguggcacugcgccgcgugcgccaugcugaacgagcccugggccguccugugcguggccugcgaccgcccccgcggcugcaaggggcugggccuggggaccgagggcccgcaggggaccggcggccuggagcccgaccucgcccgggggcgcugggcgugccaguccugcaccuucgagaacgaggccgccgccgugcugugcagcaucugcgagcggccccgccuggcgcagcccccgucccucgucguggacagccgggacgccggcaucugccugcagccccugcagcagggggacgcccuccuggccuccgcccagagccaggugugguacugcauccacugcacguucugcaacuccagccccggcugggucugcgugaugugcaaccgcaccuccagccccaucccggcgcagcacgcgccccggcccuacgccuccagccuggagaaggggcccccgaagcccggcccgccccgccggcucuccgcgccccugcccagcuccugcggcgaccccgagaagcagcgccaggacaagaugcgggaggaggggcugcagcucgugagcaugauccgcgagggcgaggccgccggggccugccccgaggagaucuucagcgcccugcaguacuccggcaccgaggucccgcugcaguggcuccggagcgagcugcccuacgugcuggagaugguggccgagcucgccgggcagcaggaccccggccugggcgcguucuccugccaggaggcccgccgggccuggcuggaccgccacgggaaccucgacgaggccgucgaggagugcgugcggacccgccggcgcaagguccaggagcugcagagccugggcuucgggcccgaggagggcucccuccaggcgcuguuccagcacggcggggacgugagccgcgcccugacggagcuccagcggcagcgccuggagccguuccggcagcgccugugggacuccggccccgagcccaccccgagcugggacgggcccgacaagcagucccucgugcggcgccugcuggccgucuacgcccuccccagcuggggccgggccgagcuggcgcugucccuccugcaggagacgccccgcaacuacgagcugggggacgugguggaggccguccggcacagccaggaccgcgccuuccuccggcgccugcuggcccaggagugcgccgugugcggcugggcgcucccgcacaaccggaugcaggcccugaccuccugcgagugcaccaucugccccgacugcuuccgccagcacuucaccaucgcccugaaggagaagcacaucaccgacauggugugccccgccugcggccggcccgaccucaccgacgacacgcagcugcugagcuacuucuccacccucgacauccagcugcgcgagagccuggagccggacgccuacgcccucuuccacaagaagcugaccgaggggguccugaugcgggaccccaaguuccucuggugcgcccagugcuccuucggcuucaucuacgagcgcgagcagcuggaggcgaccugcccccagugccaccagacguucugcgugcggugcaagcgccagugggaggagcagcaccgggggcgcagcugcgaggacuuccagaacuggaagcgcaugaacgaccccgaguaccaggcccagggccuggccauguaccuccaggagaacgggaucgacugcccgaagugcaaguucagcuacgcccuggcccggggcggcugcaugcacuuccacugcacccagugccgccaccaguucugcuccgggugcuacaacgccuucuacgccaagaacaagugccccgagcccaacugccgggugaagaagucccugcacggccaccacccccgcgacugccucuucuaccugcgggacuggaccgcgcugcgccuccagaagcugcugcaggacaacaacgucauguucaacaccgagccgcccgccggggcccgggccgugcccggcgggggcugccgcgugaucgagcagaaggagguccccaacggccuccgggacgaggccugcgggaaggagacgccggcgggcuacgccgggcugugccaggcccacuacaaggaguaccuggugagccucaucaacgcccacagccuggaccccgccacccuguacgagguggaggagcucgagaccgcgaccgagcgcuaccugcacguccggccccagccccuggccggcgaggacccgcccgccuaccaggcccgccuccugcagaagcugaccgaggaggugccccucgggcaguccaucccccggcgccggaaguga

SEQ ID NO: 35804 - RNA, 1119 nt, Artificial Sequence
  derived and/or modified sequence opt1 from RNF34__Homo_sapiens__NP_079402
augaaggccggcgccaccagcaugugggcguccugcugcgggcugcucaacgaggugaugggcaccggggccguccgcggccagcagagcgccuucgccggggccacgggccccuuccgguucaccccgaaccccgaguucuccaccuacccgcccgcggccaccgagggccccaacaucgugugcaaggccugcgggcugagcuucuccguguuccgcaagaagcacgucugcugcgacugcaagaaggacuucugcagcgugugcuccgugcugcaggagaaccuccggcgcugcagcacgugccaccuccugcaggagaccgccuuccagcggccccagcugaugcgccugaaggucaaggaccugcggcaguaccucauccugcgcaacauccccaucgacacgugccgggagaaggaggaccugguggaccucgugcugugccaccacggccugggguccgaggacgacauggacaccagcucccucaacagcucccgcagccagaccuccagcuucuucacccgguccuucuucagcaacuacaccgcgcccuccgccaccaugagcagcuuccagggcgagcugauggacggggaccagacgucccgcagcggcgucccggcccaggugcaguccgagaucaccagcgccaacaccgaggacgacgacgacgacgacgacgaggacgacgacgacgaggaggagaacgccgaggaccggaaccccggccuguccaaggagcgcgugcgggcgagccucuccgaccugagcucccuggacgacgucgaggggaugagcgugcgccagcucaaggagauccuggcccggaacuucgugaacuacuccggcugcugcgagaagugggagcuggucgagaaggugaaccgccucuacaaggagaacgaggagaaccagaaguccuacggggagcggcugcagcugcaggacgaggaggacgacagccucugccgcaucugcauggacgccgugaucgacugcguccugcuggagugcggccacauggugaccugcacgaagugcggcaagcggaugagcgagugccccaucugccgccaguacgugguccgcgccgugcacguguucaaguccuga

SEQ ID NO: 35805 - RNA, 1263 nt, Artificial Sequence
  derived and/or modified sequence opt1 from RNF39__Homo_sapiens__NP_079512
augugguggcgcgaccugacccggcuccgccuguggcugaagcgggaggccauccccggcgaggggcgcaaggccgcgaaggugaacgccggcgucggggagaagggcaucuacaccgccagcucccgcgggggcccgcccagcgcccgguccaaggccgugacgguggucgcggagggcgccgccagccgguccuggcucagcauggacgcccccgagcuggggcccggccugguggagcgccucgagcagcuggcgaccugcccgcugugcgggggcuccuucgaggaccccgugcuccuggccugcgagcacagcuucugccgggccugccuggcccgccggugggggaccccgcccgccaccggcacggaggcgucccccaccgccugccccugcugcggccuccccugcccccgccggagccugcgcuccaacguccggcuggccguggaggugcgcaucagccgggagcuccgcgagaagcuggccgagccgggggcccgggcgggccgccggcgcgggggccgcauccccaccaugggcugccuggaccuccccggggaggacaugcggaagaccuggcgccgguucgagguccccacguccaagagcuccaacagcgaggacgaccugccggaggacuaccccguggugaagaagaugcugcaccgccucaccgccgaccugacccuggaccccggcaccgcccaccggcgccuccugaucuccgccgaccggcgcagcguccagcuggcgcccccggggacgcccgccccgcccgacggccccaagcgguucgaccagcuccccgccgugcugggggcccagggcuucggcgccgggcgccacugcugggagguggagaccgccgacgcggccuccugccgggacagcagcggcgaggacgccgacgacgaggagucccacuacgccgucggggcggccggcgagagcgugcagcgcaaggggugcgugcggcugugccccgccggcgccgucugggccguggagggccgcgggggccggcucugggcgcugaccgcccccgagccgacccugcucgggggcguggagcccccgccccgccggauccgcgucgaccuggacugggagcgggggcgcguggccuucuacgacggccgcucccuggaccuccuguacgccuuccaggcccccggcccccugggggagcggaucuucccccucuucugcacgugcgacccgcgcgcgccccugcggaucgugcccgccgagagcuga

SEQ ID NO: 35806 - RNA, 2706 nt, Artificial Sequence
  derived and/or modified sequence opt1 from RNF40__Homo_sapiens__NP_001193963
augagcggccccgggaacaagcgcgccgccggcgacgggggcuccgggccgcccgagaagaagcugagccgggaggagaagaccaccacgacccucaucgagcccauccgccugggcggcaucuccagcaccgaggagauggaccugaaggugcuccaguucaagaacaagaagcuggcggagcggcuggagcagcgccaggccugcgaggacgagcuccgggagcgcaucgagaagcuggagaagcggcaggccaccgacgacgccacgcugcucaucgucaaccgcuacugggcccagcuggacgagaccguggaggcgcugcuccggugccacgagucccagggggagcugagcuccgcccccgaggccccgggcacccaggaggggccgaccugcgacggcacgccccugcccgagcccgggaccagcgagcuccgcgacccccugcugaugcagcuccggccgccccuguccgagcccgcccuggcguucguggucgcccucggcgccagcuccagcgaggagguggagcuggagcugcagggccgcauggaguucuccaaggccgccgugagccgggucguggaggcguccgaccgccuccagcggcgcguggaggagcugugccagcgggucuacagccgcggggacuccgagccccugagcgaggccgcccaggcccacacccgggagcucggccgcgagaaccggcgccugcaggaccuggccacccagcuccaggagaagcaccaccgcaucucccuggaguacagcgagcugcaggacaaggugacgagcgcggagaccaaggugcucgagauggagaccaccgucgaggaccugcagugggacaucgagaagcugcggaagcgcgagcagaagcucaacaagcaccuggccgaggcccuggagcagcucaacuccggguacuacgugagcggcuccagcuccggcuuccagggcggccagaucacgcugagcaugcagaaguccgacgagcuggggcuccagaagaagcugcggaccgaggugauccagcuggaggacacccucgcccagguccgcaaggaguacgagaugcugcggaucgaguucgagcagaaccuggccgcgaacgagcaggccggccccaucaaccgcgagaugcggcaccucaucagcucccugcagaaccacaaccaccagcugaagggggacgcccagcgcuacaagcggaagcugcgcgaggugcaggccgagaucggcaagcuccgggcccaggcgagcggcuccgcccacagcacccccaaccuggggcacccggaggacuccggcgugagcgcccccgcccccgggaaggaggagggcgggcccggcccggucuccacgcccgacaaccgcaaggagauggcgcccgugcccggcaccaccaccacgaccaccagcgugaagaaggaggagcuggucccguccgaggaggacuuccaggggaucacccccggcgcccaggggcccagcucccggggccgcgagcccgaggcccggccgaagcgcgagcuccgggagcgcgaggggcccagccuggggcccccgcccguggccagcgcccugucccgggcggaccgcgagaaggccaagguggaggagacgaagcgcaaggagagcgagcuccugaagggccugcgggccgagcucaagaaggcccaggagucccagaaggagaugaagcugcugcucgacauguacaagagcgcccccaaggagcagcgcgacaagguccagcugauggcggccgagcggaaggccaaggccgagguggacgagcugcgcucccggauccgcgagcucgaggagcgggaccgccgggagagcaagaagaucgccgacgaggacgcgcugcgccggauccgccaggccgaggagcagaucgagcaccuccagcggaagcucggggccaccaagcaggaggaggaggcccugcuguccgagauggacgucaccggccaggcguucgaggacaugcaggagcagaacgggcgccuccugcagcagcugcgggagaaggacgacgccaacuucaagcucaugagcgagcgcaucaaggccaaccagauccacaagcugcugcgggaggagaaggacgagcucggcgagcagguccugggccugaagucccagguggacgcccagcuccugaccgugcagaagcuggaggagaaggagcgcgcccuccaggggagccugggcgggguggagaaggagcugacgcuccggucccaggcgcuggagcugaacaagcgcaaggccguggaggccgcccagcucgccgaggaccugaagguccagcuggagcacgugcagacccggcuccgcgagauccagcccugccuggcggagagccgcgccgcccgggagaaggaguccuucaaccugaagcgcgcccaggaggacaucagccggcuccgccggaagcuggagaagcagcgcaagguggaggucuacgccgacgcggacgagauccugcaggaggagaucaaggaguacaaggcccggcugaccugcccgugcugcaacacccgcaagaaggacgccgugcugacgaagugcuuccacguguucugcuucgagugcguccggggccgcuacgaggcccggcagcgcaagugccccaagugcaacgcggccuucggggcccacgacuuccaccggaucuacaucuccuga

SEQ ID NO: 35807 - RNA, 954 nt, Artificial Sequence
  derived and/or modified sequence opt1 from RNF41__Homo_sapiens__NP_001229755
augggcuacgacgugacccgcuuccagggggacgucgacgaggaccugaucugccccaucugcagcggcgugcucgaggagccggugcaggcgccccacugcgagcacgccuucugcaacgccugcaucacccagugguucucccagcagcagacgugccccgucgaccggagcguggugaccgucgcccaccuccgccccgugccgcggaucaugcgcaacaugcuguccaagcugcagaucgccugcgacaacgccguguucgggugcagcgccgucgugcggcuggacaaccugaugucccaccucagcgacugcgagcacaaccccaagcgccccgugaccugcgagcagggcugcgggcuggagaugcccaaggacgagcugccgaaccacaacugcaucaagcaccuccgguccgucgugcagcagcagcagacccgcaucgcggagcuggagaagacgagcgccgagcacaagcaccagcuggccgagcagaagcgggacauccagcuccugaaggccuacaugcgcgcgauccgguccgugaaccccaaccugcagaaccucgaggagaccaucgaguacaacgagauccuggagugggucaacagccugcagcccgcccgcgugacccgguggggcggcaugaucuccacccccgacgccgugcuccaggccgucaucaagcgcagccugguggaguccgggugcccggccagcaucgugaacgagcugaucgagaacgcgcacgagcgguccuggccccagggccucgccacgcuggagacccgccagaugaaccggcgcuacuacgagaacuacgucgccaagcggauccccgggaagcaggccgugguggucauggccugcgagaaccagcacaugggcgacgacauggugcaggagcccgggcuggucaugaucuucgcgcacggcguggaggagaucuga

SEQ ID NO: 35808 - RNA, 2352 nt, Artificial Sequence
  derived and/or modified sequence opt1 from RNF43__Homo_sapiens__NP_060233
augagcggcgggcaccagcugcagcucgccgcccuguggcccuggcugcucauggcgacccugcaggccggcuucgggcgcaccggccuggugcucgccgccgccgucgaguccgagcggagcgcggagcagaaggccaucauccgcgugaucccgcugaagauggaccccaccgggaagcugaaccucacccuggagggcguguucgccggcgucgccgagaucacccccgcggaggggaagcugaugcagucccacccccucuaccugugcaacgccagcgacgacgacaaccuggagccgggcuucaucuccaucgugaagcucgagagcccccggcgcgcgccccggcccugccugucccuggccagcaaggcccgcauggccggggagcggggcgccuccgccguccucuucgacaucaccgaggaccgcgccgccgcggagcagcugcagcagccgcuggggcucacguggcccgucgugcugaucuggggcaacgacgccgagaagcugauggaguucguguacaagaaccagaaggcccacguccggaucgagcucaaggagccgcccgccuggcccgacuacgacguguggauccugaugaccguggucggcaccaucuucgugaucauccuggccagcgugcuccgcauccggugccgcccccggcacucccgccccgacccccugcagcagcggaccgcgugggccaucagccagcuggccacgcgccgguaccaggccuccugccgccaggcccgcggggaguggccggacagcggcuccagcugcuccagcgcgcccgugugcgccaucugccucgaggaguucuccgaggggcaggagcugcgggugaucagcugccugcacgaguuccaccggaacugcguggaccccuggcuccaccagcaccggaccugcccccugugcauguucaacaucaccgagggcgacagcuucucccagagccugggcccgucccgcagcuaccaggagcccgggcgccgccuccaccugauccggcagcaccccggccacgcccacuaccaccuccccgccgcguaccugcuggggccgucccgcagcgccgucgcccggccgccccgccccggccccuuccugcccucccaggagcccgggaugggcccgcggcaccaccgcuucccccgggccgcccacccccgcgcgcccggcgagcagcagcggcucgccggggcccagcacccguacgcccagggcugggggcugagccaccuccaguccaccagccagcaccccgccgcgugccccgugccccugcgccgggcccgcccgcccgacuccagcggcuccggggagagcuacugcacggagcgguccggcuaccuggccgacggccccgccagcgacuccagcuccgggcccugccacggcagcagcuccgacagcguggucaacugcaccgacaucucccugcagggggugcacggcagcuccagcaccuucugcuccagccucuccagcgacuucgacccgcugguguacugcucccccaagggggacccccagcgcgucgacaugcagcccagcgugaccucccggccgcgcagccuggacuccgucgugcccacgggcgagacccaggugagcucccacguccacuaccaccggcaccgccaccaccacuacaagaagcgcuuccaguggcacggccggaagcccgggcccgagaccggcgugccgcagagccgcccgcccaucccccggacccagccccagcccgagcccccgagccccgaccagcaggucacgcgcuccaacagcgccgcgcccuccgggcggcugagcaacccccagugcccgcgcgcccuccccgagcccgcccccggcccgguggacgccuccagcaucugccccuccaccagcucccuguucaaccugcagaaguccagccucagcgcgcggcacccccagcgcaagcggcgcggcgggcccuccgagccgacccccggcagccggccccaggacgccaccgugcaccccgccugccagaucuucccgcacuacacgcccuccguggccuaccccuggagccccgaggcccacccgcugaucugcgggccgcccggccuggacaagcgccuccugcccgagacccccgggcccugcuacuccaacagccagcccgucuggcugugccucacgccccggcagccgcuggagccccacccgcccggcgagggccccuccgaguggagcagcgacaccgcggaggggcgccccugccccuacccgcacugccaggugcuguccgcccagcccggcagcgaggaggagcucgaggagcugugcgagcaggccguguga

SEQ ID NO: 35809 - RNA, 1056 nt, Artificial Sequence
  derived and/or modified sequence opt1 from RNF44__Homo_sapiens__XP_005265902
augcugcaccccgccacccagcagagccccuucaugguggaccuccacgagcagguccaccagggccccgugccccuguccuacaccgugacgaccgucaccacccagggguucccccugcccacgggccagcacauccccgggugcagcgcccagcagcuccccgcgugcuccgugauguucagcggccagcacuacccccugugcugccugcccccgccccucauccaggccugcaccaugcagcagcugcccgugcccuaccaggccuacccccaccugaucuccagcgaccacuacauccuccacccgccgccgcccgccccgccgccccagcccacccacauggcgccccuggggcaguucgucucccugcagacccagcacccccgcaugccccuccagcggcuggacaacgacguggaccugcgcggcgaccagcccagccucggcuccuucacguacagcaccuccgcccccgggcccgcccugagccccuccgugccccugcacuaccucccccacgacccgcugcaccaggagcugagcuucggcguccccuacucccacaugaugccccggcgccucagcacccagcgguaccgccugcagcagccccugccgcccccgccgccgccgcccccgccgccgcccuacuaccccuccuuccuccccuacuuccugagcaugcugcccaugucccccaccgccauggggcccacgaucagccucgaccuggacguggacgacguggagauggagaacuacgaggcccugcucaaccuggcggagcggcugggcgacgccaagccccgcgggcucaccaaggccgacaucgagcagcugcccagcuaccgguucaaccccgacucccaccagagcgagcagacccugugcgucgugugcuucuccgacuucgaggcccgccagcuccugcgggugcugcccugcaaccacgaguuccacaccaagugcgucgacaaguggcucaaggccaaccgcacgugccccaucugccgggcggacgccagcgaggugccccgcgaggccgaguga

SEQ ID NO: 35810 - RNA, 342 nt, Artificial Sequence
  derived and/or modified sequence opt1 from RNF4__Homo_sapiens__NP_001171939
augagcacccgcaagcggcgcggcggggccaucaacucccggcaggcccagaagcgcacccgggaggcgacgagcacccccgagaucucccuggaggccgagccgaucgagcucguggagaccgccggcgacgagaucgucgaccugaccugcgagagccuggagcccgugguggucgaccucacgcacaacgacuccguggugaucgucgacgggccccaggugcugagcgugguccccuccgccuggaccgacacccagcgcagcugccggauggacguguccagcuucccgcagaacgccgcgauguccagcguggccuccgccagcgucauccccuga

SEQ ID NO: 35811 - RNA, 543 nt, Artificial Sequence
  derived and/or modified sequence opt1 from RNF5__Homo_sapiens__NP_008844
auggccgccgcggaggaggaggacggcgggcccgagggcccgaaccgcgagcgcgggggcgccggggccaccuucgagugcaacaucugccuggagaccgcccgggaggccguggucagcgugugcggccaccucuacugcuggcccugccugcaccaguggcuggagacgcggcccgagcgccaggagugccccgugugcaaggcgggcaucucccgggagaaggucgugccgcucuacgggcgcggcagccagaagccccaggacccccggcugaagacgcccccgcgcccccaggggcagcggcccgcccccgagucccgcggcggguuccagccguucggcgacaccggcggguuccacuucagcuucggcgugggggccuuccccuucggcuucuucaccaccgucuucaacgcccacgagcccuuccggcgcggcaccgggguggaccugggccaggggcaccccgcguccagcuggcaggacucccucuuccuguuccuggccaucuucuucuucuucuggcuccugagcaucuga

SEQ ID NO: 35812 - RNA, 2058 nt, Artificial Sequence
  derived and/or modified sequence opt1 from RNF6__Homo_sapiens__NP_005968
augaaccagagccgcucccggagcgacggcggguccgaggagacccugccccaggaccacaaccaccacgagaacgagcgccgguggcagcaggagcgccuccaccgggaggaggccuacuaccaguucaucaacgagcugaacgacgaggacuaccgccugaugcgggaccacaaccuccugggcaccccgggggagaucaccagcgaggagcugcagcagcgccucgacggcgugaaggagcagcuggccucccagcccgaccugcgggacgggaccaacuaccgcgacagcgaggucccccgggaguccagccacgaggacucccuccuggaguggcugaacaccuuccgccggaccggcaacgcgacgcgcagcggccagaacgggaaccagaccuggcgggccgugucccgcaccaaccccaacaacggcgaguuccgguucagccucgagauccacgugaaccacgagaaccgcggguucgagauccacggcgaggacuacaccgacaucccgcuguccgacagcaaccgggaccacacggccaaccgccagcagcgguccaccagccccgucgcccgccgcacccggucccagaccagcgugaacuucaacggguccagcagcaacaucccccgcacgcggcuggccucccgcggccagaaccccgcggagggcagcuucuccacccucgggcggcugcgcaacggcaucgggggcgccgccggcaucccgcgggccaacgcgagccgcaccaacuucuccagccacaccaaccaguccgggggcagcgagcugcggcagcgcgaggggcagcgguucggcgccgcccacgugugggagaacggggcccgcuccaacgucacggugcggaacaccaaccagcgccucgagcccauccggcugcgcagcaccuccaacagccggucccgcagccccauccagcggcaguccggcaccguguaccacaacagccagcgcgagucccgccccguccagcagacgacccggcgcagcgugcggcgccggggccgcacccggguguuccuggagcaggaccgcgagcgggagcgccgggggaccgccuacacgccguucuccaacagccgccucgucagccggaucaccguggaggagggcgaggaguccagccgcuccagcaccgcggugcggcgccaccccaccaucacgcuggaccugcagguccggcgcauccggcccggggagaaccgcgaccgggacuccaucgccaaccgcacccgcagccgggugggccucgccgagaacaccgugaccaucgaguccaacagcgggggcuuccgccggacgaucucccgccuggagcggagcggcauccgcaccuacgucuccaccaucaccgugccccugcggcgcaucagcgagaacgagcucguggagccguccagcgucgcccugcgguccauccugcgccagaucaugacgggguucggcgagcucagcucccugauggaggccgacagcgagagcgagcugcagcggaacgggcagcaccuccccgacaugcacuccgagcugagcaaccugggcaccgacaacaaccgcucccagcaccgggaggggagcucccaggaccgccaggcgcagggcgacagcaccgagaugcacggcgagaacgagaccacccagccccacacgcggaacuccgacagccgcgggggccggcagcuccgcaaccccaacaaccugguggagaccgggacccugccgauccuccggcuggcccacuucuuccugcucaacgaguccgacgacgacgaccgcauccgcggccugaccaaggagcagaucgacaaccugagcacgcggcacuacgagcacaacuccaucgacagcgagcucggcaagaucugcuccgugugcaucagcgacuacgucaccgggaacaagcugcgccagcugcccugcaugcacgaguuccacauccacugcaucgaccgguggcucuccgagaacugcacgugccccaucugccgccagcccgugcugggcagcaacaucgccaacaacggguga

SEQ ID NO: 35813 - RNA, 294 nt, Artificial Sequence
  derived and/or modified sequence opt1 from RNF7__Homo_sapiens__NP_001188299
auggccgacguggaggacggcgaggagaccugcgcccuggcgagccacuccgggagcuccggcagcaaguccgggggcgacaagauguucagccucaagaaguggaacgccgucgccaugugguccugggacguggagugcgacaccugcgccaucugccgcgugcaggucauggugguguggggggagugcaaccacagcuuccacaacugcugcaugucccugugggucaagcagaacaaccggugcccccugugccagcaggacuggguggugcagcgcaucggcaaguga

SEQ ID NO: 35814 - RNA, 1458 nt, Artificial Sequence
  derived and/or modified sequence opt1 from RNF8__Homo_sapiens__NP_003949
augggcgagcccggguucuucgugaccggcgaccgcgccgggggccggagcuggugccugcgccgggucgggauguccgccggcuggcuccugcuggaggacggcugcgaggugaccguggggcgcggcuucggggucacguaccagcucgugagcaagaucugcccgcugaugaucucccggaaccacugcgugcugaagcagaaccccgagggccaguggaccaucauggacaacaagagccucaacggggucuggcugaaccgcgcgcggcuggagccccuccgcguguacuccauccaccagggcgacuacauccagcugggcgugccccuggagaacaaggagaacgccgaguacgaguacgaggucaccgaggaggacugggagaccaucuacccgugccucagccccaagaacgaccagaugaucgagaagaacaaggagcugcggacgaagcgcaaguucucccuggacgagcucgccgggcccggcgccgaggggcccagcaaccugaaguccaagaucaacaaggugagcugcgaguccggccagccggucaagagccagggcaagggggagguggccuccacccccagcgacaaccuggaccccaagcucaccgcgcuggagcccuccaagaccacgggcgccccgaucuaccccggguuccccaaggugaccgaggugcaccacgagcagaaggccagcaacuccagcgccucccagcggagccugcagauguucaaggucaccaugagccgcauccuccggcugaagauccagaugcaggagaagcacgaggcggugaugaacgugaagaagcagacccagaagggcaacuccaagaaggucgugcagauggagcaggagcugcaggaccuccagagccagcugugcgccgagcaggcccagcagcaggcccgcguggagcagcuggagaagacguuccaggaggaggagcagcaccuccaggggcuggagaucgcccagggcgagaaggaccugaagcagcagcucgcgcaggcccugcaggagcacugggcccugauggaggagcucaaccgguccaagaaggacuucgaggccaucauccaggccaagaacaaggagcuggagcagaccaaggaggagaaggagaagaugcaggcgcagaaggaggagguccugagccacaugaacgacgugcucgagaacgagcugcagugcaucaucugcuccgaguacuucaucgaggccgugacccugaacugcgcccacagcuucugcuccuacugcaucaacgaguggaugaagcgcaagaucgagugccccaucugccggaaggacaucaagagcaagaccuacucccucguccuggacaacugcaucaacaagauggugaacaaccugagcuccgaggucaaggagcgccggaucgugcucauccgcgagcggaaggccaagcgccuguucuga

SEQ ID NO: 35815 - RNA, 1725 nt, Artificial Sequence
  derived and/or modified sequence opt1 from RNGTT__Homo_sapiens__NP_001273355
auggcccacaacaagaucccgccccgcuggcugaacugcccccggcgcggccagcccguggccgggcgguuccucccccugaagaccaugcugggcccccgcuacgacagccaggucgcggaggagaaccgguuccaccccuccaugcucagcaacuaccugaagucccugaaggugaagauggggcuccugguggaccugaccaacacgagccgcuucuacgaccggaacgacaucgagaaggagggcaucaaguacaucaagcuccagugcaaggggcacggcgagugccccaccaccgagaacaccgagacguucauccgccugugcgagcgguucaacgagcgcaacccgcccgagcugaucggcguccacugcacccacggguucaaccggaccggcuuccucaucugcgccuuccugguggagaagauggacugguccaucgaggccgccguggccaccuucgcgcaggcccgcccgcccgggaucuacaagggcgacuaccugaaggagcuguuccggcgcuacggggacaucgaggaggccccgcccccgccccugcugcccgacuggugcuucgaggacgacgaggacgaggacgaggacgaggacggcaagaaggagagcgagcccggcuccagcgccuccuucgggaagcggcgcaaggagcggcucaagcucggcgcgaucuuccuggagggggucacggugaagggcgugacccaggucaccacccagcccaagcucggcgaggugcagcagaagugccaccaguucugcgggugggagggcagcggguuccccggcgcccagcccguguccauggacaagcagaacaucaagcugcuggaccucaagcccuacaaggucagcuggaaggccgacgggacgcgcuacaugaugcugaucgacggcaccaacgagguguucaugaucgaccgggacaacuccguguuccacgucagcaaccuggaguuccccuuccgcaaggaccuccggaugcaccuguccaacacccugcucgacggcgagaugaucaucgaccgcgugaacgggcaggccgugccccgcuaccugaucuacgacaucaucaaguucaacagccagcccgucggcgacugcgacuucaacgugcggcugcagugcaucgagcgcgagaucaucuccccgcggcacgagaagaugaagaccgggcucaucgacaagacgcaggagcccuucagcgugcgcaacaagcccuucuucgacaucugcaccucccggaagaaguacaagcccggccgcugcgacgacauccugaaguggaagccgcccagccugaacagcgucgacuuccggcucaagaucacccgcaugggcggggagggccugcugccccagaacguggggcuccuguacgugggcggguacgagcggccguucgcccagaucaaggucaccaaggagcugaagcaguacgacaacaagaucaucgagugcaaguucgagaacaacuccuggguguucaugcgccagcggacggacaagagcuuccccaacgcguacaacaccgccauggccgucugcaacuccaucagcaaccccgugaccaaggagaugcuguucgaguucaucgaccgcugcaccgccgccucccagggccagaagcggaagcaccaccucgaccccgacacggagcugaugccgcccccgccgcccaagcgcccccggccccucaccuga

SEQ ID NO: 35816 - RNA, 1386 nt, Artificial Sequence
  derived and/or modified sequence opt1 from RNH1__Homo_sapiens__XP_011518565
augagccuggacauccagucccucgacauccagugcgaggagcugagcgacgcccgcugggccgagcugcucccccugcugcagcagugccaggugguccggcucgacgacugcggccugaccgaggcgcgcugcaaggacaucuccagcgcccugcgggugaacccggcccucgccgagcugaaccugcgcuccaacgagcucggggacgugggcguccacugcgugcugcaggggcugcagacccccagcugcaagauccagaagcucucccugcagaacugcugccugacgggcgccgggugcggcgugcucagcuccacccugcggacccugcccacccuccaggagcugcaccugagcgacaaccuccugggcgacgcggggcugcagcuccugugcgagggccugcucgacccccagugccgccuggagaagcugcagcucgaguacugcucccugagcgccgccuccugcgagccgcuggccagcguccuccgggcgaagcccgacuucaaggagcugacgguguccaacaacgacaucaacgaggccggggugcgcguccugugccagggccucaaggacagccccugccagcuggaggcccugaagcucgaguccugcggggugaccagcgacaacugccgggaccugugcggcaucguggccuccaaggccagccugcgcgagcucgcgcugggcagcaacaagcugggggacgucggcauggccgagcucugccccgggcugcugcacccguccagccggcugcgcacccucuggaucugggagugcggcaucaccgccaagggcugcggggaccugugccgggugcugcgcgccaaggagucccucaaggagcugagccuggccggcaacgagcucggggacgagggcgcgcggcugcugugcgagacgcuccuggagcccgggugccagcuggagucccucugggucaagagcugcuccuucaccgccgccugcugcagccacuucuccagcgugcuggcccagaaccgcuuccugcucgagcugcagaucuccaacaaccggcuggaggacgccggcgugcgcgagcucugccagggccuggggcagcccggcagcgugcugcggguccucuggcuggcggacugcgacguguccgacagcuccugcagcucccuggccgccacccuccuggccaaccacagccugcgcgagcucgaccuguccaacaacugccugggggacgccggcauccuccagcugguggagagcguccggcagcccgggugccugcucgagcagcuggugcuguacgacaucuacuggagcgaggagauggaggaccgccuccaggcgcuggagaaggacaagccgucccugcgcgugaucagcuga

SEQ ID NO: 35817 - RNA, 1029 nt, Artificial Sequence
  derived and/or modified sequence opt1 from RNLS__Homo_sapiens__NP_001026879
auggcccaggugcugaucgucggcgccgggaugaccggcagccucugcgcggcccugcugcgccggcagaccuccgggccccucuaccuggccgugugggacaaggccgaggacagcggcgggcgcaugacgaccgccugcuccccgcacaacccccagugcaccgcggaccugggcgcccaguacaucacgugcacgccccacuacgccaagaagcaccagcgguucuacgacgagcuccuggccuacggcgugcugcgcccccucagcuccccgaucgaggggauggucaugaaggagggcgacugcaacuucguggcgccccaggggaucagcuccaucaucaagcacuaccugaaggagagcggcgccgagguguacuuccggcaccgcgucacccagaucaaccugcgggacgacaagugggagguguccaagcagaccgggagccccgagcaguucgaccucaucgugcugaccaugcccgucccggagauccugcagcuccagggcgacaucaccacccugaucuccgagugccagcgccagcagcuggaggccgugagcuacuccagccgguacgcccucggccuguucuacgaggccgggaccaagaucgacgugcccugggcgggccaguacaucaccuccaaccccugcauccgcuucgucagcaucgacaacaagaagcggaacaucgaguccagcgagaucgggcccucccuggugauccacacgaccgugccguucggcgucaccuaccucgagcacagcaucgaggacgugcaggagcugguguuccagcagcuggagaacauccuccccggccugccccagcccaucgccaccaagugccagaaguggcgccacagccaggucacgaacgccgccgccaacugcccggggcagaugacccugcaccacaagcccuuccucgcgugcggcggggacggcuucacccaguccaacuucgacgggugcaucaccagcgcccugugcgugcuggaggcccucaagaacuacaucuga

SEQ ID NO: 35818 - RNA, 1431 nt, Artificial Sequence
  derived and/or modified sequence opt1 from RNMT__Homo_sapiens__NP_003790
auggccaacagcgccaaggcggaggaguacgagaagaugucccuggagcaggccaaggccagcgugaacuccgagaccgagagcuccuucaacaucaacgagaacaccacggccagcggcaccgggcucuccgagaagaccagcgucugccgccagguggacaucgcccggaagcgcaaggaguucgaggacgaccuggugaaggaguccagcuccugcggcaaggacacccccagcaagaagcggaagcuggacccggagaucguccccgaggagaaggacugcggggacgcggagggcaacuccaagaagcgcaagcgggagacggaggacgugcccaaggacaagagcuccaccggggacggcacccagaacaagcgcaagaucgcccucgaggacgugcccgagaagcagaagaaccuggaggagggccacagcuccaccgucgccgcccacuacaacgagcugcaggagguggggcucgagaagcggagccagucccgcaucuucuaccugcggaacuucaacaacuggaugaaguccgugcugaucggcgaguuccucgagaagguccgccagaagaagaagcgggacaucacggugcuggaccuggggugcggcaagggcggggaccuccugaaguggaagaagggccgcaucaacaagcuggugugcaccgacaucgcggacgucagcgugaagcagugccagcagcgguacgaggacaugaagaaccgccgggacagcgaguacaucuucagcgccgaguucaucaccgccgacuccagcaaggagcuccugaucgacaaguuccgcgacccgcagaugugcuucgacaucugcuccugccaguucgugugccacuacagcuucgaguccuacgagcaggccgacaugaugcugcggaacgccugcgagcgccucagccccgggggcuacuucaucgggaccacgcccaacuccuucgagcugauccggcgccuggaggcgagcgagaccgaguccuucggcaacgagaucuacaccgucaaguuccagaagaagggcgacuacccccucuucgggugcaaguacgacuucaaccuggagggcgugguggacgucccggaguuccugguguacuucccccuccugaacgagauggccaagaaguacaacaugaagcugguguacaagaagaccuuccucgaguucuacgaggagaagaucaagaacaacgagaacaagaugcugcugaagcggaugcaggcccucgagcccuaccccgccaacgagagcuccaagcuggucagcgagaagguggacgacuacgagcacgccgcgaaguacaugaagaacucccaggugcgccugccgcucgggacgcugagcaaguccgagugggaggccaccagcaucuaccuggucuucgccuucgagaagcagcaguga

SEQ ID NO: 35819 - RNA, 1953 nt, Artificial Sequence
  derived and/or modified sequence opt1 from RNPEP__Homo_sapiens__NP_064601
auggccagcggcgagcacucccccgggagcggcgccgcgcgccggccgcugcacuccgcccaggccguggacgucgccagcgccuccaacuuccgcgcguucgagcuccugcaccuccaccucgaccugcgggccgaguucgggccgcccggccccggggccggcagccgcggccuguccgggaccgccgugcucgaccugcggugccuggagcccgagggcgcggccgagcuccgccuggacagccaccccugccuggaggugaccgccgccgcccuccggcgcgagcggcccggguccgaggagcccccggcggagcccgucagcuucuacacgcagcccuucucccacuacggccaggcccugugcgugagcuucccccagccgugccgcgccgccgagcggcuccaggugcugcugaccuaccgcgucggggagggccccggcgugugcuggcuggcccccgagcagaccgcggggaagaagaagcccuucguguacacccagggccaggccguccucaaccgggccuucuucccgugcuucgacacgcccgccgugaaguacaaguacuccgcccugaucgaggugcccgacggguucaccgcggucaugagcgccuccaccugggagaagcgcggccccaacaaguucuucuuccagaugugccagccgauccccagcuaccugaucgcccucgccaucggcgaccugguguccgccgagguggggccccggagccgcgucugggcggagcccugccugaucgacgccgccaaggaggaguacaacggcgugaucgaggaguuccucgccaccggggagaagcuguucggcccguacgugugggggcgguacgaccugcuguucaugccgcccuccuuccccuucggcggcauggagaaccccugccugacguucgucacccccugccugcucgcgggggaccgcagccuggccgacgugaucauccacgagaucagccacuccugguucggcaaccuggugaccaacgccaacuggggcgaguucuggcucaacgagggguucaccauguacgcccagcggcgcaucagcacgauccuguucggggccgcguacacgugccuggaggccgccaccggccgggcccuccugcgccagcacauggacaucaccggcgaggagaacccccugaacaagcuccgcgucaagaucgagccggggguggaccccgacgacaccuacaacgagacccccuacgagaagggcuucugcuucguguccuaccuggcccaccuggucggggaccaggaccaguucgacagcuuccucaaggcguacgugcacgaguucaaguuccgguccauccuggccgacgacuuccuggacuucuaccucgaguacuuccccgagcugaagaagaagcgcgucgacaucaucccgggcuucgaguucgaccgguggcugaacacccccggguggccgcccuaccuccccgaccugagccccggcgacucccugaugaagcccgccgaggagcuggcccagcucugggccgcggaggagcuggacaugaaggccaucgaggccguggccaucagccccuggaagaccuaccagcugguguacuuccucgacaagauccugcagaaguccccgcugccgcccggcaacgucaagaagcucggggacacguaccccagcaucuccaacgcgcgcaacgccgagcugcggcugcgcuggggccagaucgugcucaagaacgaccaccaggaggacuucuggaaggugaaggaguuccugcacaaccaggggaagcagaaguacacccugccccucuaccacgccaugaugggcggcagcgaggucgcccagacccuggccaaggagaccuucgcguccacggccagccagcugcacuccaacguggugaacuacguccagcagaucguggcccccaaggggagcuga

SEQ ID NO: 35820 - RNA, 2178 nt, Artificial Sequence
  derived and/or modified sequence opt1 from RNPEPL1__Homo_sapiens__NP_060696
auggccgcccagugcugcugccgccaggcgcccggcgccgaggccgccccggugcggcccccgcccgagcccccgcccgcccuggacgucgcgagcgccuccagcgcccagcuguuccgccugcggcaccuccagcucgggcuggagcugcgccccgaggcccgggagcucgcgggcugccuggugcuggagcucugcgcccugcgccccgcgccccgggcccuggugcucgacgcccaccccgcccugcgccugcacuccgccgccuuccggcgcgcccccgccgcggccgccgagaccccgugcgccuucgccuucagcgcgcccgggcccggccccgccccgcccccgccccuccccgccuuccccgaggcccccggguccgagcccgccugcugcccgcuggcguuccgggucgaccccuucaccgacuacggcagcucccugacggugacccucccgcccgagcugcaggcccaccagcccuuccaggugauccugcgcuacaccagcaccgacgcccccgccaucugguggcucgaccccgagcugacguacggcugcgcgaagccguucgucuucacccaggggcacuccgugugcaaccggagcuucuuccccugcuucgacacccccgccgugaagugcaccuacuccgccgucgugaaggcccccagcggcgugcagguccugauguccgccacgcgcagcgcguacauggaggaggaggggguguuccacuuccacauggagcacccggugcccgccuaccucgucgcccugguggccggcgaccugaagcccgccgacaucgggccccggucccgcgugugggcggagccgugccuccugcccaccgccaccagcaagcuguccggcgccgucgagcaguggcucagcgccgccgagcggcuguacggccccuacaugugggggcgcuacgacaucguguuccugcccccguccuuccccaucguggcgauggagaaccccugccucaccuucaucaucagcagcauccuggaguccgacgaguuccuggucaucgacgugauccacgagguggcccacagcugguucggcaacgccgucacgaacgccaccugggaggagauguggcucuccgaggggcuggcgaccuacgcccagcggcgcaucaccacggagaccuacggcgccgccuucacgugccuggagaccgccuuccggcucgacgcgcugcaccgccagaugaagcugcucggcgaggacagccccguguccaagcugcaggucaagcuggagccgggggugaaccccagccaccucaugaaccuguucaccuacgagaagggcuacugcuucguguacuaccugucccagcucugcggggacccccagcgcuucgacgacuuccugcgggccuacgucgagaaguacaaguucaccagcgugguggcccaggaccugcuggacuccuuccucagcuucuuccccgagcugaaggagcaguccgucgacugccgcgccggccuggaguucgagcgguggcucaacgccaccgggccgccccuggcggagcccgaccugagccagggcuccagccucacccgccccguggaggcccuguuccagcuguggacggccgagccgcucgaccaggccgccgcguccgccagcgccaucgacaucuccaaguggcggaccuuccagaccgcccuguuccuggaccgccuccuggacggcagcccccugccccaggagguggucaugucccucagcaagugcuacagcucccugcuggacagcaugaacgcggagauccggauccgcuggcuccagaucguggugcggaacgacuacuacccggaccugcaccgcguccggcgcuuccuggagucccagaugagccggauguacaccaucccccucuacgaggaccugugcacgggggcccugaaguccuucgcccucgagguguucuaccagacccagggccgccugcaccccaaccugcggcgcgccauccagcagauccucagccaggggcugggcuccagcaccgagcccgccuccgagccgagcaccgagcuggggaaggcggaggccgacacggacuccgacgcccaggcccuccugcugggcgacgaggcccccagcuccgcgaucagccuccgggacgugaacgucuccgccuga

SEQ ID NO: 35821 - RNA, 849 nt, Artificial Sequence
  derived and/or modified sequence opt1 from RNPS1__Homo_sapiens__NP_001273555
auggcccccagccccaccaagcgcaaggaccgguccgacgagaaguccaaggaccgcagcaaggacaagggcgccaccaaggagagcuccgagaaggaccgggggcgcgacaagacgcggaagcgccggagcgcguccagcggcuccagcuccacccgcagccgguccagcuccaccagcuccagcggguccagcaccagcacgggcuccagcuccgggagcuccagcuccagcgccuccagccgcuccggcagcuccagcaccucccggagcuccagcuccagcagcuccagcggcucccccagccccucccgccggcgccacgacaaccggcgccggagccgcuccaagagcaagccgcccaagcgggacgagaaggagcgcaagcggcgcucccccagccccaagcccaccaaggugcacaucgggcgccucacccggaacgucacgaaggaccacaucauggagaucuucuccaccuacggcaagaucaagaugaucgacaugcccguggagcgcaugcacccccaccucagcaagggguacgccuacguggaguucgagaaccccgacgaggccgagaaggcccugaagcacauggacggcgggcagaucgacggccaggagaucaccgcgaccgccguccuggcccccuggccgcggcccccgccccgccgguucuccccgccccgccggaugcugcccccgccgcccauguggcgccggagcccgccccgcaugcggcgccggucccgcagcccccggcgccggucccccgugcgccggcgcagccgcagccccggccggcgccggcaccgcucccggagcuccagcaacuccagccgcuga

SEQ ID NO: 35822 - RNA, 4656 nt, Artificial Sequence
  derived and/or modified sequence opt1 from ROBO1__Homo_sapiens__NP_001139317
augaucgccgagcccgcccacuucuaccuguucggccucaucugccugugcagcgggucccgccugcggcaggaggacuucccgccccgcaucguggagcaccccagcgaccucaucgucuccaagggcgagcccgcgacccugaacugcaaggccgaggggcggccgacccccacgaucgagugguacaagggcggggagcgcguggagaccgacaaggacgacccccggagccaccgcaugcugcuccccuccggcagccuguucuuccugcggaucgugcacggccgcaagucccggccggacgagggggucuacgugugcguggcccgcaacuaccucggcgaggccgucagccacaacgccucccuggagguggcgauccugcgggacgacuuccgccagaaccccagcgacgugauggucgccgugggggagcccgccgugauggagugccagcccccgcggggccaccccgagcccaccaucuccuggaagaaggacgggagcccccucgacgacaaggacgagcgcaucaccauccggggcggcaagcugaugaucacguacacccgcaaguccgacgccgggaaguacgucugcgugggcaccaacauggugggggagcgggagagcgaggucgcggagcugaccgugcucgagcgcccguccuucgugaagcggcccagcaaccuggccgucacgguggacgacuccgccgaguucaagugcgaggcccgcggcgaccccgugcccaccguccgguggcgcaaggacgacggcgagcugccgaagagccgcuacgagauccgggacgaccacacccucaagauccgcaaggugaccgccggggacaugggcuccuacacgugcguggcggagaacauggucgggaaggccgaggccagcgccacccugaccgugcaggucggcagcgagcccccccacuucguggugaagccccgggaccaggucguggcccuggggcgcaccgugacguuccagugcgaggcgaccggcaacccgcagcccgccaucuucuggcggcgcgagggcucccagaaccuccuguucagcuaccagcccccccaguccagcucccgguucagcgucucccagaccggggaccugaccaucacgaacgugcagcgcagcgacgugggcuacuacaucugccagacccucaacgucgccggguccaucaucaccaaggccuaccuggaggugaccgacgugaucgccgaccggccgccccccgucauccgccagggcccggugaaccagacgguggcggucgacgggaccuucgugcugagcugcguggccaccggcucccccguccccaccauccucuggcggaaggacggcgugcuggugagcacgcaggacucccgcaucaagcagcuggagaacgggguccuccagauccgguacgccaagcugggcgacaccgggcgcuacaccugcaucgccagcacccccuccggcgaggccacguggagcgcguacaucgaggugcaggaguucggggugccgguccagcccccccggcccaccgacccgaaccugauccccuccgcccccagcaagcccgaggugaccgacgugucccgcaacaccgucacgcucagcuggcagccgaaccugaacagcggcgccacccccaccuccuacaucaucgaggccuucagccacgcguccggcagcuccuggcagaccguggccgagaacgugaagaccgagacgagcgccaucaaggggcugaagcccaacgccaucuaccucuuccugguccgggccgcgaacgccuacggcaucuccgaccccagccagaucuccgacccggugaagacccaggacgugcugcccaccagccagggggucgaccacaagcaggugcagcgcgagcucggcaacgccgugcugcaccugcacaaccccaccguccucuccagcuccagcaucgaggugcacuggacgguggaccagcagucccaguacauccagggcuacaagauccuguaccggcccagcggggccaaccacggcgaguccgacuggcuggucuucgaggugcgcaccccggccaagaacagcguggucauccccgaccuccgcaagggggugaacuacgagaucaaggcgcggcccuucuucaacgaguuccagggcgccgacagcgagaucaaguucgccaagacccuggaggaggcccccuccgccccgccccagggggugaccgucagcaagaacgacggcaacggcacggcgauccugguguccuggcagcccccgcccgaggacacccagaacgggauggugcaggaguacaaggucuggugccucggcaacgagacccgcuaccacaucaacaagaccguggacgggagcacguucuccguggucauccccuuccuggugcccggcauccgguacagcgucgagguggccgccuccaccggggccggcagcggcgugaaguccgagccgcaguucauccagcuggacgcgcacgggaaccccgucagccccgaggaccaggugucccuggcccagcagaucagcgacguggucaagcagcccgccuucaucgccggcaucggggccgcgugcuggaucauccucaugguguucuccaucuggcuguaccgccaccggaagaagcgcaacggccugaccagcaccuacgccgggauccggaaggugacguaccagcgcggcggcgaggccgucuccagcgggggccggccggggcuccugaacaucuccgagcccgccgcccagcccuggcuggcggacaccuggcccaacaccggcaacaaccacaacgacugcagcaucuccugcugcaccgccgggaacggcaacagcgacagcaaccucacgaccuacucccgcccgggccagcccacccccuacgccaccacgcagcugauccagagcaaccuguccaacaacaugaacaacgggagcggcgacuccggggagaagcacuggaagccccucggccagcagaagcaggagguggccccggugcaguacaacaucgucgagcagaacaagcugaacaaggacuaccgggccaacgacaccgugccccccaccauccccuacaaccagagcuacgaccagaacaccggcggguccuacaacagcuccgaccgcggcagcuccacgagcgggucccagggccacaagaagggggcgcggaccccgaaggugcccaagcagggcggcaugaacugggccgaccugcucccccccccgcccgcccacccccccccgcacagcaacuccgaggaguacaacaucagcgucgacgaguccuacgaccaggagaugcccugccccgugccgcccgcccgcauguaccugcagcaggacgagcuggaggaggaggaggacgagcgggggcccacccccccggugcgcggcgcggccagcucccccgccgccgucagcuacagccaccaguccaccgccacgcucacccccagcccccaggaggagcugcagccgaugcugcaggacugccccgaggagaccgggcacaugcagcaccagcccgaccggcgccggcagcccguguccccgcccccccccccgcgccccaucagccccccccacaccuacggcuacaucuccgggccgcucgugagcgacauggacacggacgcgcccgaggaggaggaggacgaggccgacauggaggucgccaagaugcagacccggcgccugcugcuccgcggccuggagcagacccccgccuccagcgugggcgaccuggaguccagcgugaccggguccaugaucaacggcugggggagcgccuccgaggaggacaacaucagcuccggccggagcuccgucagcuccagcgacgggagcuucuucaccgacgcggacuucgcccaggccguggccgccgcggccgaguacgccggccucaagguggcccgccggcagaugcaggacgccgcgggccgccggcacuuccacgccucccagugcccccgcccgacgagccccgucuccaccgacagcaacauguccgccgccgugaugcagaagacccggcccgcgaagaagcugaagcaccagcccgggcaccugcgccgggagaccuacacggacgaccucccgccccccccggugcccccccccgccaucaagagcccgaccgcccaguccaagacccagcuggagguccgccccguggugguccccaagcugcccagcauggacgcccggaccgaccgcuccagcgaccggaagggcuccagcuacaaggggcgcgaggugcucgacggccggcagguggucgacaugcgcacgaacccgggcgacccccgggaggcccaggagcagcagaacgacgggaagggccgcgggaacaaggcggccaagcgggaccugccccccgccaagacccaccugauccaggaggacauccucccguacugccgccccaccuuccccaccuccaacaacccccgcgacccgagcuccagcuccagcauguccagccggggcagcgggucccgccagcgggagcaggccaacgugggccgccggaacaucgccgagaugcaggugcugggcggguacgagcgcggcgaggacaacaacgaggagcuggaggagacggagagcuga

SEQ ID NO: 35823 - RNA, 4185 nt, Artificial Sequence
  derived and/or modified sequence opt1 from ROBO2__Homo_sapiens__NP_001122401
auggcccgccggcacgagcgcgugacccggcgcauguggaccugggcccccggccugcucaugaugacggucguguucugggggcaccagggcaacgggcagggccaggggagccggcugcgccaggaggacuucccgccccggaucguggagcaccccuccgacgucaucgugagcaagggcgagcccaccacccugaacugcaaggcggagggccgcccgacccccacgaucgagugguacaaggacggggagcggguggagaccgacaaggacgacccccgcucccaccggaugcuccugcccagcggcucccuguucuuccuccgcaucguccacgggcggcgcagcaagccggacgagggcuccuacgugugcguggcccggaacuaccugggggaggccgucagccgcaacgccucccuggagguggcccuccugcgggacgacuuccgccagaaccccaccgacguggucguggcggccggcgagcccgccauccuggagugccagcccccgcggggccaccccgagcccaccaucuacuggaagaaggacaaggugcgcaucgacgacaaggaggagcggaucagcauccgcgggggcaagcucaugaucuccaacacgcgcaagagcgacgccgggauguacacgugcgucggcaccaacauggugggcgagcgggacuccgaccccgcggagcugaccguguucgagcgcccgacguuccugcggcgccccaucaaccaggucgugcucgaggaggaggccguggaguuccggugccagguccagggggacccccagcccaccgugcgcuggaagaaggacgacgccgaccugccgcggggccgcuacgacaucaaggacgacuacacccugcggaucaagaagaccaugagcacggacgaggggaccuacaugugcaucgccgagaaccgcgugggcaagauggaggccuccgcgacccucaccguccgggccccgccccaguucgugguccgcccccgggaccagaucguggcccaggggcgcacggugaccuuccccugcgagaccaagggcaacccccagcccgccgucuucuggcagaaggagggcagccagaaccugcuguuccccaaccagccgcagcagcccaacucccggugcagcgugucccccaccggggaccucacgaucaccaacauccagcgcagcgacgccggcuacuacaucugccaggcgcugaccguggccgggagcauccuggccaaggcccagcucgaggucaccgacgugcugacggaccggccgccgcccaucauccugcagggccccgccaaccagacccucgcgguggacgggaccgcccugcugaagugcaaggccaccggcgacccccuccccgucaucuccuggcugaaggagggcuucaccuuccccgggcgcgacccccgggccaccauccaggagcagggcacccugcagaucaagaaccuccgcaucagcgacaccgggacguacacgugcguggccaccuccagcuccggcgagaccagcugguccgcggugcuggacgucaccgagagcggggccaccaucuccaagaacuacgaccugagcgaccucccgggcccgcccuccaagccccaggugaccgacgugaccaagaacagcgucacccuguccuggcagcccggcacgcccgggacccugcccgccagcgccuacaucaucgaggcguucucccagagcguguccaacagcuggcagaccguggccaaccacgucaagaccacgcucuacaccgugcgcggccugcggcccaacaccaucuaccuguucauggugcgcgccaucaacccgcaggggcucuccgaccccagccccaugagcgaccccguccggacccaggacaucuccccgcccgcccagggcguggaccaccgccaggugcagaaggagcugggcgacguccuggugcggcuccacaaccccgugguccugacgcccaccaccguccaggugaccuggacgguggaccgccagccgcaguucauccagggguaccgggugauguaccgccagaccagcggccugcaggccaccuccagcuggcagaaccucgacgcgaaggugcccaccgagcgguccgccguccuggugaaccugaagaagggggugacguacgagaucaagguccgccccuacuucaacgaguuccagggcauggacagcgaguccaagaccgugcggaccaccgaggaggccccgagcgccccgccccaguccgugacgguccugaccguggggagcuacaacuccaccagcaucuccgugagcugggacccgcccccgcccgaccaccagaacggcaucauccaggaguacaagaucuggugccucggcaacgagacccgcuuccacaucaacaagacggucgacgccgcgauccgguccgugaucaucgggggccuguuccccgggauccaguaccgcguggaggucgccgccagcaccuccgccggcgugggggucaagagcgagccccagcccaucaucaucggccggcgcaacgagguggugaucaccgagaacaacaacagcaucaccgagcagaucacggacguggucaagcagcccgccuucaucgcgggcaucgggggcgccugcugggugauccugaugggguucuccaucuggcucuacuggcggcgcaagaagcggaagggccugagcaacuacgccgucaccuuccagcgcggggacggcggccugauguccaacgggagccggcccggccuccugaacgccggggaccccuccuaccccuggcuggcggacagcuggcccgccaccucccuccccgugaacaacagcaacuccggcccgaacgagaucgggaacuucggccgcggcgacgugcugccgcccguccccgggcagggcgacaagaccgccacgaugcugagcgacggggccaucuacuccagcaucgacuucaccaccaagaccuccuacaacagcuccagccagaucacccaggccacgcccuacgcgaccacccagauccuccacuccaacagcauccacgagcuggccguggaccugcccgacccccaguggaaguccagcauccagcagaagaccgaccucaugggcuucggcuacagccugcccgaccagaacaaggggaacaacggcgggaagggcgggaagaagaagaagaacaagaacuccagcaagccgcagaagaacaacggcuccacgugggccaacgugccccugccgccgccgcccguccagccccuccccggcaccgagcuggagcacuacgccguggagcagcaggagaacggguacgacagcgacuccuggugcccgccccugcccgugcagaccuaccuccaccagggccuggaggacgagcuggaggaggacgacgaccgcguccccaccccgcccgugcgcgggguggccagcucccccgcgaucagcuucggccagcaguccacggccacccucacccccagcccccgggaggagaugcagcccaugcugcaggcccaccuggacgagcucacccgggccuaccaguucgacaucgccaagcagacguggcacauccaguccaacaaccagccgccccagccgcccgugccgccccugggguacgucagcggcgcgcugaucuccgaccucgagaccgacguggccgacgacgacgccgacgacgaggaggaggcccuggagaucccccgcccccugcgggcgcucgaccagacccccggcagcuccauggacaaccuggacagcuccgucaccgggaaggccuucacgagcucccagcgcccccggcccaccagccccuucagcaccgacuccaacaccagcgccgcccugucccagagccagcgcccccggcccacgaagaagcacaagggcgggcgcauggaccagcagcccgcccucccccaccggcgcgagggcaugaccgacgaggaggcgcuggugcccuacuccaagccgagcuuccccucccccgggggccacagcuccagcggcaccgccuccagcaagggguccaccggcccgcggaagacggaggugcugcgcgccgggcaccagcggaacgccagcgaccuccuggacaucggcuacaugggcuccaacagccaggggcaguucaccggcgagcuguga

SEQ ID NO: 35824 - RNA, 4161 nt, Artificial Sequence
  derived and/or modified sequence opt1 from ROBO3__Homo_sapiens__NP_071765
augcugcgcuaccuccugaagacccugcuccagaugaaccuguucgccgacagccuggccggcgacaucuccaacagcuccgagcuccugcugggguucaacagcucccucgcggcccugaaccacacccugcuccccccgggcgaccccagccugaacgggucccgggugggccccgaggacgccaugccccgcaucgucgagcagccgcccgaccugcucgugagccggggggagcccgccacgcugcccugccgcgccgagggccggccgcgccccaacaucgagugguacaagaacggcgcgcggguggccaccguccgcgaggacccccgggcccaccgccugcuccugcccuccggggcccuguucuucccgcggaucgugcacggccgccgggcgcgccccgacgaggggguguacaccugcgucgcccggaacuaccucggcgccgccgccagccgcaacgcgucccuggagguggccgugcugcgggacgacuuccgccagagccccgggaacgucgugguggccgucggcgagcccgccgugcucgagugcgugccgccccggggccaccccgagcccuccgucagcuggcgcaaggacggggcccggcugaaggaggaggagggccgcaucaccauccgcgggggcaagcugaugaugucccacacgcucaagagcgacgcgggcauguacgugugcguggccuccaacauggccggggagcgggagagcgccgccgcggaggucauggugcuggagcgcccguccuuccugcggcgccccgugaaccaggucgugcucgccgacgcccccgugaccuuccugugcgaggucaagggcgaccccccgccccggcugcgcuggcggaaggaggacggggagcuccccaccggccgcuacgagauccggagcgaccacagccuguggaucgggcacguguccgccgaggacgagggcaccuacacgugcgucgccgagaacagcgugggccgcgcggaggccuccgggagccuguccgugcacguccccccgcagcucgugacccagccccaggaccagauggccgcccccggcgagagcguggcguuccagugcgagaccaaggggaacccgccccccgccaucuucuggcagaaggagggcucccagguccugcuguuccccagccagucccuccagccgaccgggcgguucagcguguccccccgcggccagcugaacaucacggccgugcagcggggcgacgccggguacuacgucugccaggccgugagcguggcgggcuccauccuggccaaggcccuccuggagaucaagggggccagccuggacggccucccccccgucauccugcaggggccggccaaccagacccuggugcucggcuccagcguguggcugcccugccgcgucaccggcaacccccagcccuccgugcgguggaagaaggacgggcaguggcugcagggcgacgaccugcaguucaagaccauggcgaacgggacgcucuacaucgccaacgugcaggagauggacaugggcuucuacagcugcgucgccaaguccagcaccggcgaggccaccuggagcggguggcugaagaugcgcgaggacuggggcguguccccggacccccccaccgagcccagcuccccgcccggggcccccagccagcccguggucacggagaucaccaagaacuccaucacccugaccuggaagccgaacccccagacgggcgcggccgugaccagcuacgugaucgaggccuucucccccgccgcggggaacaccuggcggaccgucgccgacggcgugcagcucgagacgcacaccgugagcggccugcagcccaacaccaucuaccuguuccucguccgcgccgugggggccuggggccuguccgagccgagccccguguccgagcccguccggacccaggacagcuccccgagccgccccguggaggaccccuggcgcgggcagcagggccuggccgagguggcgguccggcuccaggagcccaucgugcuggggccgcgcacgcugcagguguccuggaccgucgacggccccgugcagcucgugcagggcuuccgggucagcuggcgcguggccgggcccgagggcggguccuggaccaugcuggaccugcagagccccagccagcaguccaccgugcuccggggccugccgcccgggacgcagauccagaucaagguccaggcccagggccaggagggccugggggccgagagccucuccgugacccgcagcauccccgaggaggcccccuccggcccgccccaggggguggcggucgcccugggcggggacggcaacagcuccaucaccgugagcugggagcccccccugccgucccagcagaacggcgugaucaccgaguaccagaucuggugccucgggaacgagagccgguuccaccugaaccgcuccgccgccggcugggcccggagcgcgaugcugcgcgggcucguccccggccugcuguaccggacccucguggccgccgccacguccgcgggcguggggguccccagcgcccccgugcugguccagcugccguccccccccgaccucgagcccggccuggaggugggggccggccuggccgugcgccucgcccggguccugcgcgagccggcguuccuggccgggagcggcgccgccugcggcgcccuccugcuggggcucugcgcggcccuguacuggcggcgcaagcagcggaaggagcugucccacuacaccgccagcuucgccuacacccccgccguguccuucccccacagcgagggccucagcggggcguccagccgccccccgaugggccuggggcccgcccccuacuccuggcuggccgacagcuggccgcaccccucccggagccccuccgcccaggagccccgcggcagcugcugcccguccaaccccgaccccgacgaccgguacuacaacgaggccggcaucagccucuaccuggcgcagaccgcccgcgggacggccgcccccggcgaggggccgguguacuccaccaucgaccccgcgggcgaggagcugcagaccuuccacgggggcuucccccagcaccccagcggcgaccucgggccguggucccaguacgccccccccgaguggagccagggcgacuccggggccaagggcggcaaggucaagcugcuggggaagcccgugcagaugccgagccucaacuggcccgaggcccugccccccccgccccccuccugcgagcugagcugccucgagggccccgaggaggagcuggagggguccagcgagccggaggaguggugcccccccaugcccgagcgcagccaccugaccgagccguccagcuccggcgggugccucgugacgcccagccggcgcgagacccccuccccgacccccagcuacggccagcaguccaccgccacgcugacccccagccccccggaccccccccagcccccgaccgacaugccccaccugcaccagaugccccggcgcgucccccucggcccguccagcccccuguccgugagccagcccaugcuggggauccgggaggcgcgccccgccggccucggggccggcccggccgccuccccccaccugagccccucccccgcgccgagcaccgccuccagcgcccccgggcggacguggcagggcaacggcgagaugacccccccccugcaggggccgcgcgcccgguuccgcaagaagcccaaggcccuccccuaccggcgcgagaacuccccgggcgaccugcccccccccccgcugcccccccccgaggaggaggcgagcugggcccucgagcugcgggccgccgggagcauguccagccuggagcgcgagcgguccggcgagcgcaaggcggugcaggccgucccgcucgccgcccagcgggugcugcaccccgacgaggaggccuggcugcccuacagccgccccuccuuccucagccgggggcagggcaccuccaccugcagcacggcgggcuccaacagcucccgcgggagcuccagcucccgcggcagccgggggccgggccgcucccggagccgcucccagagccggagccagucccagcgccccgggcagaagcggcgcgaggagccccgguga

SEQ ID NO: 35825 - RNA, 2589 nt, Artificial Sequence
  derived and/or modified sequence opt1 from ROBO4__Homo_sapiens__NP_001288017
augguggccgucgugggcgagcaguucacccuggagugcgggcccccguggggccaccccgagcccaccgugagcugguggaaggacgggaagccccucgcccugcagccgggccgccacacggucuccgggggcagccugcucauggcgcgggccgagaaguccgacgagggcaccuacaugugcguggccaccaacagcgccgggcaccgcgagucccgggccgcgcgcgugagcauccaggagccccaggacuacaccgagcccgucgagcugcuggccgugcggauccagcucgagaacgugacgcugcugaaccccgacccggccgagggccccaagccccgccccgccgucuggcucuccuggaaggugagcgggccggcggcccccgcccaguccuacaccgcccuguuccggacccagaccgcccccggcgggcagggcgcgcccugggccgaggagcugcucgccggcuggcagagcgccgagcuggggggccugcacugggggcaggacuacgaguucaaggugcgcccguccagcggccgggcccgcggccccgacuccaacguccuccugcugcggcuccccgagaaggugcccagcgcgccgccccaggaggugacgcugaagcccgggaacggcaccgucuucguguccugggugcccccgcccgccgagaaccacaacgggaucauccgcggcuaccaggucuggagccuggggaacaccucccucccccccgccaacuggaccguggugggcgagcagacgcagcuggagaucgccacccacaugccgggcagcuacugcguccagguggccgcggugaccggggccggcgccggggagcccucccggcccgucugccugcuccuggagcaggccauggagcgcgccacccaggagccgagcgagcacggccccuggacgcuggagcagcuccgggcgacccugaagcgccccgaggugaucgccaccugcggggucgcccuguggcuccugcugcucggcaccgccgugugcauccaccggcgccggcgcgcgcgggugcaccugggccccgggcuguaccgcuacacgagcgaggacgccauccucaagcaccgcauggaccacuccgacagccaguggcuggccgacaccuggcgguccaccagcggcucccgcgaccugagcuccagcuccagccucuccagccggcugggggccgacgcccgcgacccgcuggacugccggcgcucccuccugagcugggacucccggagccccggcgucccccugcuccccgacaccuccacguucuacgggagccugaucgcggagcugccguccagcacccccgcccgccccagcccccaggugccggccgugcggcgccuccccccccagcuggcccagcuguccagccccugcuccagcuccgacagccugugcucccggcgcggccucagcuccccgcggcugagccuggcccccgcggaggccuggaaggccaagaagaagcaggagcuccagcacgccaacuccagcccccugcugcgcggcucccacagccucgagcugcgggccugcgagcuggggaaccgcggcuccaagaaccucagccagucccccggggcggucccgcaggcccugguggccuggcgggcccugggccccaagcuccugagcagcuccaacgagcuggugacccgccaccucccccccgcgccgcuguucccccacgagacccccccgacgcagagccagcagacccagccccccgucgccccccaggccccguccagcauccugcuccccgccgcccccauccccauccuguccccgugcagcccccccuccccccaggcgagcucccugagcggcccgucccccgccagcucccggcucagcuccagcucccugagcucccugggggaggaccaggacagcgugcucacccccgaggagguggcccugugccuggagcucagcgagggcgaggagaccccccgcaacuccgucagcccgaugccccgcgcccccucccccccgacgaccuacggguacaucagcgugcccaccgccuccgaguucaccgacaugggccggacggggggcggcguggggcccaagggcgggguccugcugugccccccgcgccccugccucacccccacccccagcgagggcucccuggcgaacggguggggcagcgccuccgaggacaacgccgccagcgcccgggcgucccuggugagcuccagcgacggcuccuuccucgccgacgcccacuucgcccgcgcgcuggccguggccgucgacagcuucggguucggccuggagccgcgggaggccgacugcguguucaucgacgccuccagcccccccuccccgcgcgacgagaucuuccucacccccaaccugagccugccccucugggaguggcggcccgacuggcuggaggacauggaggugagccacacccagcgccuggggcggggcaugccgcccuggccccccgacucccagaucagcucccagcgcagccagcuccacugccggaugccgaaggcgggggccucccccgucgacuacagcuga

SEQ ID NO: 35826 - RNA, 4065 nt, Artificial Sequence
  derived and/or modified sequence opt1 from ROCK1__Homo_sapiens__NP_005397
augagcaccggcgacuccuucgagacccgcuucgagaagauggacaaccugcuccgggaccccaagagcgaggugaacuccgacugccugcuggacgggcucgacgcccuggucuacgaccuggacuucccggcccuccgcaagaacaagaacaucgacaacuuccugagccgguacaaggacacgaucaacaagauccgcgaccugcggaugaaggcggaggacuacgagguggugaaggucaucggccgcggggccuucggcgaggugcagcucgugcggcacaaguccacccgcaaggucuacgccaugaagcugcugagcaaguucgagaugaucaagcgguccgacagcgccuucuucugggaggagcgcgacaucauggccuucgcgaacucccccuggguggugcagcuguucuacgccuuccaggacgaccgguaccuguacauggucauggaguacaugcccgggggcgaccuggugaaccucaugagcaacuacgacgugcccgagaagugggcccgcuucuacaccgccgaggucgugcuggcgcuggacgccauccacuccaugggcuucauccaccgggacgugaagccggacaacaugcuccuggacaagagcgggcaccugaagcucgccgacuucgggaccugcaugaagaugaacaaggaggggaugguccgcugcgacacggccgugggcacccccgacuacaucucccccgaggugcucaagagccagggcggcgacggcuacuacgggcgggagugcgacuggugguccgucggcguguuccuguacgagaugcucgugggggacacccccuucuacgccgacagccuggucggcaccuacuccaagaucaugaaccacaagaacagccugacguucccggacgacaacgacaucuccaaggaggcgaagaaccucaucugcgccuuccugaccgaccgcgaggugcggcugggccgcaacgggguggaggagaucaagcggcaccucuucuucaagaacgaccagugggccugggagacccugcgcgacaccgucgcccccgugguccccgaccugagcagcgacaucgacacguccaacuucgacgaccucgaggaggacaagggcgaggaggagaccuuccccaucccgaaggccuucguggggaaccagcugcccuucgugggcuucaccuacuacagcaaccggcgcuaccuguccagcgcgaaccccaacgacaaccgcaccuccagcaacgccgacaagucccuccaggagagccugcagaagacgaucuacaagcuggaggagcagcuccacaacgagaugcagcugaaggacgagauggagcagaagugccggaccuccaacaucaagcuggacaagaucaugaaggagcucgacgaggaggggaaccagcgccggaaccuggagagcaccgucucccagaucgagaaggagaagaugcugcuccagcaccgcaucaacgaguaccagcggaaggccgagcaggagaacgagaagcgccggaacguggagaacgaggugagcacccugaaggaccagcuggaggaccucaagaaggucucccagaacagccagcuggccaacgagaagcugucccagcugcagaagcagcucgaggaggccaacgaccugcugcgcacggagagcgacaccgcggugcggcuccgcaagucccacaccgagaugagcaaguccaucagccagcuggagagccugaaccgggagcuccaggagcgcaaccggauccuggagaacuccaagagccagaccgacaaggacuacuaccagcugcaggccauccucgaggccgagcgccgggaccgcggccacgacuccgagaugaucggcgaccugcaggcccggaucacgagccugcaggaggaggugaagcaccucaagcacaaccuggagaaggucgagggggagcgcaaggaggcccaggacaugcugaaccacuccgagaaggagaagaacaaccucgagaucgaccugaacuacaagcucaagagccuccagcagcggcuggagcaggaggugaacgagcacaaggugaccaaggcgcgccugaccgacaagcaccaguccaucgaggaggccaagagcgucgccaugugcgagauggagaagaagcucaaggaggagcgcgaggcccgggagaaggcggagaaccgcguggugcagaucgagaagcagugcuccaugcuggacgucgaccugaagcagagccagcagaagcucgagcaccugaccggcaacaaggagcggauggaggacgaggugaagaaccugacgcuccagcuggagcaggaguccaacaagcgccugcuccugcagaacgagcugaagacccaggccuucgaggccgacaaccucaaggggcuggagaagcagaugaagcaggagaucaacacccugcucgaggccaagcggcugcuggaguucgagcucgcccagcugaccaagcaguaccgcggcaacgaggggcagaugcgggagcugcaggaccagcucgaggcggagcaguacuucagcacgcuguacaagacccaggugaaggagcugaaggaggagaucgaggagaagaaccgcgagaaccucaagaagauccaggagcugcagaacgagaaggagacccuggccacccagcucgaccuggccgagacgaaggccgaguccgagcagcuggcccggggccuccuggaggagcaguacuucgagcugacccaggagagcaagaaggcggccucccgcaaccggcaggagaucaccgacaaggaccacaccgucagccgccucgaggaggccaacuccaugcugaccaaggacaucgagauccugcggcgcgagaacgaggagcucacggagaagaugaagaaggccgaggaggaguacaagcuggagaaggaggaggagaucagcaaccugaaggccgcguucgagaagaacaucaacaccgagcggacccucaagacccaggccgugaacaagcuggccgagaucaugaaccgcaaggacuucaagaucgaccggaagaaggccaacacgcaggaccugcgcaagaaggagaaggagaaccggaagcuccagcuggagcugaaccaggagcgcgagaaguucaaccagaugguggucaagcaccagaaggagcucaacgacaugcaggcgcagcugguggaggagugcgcccaccggaacgagcugcagaugcagcucgccagcaaggaguccgacaucgagcagcugcgcgccaagcugcucgaccugagcgacuccaccagcguggccuccuuccccagcgcggacgagaccgacggcaaccugccggagucccgcaucgagggguggcucagcguccccaaccggggcaacaucaagcgcuacggguggaagaagcaguacgugguggucuccagcaagaagauccuguucuacaacgacgagcaggacaaggagcaguccaaccccagcauggugcuggacaucgacaagcuguuccacgugcggcccgucacccagggcgacguguaccgcgccgagacggaggagaucccgaagaucuuccagauccuguacgccaacgagggggagugccggaaggacguggagauggagcccguccagcaggccgagaagaccaacuuccagaaccacaagggccacgaguucauccccacccuguaccacuuccccgccaacugcgacgcgugcgccaagccgcucuggcacguguucaagcccccgcccgcccuggagugccgccggugccacgugaagugccaccgcgaccaccuggacaagaaggaggaccucaucugccccugcaaggucuccuacgacgugaccagcgcccgggacaugcugcugcucgccugcucccaggacgagcagaagaagugggugacgcaccuggucaagaagauccccaagaacccgcccagcggcuucgugcgcgcgagcccccggacccuguccacccgcuccaccgccaaccagagcuuccggaagguggucaagaacacgagcgggaagaccuccuga

SEQ ID NO: 35827 - RNA, 4167 nt, Artificial Sequence
  derived and/or modified sequence opt1 from ROCK2__Homo_sapiens__NP_004841
augagccggcccccgcccaccggcaagaugcccggggcccccgagaccgccccgggcgacggggcgggcgccucccggcagcgcaagcuggaggcccucauccgggacccccgcagccccaucaacguggagucccugcuggacgggcucaacagccugguccuggaccucgacuuccccgcccugcggaagaacaagaacaucgacaacuuccugaaccgcuacgagaagaucgugaagaagauccggggccuccagaugaaggccgaggacuacgacguggucaaggugaucggccgcggggcguucggcgaggugcagcugguccggcacaaggccucccagaagguguacgccaugaagcugcucagcaaguucgagaugaucaagcgcuccgacagcgccuucuucugggaggagcgggacaucauggcguucgccaacuccccgugggugguccagcuguucuacgccuuccaggacgaccgcuaccuguacauggugauggaguacaugcccgggggcgaccucgugaaccugaugagcaacuacgacguccccgagaagugggccaaguucuacacggccgagguggugcuggcgcucgacgccauccacuccauggggcugauccaccgggacgucaagcccgacaacaugcugcucgacaagcacggccaccugaagcuggccgacuucgggaccugcaugaagauggacgagaccgggauggugcacugcgacaccgccgugggcacgccggacuacaucagccccgagguccucaagucccagggcggcgacggcuucuacgggcgcgagugcgacugguggagcgugggcguguuccuguacgagaugcuggucggggacacccccuucuacgccgacucccucgugggcaccuacagcaagaucauggaccacaagaacucccugugcuuccccgaggacgcggagaucagcaagcacgccaagaaccugaucugcgccuuccucaccgaccgggaggugcgccuggggcggaacggcgucgaggagauccgccagcacccguucuucaagaacgaccaguggcacugggacaacauccgggagacggccgcccccgugguccccgagcuguccagcgacaucgacagcuccaacuucgacgacaucgaggacgacaagggcgacguggagaccuuccccaucccgaaggcguucguggggaaccagcuccccuucaucggcuucaccuacuaccgcgagaaccugcugcucagcgacucccccagcugccgggagaccgacuccauccagagccgcaagaacgaggagucccaggagauccagaagaagcuguacacgcuggaggagcaccucagcaacgagaugcaggccaaggaggagcuggagcagaagugcaaguccgucaacacccgccuggagaagaccgccaaggagcucgaggaggagaucacccugcgcaagagcguggaguccgcccugcgccagcucgagcgggagaaggcccugcugcagcacaagaacgcggaguaccagcgcaaggccgaccacgaggccgacaagaagcggaaccucgagaacgacgugaacagccugaaggaccagcuggaggaccugaagaagcgcaaccagaacucccagaucagcacggagaaggucaaccagcuccagcggcagcuggacgagaccaacgcccugcuccgcaccgaguccgacaccgcggcccggcugcgcaagacgcaggccgagagcuccaagcagauccagcagcuggagagcaacaaccgggaccuccaggacaagaacugccugcuggagaccgccaagcucaagcuggagaaggaguucaucaaccugcaguccgcccucgagagcgagcgccgggaccgcacccacgggagcgagaucaucaacgaccugcagggccggaucugcgggcuggaggaggaccucaagaacggcaagauccugcuggcgaagguggagcucgagaagcgccagcugcaggagcgguucaccgaccuggagaaggagaaguccaacauggagaucgacaugacguaccagcucaaggugauccagcagagccuggagcaggaggaggccgagcacaaggccaccaaggcccgccuggccgacaagaacaagaucuacgaguccaucgaggaggccaagagcgaggcgaugaaggagauggagaagaagcuccuggaggagcggacccugaagcagaaggucgagaaccuccugcuggaggccgagaagcgcugcucccuccuggacugcgaccugaagcagagccagcagaagaucaacgagcuccugaagcagaaggacgugcugaacgaggacgugcgcaaccucacccugaagaucgagcaggagacgcagaagcggugccugacccagaacgaccucaagaugcagacccagcaggucaacacccugaagauguccgagaagcagcugaagcaggagaacaaccaccucauggagaugaagaugaaccuggagaagcagaacgccgagcugcgcaaggagcggcaggacgccgacggccagaugaaggagcuccaggaccagcuggaggcggagcaguacuucagcacgcuguacaagacccaggugcgcgagcucaaggaggagugcgaggagaagaccaagcuggggaaggagcugcagcagaagaagcaggagcuccaggacgagcgggacucccuggccgcccagcuggagaucacccucacgaaggccgacagcgagcagcuggcgcgcuccaucgccgaggagcaguacagcgaccuggagaaggagaagaucaugaaggagcucgagaucaaggagaugauggcccggcacaagcaggagcugaccgagaaggacgccaccaucgccucccuggaggagaccaaccgcacccucacgagcgacguggcgaaccuggccaacgagaaggaggagcugaacaacaagcucaaggacguccaggagcagcugucccggcugaaggacgaggagaucagcgccgccgccaucaaggcgcaguucgagaagcagcuccugaccgagcgcacccugaagacccaggccgugaacaagcucgccgagaucaugaaccggaaggagcccgugaagcgcggcaacgacacggacguccggcgcaaggagaaggagaaccggaagcugcacauggagcugaaguccgagcgcgagaagcucacccagcagaugaucaaguaccagaaggagcugaacgagaugcaggcccagaucgccgaggagagccagauccggaucgagcugcagaugacccucgacagcaaggacuccgacaucgagcagcugcgcagccagcugcaggcgcuccacaucgggcuggacuccagcuccaucggcagcgggccgggcgacgccgaggccgacgacggcuuccccgagucccggcuggagggguggcucagccugcccgugcgcaacaacaccaagaaguucggcugggugaagaaguacgucaucguguccagcaagaagauccuguucuacgacuccgagcaggacaaggagcagagcaaccccuacauggugcucgacaucgacaagcuguuccacguccggccggugacgcagaccgacguguaccgcgccgacgcgaaggagaucccccgcaucuuccagauccuguacgccaacgagggggaguccaagaaggagcaggaguuccccgucgagccggugggcgagaaguccaacuacaucugccacaagggccacgaguucauccccacccucuaccacuuccccaccaacugcgaggccugcaugaagccccuguggcacauguucaagccgccgcccgcccuggagugccggcgcugccacaucaagugccacaaggaccacauggacaagaaggaggagaucaucgcccccugcaagguguacuacgacaucuccacggcgaagaaccuccugcugcucgccaacagcaccgaggagcagcagaagugggucucccggcuggugaagaagauccccaagaagccgcccgcccccgaccccuucgcccgcagcagcccccggaccagcaugaagauccagcagaaccagagcauccgccggcccucccgccagcuggcccccaacaagccgagcuga

SEQ ID NO: 35828 - RNA, 864 nt, Artificial Sequence
  derived and/or modified sequence opt1 from ROGDI__Homo_sapiens__NP_078865
auggccaccgugauggccgcgaccgccgccgagcgcgccguccuggaggaggaguuccgguggcuccugcacgacgaggugcacgccgugcugaagcagcuccaggacauccugaaggaggcgagccugcgcuucacgcuccccggcuccgggaccgagggcccggccaagcaggagaacuucauccuggggagcugcggcaccgaccaggucaagggggugcugacccuccagggcgacgcccugucccaggccgacgugaaccugaagaugccccggaacaaccagcuccugcacuucgcguuccgcgaggacaagcaguggaagcugcagcagauccaggacgcccggaaccacgucagccaggccaucuaccuccugacgucccgcgaccagagcuaccaguucaagaccggcgccgaggugcugaagcucauggacgccgugaugcugcagcugacccgggcgcgcaaccggcucaccacgcccgccacccugacccugcccgagaucgccgccuccgggcucacccgcauguucgccccggcgcugcccagcgaccugcucgucaacguguacaucaaccugaacaagcugugccucacgguguaccagcugcacgcccugcagcccaacuccaccaagaacuuccggcccgccggcggggccguccuccacagcccgggcgccauguucgagugggggucccagcgccuggaggugagccacgugcacaaggucgagugcgugauccccuggcugaacgacgcgcucguguacuucaccgucucccugcagcugugccagcagcucaaggacaagaucagcguguucuccagcuacugguccuaccggcccuucuga

SEQ ID NO: 35829 - RNA, 1056 nt, Artificial Sequence
  derived and/or modified sequence opt1 from ROM1__Homo_sapiens__NP_000318
auggcccccgugcugccccucguccugccccugcagccccgcauccggcucgcccagggccuguggcugcucagcuggcugcuggcgcucgccgggggcgugauccugcugugcuccgggcaccuccuggugcagcugcgccaccucggcaccuuccuggcccccagcugccaguucccgguccugccccaggccgcccucgcggccggggccguggcccugggcaccggccuggugggggucggcgcgucccgggccagccucaacgccgcccuguacccgcccuggcgcggggugcugggcccccuccugguggccgggacggcgggcggcgggggccugcucgucguggcccuggggcuggcccucgcccugcccggcucccuggacgaggcccucgaggagggccuggugaccgcgcuggcccacuacaaggacaccgagguccccgggcacugccaggccaagcggcucguggacgagcugcagcugcgcuaccacugcugcggccggcacggguacaaggacugguucggcgugcagugggucagcucccgcuaccucgaccccggggaccgggacguggccgaccgcauccagagcaacguggagggccuguaccugaccgacggcgucccguucuccugcugcaacccccacagcccccggcccugccuccagaaccgccuguccgacagcuacgcccacccgcuguucgacccccggcagcccaaccagaaccucugggcgcaggggugccacgaggugcugcuggagcaccuccaggaccuggccggcacgcugggguccaugcuggccgugaccuuccuccugcaggcccugguccuccugggccugcgcuaccuccagaccgcccuggaggggcugggcggcgugaucgacgccgggggcgagacccagggguaccucuuccccagcggccugaaggacaugcugaagacggcguggcuccagggcgggguggccugccggccggcccccgaggaggcgccgcccggcgaggccccgcccaaggaggaccuguccgaggccuga

SEQ ID NO: 35830 - RNA, 363 nt, Artificial Sequence
  derived and/or modified sequence opt1 from ROPN1B__Homo_sapiens__XP_005247195
auguggaagguggucaaccugcccaccgaccucuucaacagcgugaugaacgugggccgcuucaccgaggagaucgaguggcugaaguuccuggcccucgccugcuccgcgcugggggucacgaucaccaagacccugaagaucgugugcgaggugcucagcugcgaccacaacggcgggcugccgcggauccccuucuccaccuuccaguuccuguacacguacaucgccgaggucgacggcgagaucugcgccagccacgugucccgcaugcucaacuacaucgagcaggaggugaucgggcccgacggccugaucaccgucaacgacuucacccagaacccccggguguggcuggaguga

SEQ ID NO: 35831 - RNA, 441 nt, Artificial Sequence
  derived and/or modified sequence opt1 from ROPN1__Homo_sapiens__XP_011511238
auggcccagaccgacaagcccacgugcaucccgcccgagcugcccaagaugcucaaggaguucgccaaggcggccauccgcgugcagccccaggaccugauccagugggccgccgacuacuucgaggcccugagccggggcgagaccccgcccguccgcgagcgguccgagcgcguggcgcucugcaaccgggccgagcugacccccgagcugcucaagauccugcacagccagguggccgggcgccugaucauccgggccgaggagcucgcgcagauguggaaggucgugaaccugcccaccgaccuguucaacuccgugaugaacgucggccgcuucaccgaggagaucgaguggcucaaguuccuggcccuggccugcagcgcccucggggugcggcagccgcgcgccgacugccggaagcgccugcccgacacguga

SEQ ID NO: 35832 - RNA, 693 nt, Artificial Sequence
  derived and/or modified sequence opt1 from ROPN1L__Homo_sapiens__NP_114122
augccccugccggacaccauguucugcgcccagcagauccacaucccgcccgagcuccccgacauccugaagcaguucaccaaggccgcgauccgcacgcagcccgccgacgugcugcgguggagcgccggcuacuucuccgcccucagccgcggggacccccugcccgucaaggaccggauggagaugcccaccgccacccagaagaccgacacgggccugacccaggggcuccugaaggugcugcacaagcagugccaccacaagcgcuacguggagcucaccgaccuggagcagaaguggaagaaccugugccucccgaaggagaaguucaaggcgcugcugcagcucgaccccugcgagaacaagaucaaguggaucaacuuccuggcccugggcugcuccaugcucgggggcagccugaacaccgcccugaagcaccucugcgagauccugacggacgaccccgagggcgggcccgcccggaucccguucaagaccuucuccuacgucuaccgcuaccuggcgcggcucgacagcgacgugagcccccuggagaccgaguccuaccuggccucccucaaggagaacaucgacgcccgcaagaacggcaugaucgggcugagcgacuucuucuuccccaagcggaagcugcucgaguccaucgagaacagcgaggacgugggccacuga

SEQ ID NO: 35833 - RNA, 2625 nt, Artificial Sequence
  derived and/or modified sequence opt1 from ROR1__Homo_sapiens__XP_011539828
augaacaacaucaccaccagccugggccagacggccgagcuccacugcaagguguccgggaacccgccgcccaccauccgcugguucaagaacgacgcccccgucgugcaggagccccggcgccugagcuuccgguccaccaucuacggcagccgccugcggauccgcaaccucgacaccacggacaccggguacuuccagugcguggcgaccaacggcaaggaggucguguccagcaccggggugcuguucgucaaguucggcccgccgcccacggccucccccggcuacagcgacgaguacgaggaggacggguucugccagcccuaccggggcaucgccugcgcccgcuucaucgggaaccggaccguguacauggagucccugcacaugcagggcgagaucgagaaccagaucaccgccgcguucaccaugaucgggacgagcucccaccucagcgacaagugcucccaguucgccauccccagccugugccacuacgccuuccccuacugcgacgagaccuccagcgugcccaagccgcgcgaccugugccgggacgagugcgagauccucgagaacguccugugccagaccgaguacaucuucgcccgcuccaaccccaugauccugaugcggcucaagcugcccaacugcgaggaccugccccagccggagagccccgaggcggccaacugcauccgcaucggcauccccauggccgaccccaucaacaagaaccacaagugcuacaacuccaccggcguggacuaccgggggacggugagcgucaccaagagcggccgccagugccagccguggaacucccaguacccccacacccacaccuucacggcccuccgguuccccgagcugaacgggggccacagcuacugccgcaaccccggcaaccagaaggaggcccccuggugcuucacccuggacgagaacuucaaguccgaccucugcgacauccccgcgugcgacagcaaggacuccaaggagaagaacaagauggagauccuguacauccuggugcccagcguggccaucccccucgccaucgcccugcuguucuucuucaucugcgucugccggaacaaccagaaguccagcuccgccccggugcagcgccagcccaagcacgugcgggggcagaacgucgagaugagcaugcucaacgcguacaagcccaaguccaaggccaaggagcugccgcugagcgccgugcgcuucauggaggagcucggcgagugcgccuucgggaagaucuacaagggccaccuguaccugcccgggauggaccacgcccagcucguggcgaucaagacccugaaggacuacaacaacccccagcaguggaccgaguuccagcaggaggccucccugauggccgagcuccaccaccccaacaucgucugccugcugggcgccgugacgcaggagcagccggugugcaugcuguucgaguacaucaaccagggcgaccuccacgaguuccugaucaugcgcagcccccacuccgacgucgggugcagcuccgacgaggacggcaccgucaagagcucccucgaccacggggacuuccugcacaucgccauccagaucgcggccggcauggaguaccugagcagccacuucuucgugcacaaggaccucgccgcccggaacauccugaucggggagcagcugcacgugaagaucuccgaccucggccugagccgcgagaucuacuccgcggacuacuaccgggugcagagcaagucccugcuccccauccgcuggaugcccccggaggccaucauguacggcaaguucagcuccgacagcgacaucugguccuucggggucgugcugugggagaucuucagcuucggccugcagcccuacuacggguucuccaaccaggaggugaucgagaugguccggaagcgccagcugcuccccugcagcgaggacugcccgccccggauguacucccugaugaccgagugcuggaacgagauccccagccgccggccccgcuucaaggacauccacgugcggcugcgcuccugggagggccucagcucccacaccagcagcacgacccccuccgggggcaacgccaccacccagacgaccagccuguccgccagcccgguguccaaccugagcaacccccgguaccccaacuacauguuccccucccagggcaucaccccgcaggggcagaucgccggcuucaucgggccgcccaucccccagaaccagcgcuucauccccaucaacggcuaccccaucccgcccggcuacgcggccuuccccgccgcccacuaccagcccaccgggcccccgcgggucauccagcacugcccgccgcccaagagccgcucccccagcuccgccagcggcuccacgagcaccgggcacgugaccucccuccccagcuccggcagcaaccaggaggcgaacaucccccugcugccccacauguccauccccaaccaccccgggggcaugggcaucaccguguucgggaacaagagccagaagcccuacaagaucgacagcaagcaggccucccuccugggcgacgccaacauccacgggcacaccgagagcaugaucuccgccgagcuguga

SEQ ID NO: 35834 - RNA, 2832 nt, Artificial Sequence
  derived and/or modified sequence opt1 from ROR2__Homo_sapiens__NP_004551
auggcccgcggcagcgcccugccccggcgcccgcuccugugcauccccgcggugugggccgccgccgcccugcuccuguccgucagccggaccuccggggagguggaggugcuggaccccaacgacccccucggcccgcuggacgggcaggacggccccauccccacccugaagggguacuuccucaacuuccuggagcccgucaacaacaucacgaucgugcagggccagaccgcgauccugcacugcaagguggccggcaacccgccgcccaacguccgcuggcucaagaacgacgcccccguggugcaggagccccggcgcaucaucauccggaagaccgaguacgggagccgccugcggauccaggaccuggacaccacggacaccggcuacuaccagugcgucgccaccaacgggaugaagaccaucacggcgaccggcgugcuguucgugcgccuggggcccacccacucccccaaccacaacuuccaggacgacuaccacgaggacggcuucugccagcccuaccggggcaucgccugcgcccgcuucaucgggaaccggaccaucuacgucgacagccugcagaugcagggcgagaucgagaaccgcaucacggccgccuucaccaugaucgggaccuccacccaccucagcgaccagugcucccaguucgcgaucccgagcuucugccacuucguguucccccugugcgacgcccggucccgcacgcccaagccccgggagcugugccgcgacgagugcgaggugcucgagagcgaccugugccggcaggaguacaccaucgcccgcuccaacccgcugauccucaugcggcugcagcugcccaagugcgaggcccuccccaugcccgagagcccggacgccgcgaacugcaugcgcaucggcauccccgccgagcgccugggccgguaccaccagugcuacaacggguccggcauggacuaccgcgggaccgccagcaccacgaaguccggccaccagugccagcccugggcccugcagcacccccacagccaccaccucuccagcaccgacuucccggagcucgggggcggccacgccuacugccggaaccccgggggccagauggaggggcccuggugcuucacccagaacaagaacguccgcauggagcugugcgacgugccgagcugcagcccccgggacuccuccaagaugggcauccucuacauccuggugcccagcaucgcgaucccccuggucaucgccugccucuucuuccuggugugcaugugccgcaacaagcagaaggccuccgccagcaccccgcagcggcgccagcugauggccucccccagccaggacauggagaugccccucaucaaccagcacaagcaggcgaagcugaaggagaucucccugagcgccgugcgguucauggaggagcucggggaggaccgcuucggcaaggucuacaagggccaccuguucgggcccgccccgggcgagcagacgcaggccguggcgaucaagacccugaaggacaaggccgaggggccccuccgggaggaguuccgccacgaggccaugcugcgggcccgccugcagcaccccaacguggucugccuccugggcguggucaccaaggaccagccccuguccaugaucuucagcuacugcucccacggggaccugcacgaguuccucgugaugcggagcccgcacuccgacgugggcagcaccgacgacgaccgcacggucaaguccgcccuggagccgcccgacuucgugcaccugguggcgcagaucgccgccggcauggaguaccucagcucccaccacgucgugcacaaggaccuggccacccggaacgugcuggucuacgacaagcucaacgugaagaucagcgaccuggggcuguuccgcgagguguacgccgcggacuacuacaagcuccugggcaacagccugcuccccauccgguggauggcccccgaggccaucauguacgggaaguucuccaucgacagcgacaucugguccuacggcgucgugcugugggagguguucagcuacggccugcagcccuacugcggguacuccaaccaggacgucguggagaugauccgcaaccgccaggugcuccccugccccgacgacugcccggccugggucuacgcccugaugaucgagugcuggaacgaguuccccagccggcgcccccgguucaaggacauccacucccgccugcgggcguggggcaaccucagcaacuacaacuccagcgcccagaccuccggggccagcaacaccacgcagaccuccagccuguccaccagccccguguccaacgugagcaacgcccgcuacgucggcccgaagcagaaggcgccgcccuucccccagccccaguucauccccaugaaggggcagauccggcccauggugccgccgccccagcuguacgugcccgucaacggcuaccagcccgugcccgccuacggcgccuaccuccccaacuucuaccccgugcagaucccgaugcagauggcgccccagcaggucccgccccagauggugcccaagcccagcucccaccacagcggguccggcagcaccuccacgggguacgugaccaccgcccccagcaacaccuccauggccgaccgcgccgcccugcugagcgagggcgccgacgacacccagaacgcccccgaggacggggcgcaguccacgguccaggaggccgaggaggaggaggagggcagcgugccggagaccgagcuccugggcgacugcgacacccuccagguggacgaggcccagguccagcuggaggccuga

SEQ ID NO: 35835 - RNA, 1647 nt, Artificial Sequence
  derived and/or modified sequence opt1 from RORA__Homo_sapiens__NP_002934
augaacgagggcgcccccggggacagcgaccuggagaccgaggcccgcgugccgugguccaucaugggccacugccuccggaccgggcaggcgcgcaugagcgccacgcccacccccgccggcgagggggcccgguccagcuccaccugcagcucccugagccgccuguucuggucccagcucgagcacaucaacugggacggcgccaccgcgaagaacuucaucaaccugcgggaguucuucagcuuccugcuccccgcccugcgcaaggcccagaucgagaucaucccgugcaagaucugcggcgacaaguccagcgggauccacuacggcgucaucacgugcgaggggugcaagggcuucuuccggcgcucccagcagagcaacgccaccuacuccugcccccggcagaagaacugccugaucgaccgcaccagccggaaccgcugccagcacugccggcuccagaagugccuggcgguggggaugucccgcgacgccgugaaguucggccggaugagcaagaagcagcgcgacucccuguacgccgagguccagaagcaccggaugcagcagcagcagcgcgaccaccagcagcagcccggcgaggccgagccccucaccccgacguacaacaucagcgccaacgggcugaccgagcugcacgacgaccucagcaacuacaucgacggccacacccccgagggguccaaggcggacagcgccguguccagcuucuaccuggacauccagcccucccccgaccagagcggccuggacaucaacggcaucaagccggagcccaucugcgacuacacccccgccuccggguucuuccccuacugcagcuucacgaacggcgagaccuccccgaccgugagcauggccgagcucgagcaccuggcccagaacaucuccaagagccaccuggagaccugccaguaccuccgggaggagcugcagcagaucacguggcagaccuuccugcaggaggagaucgagaacuaccagaacaagcagcgcgaggucauguggcagcucugcgcgaucaagaucaccgaggccauccaguacgugguggaguucgccaagcggaucgacggguucauggagcugugccagaacgaccagaucguccugcucaaggccggcucccuggaggugguguucauccgcaugugccgcgccuucgacagccagaacaacaccgucuacuucgacgggaaguacgcgucccccgacguguucaagagccugggcugcgaggacuucaucuccuucguguucgaguucggcaagagccucugcuccaugcaccugacggaggacgagaucgcccuguucagcgccuucguccucaugagcgccgaccgguccuggcugcaggagaaggugaagaucgagaagcugcagcagaagauccagcucgcccugcagcacgugcugcagaagaaccaccgcgaggacgggauccucaccaagcugaucugcaaggucagcacccugcgggcgcucugcggccgccacaccgagaagcugauggccuucaaggccaucuaccccgacaucgugcggcugcacuuccccccgcucuacaaggagcuguucacguccgaguucgagcccgccaugcagaucgacggguga

SEQ ID NO: 35836 - RNA, 1380 nt, Artificial Sequence
  derived and/or modified sequence opt1 from RORB__Homo_sapiens__NP_008845
augcgcgcccagaucgaggugauccccugcaagaucugcggcgacaagagcuccgggauccacuacggcgucaucacgugcgaggggugcaagggcuucuuccggcgcagccagcagaacaacgccuccuacagcugcccgcggcagcgcaacugccugaucgaccggaccaaccgcaaccggugccagcacugccgccuccagaagugccuggcgcuggggaugucccgggacgccgugaaguucggccgcaugagcaagaagcagcgggacucccucuacgccgaggugcagaagcaccagcagcgccugcaggagcagcggcagcagcagagcggcgaggccgaggcccuggcgcgcgucuacuccagcuccaucagcaacgggcucuccaaccugaacaacgagaccagcggcaccuacgccaacgggcacgugaucgaccugcccaaguccgagggcuacuacaacguggacagcgggcagcccucccccgaccagagcggccucgacaugaccggcaucaagcagaucaagcaggagccgaucuacgaccugaccuccguccccaaccuguucacguacagcagcuucaacaacgggcagcucgcccccggcaucaccaugaccgagaucgaccggaucgcccagaacaucaucaagucccaccuggagaccugccaguacacgauggaggagcugcaccagcucgcguggcagacccacaccuacgaggagaucaaggccuaccagagcaagucccgcgaggcccuguggcagcagugcgccauccagaucacccacgccauccaguacgugguggaguucgcgaagcggaucacgggguucauggagcugugccagaacgaccagauccuccugcucaagagcggcugccucgaggucgugcuggugcgcaugugccgggccuucaacccccugaacaacaccguccucuucgagggcaaguacgggggcaugcagauguucaaggcccugggguccgacgaccuggugaacgaggccuucgacuucgccaagaaccucugcagccugcagcugaccgaggaggagaucgcccucuucuccagcgcggugcugaucuccccggaccgcgccuggcugaucgagccccggaagguccagaagcuccaggagaagaucuacuucgcccugcagcacgugauccagaagaaccaccuggacgacgagacccucgccaagcugaucgcgaagauccccacgaucaccgccgugugcaaccugcacggcgagaagcuccaggucuucaagcagagccaccccgagaucgugaacacccuguucccgccccuguacaaggagcuguucaaccccgacugcgccaccgggugcaaguga

SEQ ID NO: 35837 - RNA, 1494 nt, Artificial Sequence
  derived and/or modified sequence opt1 from RORC__Homo_sapiens__NP_001001523
augcgcacccagaucgaggugauccccugcaagaucugcggcgacaagagcuccgggauccacuacggcgucaucacgugcgaggggugcaagggcuucuuccggcgcagccagcggugcaacgccgccuacuccugcacccgccagcagaacugcccgaucgaccggaccagccgcaaccggugccagcacugccgccugcagaagugccucgcgcuggggaugucccgggacgccgugaaguucggccgcaugagcaagaagcagcgggacucccugcacgccgaggugcagaagcagcuccagcagcgccagcagcagcagcaggagcccgucgugaagaccccgcccgccggcgcccagggggcggacacccugacguacacccugggccuccccgacgggcagcugccccugggcagcucccccgaccuccccgaggccagcgccugcccgcccgggcugcugaaggccuccggcagcggccccuccuacagcaacaaccucgcgaaggccgggcugaacggcgccuccugccaccuggaguacagccccgagcgggggaaggccgagggccgcgaguccuucuacagcaccggcucccagcucaccccggaccggugcgggcugcgcuucgaggagcaccggcaccccggccugggggagcucggccaggggcccgacagcuacggcagccccuccuuccgcagcacgccggaggcccccuacgcgucccugaccgagaucgagcaccuggugcagagcgucugcaaguccuaccgggagaccugccagcuccgccuggaggaccugcuccggcagcgcagcaacaucuucucccgcgaggaggugaccggcuaccagcgcaagagcaugugggagaugugggagcggugcgcccaccaccugacggaggccauccaguacguggucgaguucgccaagcggcuguccggguucauggagcucugccagaacgaccagaucgugcugcugaaggccggcgcgauggaggugguccucgugcgcaugugccgggccuacaacgccgacaaccgcaccguguucuucgaggggaaguacggcgggauggagcuguuccgggcccugggcugcagcgagcucaucuccagcaucuucgacuucucccacagccuguccgcccugcacuucagcgaggacgagaucgcgcucuacaccgcccugguccugaucaacgcccaccgccccggccuccaggagaagcggaagguggagcagcugcaguacaaccuggagcucgccuuccaccaccaccugugcaagacccaccgccaguccauccuggccaagcugcccccgaaggggaagcugcggagccugugcucccagcacguggagcgccuccagaucuuccagcaccuccaccccaucgucgugcaggcggccuucccgccccuguacaaggagcuguucagcacggagaccgagagccccgugggccucuccaaguga

SEQ ID NO: 35838 - RNA, 7044 nt, Artificial Sequence
  derived and/or modified sequence opt1 from ROS1__Homo_sapiens__NP_002935
augaagaacaucuacugccugauccccaagcucgugaacuucgccacccugggcugccuguggaucagcguggugcagugcaccgugcucaacagcugccucaagagcugcgugaccaaccuggggcagcagcucgaccugggcacgccccacaaccugagcgagcccugcauccaggggugccacuucuggaacagcguggaccagaagaacugcgcccucaagugccgggagagcugcgaggugggcugcagcagcgcggagggggccuacgaggaggagguccuggagaacgccgaccugcccaccgcccccuucgccagcuccaucggcagccacaacaugacccuccgguggaaguccgcgaacuucagcggcgugaaguacaucauccaguggaaguacgcccagcugcugggguccuggacguacaccaagaccgugagccgcccguccuacgucgugaagccccuccaccccuucaccgaguacaucuuccggguggucuggaucuucacggcccagcugcagcuguacuccccgcccucccccagcuaccgcacccacccccacggcgugcccgagaccgccccgcucauccggaacaucgaguccagcagccccgacaccguggaggucuccugggacccgccccaguuccccggcgggcccauccugggguacaaccugcgccucaucagcaagaaccagaagcuggacgcgggcacgcagcggaccuccuuccaguucuacagcacccugcccaacaccaucuaccgcuucuccaucgccgccgugaacgaggugggcgaggggcccgaggccgagagcuccaucacgaccagcuccagcgccguccagcaggaggagcaguggcuguuccugucccggaagaccagccugcgcaagcggucccucaagcaccugguggacgaggcgcacugccugcgccucgacgccaucuaccacaacaucaccggcaucagcguggacguccaccagcagaucguguacuucuccgaggggacgcugaucugggccaagaaggccgccaacaugagcgacguguccgaccugcggaucuucuaccgcggcagcggccucaucuccagcaucagcaucgacuggcuguaccagcggauguacuucaucauggacgagcuggucugcgugugcgaccucgagaacugcuccaacaucgaggagaucaccccgcccagcaucuccgcgccccagaagaucgucgccgacagcuacaacggguacguguucuaccugcugcgcgacggcaucuaccgggccgaccuccccgugccguccgggcgcugcgccgaggccguccggaucguggagagcugcacccugaaggacuucgcgaucaagccccaggccaagcgcaucaucuacuucaacgacaccgcccagguguucauguccacguuccuggacggcagcgccucccaccucauccugccccggauccccuucgccgacgucaagagcuucgcgugcgagaacaacgacuuccuggugaccgacgggaaggugaucuuccagcaggacgcccucuccuucaacgaguucaucgucggcugcgaccugagccacaucgaggaguucggcuucgggaaccuggugaucuucggcuccagcucccagcuccacccgcugcccgggcgcccccaggagcugagcgugcuguucggcucccaccaggcccucguccaguggaagccgcccgcccuggcgaucggggccaacgugauccugaucagcgacaucaucgagcuguucgagcugggccccagcgccuggcagaacuggaccuacgaggugaaggucuccacccaggacccgcccgaggugacgcacaucuuccugaacaucagcggcaccaugcucaacgugcccgagcugcaguccgccaugaaguacaaggucagcgugcgcgccuccagccccaagcggcccgggccgugguccgagcccagcgugggcaccacccugguccccgcguccgagcccccguucaucauggccgugaaggaggacgggcucuggagcaagccccugaacuccuucggccccggggaguuccugagcuccgacaucggcaacgugagcgacauggacugguacaacaacucccucuacuacagcgacacgaagggcgacgucuucguguggcugcugaacgggaccgacaucuccgagaacuaccaccuccccagcaucgccggcgccggggcccuggcguucgaguggcugggccacuuccucuacugggccggcaagaccuacgugauccagcgccaguccguccugaccgggcacacggacaucgugacccacgugaagcugcucgucaacgacauggugguggacagcgucggcggguaccuguacuggaccacccuguacagcguggaguccacccggcucaacggcgagagcucccuggugcugcagacccagcccugguucagcgggaagaaggucaucgcccucacccuggaccuguccgacggccuccuguacuggcuggugcaggacagccagugcauccaccucuacaccgccgugcugcgcggccaguccaccggggacacgaccaucaccgaguucgccgcguggagcaccuccgagaucagccagaacgcccugauguacuacuccggccgccuguucuggaucaacggguuccgcaucaucacgacccaggagaucggccagaagaccagcgucuccgugcuggagcccgcccgguucaaccaguucaccaucauccagacgagccugaagccccuccccgggaacuucuccuucaccccgaaggugauccccgacagcguccaggaguccagcuuccgcaucgagggcaacgccuccagcuuccagauccuguggaacgggccgcccgcgguggacuggggcguggucuucuacagcguggaguucuccgcccacagcaaguuccuggccuccgagcagcacagccucccgguguucaccgucgagggccuggagcccuacgcccuguucaaccucuccgugacccccuacacguacugggggaagggcccgaagaccagccugucccugcgggcccccgagaccgugcccagcgcgcccgagaacccgcgcaucuucauccuccccuccgggaagugcugcaacaagaacgaggucguggucgaguuccgguggaacaagcccaagcacgagaacggcgugcugaccaaguucgagaucuucuacaacaucagcaaccaguccaucacgaacaagaccugcgaggacuggaucgccgugaacgucacccccagcgugauguccuuccagcuggagggcaugagcccgcgcugcuucaucgccuuccaggugcgggccuucaccuccaaggggcccggccccuacgccgacgucgucaagagcacgaccuccgagaucaaccccuucccgcaccucaucacccugcuggggaacaagaucguguuccucgacauggaccagaaccaggucguguggaccuucagcgcggagcgcgugaucuccgccgucugcuacacggccgacaacgagaugggcuacuacgccgagggggacagccuguuccugcuccaccuccacaaccggagcuccagcgagcuguuccaggacucccucguguucgacaucaccgugaucaccaucgacuggaucagccgccaccuguacuucgcccugaaggagucccagaacggcaugcaggucuucgacguggaccucgagcacaaggugaaguacccccgggaggucaagauccacaaccgcaacagcaccaucaucuccuucagcguguacccccugcugucccggcucuacuggacggaggugagcaacuucggcuaccagauguucuacuacuccaucaucagccacacccugcaccgcauccugcagcccaccgcgaccaaccagcagaacaagcgcaaccagugcuccugcaacgucacggaguucgagcucagcggggccauggccaucgacaccuccaaccuggagaagccgcugaucuacuucgccaaggcgcaggagaucugggccauggaccucgagggcugccagugcuggcgggugaucaccgugcccgccaugcuggccgggaagacccuggucagccucaccguggacggcgaccugaucuacuggaucaucacggccaaggacuccacccagaucuaccaggcgaagaagggcaacggggccaucgugagccaggucaaggcccugcgcucccggcacauccucgccuacagcagcgugaugcagcccuuccccgacaaggccuuccugucccuggcgagcgacaccguggagccgaccauccucaacgccacgaacaccucccugaccauccgccugccccucgccaagaccaaccugacgugguacggcaucaccagccccacccccaccuaccuggucuacuacgccgaggugaacgaccggaagaacuccagcgaccucaaguaccgcauccuggaguuccaggacuccaucgcccugaucgaggaccuccagccguucagcacguacaugauccagaucgcggugaagaacuacuacuccgacccccuggagcaccucccgcccgggaaggagaucuggggcaagaccaagaacggggucccggaggccgugcagcucaucaacaccaccgugcggagcgacacgucccugaucaucagcuggcgcgagucccacaagcccaacggccccaaggagagcguccgguaccagcuggccaucucccaccuggcccucaucccggagacgccccugcgccagagcgaguuccccaacggccggcugacccuccuggugacccgccuguccgggggcaacaucuacgugcucaagguccuggccugccacagcgaggagauguggugcacggagucccaccccgugaccguggagauguucaacaccccggagaagcccuacagccugguccccgagaacaccagccuccaguucaacuggaaggcgccccugaacgugaaccugauccgguucuggguggagcuccagaaguggaaguacaacgaguucuaccacgucaagacguccugcagccaggggccggccuacgugugcaacaucaccaaccugcagcccuacaccuccuacaacgugcgcgucgugguggucuacaagaccggcgagaacagcacgucccugcccgagagcuucaagaccaaggccggggugcccaacaagccgggcauccccaagcuccuggagggcuccaagaacagcauccagugggagaaggccgaggacaacgggugccggaucaccuacuacauccuggagauccgcaaguccaccagcaacaaccuccagaaccagaaccugcgguggaagaugacguucaacggcuccugcagcuccgucugcaccuggaaguccaagaaccugaaggggaucuuccaguuccgcgugguggcggccaacaaccucggcuucggggaguacuccggcaucagcgagaacaucauccuggucggcgacgacuucuggauccccgagaccuccuucauccugaccaucaucguggggaucuuccucguggucacgaucccccugaccuucguguggcaccggcgccugaagaaccagaaguccgccaaggagggcgugaccguccucaucaacgaggacaaggagcuggccgagcugcgggggcucgccgcgggcgugggccuggccaacgccugcuacgccauccacacccugccgacccaggaggagaucgagaaccuccccgccuucccccgcgagaagcugacgcugcgccuccugcuggggagcggcgcguucggggagguguacgagggcaccgccgucgacauccucggggugggcuccggcgagaucaagguggccgucaagacccugaagaaggggagcaccgaccaggagaagaucgaguuccugaaggaggcccaccucauguccaaguucaaccaccccaacauccugaagcagcugggcgugugccuccugaacgagccgcaguacaucauccuggagcucauggagggcggggaccugcugacguaccuccggaaggcccgcauggcgaccuucuacgggccccugcugacccucguggaccuggucgaccugugcguggacaucagcaagggcugcguguaccucgagcggaugcacuucauccaccgcgaccuggccgcccggaacugccuggucuccgugaaggacuacaccagcccccgcaucgugaagaucggcgacuucgggcucgcccgggacaucuacaagaacgacuacuaccgcaagcggggcgaggggcugcugcccguccgcuggauggcgccggagucccucauggacggcaucuucacgacccagagcgacgugugguccuucgggauccugaucugggagauccugacccucggccaccagcccuaccccgcccacagcaaccuggacgugcugaacuacguccagaccggcgggcggcucgagcccccgcgcaacugccccgacgaccuguggaaccugaugacgcagugcugggcccaggagcccgaccagcggccgaccuuccaccgcauccaggaccagcuccagcuguuccggaacuucuuccugaacuccaucuacaagagccgcgacgaggccaacaacuccggcgugaucaacgagagcuucgagggggaggacggcgacgugaucugccucaacuccgacgacaucaugcccgucgcccugauggagaccaagaaccgggaggggcugaacuacauggugcucgcgaccgagugcggccagggcgaggagaaguccgaggggccccugggcucccaggagagcgaguccugcgggcugcgcaaggaggagaaggagccccacgccgacaaggacuucugccaggagaagcaggucgccuacugcccgagcggcaagcccgagggccucaacuacgccugccugacgcacagcggguacggcgacggguccgacuga

SEQ ID NO: 35839 - RNA, 6471 nt, Artificial Sequence
  derived and/or modified sequence opt1 from RP1__Homo_sapiens__NP_006260
augagcgacacccccuccaccggcuucagcaucauccacccgacguccagcgaggggcaggugccccccccccgccaccugucccucacccacccggucguggccaagcggaucagcuucuacaaguccggcgacccccaguucgggggcgugcgcgucguggugaacccccggagcuucaaguccuucgacgcccugcuggacaaccucagccgcaaggucccccugccguucggggugcggaacaucuccaccccccgcggccggcacagcaucacccgccuggaggagcucgaggacggcgaguccuaccugugcagccacgggcggaaggugcagcccgucgaccuggacaaggcgcgccggcgcccccggccguggcucuccagccgcgccaucuccgcccacagccccccccaccccguggccguggccgcgccgggcaugccccggcccccccgcucccuggucguguuccggaacggggacccgaagacgcgccgggccgugcugcucagccgccgggucacccagagcuucgaggccuuccugcagcaccugaccgaggugaugcagcgccccguggucaagcucuacgccaccgacggccgccgggugcccucccugcaggcggugauccugagcuccggggccgucguggccgccggccgcgagcccuucaagccgggcaacuacgacauccagaaguaccuccugcccgcccggcugcccgggaucagccagcgcguguaccccaagggcaacgcgaaguccgagagccggaagaucuccacgcacaugagcuccagcucccgcagccagaucuacuccgucagcuccgagaagacccacaacaacgacugcuaccucgacuacagcuucgugccggagaaguaccuggcccuggagaagaacgacucccagaaccuccccaucuaccccagcgaggacgacaucgagaaguccaucaucuucaaccaggacgggaccaugaccgucgagaugaaggugcgguuccgcaucaaggaggaggagacgaucaaguggaccaccaccgugagcaagacgggcccgagcaacaacgacgagaaguccgagaugagcuuccccggccggaccgagucccgcagcuccgggcugaagcuggccgccugcagcuucuccgccgacgucagccccauggagcgguccagcaaccaggagggcucccucgcggaggagaucaacauccagaugaccgaccagguggccgagaccugcagcuccgccagcugggagaacgccacgguggacaccgacaucauccaggggacccaggaccaggccaagcaccgcuucuaccggcccccgacccccggccugcgccggguccgccagaagaaguccgugaucgggagcgugacgcuggucuccgagaccgaggugcaggagaagaugaucggccaguucagcuacagcgaggagcgggaguccggcgagaacaagagcgaguaccacauguucacccacuccugcagcaagauguccagcguguccaacaagcccguccucgugcagaucaacaacaacgaccagauggaggagagcucccuggagcgcaagaaggagaacagccugcucaaguccagcgcgaucuccgccggggugaucgagaucaccagccagaagaugcuggagaugucccacaacaacggccugcccagcacgaucuccaacaacagcaucgucgaggaggacgugguggacugcgucgugcucgacaacaagaccgggaucaagaacuucaagaccuacggcaacaccaacgaccgguucuccccgaucagcgccgacgccacgcacuucagcuccaacaacagcgggaccgacaagaacaucuccgaggcccccgcgagcgaggccuccagcaccgugaccgcccgcaucgaccgccugaucaacgaguucgcccagugcggccugacgaagcuccccaagaacgagaagaagauccuguccagcgucgcguccaagaagaagaagaagagccggcagcaggccaucaacucccgcuaccaggacggccagcuggccaccaaggggauccucaacaagaacgagcggaucaacaccaagggccgcaucaccaaggagaugaucgugcaggacagcgacuccccccugaaggggggcauccugugcgaggaggaccuccagaagagcgacaccgugaucgaguccaacacguucugcagcaaguccaaccugaacagcaccaucuccaagaacuuccaccggaacaagcugaacaccacccagaacagcaagguccaggggcuccugacgaagcgcaagagccggucccugaacaagaucagccugggcgccccgaagaagcgcgagaucggccagcgggacaagguguucccccacaacgaguccaaguacugcaagagcaccuucgagaacaagucccucuuccacguguucaacauccuggagcagaagcccaaggacuucuacgccccccagagccaggcggaggucgccuccggguaccugcgcggcauggccaagaagagccucguguccaaggugaccgacagccacaucacccugaagucccagaagaagcggaagggggacaaggucaaggccagcgccauccuguccaagcagcacgcgacgacccgcgccaacagccucgccucccugaagaagccggacuuccccgaggccaucgcccaccacagcauccagaacuacauccaguccuggcugcagaacaucaaccccuaccccacccucaagccgaucaagagcgcgcccgugugccggaacgagaccuccguggucaacugcagcaacaacagcuucuccggcaacgacccccacacgaacagcggcaagaucuccaacuucgugauggagagcaacaagcacaucaccaagaucgccgggcugaccggcgacaaccugugcaaggagggggacaaguccuucaucgccaacgacaccggcgaggaggaccuccacgagacgcagguggggagccugaacgacgccuaccuggucccccuccacgagcacugcacccugucccagagcgcgaucaacgaccacaacaccaagucccacaucgccgccgagaagagcggcccggagaagaagcugguguaccaggagaucaaccucgcccgcaagcggcaguccguggaggccgcgauccaggucgaccccaucgaggaggagacccccaaggaccugcugccggugcucaugcugcaccagcugcaggccagcgugcccggcauccacaagacgcagaacggggucgugcagaugcccggcucccucgccggggugcccuuccacagcgccaucugcaacuccagcaccaaccugcugcucgccuggcugcugguccucaaccugaagggcuccaugaacagcuucugccagguggacgcgcacaaggccaccaacaaguccagcgagacccuggcccuccuggagauccugaagcacaucgccaucacggaggaggccgacgaccucaaggcggccguggccaaccuggucgagagcaccaccucccacuucgggcugagcgagaaggagcaggacauggugccgaucgaccucuccgccaacugcagcaccgugaacauccaguccguccccaagugcagcgagaacgagcgcacgcagggcaucuccagccuggacggcgggugcuccgcgagcgaggccugcgcccccgaggugugcguccuggaggugaccugcucccccugcgagaugugcaccgugaacaaggccuacagcccgaaggagaccugcaaccccuccgacacguucuuccccagcgacggcuacggggucgaccagaccuccaugaacaaggccugcuuccucggcgaggugugcagccugaccgacaccguguucuccgacaaggcgugcgcccagaaggagaaccacacguacgagggggccugccccaucgacgagaccuacgucccggugaacgugugcaacaccaucgacuuccugaacagcaaggagaacaccuacaccgacaaccucgacuccacggaggagcuggagcggggcgacgacauccagaaggaccugaacauccucaccgaccccgaguacaagaacggcuucaacacccuggucagccaccagaacgugagcaaccuguccagcugcgggcucugccuguccgagaaggaggccgagcuggacaagaagcacagcucccucgacgacuucgagaacugcagccugcgcaaguuccaggacgagaacgccuacaccuccuucgacauggaggagccccggacgagcgaggagcccggcuccaucaccaacagcaugaccuccagcgagcgcaacaucuccgagcuggagagcuucgaggagcucgagaaccacgacaccgacaucuucaacacgguggucaacgggggcgagcaggcgaccgaggagcugauccaggaggagguggaggccuccaagacccuggagcucaucgacaucagcuccaagaacaucauggaggagaagcggaugaacgggaucaucuacgagaucaucagcaagcgccuggccaccccgcccagccuggacuucugcuacgacuccaagcagaacagcgagaaggagacgaacgagggcgagaccaagauggugaagaugauggucaagaccauggagaccggcuccuacagcgaguccagccccgaccucaagaagugcaucaagucccccgugacgagcgacugguccgacuaccgcccggacagcgacuccgagcagcccuacaagaccagcuccgacgaccccaacgacagcggggagcugacccaggagaaggaguacaacaucggcuucgugaagcgggccaucgagaagcuguacgggaaggccgacaucaucaagcccuccuucuucccgggcagcacccgcaagucccaggucugccccuacaacagcguggaguuccagugcucccggaaggcgagccucuacgacagcgagggccaguccuucgggagcuccgagcaggugagcuccagcuccagcaugcugcaggaguuccaggaggagcgccaggacaagugcgacgucuccgccgugcgggacaacuacugccgcggcgacaucguggagcccgggacgaagcagaacgacgacagccggauccugaccgacaucgaggagggcguccucaucgacaaggggaaguggcugcugaaggagaaccaccuccugcgcauguccagcgagaaccccggcaugugcggcaacgccgacaccaccuccguggacacgcugcucgacaacaacagcuccgaggugccguacagccacuucgggaaccuggcccccggccccaccauggacgagcuguccagcuccgagcucgaggagcugacccagccgcuggagcucaagugcaacuacuucaacaugccccacgggagcgacagcgagcccuuccacgaggaccugcuggacguccggaacgagaccugcgccaaggagcgcaucgcgaaccaccacacggaggagaagggcucccaccagagcgagcgggugugcaccuccgugacccacagcuucaucuccgccgggaacaaggucuaccccgugagcgacgacgccaucaagaaccagccgcuccccggcuccaacaugauccacggcacccugcaggaggccgacagccuggacaagcucuacgcgcugugcgggcagcacugccccauccugacggugaucauccagcccaugaacgaggaggaccgcggcuucgccuaccggaaggaguccgacaucgagaacuuccucggguucuaccuguggaugaagauccacccguaccugcuccagaccgacaagaacgucuuccgcgaggagaacaacaaggccagcaugcggcagaaccugaucgacaacgccaucggcgacaucuucgaccaguucuacuucuccaacaccuucgaccugauggggaagcgccggaagcagaagcgcaucaacuuccugggccucgaggaggagggcaaccugaagaaguuccagcccgaccugaaggagcgguucugcaugaacuuccuccacaccagccugcuggugguggggaacgucgacuccaacacgcaggaccucagcggccagaccaacgagaucuucaaggccguggacgagaacaacaaccugcugaacaaccgcuuccaggggucccgcaccaaccucaaccaggugguccgggagaacaucaacugccacuacuucuucgagaugcugggccaggcgugccugcucgacaucugccagguggagaccagccugaacaucuccaaccgcaacauccuggagcucugcauguucgagggcgagaaccuguucaucugggaggaggaggacauccugaaccucaccgaccuggagagcucccgggagcaggaggaccuguga

SEQ ID NO: 35840 - RNA, 7203 nt, Artificial Sequence
  derived and/or modified sequence opt1 from RP1L1__Homo_sapiens__NP_849188
augaacagcaccccgcgcaacgcccaggcccccucccaccgggagugcuuccugcccuccguggcgcgcacccccuccgugaccaaggugacccccgccaagaagaucaccuuccucaagcggggcgacccccgcuucgccggggugcggcuggccguccaccagcgcgccuucaagaccuucagcgcgcugauggacgagcucucccagcgggugccccugagcuucggcgugcgcuccgucaccacgccccgcgggcugcacagccucuccgcccuggagcagcuggaggacggcgggugcuaccucugcagcgacaagaagccgcccaagacccccuccggccccggccgcccccaggagcggaaccccaccgcccagcagcugcgcgacguggaggggcagcgggaggcccccggcaccagcuccagccgcaagucccugaagacgccccggcgcauccuccugaucaagaacauggacccccggcugcagcagaccgugguccucagccaccgcaacacccggaaccuggcggccuuccuggggaaggccuccgaccuccugcgcuuccccgugaagcagcuguacaccaccagcggcaagaagguggacucccuccaggcccugcugcacagccccagcguccucgugugcgccgggcacgaggcguuccggacccccgccaugaagaacgcccgccgcuccgaggccgagacccugagcggccugacgucccggaacaagaacggcagcugggggcccaagaccaagcccuccgugauccacagccgcagcccgcccggcagcacgccccggcuccccgagcgccccgggcccuccaacccgcccgucggccccgcccccggccggcacccccaggacacccccgcgcagagcgggccccugguggccggcgacgacaugaagaagaaggugcgcaugaacgaggacgggucccugagcgucgagaugaaggugcgguuccaccucgugggcgaggacacccugcuguggucccgccggauggggcgcgccagcgcccucaccgccgcguccggcgaggaccccguccugggcgagguggacccgcugugcugcgugugggagggguaccccuggggcuucagcgagcccggggucuggggcccccggccgugccgcguggggugccgggaggucuucggccgcggcgggcagcccggccccaaguacgagaucuggaccaacccccuccacgccucccagggggagcggguggccgcccgcaagcgguggggccuggcccagcacgugcgcugcagcgggcuguggggccacggcaccgcggggcgggagcgcugcucccaggacagcgccagcccggccuccagcaccggccuccccgagggguccgagcccgagagcuccugcugcccccgcaccccggaggacggcgucgacagcgccucccccagcgcgcagaucggcgccgagcggaaggccgggggcucccugggggaggaccccggccugugcaucgacggggccggccucggcgggcccgagcagggcgggcgccugaccccgcgggcccgcagcgaggagggcgcguccagcgacuccagcgccuccaccgggagccacgagggcuccagcgaguggggcgggcggccccagggcugccccgggaaggcccgcgccgagaccagccagcaggaggccuccgagggcggggaccccgcgagcccggcccugucccucagcucccugcggagcgacgaccugcaggccgagacccagggccagggcaccgagcaggccaccggggccgcggugacgcgcgagccccucgugcugggccuguccugcagcugggacuccgagggggccagcuccacccccuccacgugcaccuccagccagcagggccagcggcgccaccggucccgcgccagcgccauguccagcccguccagccccgggcugggccgggucgcgccccgcggccacccccggcacagccacuaccgcaaggacacccacuccccgcucgacagcuccgugaccaagcaggucccccggccgcccgagcgccggcgcgccugccaggacgggagcgucccgcgguacuccggcagcuccagcuccacccgcacccaggccagcgggaaccugcggccgcccuccagcggcucccugcccagccaggaccuccugggcaccuccagcgccacggugaccccggccgugcacuccgacuucgucagcggggugagcccccacaacgcgcccagcgccggcugggccggggacgccggcagccggaccugcucccccgccccgaucccgccccacaccagcgacuccugcagcaaguccggggcggccagccugggcgaggaggcccgcgacacgccccagcccuccagcccccucgugcugcaggucggccggcccgagcagggggccgugggcccccaccgcucccacugcugcagccagccggggacccagcccgcccaggaggcgcagcggggccccucccccgaggccagcuggcugugcgggcgcuacugcccgacgccgccccggggccgcccgugcccccagcggcgcuccagcuccugcggcagcaccggguccagccaccaguccacggcccggggccccgggggcagcccccaggaggggacccgccagccgggccccacccccagccccggcccgaacuccggggccagccggcgcuccagcgcgucccagggcgccgggagccggggccucuccgaggagaagacccugcgcagcggcgggggcccccaggggcaggaggaggccuccggcgugagccccuccagccugccccgguccagcccggaggccgucgugcgcgaguggcucgacaacauccccgaggagcccauccugaugacguacgagcuggccgacgagaccaccggggcggccggcggcgggcuccggggccccgagguggacccgggggacgaccacucccuggagggccugggggagcccgcccaggccggccagcagagccucgagggcgaccccgggcaggaccccgagccggagggcgcccugcugggguccagcgacaccggcccccaguccggggagggcgucccccagggcgcggcccccgagggggugagcgaggccccggccgaggccggcgcggaccgcgaggcccccgccgggugccgcgugagccuccgggcccugcccggccgcgucuccgccagcacgcagaucaugcgggcgcugaugggguccaagcagggccgccccagcuccgugccggaggugagccggcccauggcccgccggcucuccugcagcgccggcgcccugaucacgugccuggcgucccuccagcuguucgaggaggaccuggggagccccgccuccaagguccgcuucaaggacagcccgcgguaccaggagcuccuguccaucagcaaggaccuguggcccggcugcgacgugggggaggaccagcucgacuccggccugugggagcugaccuggagccaggcccuccccgaccugggcucccacgccaugaccgagaacuucacgcccaccagcuccagcgggguggacaucagcuccggcagcgggggcuccggggagagcuccgucccgugcgccauggacggcacccuggugacccagggcacggagcucccccugaagaccagcaaccagcgccccgacucccggaccuacgagagccccggggaccuggagaaccagcagcagugcugcuucccgaccuuccucaacgcgcgcgccugcgccugcgccacgaacgaggacgaggccgagcgggacuccgaggagcagcgcgcgagcuccaaccuggagcagcuggccgagaacaccgugcaggaggagguccagcucgaggagaccaaggagggcaccgagggggagggccugcaggaggaggccgugcagcuggaggagacgaagaccgaggaggggcuccaggaggagggcgugcagcuggaggagaccaaggagaccgagggcgaggggcagcaggaggaggaggcccagcuggaggagaucgaggagacgggcggggagggccuccaggaggaggggguccagcuggaggaggugaaggagggccccgagggcgggcugcagggcgaggcccucgaggaggggcugaaggaggagggccugcccgaggaggggagcgugcacggccaggagcucuccgaggcgagcucccccgacggcaaggggagccaggaggacgacccgguccaggaggaggaggccggccgggccuccgccagcgcggagcccugccccgccgaggggaccgaggagcccaccgagccgcccagccaccuguccgagaccgaccccagcgccuccgagcgccagagcggcucccagcuggagcccggccucgagaagccgcccggggccaccaugaugggccaggagcacacgcaggcccagcccacccagggggcggccgagcggagcuccagcguggccugcuccgccgcccuggacugcgaccccaucugggugagcguccugcucaagaagaccgagaaggcguuccuggcccaccuggccuccgccguggccgagcuccgcgcgcgguggggccugcaggacaacgaccugcucgaccagauggccgccgagcugcagcaggacguggcccagcgccugcaggacagcaccaagcgggagcuccagaagcugcaggggcgcgcgggccgcaugguccuggagccgccccgggaggcccucacgggcgagcugcugcuccagacccagcagcgccggcaccgccugcgggggcugcgcaaccucuccgccuucagcgagcggacccugggccuggggccccucuccuucacccuggaggacgagccggcccugagcacggcccucggcucccagcugggggaggaggcggagggcgaggaguucugccccugcgaggccugcgugcgcaagaaggugagccccaugucccccaaggccaccaugggcgccacccgggggccgaucaaggaggccuucgaccugcagcagauccuccagcgcaagcggggcgagcacaccgacggggaggcggccgaggucgcccccggcaagacgcacaccgaccccaccagcacccgcacggugcagggggccgagggcggccuggggcccggccugagccaggggccgggcguggacgagggcgaggacggggagggcucccagcggcucaaccgcgacaaggaccccaagcugggggaggccgagggcgacgcgauggcccaggagcgggaggggaagacccacaacagcgagaccuccgccggcagcgagcugggcgaggccgagcaggagggggagggcaucuccgagcgcggggagaccggcgggcagggcagcggccacgaggacaaccugcagggggaggccgcggccggcggggaccaggaccccggccaguccgacggggccgagggcaucgaggcccccgaggcggagggcgaggcccagccggagagcgagggggucgaggcccccgaggccgagggcgacgcccaggaggcggagggggaggcccagcccgaguccgaggacguggaggcccccgaggccgagggcgaggcccagccggagagcgaggacgucgagacgcccgaggcggagugggaggugcagcccgaguccgagggggccgaggcccccgaggccgagaaggaggcccagccggagaccgagagcguggaggcgcucgagaccgagggcgaggacgagcccgaguccgagggcgccgaggcccaggaggccgaggaggcggcccaggaggccgaggggcagacccagcccgagagcgaggucaucgagucccaggaggccgaggaggaggcccagcccgagagcgaggacguggaggcgcuggagguggaggucgagacgcaggaggccgagggcgaggcccagccggaguccgaggacguggaggcccccgaggccgagggggagaugcaggaggcggaggaggaggcccagcccgagagcgacggcguggaggcccagcccaaguccgagggcgaggaggcccaggaggucgagggggagacccagaagaccgagggcgacgcccagccggagagcgacgggguggaggcgcccgaggccgaggaggaggcccaggaggccgagggcgaggugcaggaggcggagggggaggcccaccccgagagcgaggacgucgacgcccaggaggccgagggcgaggcccagccggaguccgagggcguggaggcgcccgaggccgagggggaggcccagaaggccgagggcaucgaggcccccgagaccgagggggaggcgcagcccgagagcgagggcaucgaggccccggaggccgagggggaggcccagcccgaguccgagggcguggaggcccaggacgcggagggcgaggcccagcccgagagcgaggggaucgaggcccaggaggccgaggaggaggcccagcccgagcuggagggcgucgaggcgccggaggccgagggggaggcccagcccgaguccgagggcaucgaggcccccgaggcggagggggaggcccagcccgagcucgagggcguggaggccccggaggccgaggaggaggcccagcccgagcccgagggcguggagacgcccgaggcggagggggaggcccagccggagagcgagggcgagacccagggggagaagaagggcagcccccaggucucccugggcgacgggcaguccgaggaggccagcgaguccagcucccccgugcccgaggaccggccgacgccgccgcccagcccgggcggggacacgccccaccagcgccccggcucccagacggggcccagcuccagccgggccuccagcuggggcaacugcuggcagaaggacagcgagaacgaccacgugcugggcgacacccgcuccccggacgccaagagcaccgggacgccccacgcggagcgcaaggccacccggauguaccccgaguccagcaccuccgagcaggaggaggccccgcucggcagccgcacccccgagcagggggccuccgagggcuacgaccugcaggaggaccaggcccuggggagccucgcgcccaccgaggccgucggccgggccgacggcuucgggcaggacgaccuggacuucuga

SEQ ID NO: 35841 - RNA, 1053 nt, Artificial Sequence
  derived and/or modified sequence opt1 from RP2__Homo_sapiens__NP_008846
augggcugcuucuucagcaagcgccggaaggccgacaaggagucccgccccgagaacgaggaggagcggccgaagcaguacagcugggaccagcgcgagaagguggaccccaaggacuacauguucuccgggcugaaggacgagaccgucggccggcuccccgggaccguggccggccagcaguuccugauccaggacugcgagaacugcaacaucuacaucuucgaccacagcgcgacggugaccaucgacgacugcaccaacugcaucaucuuccuggggcccgucaagggcuccguguucuuccgcaacugccgggacugcaagugcacccucgccugccagcaguuccgcgugcgggacugccgcaagcuggaggucuuccugugcugcgccacgcagccgaucaucgagagcuccagcaacaucaaguucggcugcuuccagugguacuaccccgagcucgccuuccaguucaaggacgccgggcuguccaucuucaacaacaccuggagcaacauccacgacuucacccccguguccggcgagcugaacuggagccuccugcccgaggacgcggugguccaggacuacgugccgauccccaccacggaggagcugaaggccgugcgggucuccaccgaggccaaccgcagcaucgugcccaucucccgggggcagcgccagaaguccagcgacgagagcugccucgugguccuguucgccggcgacuacaccaucgcgaacgcccggaagcugaucgacgagaugguggggaagggcuucuuccucgugcagaccaaggaggucuccaugaaggccgaggacgcccagcgcguguuccgggagaaggcccccgacuuccugccgcugcucaacaagggccccgugaucgcgcuggaguucaacggggacggcgccgucgaggugugccagcugaucgugaacgagaucuucaacgggacgaagauguucgucagcgagagcaaggagaccgccuccggcgacguggacagcuucuacaacuucgccgacauccagaugggcaucuga

SEQ ID NO: 35842 - RNA, 666 nt, Artificial Sequence
  derived and/or modified sequence opt1 from RP9__Homo_sapiens__NP_976033
augagcucccgccccggccgggaggacgugggggccgccggcgcgcgccggccgcgcgagccgcccgagcaggagcugcagcggcgccgggagcagaagcgccggcgccacgacgcccagcagcuccagcagcugaagcaccuggagagcuucuacgagaagcccccgcccgggcucaucaaggaggacgagaccaagcccgaggacugcauccccgacgucccgggcaacgagcacgcccgggaguuccuggcccacgcccccaccaaggggcuguggaugccccucggcaaggaggugaaggugaugcagugcuggcgcugcaagcgguacggccaccgcacgggggacaaggagugccccuucuucaucaagggcaaccagaagcuggagcaguuccgggucgcgcacgaggaccccauguacgacaucauccgcgacaacaagcggcacgagaaggacgugcgcauccagcagcugaagcagcuccuggaggacuccaccagcgacgaggaccgguccagcuccagcuccagcgaggggaaggagaagcacaagaagaagaagaagaaggagaagcacaagaagcgcaagaaggagaagaagaagaagaagaagcggaagcacaaguccagcaaguccaacgagggcagcgacuccgaguga

SEQ ID NO: 35843 - RNA, 1851 nt, Artificial Sequence
  derived and/or modified sequence opt1 from RPA1__Homo_sapiens__NP_002936
auggugggccagcugagcgagggggccaucgccgcgaucaugcagaagggcgacaccaacaucaagcccauccuccaggucaucaacauccgcccgaucaccacggggaacuccccgccccgguaccgccugcugaugagcgacggccucaacacccuguccagcuucaugcuggccacccagcucaacccccugguggaggaggagcagcuguccagcaacugcgugugccagauccaccgguucaucgucaacacccucaaggacgggcgccggguggugauccugauggagcuggagguccucaaguccgccgaggccgugggcgugaagaucggcaaccccguccccuacaacgaggggcugggccagccccagguggcgcccccggcccccgccgccagccccgccgcguccagccgcccccagccgcagaacggguccagcggcaugggguccacggugagcaaggccuacggcgccuccaagaccuucggcaaggccgccgggcccagccugucccacaccagcggcgggacccaguccaaggucgugcccaucgcgagccucacgcccuaccagagcaaguggaccaucugcgcccgggugaccaacaagucccagauccgcaccuggagcaacucccggggcgagggcaagcuguucagccuggagcucgucgacgaguccggggagauccgcgccacggccuucaacgagcaggucgacaaguucuucccgcugaucgaggugaacaaggucuacuacuucagcaagggcacccugaagaucgccaacaagcaguucaccgcggugaagaacgacuacgagaugaccuucaacaacgagacguccgugaugcccugcgaggacgaccaccaccuccccaccguccaguucgacuucaccgggaucgacgaccuggagaacaagagcaaggacucccugguggacaucaucggcaucugcaagagcuacgaggacgccaccaagaucacggugcgguccaacaaccgcgaggucgccaagcggaacaucuaccucauggacaccagcgggaagguggucaccgccacccuguggggcgaggacgccgacaaguucgacggcucccgccagcccgugcuggcgaucaagggggcccgggugagcgacuucggcgggcgcucccucagcguccuguccagcuccacgaucaucgccaacccggacauccccgaggccuacaagcugcggggcugguucgacgccgaggggcaggcgcucgacggcgugagcaucagcgaccugaaguccggcggggugggcgggagcaacaccaacuggaagacccuguacgaggucaaguccgagaaccucggccagggggacaagcccgacuacuucagcuccguggccaccguggucuaccugcgcaaggagaacugcauguaccaggccugccccacgcaggacugcaacaagaaggugaucgaccagcagaacggccuguaccggugcgagaagugcgacaccgaguucccgaacuucaaguaccgcaugauccucagcgugaacaucgccgacuuccaggagaaccagugggugaccugcuuccaggaguccgcggaggccauccugggccagaacgccgccuaccugggggagcucaaggacaagaacgagcaggccuucgaggagguguuccagaacgcgaacuuccggagcuucaucuuccgcgugcgcgucaagguggagaccuacaacgacgagucccggaucaaggccacggugauggacgucaagcccguggacuaccgcgaguacggccggcgccuggugaugagcauccggcgcuccgcccugauguga

SEQ ID NO: 35844 - RNA, 837 nt, Artificial Sequence
  derived and/or modified sequence opt1 from RPA2__Homo_sapiens__NP_001284487
augggccgcggggaccggaacaagcgcagcauccggggcuucgaguccuacgggagcuccagcuacggcggggccggcggcuacacccagucccccgggggcuucgggagcccggcccccucccaggcggagaagaagucccgcgcccgggcccagcacaucgugcccugcaccaucagccagcugcucagcgccacgcuggucgacgagguguuccgcaucggcaacguggagaucucccaggucaccaucguggggaucauccggcacgccgagaaggcgcccaccaacaucguguacaagaucgacgacaugaccgccgccccgauggacguccgccaguggguggacacggacgacaccagcuccgagaacaccguggucccgcccgagaccuacgugaagguggccggccaccuccggagcuuccagaacaagaagucccuggucgcguucaagaucaugccccuggaggacaugaacgaguucacgacccacauccuggaggugaucaacgcccacauggugcucagcaaggccaacucccagcccagcgccggccgcgcccccaucuccaaccccgggaugagcgaggcgggcaacuucgggggcaacagcuucaugcccgccaacggccugaccgucgcccagaaccaggugcugaaccucaucaaggccugcccgcggcccgaggggcugaacuuccaggaccugaagaaccagcucaagcacauguccgugagcuccaucaagcaggccgucgacuuccugagcaacgagggccacaucuacuccaccguggacgacgaccacuucaagagcacggacgcggaguga

SEQ ID NO: 35845 - RNA, 366 nt, Artificial Sequence
  derived and/or modified sequence opt1 from RPA3__Homo_sapiens__NP_002938
augguggacaugauggaccugccccgcagccggaucaacgccggcaugcucgcccaguucaucgacaagccggucugcuucguggggcgccuggagaagauccaccccaccggcaagauguucauccuguccgacggggagggcaagaacgggaccaucgagcucauggagccccuggacgaggagaucagcggcaucguggaggucgugggccgggugacggcgaaggccaccauccugugcaccuccuacguccaguucaaggaggacagccaccccuucgaccucgggcuguacaacgaggccgugaagaucauccacgacuucccgcaguucuacccccugggcaucgugcagcacgacuga

SEQ ID NO: 35846 - RNA, 786 nt, Artificial Sequence
  derived and/or modified sequence opt1 from RPA4__Homo_sapiens__NP_037479
augagcaaguccggcuucgggagcuacggcuccaucagcgccgccgacggggcguccggcgggagcgaccagcugugcgagcgcgacgccacccccgccaucaagacccagcggccgaaggugcgcauccaggacgucgugcccugcaacgugaaccagcuccuguccagcacggucuucgaccccguguucaaggugcggggcaucaucgucucccaggugagcaucgugggcgucauccgcggggccgagaaggccuccaaccacaucugcuacaagaucgacgacaugaccgcgaagcccaucgaggcccggcagugguucggccgcgagaaggugaagcaggucaccccgcugagcguggggguguacgugaaggucuucggcauccucaagugccccaccgggacgaagucccuggaggugcugaagauccacgugcucgaggacaugaacgaguucaccguccacauccuggagaccgugaacgcccacaugaugcuggacaaggcccggcgcgacaccacgguggagagcguccccgugucccccagcgaggugaacgacgcgggcgacaacgacgagucccaccggaacuucauccaggacgagguccuccgccugauccacgagugcccgcaccaggagggcaagagcauccacgagcugcgggcccagcucugcgaccuguccgugaaggccaucaaggaggccaucgacuaccugaccgucgaggggcacaucuaccccaccguggaccgcgagcacuucaagagcgccgacuga

SEQ ID NO: 35847 - RNA, 660 nt, Artificial Sequence
  derived and/or modified sequence opt1 from RPAIN__Homo_sapiens__NP_001028174
auggccgagagccugcgcagcccccggcgcagccucuacaagcuggugggcuccccgcccuggaaggaggccuuccggcagcgcugccuggagcggaugcgcaacagccgggaccgccuccugaaccgguaccgccaggcgggguccagcggccccgggaacucccagaacagcuuccugguccaggaggugauggaggaggaguggaacgcccuccaguccguggagaacugccccgaggaccuggcccagcuggaggagcucaucgacauggccguccuggaggagauccagcaggagcugaucaaccaggagcagagcaucaucuccgaguacgagaagucccuccaguucgacgagaagugccuguccaucaugcuggccgagugggaggcgaacccgcucaucugccccgugugcaccaaguacaaccugcggaucaccagcggcguggucgugugccagugcgggcuguccauccccagccacuccagcgagcucacggagcagaagcugcgcgccugccuggagggcuccaucaacgagcacagcgcccacugcccccacaccccggaguucagcgugaccggcgggaccgaggagaaguccagccuccugauguccugccuggccugcgacacgugggcggucauccucuga

SEQ ID NO: 35848 - RNA, 4182 nt, Artificial Sequence
  derived and/or modified sequence opt1 from RPAP1__Homo_sapiens__NP_056355
augcugagccgccccaagcccggcgaguccgagguggaccuccugcacuuccagagccaguuccuggccgccggggcggcccccgccguccagcucgugaagaagggcaaccgcgggggcggggacgccaacuccgaccggccgccccugcaggaccaccgggacguggucaugcuggacaaccuccccgaccugccgcccgcccuggugcccagcccgcccaagcgcgcgcggcccucccccggccacugccuccccgaggacgaggaccccgaggagcgccugcggcgccacgaccagcacaucaccgccgugcugaccaagaucaucgagcgggacacgagcuccgucgccgugaaccuccccgugcccagcggcgucgccuucccggcgguguuccugcgcucccgggacacccagggcaagagcgccaccuccggcaagcgcagcaucuucgcccaggagaucgccgcccggcgcaucgcggaggccaaggggcccuccgugggcgaggucgugcccaacguggggcccccggagggcgccgugaccugcgagacgcccacgccccggaaccagggcugccagcugcccgggagcucccacagcuuccagggcccgaaccucgugaccgggaagggccugcgcgaccaggaggccgagcaggaggcccagaccauccacgaggagaacaucgcgcggcugcaggccauggcccccgaggagauccuccaggagcagcagcgccugcuggcccagcucgaccccucccugguggccuuccugcggagccacucccacacccaggagcagaccggcgagaccgcgagcgaggagcagcgccccgggggcccgagcgccaacgucaccaaggaggagccccucauguccgccuucgccagcgagccccggaagcgcgacaagcuggagccggaggcccccgcgcuggcccuccccgugacgccccagaaggaguggcugcacauggacaccguggagcuggagaagcuccacuggacccaggaccugccgcccguccgccggcagcagacccaggagcgcaugcaggcccgguucucccugcagggggagcuccuggcccccgacguggaccugcccacgcaccucggccugcaccaccacggggaggaggcggagcgcgccggcuacagccugcaggagcuguuccaccugacccggucccaggugagccagcagcgcgcccuggcccuccacguccuggcccaggugaucucccgggcgcaggccggcgaguucggggaccgccuggccggcagcguccucucccugcugcucgacgccggguuccuguuccugcugcgguucagccucgacgaccgcguggacggcgugaucgccaccgcgauccgggcccuccgcgcccugcucgucgccccgggggacgaggagcugcuggacuccaccuucagcugguaccacggggcccucacguucccccugaugcccucccaggaggacaaggaggacgaggacgaggacgaggagugccccgcgggcaaggccaagcgcaagagcccggaggaggagucccggcccccgcccgaccuggcccggcacgacgucaucaaggggcuccuggccaccagccugcucccccgccugcgguacgugcuggaggucaccuaccccggccccgcgguggugcucgacauccuggccguccugauccgccucgcccggcacucccuggagagcgccacccgcgugcuggagugcccccgccucaucgagacgaucgugcgggaguuccugccgaccuccuggagccccgucggggccggccccacccccagccuguacaaggugccgugcgcgaccgccaugaagcuccugcgcgugcuggccuccgccgggcggaacaucgccgcgcgccuccugagcuccuucgaccugcggagccgccucugccggaucaucgccgaggcgccccaggagcuggcccugcccccggaggaggccgagaugcucuccacggaggcccugcgccugugggccgucgccgccagcuacggccagggcggguaccucuaccgggagcuguaccccgugcugaugcgcgcgcuccagguggucccccgggagcuguccacccacccgccccagccccugagcaugcagcgcaucgccucccuccugacccugcucacccagcugacgcuggccgccggcagcacccccgccgagaccaucuccgacagcgcggaggccucccucagcgccacccccucccuggugacguggacccaggugagcgggcugcagccgcucgucgagcccugccugcggcagacccugaagcuccugucccgccccgagauguggcgggccgugggccccgugccggucgccugccugcuguuccucggcgcguacuaccaggccuggagccagcagcccagcuccugccccgaggacuggcugcaggacaugcagcgccucagcgaggagcugcugcucccccugcugucccagccgacccucgggagccugugggacucccugcggcacugcagccuccugugcaacccccuguccugcgugcccgcccucgaggcgcccccgagccuggugucccugggcugcagcgggggcugcccccgccucucccuggccgggagcgccucccccuuccccuuccugaccgcccuccugagccugcucaacacgcuggcccagauccacaagggccugugcggccagcucgccgccauccuggcggccccggggcugcagaacuacuuccuccagugcgucgcccccggcgccgcgccccaccugacccccuucuccgccugggcccugcggcacgaguaccaccuccaguaccuggcccuggcccucgcgcagaaggccgccgcccugcagccgcugcccgccacccacgcggcccuguaccacgggauggcccucgcccugcugagccgccuccugcccggcuccgaguaccugacccacgagcuccugcugagcugcguguuccggcucgaguuccugccggagcgcacguccgggggccccgaggccgcggacuucagcgaccagcugagccucggcuccagccgcgugccccggugcgggcagggcacccugcuggcccaggccugccaggaccuccccuccauccgcaacugcuaccugacccacugcagcccggcccgggcgucccugcucgccagccaggcccugcaccgcggggagcugcagcggguccccacccuccugcugcccaugcccacggagccgcuccugcccaccgacuggcccuuccugccccucauccgccuguaccaccgggccuccgacaccccgagcggccugucccccaccgacacgauggggaccgccaugcgcgugcuccagugggugcugguccuggagagcuggcggccccaggcgcucugggccgugcccccggccgcccgccuggcccggcugaugugcguguuccucgucgacuccgagcuguuccgcgagagccccgugcagcaccugguggcggcccuccuggcccagcugugccagccccagguccuccccaaccugaaccuggacugccggcucccgggccugaccuccuuccccgaccuguacgccaacuuccucgaccacuucgaggccgugagcuucggcgaccaccuguucggggcgcuggugcuccugccccugcagcgccgguucuccgucacccuccgccuggcccuguucggcgagcacgugggggcccuccgggcccugagccugccccucacgcagcugccggugucccuggagugcuacaccgucccgcccgaggacaaccucgcgcugcugcagcucuacuuccgcacccuggugaccggcgcccugcggccccgcuggugccccgugcucuacgccgucgccguggcccacgugaacagcuucaucuucucccaggacccccagagcagcgacgaggucaaggcggcccgccgguccaugcugcagaagacguggcugcucgccgacgaggggcugcgccagcaccuccugcacuacaagcugcccaacagcacccugccggagggcuucgagcucuacucccagcugccgccccugcggcagcacuaccuccagcgccugaccagcaccgugcugcagaacggcgucuccgagacguga

SEQ ID NO: 35849 - RNA, 600 nt, Artificial Sequence
  derived and/or modified sequence opt1 from RPE__Homo_sapiens__NP_001265214
auggccagcggcugcaagaucgggcccuccauccugaacagcgaccucgccaaccugggcgcggagugccugcgcaugcucgacuccggggccgacuaccugcaccuggacgugauggacggccacuucgucccgaacaucaccuucgggcaccccgugguggagagccuccggaagcagcugggccaggaccccuucuucgacaugcacaugauggucuccaagcccgagcagugggugaagccgauggccguggccggcgccaaccaguacaccuuccaccuggaggcgacggagaaccccggggcccucaucaaggacauccgcgagaacggcaugaaggucgggcuggccaucaagcccggcaccagcguggaguaccuggcccccugggcgaaccagaucgacauggcccucgugaugaccgucgagccgggguucggcggccagaaguucauggaggacaugaugcccaaggccggggccaacaugaucguguccggcagcgccaucaugcgguccgaggacccccgcagcgugaucaaccugcugcggaacgucugcuccgaggcggcccagaagcgcagccucgaccgguga

SEQ ID NO: 35850 - RNA, 2448 nt, Artificial Sequence
  derived and/or modified sequence opt1 from RPGR__Homo_sapiens__NP_000319
augcgcgagcccgaggagcugaugccggacagcggcgccguguucaccuucgggaaguccaaguucgccgagaacaaccccggcaaguucugguucaagaacgacguccccgugcaccucagcugcggggacgagcacuccgcgguggucaccggcaacaacaagcuguacauguucgggagcaacaacuggggccagcugggccucggguccaagagcgccaucuccaagcccacgugcgugaaggcccugaagccggagaaggugaagcuggccgccugcggccggaaccacacccucgucagcaccgagggcgggaacguguacgcgaccgggggcaacaacgagggccagcuggggcugggcgacacggaggagcgcaacaccuuccacgugaucuccuucuucaccagcgagcacaagaucaagcagcucuccgccgggagcaacaccuccgccgcccugacggaggacggccggcuguucauguggggcgacaacagcgaggggcagaucggccucaagaacgucuccaacgugugcgugccccagcaggucaccaucgggaagcccgugagcuggaucuccugcggcuacuaccacagcgcguucgugaccaccgacggggagcuguacgucuucggcgagcccgagaacggcaagcuggggcucccgaaccagcugcugggcaaccaccgcacgccccagcucguguccgagauccccgagaaggugauccaggucgccugcgggggcgagcacaccguggugcugaccgagaacgccgucuacaccuucgggcugggccaguucggccagcucgggcugggcacguuccuguucgagaccagcgagcccaaggugaucgagaacauccgggaccagaccaucagcuacaucuccugcggggagaaccacaccgcccucaucacggacaucggccugauguacaccuucggggacggccgccacggcaagcuggggcucggccuggagaacuucaccaaccacuucaucccgacccugugcagcaacuuccuccgguucaucgugaagcuggucgccugcgggggcugccacaugguggucuucgcggcgccccaccgcggcguggccaaggagaucgaguucgacgagaucaacgacacgugccuguccguggccaccuuccuccccuacagcucccugaccagcgggaacguccugcagcggacccucuccgcccgcaugcggcgccgggagcgcgagcggagccccgacuccuucagcaugcgccggacgcugccgcccaucgagggcacccuggggcucuccgccugcuuccugcccaacagcguguucccccgcugcuccgagcggaaccugcaggagagcgugcucuccgagcaggaccugaugcagccggaggagcccgacuaccugcucgacgagaugaccaaggaggccgagaucgacaacagcuccaccgucgagagccugggcgagacgaccgacauccugaacaugacccacaucaugucccucaacagcaacgagaagucccugaagcugagccccgugcagaagcagaagaagcagcagaccaucggggagcugacgcaggacaccgcccucaccgagaacgacgacagcgacgaguacgaggagauguccgagaugaaggagggcaaggccugcaagcagcacgugagccagggcaucuucaugacccagcccgccaccacgaucgaggcguucuccgacgaggaggucgagaucccggaggagaaggagggggccgaggacagcaagggcaacgggaucgaggagcaggagguggaggccaacgaggagaacgugaagguccacggcgggcgcaaggagaagaccgagauccuguccgacgaccugaccgacaaggccgaggaccacgaguucagcaagaccgaggagcucaagcuggaggacguggacgaggagaucaacgccgagaacguggaguccaagaagaagacggucggcgacgacgagagcgugcccaccggcuaccacuccaagaccgagggggcggagcggaccaacgacgacagcuccgccgagacgaucgagaagaaggagaaggccaaccuggaggagcgcgccaucugcgaguacaacgagaaccccaagggcuacaugcucgacgacgcggacagcuccagccuggagauccuggagaacuccgagaccacccccagcaaggacaugaagaagaccaagaagaucuuccucuucaagcgcgugccgagcaucaaccagaagaucgucaagaacaacaacgagccccugcccgagaucaaguccaucggggaccagaucauccucaagagcgacaacaaggacgccgaccagaaccacaugucccagaaccaccagaacaucccgcccacgaacaccgagcggcgcagcaaguccugcaccauccuguga

SEQ ID NO: 35851 - RNA, 3861 nt, Artificial Sequence
  derived and/or modified sequence opt1 from RPGRIP1__Homo_sapiens__NP_065099
augagccaccugguggaccccaccuccggcgaccucccgguccgcgacaucgacgccaucccccuggugcugcccgccagcaaggggaagaacaugaagacccagcccccgcucucccggaugaaccgcgaggagcuggaggacagcuucuuccggcugcgcgaggaccacaugcucgugaaggagcuguccuggaagcagcaggacgagaucaagcggcugcgcacgacccuccugcggcugaccgcggccggccgcgaccuccgggucgccgaggaggccgcgccccugagcgagaccgcccgccgggggcagaaggccggcuggcgccagcggcuguccaugcaccagcgcccccagaugcaccggcuccaggggcacuuccacugcgugggccccgccagcccgcgccgggcccagccccgcgugcaggucggccaccggcagcugcacacggcgggggcccccgugcccgagaagccgaagcgcggcccccgggaccgccuguccuacaccgccccgcccagcuucaaggagcacgccaccaacgagaaccgcggggagguggccuccaagcccagcgagcucgucuccggcagcaacuccaucaucagcuucuccagcgugaucuccauggcgaagcccaucgggcugugcaugcccaacagcgcccacaucauggccagcaacaccaugcaggucgaggagcccccgaagucccccgagaagauguggcccaaggacgagaacuucgagcagcggagcucccuggagugcgcccagaaggccgcggagcuccgcgccagcaucaaggagaagguggagcugauccggcugaagaagcuccugcacgagcgcaacgccucccuggugaugacgaaggcccagcucaccgaggugcaggaggccuacgagacccugcugcagaagaaccagggcauccucagcgcggcccacgaggcccugcugaagcaggucaacgagcuccgggccgagcugaaggaggaguccaagaaggccgugagccugaagucccagcucgaggacgugagcauccugcagaugacccugaaggaguuccaggagcgcgucgaggaccucgagaaggagcggaagcugcugaacgacaacuacgacaagcuccuggaguccaugcuggacagcuccgacagcuccagccagccccacugguccaacgagcucaucgcggagcagcugcagcagcaggucagccagcugcaggaccagcucgacgccgagcuggaggacaagcgcaaggugcugcuggagcucucccgggagaaggcccagaacgaggaccugaagcuggaggugacgaacauccuccagaagcacaagcaggagguggagcugcugcagaacgccgcgaccaucagccagccgcccgaccgccagagcgagcccgccacccaccccgccgugcuccaggagaacacccagaucgagccguccgagcccaagaaccaggaggagaagaagcugagccagguccugaacgagcuccaggugucccacgccgagacgacccuggagcuggagaagacccgggacaugcucauccugcagcgcaagaucaacgucugcuaccaggaggagcuggaggccaugaugaccaaggcggacaacgacaaccgggaccacaaggagaagcucgagcgccugacgcggcugcucgaccugaagaacaaccgcaucaagcagcuggagggcauccuccggagccacgaccugcccaccuccgagcagcugaaggacguggccuacgggacccgcccgcucagccugugccuggagacccuccccgcccacggcgacgaggacaagguggacaucucccugcugcaccagggggagaaccucuucgagcugcacauccaccaggccuuccugacgagcgccgcgcucgcccaggccggcgacacccagcccaccaccuucugcacguacuccuucuacgacuucgagacccacugcacgccccugagcgucggcccgcagccccuguacgacuucaccucccaguacgugauggagaccgacagccucuuccugcacuaccugcaggaggccuccgcccggcucgacauccaccaggcgauggccagcgagcacuccacccuggccgccggguggaucugcuucgaccgcgugcuggagaccgucgagaaggugcacggccucgcgacccugaucggggccggcggggaggaguucggcgugcuggaguacuggaugcgccuccgguuccccaucaagcccagccugcaggccugcaacaagcgcaagaaggcccaggucuaccuguccacggacgugcucggcgggcggaaggcccaggaggaggaguuccgcagcgagagcugggagccgcagaacgagcuguggaucgagaucaccaagugcugcggccugcggucccgcuggcucgggacccagcccagccccuacgcgguguaccgguucuucaccuucuccgaccacgacaccgccaucauccccgccagcaacaacccguacuuccgcgaccaggcccgguuccccguccuggugacguccgaccuggaccacuaccuccgccgggaggcccugagcauccacguguucgacgacgaggaccuggagcccggcuccuaccucgggcgcgcgcgggucccccugcugccgcucgccaagaacgagagcaucaagggcgacuucaaccugaccgaccccgccgagaagcccaacggcuccauccaggugcagcuggacuggaaguuccccuacaucccgcccgagagcuuccucaagcccgaggcccagaccaaggggaaggacaccaaggacuccagcaagaucuccagcgaggaggagaaggccuccuuccccagccaggaccagauggcguccccggaggugcccaucgaggccggccaguaccgcagcaagcggaagcccccgcacgggggcgagcgcaaggagaaggagcaccaggucguguccuacagccggcgcaagcacgggaagcggaucggcgugcagggcaagaaccgcauggaguaccugagccugaacauccucaacgggaacacgcccgagcaggucaacuacaccgaguggaaguucuccgagaccaacagcuucaucggcgacggguucaagaaccagcacgaggaggaggagaugacccugucccacagcgcccugaagcagaaggagccccuccaccccgugaacgacaaggaguccagcgagcagggcuccgaggugagcgaggcccagacgaccgacuccgacgacgucaucgugccgcccaugagccagaaguaccccaaggcggacuccgagaagaugugcaucgagaucgugagccuggccuucuaccccgaggccgaggucauguccgacgagaacaucaagcaggucuacguggaguacaaguucuacgaccugccgcucagcgagaccgagacccccgugucccugcggaagccccgcgccggcgaggagauccacuuccacuucagcaaggugaucgaccuggacccccaggagcagcaggggcgccggcgcuuccucuucgacaugcugaacggccaggacccggaccaggggcaccugaaguucacgguggucuccgacccccucgacgaggagaagaaggagugcgaggaggugggcuacgccuaccugcagcuguggcagauccucgagagcgggcgggacauccuggagcaggagcuggacaucgugucccccgaggaccucgcgacccccaucggccgccugaaggucagccugcaggccgccgccgugcuccacgccaucuacaaggagaugaccgaggaccuguucagcuga

SEQ ID NO: 35852 - RNA, 3708 nt, Artificial Sequence
  derived and/or modified sequence opt1 from RPGRIP1L__Homo_sapiens__NP_001121369
augagcggccccaccgacgagaccgccggggaccugccggugaaggacacgggccucaaccuguucgggaugggcgggcugcaggagaccuccaccacccgcacgaugaagucccggcaggccgucagccgcgugagccgggaggagcucgaggaccgcuuccugcggcugcacgacgagaacauccuccugaagcagcacgcgcgcaagcaggaggacaagaucaagcggauggccaccaagcugauccgccucgugaacgacaagaagcgguacgagcgcgucggcggcgggcccaagcggcugggccgcgacguggagauggaggagaugaucgagcagcugcaggagaaggugcacgagcucgagaagcagaacgagacccugaagaaccggcugaucuccgccaagcagcagcuccagacccagggguaccgccagacgcccuacaacaacguccagagccggaucaacaccggccgccggaaggccaacgagaacgccgggcugcaggagugcccccgcaagggcaucaaguuccaggacgcggacguggccgagaccccgcaccccauguucaccaaguacggcaacucccugcucgaggaggcccgcggggagauccggaaccuggagaacgugauccagagccagcggggccagaucgaggagcuggagcaccucgccgagauccugaagacgcagcugcgccgcaaggagaacgagaucgagcucucccugcugcagcuccgggagcagcaggcgaccgaccagcgcagcaacauccgggacaacgucgagaugaucaagcugcacaagcagcugguggagaaguccaacgcccucagcgccauggaggggaaguucauccagcugcaggagaagcagcgcacccugcggaucucccacgacgcccucauggccaacggcgacgagcugaacaugcagcugaaggagcagcgccucaagugcugcagccuggagaagcagcugcacuccaugaaguucagcgagcggcgcaucgaggagcuccaggaccggaucaacgaccuggagaaggagcgcgagcugcucaaggagaacuacgacaagcuguacgacuccgcguucagcgccgcccacgaggagcaguggaagcugaaggagcagcagcucaaggugcagaucgcccagcuggagaccgcccugaaguccgaccucacggacaagaccgagauccuggaccggcugaagaccgagcgcgaccagaacgagaagcugguccaggagaaccgggagcuccagcugcaguaccuggagcagaagcagcagcucgacgagcugaagaagcgcaucaagcuguacaaccaggagaacgacaucaacgcggacgagcucagcgaggcccugcugcucaucaaggcccagaaggagcagaagaacggcgaccugagcuuccuggugaagguggacuccgagaucaacaaggaccucgagcggagcaugcgcgagcugcaggccacccacgccgagacgguccaggagcuggagaagacccggaacaugcucaucaugcagcacaagaucaacaaggacuaccagauggagguggaggcggugacccgcaagauggagaaccugcagcaggacuacgagcugaaggucgagcaguacgugcaccuccuggacauccgggccgcccgcauccacaagcuggaggcccagcucaaggacaucgccuacgggaccaagcaguacaaguucaagcccgagaucaugcccgacgacuccguggacgaguucgacgagacgauccaccuggagcgcggcgagaaccuguucgagauccacaucaacaaggucaccuucagcuccgaggugcuccaggcgagcggggacaaggagccggugaccuucugcaccuacgccuucuacgacuucgagcugcagacgacccccgucgugcggggccugcaccccgaguacaacuucaccucccaguaccucguccacgugaacgaccuguuccugcaguacauccagaagaacaccaucacgcucgaggugcaccaggccuacagcaccgaguacgagaccaucgccgcgugccagcugaaguuccacgagauccuggagaaguccgggcgcaucuucugcaccgccagccucaucggcacgaagggcgacauccccaacuucgggaccgucgaguacugguuccggcugcgcgugccgauggaccaggccauccggcuguaccgcgagcgggccaaggcccucggcuacaucaccuccaacuucaaggggcccgagcacaugcagagccugucccagcaggcgcccaagaccgcccagcugagcuccaccgacagcacggacggcaaccucaacgagcugcacaucaccauccgcugcugcaaccaccuccagucccgggccagccaccuccagccccacccguacguggucuacaaguucuucgacuucgccgaccacgacaccgccaucauccccuccagcaacgacccccaguucgacgaccacauguacuuccccgugccgaugaacauggaccuggaccgcuaccucaagagcgagucccugagcuucuacguguucgacgacuccgacacccaggagaacaucuacaucgggaaggucaacgugccccugaucagccuggcgcacgaccggugcaucuccggcaucuucgagcugacggaccaccagaagcaccccgccggcaccauccacgugauccugaaguggaaguucgccuaccugcccccgagcggguccaucaccaccgaggaccucggcaacuucauccgcagcgaggagcccgaggucgugcagcggcugccgcccgccuccagcguguccacgcugguccucgcgccccgccccaagccccggcagcgccugaccccgguggacaagaaggugagcuucgucgacaucaugccccaccaguccgacgugagccaggagggguccguggacgaggucaaggagaacaccgagaagaugcagcagggcaaggacgacgugagccugcucuccgaggggcagcuggccgagcagagccuggccagcuccgaggacgagaccgagaucacggaggaccucgagcccgagguggaggaggacaugagcgccuccgacagcgacgacugcaucauccccggcccgaucuccaagaacaucaagcagcccagcgagaagauccggaucgagaucaucgcccugucccugaacgacagccaggucaccauggacgacaccauccagcgccucuucguggagugccgguucuacucccugcccgcggaggagacccccgugagccugccgaagcccaaguccggccagugggucuacuacaacuacagcaacgugaucuacguggacaaggagaacaacaaggccaagcgcgacauccucaaggccauccugcagaagcaggagaugcccaaccggucccugcgcuucacggucgugagcgacccgcccgaggacgagcaggaccucgagugcgaggacaucgggguggcccacgucgaccuggccgacauguuccaggagggccgcgaccugaucgagcagaacaucgacguguucgacgcgcgggccgacggggagggcaucggcaagcuccgcgugaccgucgaggcccugcacgcccugcaguccguguacaagcaguaccgggacgaccucgaggccuga

SEQ ID NO: 35853 - RNA, 2085 nt, Artificial Sequence
  derived and/or modified sequence opt1 from RPH3A__Homo_sapiens__NP_001137326
augaccgacaccguguucagcaacuccagcaaccgcuggauguaccccuccgaccggccgcugcagagcaacgacaaggagcagcuccaggccggcugguccguccaccccgggggccagcccgaccgccagcggaagcaggaggagcugacggacgaggagaaggagaucaucaaccgcgugaucgcccgggcggagaagauggaggagauggagcaggagcgcaucgggcggcugguggaccgccucgagaacaugcggaagaacgucgccggcgacggggugaaccgcugcauccugugcggcgagcagcugggcaugcucgggagcgccugcguggucugcgaggacugcaagaagaacgugugcaccaagugcggcguggagaccaacaaccggcugcacuccgucuggcugugcaagaucugcaucgagcagcgcgagguguggaagcggagcggggccugguucuucaagggcuuccccaagcagguccucccgcagcccaugcccaucaagaagaccaagccccagcagccggucuccgagcccgccgcgcccgagcagcccgccccggagcccaagcaccccgcccgcgcccccgcgcgcggggacagcgaggaccggcggggcccgggccagaagacggggcccgaccccgccuccgcccccggccgcgggaacuacggcccgcccgugcggcgcgccagcgaggcccggauguccagcuccagccgcgacuccgagagcugggaccacuccggcggggcgggcgacagcagccgcucccccgccgggcugcggcgcgccaacagcgugcaggccucccggcccgccccgggcagcgugcagucccccgcgccgccccagcccgggcagcccggcacccccggcgggagccgcccgggccccgggcccgccggccgguuccccgaccagaagccggagguggcccccuccgaccccgggaccaccgcgcccccgcgcgaggagcggacgggcggcgucgggggcuaccccgccgugggggcccgcgaggaccggaugagccaccccuccggccccuacagccaggccuccgccgccgccccgcagcccgcggccgcccgccagccgccgccgcccgaggaggaggaggaggaggccaacagcuacgacuccgacgaggcgaccacccugggggcccucgaguucagccugcuguacgaccaggacaacuccagccuccagugcaccaucaucaaggccaagggccugaagcccauggacuccaacggccuggccgaccccuacgugaagcuccaccuccugcccggggccagcaaguccaacaagcugcggacgaagacccugcgcaacacccggaaccccaucuggaacgagacccugguguaccacggcaucacggacgaggacaugcagcgcaagacccuccggaucagcgucugcgacgaggacaaguucgggcacaacgaguucaucggcgagacccgcuucagccugaagaagcugaagcccaaccagcggaagaacuucaacaucugccucgagcgcgugauccccaugaagcgggcgggcaccacgggguccgcccgcggcauggcccuguacgaggaggagcaggucgagcgcgugggggacaucgaggagcggggcaagauccuggugagccucauguacuccacccagcagggcgggcugaucgucggcaucauccgcugcgugcaccuggccgccauggacgcgaacggguacagcgaccccuucgugaagcucuggcugaagcccgacaugggcaagaaggccaagcacaagacccagaucaagaagaagacccugaaccccgaguucaacgaggaguucuucuacgacaucaagcacuccgaccucgccaagaagucccuggacaucagcgucugggacuacgacaucggcaagagcaacgacuacaucggcgggugccagcuggggaucuccgccaagggcgagcggcucaagcacugguacgagugccugaagaacaaggacaagaagaucgagcgcuggcaccagcugcagaacgagaaccacgugagcuccgacuga

SEQ ID NO: 35854 - RNA, 948 nt, Artificial Sequence
  derived and/or modified sequence opt1 from RPH3AL__Homo_sapiens__XP_011545302
auggccgacaccaucuucggcagcgggaacgaccagugggugugccccaacgaccgccagcuggcccuccgggcgaagcugcagaccggcugguccguccacacguaccagaccgagaagcagcgccggaagcagcaccugagcccggccgagguggaggccauccuccaggugauccagcgcgccgagcggcuggacguccuggagcagcagcgcaucgggcggcucguggagcgccuggagaccaugcggcgcaacgugaugggcaacgggcugucccagugccuccugugcggcgagguccugggcuuccucgggagcuccagcguguucugcaaggacugccggaagaaggugugcaccaagugcggcaucgaggccucccccgggcagaagcgcccccuguggcugugcaagaucugcagcgagcagcgggaggucuggaagcgcuccggcgcgugguucuacaaggggcuccccaaguacauccugccgcugaagacgcccggccgggccgacgacccccacuuccgcccccucccgaccgagcccgccgagcgggagccccgcagcuccgagaccagccggaucuacaccugggcccgcggccgggugguguccagcgacuccgacagcgacuccgaccugagcuccagcagccuggaggaccgccuccccuccacggggguccgcgaccggaagggcgacaagccguggaaggagagcgggggcuccguggaggcgccccgcaugggcuucacccacccgcccgggcaccugagcggcugccaguccagccuggccuccggggagaccggcaccgggagcgccgacccgcccggcggcccccggcccgggcucacgcgccgggcccccgugaaggacacccccggccgcgcccccgcggccgacgccgcccccgccgggccguccagcugccugggcuga

SEQ ID NO: 35855 - RNA, 936 nt, Artificial Sequence
  derived and/or modified sequence opt1 from RPIA__Homo_sapiens__NP_653164
augcagcgccccggcccguucagcacccuguacgggcgggugcucgcgccccugcccggccgcgccgggggcgccgccuccgggggcggcgggaacagcugggaccugcccggcucccacguccggcucccggggcgcgcccagagcggcacccgcggcggggccgggaacacguccaccagcugcggggacuccaacagcaucugccccgcccccuccaccaugagcaaggcggaggaggccaagaagcuggccggccgggccgcgguggagaaccacgugcggaacaaccagguccuggggaucggcuccggcagcaccaucgugcacgccgugcagcgcaucgccgagcgggucaagcaggagaaccucaaccuggugugcauccccacguccuuccaggcccgccagcugauccuccaguacgggcugacccugagcgaccucgaccggcacccggagaucgaccuggccaucgacggcgcggacgagguggacgccgaccugaaccucaucaagggcggcgggggcugccugacccaggagaagaucgucgccggcuacgccucccgcuucaucgugaucgccgacuuccggaaggacagcaagaaccugggggaccaguggcacaagggcauccccaucgaggugauccccauggcguacguccccgugucccgcgccgugagccagaaguucgggggcgucguggagcuccggauggccgugaacaaggccgggccggucgugaccgacaacggcaacuucauccuggacuggaaguucgaccgcgugcacaagugguccgaggucaacacggccaucaagaugauccccggcgugguggacaccgggcuguucaucaacauggcggagcgggucuacuucggcaugcaggacgggagcgugaacaugcgcgagaagcccuucugcuga

SEQ ID NO: 35856 - RNA, 654 nt, Artificial Sequence
  derived and/or modified sequence opt1 from RPL10A__Homo_sapiens__NP_009035
augagcuccaaggugagccgcgacacccuguacgaggccguccgggaggugcuccacggcaaccagcgcaagcggcgcaaguuccuggagaccguggagcugcagaucucccucaagaacuacgacccccagaaggacaagcgguucagcgggacgguccgccugaaguccaccccgcggcccaaguucagcgugugcgugcugggcgaccagcagcacugcgacgaggccaaggcggucgacaucccccacauggacaucgaggcccucaagaagcugaacaagaacaagaagcuggugaagaagcucgccaagaaguacgacgccuuccuggccuccgagagccugaucaagcagaucccccgcauccucgggccgggccugaacaaggcggggaaguuccccucccugcucacccacaacgagaacaugguggccaaggucgacgaggucaagagcaccaucaaguuccagaugaagaaggugcugugccuggccguggccgugggccacgugaagaugacggacgacgagcucgucuacaacauccaccuggcggugaacuuccuggugucccuccugaagaagaacuggcagaacguccgggcccuguacaucaagagcaccaugggcaagccccagcgccucuacuga

SEQ ID NO: 35857 - RNA, 651 nt, Artificial Sequence
  derived and/or modified sequence opt1 from RPL10__Homo_sapiens__NP_001243506
augggccgccggcccgcccgcugcuaccgguacugcaagaacaagccguaccccaagagccgcuucugccgcggggugcccgacgccaagauccggaucuucgaccugggccggaagaaggcgaaggucgacgaguucccccucugcgggcacaugguguccgacgaguacgagcagcugagcuccgaggcccuggaggccgcccgcaucugcgccaacaaguacauggucaagagcugcggcaaggacggguuccacauccgggugcgccuccacccguuccacgugauccggaucaacaagaugcuguccugcgcgggcgccgaccgcagcaccucccagcggagcggcgccucccccagcuccaugcugaugaaccucaagaccugguggcucaagagcggguccagccagauggccgugggcuccagcacgucccccgucguggcgcuguggaccagcgggggccccugcacccacgagggguuccagugcgccgccccgcugcugauccugaccaacaaguucuacuuccucuccacguacguguucgucagcaccuuccugaccggcaaggagcugccccucggcaccuucgggagccugcccuuccacuuccgcaaccggcugacgacccagcccugcuccuga

SEQ ID NO: 35858 - RNA, 645 nt, Artificial Sequence
  derived and/or modified sequence opt1 from RPL10L__Homo_sapiens__NP_542784
augggccgccggcccgcccgcugcuaccgguacugcaagaacaagccguaccccaagagccgcuucugccgcggggugcccgacgccaagauccggaucuucgaccugggccggaagaaggcgaaggucgacgaguucccccucgggggccacaugguguccgacgaguacgagcagcugagcuccgaggcccuggaggccgcccgcaucugcgccaacaaguacauggucaagagcugcgggcgggacggcuuccacaugcgcgugcggcuccacccguuccacgugauccgcaucaacaagaugcuguccugcgcgggcgccgaccggcugcagaccgggaugcgcggcgccuucgggaagccccagggcaccguggcccggguccacaucggccaggugaucaugagcauccgcacgaagcuccagaacgaggagcacgugaucgaggcgcugcggcgcgccaaguucaaguuccccgggcggcagaagauccacaucuccaagaaguggggcuucaccaaguucaacgccgacgaguucgaggacauggucgccaagaagugccugauccccgacgggugcggcgugaaguacgugccgagccacgggccccucgacaaguggcgcguccugcacuccuga

SEQ ID NO: 35859 - RNA, 498 nt, Artificial Sequence
  derived and/or modified sequence opt1 from RPL12__Homo_sapiens__NP_000967
augcccccgaaguucgaccccaacgagaucaagguggucuaccugcgcugcaccggcggggaggugggcgccaccagcgcccucgcgcccaagaucgggccccugggccuguccccgaagaaggugggggacgacaucgccaaggccacgggcgacuggaagggccuccggaucaccgucaagcugaccauccagaaccgccaggcccagaucgagguggugcccagcgccuccgcgcugaucaucaaggcccucaaggagccgccccgggaccgcaagaagcagaagaacaucaagcacagcgggaacaucaccuucgacgagaucgucaacaucgcccggcagaugcgccaccggucccuggcccgcgagcugagcggcacgaucaaggagauccucgggaccgcgcaguccgugggcugcaacguggacgggcggcacccccacgacaucaucgacgacaucaacagcggcgccgucgagugccccgccuccuga

SEQ ID NO: 35860 - RNA, 495 nt, Artificial Sequence
  derived and/or modified sequence opt1 from RPL13__Homo_sapiens__NP_001230060
auggcccccagccgcaacggcauggugcugaagccgcacuuccacaaggacuggcagcggcgcgucgccaccugguucaaccagcccgcgcggaagauccgccggcgcaaggcccggcaggccaaggcccgccggaucgcgccccgccccgccuccgggccgauccggcccaucgugcgcugccccaccgugcgguaccacacgaagguccgcgccggccggggguucagccucgaggagcugcgcguggccggcauccacaagaagggggacuccagcgccgaggagcugaagcucgcgacccagcugaccggccccgugaugccgguccggaacguguacaagaaggagaaggcccgcgugaucaccgaggaggagaagaacuucaaggccuucgccucccugcggauggcccgcgcgaacgcccgccucuucggcauccgggccaagcgcgccaaggaggccgcggagcaggacgucgagaagaagaaguga

SEQ ID NO: 35861 - RNA, 648 nt, Artificial Sequence
  derived and/or modified sequence opt1 from RPL14__Homo_sapiens__NP_001030168
augguguuccgccgguucgucgaggugggccgcguggccuacgucagcuucgggccccacgccggcaagcugguggcgaucguggacgucaucgaccagaaccgggcccucguggacgggccgugcacccaggugcgccggcaggccaugcccuucaagugcaugcagcugaccgacuucauccugaaguucccccacuccgcccaccagaaguacguccgccaggccuggcagaaggcggacaucaacacgaagugggccgccacccggugggccaagaagaucgaggcgcgcgagcggaaggccaagaugaccgacuucgaccgcuucaaggugaugaaggccaagaagaugcggaaccgcaucaucaagaacgaggugaagaagcuccagaaggccgcccugcugaaggcgagccccaagaaggccccgggcaccaaggggacggccgccgccgcggccgccgccgccgcggccaagguccccgccaagaagaucaccgccgccuccaagaaggcgcccgcccagaaggugcccgcccagaaggccaccggccagaaggcggccccggcccccaaggcccagaagggccagaaggcccccgcgcagaaggcccccgccccgaaggccagcgggaagaaggccuga

SEQ ID NO: 35862 - RNA, 438 nt, Artificial Sequence
  derived and/or modified sequence opt1 from RPL15__Homo_sapiens__NP_001240313
augggcgccuacaaguacauccaggagcuguggcgcaagaagcagagcgacgugaugcgguuccuccugcgcguccggugcuggcaguaccgccagcuguccgcccuccaccgggcgccccgcccgacccggcccgacaaggcccgccggcugggguacaaggccaagcagggcuacgugaucuaccgcauccgggugcgccgcgggggccggaagcggcccguccccaagggggccaccuacggcaagccggugcaccacggcgugaaccagcugaaguucgcccgcagccuccaguccgucgcggaggagcgggccgggcgccacugcggcgcccugcgggugcugaacagcuacuggauggagucccacagccacuccgggggcagcgccguggggcagucccgccucacggcgaccagcgucucccggguguga

SEQ ID NO: 35863 - RNA, 687 nt, Artificial Sequence
  derived and/or modified sequence opt1 from RPL17-C18orf32__Homo_sapiens__NP_001186284
auggugcgcuacagccuggaccccgagaacccgaccaaguccugcaagagccggggcuccaaccuccgcguccacuucaagaacacccgggagacggcccaggccaucaaggggaugcacauccgcaaggcgaccaaguaccugaaggacgugacccugcagaagcagugcgugcccuuccggcgcuacaacggcggggucggccggugcgcccaggccaagcaguggggguggacccagggccgcuggcccaagaaguccgccgaguuccuccugcacaugcugaagaacgccgagagcaacgcggagcucaagggccuggacguggacagccuggugaucgagcacauccaggucaacaaggcccccaagaugcggcgccggacguaccgcgcccacgggcggaucaacccguacauguccagccccugccacaucgagaugauccucaccgagaaggagcagaucgugcccaagcccgaggaggagguggcccagaagaagaagcugcgcuccagcucccugggcaaguggugcgcguuccucgucagcuccuuccaguucugcagcggguccaccaagaacagcuggucccacaucuacacccugugguucccgcccagccuggugguguacggccuccggaagcaguacaagaaccccaugauccagacgaaggccaaguga

SEQ ID NO: 35864 - RNA, 555 nt, Artificial Sequence
  derived and/or modified sequence opt1 from RPL17__Homo_sapiens__NP_001030178
auggugcgcuacagccuggaccccgagaacccgaccaaguccugcaagagccggggcuccaaccuccgcguccacuucaagaacacccgggagacggcccaggccaucaaggggaugcacauccgcaaggcgaccaaguaccugaaggacgugacccugcagaagcagugcgugcccuuccggcgcuacaacggcggggucggccggugcgcccaggccaagcaguggggguggacccagggccgcuggcccaagaaguccgccgaguuccuccugcacaugcugaagaacgccgagagcaacgcggagcucaagggccuggacguggacagccuggugaucgagcacauccaggucaacaaggcccccaagaugcggcgccggacguaccgcgcccacgggcggaucaacccguacauguccagccccugccacaucgagaugauccucaccgagaaggagcagaucgugcccaagcccgaggaggagguggcccagaagaagaagaucucccagaagaagcugaagaagcagaagcugauggcgcgcgaguga

SEQ ID NO: 35865 - RNA, 567 nt, Artificial Sequence
  derived and/or modified sequence opt1 from RPL18__Homo_sapiens__NP_000970
augggcguggacauccgccacaacaaggaccggaagguccgccggaaggagcccaagagccaggacaucuaccugcgccuccuggugaagcuguaccgguuccucgcccgccggaccaacuccaccuucaaccaggugguccugaagcgccuguucaugagccggacgaaccgcccgccccucucccugagccggaugauccgcaagaugaagcugcccgggcgggagaacaagaccgccgugguggucggcaccaucaccgacgacgugcgcgugcaggagguccccaagcucaaggugugcgcgcugcgggugacgucccgcgcccggagccgcauccugcgggccgggggcaagauccucaccuucgaccagcuggcccuggacuccccgaaggggugcggcaccguccuccugagcggcccccgcaaggggcgggagguguaccgccacuucggcaaggcccccgggacgccccacucccacaccaagccguacgugcgcagcaagggccggaaguucgagcgcgcgcgggggcgccgggccucccgcggcuacaagaacuga

SEQ ID NO: 35866 - RNA, 591 nt, Artificial Sequence
  derived and/or modified sequence opt1 from RPL19__Homo_sapiens__NP_000972
augagcaugcugcgccuccagaagcggcuggccuccagcgugcugcgcugcggcaagaagaaggucuggcucgaccccaacgagaccaacgagaucgccaacgcgaacucccggcagcagauccgcaagcugaucaaggacgggcugaucauccggaagccggugaccgugcacagccgcgcccggugccgcaagaacacgcucgcccggcgcaagggccggcacauggggaucggcaagcgcaaggggaccgccaacgcccggaugcccgagaaggucaccuggaugcgccggaugcgcauccugcggcgccugcuccggcgcuaccgggaguccaagaagaucgaccgccacauguaccacagccuguaccugaaggugaagggcaacguguucaagaacaagcgcauccucauggagcacauccacaagcugaaggcggacaaggcccggaagaagcugcucgccgaccaggccgaggcgcgccgguccaagaccaaggaggcccgcaagcggcgcgaggagcggcugcaggccaagaaggaggagaucaucaagacgcugagcaaggaggaggagaccaagaaguga

SEQ ID NO: 35867 - RNA, 483 nt, Artificial Sequence
  derived and/or modified sequence opt1 from RPL21__Homo_sapiens__NP_000973
augaccaacaccaagggcaagcgccgggggacgcgcuacauguucagccggcccuuccgcaagcacggcguggucccgcuggccaccuacaugcggaucuacaagaagggggacaucguggacaucaagggcauggggaccgugcagaagggcaugccccacaagugcuaccacggcaagaccgggcgcgucuacaacgugacgcagcacgccgugggcaucgucgugaacaagcaggucaaggggaagauccucgccaagcggaucaacgugcgcaucgagcacaucaagcacuccaagagccgggacuccuuccugaagcgcgugaaggagaacgaccagaagaagaaggaggccaaggagaagggcaccugggugcagcugaagcggcagcccgcgcccccgcgcgaggcccacuucguccggaccaacgggaaggagcccgagcuccuggagcccauccccuacgaguucauggccuga

SEQ ID NO: 35868 - RNA, 471 nt, Artificial Sequence
  derived and/or modified sequence opt1 from RPL23A__Homo_sapiens__NP_000975
auggcccccaaggccaagaaggaggcgccggccccgcccaaggccgaggccaaggccaaggcgcugaaggccaagaaggccgugcucaagggcguccacagccacaagaagaagaagauccgcaccucccccaccuuccggcgccccaagacgcugcggcugcgccggcagcccaaguacccccgcaagagcgcgccccggcgcaacaagcucgaccacuacgccaucaucaaguucccgcugaccaccgaguccgccaugaagaagaucgaggacaacaacacccugguguucaucguggacgucaaggccaacaagcaccagaucaagcaggccgugaagaagcucuacgacaucgacguggccaaggucaacacgcugauccggcccgacggggagaagaaggcguacgugcgccuggcccccgacuacgacgcccucgacguggccaacaagaucggcaucaucuga

SEQ ID NO: 35869 - RNA, 423 nt, Artificial Sequence
  derived and/or modified sequence opt1 from RPL23__Homo_sapiens__NP_000969
augagcaagcgcggccgcgggggcuccagcggggccaaguuccggaucucccugggccuccccgugggggccgucaucaacugcgcggacaacaccggcgccaagaaccuguacaucaucagcgugaagggcaucaaggggcggcugaaccgccucccggccgccggcgugggggacauggucauggccaccgugaagaagggcaagcccgagcugcggaagaaggugcaccccgcggucgugauccgccagcggaaguccuaccgccggaaggacgggguguuccuguacuucgaggacaacgccggcgucaucgugaacaacaagggcgagaugaaggggagcgccaucacgggccccguggccaaggagugcgcggaccucuggccgcgcaucgccuccaacgccgggagcaucgccuga

SEQ ID NO: 35870 - RNA, 474 nt, Artificial Sequence
  derived and/or modified sequence opt1 from RPL24__Homo_sapiens__NP_000977
augaagguggagcugugcagcuucuccggcuacaagaucuaccccgggcacggccgccgguacgcccgcaccgacgggaaggucuuccaguuccucaacgccaagugcgagagcgccuuccuguccaagcggaacccgcgccagaucaacuggaccgugcuguaccggcgcaagcacaagaagggccagagcgaggagauccagaagaagcggacgcgccgggccgugaaguuccagcgcgccaucaccggggccucccucgccgacaucauggcgaagcggaaccagaagcccgagguccgcaaggcccagcgggagcaggccauccgcgccgcgaaggaggccaagaaggccaagcaggccagcaagaagaccgccauggcggccgccaaggcccccaccaaggccgcgcccaagcagaagaucgugaagccggugaaggucuccgcgccccgggugggcggcaagcgcuga

SEQ ID NO: 35871 - RNA, 447 nt, Artificial Sequence
  derived and/or modified sequence opt1 from RPL27A__Homo_sapiens__NP_000981
augcccagccgccugcggaagacccgcaagcuccggggccacgugucccacgggcacggccgcaucgggaagcaccggaagcacccgggcgggcgcggcaacgccggcgggcugcaccaccaccggaucaacuucgacaaguaccaccccggcuacuucgggaaggucggcaugaagcacuaccaccugaagcgcaaccagagcuucugccccaccgugaaccucgacaagcuguggacgcugguguccgagcagacccgggucaacgccgcgaagaacaagaccggggccgcccccaucaucgacguggugcgcagcggcuacuacaagguccucggcaaggggaagcugccgaagcagcccgugaucgugaaggccaaguucuucucccggcgcgccgaggagaagaucaagagcgucggcggggcgugcgugcugguggccuga

SEQ ID NO: 35872 - RNA, 480 nt, Artificial Sequence
  derived and/or modified sequence opt1 from RPL29__Homo_sapiens__NP_000983
auggccaagagcaagaaccacaccacccacaaccagucccgcaaguggcaccggaacggcaucaagaagccccgcagccagcgguacgagucccugaaggggguggacccgaaguuccuccgcaacaugcgguucgccaagaagcacaacaagaagggccugaagaagaugcaggcgaacaacgccaaggccaugagcgcccgcgccgaggcgaucaaggcccuggucaagcccaaggaggugaagcccaagauccccaagggggugucccggaagcucgaccgccuggccuacaucgcccacccgaagcugggcaagcgggcgcgcgcccggaucgccaaggggcuccgccugugccggcccaaggccaaggccaaggcgaaggccaaggaccagacgaaggcccaggccgccgcgcccgccagcguccccgcccaggccccgaagcgcacccaggcccccaccaaggcguccgaguga

SEQ ID NO: 35873 - RNA, 348 nt, Artificial Sequence
  derived and/or modified sequence opt1 from RPL30__Homo_sapiens__NP_000980
augguggccgccaagaagaccaagaagucccuggagagcaucaacagccgccuccagcuggucaugaaguccggcaaguacgugcugggguacaagcagacccucaagaugauccggcagggcaaggcgaagcuggugauccuggccaacaacugccccgcccuccgcaagagcgagaucgaguacuacgccaugcuggccaagacggggguccaccacuacuccggcaacaacaucgagcuggggaccgcgugcggcaaguacuaccgggugugcacccucgccaucaucgacccgggcgacagcgacaucauccgcuccaugcccgagcagaccggggagaaguga

SEQ ID NO: 35874 - RNA, 378 nt, Artificial Sequence
  derived and/or modified sequence opt1 from RPL31__Homo_sapiens__NP_000984
auggcccccgccaagaagggcggggagaagaagaagggccgcagcgcgaucaacgagguggucacccgggaguacaccaucaacauccacaagcgcauccacggggugggcuucaagaagcgggccccgcgcgcccugaaggagauccggaaguucgccaugaaggagauggggacgcccgacgugcgcaucgacacccggcucaacaaggccgucugggcgaagggcauccgcaacgugcccuaccggauccgcgugcggcugucccgcaagcggaacgaggacgaggacagccccaacaagcuguacacccucgucaccuacgugccggugacgaccuucaagaaccugcagaccgucaacguggacgagaacuga

SEQ ID NO: 35875 - RNA, 354 nt, Artificial Sequence
  derived and/or modified sequence opt1 from RPL34__Homo_sapiens__NP_001306164
auggugcagcgccugaccuaccggcgccggcucagcuacaacaccgccuccaacaagacgcgccugagccggacccccggcaaccgcaucgucuaccuguacaccaagaagguggggaaggccccgaaguccgcgugcggcgugugccccgggcggcuccgcggcguccgggccgugcgccccaaggugcugaugcggcugagcaagaccaagaagcacgucucccgcgccuacgggggcagcaugugcgccaagugcgugcgggaccgcaucaagcgggccuuccucaucgaggagcagaagaucguggucaaggugcugaaggcgcaggcccagucccagaaggccaaguga

SEQ ID NO: 35876 - RNA, 372 nt, Artificial Sequence
  derived and/or modified sequence opt1 from RPL35__Homo_sapiens__NP_009140
auggccaagaucaaggcccgcgaccugcggggcaagaagaaggaggagcuccugaagcagcuggacgaccucaagguggagcugagccagcugcgcgucgcgaaggugaccgggggcgccgccuccaagcucagcaagauccgggugguccgcaaguccaucgcccgggugcugaccgugaucaaccagacgcagaaggagaaccugcgcaaguucuacaaggggaagaaguacaagccccucgaccugcggccgaagaagacccgcgccaugcggcgccggcugaacaagcacgaggagaaccucaagaccaagaagcagcagcgcaaggagcggcuguacccccugcgcaaguacgcggucaaggccuga

SEQ ID NO: 35877 - RNA, 429 nt, Artificial Sequence
  derived and/or modified sequence opt1 from RPL36A__Homo_sapiens__NP_066357
augaucgcccccaccgacagccacgaggaggugcgcuccggcaccagcuacauccugccguucgccucccgguuccucagcuuccgcgcggacuccgcccacgccagcauggucaacgugcccaagacgcggcgcaccuucugcaagaagugcgggaagcaccagccccacaaggugacccaguacaagaagggcaaggacucccuguacgcccaggggaagcggcgcuacgaccggaagcagagcggcuacgggggccagaccaagcccaucuuccgcaagaaggccaagacgaccaagaagaucguccugcggcucgagugcguggagccgaacugccgcuccaagcggaugcuggcgaucaagcgcugcaagcacuucgagcugggcggggacaagaagcggaagggccaggugauccaguucuga

SEQ ID NO: 35878 - RNA, 321 nt, Artificial Sequence
  derived and/or modified sequence opt1 from RPL36AL__Homo_sapiens__NP_000992
auggugaacguccccaagacccgccggaccuucugcaagaagugcgggaagcaccagccgcacaaggugacgcaguacaagaaggggaaggacagccuguacgcccagggccgccggcgcuacgaccggaagcaguccggguacggcgggcagaccaagcccaucuuccgcaagaaggccaagaccaccaagaagaucgugcuccggcuggagugcgucgagcccaacugccgcagcaagcggaugcuggcgaucaagcgcugcaagcacuucgagcucggcggcgacaagaagcggaagggccaggugauccaguucuga

SEQ ID NO: 35879 - RNA, 279 nt, Artificial Sequence
  derived and/or modified sequence opt1 from RPL37A__Homo_sapiens__NP_000989
auggccaagcgcaccaagaaggugggcaucgucgggaaguacggcacccgguacggggccagccugcgcaagauggugaagaagaucgagaucucccagcacgcgaaguacacgugcagcuucugcggcaagaccaagaugaagcggcgcgccguggggaucuggcacugcggcuccugcaugaagaccgucgccggcggggccuggaccuacaacacgaccagcgccgugaccgugaaguccgcgauccggcgccucaaggagcugaaggaccaguga

SEQ ID NO: 35880 - RNA, 213 nt, Artificial Sequence
  derived and/or modified sequence opt1 from RPL38__Homo_sapiens__NP_000990
augccccgcaagaucgaggagaucaaggacuuccugcucaccgcccggcgcaaggacgccaagagcgugaagaucaagaagaacaaggacaacgucaaguucaaggugcggugcucccgcuaccuguacacccuggugaucacggacaaggagaaggcggagaagcucaagcagagccugccgcccggccuggccgucaaggagcucaaguga

SEQ ID NO: 35881 - RNA, 156 nt, Artificial Sequence
  derived and/or modified sequence opt1 from RPL39__Homo_sapiens__NP_000991
augagcucccacaagaccuuccgcaucaagcgguuccuggccaagaagcagaagcagaaccgccccaucccgcaguggauccggaugaagaccggcaacaagauccgcuacaacagcaagcggcgccacuggcggcgcacgaagcucgggcuguga

SEQ ID NO: 35882 - RNA, 156 nt, Artificial Sequence
  derived and/or modified sequence opt1 from RPL39L__Homo_sapiens__NP_443201
augagcucccacaagaccuucaccaucaagcgcuuccuggccaagaagcagaagcagaaccggcccaucccgcaguggauccagaugaagcccggcagcaagauccgcuacaacuccaagcggcgccacuggcggcgcacgaagcucgggcuguga

SEQ ID NO: 35883 - RNA, 1212 nt, Artificial Sequence
  derived and/or modified sequence opt1 from RPL3__Homo_sapiens__NP_000958
augagccaccgcaaguucuccgcgccccggcacggcagccugggguuccucccgcgcaagcgguccagccgccaccggggcaaggugaaguccuuccccaaggacgaccccagcaagcccguccaccugaccgccuuccugggguacaaggccggcaugacccacaucgugcgcgagguggaccggccgggguccaaggucaacaagaaggaggugguggaggccgucacgaucguggagaccccgcccaugguggucgugggcaucgugggcuacgucgagacgccccgcgggcuccggaccuucaagaccguguucgccgagcacaucagcgacgagugcaagcgccgguucuacaagaacuggcacaaguccaagaagaaggccuucaccaaguacugcaagaaguggcaggacgaggacggcaagaagcagcuggagaaggacuucagcuccaugaagaaguacugccaggugauccgcgucaucgcccacacccagaugcggcugcucccccugcgccagaagaaggcgcaccugauggagauccaggugaacgggggcaccguggccgagaagcucgacugggcccgggagcgccuggagcagcagguccccgugaaccagguguucgggcaggacgagaugaucgacgucaucggcgugacgaagggcaagggguacaagggcgugaccagccgguggcacaccaagaagcugccccgcaagacccaccgggggcuccgcaaggucgccugcaucggcgcguggcaccccgcccggguggccuucuccgucgcccgcgccggccagaagggguaccaccaccgcacggagaucaacaagaagaucuacaagaucggccagggguaccugaucaaggacggcaagcugaucaagaacaacgcgagcaccgacuacgaccucuccgacaagagcaucaacccgcucgggggcuucgugcacuacggcgaggugaccaacgacuucgucaugcugaaggggugcguggugggcaccaagaagcggguccugacgcugcgcaagucccugcucgugcagaccaagcggcgcgcccuggagaagaucgaccugaaguucaucgacaccaccagcaaguucgggcacggccgguuccagacgauggaggagaagaaggccuucauggggccccucaagaaggaccgcaucgccaaggaggagggcgccuga

SEQ ID NO: 35884 - RNA, 78 nt, Artificial Sequence
  derived and/or modified sequence opt1 from RPL41__Homo_sapiens__NP_066927
augcgcgccaaguggcggaagaagcgcaugcggcgccugaagcggaagcgccggaagaugcgccagcggagcaaguga

SEQ ID NO: 35885 - RNA, 1284 nt, Artificial Sequence
  derived and/or modified sequence opt1 from RPL4__Homo_sapiens__NP_000959
auggccugcgcccgcccccugaucagcguguacuccgagaagggcgagagcuccgggaagaacgucacccucccggcgguguucaaggcccccauccggcccgacaucgugaacuucguccacaccaaccugcgcaagaacaaccggcagcccuacgccgugagcgagcuggccggccaccagacguccgccgagagcugggggaccggccgcgcgguggcccggaucccgcgcguccgcgggggcggcacccaccgguccgggcagggcgccuucgggaacaugugccggggcgggcgcauguucgcccccaccaagacguggcggcgcuggcaccggcgcgugaacaccacccagaagcgguacgcgaucugcagcgcccucgccgccuccgcccugcccgcgcuggugaugagcaagggccaccgcaucgaggagguccccgagcucccgcuggugguggaggacaaggucgagggcuacaagaagaccaaggaggccgugcugcuccugaagaagcugaaggccuggaacgacaucaagaagguguacgccucccagcggaugcgcgccgggaagggcaagaugcggaaccgccggcgcauccagcgccgggggcccugcaucaucuacaacgaggacaacggcaucaucaaggcguuccgcaacauccccggcaucacgcuccugaacgucagcaagcugaacauccucaagcuggcccccgggggccacguggggcgguucugcaucuggaccgaguccgccuuccgcaagcuggacgagcucuacggcaccuggcggaaggccgccagccugaaguccaacuacaaccugccgaugcacaagaugaucaacaccgaccucagccgcauccugaagucccccgagauccagcgggcgcugcgcgcgccccggaagaagauccaccgccgggugcucaagaagaacccccugaagaaccugcgcaucaugcucaagcugaacccguacgccaagacgaugcggcgcaacaccauccugcggcaggcccgcaaccacaagcuccgggucgacaaggccgccgccgccgccgcggcccugcaggccaagagcgacgagaaggccgccguggcggggaagaagcccguggucggcaagaagggcaagaaggccgccgugggggugaagaagcagaagaagccccuggucggcaagaaggccgccgcgaccaagaagcccgccccggagaagaagcccgccgagaagaagcccaccacggaggagaagaagcccgccgccuga

SEQ ID NO: 35886 - RNA, 867 nt, Artificial Sequence
  derived and/or modified sequence opt1 from RPL6__Homo_sapiens__NP_001307069
auggccggcgagaagguggagaagcccgacaccaaggagaagaagccggaggccaagaaggucgacgccgggggcaaggugaagaaggggaaccugaaggcgaagaagcccaagaagggcaagccccacugcagccgcaaccccgugcucguccgggggaucggccgcuacucccggagcgccauguacucccgcaaggccauguacaagcggaaguacagcgccgcgaaguccaagguggagaagaagaagaaggagaaggugcuggccaccgucacgaagccggugggcggggacaagaacggcgggacccgcguggucaagcugcggaagaugccccgcuacuaccccaccgaggacgugccccggaagcuccugagccacggcaagaagccguucucccagcacgugcgcaagcugcgggccagcaucacccccgggacgauccucaucauccugaccggccgccaccggggcaagcgcgucguguuccugaagcagcucgccuccgggcugcugcucgugaccggcccccugguccugaaccgggugccccuccgccggacccaccagaaguucgugaucgcgacgagcaccaagaucgacaucuccaacgucaagaucccgaagcaccugaccgacgccuacuucaagaagaagaagcugcgcaagccccggcaccaggagggggagaucuucgacaccgagaaggagaaguacgagaucacggagcagcgcaagaucgaccagaaggccguggacagccagauccuccccaagaucaaggccaucccccagcugcagggcuaccugcgguccguguucgcccucaccaacggcaucuacccgcacaagcuggucuucuga

SEQ ID NO: 35887 - RNA, 801 nt, Artificial Sequence
  derived and/or modified sequence opt1 from RPL7A__Homo_sapiens__NP_000963
augcccaagggcaagaaggccaaggggaagaagguggccccggcgcccgccgucgugaagaagcaggaggccaagaagguggucaacccccuguucgagaagcgccccaagaacuucggcaucgggcaggacauccagccgaagcgggaccucacccgcuucgugaaguggccccgguacauccgccugcagcggcagcgcgccauccuguacaagcggcucaaggugccgcccgccaucaaccaguucacccaggcgcuggaccgccagacggccacccagcugcucaagcuggcccacaaguaccggcccgagaccaagcaggagaagaagcagcgccugcucgcccgggcggagaagaaggccgccggcaagggggacguccccaccaagcgcccgcccgugcugcgggccggcgugaacacggucaccacccugguggagaacaagaaggcccagcucguggucaucgcgcacgacguggaccccaucgagcugguggucuuccugcccgcccucugccgcaagaugggcgugcccuacugcaucaucaaggggaaggcccggcugggccgccuggugcaccggaagaccugcacgaccgucgccuucacccaggugaacagcgaggacaagggggcccucgcgaagcugguggaggccauccgcaccaacuacaacgaccgguacgacgagauccgccggcacuggggcgggaacguccugggccccaaguccguggcccgcaucgccaagcucgagaaggccaaggcgaaggagcuggccacgaagcugggcuga

SEQ ID NO: 35888 - RNA, 747 nt, Artificial Sequence
  derived and/or modified sequence opt1 from RPL7__Homo_sapiens__NP_000962
auggagggcguggaggagaagaagaaggagguccccgccgugccggagacccugaagaagaagcgccggaacuucgccgagcucaagaucaagcgccugcggaagaaguucgcgcagaagaugcugcgcaaggcccggcgcaagcucaucuacgagaaggccaagcacuaccacaaggaguaccggcagauguaccgcaccgagauccggauggcccgcauggcccggaaggcggggaacuucuacgugcccgccgagcccaagcuggccuucgucauccgcauccggggcaucaacggggugagccccaaggugcgcaagguccugcagcuccugcggcugcgccagaucuucaacggcacguucgugaagcucaacaaggccuccaucaacaugcugcggaucguggagccguacaucgcguggggguaccccaaccugaaguccgucaacgagcucaucuacaagcgcggcuacggcaagaucaacaagaagcggaucgcccugaccgacaacgcccugaucgcccgcucccucgggaaguacggcaucaucugcauggaggaccugauccacgagaucuacaccguggggaagcgguucaaggaggccaacaacuuccuguggcccuucaagcucagcagcccccgcggcgggaugaagaagaagaccacgcacuucguggagggcggcgacgcggggaaccgcgaggaccagaucaaccggcugauccgccggaugaacuga

SEQ ID NO: 35889 - RNA, 954 nt, Artificial Sequence
  derived and/or modified sequence opt1 from RPLP0__Homo_sapiens__NP_000993
augccccgcgaggaccgggccaccuggaaguccaacuacuuccugaagaucauccagcuccuggacgacuacccgaagugcuucaucgugggggccgacaacgucgggagcaagcagaugcagcagauccgcaugagccugcggggcaaggcgguggugcucauggggaagaacaccaugaugcgcaaggccauccggggccaccuggagaacaaccccgcccuggagaagcuccugccccacauccgcgggaacgucggcuucguguucacgaaggaggaccugaccgagauccgggacaugcuccuggccaacaaggugcccgccgcggcccgcgccggcgccaucgcgccgugcgaggucaccgugcccgcccagaacaccgggcugggccccgagaagacguccuucuuccaggcccucgggaucaccaccaagaucagccggggcaccaucgagauccuguccgacgugcagcugaucaagacgggggacaaggucggcgccagcgaggccacccuccugaacaugcugaacaucucccccuucagcuucggccucgugauccagcaggucuucgacaacggguccaucuacaacccggaggugcuggacaucaccgaggagacccugcacagccgcuuccucgagggcgugcggaacguggcguccgucugccugcagaucggguaccccacgguggccagcgugccccacuccaucaucaacggcuacaagcgcguccuggcccucagcguggagaccgacuacaccuucccccuggccgagaaggugaaggccuuccuggcggacccguccgccuucgucgccgccgcccccguggcggccgccaccacggccgcccccgcggccgccgccgcgcccgccaagguggaggccaaggaggagagcgaggaguccgacgaggacaugggcuucggccucuucgacuga

SEQ ID NO: 35890 - RNA, 345 nt, Artificial Sequence
  derived and/or modified sequence opt1 from RPLP1__Homo_sapiens__NP_000994
auggccagcguguccgagcuggccugcaucuacagcgcgcucauccugcacgacgacgaggucaccgugaccgaggacaagaucaacgcccugaucaaggccgccggggugaacgucgagcccuucuggccgggccucuucgccaaggcgcuggccaacgugaacaucgggucccugaucugcaacgugggggccggcgggcccgcccccgcggccggcgccgcccccgccggcgggccggcgcccagcacggccgccgcccccgccgaggagaagaaggucgaggcgaagaaggaggaguccgaggagagcgacgacgacaugggcuucggccucuucgacuga

SEQ ID NO: 35891 - RNA, 1824 nt, Artificial Sequence
  derived and/or modified sequence opt1 from RPN1__Homo_sapiens__NP_002941
auggaggcccccgccgcgggccuguuccuccugcugcuccuggggaccugggccccggcccccggcagcgccuccagcgaggccccgccccugaucaacgaggacgugaagcgcaccgucgaccucuccagccaccuggcgaaggugacggccgaggugguccuggcccaccucgggggcggguccaccagccgggccaccuccuuccugcuggcgcucgagcccgagcuggaggcccgccuggcccaccucggcguccaggugaagggcgaggacgaggaggagaacaaccuggaggugcgggagaccaagaucaagggcaagagcgggcgcuucuucacggugaagcugcccguggcccucgaccccggggccaagaucuccgucaucguggagaccguguacacccacguccugcaccccuacccgacccagaucacgcagagcgagaagcaguucgugguguucgagggcaaccacuacuucuacucccccuaccccaccaagacccagaccaugcgggucaagcuggcgagccgcaacguggaguccuacacgaagcucgggaaccccacccggagcgaggaccugcuggacuacggcccguuccgcgacgugcccgccuacucccaggacaccuucaagguccacuacgagaacaacagccccuuccucaccaucacguccaugacccgggugaucgaggugagccacuggggcaacaucgccgucgaggagaacguggaccugaagcacaccggggccgugcugaagggccccuucucccgcuacgacuaccagcggcagccggacagcgggaucagcuccauccgcagcuucaagaccauccuccccgccgcggcccaggacgucuacuaccgggacgagaucggcaacguguccacgagccaccuccugauccuggacgacuccgucgagauggagauccgcccccgguucccccuguucggcggguggaagacccacuacaucgugggcuacaaccugccgagcuacgaguaccucuacaaccugggggaccaguacgcccugaagaugcgcuucguggaccacgucuucgacgagcaggucaucgacucccucaccgugaagaucauccugcccgagggcgccaagaacaucgagaucgacagccccuacgagaucucccgggcccccgacgagcugcacuacaccuaccucgacacguucgggcgcccggugaucguggcguacaagaagaaccugguggagcagcacauccaggacaucgucgugcacuacaccuucaacaaggugcugaugcuccaggagccccugcuggucguggccgccuucuacauccucuucuucaccgugaucaucuacguccggcuggacuucagcaucaccaaggaccccgccgccgaggcgcgcaugaagguggccugcaucacggagcagguccugacccucgugaacaagcggaucggccuguaccgccacuucgacgagaccgugaaccgcuacaagcagucccgggacaucagcacccugaacuccggcaagaagucccuggagacggagcacaaggcccucaccagcgagaucgcccugcugcagagccgccucaagaccgagggguccgaccugugcgaccgggugagcgagaugcagaagcuggacgcgcaggucaaggagcucgugcugaaguccgccguggaggccgagcgccuggucgccggcaagcucaagaaggacaccuacaucgagaacgagaagcugaucagcgggaagcggcaggagcuggugacgaagaucgaccacauccucgacgcccuguga

SEQ ID NO: 35892 - RNA, 1848 nt, Artificial Sequence
  derived and/or modified sequence opt1 from RPN2__Homo_sapiens__NP_001129243
auggcgcccccgggcagcuccaccguguuccugcucgcccugaccaucaucgccagcacgugggcccugacccccacccacuaccucaccaagcacgacgucgagcgccugaaggccucccuggaccggcccuucacgaaccucgagagcgccuucuacuccaucguggggcugagcucccugggcgcccaggugcccgacgcgaagaucagcaucuccaacgagaccaaggaccuccugcuggccgccgucagcgaggacuccagcgugacccagaucuaccacgccguggcggcccucuccggguucggccugccgcuggccagccaggaggcccucuccgcccugaccgcgcgccugagcaaggaggagacgguccucgccaccgugcaggcccugcagaccgccucccaccugagccagcaggccgaccuccgguccaucguggaggagaucgaggaccuggucgcgcgccuggacgagcucgggggcguguaccugcaguucgaggagggccuggagaccacggcccucuucguggccgccaccuacaagcugauggaccacgucgggaccgagcccagcaucaaggaggaccaggugauccagcugaugaacgccaucuucagcaagaagaacuucgagucccucagcgaggcguucuccguggccagcgccgccgccguccugucccacaaccgguaccacgugcccguggucguggugcccgagggcagcgcguccgacacccacgagcaggccauccugcgccuccaggucacgaacgugcugagccagccgcugacccaggccaccgugaagcucgagcacgccaaguccgucgcgagccgggccaccgugcugcagaagacguccuucacccccgucggggacguguucgagcugaacuucaugaacgugaaguucagcuccggcuacuacgacuuccucgucgagguggagggggacaaccgcuacaucgccaacaccguggagcugcgggucaagaucagcaccgaggugggcaucacgaacguggaccuguccaccgucgacaaggaccagagcaucgcccccaagaccacccgcgugacguaccccgccaaggcgaagggcaccuucaucgccgacucccaccagaacuucgcccucuucuuccagcugguggacgucaacaccggggccgagcugaccccgcaccagacguucgugcggcuccacaaccagaagaccggccaggagguggucuucguggccgagcccgacaacaagaacguguacaaguucgagcuggacaccagcgagcgcaagaucgaguucgacuccgcgagcgggaccuacacgcuguaccucaucaucggcgacgccacccugaagaaccccauccuguggaacgucgccgacguggugaucaaguuccccgaggaggaggccccgagcaccguccugucccagaaccucuucacccccaagcaggagauccagcaccuguuccgggagcccgagaagcggcccccgaccguggugagcaacacguucaccgcccugauccucagcccccugcugcuccuguucgcgcuguggauccgcaucggcgccaacgucuccaacuucaccuucgcccccuccaccaucaucuuccaccucgggcacgccgcgaugcugggccugauguacguguacuggacgcagcucaacauguuccagacccugaaguaccuggccauccucgggagcgugaccuuccuggccggcaaccgcaugcuggcccagcaggccgucaagcggaucgcggccgagcaguccagccgccucgccaaguaccggacccugcgcacggcccacuga

SEQ ID NO: 35893 - RNA, 375 nt, Artificial Sequence
  derived and/or modified sequence opt1 from RPP14__Homo_sapiens__NP_001092253
augcccgccccggccgcgaccuacgagcgcguggucuacaagaaccccagcgaguaccacuacaugaaggugugccuggaguuccaggacugcggcguggggcucaacgccgcccaguucaagcagcugcugaucuccgccgucaaggaccucuucggcgagguggacgccgcgcugccccuggacauccucaccuacgaggagaagacgcugagcgccauccugcggaucugcuccagcgggcucgugaagcugugguccagccugacccuccugggcuccuacaaggggaagaagugcgccuuccgcgucauccaggugagccccuuccugcucgcccuguccggcaacagccgggagcuggugcucgacuga

SEQ ID NO: 35894 - RNA, 489 nt, Artificial Sequence
  derived and/or modified sequence opt1 from RPP21__Homo_sapiens__NP_001186049
auggccggccccgugaaggaccgcgaggccuuccagcggcugaacuuccucuaccaggcggcccacugcguccuggcccaggacccggagaaccaggcccuggcccgcuucuacugcuacaccgagcggaccaucgcgaagcgccucgugcugcggcgcccccugagcuccagcgcgccccgggaccccuccgugaagcgcacgcucugccgggggugcagcucccugcuggucccgggccucacgugcacccagcgccagcggcgcugccgggggcagcgcuggaccgugcagaccugccugaccugccagcggagccagcgcuuccugaacgaccccggccaccuccuguggggcgaccggcccgaggcccagcuggggucccaggccgacagcaagccccuccagccgcugcccaacaccgcccacuccaucagcgaccgccugcccgaggagaagaugcagacccagggcuccagcaaccaguga

SEQ ID NO: 35895 - RNA, 600 nt, Artificial Sequence
  derived and/or modified sequence opt1 from RPP25__Homo_sapiens__NP_060263
auggagaacuuccgcaaggugcggagcgaggaggcccccgccggcugcggggcggagggcgggggcccgggguccggccccuucgccgaccuggcccccggcgccguccacaugcgcgugaaggaggggagcaagauccggaaccucauggccuucgcgaccgccuccauggcccagcccgccacccgcgcgaucguguucagcggcugcgggcgggccacgaccaagaccgugaccugcgccgagauccugaagcgccggcuggccggccuccaccaggucacgcgccugcgguaccgcuccgugcgggaggucuggcagagccugccgcccgggcccacccagggccagacccccggcgagccggccgcgucccucagcgugcugaagaacgugcccgggcuggccauccuccuguccaaggacgcccuggacccccgccagcccggcuaccagccgcccaacccccaccccgggccgagcuccccgcccgccgcccccgcgagcaagcggucccucggcgagcccgccgccggcgaggggagcgccaagcgcucccagcccgagcccggcgucgccgacgaggaccagaccgcguga

SEQ ID NO: 35896 - RNA, 852 nt, Artificial Sequence
  derived and/or modified sequence opt1 from RPP38__Homo_sapiens__NP_001252530
auggccgccgcgccccaggcccccggccgcgggagccugcggaagacccgcccccucguggucaagaccucccugaacaaccccuacaucauccgguggagcgcccuggaguccgaggacaugcacuucauccuccagacgcuggaggaccgccugaaggccaucggccuccagaagaucgaggacaagaagaagaagaacaagacccccuuccugaagaaggagagccgggagaagugcuccaucgccguggacaucagcgagaaccugaaggagaagaagaccgacgcgaagcagcaggucuccggguggaccccggcccacgugcgcaagcagcucgccaucggcgugaacgaggugacgcgggcccuggagcgccgggagcugcuccugguccuggugugcaagagcgugaagcccgcgaugaucaccucccaccucauccagcugagccugucccgcagcguccccgccugccaggugccccggcucuccgagcgcaucgccccggugaucgggcugaagugcguccuggcccucgccuucaagaagaacaccaccgacuucguggacgaggugcgggcgaucaucccccgcguccccagccuguccgugcccuggcugcaggaccggaucgaggacagcggcgagaaccucgagacggagccgcuggagucccaggaccgcgagcugcucgacaccagcuucgaggaccuguccaagcccaagcggaagcuggccgacggccgccaggccagcgugacccuccagccccugaagaucaagaagcugauccccaacccgaacaagauccggaagccgcccaagagcaagaaggccacccccaaguga

SEQ ID NO: 35897 - RNA, 1092 nt, Artificial Sequence
  derived and/or modified sequence opt1 from RPP40__Homo_sapiens__NP_006629
auggccacccugcgccggcuccgcgaggcgccccggcaccuccuggugugcgagaaguccaacuucggcaaccacaagagccgccaccggcaccugguccagacccacuacuacaacuaccgcgugagcuuccugauccccgagugcgggauccuguccgaggagcucaagaaccuggugaugaacacgggccccuacuacuucgucaagaaccugccccuccacgagcugaucacccccgaguucaucagcaccuucaucaagaagggguccugcuacgcccugaccuacaacacgcacaucgacgaggacaacaccguggcccuccugccgaacggcaagcugauccucagccuggacaaggacaccuacgaggagaccgggcugcagggccaccccucccaguucagcggccggaagaucaugaaguucaucguguccaucgaccucauggagcugagccugaaccucgacuccaagaaguacgagcgcaucagcugguccuucaaggagaagaagccccugaaguucgacuuccugcucgccuggcacaagacggggagcgaggaguccaccaugaugagcuacuucuccaaguaccagauccaggagcaccagcccaaggucgcccugagcacccugcgggaccuccagugcccggugcugcaguccagcgagcuggagggcacccccgaggugagcugccgcgcccucgagcuguucgacuggcugggggcggucuucuccaacguggaccucaacaacgagcccaacaacuucaucagcacguacugcugccccgagccguccaccguggucgccaaggccuaccugugcaccaucaccggcuucauccugcccgagaagaucugccuccugcuggagcaccucugccacuacuucgacgagcccaagcuggcccccugggugacgcugagcgugcagggguucgcggacuccccggucagcugggagaagaacgagcacggcuuccggaagggcggggagcaccucuacaacuucgugaucuucaacaaccaggacuacuggcugcagauggccgugggcgccaacgaccacugcccgcccuga

SEQ ID NO: 35898 - RNA, 831 nt, Artificial Sequence
  derived and/or modified sequence opt1 from RPRD1A__Homo_sapiens__NP_001290340
augcgcaacagcaacuggcgguucugccagaccggcaucuacuccaagcccaaccgcaagcugaccuuccucuaccuggccaacgacgugauccagaacagcaagcggaaggggccggaguucacgaaggacuucgcccccgucaucguggaggcguucaagcacguguccagcgagaccgacgaguccugcaagaagcaccugggccgcguccucagcaucugggaggagcgguccguguacgagaacgacgugcuggagcagcugaagcaggcccucuacggggacaagaagccccgcaagcggaccuacgagcagaucaaggucgacgagaacgagaacugcagcucccugggcagccccuccgagccgccccagacccuggaccucgugcgcgcccugcaggaccuggagaacgccgccagcggggacgcggccgugcaccagcggaucgccucccuccccgucgaggugcaggaggugagccugcuggacaagaucacggacaaggaguccggcgagcgccucagcaagauggucgaggacgccugcaugcugcuggcggacuacaacggccggcucgccgccgagaucgacgaccgcaagcagcugacccggaugcuggccgacuuccuccgcugccagaaggaggcccuggcggagaaggagcacaagcuggaggaguacaagcggaagcucgcccgcgugucccuggugcggaaggagcugcgcagccggauccagucccuccccgaccugagccgccugccgaacgucaccgggagccacaugcaccuccccuucgccggcgacaucuacuccgaggacuga

SEQ ID NO: 35899 - RNA, 981 nt, Artificial Sequence
  derived and/or modified sequence opt1 from RPRD1B__Homo_sapiens__NP_067038
augagcuccuucagcgaguccgcccuggagaagaagcucagcgagcuguccaacagccagcaguccgugcagacccugagccucuggcugauccaccaccgcaagcacgccggccccaucgucuccguguggcaccgggagcugcgcaaggccaagagcaaccggaagcucaccuuccuguaccuggcgaacgacgugauccagaacuccaagcgcaaggggccggaguucacgcgggaguucgagagcguccucguggacgccuucucccacguggcccgcgaggccgacgagggcugcaagaagccccuggagcggcugcucaacaucuggcaggagcgcagcgucuacgggggcgaguucauccagcagcugaagcuguccauggaggacagcaaguccccgccgcccaaggcgaccgaggagaagaagucccucaagcggaccuuccagcagauccaggaggaggaggacgacgacuaccccgggagcuacagcccccaggaccccagcgccggcccccugcugaccgaggagcucaucaaggcccugcaggaccuggagaacgccgcguccggcgacgccacggugcgccagaagaucgccagccucccccaggaggugcaggacgucucccugcuggagaagaucaccgacaaggaggccgccgagcggcucagcaagaccguggacgaggcgugccugcugcucgccgaguacaacgggcgccuggccgccgagcuggaggaccggcgccagcucgcccggaugcugguggaguacacccagaaccagaaggacguccuguccgagaaggagaagaagcucgaggaguacaagcagaagcuggcgcgcgugacccaggugcggaaggagcucaagagccacauccagucccugcccgaccugagccugcuccccaacgucacgggcgggcuggccccgcugcccuccgccggcgaccucuucagcaccgacuga

SEQ ID NO: 35900 - RNA, 2805 nt, Artificial Sequence
  derived and/or modified sequence opt1 from RPRD2__Homo_sapiens__NP_001284602
auggccgccggcgggggcgggggcagcuccaaggcgagcuccagcuccgccagcuccgccggggcccuggagagcucccucgaccgcaaguuccagagcgugaccaacaccauggaguccauccagggccugagcuccuggugcaucgagaacaagaagcaccacagcacgaucgucuaccacuggaugaaguggcugcggcgcuccgccuacccccaccggcucaaccuguucuaccuggcgaacgacgugauccagaacugcaagcgcaagaacgccaucaucuuccgggagagcuucgccgacgugcucccggaggccgcggcccuggucaaggaccccuccgugagcaaguccguggagcgcaucuucaagaucugggaggaccggaacgucuaccccgaggagaugaucguggcccugcgcgaggcccucaccagcaccaaccccaaggccgcgcucaagagcaagaucguggccgaguuccggucccaggcccugaucgaggagcugcugcuguacaagcgcagcgaggaccagaucgagcucaaggagaagcagcuguccaccaugcgggucgacgugugcagcacggagacccugaagugccucaaggacaagaccggcgggaagaaguucuccaaggaguucgaggaggccagcuccaagcuggaggaguucgugaacggccuggacaagcaggucaagaacgggccgagccucaccgaggcccuggagaacgcgggcaucuucuacgaggcccaguacaaggaggugaagguggucgccaacgccuacaagacguucgccaaccgcgugaacaaccugaagaagaagcucgaccagcugaaguccacccugcccgaccccgaggagagccccgugccgucccccagcauggacgcgcccucccccaccgggagcgaguccccguuccagggcaugggcggggaggagagccagucccccaccauggagagcgagaaguccgccacgcccgagcccgucaccgacaaccgggacguggaggacauggagcucagcgacguggaggacgacggcagcaagaucaucgucgaggaccgcaaggagaagccggccgagaaguccgccgugagcaccuccgugcccaccaagcccacggagaacaucagcaaggccuccagcugcacccccgucccggugaccaugaccgcgacgccgccccugcccaagcccgucaacaccucccugagccccucccccgcccucgcccugcccaaccuggccaacguggaccucgcgaagaucagcuccauccugagcucccugaccagcgugaugaagaacaccggggucuccccggccagccggcccucccccggcacgccgaccagccccagcaaccucaccuccggccugaagacccccgcccccgccacgaccaccagccacaacccgcuggccaacauccucuccaagguggagaucacccccgagagcauccuguccgcgcugagcaagacgcagacccaguccgcccccgcccuccaggggcugagcucccugcuccagagcgugaccggcaaccccgucccggccuccgaggccgcgagccaguccaccagcgccucccccgccaacacgaccgugagcaccaucaaggggcgcaaccugcccuccagcgcccagcccuucaucccgaaguccuucaacuacagccccaacagcuccaccagcgagguguccagcaccuccgccagcaaggcguccaucggccagagccccgggcugcccuccacgaccuucaagcucccgagcaacucccugggcuucaccgccacccacaacacgagccccgccgccccgcccaccgaggucaccaucugccaguccagcgagguguccaagcccaagcuggagagcgaguccaccagccccucccuggagaugaagauccacaacuuccucaagggcaaccccggguucagcggccugaaccugaacauccccauccucagcucccuggggagcuccgcgccgagcgagucccaccccagcgacuuccagcggggccccacguccaccagcaucgacaacaucgacgggaccccggugcgcgacgagcgguccggcacccccacgcaggacgagaugauggacaagcccaccagcuccagcgucgacaccaugucccugcucagcaagaucaucucccccggcagcuccaccccgagcuccacgcgcagcccgccgcccgggcgggacgagagcuacccccgcgagcuguccaacagcguguccaccuaccgccccuucggccuggggagcgagucccccuacaagcagcccagcgacggcauggagcggcccuccagccucauggacuccagccaggagaaguucuaccccgacaccuccuuccaggaggacgaggacuaccgcgacuucgaguacagcgggccgccgcccuccgccaugaugaaccuggagaagaagcccgccaagagcauccugaaguccagcaagcucuccgacaccacggaguaccagcccauccugagcuccuacagccaccgggcccaggaguucggcgucaagagcgccuucccgcccuccgugcgcgcgcugcucgacagcuccgagaacugcgaccggcugagcuccagccccggccuguucggggccuucuccgugcgcggcaacgagcccgggagcgaccggucccccagccccaagcaccccugccgcucccacggcagccccacccacgugcggcgcggcgagucccccgggcuccaccacuuccaccacgucgacgacuga

SEQ ID NO: 35901 - RNA, 330 nt, Artificial Sequence
  derived and/or modified sequence opt1 from RPRM__Homo_sapiens__NP_062819
augaaccccgcccugggcaaccagaccgacguggccggccucuuccuggcgaacagcuccgaggcccuggagcgcgccguccggugcugcacccaggccagcguggugacggacgacggguucgccgagggcgggccggacgagcgcucccucuacaucaugcgggucgugcagaucgcggugaugugcguccugagccugaccgugguguucgggaucuucuuccucggcugcaaccugcugaucaaguccgagggcaugaucaacuuccucgucaaggaccgccggcccagcaaggagguggaggccguggucguggggcccuacuga

SEQ ID NO: 35902 - RNA, 498 nt, Artificial Sequence
  derived and/or modified sequence opt1 from RPS10__Homo_sapiens__NP_001191020
augcugaugcccaagaagaaccgcaucgccaucuacgagcuccuguucaaggagggcgugauggucgccaagaaggacgugcacaugcccaagcaccccgagcuggcggacaagaacgugcccaaccuccacgucaugaaggccaugcagagccugaagucccggggguacgugaaggagcaguucgccuggcgccacuucuacugguaccugaccaacgagggcauccaguaccuccgggacuaccugcaccucccgcccgagaucgugcccgccacccugcgccggagccgccccgagacggggcggccccgcccgaagggccuggagggggagcggcccgcccgccugacccggggcgaggcggaccgcgacaccuaccggcgcuccgccgucccgcccggcgccgacaagaaggccgaggcgggggccggcagcgccaccgaguuccaguuccgcgggggcuucgggcggggccggggccagccgccccaguga

SEQ ID NO: 35903 - RNA, 456 nt, Artificial Sequence
  derived and/or modified sequence opt1 from RPS14__Homo_sapiens__NP_001020242
auggccccgcgcaagggcaaggagaagaaggaggagcaggucaucagccuggggccccagguggccgagggcgagaacguguucggggugugccacaucuucgcguccuucaacgacaccuucguccacgugaccgaccucagcggcaaggagacgaucugccgggugaccgggggcaugaaggucaaggccgaccgcgacgaguccagccccuacgccgccaugcuggccgcgcaggacguggcccagcggugcaaggagcugggcaucaccgcccuccacaucaagcugcgcgccaccgggggcaaccggacgaagacccccgggcccggcgcgcaguccgcccugcgcgcccucgcccggagcgggaugaagaucggccgcaucgaggacgugaccccgauccccuccgacagcacccggcgcaagggcgggcggcgcggccggcgccuguga

SEQ ID NO: 35904 - RNA, 393 nt, Artificial Sequence
  derived and/or modified sequence opt1 from RPS15A__Homo_sapiens__NP_001025180
auggugcgcaugaacguccuggccgacgcccucaagagcaucaacaacgcggagaagcggggcaagcgccaggugcugauccggcccugcuccaaggugaucguccgcuuccugaccgugaugaugaagcacggguacaucggcgaguucgagaucaucgacgaccaccgggccgggaagaucguggucaaccucaccggccgccugaacaagugcggggugaucagcccgcgguucgacgugcagcugaaggaccucgagaaguggcagaacaaccugcugcccucccgccaguucggcuucaucguccucacgaccagcgccggcaucauggaccacgaggaggcccggcgcaagcacaccgggggcaagauccugggguucuucuucuga

SEQ ID NO: 35905 - RNA, 459 nt, Artificial Sequence
  derived and/or modified sequence opt1 from RPS16__Homo_sapiens__XP_005259194
augcccagcaagggcccgcugcaguccgugcaggucuucgggcgcaagaagaccgccaccgccguggcgcacugcaagcggggcaacgggcucaucaaggugaacggccgcccccuggagaugaucgagccccggacgcugcaguacaagcuccuggagcccguccugcuccuggggaaggagcgcuucgccggcguggacauccgggugcgcgucaagggcgggggccacguggcccagaucuacggggagagccaggagcugggcgccuggcggcgcuggcucugggagggcgggcugcacuccgccccggugcccuucaacugcgucagcuucucccagcugagcgugucccccagccccaagccgugguggcccaucacccggaacauguggaugcgccucccccggcgccgguccaagaccagcuccagcuccaugaccggccccugcugguga

SEQ ID NO: 35906 - RNA, 459 nt, Artificial Sequence
  derived and/or modified sequence opt1 from RPS18__Homo_sapiens__NP_072045
augagccuggugauccccgagaaguuccagcacauccuccgcguccugaacaccaacaucgacggccggcgcaagaucgccuucgccaucaccgcgaucaagggggugggccggcgcuacgcccacgugguccugcggaaggccgacaucgaccucacgaagcgcgccggggagcugaccgaggacgagguggagcgggugaucaccaucaugcagaacccgcgccaguacaagauccccgacugguuccugaaccggcagaaggacgucaaggacggcaaguacucccaggugcucgccaacgggcuggacaacaagcugcgcgaggaccucgagcggcugaagaagauccgcgcgcaccggggccugcgccacuucuggggccuccgggugcgcgggcagcacaccaagacgaccggccggcgcgggcggaccgucggcgugagcaagaagaaguga

SEQ ID NO: 35907 - RNA, 411 nt, Artificial Sequence
  derived and/or modified sequence opt1 from RPS19BP1__Homo_sapiens__NP_919307
augagcgccgcccugcuccgccggggccuggagcugcucgcggccuccgaggcgccccgcgacccgcccgggcaggccaagccccggggcgcccccgugaagcgcccgcggaagaccaaggccauccaggcccagaagcugcgcaacagcgccaaggggaagguccccaaguccgcccuggacgaguaccggaagcgcgagugccgggaccaccuccgcgugaaccugaaguuccugacccggacgcgcagcaccguggcggaguccgucagccagcagauccuccggcagaaccgcggccggaaggccugcgaccgccccguggccaagaccaagaagaagaaggccgaggggaccguguucacggaggaggacuuccagaaguuccagcaggaguacuucggcuccuga

SEQ ID NO: 35908 - RNA, 429 nt, Artificial Sequence
  derived and/or modified sequence opt1 from RPS20__Homo_sapiens__NP_001139699
auggccuucaaggacaccggcaagacccccguggagccggaggucgccauccaccgcauccggaucacgcugaccagccgcaacgugaagucccucgagaaggugugcgcggaccugauccgcggggccaaggagaagaaccugaaggucaagggccccgugcggaugcccaccaagacccuccggaucacgacccgcaagacccccugcggggagggcagcaagaccugggaccgguuccagaugcgcauccacaagcggcugaucgaccugcacuccccgagcgagaucgugaagcagaucacguccaucagcaucgagcccggggucgagcucaucgaguccaccgacgccgagcccauggacaccgagggccagcaguacacccugcgcagcguguucgagucccccggcacgugcccguucuga

SEQ ID NO: 35909 - RNA, 396 nt, Artificial Sequence
  derived and/or modified sequence opt1 from RPS24__Homo_sapiens__NP_001135754
augaacgacaccgugaccauccgcacgcggaaguucaugaccaaccgccugcuccagcggaagcagauggucaucgacgugcugcaccccggcaaggccaccgugccgaagaccgagauccgcgagaagcuggccaagauguacaagacgacccccgacgucaucuucguguucggguuccggacccacuucggcgggggcaagaccacgggguucggcaugaucuacgacagccucgacuacgcgaagaagaacgagcccaagcaccgccuggcccggcacggccuguacgagaagaagaagaccucccgcaagcagcggaaggagcgcaagaaccggaugaagaaggugcgcgggaccgccaaggccaacgucggcgccgggaagaagaaguga

SEQ ID NO: 35910 - RNA, 471 nt, Artificial Sequence
  derived and/or modified sequence opt1 from RPS27A__Homo_sapiens__NP_001170884
augcagaucuucgugaagacccugaccggcaagacgaucacccucgaggucgagcccagcgacaccaucgagaacgugaaggccaagauccaggacaaggaggggaucccgcccgaccagcagcgccugaucuucgccggcaagcagcuggaggacgggcggacccucuccgacuacaacauccagaaggagagcacgcugcaccuggugcuccgccugcggggcggggcgaagaagcgcaagaagaaguccuacaccacccccaagaagaacaagcacaagcggaagaaggucaagcuggccgugcucaaguacuacaagguggacgagaacggcaagaucagccgccugcggcgcgagugccccuccgacgagugcggcgccggggucuucauggccagccacuucgaccggcacuacugcggcaagugcugccugaccuacugcuucaacaagccggaggacaaguga

SEQ ID NO: 35911 - RNA, 255 nt, Artificial Sequence
  derived and/or modified sequence opt1 from RPS27__Homo_sapiens__NP_001021
augccccuggccaaggaccuccugcacccgagccccgaggaggagaagcgcaagcacaagaagaagcggcuggugcagucccccaacagcuacuucauggacgucaagugccccggcugcuacaagaucaccaccguguucucccacgcccagacggugguccucugcguggggugcagcaccgugcugugccagccgaccggcgggaaggcgcgccugaccgagggcugcuccuuccggcgcaagcagcacuga

SEQ ID NO: 35912 - RNA, 255 nt, Artificial Sequence
  derived and/or modified sequence opt1 from RPS27L__Homo_sapiens__NP_057004
augccccuggcccgcgaccuccugcacccgagccuggaggaggagaagaagaagcacaagaagaagcggcucgugcagucccccaacagcuacuucauggacgucaagugccccggcugcuacaagaucaccaccguguucucccacgcccagacggugguccugugcguggggugcagcaccgugcugugccagcccaccggcgggaaggcgcgccucaccgagggcugcuccuuccggcgcaagcagcacuga

SEQ ID NO: 35913 - RNA, 171 nt, Artificial Sequence
  derived and/or modified sequence opt1 from RPS29__Homo_sapiens__NP_001023
augggccaccagcagcuguacuggagccacccccgcaaguucgggcagggcucccggagcugccgcgugugcuccaaccggcacgggcucauccgcaaguacggccugaacaugugccggcagugcuuccgccaguacgccaaggacaucggguucaucaagcuggacuga

SEQ ID NO: 35914 - RNA, 882 nt, Artificial Sequence
  derived and/or modified sequence opt1 from RPS2__Homo_sapiens__NP_002943
auggccgacgacgccggcgcggccgggggccccgggggccccgggggccccggcauggggaaccgcggcggguuccggggcggguucggcagcggcauccgcgggcggggccgcgggcggggccgcggccgggggcgcggccgcggggcccggggcgggaaggccgaggacaaggaguggaugcccgugaccaagcugggccggcucgucaaggacaugaagaucaagucccuggaggagaucuaccuguucagccuccccaucaaggaguccgagaucaucgacuucuuccugggcgccagccugaaggacgaggugcucaagaucaugccggugcagaagcagacccgcgcggggcagcggacgcgcuucaaggccuucgucgccaucggcgacuacaacgggcacgugggccugggggugaagugcuccaaggaggucgccaccgcgauccggggcgccaucauccuggccaagcucagcaucgugcccgugcgccggggcuacugggggaacaagaucggcaagccccacaccguccccugcaaggugaccgggcgcugcggcuccgugcugguccggcugaucccggccccgcgcgggacgggcaucgugagcgcccccgugcccaagaagcuccugaugauggcgggcaucgacgacugcuacaccuccgcccgggggugcaccgccacccugggcaacuucgccaaggccacguucgacgcgaucagcaagaccuacuccuaccucaccccggaccuguggaaggagaccgucuucaccaagagccccuaccaggaguucacggaccaccuggugaagacccacacccgcguguccguccagcgcacgcaggcccccgccguggccaccaccuga

SEQ ID NO: 35915 - RNA, 795 nt, Artificial Sequence
  derived and/or modified sequence opt1 from RPS3A__Homo_sapiens__NP_000997
auggccgugggcaagaacaagcgccugaccaagggcgggaagaagggggccaagaagaaggucguggaccccuucagcaagaaggacugguacgacgugaaggcgccggccauguucaacauccggaacaucggcaagacccucgucacgcgcacccaggggaccaagaucgccuccgacggccugaagggccggguguucgaggugagccuggccgaccuccagaacgacgaggucgccuuccgcaaguucaagcugaucaccgaggacgugcaggggaagaacugccugacgaacuuccacggcauggaccucacccgggacaagaugugcuccauggugaagaaguggcagaccaugaucgaggcgcacgucgacgugaagaccacggacggguaccugcugcgccucuucugcgugggcuucaccaagaagcggaacaaccagauccgcaagaccagcuacgcccagcaccagcagguccggcagauccgcaagaagaugauggagaucaugacccgggaggugcagacgaacgaccugaaggagguggucaacaagcugauccccgacuccaucgggaaggacaucgagaaggccugccagagcaucuacccccuccacgacguguucgugcgcaaggucaagaugcugaagaagcccaaguucgagcugggcaagcucauggagcugcacggcgagggguccagcuccggcaaggccaccggggacgagaccggcgcgaagguggagcgggccgacggcuacgagccgcccgugcaggagagcgucuga

SEQ ID NO: 35916 - RNA, 732 nt, Artificial Sequence
  derived and/or modified sequence opt1 from RPS3__Homo_sapiens__NP_000996
auggccgugcagaucagcaagaagcgcaaguucgucgccgacggcaucuucaaggcggagcugaacgaguuccucacccgggagcuggccgaggacggguacuccggcguggaggugcgcgucacccccacgcggaccgagaucaucauccuggccacccgcacccagaacgugcucggggagaagggccggcgcauccgggagcugacggccgugguccagaagcgcuucggguucccggagggcagcguggagcuguacgccgagaagguggcgacccggggccucugcgccaucgcccaggccgagucccugcgcuacaagcugcucgggggccuggcgguccggcgcgccugcuacggggugcugcgguucaucauggagagcggcgccaaggggugcgagguggucguguccggcaagcuccgcggccagcgggccaagagcaugaaguucguggacgggcugaugauccacuccggcgaccccgucaacuacuacguggacaccgccgugcgccacguccugcuccggcagggggugcugggcaucaaggugaagaucaugcugcccugggaccccaccggcaagaucgggccgaagaagccccuccccgaccacgucagcaucguggagcccaaggacgagauccugccgacgacccccaucuccgagcagaagggcgggaagcccgagcccccggcgaugccccagcccgugcccaccgccuga

SEQ ID NO: 35917 - RNA, 792 nt, Artificial Sequence
  derived and/or modified sequence opt1 from RPS4X__Homo_sapiens__NP_000998
auggcccgcggccccaagaagcaccugaagcggguggccgcgccgaagcacuggaugcucgacaagcugaccggggucuucgcgccccgccccagcaccggcccccacaagcugcgggagugccucccgcugaucaucuuccugcgcaaccggcucaaguacgcccugacgggggacgaggugaagaagaucugcaugcagcgcuucaucaagaucgacggcaaggugcggaccgacaucaccuaccccgccggguucauggacgucaucuccaucgacaagaccggcgagaacuuccgccugaucuacgacacgaagggccgguucgccgugcaccgcaucacccccgaggaggccaaguacaagcucugcaaggugcggaagaucuucgucgggaccaagggcaucccccaccuggugacccacgacgcccgcacgauccgguacccggacccccugaucaaggugaacgacaccauccagaucgaccucgagaccgggaagaucaccgacuucaucaaguucgacacgggcaaccugugcauggucaccgggggcgccaaccugggccgcaucggggugaucaccaaccgggagcgccaccccggcagcuucgacgugguccacgugaaggacgccaacgggaacuccuucgcgacccggcucagcaacaucuucgugaucggcaagggcaacaagcccuggaucucccugccgcgcgggaagggcauccggcugacgaucgccgaggagcgcgacaagcggcucgccgccaagcagagcuccggguga

SEQ ID NO: 35918 - RNA, 792 nt, Artificial Sequence
  derived and/or modified sequence opt1 from RPS4Y1__Homo_sapiens__NP_000999
auggcccgcggccccaagaagcaccugaagcggguggccgcgccgaagcacuggaugcucgacaagcugaccggggucuucgcgccccgccccagcaccggcccccacaagcugcgggagugccucccgcugaucguguuccugcgcaaccggcucaaguacgcccugacgggggacgaggugaagaagaucugcaugcagcgcuucaucaagaucgacggcaagguccggguggacgugaccuaccccgccggguucauggacgucaucuccaucgagaagaccggcgagcacuuccgccugguguacgacaccaagggccgguucgccgugcaccgcaucacggucgaggaggccaaguacaagcucugcaaggugcggaagaucaccgugggggucaagggcaucccccaccuggugacccacgacgcccgcaccauccgguaccccgacccggugaucaaggucaacgacacggugcagaucgaccuggggaccggcaagaucaucaacuucaucaaguucgacaccgggaaccucugcauggugaucggcggcgccaaccuggggcgcgucggcgugaucaccaaccgggagcgccaccccgggagcuucgacgugguccacgugaaggacgccaacggcaacuccuucgcgacgcggcugagcaacaucuucgugaucggcaacgggaacaagcccuggaucucccucccccgcggcaaggggauccggcugaccgucgccgaggagcgcgacaagcggcuggccaccaagcagagcuccggcuga

SEQ ID NO: 35919 - RNA, 2226 nt, Artificial Sequence
  derived and/or modified sequence opt1 from RPS6KA2__Homo_sapiens__NP_001006933
augcccaucgcccagcugcucgagcuguggaagaagaucgagguggagccgauggagaucgagaccaccgaggaggaccugaaccucgacgucgagcccgccacggaggacaccgcggaggaggaggagggcguggugaaggagaucgacaucagccaccacgucaaggagggguucgagaaggccgaccccucccaguucgagcugcugaaggugcucggccaggggagcuacggcaagguguuccugguccgcaaggugaagggguccgacgccggccagcuguacgccaugaaggugcucaagaaggccacccugaagguccgggaccgcgugcggagcaagauggagcgcgacauccuggcggaggugaaccaccccuucaucgucaagcuccacuacgccuuccagaccgagggcaagcuguaccugauccucgacuuccugcgcgggggcgaccuguucacgcggcucuccaaggaggugauguucaccgaggaggacgugaaguucuaccuggccgagcuggcccucgcgcuggaccaccuccacagccuggggaucaucuaccgggaccugaagccggagaacauccugcucgacgaggagggccacaucaagaucaccgacuucgggcuguccaaggaggccaucgaccacgacaagcgcgccuacagcuucugcggcaccaucgaguacauggcccccgaggucgugaaccggcgcggccacacgcaguccgccgacugguggagcuucggggugcugauguucgagaugcucaccggcucccugcccuuccaggggaaggaccggaaggagaccauggcgcugauccucaaggccaagcugggcaugccccaguuccugagcggcgaggcccagucccuccugcgcgcccuguucaagcggaacccgugcaaccgccucggggccggcaucgacggggucgaggagaucaagcggcaccccuucuucgugaccaucgacuggaacacgcuguaccgcaaggagaucaagccgcccuucaagcccgcggugggccggcccgaggacaccuuccacuucgaccccgaguucaccgcccgcacccccacggacagcccgggggucccgcccuccgccaacgcccaccaccuguuccggggcuucagcuucguggccuccagccucauccaggagcccucccagcaggaccugcacaaggugcccguccaccccaucgugcagcagcugcacggcaacaacauccacuucaccgacggguacgagaucaaggaggacaucggcgucgggagcuacagcgugugcaagcgcugcgugcacaaggcgaccgacaccgaguacgccgucaagaucaucgacaaguccaagcgggaccccagcgaggagaucgagauccuccugcgcuacggccagcaccccaacaucaucacgcugaaggacguguacgacgacgggaaguucguguaccucgucauggagcugaugcgcggcggcgagcugcuggaccggauccuccgccagcgguacuucuccgagcgcgaggccagcgacgugcugugcaccaucaccaagaccauggacuaccugcacucccagggggugguccaccgggaccucaagccgagcaacauccuguaccgcgacgaguccggcagccccgaguccauccgggugugcgacuucggguucgccaagcagcugcgcgccggcaacgggcuccugaugacgcccugcuacaccgcgaacuucguggcccccgagguccugaagcggcagggcuacgacgccgccugcgacaucuggagccucggcauccugcuguacaccaugcucgcgggguucaccccguucgccaacggccccgacgacacgcccgaggagauccuggcccgcaucggguccggcaaguacgcccugagcggcgggaacugggacuccaucagcgacgccgcgaaggacgugguguccaagaugcuccacgucgacccgcaccagcggcugaccgccaugcagguccugaagcaccccuggguggugaaccgcgaguaccucagccccaaccagcugucccggcaggacgugcaccuggugaagggcgccauggccgccaccuacuucgcgcucaaccgcacgccccaggccccgcggcuggagcccguccugagcuccaaccucgcccagcgccgggggaugaagcgccugaccagcacccggcuguga

SEQ ID NO: 35920 - RNA, 2223 nt, Artificial Sequence
  derived and/or modified sequence opt1 from RPS6KA3__Homo_sapiens__NP_004577
augccccuggcccagcucgccgacccguggcagaagauggcgguggagagccccuccgacagcgccgagaacggccagcagaucauggacgagcccaugggggaggaggagaucaacccccagaccgaggaggucuccaucaaggagaucgccaucacccaccacgugaaggagggccacgagaaggccgacccgagccaguucgagcugcugaaggugcucgggcagggcuccuucgggaaggucuuccuggugaagaagaucagcggcuccgacgcccgccagcuguacgcgaugaaggugcucaagaaggccacgcugaagguccgggaccgcgugcggaccaagauggagcgcgacauccugguggaggucaaccaccccuucaucgugaagcuccacuacgccuuccagaccgagggcaagcuguaccugauccucgacuuccugcgcgggggcgaccuguucacccggcucagcaaggaggugauguucacggaggaggacgucaaguucuaccuggccgagcuggcgcucgcccuggaccaccuccacucccuggggaucaucuaccgggaccugaagcccgagaacauccugcucgacgaggagggccacaucaagcugaccgacuucgggcugagcaaggaguccaucgaccacgagaagaaggccuacagcuucugcggcaccguggaguacauggcccccgagguggucaaccgccggggccacacccaguccgccgacugguggagcuucggggugcucauguucgagaugcugacgggcacccugccguuccaggggaaggaccgcaaggagaccaugaccaugauccucaaggcgaagcugggcaugccccaguuccugucccccgaggcccagagccuccugcggaugcuguucaagcgcaaccccgccaaccggcucggcgccgggccggacggcguggaggagaucaagcgccacuccuucuucagcacgaucgacuggaacaagcuguaccggcgcgagauccacccgcccuucaagcccgccaccgggcggcccgaggacaccuucuacuucgaccccgaguucaccgcgaagacgcccaaggacucccccggcaucccgcccagcgccaacgcccaccagcuguuccgcggguucagcuucgucgccaucaccuccgacgacgagagccaggccaugcagaccgugggcgugcacuccaucguccagcagcuccaccggaacagcauccaguucaccgacggcuacgaggugaaggaggacaucggggugggcuccuacagcgucugcaagcgcugcauccacaaggcgacgaacauggaguucgccgugaagaucaucgacaaguccaagcgggaccccaccgaggagaucgagauccugcugcgcuacgggcagcaccccaacaucaucacccucaaggacgucuacgacgacggcaaguacguguacguggucaccgagcugaugaagggcggggagcugcucgacaagauccugcgccagaaguucuucagcgagcgggaggccuccgccgugcuguucacgaucaccaagaccguggaguaccuccacgcccagggcgucgugcaccgcgaccugaagccgagcaacauccuguacguggacgaguccgggaaccccgagagcauccggaucugcgacuucggcuucgcgaagcagcugcgcgccgagaacgggcuccugaugacccccugcuacacggccaacuucgucgcccccgaggugcugaagcggcagggcuacgacgcggccugcgacaucuggucccucggggugcugcuguacaccaugcucaccggcuacaccccguucgccaacggccccgacgacacgcccgaggagauccuggcccgcaucgggagcggcaaguucucccugagcgggggcuacuggaacuccgucagcgacaccgccaaggaccucguguccaagaugcugcacguggacccgcaccagcggcugaccgcggcccucguccugcgccaccccuggaucgugcacugggaccagcugccccaguaccagcucaaccggcaggacgcgccccaccuggugaagggcgccauggccgccaccuacagcgcccugaaccgcaaccagagcccgguccucgagcccguggggcgguccacgcuggcccagcgccggggcaucaagaagaucaccagcaccgcccuguga

SEQ ID NO: 35921 - RNA, 2301 nt, Artificial Sequence
  derived and/or modified sequence opt1 from RPS6KA4__Homo_sapiens__NP_001006945
augggcgacgaggacgacgacgagagcugcgccguggagcugcgcaucaccgaggccaaccucaccgggcacgaggagaaggucuccguggagaacuucgagcugcugaaggugcucggcacgggggccuacggcaaggucuuccuggugcggaaggccgggggccacgacgccggcaagcuguacgccaugaaggugcuccgcaaggccgcgcugguccagcgggccaagacccaggagcacacccgcaccgagcggagcgugcuggagcucgugcgccaggcccccuuccuggucacgcugcacuacgccuuccagaccgacgcgaagcuccaccugauccuggacuacguguccgggggcgagauguucacccaccucuaccagcggcaguacuucaaggaggccgaggugcgcgucuacgggggcgagaucgugcuggcccuggagcaccuccacaagcuggggaucaucuaccgggaccugaagcucgagaacgugcugcuggacagcgagggccacaucguccucaccgacuucggccuguccaaggaguuccugacggaggagaaggagcgcaccuucagcuucugcgggaccaucgaguacauggccccggagaucauccgguccaagaccggccacgggaaggccguggacugguggagccucggcauccugcuguucgagcuccugacgggcgcgucccccuucacccuggagggggagcgcaacacccaggccgaggugagccggcgcauccucaagugcuccccgcccuucccgccccggaucggccccgucgcccaggaccugcugcagcgccuccugugcaaggaccccaagaagcggcugggggccggcccccagggggcccaggaggugcgcaaccaccccuucuuccagggccucgacuggguggcgcuggccgcccggaagauccccgcccccuuccgcccgcagauccggagcgagcuggacgucggcaacuucgccgaggaguucacccgccucgagcccguguacuccccgcccgggagcccgccgcccggcgacccccgcaucuuccagggguacuccuucguggcgcccagcauccuguucgaccacaacaacgccgucaugacggacggccuggaggcccccggggccggcgaccggcccggccgcgccgcgguggcccgguccgccaugaugcagcaguacgagcucgaccugcgcgagcccgcccuggggcagggcagcuucuccgucugccggcgcugccggcagcgccagagcgggcaggaguucgcggugaagauccucagccggcgccuggaggccaacacccagcgggagguggccgcccugcgccugugccagucccaccccaacgucgugaaccuccacgaggugcaccacgaccagcugcacaccuaccugguccucgagcugcugcggggcggggagcuccuggagcacauccgcaagaagcggcacuucagcgaguccgaggccagccagauccugcgcucccucgugagcgcgguguccuucaugcacgaggaggccggcgucgugcaccgggaccugaagcccgagaacauccuguacgccgacgacacccccggcgcccccgugaagaucaucgacuucggguucgcccgccuccggccgcagagccccggcguccccaugcagacgccgugcuucacccugcaguacgcggcccccgagcugcucgcccagcagggguacgacgaguccugcgaccuguggagccugggcgugauccucuacaugaugcuguccggccaggugcccuuccagggggccagcggccagggcgggcagucccaggccgcggagaucaugugcaagauccgcgaggggcgcuucagccuggacggcgaggccuggcagggcgucuccgaggaggccaaggagcucgugcgggggcugcugaccguggaccccgccaagcgccucaagcuggagggccugcgggggagcuccuggcuccaggacggcagcgcgcgcuccagcccgccccugcggacccccgacguccuggagagcuccgggcccgccgugcgcagcggccucaacgccacguucauggccuucaaccggggcaagcgcgagggguucuuccugaaguccguggagaacgccccgcuggcgaagcggcgcaagcagaagcuccggagcgccaccgccucccgccggggcagccccgcccccgccaaccccgggcgcgcgccggucgccuccaagggcgcgccccggcgcgccaacgggccccugcccccgagcuga

SEQ ID NO: 35922 - RNA, 2409 nt, Artificial Sequence
  derived and/or modified sequence opt1 from RPS6KA5__Homo_sapiens__NP_004746
auggaggaggagggcgggagcuccggcggggccgccggcaccagcgcggacgggggcgacggcggggagcagcugcucaccgugaagcacgagcugcgcacggccaaccugaccggccacgccgagaaggucgggaucgagaacuucgagcuccugaaggugcugggcaccggggccuacggcaagguguuccucguccggaagaucuccggccacgacaccgggaagcuguacgccaugaaggugcugaagaaggcgacgaucgugcagaaggccaagaccaccgagcacacccgcacggagcggcagguccucgagcacauccgccagagccccuuccuggugacccugcacuacgccuuccagaccgagaccaagcuccaccugauccuggacuacaucaacggcggggagcuguucacgcaccugucccagcgggagcgcuucaccgagcacgaggugcagaucuacgucggcgagaucgugcuggcccucgagcaccuccacaagcugggcaucaucuaccgggacaucaagcucgagaacauccugcuggacagcaacgggcacgugguccucaccgacuucggccuguccaaggaguucguggcggacgagaccgagcgcgccuacagcuucugcgggacgaucgaguacauggccccggacaucgugcggggcggggacuccggccacgacaaggccgucgacugguggagccugggcgugcucauguacgagcugcugaccggggccucccccuucaccguggacggcgagaagaacagccaggcggagaucucccgccggauccucaagagcgagccgcccuacccccaggagauguccgcccuggccaaggaccugauccagcgccuccugaugaaggaccccaagaagcggcuggggugcggcccccgcgacgccgacgagaucaaggagcaccucuucuuccagaagaucaacugggacgaccuggccgcgaagaagguccccgccccguucaagcccgugauccgggacgagcuggacgugagcaacuucgccgaggaguucaccgagauggaccccacguacucccccgccgcccucccgcagagcuccgagaagcuguuccagggguacagcuucgucgcgcccagcauccuguucaagcgcaacgccgccgugaucgacccccuccaguuccacaugggcguggagcggcccggcgucaccaacguggcccgcuccgccaugaugaaggacagcccguucuaccagcacuacgaccuggaccugaaggacaagccccucggggagggcuccuucagcaucugccggaagugcguccacaagaaguccaaccaggcguucgccgugaagaucaucagcaagcgcauggaggccaacacccagaaggagaucaccgcccugaagcugugcgaggggcaccccaacaucgugaagcuccacgaggucuuccacgaccagcugcacacguuccuggugauggagcugcucaacggcggggagcuguucgagcggaucaagaagaagaagcacuucuccgagaccgaggcgagcuacaucaugcgcaagcugguguccgccgucagccacaugcacgacgugggcgugguccaccgcgaccucaagcccgagaaccugcuguucaccgacgagaacgacaaccucgagaucaagaucaucgacuucggcuucgcccggcugaagccgcccgacaaccagccccugaagacccccugcuucacgcuccacuacgccgccccggagcugcugaaccagaacggguacgacgaguccugcgaccucuggagccugggcgugauccuguacaccaugcucuccggccaggugcccuuccagagccacgaccgcucccugaccugcaccagcgcggucgagaucaugaagaagaucaagaagggggacuucuccuucgagggcgaggccuggaagaacgugagccaggaggccaaggaccugauccaggggcuccugacgguggaccccaacaagcggcugaagauguccggccuccgcuacaacgaguggcugcaggacgggagccagcugagcuccaacccccucaugaccccggacauccugggcagcuccggggccgccguccacacgugcgugaaggcgaccuuccacgccuucaacaaguacaagcgggagggcuucugccugcagaacguggacaaggcgccccucgccaagcgccggaagaugaagaagaccagcaccuccaccgagacccgcagcuccagcuccgagagcucccacagcuccagcucccacagccacggcaagaccacgcccaccaagacccugcagccguccaaccccgccgacagcaacaaccccgagacccuguuccaguucagcgacuccgucgccuga

SEQ ID NO: 35923 - RNA, 2238 nt, Artificial Sequence
  derived and/or modified sequence opt1 from RPS6KA6__Homo_sapiens__NP_055311
augcugcccuucgccccgcaggacgagcccugggaccgcgagauggagguguucagcggcgggggcgccuccagcggggaggucaacggccucaagaugguggacgagcccauggaggagggggaggcggacuccugccacgacgagggcguggucaaggagauccccaucacccaccacgugaaggagggcuacgagaaggccgacccggcccaguucgagcugcugaaggugcucgggcagggcagcuucgggaaggucuuccuggugcggaagaagaccggccccgacgccgggcagcuguacgccaugaaggugcucaagaaggcgucccugaagguccgcgaccgggugcgcacgaagauggagcgggacauccugguggaggucaaccaccccuucaucgugaagcuccacuacgccuuccagaccgagggcaagcuguaccugauccucgacuuccugcgcggcggggacguguucacccggcugagcaaggagguccucuucaccgaggaggacgugaaguucuaccuggccgagcuggcccucgcgcuggaccaccuccaccagcugggcaucguguaccgcgaccugaagcccgagaacauccugcucgacgagaucgggcacaucaagcugacggacuucggccuguccaaggagagcgucgaccaggagaagaaggccuacuccuucugcggcaccguggaguacauggccccggagguggucaaccggcgcgggcacagccaguccgccgacugguggagcuacggcgugcucauguucgagaugcugaccgggacccugcccuuccagggcaaggaccggaacgagacgaugaacaugauccucaaggccaagcuggggaugccccaguuccuguccgcggaggcccagagccuccugcgcaugcuguucaagcggaaccccgccaaccgccucggcuccgagggcguggaggagaucaagcggcaccuguucuucgccaacaucgacugggacaagcuguacaagcgcgagguccagccgcccuucaagcccgccagcgggaagcccgacgacaccuucugcuucgacccggaguucaccgcgaagacccccaaggacucccccggccuccccgccagcgccaacgcccaccagcuguucaagggguucuccuucguggccacgagcaucgcggaggaguacaagaucaccccgaucaccagcgccaacguccugcccaucgugcagaucaacggcaacgccgcccaguucggggagguguacgagcucaaggaggacaucggcgucggcuccuacagcgugugcaagcggugcauccacgccaccacgaacauggaguucgcggugaagaucaucgacaaguccaagcgcgaccccagcgaggagaucgagauccugaugcgguacgggcagcaccccaacaucaucacccugaaggacgucuucgacgacggccgcuacguguaccucgugaccgaccugaugaagggcggggagcugcucgaccggauccugaagcagaagugcuucuccgagcgcgaggccagcgacauccuguacgucaucuccaagaccguggacuaccugcacugccagggggugguccaccgcgaccucaagccgagcaacauccuguacauggacgaguccgccagcgccgacuccauccggaucugcgacuucggcuucgcgaagcagcugcgcggcgagaacgggcuccugcugacgcccugcuacaccgccaacuucguggcccccgaggugcucaugcagcagggcuacgacgccgccugcgacaucuggagccuggggguccuguucuacaccaugcucgcgggcuacacccccuucgccaacggcccgaacgacacgcccgaggagauccugcugcggaucgggaacggcaaguucucccucagcgggggcaacugggacaacaucuccgacggggccaaggaccugcugagccacaugcuccacauggacccccaccagcgcuacaccgccgagcagauccugaagcacuccuggaucacccaccgggaccagcugccgaacgaccagcccaagcgcaacgacgugagccacguggucaagggcgccaugguggcgaccuacuccgcccucacgcacaagaccuuccagcccgugcuggagcccgucgccgccagcagccuggcccagcggcgcuccaugaagaagcggaccagcaccggccucuga

SEQ ID NO: 35924 - RNA, 1509 nt, Artificial Sequence
  derived and/or modified sequence opt1 from RPS6KB1__Homo_sapiens__NP_001258971
augcgccggcgccggcgccgggacggcuucuaccccgccccggacuuccgcgaccgggaggccgaggacauggccgggguguucgacaucgaccuggaccagcccgaggacgccggcagcgaggacgagcucgaggagggcgggcagcugaacgaguccauggaccacgggggcgucggccccuacgagcuggggauggagcacugcgagaaguucgagaucagcgagaccuccgugaaccgcggccccgagaagauccggccggagugcuucgagcuccugcgcgugcuggggaagggcggguacggcaaggccaugaucguccggaacgccaaggacaccgcccacacgaaggcggagcgcaacauccucgaggaggugaagcaccccuucaucguggaccugaucuacgccuuccagaccggcgggaagcuguaccucauccuggaguaccugagcggcggggagcuguucaugcagcuggagcgggagggcaucuucauggaggacaccgccugcuucuaccuggccgagaucuccauggcgcucggccaccuccaccagaaggggaucaucuaccgcgaccugaagcccgagaacaucaugcucaaccaccagggccacgucaagcugaccgacuucgggcugugcaaggagagcauccacgacggcacggugacccacaccuucugcgggaccaucgaguacauggcccccgagauccucaugcgguccggccacaaccgcgccguggacugguggagccugggcgcccugauguacgacaugcucacgggggccccgcccuucaccggcgagaaccggaagaagaccaucgacaagauccugaagugcaagcugaaccucccgcccuaccugacccaggaggcgcgcgaccugcucaagaagcugcugaagcggaacgccgccucccgccucggggccggccccggggacgccggcgagguccaggcgcaccccuucuuccggcacaucaacugggaggagcugcuggcccgcaagguggagccgcccuucaagccccuccugcagagcgaggaggacgugucccaguucgacagcaaguucacgcgccagacccccgucgacucccccgacgacagcacccuguccgagagcgccaaccagguguuccucggcuucaccuacguggcccccuccguccuggagagcgugaaggagaaguucuccuucgagccgaagauccggagcccccgccgguucaucgggagcccccgcacgcccguguccccggucaaguucagccccggcgacuucugggggcggggcgccuccgcgagcaccgccaacccccagacccccguggaguacccgauggagaccuccgggaucgagcagauggacgugacgaugagcggcgaggccuccgcgccccugcccauccgccagccgaacagcggccccuacaagaagcaggccuuccccaugaucuccaagcggcccgagcaccuccgcaugaaccuguga

SEQ ID NO: 35925 - RNA, 1449 nt, Artificial Sequence
  derived and/or modified sequence opt1 from RPS6KB2__Homo_sapiens__NP_003943
auggccgccguguucgaccuggaccucgagaccgaggagggcagcgagggggagggcgagcccgagcugucccccgccgacgccugcccccuggccgagcuccgcgccgccgggcuggagcccgucggccacuacgaggagguggagcugaccgagacgagcgugaacgucgggcccgagcggaucggcccccacugcuucgagcuccugcgcgugcugggcaagggcggguacgggaagguguuccagguccggaaggugcagggcaccaaccucgggaagaucuacgcgaugaaggugcugcgcaaggccaagaucguccggaacgccaaggacaccgcccacacccgcgcggagcggaacauccuggaguccgugaagcaccccuucaucguggagcucgccuacgccuuccagacgggcggcaagcuguaccugauccucgagugccugagcgggggcgagcuguucacccaccucgagcgcgaggggaucuuccuggaggacaccgccugcuucuaccuggccgagaucacccucgcgcugggccaccuccacucccagggcaucaucuaccgggaccugaagcccgagaacaucaugcugagcucccaggggcacaucaagcugacggacuucggccucugcaaggagagcauccacgagggggccgucacccacaccuucugcggcaccaucgaguacauggcccccgagauccuggugcgcuccgggcacaaccgggccguggacugguggagccugggcgcccucauguacgacaugcugacgggcuccccgcccuucaccgcggagaaccgcaagaagaccauggacaagaucauccgggggaagcuggcccucccgcccuaccugacccccgacgcccgcgaccuggucaagaaguuccucaagcggaaccccagccagcgcaucggcgggggccccggggacgccgccgacgugcagcggcaccccuucuuccgccacaugaacugggacgaccugcuggcguggcggguggacccgcccuuccgccccugccuccaguccgaggaggacgucagccaguucgacacgcgguucacccgccagacccccguggacuccccggacgacaccgcccugagcgaguccgccaaccaggccuuccugggcuucacguacguggcccccagcguccucgacuccaucaaggagggcuucagcuuccagcccaagcugcgcagcccccggcgccugaacuccagcccgcgggcgcccgugagcccccucaaguucucccccuucgagggguuccgcccgucccccagccugcccgagccgaccgagcugccccucccgccccugcugcccccgccgccgcccuccaccaccgcgccccugcccauccggccgcccagcggcacgaagaaguccaagcgcgggcggggccgccccgggcgguga

SEQ ID NO: 35926 - RNA, 585 nt, Artificial Sequence
  derived and/or modified sequence opt1 from RPS9__Homo_sapiens__XP_006726028
augcccguggcccgcagcugggucugccggaagaccuacgugaccccgcgccggcccuucgagaagucccgccuggaccaggagcucaagcugaucggcgaguacgggcugcggaacaagcgcgagguguggcgggucaaguucacgcucgccaagauccgcaaggcggcccgggagcugcugacccucgacgagaaggacccccgccggcuguucgagggcaacgcccugcuccgccggcuggugcgcaucggggugcuggacgagggcaagaugaagcucgacuacauccuggggcugaagaucgaggacuuccucgagcggcgccugcagacccaggucuucaagcugggccucgccaagagcauccaccacgcccgggugcugauccgccagcggcacauccgcgugcggaagcaggucgugaacauccccuccuucaucgugcgccuggacagccagaagcacaucgacuucucccuccgcagcccguacggcgggggccggcccgggcgcgucaagcggaagaacgcgaagaagggccagggcggggccggcgccggggacgacgaggaggaggacuga

SEQ ID NO: 35927 - RNA, 888 nt, Artificial Sequence
  derived and/or modified sequence opt1 from RPSA__Homo_sapiens__NP_002286
augagcggcgcccuggacgugcuccagaugaaggaggaggacguccugaaguuccuggccgcggggacccaccucggcgggaccaaccuggacuuccagauggagcaguacaucuacaagcgcaaguccgacggcaucuacaucaucaaccugaagcggacgugggagaagcuccugcuggccgcccgcgccaucguggccaucgagaaccccgcggacgugagcgucaucuccagccggaacaccgggcagcgcgccgugcucaaguucgccgccgcgaccggcgccaccccgaucgccggccgguucacgcccgggaccuucaccaaccagauccaggccgccuuccgcgagccccggcugcugguggucaccgacccccgcgcggaccaccagccgcucacggaggccuccuacgugaaccugcccaccaucgcccugugcaacaccgacagcccccuccgguacguggacaucgccauccccugcaacaacaagggcgcccacuccgucgggcugaugugguggaugcuggcgcgcgaggugcuccggaugcgcggcaccaucagccgggagcacccgugggaggugaugcccgaccuguacuucuaccgcgaccccgaggagaucgagaaggaggagcaggccgccgccgagaaggccgucacgaaggaggaguuccagggggaguggaccgcgcccgccccggaguucaccgccacccagcccgagguggccgacugguccgagggcgugcagguccccagcgugcccauccagcaguucccgacggaggacugguccgcccagcccgcgaccgaggacuggagcgccgcccccaccgcccaggcgaccgagugggugggcgccacgaccgacugguccuga

SEQ ID NO: 35928 - RNA, 3534 nt, Artificial Sequence
  derived and/or modified sequence opt1 from RPTOR__Homo_sapiens__NP_001156506
auggagagcgagaugcugcagagcccccuccugggccugggggaggaggacgaggccgaccucaccgacuggaaccugccgcuggccuucaugaagaagcgccacugcgagaagaucgagggcuccaagucccucgcgcagagcuggcggaugaaggaccgcaugaagaccguguccgucgcccuggugcugugccucaacgugggggucgacccgcccgacguggugaagacgacccccugcgcccggcuggagugcuggaucgacccccugagcaugggcccccagaaggcccucgagaccaucggggccaaccugcagaagcaguacgagaacuggcagccccgcgcgcgguacaagcagucccuggaccccaccgucgacgaggugaagaagcucugcacgagccugcgccggaacgccaaggaggagcgcgugcuguuccacuacaacggccacggcgucccgcggcccaccgugaacggggaggugugggucuucaacaagaacuacacccaguacaucccccucuccaucuacgaccugcagaccuggaugggcagccccuccaucuucguguacgacugcagcaacgccgggcugaucgugaaguccuucaagcaguucgcccuccagcgcgagcaggagcuggaggucgcggccaucaacccgaaccacccccuggcccagaugccccugcccccgagcaugaagaacugcauccagcucgccgccugcgaggcgacggagcugcuccccaugauccccgaccugcccgccgaccuguucaccuccugccucaccaccccgaucaagaucgcccugcggugguucugcaugcagaagugcgugagccuggugcccggcgucacgcucgaccugaucgagaagauccccgggcgccugaacgaccggcgcacgccccucggcgagcugaacuggaucuucaccgccaucaccgacaccaucgccuggaacgugcugccgcgggaccucuuccagaagcuguuccgccaggaccugcucguggcgucccuguuccggaacuuccugcucgccgagcgcaucaugcggagcuacaacugcacccccgucuccagcccccgccugcccccgaccuacaugcacgccauguggcaggccugggaccuggccguggacaucugccucagccagcugcccaccaucaucgaggagggcacggcguuccggcacucccccuucuucgccgagcagcugaccgccuuccagguguggcugaccaugggggucgagaaccgcaacccgcccgagcagcuccccaucgugcugcagguccugcucagccaggugcaccgccugcgggcccuggaccuccugggccgcuuccuggaccucgggcccugggccgugucccuggcgcugagcgucggcaucuucccguacgugcucaagcugcugcaguccagcgcccgggagcuccgcccccugcugguguucaucugggccaagauccucgccgucgacuccgagcuggugguggcgcugagccaccucgucgugcaguacgaguccaacuucugcaccguggcccugcaguucaucgaggaggagaagaacuacgcccugcccagccccgccacgaccgagggcgggucccucaccccgguccgggacagccccugcacgccccgccugcgguccgugagcuccuacggcaacauccgcgccguggcgaccgcccggagccugaacaagucccuccagaaccugagccugaccgaggaguccgggggcgccgucgccuucagccccgggaaccucagcaccuccagcuccgccagcuccacccugggcagcccggagaacgaggagcacauccuguccuucgagacgaucgacaagaugcgccgggcgagcuccuacagcucccucaacagccugaucggcguguccuucaacagcguguacacccagaucuggcgcguccugcuccaccuggccgccgaccccuaccccgagguguccgacguggccaugaagguccugaacagcaucgccuacaaggcgaccgugaacgcccggccccagcgcgugcucgacaccuccagccugacgcagagcgccccggccucccccaccaacaaggggguccacauccaccaggcgggcgggagcccgcccgccuccagcaccuccagcuccagccugaccaacgacguggccaagcagcccgugucccgggaccuccccagcggccgccccgggaccacgggccccgccggcgcccaguacaccccgcacucccaccaguucccccggacccgcaagauguucgacaaggggcccgagcagaccgcggacgacgccgacgacgccgccggccacaagagcuucaucuccgccacgguccagaccggguucugcgacuggagcgcgcgguacuucgcccagccggugaugaagauccccgaggagcacgaccuggagucccagauccgcaaggagcgcgaguggcgguuccugcgcaacagccgggugcgccggcaggcccagcaggucauccagaagggcaucacccgccucgacgaccagaucuuccugaaccggaaccccggggugcccuccguggucaaguuccacccguucacccccugcaucgccguggccgacaaggacagcaucugcuucugggacugggagaagggcgagaagcuggacuacuuccacaacggcaacccccgcuacacgcgggugaccgcgauggaguaccucaacgggcaggacugcucccugcugcucaccgccaccgacgacggcgccauccgcgucuggaagaacuucgccgaccuggagaagaaccccgagauggugacggcguggcaggggcugagcgacaugcucccgaccacccggggcgccggcaugguggucgacugggagcaggagaccgggcugcugaugagcuccggcgacgugcgcaucgugcggaucugggacacggaccgcgagaugaagguccaggacauccccaccggggccgacagcugcgugaccucccucagcugcgacucccaccggagccugaucguggccggccugggggacggcuccauccgcgucuacgaccggcgcauggcccucagcgagugccgggugaugaccuaccgcgagcacacggcguggguggucaaggccucccugcagaagcggcccgacggccacaucgugagcguguccgucaacggggacgugcgcaucuucgacccccgcaugccggagagcgucaacgugcugcagaucgugaagggccucaccgcccuggacauccacccccaggccgaccugaucgccugcggguccgucaaccaguucaccgcgaucuacaacagcuccggcgagcucaucaacaacaucaaguacuacgacggguucaugggccagcgggugggcgccaucagcugccuggccuuccacccccacuggccccaccuggccgugggguccaacgacuacuacaucagcgucuacuccguggagaagcgcgugcgguga

SEQ ID NO: 35929 - RNA, 996 nt, Artificial Sequence
  derived and/or modified sequence opt1 from RQCD1__Homo_sapiens__NP_001258563
augcacagccuggccaccgccgcgcccgugccgaccacgcucgcccaggucgaccgcgagaagaucuaccaguggaucaacgagcuguccagccccgagacccgggagaacgcccugcucgagcuguccaagaagcgcgagagcgugcccgaccuggcccccaugcucuggcacuccuucggcaccaucgccgcgcugcugcaggagaucgugaacaucuacccgagcaucaacccgcccacccucacggcccaccaguccaaccgggucugcaacgcccuggcccugcuccagugcguggcgagccaccccgagacccgcuccgccuuccuggccgcccacaucccccuguuccucuaccccuuccugcacaccgugagcaagacccggcccuucgaguaccugcgccucacgucccugggggucaucguggagaccggcuuccaccacguggggcaggccgaccuggagcuccccaccagcuccgaccugccggcgagcgccucccagagcgccggcaucaccggggcccuggucaagacggacgagcaggaggugaucaacuuccuccugaccaccgagaucaucccccugugccuccggaucauggaguccggcagcgagcuguccaagaccguggccacguucauccugcagaagauccuccuggacgacaccggccuggcguacaucugccagaccuacgagcgcuucagccacgucgccaugauccucgggaagauggugcugcagcugagcaaggagcccuccgcccggcuccugaagcacgugguccgcugcuaccugcggcucagcgacaacccccgcgcccgggaggcccugcgccagugccugccggaccagcucaaggacaccacguucgcccaggugcugaaggacgacaccaccaccaagcgguggcuggcgcagcucgugaagaaccugcaggagggccaggucacggacccccgcgggaucccccugcccccgcaguga

SEQ ID NO: 35930 - RNA, 927 nt, Artificial Sequence
  derived and/or modified sequence opt1 from RRAD__Homo_sapiens__NP_001122322
augacccugaacggcgggggcagcggggccggcgggucccgcggcggcgggcaggagcgggagcgccggcgcggcagcacccccugggggccggccccgccccuccaccggcgcuccaugcccguggacgagcgggaccugcaggcggcccugacgcccggcgcccucaccgccgccgcggccgggaccggcacccagggcccccgccuggacuggcccgaggacagcgaggacucccugagcuccgggggcagcgacuccgacgagagcgucuacaaggugcuccugcugggggcccccggcgugggcaaguccgcccucgcgcggaucuucgggggcgucgaggacgggccggaggccgaggccgccggccacacguacgaccgcagcaucgugguggacggggaggaggccucccugauggucuacgacaucugggagcaggacggcggccgguggcugcccgggcacugcauggcgaugggcgacgccuacgugaucguguacagcgucaccgacaagggguccuucgagaaggccagcgagcuccgcgugcagcugcggcgcgcccggcagaccgacgacgugcccaucauccuggucggcaacaaguccgaccucgugcgcagccgggagguguccgucgacgaggggcgcgccugcgcggugguguucgacugcaaguucaucgagaccagcgccgcccugcaccacaacguccaggcccuguucgagggcguggugcggcagauccgccuccggcgcgacagcaaggaggccaacgcgcgccggcaggccggcacgcgccggcgcgagucccuggggaagaaggccaagcgguuccugggccgcaucgucgcccggaacagccgcaagauggccuuccgggcgaaguccaagagcugccacgaccucuccgugcuguga

SEQ ID NO: 35931 - RNA, 942 nt, Artificial Sequence
  derived and/or modified sequence opt1 from RRAGA__Homo_sapiens__NP_006561
augcccaacaccgccaugaagaagaaggugcugcucaugggcaagagcggguccggcaagaccagcaugcgcuccaucaucuucgccaacuacaucgcgcgggacacgcgccggcugggggccaccaucgacgucgagcacagccacgugcgcuuccugggcaaccucgugcugaaccugugggacugcgggggccaggacaccuucauggagaacuacuucaccucccagcgggacaacaucuuccgcaacgucgaggugcucaucuacguguucgacgucgagagccgggagcuggagaaggacaugcacuacuaccaguccugccuggaggccauccuccagaacagcccggacgccaagaucuucugccuggugcacaagauggaccuggugcaggaggaccagcgcgaccucaucuucaaggagcgggaggaggaccugcgccggcugucccgcccccucgagugcgccugcuuccggacgagcaucugggacgagacccuguacaaggcgugguccagcaucgucuaccagcugauccccaacgugcagcagcucgagaugaaccugcgcaacuucgcccagaucaucgaggccgacgaggugcuccuguucgagcgggccaccuuccuggucaucucccacuaccagugcaaggagcagcgcgacgugcaccgguucgagaagaucagcaacaucaucaagcaguucaagcuguccugcagcaagcucgcggccuccuuccagagcauggaggugcgcaacuccaacuucgccgccuucaucgacaucuucaccagcaacacguacgucaugguggugaugagcgaccccuccaucccgagcgccgcgacccugaucaacauccggaacgcccgcaagcacuucgagaagcuggagcgggucgacggccccaagcacucccuccugaugcgcuga

SEQ ID NO: 35932 - RNA, 384 nt, Artificial Sequence
  derived and/or modified sequence opt1 from RRAS2__Homo_sapiens__NP_001096139
augcgcgagcaguacaugcggaccggcgagggguuccugcucguguucagcgucaccgaccgcggcuccuucgaggagaucuacaaguuccagcggcagauccugcgcgugaaggaccgggacgaguuccccaugauccugaucgggaacaaggccgaccucgaccaccagcgccaggugacgcaggaggagggccagcagcuggcccggcagcugaaggucaccuacauggaggcgagcgccaagauccgcaugaacguggaccaggccuuccacgagcucgugcgggucauccgcaaguuccaggagcaggagugcccgcccucccccgagcccacccggaaggagaaggacaagaaggggugccacugcgugaucuucuga

SEQ ID NO: 35933 - RNA, 657 nt, Artificial Sequence
  derived and/or modified sequence opt1 from RRAS__Homo_sapiens__NP_006261
augagcuccggggccgccagcgggaccggccgcgggcggccccgcggcgggggccccggccccggggacccgccgcccuccgagacccacaagcugguggucgugggcgggggcggggugggcaagagcgcccucacgauccaguucauccaguccuacuucgucagcgacuacgaccccaccaucgaggacuccuacaccaagaucugcagcguggacggcauccccgcccggcuggacauccuggacaccgccgggcaggaggaguucggcgccaugcgcgagcaguacaugcgggccgggcacggcuuccuccugguguucgcgaucaacgaccgccaguccuucaacgaggucggcaagcuguucacgcagauccuccgggugaaggaccgcgacgacuuccccgugguccugguggggaacaaggccgaccuggagagccagcgccaggugccccgguccgaggccagcgccuucggcgcgucccaccacgucgccuacuucgaggccagcgccaagcuccggcugaacguggacgaggccuucgagcagcuggugcgcgcgguccggaaguaccaggagcaggagcucccgcccagcccgcccuccgcgccccgcaagaagggcggcgggugccccugcgugcugcuguga

SEQ ID NO: 35934 - RNA, 2934 nt, Artificial Sequence
  derived and/or modified sequence opt1 from RRBP1__Homo_sapiens__NP_001036041
auggacaucuacgacacccagacccugggcguggucguguucgggggcuucaugguggucagcgccaucgggaucuuccucguguccacguucagcaugaaggagaccuccuacgaggaggcccuggcgaaccagcgcaaggagauggccaagacccaccaccagaagguggagaagaagaagaaggagaagaccgucgagaagaagggcaagacgaagaagaaggaggagaagcccaacgggaagaucccggaccacgaccccgcccccaacgugaccgugcugcuccgggagcccguccgcgccccggccguggcgguggcccccacccccguccagcccccgaucaucguggcccccguggccaccguccccgcgaugccccaggagaagcuggccagcuccccgaaggacaagaagaagaaggagaagaagguggccaagguggagcccgccgucagcuccguggugaacagcauccagguccugacguccaaggccgcgauccucgagaccgcccccaaggagggccggaacaccgacguggcccagagccccgaggccccgaagcaggaggcccccgcgaagaagaaguccggcagcaagaagaaggggccgcccgacgccgacggcccccuguaccugcccuacaagacccucguguccacggucgggagcaugguguucaacgagggcgaggcccagcgccugaucgagauccuguccgagaaggccgggaucauccaggacaccuggcacaaggccacccagaagggcgaccccgucgcgauccucaagcggcagcuggaggagaaggagaagcugcucgccaccgagcaggaggacgccgccguggccaagagcaagcugcgcgagcugaacaaggagauggcggccgagaaggccaaggccgcggccggcgaggccaaggugaagaagcagcucgucgcccgggagcaggagaucacggccgugcaggcgcgcaugcaggccuccuaccgggagcacgugaaggagguccagcagcugcaggggaagauccgcacccugcaggagcagcucgagaacggccccaacacccagcuggcccggcugcagcaggagaacagcauccuccgcgacgcccugaaccaggccaccucccagguggagagcaagcagaacgcggagcuggccaagcuccggcaggagcugagcaagguguccaaggagcuggucgagaaguccgaggccgugcgccaggacgagcagcagcggaaggcccucgaggccaaggcggccgccuucgagaagcagguccugcagcugcaggccagccaccgcgagagcgaggaggcgcuccagaagcggcuggacgaggugucccgcgagcugugccacacgcagagcucccacgccagccuccgggccgacgccgagaaggcccaggagcagcagcagcagauggcggagcugcacuccaagcugcagagcuccgaggccgaggugcgcagcaagugcgaggagcucuccgggcugcacggccagcugcaggaggcccgggccgagaacagccagcucaccgagcgcauccgcuccaucgaggcccugcuggaggcgggccaggcccgggacgcccaggacgugcaggccagccaggccgaggcggaccagcagcagacccgccucaaggagcuggagucccaggucagcgggcuggagaaggaggccaucgagcuccgggaggccguggagcagcagaaggugaagaacaacgaccugcgcgagaagaacuggaaggccauggaggcgcuggccaccgccgagcaggccugcaaggagaagcugcacucccucacgcaggccaaggaggagagcgagaagcagcugugccugaucgaggcgcagaccauggaggcccuccuggcccugcucccggagcugagcguccuggcccagcagaacuacaccgaguggcuccaggaccugaaggagaagggccccacccugcucaagcacccgcccgcccccgcggagcccuccagcgaccuggccuccaagcugcgggaggccgaggagacgcagagcacccuccaggccgagugcgaccaguaccgcuccauccuggccgagaccgaggggaugcugcgggaccuccagaaguccguggaggaggaggagcaggucuggcgcgcgaaggugggcgccgccgaggaggagcugcagaagucccgggugaccgugaagcaccuggaggagaucgucgagaagcucaagggggagcuggagagcagcgaccaggugcgcgagcacacgagccaccuggaggccgagcucgagaagcacauggccgcggccuccgccgagugccagaacuacgccaaggagguggcgggccugcggcagcugcuccuggagagccagucccagcuggacgccgccaagagcgaggcccagaagcaguccgacgagcucgcccugguccgccagcagcugagcgagaugaagucccacguggaggacggcgacaucgcgggggcccccgccagcagcccggaggccccgcccgccgagcaggaccccgugcagcucaagacccagcuggaguggaccgaggcgauccuggaggacgagcagacccagcggcagaagcucacggccgaguucgaggaggcccagaccuccgccugccgccugcaggaggagcuggagaagcuccggaccgccggcccccuggagagcuccgagaccgaggaggcgagccagcugaaggagcgccucgagaaggagaagaagcugaccuccgaccuggggcgggccgccacgcgccuccaggagcugcugaagaccacccaggagcagcucgcccgggagaaggacaccgucaagaagcugcaggagcagcuggagaaggcggaggacggcagcuccagcaaggaggggacguccguguga

SEQ ID NO: 35935 - RNA, 4431 nt, Artificial Sequence
  derived and/or modified sequence opt1 from RREB1__Homo_sapiens__NP_001003700
augaccagcuccagccccgccggccuggagggguccgaccucagcuccaucaacaccaugaugagcgccgugauguccgucggcaaggugacggagaacgggggcagcccgcaggggaucaagucccccagcaagccgcccggccccaaccgcaucggccggcgcaaccaggagaccaaggaggagaaguccagcuacaacugcccccugugcgagaagaucugcaccacccagcaccagcugacgaugcacauccggcagcacaacaccgacaccgggggcgcggaccacuccugcagcaucugcgggaagucccucagcuccgccagcucccuggaccgccacaugcuggugcacagcggcgagcggcccuacaagugcaccgucugcgggcagagcuucacgaccaacggcaacaugcaccgccacaugaagauccacgagaaggaccccaacuccgccaccgccaccgccccgcccagcccccucaagcggcgccggcuguccagcaagcgcaagcugucccacgacgcggagagcgagcgggaggaccccgccccggccaagaagaugguggaggacggccaguccggggaccucgagaagaaggccgacgagguguuccacugccccgucugcuucaaggaguucgugugcaaguacggccuggagacgcacauggagacccacagcgacaacccccugcgcugcgacaucugcugcgugaccuuccggacccaccgcgggcuccugcggcacaacgcgcugguccacaagcagcucccccgcgacgccaugggccggccguucauccagaacaaccccuccauccccgccggcuuccacgaccugggguucacggacuucagcugccgcaaguucccccggaucucccaggccuggugcgagaccaaccugcgccggugcaucagcgagcagcaccgcuucgugugcgacacgugcgacaaggccuucccgaugcucugcucccuggcgcugcacaagcagacccacguggccgccgaccagggccaggagaagccccaggccacgccccuccccggggacgcccuggaccagaagggcuuccuggcgcuccuggggcugcagcacaccaaggacguccgcccggcccccgccgaggagccccuccccgacgacaaccaggccauccagcugcagacccugaagugccagcucccgcaggaccccggcugcaccaaccugcugagccucucccccuucgaggccgcgagccugggcgggucccugacggugcucccggccaccaaggacagcaucaagcaccugucccugcagcccuuccagaagggcuucaucauccagcccgacagcagcaucguggucaagcccaucuccggggagagcgccaucgagcucgccgacauccagcagauccugaagauggccgcguccgccccgccccagaucagccugccgcccuucuccaaggcccccgccgcgccccuccaggccaucuucaagcacaugccgccccugaagcccaagccccuggugacgccccggaccguggucgccaccagcacgcccccgccccucaucaacgcccagcaggccucccccggcugcaucagccccucccugccgcccccgccccugaagcuccugaaggggagcguggaggcggccuccaacgcccaccuccugcagagcaaguccggcacccagccccacgccgccacccgccugagccugcagcagccccgggcggagcugcccggccagccggagaugaagacccagcucgagcaggacuccaucaucgaggcccugcugccccucagcauggaggccaagaucaagcaggagaucaccgagggggagcugaaggccuucaugaccgcccccggcgggaagaagacccccgcgaugcgcaaggugcuguacccgugccgguucugcaaccaggucuucgccuucuccggcgugcuccgcgcccacgugcggagccaccuggggaucagccccuaccagugcaacaucugcgacuacaucgccgcggacaaggccgcccugauccgccaccuccggacccacuccggcgagcgccccuacaucugcaagaucugccacuaccccuucaccgucaaggccaacugcgagcggcaccuccgcaagaagcaccugaaggccacccggaaggacaucgagaagaacaucgaguacgugagcuccagcgcggccgagcuggucgacgccuucugcgccccggacaccgugugccgccugugcggcgaggaccugaagcacuaccgggcccuccgcauccacaugcggacccacugcgggcgcggccucgggggcggccacaaggggcggaagcccuucgagugcaaggagugcuccgcggccuucgccgccaagcgcaacugcauccaccacauccugaagcagcaccuccacgugcccgagcaggacaucgagagcuacguccuggccgcggacggccuggggcccgccgaggccccggccgcggaggccuccggccgcggggaggacagcggcugcgccgcccugggcgacugcaagccccugacggccuuccuggagccccagaacggguuccuccaccggggccccacccagccgcccccgccccacguguccaucaagcuggagcccgcgagcuccuucgccguggacuucaacgagccccuggacuucagccagaaggggcucgcccugguccaggugaagcaggagaacaucuccuuccugagccccuccagccucgugcccuacgacugcuccauggagccgaucgaccugagcauccccaagaacuuccgcaagggcgacaaggaccuggccacccccuccgaggccaagaagcccgaggaggaggcggggagcagcgagcagccgucccccugccccgccccgggccccagccuccccgucacccugggccccuccgggauccuggagagcccgauggcccccgcccccgccgcgacgcccgagccgcccgcccagccccuccagggccccgugcagcuggccgugccgaucuacuccagcgcccuggucuccagcccgccccucgugggguccagcgcccugcuguccggcaccgcgcuccugcggccccugcgccccaagccgccccuccugcugcccaagccgcccgugaccgaggagcucccgccccuggccagcaucgcccagaucaucuccagcgucuccagcgcccccacccugcucaagacgaagguggcggaccccgggcccgccuccaccggcagcaacaccaccgccuccgacagccugggcgggagcgugcccaaggccgccacgaccgcgacccccgccgccaccacgucccccaaggagagcuccgagcccccggcccccgccagcucccccgaggcggccagccccaccgagcagggcccggccgggaccuccaagaagcggggccgcaagcgggggaugcgcagccggccccgcgccaacuccggcggcgucgaccuggacagcuccggggaguucgccagcaucgagaagaugcucgcgaccacggacaccaacaaguucucccccuuccugcagaccgccgaggacaacacccaggacgagguggccggcgcccccgcggaccaccacgggccgagcgacgaggagcagggcuccccgcccgaggacaagcugcuccgggccaagcgcaacagcuacacgaacugccugcagaagaucacgugcccccacugcccccggguguuccccugggccuccagccugcagcgccacaugcucacccacaccggccagaagcccuuccccugccagaagugcgacgccuucuucuccaccaaguccaacugcgagcggcaccagcugcgcaagcacggggucacgaccugcagccugcggcgcaacggccucaucccgcagagcaaggagagcgacguggggucccacgacagcaccggcgagcggcccuacaagugccagaccugcgagcgcaccuucacccugaagcacucccuggugcggcaccagcgcauccaccagaaggcccgccacgcgaagcaccacgggaaggacagcgacaaggaggagcggggcgaggaggacuccgagaacgagagcacccacuccggcaacaacgccgucagcgagaacgaggccgagcucgcccccaacgccuccaaccacauggcggugacgcgcagccggaaggaggggcuggccuccgccaccaaggacugcagccaccgcgaggagaaggugaccgccggcuggcccuccgagccggggcagggcgaccugaaccccgagagccccgccgcgcucgggcaggaccugcuggagccccgguccaagcgcccggcccaccccauccucgccaccgccgacggcgcgagccagcuggucggcauggaguga

SEQ ID NO: 35936 - RNA, 1014 nt, Artificial Sequence
  derived and/or modified sequence opt1 from RRH__Homo_sapiens__NP_006574
augcugcgcaacaaccucggcaacagcuccgacagcaagaacgaggacggguccguguucagccagaccgagcacaacaucgucgccaccuaccugaucauggccggcaugaucuccaucaucagcaacaucaucgugcuggggaucuucaucaaguacaaggagcuccggacgcccaccaacgcgaucaucaucaaccuggccgugaccgacaucggcgucuccagcaucggguacccgauguccgccgccagcgaccuguacggcuccuggaaguucggcuacgccgggugccagguguacgcgggccucaacaucuucuucgggauggccagcaucggccugcugaccguggucgccguggaccgcuaccucacgaucugccugcccgacguggggcggcgcaugaccaccaacaccuacaucggccugauccucggcgccuggaucaacgggcuguucugggcgcugaugcccaucaucggcugggccuccuacgcccccgacccgacgggggcgaccugcaccaucaacuggcggaagaacgaccgcagcuucgucuccuacaccaugacggugaucgccaucaacuucaucgugccccucaccgucauguucuacugcuacuaccacgugacccugagcaucaagcaccacaccacguccgacugcaccgagagccugaaccgggacugguccgaccagaucgacgugaccaagaugagcgucaucaugaucugcauguuccucguggccuggagccccuacuccaucgugugccugugggccagcuucggcgaccccaagaagaucccgccgcccauggccaucaucgcgccccuguucgccaaguccagcaccuucuacaaccccugcaucuacgucguggccaacaagaaguuccgccgggccaugcucgccauguucaagugccagacgcaccagaccaugcccgugaccuccauccugcccauggacgucagccagaacccccuggccuccggccgcaucuga

SEQ ID NO: 35937 - RNA, 2379 nt, Artificial Sequence
  derived and/or modified sequence opt1 from RRM1__Homo_sapiens__NP_001024
augcacgugaucaagcgcgacggccggcaggagcgcgucauguucgacaagaucaccagccggauccagaagcugugcuacgggcucaacauggacuucguggaccccgcccagaucaccaugaaggugauccagggccuguacuccggggucacgaccguggagcuggacacccucgccgcggagaccgccgccacgcugaccaccaagcacccggacuacgccauccuggccgcgcgcaucgccgugagcaaccuccacaaggagaccaagaaggucuucuccgacgugauggaggaccuguacaacuacaucaacccccacaacggcaagcacagccccaugguggccaaguccacgcuggacaucguccucgccaacaaggaccggcugaacagcgcgaucaucuacgaccgcgacuucuccuacaacuacuucggguucaagacccuggagcggagcuaccuccugaagaucaacggcaagguggccgagcgcccccagcacaugcugaugcggguguccgucggcauccacaaggaggacaucgacgccgccaucgagaccuacaaccuccugagcgagcgcugguucacccacgccuccccgacgcuguucaacgcggggaccaaccggccccagcucagcuccugcuuccugcugagcaugaaggacgacuccaucgagggcaucuacgacacccucaagcagugcgcccugaucagcaaguccgccgggggcaucgggguggccgugagcugcauccgcgccaccggcuccuacaucgcgggcacgaacgggaacagcaacggccugguccccaugcuccggguguacaacaacaccgcccgcuacguggaccagggcgggaacaagcggcccggcgccuucgccaucuaccuggagccguggcaccuggacaucuucgaguuccucgaccugaagaagaacaccgggaaggaggagcagcgcgcccgggaccuguucuucgcgcucuggauccccgaccuguucaugaagcgcgucgagaccaaccaggacuggagccugaugugccccaacgagugccccggccucgacgagguguggggcgaggaguucgagaagcuguacgccuccuacgagaagcaggggcgggugcgcaaggucgugaaggcccagcagcugugguacgccaucaucgagagccagacggagaccgggaccccguacaugcucuacaaggacuccugcaaccgcaagagcaaccagcagaaccugggcaccaucaagugcuccaaccugugcacggagaucguggaguacaccagcaaggacgaggucgccgugugcaaccucgcgucccuggcccugaacauguacgucaccagcgagcacaccuacgacuucaagaagcucgccgaggugacgaagguggucgugcggaaccugaacaagaucaucgacaucaacuacuaccccgugcccgaggccugccuguccaacaagcgccaccggcccaucggcaucgggguccagggccucgcggacgccuucauccugaugcgcuacccguucgagagcgccgaggcccagcugcucaacaagcagaucuucgagaccaucuacuacggggcccuggaggcguccugcgaccuggccaaggagcagggccccuacgagaccuacgaggggagccccguguccaagggcauccugcaguacgacauguggaacgugacccccacggaccucugggacuggaagguccugaaggagaagaucgccaaguacggcauccggaacagccugcucaucgccccgaugcccaccgccuccaccgcgcagauccuggggaacaacgagagcaucgagcccuacaccuccaacaucuacacgcgccgggugcugagcggcgaguuccagaucgugaacccccaccuccugaaggaccugaccgagcgcgggcucuggcacgaggagaugaagaaccagaucaucgccugcaacggcuccauccagagcaucccggagauccccgacgaccugaagcagcuguacaagaccgucugggagaucagccagaagaccgugcucaagauggccgccgagcgcggggccuucaucgaccagucccagagccugaacauccacaucgcggagcccaacuacggcaagcugaccuccaugcacuucuacggcuggaagcaggggcucaagacgggcauguacuaccugcggacccggcccgccgccaacccgauccaguucacccugaacaaggagaagcucaaggacaaggagaaggugagcaaggaggaggaggagaaggagcgcaacaccgccgcgauggucugcucccuggagaaccgggacgagugccugaugugcgggagcuga

SEQ ID NO: 35938 - RNA, 1272 nt, Artificial Sequence
  derived and/or modified sequence opt1 from RRM2B__Homo_sapiens__NP_001165948
augcugcuccugcgccugcccccgcaccggagccacgccagcccccucgacugcaagcugcaggaccgcugccggaagugcuacagcccccgcuccggccaggccugcccgcccgcgcuggccgccgccuggcuccggcgcugcgagcggcgcgggggccggccccgcgggggccggcgcaaggagcugacccuggggcuccggcccgcccgcugcagcgcgcccggcccggccaaggacgacgccuggcggccccaggccggccgcuccagcuccgacaccaacgagagcgagaucaaguccaacgaggagccccugcugcggaaguccucccgccgguucgugaucuuccccauccaguacccggacaucuggaagauguacaagcaggcgcaggccagcuucuggacggccgaggaggucgaccucuccaaggaccugccccacuggaacaagcugaaggccgacgagaaguacuucaucagccacauccucgccuucuucgcggccuccgacgggaucgugaacgagaaccugguggagcgcuucagccaggagguccaggugcccgaggcccggugcuucuacggcuuccagauccugaucgagaacgugcacuccgagauguacagccuccugaucgacaccuacauccgcgaccccaagaagcgcgaguuccuguucaacgccaucgagaccaugccguacgucaagaagaaggccgacugggcgcuccgguggaucgccgaccgcaaguccaccuucggggagcgggugguggccuucgccgccgucgagggcguguucuucagcgggagcuucgcggccaucuucuggcugaagaagcgcggccugaugcccggccucacguucuccaacgagcugaucagccgggacgaggggcugcacugcgacuucgccugccucauguuccaguaccuggugaacaagcccuccgaggagcgcguccgggagaucaucguggacgccgugaagaucgagcaggaguuccugaccgaggcccuccccgucggccugaucgggaugaacugcauccugaugaagcaguacaucgaguucguggcggaccgccuccugguggagcugggcuucagcaaggucuuccaggccgagaacccguucgacuucauggagaacaucucccucgagggcaagaccaacuucuucgagaagcgggugagcgaguaccagcgcuucgccgugauggccgagaccacggacaacgucuucacccuggacgcggacuucuga

SEQ ID NO: 35939 - RNA, 1170 nt, Artificial Sequence
  derived and/or modified sequence opt1 from RRM2__Homo_sapiens__NP_001025
augcugagccuccgcgugccccuggccccgaucaccgacccccagcagcugcagcucagcccccugaagggccugucccucgucgacaaggagaacacgcccccggcccuguccgggacccgggugcuggcgagcaagaccgcccgccggaucuuccaggagcccaccgagcccaagaccaaggccgccgcccccggcguggaggacgagccgcuccugcgcgagaacccccggcgcuucgucaucuuccccaucgaguaccacgacaucuggcagauguacaagaaggcggaggccuccuucuggacggccgaggagguggaccugagcaaggacauccagcacugggagucccucaagcccgaggagcgguacuucaucagccacgugcuggccuucuucgcggccuccgacgggaucgucaacgagaaccugguggagcgcuucagccaggaggugcagaucaccgaggcccggugcuucuacggcuuccagaucgccauggagaacauccacuccgagauguacagccuccugaucgacaccuacaucaaggacccgaaggagcgcgaguuccuguucaacgccaucgagaccaugcccugcgucaagaagaaggcggacugggcccuccgguggaucggggacaaggaggccacguacggcgagcgcgugguggccuucgccgcggucgagggcaucuucuucuccgggagcuucgccuccaucuucuggcugaagaagcggggccugaugcccgggcucaccuucagcaacgagcugaucucccgcgacgagggccugcacugcgacuucgccugccucauguucaagcaccuggugcacaagcccagcgaggagcgggugcgcgagaucaucaucaacgccguccggaucgagcaggaguuccugaccgaggcccucccggugaagcugaucgggaugaacugcacccugaugaagcaguacaucgaguucguggcggaccgccucaugcuggagcugggcuucuccaaggucuuccggguggagaaccccuucgacuucauggagaacaucagccucgagggcaagacgaacuucuucgagaagcgcgugggggaguaccagcggaugggcgucaugagcucccccaccgagaacagcuucacccuggacgccgacuucuga

SEQ ID NO: 35940 - RNA, 1866 nt, Artificial Sequence
  derived and/or modified sequence opt1 from RRN3__Homo_sapiens__NP_001287993
auggccgcgccccugcuccacacccgccugccgggcgacgccgccgccagcuccagcgccgugaagaagcugggggccucccggaccggcaucagcaacaugcgcgcgcucgagaacgacuucuucaacuccccgccccggaagacgguccgcuucgggggcaccgugaccgaggugcugcugaaguacaagaagggggagaccaacgacuucgagcuccugaagaaccagcugcucgaccccgacaucaagcggcugcccuggcugaaccgcagccagacggucguggaggaguaccucgccuuccugggcaaccugguguccgcccagaccgucuuccuccggcccugccugagcaugaucgccucccacuucgugccgccccgcgugaucaucaaggagggcgacgucgacgugagcgacuccgacgacgaggacgacaaccugcccgcgaacuucgacacgugccaccgggcccuccagaucaucgcccgcuacgugcccagcacccccugguuccugaugcccauccuggucgagaaguucccguucgugcggaaguccgagcgcacccucgagugcuacgugcacaaccugcugcggaucagcgucuacuuccccacccuccgccacgagauccuggagcugaucaucgagaagcuccugaagcuggacgugaacgccucccggcaggggaucgaggacgccgaggagaccgcgacccagacgugcggcgggaccgacagcaccgagggccucuucaacauggacgaggacgaggagaccgagcacgagacgaaggccgggcccgagcgccuggaccagauggugcaccccgucgccgagcggcuggacauccucaugucccuggugcugagcuacaugaaggacgugugcuacgucgacggcaagguggacaacggcaagaccaaggaccucuaccgcgaccugaucaacaucuucgacaagcugcuccugccgacccacgccuccugccacgugcaguucuucauguucuaccugugcagcuucaagcucggguucgccgaggcguuccuggagcaccuguggaagaagcuccaggaccccagcaaccccgccaucauccggcaggccgccggcaacuacaucggguccuuccuggcccgcgcgaaguucaucccccugaucaccgucaagagcugccucgaccugcuggugaacuggcugcacaucuaccucaacaaccaggacuccggcacgaaggccuucugcgacgucgcccugcacggcccguucuacagcgccugccaggccguguucuacaccuucguguuccggcacaagcagcugcucuccgggaaccugaaggagggccugcaguaccuccagagccugaacuucgagcgcaucgucaugucccagcugaacccccucaagaucugccugcccagcguggugaacuucuucgcggccaucaccaacaaguaccagcuggucuucugcuacaccaucaucgagcgcaacaaccggcagaugcuccccgugauccgcuccacggccgggggcgacagcgugcagaucugcaccaacccgcuggacaccuucuuccccuucgaccccugcguccugaagcgguccaagaaguucaucgaccccaucuaccaggugugggaggacaugagcgccgaggagcuccaggaguucaagaagccgaugaagaaggacaucguggaggacgaggacgacgacuuccugaagggggaggucccccagaacgacaccgugaucggcaucacgcccuccagcuucgacacccacuuccgcuccccgagcuccagcgugggcuccccgcccguccuguacaugcagcccagcccccucuga

SEQ ID NO: 35941 - RNA, 834 nt, Artificial Sequence
  derived and/or modified sequence opt1 from RRNAD1__Homo_sapiens__NP_001136032
augcccggcaucagcgcccgcgggcugucccacgagggccggaagcagcucgccgugaaccugacccgcguccuggcgcucuaccggagcauccuggacgccuacaucaucgaguucuucaccgacaaccugugggacacgcucccgugcuccuggcaggaggcccuggacgggcugaagccgccccagcucgccaccaugcugcugggcaugcccggggagggcgagguggugcgcuaccggagcgucuggccccucacccugcuggcccucaaguccaccgcgugcgcccuggccuucacgcgcaugcccggcuuccagacccccagcgaguuccuggagaaccccucccagagcucccggcucaccgccccguuccgcaagcacgugcggcccaagaagcagcacgagauccgccggcugggggagcuggugaagaagcucagcgacuucaccggcugcacgcaggucguggacgugggguccggccaggggcaccugagccgcuucauggcgcugggccucggccugauggucaaguccaucgagggggaccagcggcugguggagcgcgcccagcggcucgaccaggagcugcugcaggcccucgagaaggaggagaagcgcaacccccagaucugcgccgccggcgcgaccgccagcggggcccggucccccgccgccaccgagagcggcugcccguccggcccccgcgggcccggcgagcccugcgggggccugcugcagccggggagcaccgcgugccccacgggcggcgacgccuacuccaccgggcccgccgccgugcccagcggcaccggguucccgugcuga

SEQ ID NO: 35942 - RNA, 2277 nt, Artificial Sequence
  derived and/or modified sequence opt1 from RRP1B__Homo_sapiens__NP_055871
auggcccccgccaugcagccggcggagauccaguucgcccagcgccuggccagcuccgagaagggcauccgggaccgcgccgugaagaagcuccggcaguacaucagcgucaagacccagcgcgagaccgggggcuucucccaggaggagcugcugaagaucuggaagggccucuucuacugcaugugggugcaggacgagccccugcugcaggaggagcucgccaacaccaucgcgcagcuggugcacgccgucaacaacagcgccgcccagcaccuguucauccagaccuucuggcagaccaugaaccgggaguggaagggcaucgaccgccuccggcuggacaaguacuacaugcugauccgccucgugcugcggcaguccuucgaggugcugaagcgcaacgggugggaggagagccggaucaaggucuuccucgacgugcugaugaaggaggugcugugccccgagucccagagccccaacggcguccgcuuccacuucaucgacaucuaccucgacgagcuguccaaggugggcgggaaggagcugcucgcggaccagaaccugaaguucaucgacccguucugcaagaucgccgccaagaccaaggaccacacgcuggugcagaccaucgcccggggcgucuucgaggccaucguggaccagagccccuucgugcccgaggagaccauggaggagcagaagaccaaggucggggacggcgaccucuccgcggaggagauccccgagaacgaggugagccugcgccgggccguguccaagaagaagacggcccuggggaagaaccacagccgcaaggacggccucuccgacgagcggggccgcgacgacugcgggaccuucgaggacaccggcccgcugcugcaguucgacuacaaggccgucgccgaccggcuccuggagaugaccagccgcaagaacacgccccacuucaaccggaagcgccuguccaagcucaucaagaaguuccaggaccugagcgagggguccagcaucagccagcuguccuucgcggaggacaucagcgccgacgaggacgaccagauccucucccagggcaagcacaagaagaagggcaacaagcugcuggagaagaccaaccucgagaaggagaaggggagccgcguguucugcguggaggaggaggacuccgagagcucccugcagaagcggcgccggaagaagaagaagaagcaccaccuccagcccgagaaccccggccccgggggcgccgcccccagccuggagcagaaccgcgggcgggagcccgaggccuccggccugaaggcgcugaaggcccgcgucgccgagcccggcgccgaggccaccagcuccaccggggaggagagcggcuccgagcacccgcccgcggugcccaugcacaacaagcggaagcgcccccggaagaaguccccgcgcgcccaccgggagaugcucgagagcgccgugcugccgcccgaggacaugagccaguccgggcccagcggcucccacccgcaggggccccgcggcagccccacgggcggggcccagcugcucaagcggaagcgcaagcugggcgucgugcccgucaacgggagcggccuguccaccccggcguggccgccccugcagcaggaggggccgcccaccggccccgccgagggcgccaacagccacaccacgcucccccagcggcgccggcugcagaagaagaaggccgggcccggcucccuggagcucugcgggcugcccagccagaagaccgccucccugaagaagcgcaagaagaugcgggugaugagcaaccucguggagcacaacggcguccuggaguccgaggcgggccagccccaggcccuggggagcuccgggaccugcagcucccucaagaagcagaagcugcgcgccgagagcgacuucgugaaguucgacacccccuuccugccgaagccccucuucuuccgccgggccaaguccagcacggccacccacccgcccgggcccgcggugcagcugaacaagacccccuccagcuccaagaaggucaccuucggccugaaccgcaacaugacggccgaguucaagaagaccgacaagagcauccucgugagccccaccgggcccucccggguggccuucgacccggagcagaagccccugcacggcguccugaagacccccacgagcucccccgccagcuccccgcucguggccaagaagccccugaccaccacgccccgccggcgcccccgggcgauggacuucuucuga

SEQ ID NO: 35943 - RNA, 1386 nt, Artificial Sequence
  derived and/or modified sequence opt1 from RRP1__Homo_sapiens__NP_003674
auggugagccgcguccagcugcccccggagauccagcucgcccagcggcuggccggcaacgagcaggucacccgcgaccgggcggugcgcaagcugcggaaguacaucguggcccgcacccagcgggccgccgggggcuucacgcacgacgagcuccugaagguguggaaggggcuguucuacugcauguggaugcaggacaagccccuccugcaggaggagcugggccgcaccaucucccagcucgugcacgccuuccagaccaccgaggcgcagcaccuguuccugcaggccuucuggcagacgaugaaccgggaguggaccgggaucgaccgccuccggcuggacaaguucuacaugcugaugcgcaugguccucaacgagagccugaaggugcugaagaugcagggcugggaggagcggcagaucgaggagcuccuggagcugcucaugaccgagauccugcaccccuccagccaggcccccaacggcgugaagucccacuucaucgagaucuuccuggaggagcucaccaaggucggggccgaggagcugacggcggaccagaaccugaaguucaucgacccguucugccgcaucgccgcccggaccaaggacagccucgugcugaacaacaucacccgcggcaucuucgagaccaucguggagcaggcgccccuggccaucgaggaccuccugaacgagcuggacacgcaggacgaggaggucgccuccgacagcgacgaguccagcgagggcggggagcgcggggacgcccucucccagaagcggagcgagaagccgcccgccggcuccaucugccgggccgagcccgaggccggcgaggagcaggcgggggacgaccgcgacagcggcgggcccgugcugcaguucgacuacgaggccguggccaaccggcuguucgagauggccucccgccagagcacccccucccagaaccgcaagcggcucuacaaggucauccgcaagcugcaggaccuggccggcggcaucuuccccgaggacgagaucccggagaaggcgugccggcgccuccuggaggggcggcgccagaagaagaccaagaagcagaagcggcugcuccgccugcagcaggagcggggcaagggggagaaggagccgcccagccccggcauggagcgcaagcggucccgccggcgcggggugggcgccgaccccgaggcccgggccgaggccggcgagcagcccgggaccgcggagcgcgcccugcuccgggaccagccccgcggccgggggcagcgcggcgcccgccagcggcgccggacgccccgcccgcugaccagcgcccgggcgaaggccgccaacgugcaggagcccgagaagaagaagaagcgccgggaguga

SEQ ID NO: 35944 - RNA, 1428 nt, Artificial Sequence
  derived and/or modified sequence opt1 from RRP9__Homo_sapiens__NP_004695
augagcgccaccgccgcggcccgcaagcggggcaagcccgccuccggggccggcgccggggcgggcgccgggaagcgccggcgcaaggccgacagcgccggcgaccggggcaaguccaagggcggcgggaagaugaacgaggagaucagcuccgacagcgaguccgagagccuggcgccccgcaagcccgaggaggaggaggaggaggagcucgaggagaccgcccaggagaagaagcugcggcuggccaagcucuaccuggagcagcugcgccagcaggaggaggagaaggccgaggcccgggcguucgaggaggaccagguggccgggcgccucaaggaggacguccuggagcagcgggggcgccugcagaagcucguggccaaggagauccaggcccccgccuccgcggacauccgggugcugcgcggccaccagcugagcaucacgugccucgucgugacccccgacgacuccgccaucuucagcgccgccaaggacugcuccaucaucaaguggagcguggaguccggccggaagcugcacgucaucccgcgcgccaagaagggggcggagggcaagccgcccgggcacagcucccacgugcugugcauggccaucagcuccgacggcaaguaccucgccagcggcgaccggagcaagcugauccugaucugggaggcccaguccugccagcaccucuacaccuucaccgggcaccgcgacgccgugagcggccuggcguuccggcgcgggacgcaccagcuguacuccaccagccacgaccgguccgucaagguguggaacguggccgagaacagcuacgucgagacccucuucggccaccaggacgccguggccgcgcuggacgcccugucccgcgagugcugcgugaccgccgggggccgcgacggcacgguccggguguggaagauccccgaggagagccagcucguguucuacgggcaccagggcuccaucgacugcauccaccugaucaacgaggagcacauggucagcggggccgacgacggcuccguggcccugugggggcucagcaagaagcgcccccuggcgcugcagcgggaggcccacggccuccgcggcgagcccgggcuggagcagcccuucuggaucuccagcguggccgcccugcucaacaccgaccuggucgccaccggcucccacagcuccugcgugcggcuguggcagugcggggagggcuuccgccagcucgaccugcugugcgacaucccccucgugggguucaucaacagccugaaguucuccagcagcggcgacuuccuggucgcgggcguggggcaggagcaccggcucggccgcugguggcggaucaaggaggcccgcaacuccgucugcaucaucccgcugcggcgcgugcccgugccgcccgccgccgggagcuga

SEQ ID NO: 35945 - RNA, 1098 nt, Artificial Sequence
  derived and/or modified sequence opt1 from RRS1__Homo_sapiens__NP_055984
auggagggccagagcguggaggagcugcuggccaaggccgagcaggacgaggcggagaagcugcagcgcaucaccguccacaaggagcuggagcugcaguucgaccuggggaaccugcucgccuccgaccggaacccgcccaccggccugcgcugcgccgggcccacgcccgaggccgagcugcaggcccucgcgcgggacaacacccagcugcugaucaaccagcucuggcagcugcccaccgagcgcguggaggaggccaucguggcccggcugccggagcccaccacgcgccucccccgggagaagccccugccgcgcccccggccccugacccgcuggcagcaguucgcccggcucaagggcauccgccccaagaagaagaccaaccuggucugggacgaggugagcgggcaguggcggcgccgguggggcuaccagcgcgcgcgggacgacaccaaggaguggcugaucgaggugcccggcaacgccgacccccucgaggaccaguucgccaagcgcauccaggccaagaaggagcgggucgccaagaacgagcugaaccgccugcggaaccucgcgcgcgcccacaagaugcagcugcccuccgccgccgggcugcaccccacgggccaccagagcaaggaggagcucgggcgcgccaugcaggucgcgaagguguccaccgccagcgugggccgguuccaggagcgccugccgaaggagaaggugccccggggguccggcaagaagcgcaaguuccagccccuguucggcgacuucgccgccgagaagaagaaccagcucgagcugcugcgggugaugaacagcaagaagccccagcucgacgucacccgcgccaccaacaagcagaugcgggaggaggaccaggaggaggcggccaagcgccggaagaugucccagaaggggaagcgcaagggcgggcggcagggcccgggcgggaagcgcaagggcgggccgcccagccagggcgggaagcggaagggcggccucgggggcaagaugaacuccgggccgcccggccucgggggcaagcgcaagggcgggcagcggcccggcgggaagcgccggaaguga

SEQ ID NO: 35946 - RNA, 675 nt, Artificial Sequence
  derived and/or modified sequence opt1 from RS1__Homo_sapiens__NP_000321
augagccgcaagaucgagggcuuccugcuccugcuccuguucggguacgaggccacccugggccuguccagcaccgaggacgagggggaggaccccugguaccagaaggccugcaagugcgacugccagggcgggccgaacgcgcucugguccgccggcgccacgagccuggacugcauccccgagugccccuaccacaagccccugggcuucgaguccggggaggugaccccggaccagaucacgugcagcaaccccgagcaguacgucggcugguacuccagcuggaccgccaacaaggcccggcucaacucccagggguucggcugcgcguggcugagcaaguuccaggacuccagccaguggcugcagaucgaccucaaggagaucaaggugaucuccgggauccugacccagggccgcugcgacaucgacgaguggaugaccaaguacagcgugcaguaccggaccgacgagcgccugaacuggaucuacuacaaggaccagaccggcaacaaccgggucuucuacgggaacuccgaccgcacgagcaccgugcagaaccuccugcggccgcccaucaucucccgcuucauccggcugaucccccucggcuggcacgugcgcaucgccauccggauggagcugcuggagugcgucagcaagugcgccuga

SEQ ID NO: 35947 - RNA, 1086 nt, Artificial Sequence
  derived and/or modified sequence opt1 from RSAD2__Homo_sapiens__XP_011508716
augugggugcugacccccgccgccuucgcgggcaagcuccugagcgucuuccgccagccgcuguccagccucuggcggucccuggugccccuguucugcuggcuccgcgccaccuucuggcugcuggccacgaagcggcgcaagcagcagcucgugcugcgggggcccgacgagaccaaggaggaggaggaggacccgccccugcccaccacccccacgagcgucaacuaccacuucacccgccagugcaacuacaagugcggcuucugcuuccacaccgccaagaccuccuucgugcucccccuggaggaggccaagcgggggcugcuccugcugaaggaggcgggcauggagaagaucaacuucagcgggggcgagccguuccuccaggaccgcggcgaguaccuggggaagcuggugcgguucugcaaggucgagcuccgccugcccuccgugagcaucguguccaacggcagccugauccgggagcgcugguuccagaacuacggggaguaccucgacauccuggccaucuccugcgacagcuucgacgaggaggucaacgugcugaucggccgggggcagggcaagaagaaccacguggagaaccuccagaagcugcgccgguggugccgcgacuaccgggucgccuucaagaucaacuccgugaucaaccgcuucaacguggaggaggacaugacggagcagaucaaggcccugaaccccguccgguggaagguguuccagugccuccugaucgagggcgagaacugcggggaggacgcgcugcgcgaggccgagcgguucgugaucggcgacgaggaguucgagcgcuuccucgagcgccacaaggaggucagcugccuggugcccgaguccaaccagaagaugaaggacagcuaccugauccucgacgaguacaugcgguuccugaacugccgcaaggggcggaaggacccguccaagagcauccuggacgugggcgucgaggaggccaucaaguucuccggcuucgacgagaagauguuccucaagcgcgggggcaaguacaucuggagcaaggccgaccugaagcuggacugguga

SEQ ID NO: 35948 - RNA, 4326 nt, Artificial Sequence
  derived and/or modified sequence opt1 from RSF1__Homo_sapiens__NP_057662
auggccaccgccgcggccgccgccgccgugauggcgcccccgggcugccccgggagcugccccaacuucgccgucgugugcuccuuccuggagcgcuacggcccccuccuggaccugccggagcuccccuuccccgagcuggagcgggugcugcaggcgcccccgcccgacgucgggaacggcgaggugcccaaggagcucguggagcugcaccugaagcucaugcgcaagaucggcaagagcgucaccgccgaccggugggagaaguaccugaucaagaucugccaggaguucaacuccacgugggccugggagauggagaagaagggcuaccuggagaugagcguggagugcaagcucgcccugcugaaguaccucugcgagugccaguucgacgacaaccugaaguucaagaacaucaucaacgaggaggacgccgacaccaugcgccugcagcccaucggccgggacaaggacgggcucauguacugguaccagcuggaccaggaccacaacgugcgcauguacaucgaggagcaggacgaccaggacggcuccagcuggaagugcaucguccggaaccgcaacgagcuggccgagacccucgcccugcugaaggcgcagaucgacccggugcuccugaagaacuccagccagcaggacaacuccagccgggagucccccagccuggaggacgaggagaccaagaaggaggaggagacgcccaagcaggaggagcagaaggaguccgagaagaugaaguccgaggagcagcccauggaccucgagaaccgcuccaccgccaacgugcuggaggagaccaccgucaagaaggagaaggaggacgagaaggagcuggugaagcucccggugaucgucaagcuggagaagccccugcccgagaacgaggagaagaagaucaucaaggaggagagcgacuccuucaaggagaacgugaagcccaucaagguggaggucaaggagugccgggccgacccgaaggacaccaagagcuccauggagaagcccguggcccaggagcccgagcgcaucgaguucgggggcaacaucaagagcagccacgagaucaccgagaaguccaccgaggagaccgagaagcucaagaacgaccagcaggccaagaucccccugaagaagcgggagaucaagcugagcgacgacuucgacuccccggugaaggggccccucugcaagagcgucacgcccaccaaggaguuccugaaggacgagaucaagcaggaggaggagaccugcaagcgcaucuccaccaucacggcgcugggccacgagggcaagcagcucgugaacggggaggugagcgacgagcgggucgcccccaacuucaagaccgagccgaucgagaccaaguucuacgagaccaaggaggaguccuacagccccuccaaggaccgcaacaucaucacggaggggaacgggacggagagccugaacagcgugaucaccagcaugaagaccggcgagcuggagaaggagacggcgccccuccggaaggacgccgacuccagcaucuccguccuggagauccacagccagaaggcccagaucgaggagccggacccgcccgagauggagaccucccuggacagcuccgagauggccaaggaccucagcagcaagaccgcccuguccagcaccgaguccugcacgaugaagggcgaggagaagucccccaagaccaagaaggacaagcgcccgcccauccuggagugccucgagaagcuggagaaguccaagaagaccuuccuggacaaggacgcccagcggcugagccccauccccgaggaggugcccaaguccacccucgagagcgagaagcccgggucccccgaggccgccgagacgagcccgcccuccaacaucaucgaccacugcgagaagcuggcgagcgagaaggagguggucgagugccaguccaccagcaccgugggcgggcaguccgugaagaaggucgaccuggagacccucaaggaggacagcgaguucacgaagguggagauggacaaccuggacaacgcccagaccuccggcaucgaggagcccagcgagaccaaggggagcaugcagaaguccaaguucaaguacaagcuggugcccgaggaggagaccaccgccagcgagaacacggagaucaccuccgagcgccagaaggagggcaucaagcucaccauccggaucagcucccgcaagaagaagcccgacagcccgcccaagguccuggagcccgagaacaagcaggagaagaccgagaaggaggaggagaagacgaacgugggccgcacccugcggcgcagcccccggaucagccgcccgaccgccaagguggcggagauccgggaccagaaggccgacaagaagcgcggggagggcgaggacgaggucgaggaggaguccaccgcccuccagaagacggacaagaaggagauccugaagaaguccgagaaggacaccaacagcaaggugagcaaggugaagcccaaggggaagguccgguggaccggcucccgcacccgggggcgcuggaaguacagcuccaacgacgagagcgagggcuccggcagcgagaaguccagcgccgccagcgaggaggaggaggagaaggaguccgaggaggcgauccuggccgacgacgacgagcccugcaagaagugcgggcuccccaaccacccggagcugauccugcucugcgacagcugcgacuccggcuaccacacggccugccugcggccgccccugaugaucauccccgacggggagugguucugcccgcccugccagcacaagcuccugugcgagaagcuggaggagcagcuccaggaccuggacguggcccugaagaagaaggagcgcgccgagcggcgcaaggagcggcucguguacgucggcaucagcaucgagaacaucaucccgccccaggagcccgacuucuccgaggaccaggaggagaagaagaaggacagcaagaaguccaaggcgaaccugcuggagcgccggagcacccgcacccggaagugcaucuccuaccgcuucgacgaguucgacgaggccaucgacgaggccaucgaggacgacaucaaggaggccgacgggggcggcguggggcgcggcaaggacaucagcaccaucacggggcaccggggcaaggacaucuccaccauccucgacgaggagcgcaaggagaacaagcggccccagcgcgccgcggccgcccggcgcaagaagcggcgccggcugaacgaccuggacagcgacuccaaccucgacgaggaggagagcgaggacgaguucaagaucuccgacggcagccaggacgaguucguggucuccgacgagaaccccgacgagagcgaggaggacccgcccuccaacgacgacagcgacaccgacuucugcagccgccggcugcgccggcaccccucccgccccaugcggcagagccgccggcugcgccggaagacccccaagaagaaguacuccgacgacgacgaggaggaggagagcgaggagaacucccgcgacagcgaguccgacuucagcgacgacuucuccgacgacuucguggagacgcggcgccgccggagccgccggaaccagaagcgccagaucaacuacaaggaggacuccgagagcgacgggucccagaagucccuccggcgcggcaaggagauccggcgcgugcacaagcggcgccugagcagcuccgagagcgaggaguccuaccugagcaagaacagcgaggacgacgagcucgccaaggaguccaagcggagcguccgcaagcgggggcgcuccaccgacgaguacagcgaggcggacgaggaggaggaggaggaggagggcaagcccucccggaagcgccugcaccggaucgagaccgacgaggaggagagcugcgacaacgcccacggggacgccaaccagcccgcccgcgacucccagccccgggugcugccgagcgagcaggaguccaccaagaagcccuaccgcaucgagagcgacgaggaggaggacuucgagaacgugggcaaggucggcagcccccucgacuacucccugguggaccugcccuccacgaacgggcagagcccgggcaaggccaucgagaaccucaucgggaagcccaccgagaagucccagacccccaaggacaacagcaccgcguccgccagccuggccuccaacggcacgagcgggggccaggaggccggcgcccccgaggaggaggaggacgagcugcuccgcgugaccgaccuggucgacuacgugugcaacagcgagcagcuguga

SEQ ID NO: 35949 - RNA, 1473 nt, Artificial Sequence
  derived and/or modified sequence opt1 from RSL1D1__Homo_sapiens__NP_056474
auggaggacagcgccuccgccagccuguccagcgcggccgccaccggcaccuccacgagcacccccgccgccccgaccgcgcgcaagcagcucgacaaggagcagguccggaaggccguggacgcccugcugacccacugcaagucccgcaagaacaacuacgggcuccugcugaacgagaacgagagccucuuccugaugguggugcuguggaagauccccuccaaggagcuccggguccgccugacgcugccccacagcauccgguccgacagcgaggacaucugccucuucaccaaggacgagcccaacuccaccccggagaagaccgagcaguucuaccgcaagcugcugaacaagcacggcaucaagacggugagccagaucaucucccuccagacccugaagaaggaguacaagagcuacgaggccaagcugcggcuccuguccagcuucgacuucuuccugaccgacgcgcgcauccggcgccuccugcccucccugaucgggcggcacuucuaccagcgcaagaaggugcccgucagcgugaaccuccugagcaagaaccugucccgggagaucaacgacugcaucggcgggaccgugcucaacaucagcaaguccggcagcugcuccgccauccgcaucggccacgucgggaugcagaucgagcacaucaucgagaacaucguggccgugacgaagggccugagcgagaagcugcccgagaagugggaguccgucaagcuccuguucgugaagaccgagaaguccgccgcccugccgaucuucagcagcuucguguccaacugggacgaggcgaccaagcggagccuccugaacaagaagaagaaggaggcccgccggaagcgccgggagcgcaacuucgagaagcagaaggagcggaagaagaagcgccagcaggcccgcaagaccgccuccguccugagcaaggacgacguggcccccgaguccggggacacgaccgugaagaagcccgagagcaagaaggagcagacccccgagcacggcaagaagaagcgggggcgcggcaaggcgcaggucaaggccaccaacgaguccgaggacgagaucccgcagcucgugcccaucggcaagaagacgcccgccaacgagaagguggagauccagaagcacgccaccgggaagaagucccccgccaagagcccgaaccccagcacgccccggggcaagaagcgcaaggcgcugcccgccagcgagaccccgaaggccgccgaguccgagacccccggcaagagccccgagaagaagcccaagaucaaggaggaggccgucaaggagaaguccccgagccuggggaagaaggacgcgcggcagacccccaagaagcccgaggccaaguucuucaccacccccuccaagagcgugcgcaaggccucccacacgccgaagaaguggcccaagaagcccaaggugccgcagagcaccuga

SEQ ID NO: 35950 - RNA, 492 nt, Artificial Sequence
  derived and/or modified sequence opt1 from RSL24D1__Homo_sapiens__NP_057388
augcgcaucgagaagugcuacuucugcagcggccccaucuacccggggcacggcaugauguucgugcggaacgacugcaaggucuuccgcuucugcaaguccaagugccacaagaacuucaagaagaagcggaacccccgcaaggugcgguggaccaaggccuuccgcaaggccgcggggaaggagcugaccguggacaacagcuucgaguucgagaagcggcgcaacgagcccaucaaguaccagcgggagcucuggaacaagacgaucgacgccaugaagcgcgucgaggagaucaagcagaagcggcaggccaaguucaucaugaaccgccugaagaagaacaaggagcugcagaaggugcaggacaucaaggaggugaagcagaacauccaccucauccgggcgccccuggccggcaaggggaagcagcuggaggagaagaugguccagcagcuccaggaggacguggacauggaggacgccccguga

SEQ ID NO: 35951 - RNA, 930 nt, Artificial Sequence
  derived and/or modified sequence opt1 from RSPH1__Homo_sapiens__NP_543136
augagcgaccugggcuccgaggagcucgaggaggagggggagaacgacaucggcgaguacgagggcgggcgcaacgaggccggggagcggcacggccgcggccgggcccgccugcccaacggggacaccuacgagggcagcuacgaguucgggaagcggcacggccaggggaucuacaaguucaagaacggcgcgcgcuacaucggcgaguacgugcggaacaagaagcacgggcagggcaccuucaucuacccggacgggucccgcuacgagggcgagugggccaacgaccugcggcacggccacggggucuacuacuacaucaacaacgacacguacaccggcgagugguucgcccaccagcgccacgggcagggcaccuaccucuacgccgagaccgggagcaaguacgugggcacgugggugaacggccagcaggaggggaccgccgagcugauccaccugaaccaccgguaccagggcaaguuccucaacaagaaccccgucgggcccggcaaguacguguucgacguggggugcgagcagcacggcgaguaccgccugaccgacauggagcggggcgaggaggaggaggaggaggagcuggucaccguggugcccaaguggaaggcgacgcagaucaccgagcucgcccuguggaccccgacccugcccaagaagcccacguccaccgacgggcccggccaggacgccccgggggccgagagcgcgggcgagcccggggaggaggcccaggcccuccuggagggcuucgagggcgagauggacaugcgccccggggacgaggacgccgacguccugcgggaggagucccgcgaguacgaccaggaggaguuccgguacgacauggacgagggcaacaucaacagcgaggaggaggagacccgccaguccgaccuccaggacuga

SEQ ID NO: 35952 - RNA, 2151 nt, Artificial Sequence
  derived and/or modified sequence opt1 from RSPH4A__Homo_sapiens__NP_001010892
auggaggacagcaccucccccaagcaggagaaggagaaccaggaggagcugggcgagacccgccggcccugggaggggaagacggccgccagcccccaguacuccgagcccgagagcuccgagccccucgaggcgaagcagggcccggagaccgggcgccagagccgguccagccgccccuggagcccccagucccgggccaagacgccccugggcgggccggccggccccgagaccuccagccccgcccccguguccccgcgcgagcccagcuccagccccagcccccuggccccggcgcggcaggaccucgccgccccgccccaguccgaccgcaccaccuccgucauccccgaggccggcacccccuaccccgacccccuggagcagagcagcgacaagcgggaguccacgccccaccacaccagccaguccgaggggaacaccuuccagcagagccagcagccgaagccccaccugugcggccgccgggacguguccuacaacaacgcgaagcagaaggagcuccgcuucgacguguuccaggaggaggacagcaacuccgacuacgaccugcagcagcccgcccccgggggcagcgaggucgccccguccaugcuggagaucaccauccagaacgccaaggccuaccuccugaagaccagcuccaacagcggguucaaccuguacgaccaccucuccaacaugcugacgaagauccugaacgagcggcccgagaacgcgguggacaucuucgagaacaucagccaggacgugaagauggcccacuucuccaagaaguucgacgcccuccagaacgagaacgagcugcugcccaccuacgagaucgccgagaagcagaaggcccucuuccugcagggccaccuggagggcgucgaccaggagcucgaggacgagaucgcggagaacgcccugccgaacgugauggagagcgccuucuacuucgagcaggccggggugggccuggggaccgacgagaccuaccgcaucuuccucgcccugaagcagcugacggacacccaccccauccagcggugccgcuucuggggcaagauccucggccuggagaugaacuacaucgucgcggagguggaguuccgggagggggaggacgaggaggagguggaggaggaggacgucgccgaggagcgcgacaacggcgaguccgaggcccacgaggacgaggaggacgagcugcccaagagcuucuacaaggcgccccaggccaucccgaaggaggagucccggaccggggccaacaaguacguguacuucgugugcaacgagcccggccgccccugggucaagcugcccccggugauccccgcccagaucgugaucgcccggaagaucaagaaguucuucaccgggcgccucgacgcccccaucaucagcuacccgcccuuccccggcaacgagagcaacuaccugcgcgcgcagaucgcccggaucuccgccggcacgcacgucagcccccucggguucuaccaguucggcgaggaggagggggaggaggaggaggaggccgagggcgggcgcaacuccuucgaggagaaccccgacuucgagggcauccaggugaucgaccugguggagagccuguccaacuggguccaccacgugcagcacauccucagccagggccggugcaacugguucaacuccauccagaagaacgaggaggaggaggaggaggaggacgaggagaaggacgacagcgacuacaucgagcaggagguggggcugccgcugcucacccccaucuccgaggaccuggagauccagaacaucccgcccuggaccacccgccugagcuccaaccucaucccccaguacgccaucgcgguccugcagagcaaccuguggcccggcgccuacgccuucuccaacgggaagaaguucgagaacuucuacaucggcugggggcacaaguacagccccgacaacuacacgcccccggugccgccgcccgucuaccaggaguaccccuccggccccgagaucaccgagauggacgaccccagcguggaggaggagcaggccuuccgggccgcgcaggaggccgugcuccuggccgccgagaacgaggaguccgaggaggacgaggacgaggaggacgacuacgacuga

SEQ ID NO: 35953 - RNA, 921 nt, Artificial Sequence
  derived and/or modified sequence opt1 from RSPH9__Homo_sapiens__NP_001180270
auggacgccgacagccugcuccugucccuggagcucgccagcggcuccgggcagggccugagccccgaccgccgggcgucccugcucaccagccugaugcuggugaagcgcgacuaccgguacgaccgcguccucuucugggggcggauccugggccugguggccgacuacuacaucgcccaggggcucuccgaggaccagcuggccccgcgcaagacccuguacagccucaacugcacggaguggucccugcugccgcccgccaccgaggagaugguggcgcagagcuccgucgugaagggccgguucaugggcgaccccagcuacgaguacgagcacaccgagcuccagaaggugaacgagggggagaaggucuucgaggaggagaucgugaucgacaaggccguggccaucaucccccgcggcgcccuguucaagacccccuucgggcccacgcacgucaaccggaccuucgagggccugucccucagcgaggcgaagaagcuguccagcuacuuccacuuccgcgagcccguggagcugaagaacaagacccuccuggagaaggccgaccuggacccgucccucgacuucauggacagccuggagcacgacauccccaagggguccgaggccgugguccagggcgacuucaccuggcugcucagccggugcggcuucggguggcccugcagcugggacuccugcagcguguccaugcgcgugcuggagcaccccgacggcgaggggcagugcccgggcggcgccgcccagcccgcgcuggccgggccccaccuccugcccugcagcccgcaccaggagcuguggcuccggcugcgcggccacuggcgggaggagcacgggcuggcccuccacgccaucgagugggagcccgccuggauguuccugaaccgcgucuga

SEQ ID NO: 35954 - RNA, 540 nt, Artificial Sequence
  derived and/or modified sequence opt1 from RSPO2__Homo_sapiens__NP_001269792
augcaguuccgccuguucagcuucgcccucaucauccugaacugcauggacuacucccacugccagggcaaccgguggcgccggagcaagcgcgggugccggaucgagaacugcgacuccugcuucagcaaggacuucugcaccaagugcaaggugggcuucuaccugcaccgcgggcggugcuucgacgagugccccgacggcuucgccccgcucgaggagaccauggagugcgucgggugcgaggugggccacugguccgaguggggcacgugcagccgcaacaaccggaccugcggguucaaguggggccuggagacccgcacccggcagaucgugaagaagcccgucaaggacacgauccugugccccaccaucgcggagucccgccggugcaagaugaccaugcgccacugccccgggggcaagcggaccccgaaggccaaggagaagcgcaacaagaagaagaagcggaagcucaucgagcgcgcccaggagcagcacagcguguuccuggccacggaccgggccaaccaguga

SEQ ID NO: 35955 - RNA, 819 nt, Artificial Sequence
  derived and/or modified sequence opt1 from RSPO3__Homo_sapiens__NP_116173
augcaccuccgccugaucagcuggcuguucaucauccugaacuucauggaguacaucggcucccagaacgccagccgggggcgccggcagcgccggaugcaccccaacgugucccagggcugccagggcgggugcgcgaccugcagcgacuacaacgggugccucuccugcaagccgcgccuguucuucgcccuggagcggaucggcaugaagcagaucggcgucugccucagcuccugccccagcggguacuacggcacccgcuaccccgacaucaacaagugcacgaagugcaaggccgacugcgacacgugcuucaacaagaacuucugcaccaagugcaaguccggguucuaccugcaccugggcaagugccucgacaacugccccgaggggcuggaggccaacaaccacaccauggagugcgugagcaucgugcacugcgaggucuccgaguggaacccguggagccccugcaccaagaagggcaagaccugcggcuucaagcgggggaccgagacccgcgugcgggagaucauccagcaccccuccgccaagggcaaccugugcccgcccacgaacgagacccgcaagugcaccgugcagcggaagaagugccagaagggggagcgcggcaagaagggccgggagcgcaagcggaagaagcccaacaagggggagagcaaggaggccauccccgacuccaagagccucgaguccagcaaggagauccccgagcagcgcgagaacaagcagcagcagaagaagcggaagguccaggacaagcagaaguccgugagcgugagcaccguccacuga

SEQ ID NO: 35956 - RNA, 705 nt, Artificial Sequence
  derived and/or modified sequence opt1 from RSPO4__Homo_sapiens__NP_001025042
augcgcgcgccccugugccuccugcugcucguggcccacgccgucgacaugcuggcccugaaccggcgcaagaagcaggucggcaccgggcucggcgggaacugcaccggcugcaucaucugcagcgaggagaacgggugcuccacgugccagcagcggcuguuccuguucauccgccgggagggcauccgccaguacggcaagugccuccacgacugcccgcccggguacuucggcauccgggggcaggaggugaaccgcugcaagaagugcggcgccacgugcgagagcugcuucucccaggacuucugcauccggugcaagcgccaguucuaccuguacaaggggaagugccugccgaccugcccgcccggcacccucgcccaccagaacacccgggagugccagggcgagugcgagcuggggcccuggggcggguggagccccugcacccacaacggcaagaccugcggcuccgccugggggcuggagagccgcgugcgggaggccggccgcgccgggcacgaggaggccgcgaccugccaggugcucuccgagagccggaagugccccauccagcgccccugccccggcgagcggucccccgggcagaagaagggccgcaaggaccggcgcccccggaaggaccgcaagcuggaccgccggcuggacgugcgcccgcggcagcccggccuccagcccuga

SEQ ID NO: 35957 - RNA, 831 nt, Artificial Sequence
  derived and/or modified sequence opt1 from RSRC1__Homo_sapiens__NP_001258763
augggccgccggagcuccgacaccgaggaggagagccgcuccaagcggaagaagaagcaccgccggcgcagcuccagcuccagcuccagcgacucccggaccuacagccgcaagaagggcgggcggaagucccgcagcaagucccggagcuggucccgcgaccugcagccccggagccacuccuacgaccgccggcgccggcaccgcagcagcuccagcuccagcuacgggucccggcgcaagcggagccgcucccgcagccggggccgcgggaaguccuaccgggugcagcgcagccgguccaagagccgcacgcggcgcgaguccggcaacaucaaggccggccucgagcaccucccgcccgccgagcaggcgaaggcccggcugcagcugguccuggaggccgccgccaaggcggacgaggcccugaaggccaaggagcgcaacgaggaggaggccaagcggcgcaaggaggaggaccaggcgacccucguggagcaggucaagcgggugaaggagaucgaggccaucgagagcgacuccuucgugcagcagaccuuccgcagcuccaaggaggugaagaaguccgucgagcccagcgaggugaagcaggccaccagcacgagcgggcccgccuccgccguggcggacccgcccagcaccgagaaggagaucgaccccaccuccauccccaccgccaucaaguaccaggacgacaacagccuggcccacccgaaccuguucaucgagaaggccgacgccgaggagaagugguucaagcggcucaucgcgcugcgccaggagcggcugaugggcucccccgucgccuga

SEQ ID NO: 35958 - RNA, 1305 nt, Artificial Sequence
  derived and/or modified sequence opt1 from RSRC2__Homo_sapiens__NP_075388
auggccgccagcgacaccgagcgcgacggccuggcgcccgagaagaccuccccggaccgggacaagaagaaggagcagagcgagguguccgucagcccccgcgccuccaagcaccacuacagccggucccgcagccggucccgcgagcggaagcgcaagagcgacaacgaggggcggaagcaccgcucccggagccgcuccaaggagggccggcgccacgagagcaaggacaaguccagcaagaagcacaaguccgaggagcacaacgacaaggagcacagcuccgacaaggggcgggagcgccucaacagcagcgagaacggcgaggaccggcacaagcgcaaggagcggaaguccagccgcgggcggucccacagccgcucccgcagccgggagcgccggcaccgcucccggagccgcgagcggaagaagucccgcagccggucccgcgagcggaagaagucccgcagccggagccgcgagcggaagaagucccgcagccggucccgcgagcggaagcgccgcauccggagccgcucccggagccgcagccggcaccgccaccggacgcgcucccggagccgcacccggucccgcagccgggaccgcaagaagcggaucgagaagccccgccgguucucccgcagccugucccggacccccagcccgccgcccuuccgcggccggaacaccgccauggacgcccaggaggcccuggcgcgccgccucgagcgggccaagaagcugcaggagcagcgcgagaaggagaugguggagaagcagaagcagcaggagaucgccgccgcggccgccacgggcggguccgugcugaacgucgccgcccuccuggcgagcggcacccaggugacgccccagaucgccauggccgcccagauggccgcgcugcaggccaaggcccucgccgagaccgggaucgccgugcccuccuacuacaaccccgcggccgucaaccccaugaaguucgccgagcaggagaagaagcggaagaugcuguggcagggcaagaaggagggggacaagagccaguccgccgagaucugggagaagcugaacuucggcaacaaggaccagaacgugaaguuccgcaagcucaugggcaucaagagcgaggacgaggccgggugcuccagcguggacgaggaguccuacaagacccugaagcagcaggaggaggucuuccggaaccuggacgcgcaguacgagauggcccgcagccagacccacacccagcggggcauggggcucggcuucaccagcuccaugcgcggcauggacgccguguga

SEQ ID NO: 35959 - RNA, 681 nt, Artificial Sequence
  derived and/or modified sequence opt1 from RSRP1__Homo_sapiens__XP_011540100
augagcaacuacgugaacgacauguggcccggcuccccgcaggagaaggacagccccuccaccagccgcuccgggggcagcucccggcugagcucccgcagccggucccgcagcuucucccggagcucccgcagccacucccgggucagcucccgcuucagcagccggucccgccggagcaagucccgcagccggucccgccggcgccaccagcggaaguaccgccgguacagccgcuccuacagccggucccgcagccgcucccggagccgccgguaccgcgagcggcgcuacggguucacccggcgcuacuaccggucccccagccgcuaccggucccgcagccggucccgcagccggucccgcggccggagcuacugcgggcgcgccuacgccaucgcgcggggccagcgcuacuacggcuucgggcgcacgguguaccccgaggagcacagccgguggcgcgaccggucccgcacccggagccgcucccggaccccguuccgccucagcgagaaggaccggauggagcugcuggagaucgccaagaccaacgccgccaaggcccucggcacgaccaacaucgaccugcccgcgucccugcgcaccgugcccagcgccaaggagaccucccgggggaucggcgucagcuccaacggggccaagcccgagauguucuga

SEQ ID NO: 35960 - RNA, 834 nt, Artificial Sequence
  derived and/or modified sequence opt1 from RSU1__Homo_sapiens__NP_036557
augagcaagucccugaagaagcucguggaggagagccgcgagaagaaccagcccgaggucgacauguccgaccggggcaucagcaacaugcuggacgugaacgggcuguucacccucucccacaucacccagcuggugcugagccacaacaagcucacgauggucccgcccaacaucgccgagcugaagaaccuggaggugcucaacuucuucaacaaccagaucgaggagcugcccacccagaucuccagccugcagaagcucaagcaccugaaccugggcaugaaccgccucaacacccugccccggggguucggcucccugccggcccucgaggugcuggaccugaccuacaacaaccucagcgagaacucccugcccgggaacuucuucuaccugacgacccuccgcgcgcuguaccugagcgacaacgacuucgagauccucccgcccgacaucggcaagcugaccaagcugcagauccucucccugcgggacaacgaccugaucagccuccccaaggagaucggcgagcugacccagcugaaggagcuccacauccaggggaaccgccugacgguccugccgcccgagcucggcaaccuggaccugaccgggcagaagcaggucuucaaggccgagaacaaccccugggugacccccaucgccgaccaguuccagcucggcgugucccacguguucgaguacauccggagcgagaccuacaaguaccuguacgggcgccacaugcaggccaaccccgagccgcccaagaagaacaacgacaaguccaagaagaucagccggaagccccuggccgcgaagaaccgcuga

SEQ ID NO: 35961 - RNA, 1518 nt, Artificial Sequence
  derived and/or modified sequence opt1 from RTCB__Homo_sapiens__NP_055121
augagccgcuccuacaacgacgagcugcaguuccucgagaagaucaacaagaacugcuggcggaucaagaagggcuucgugcccaacaugcaggucgaggggguguucuacgugaacgacgcccuggagaagcugauguucgaggagcuccgcaacgccugccggggcgggggcgucgggggcuuccugccggcgaugaagcagaucggcaacguggccgcccugcccgggaucgugcaccgcagcaucggccuccccgacguccacuccggguacggcuucgccaucgggaacauggccgcguucgacaugaacgaccccgaggccguggugagcccgggcggcgucggguucgacaucaacugcggcgugcggcugcugcgcaccaaccucgacgaguccgacgugcagcccgucaaggagcagcuggcccaggccauguucgaccacauccccgugggggugggcagcaagggcgucauccccaugaacgcgaaggaccuggaggaggcccucgagauggggguggacuggucccugcgggagggcuacgccugggccgaggacaaggagcacugcgaggaguacgggcgcaugcugcaggccgacccgaacaaggugagcgcgcgggccaagaagcgcggccucccccagcuggggacccugggcgccggcaaccacuacgccgagauccaggucguggacgagaucuucaacgaguacgccgcgaagaagauggggaucgaccacaagggccaggugugcgucaugauccacuccgggagccggggccucgggcaccagguggccaccgacgcccugguggccauggagaaggccaugaagcgcgacaagaucaucgucaacgaccggcagcuggcgugcgcccgcaucgccucccccgagggccaggacuaccucaagggcauggccgccgcggggaacuacgccugggugaaccggagcuccaugaccuuccugacccgccaggccuucgccaaggucuucaacaccacgcccgacgaccuggaccuccacgugaucuacgacgugagccacaacaucgcgaaggucgagcagcacgugguggacggcaaggagcggacccugcugguccaccgcaagggguccacccgggccuucccgccccaccacccccucaucgccguggacuaccagcugaccggccagcccgugcugaucgggggcacgauggggaccugcagcuacguccucaccggcaccgagcagggcaugacggagaccuucgggacgaccugccacggcgccggccgcgcccugucccgggccaagagccgccgcaaccuggacuuccaggacgugcucgacaagcuggcggacauggggaucgccauccggguggccuccccgaagcuggucauggaggaggcccccgagagcuacaagaacgugaccgacguggucaacacgugccacgacgcgggcaucagcaagaaggccaucaagcuccgccccaucgccgugaucaagggguga

SEQ ID NO: 35962 - RNA, 3903 nt, Artificial Sequence
  derived and/or modified sequence opt1 from RTEL1__Homo_sapiens__NP_001269938
augcccaagaucgugcugaacggcgucaccguggacuucccguuccagcccuacaagugccagcaggaguacaugaccaaggugcucgagugccugcagcagaaggucaacgggauccuggagagccccacgggcaccgggaagacccucugccugcugugcaccacgcucgccuggcgcgagcaccugcgggacggcaucuccgcccgcaagaucgcggagcgggcccagggggagcuguuccccgaccgcgcccucagcuccuggggcaacgccgccgcggccgccggcgacccgaucgccugcuacaccgacauccccaagaucaucuacgcgagccggacccacucccagcugacccaggugaucaacgagcugcgcaacacgagcuaccggcccaaggugugcguccucgggucccgcgagcagcugugcauccaccccgaggugaagaagcaggagagcaaccaccugcagauccaccucugccggaagaagguggccucccgcagcugccacuucuacaacaacgucgaggagaagucccuggagcaggagcuggccagcccgauccucgacaucgaggaccuggugaaguccggcagcaagcaccgggugugccccuacuaccugucccgcaaccucaagcagcaggccgacaucaucuucaugcccuacaacuaccugcuggacgccaagagccggcgcgcgcacaacaucgaccucaaggggaccgucgugaucuucgacgaggcccacaacguggagaagaugugcgaggaguccgccagcuucgaccugaccccccacgaccuggccuccggccucgacgucaucgaccaggugcuggaggagcagaccaaggccgcgcagcagggggagccgcaccccgaguucagcgccgacagccccucccccggccugaacauggagcucgaggacaucgccaagcugaagaugauccugcuccggcuggagggcgccaucgacgccguggagcugccgggggacgacagcggcgucacgaagcccggguccuacaucuucgagcucuucgcggaggcccagaucaccuuccagaccaagggcugcauccuggacagccuggaccagaucauccagcaccucgccggccgcgccgggguguucaccaacacggccggccugcagaagcuggcggacaucauccagaucguguucuccgucgaccccagcgaggggucccccggcagcccggccgggcucggcgcccugcaguccuacaaggugcacauccaccccgacgccggccaccggcgcaccgcgcagcggagcgacgccugguccaccaccgccgcccgcaagcgggggaaggugcugagcuacuggugcuucucccccggccacagcaugcacgagcucguccgccagggggugcgcucccugauccugacgagcggcacccucgcccccgucuccagcuucgcgcuggagaugcagaucccguuccccgugugccuggagaacccccacaucaucgacaagcaccagaucugggugggggucgugccccggggcccggacggcgcccagcuguccagcgccuucgaccgccgguucagcgaggagugccucuccagccuggggaaggcccugggcaacaucgcccgcgugguccccuacgggcuccugaucuucuuccccuccuacccggugauggagaagagccuggaguucuggcgggcgcgcgaccucgcccggaagauggaggcccugaagccccuguucguggagccccgcuccaagggcagcuucuccgagaccaucagcgccuacuacgcccgggucgcggcccccggguccaccggcgccacguuccucgccgugugccgcggcaaggcgagcgaggggcuggacuucuccgacaccaacggccggggggugaucgucaccggccugccguaccccccccgcauggacccccggguggugcucaagaugcaguuccuggacgagaugaagggccaggggggcgccgggggccaguuccugagcgggcaggagugguaccgccagcaggccucccgggccgucaaccaggccaucggccgcgugauccggcaccgccaggacuacggcgcgguguuccucugcgaccaccgguucgccuucgccgacgcccgcgcccagcugccgagcuggguccgcccccacgugcggguguacgacaacuucgggcacgucauccgcgacguggcgcaguucuuccggguggccgagcgcaccaugcccgcccccgccccgcgggccacggcgcccuccguccgcggcgaggacgccgugagcgaggccaagucccccgggcccuucuucagcacccggaaggccaagagccuggaccuccacgugccgucccugaagcagcgcagcuccggcagccccgcggccggggaccccgaguccagccugugcgucgaguacgagcaggagcccgugccggcccggcagcgcccccggggccuccuggccgcccuggagcacuccgagcagcgcgcgggcagccccggggaggagcaggcccacuccugcagcacccucucccugcugagcgagaagcggcccgccgaggagccgcgcggcgggcggaagaagauccgccucgugucccaccccgaggagcccgucgccggcgcccagaccgaccgggcgaagcuguucaugguggccgugaagcaggagcugagccaggccaacuucgccacguucacccaggcccuccaggacuacaagggguccgacgacuucgcggcccuggccgccugccugggcccgcucuucgccgaggaccccaagaagcacaaccugcugcagggcuucuaccaguucguccgcccccaccacaagcagcaguucgaggaggugugcauccagcucaccgggcggggcugcggguaccgccccgagcacagcaucccgcggcgccagcgcgcgcagcccgugcuggaccccaccggccggacggcccccgacccgaagcugaccgucuccaccgccgccgcgcagcagcucgacccccaggagcaccugaaccaggggcgcccccaccugagcccccggccgccccccaccggcgaccccggcucccagccgcagugggggagcggcgugccccgcgccgggaagcagggccagcacgccgugagcgccuaccucgccgacgcgcggcgcgcccugggcuccgccgggugcagccagcugcucgccgcccugaccgcguacaagcaggacgacgaccuggacaagguccucgccgugcuggccgcccugacgaccgccaagcccgaggacuucccccuccugcaccgguucuccauguucgugcgcccgcaccacaagcagcgguucagccagaccugcaccgaccugacgggccgccccuaccccgggauggagcccccgggcccccaggaggagcggcucgcggucccccccgugcugacccaccgcgccccgcagcccgggcccucccggagcgagaagaccggcaagacccaguccaagaucagcuccuuccugcgccagcggccggccggcacggugggggccggcggggaggacgcgggccccagccaguccagcgggcccccccacggcccggccgccuccgaguggggcgagccccacgggcgcgacaucgccggccagcaggccaccggggcgcccggcgggccccucagcgccggcugcgucugccagggcugcggggccgaggacguggugccguuccagugccccgccugcgacuuccagcggugccaggccugcuggcagcgccaccugcaggcgucccggaugugccccgccugccacaccgccagccgcaagcaguccgucaugcagguguucuggcccgagccgcaguga

SEQ ID NO: 35963 - RNA, 492 nt, Artificial Sequence
  derived and/or modified sequence opt1 from RTKN2__Homo_sapiens__NP_001269870
auggagggccccagccugcgcgggccggcccuccggcuggccggccugcccacccagcaggacugcaacauccaggagaagaucgaccucgagauccgcaugcgggaggggaucuggaagcugcugucccucagcacccagaaggaccaggugcugcacgcggucaagaaccugauggugugcaacgcccgccucauggccuacacguccgagcugcagaagcuggaggagcagaucgccaaccagaccggccggugcgacgugaaguucgagagcaaggagcgcaccgccugcaaggggaagaucgcgaucuccgacauccggaucccccucauguggaaggacagcgaccacuucuccaacaaggagcgcagccggcgcuacgccaucuucugccuguucaagaugggcgccaacgucuucgacaccgacguggugaacgucgacaagacgaucaccgacaucugcuucgagaacgugaccauccuguga

SEQ ID NO: 35964 - RNA, 1692 nt, Artificial Sequence
  derived and/or modified sequence opt1 from RTKN__Homo_sapiens__NP_001015055
auguucagccgcaaccaccggucccgcgugaccgucgcccggggcagcgcccuggagauggaguucaagcgcgggcgguuccgccucucccuguucagcgaccugcccgaggacaccgagcuccagcggaagcuggaccacgagauccgcaugcgggagggcgcgugcaagcugcucgccgccugcucccagcgcgagcaggcccuggaggccacgaagucccugcucgugugcaacucccggauccugagcuacaugggggagcugcagcgccggaaggaggcccaggugcucggcaagaccucccgccggccgagcgacuccgggccgcccgccgagcgcagccccugccggggccgcgucugcaucuccgaccugcggaucccccugauguggaaggacaccgaguacuucaagaacaagggcgaccuccaccgcugggccguguuccugcugcuccagcugggggagcacauccaggacaccgagaugauccugguggaccggacgcucaccgacaucagcuuccaguccaacguccuguucgccgaggcgggccccgacuucgagcugcgccucgagcuguacggggccugcguggaggaggagggcgcccugaccgggggccccaagcgccucgccaccaagcugagcuccagccugggccgguccagcgggcgccgggugcgcgccagccucgacuccgcgggcgggagcggcuccagccccauccugcugccgacgcccgucgugggcgggccccgguaccaccuccuggcccacaccacccugacccucgccgccgugcaggacggcuuccgcacgcacgaccugacccuggccucccacgaggagaaccccgcguggcucccgcuguacgggagcgucugcugccggcuggccgcccagccccucugcaugacccagcccaccgccuccggcacgcugcgcgugcagcaggccggggagaugcagaacugggcccaggugcacggcguccugaagggcaccaaccucuucugcuaccggcagcccgaggacgccgacaccggggaggagccgcugcugaccaucgccgugaacaaggagacgcgcgugcgggccggcgagcucgaccaggcccuggggcgccccuucacccugagcaucuccaaccaguacggcgacgacgaggucacccacacccugcagacggagagccgggaggcgcuccaguccuggauggaggcccuguggcagcuguucuucgacaugagccaguggaagcagugcugcgacgagaucaugaagaucgagacccccgcgccccgcaagccgccccaggcccucgcgaagcaggggucccuguaccacgagauggccaucgagccccuggacgacaucgccgccgugaccgacauccucacccagcgggagggcgcccgccuggagacgcccccgcccuggcuggcgauguucaccgaccagcccgcccuccccaacccgugcagccccgccuccguggcccccgccccggacuggacccacccccugcccuggggccggccccgcaccuucagccuggacgcggucccgcccgaccacagcccccgggcccgcagcguggcgccccucccgccccagcgcagcccccggacgcgcgggcugugcuccaagggccagccccggaccuggcugcagagcccgguguga

SEQ ID NO: 35965 - RNA, 4077 nt, Artificial Sequence
  derived and/or modified sequence opt1 from RTL1__Homo_sapiens__NP_001128360
augaucgagcccagcgaggacuccuucgagaccaugauggagcacaagaacccgagcuccaagcagauggagagcuccgagggcagcuccaacaccacggaggccaccagcggguccggcgugcgcggggaggccggccccgcgagcgggcccgcccaggagaagaaggagcccccguccggcccccugcaggagauggaggagcuccccaccgaccugcugcaggacauggaggagcccagcuccggcccgcggaaggagaucgaggacccgcccaacgaccuccugcaggaccuggaggagagcugcaacgggucccaccaggcccgcggcgacccccucagcggggccuccgaccggaugaaggaggccagcgucaaccccuccggcgcgcgcgaggagcaggaggcccacaccgaccugaaggagagcgggcgggaggagacgccccaggagcagaaccagaccgagcacagcaccgccgagcugauggccauggugcgcuccaucaucagccucuacuuccggaugcaggaccugaaggagcagcagcgcguggcggaggagauccugaucaagggcaucaacgccggccagcuccccgcccccaagcacuucuccggggaccggcgcgaguuccacgaguucaucguccugugccagcugacccuccagagcuacccgcggauguucuacaacgaccgccugcgggugggcuacgugaucaaccaccuguccgggcucgcccuggagugggccaaggcgcugcuccaggagaacagcccccugaucggcgacuuccccgccuuccuggaggccauguccgaggucuucgaguaccgccaggcccuccggguggccgaggaggcgauguucacgauccgccagggcgggcggagcgccaccgaguacaucgacgaguuccagucccuggugcccauccugggcuggccggacgagguccuccaggcccaccugugccaggggcugaacgaggagauccgccacuaccucuuccgggugccccagcccgacagccuggacucccugaucgugcucauccugcagaucgaggagaagcuggccgagcgccgggccaugcuccgccugcccccggaggcgcgcccccggaaccugaccuggaucgacagccccgcccccgagcgcuggauggucuccagcuggcucccguccgaggugcaccccgacaucaaccgggcccaccuguuccugcuccugauggugcgcgucaaccccuaccacagcguggccgugcaggcccuggucgacuccggcgcggacgggaacuucauggacgagaaguucgcccaggagcacuacguggagcucuacgagaagccguacccccagcccgugcagagcgucgacggcucccugaucggcaacgagcccguguggcuguacaccgagccgcucgugugcauccaccagaaccaccaggagagcaucgaguucgacaucguccccagccccaacuucuccgugguccuggggauccgguggcugcgcgugcacgcccccgagguggacuggaucaagggccggugcacguuccacagcccguacugccugaagaacugcuuccgcccgccgccgcccugcaucgcccucgagcggcacgggaugucccugcugcccggccucccccaccccuacagcgaccuggcggacgucuucaaccccaaggaggccgacgacgagaccuccgaccagcccagcuccgacgggagcgacgaccuguccgagagcgagcccuccgagcuccagcaggccggcgacagcgaccacuccgagaccuucuacgagugccccagcaccgcccccugggagcccgugggcgcccgcaugcaggagcgggcgcgccugcaggaggaguacugggaccugcaggacaugcucacgaaccggcaggacuacauccagaugauccccgagcuguucgaccagcugcacggggccgagugguucaccaagcucgagcugcgcggcaccaucguggaggaguccgucaacgggcaccggaccgaggacguguggaaggccgccuucggccuggagcucgaggagaugaaguccuaccagcccuucgcccugagcccggaccccaucaucccccagaacgugauccacuucauccugaaggacaugcucggguucuucguccugagcuacggccaggaggugcugaucuacagcaugucccaggaggagcaccuccaccacgugcgccagguccuggugcgguuccgccaccacaacguguacugcagccuggacaagucccaguuccaccggcagacggucgaguuccucggcuucguggugaccccgaagggggucaagcugaacaagaacgugaugaccaucaucaccggcuaccccacgcccgggagcaagcugucccuccgcaacuucaucgaguucguguuccccuaccgccacuucgucgagcgguucagcaucaucgcggagccgcuggugcgccagcugcucuccagcuaccaguucuacuggggcguggaggagcaggaggccuucgagugccugaagcgggccuuccgcaaggcgccccugcuccaccaccccaagccccagaacccguucuaccuggagaccggcgucaccgggaccgcccugcacgccucccucauccagaucgacgaccagacgggcaagcgggccugcugcgccuucuacagccgcaacaucucccccaucgagguggaguacagccaggccgagaugaagauccugcccauccgggcggccuucaugguguggugccgcuaccuggagaacaccgaggagcccaucaugauccuccugaacaccgaggaccuggccucccucaacaacgaccggcugaccguccugcucccggggcacuggguguucuucuucagccacuucaacuucgacgugauggagcugcccgagcaggacggcgggcgcgcccugccgcccguccggaaccuccgcuggcggcgcgccuuccagcggaacacggcggcccgccagacccugcugcucgccucccggggcuucccccgcgaccccagcaccgaguccggcgaggaggagaacgaggagcaggacgagcugaacgagcagauccugcggcaggagcuccuggccaugauccccaucgaccagauccugaacagcuuccucgcccacuucuccauggcgcagauccgcgccgugauccugcacuucuuccgggggcugcucuacuggaagaacacccuggcccuggccgccauccucgugcugcugcgcguccgccagugccucagccugcggcccgcgccggccaugcgcguggcccggccccagccccagcgcagccugcggcucauccuggacuccagccugaucgccggcuccagcaucacgaccgcgaucacccagcuccugacccagaugcccgcccuggugggggccaacaccaucccggcccaggagcucgccgagcuguuccugggccccgggcgcuggcagcggaacgcgcuccacucccaggcccaccgcggccugcaguucacgcccggcuucuggcugacccucugcgaguucuucgggguccgggugacgccccaggagggccaccucccggcccugcgccagaaccgguaccuggagcugcacguggucggggacgaggacguggugcugcgcgaggcccuccaggacgaccugcagcgguaccgccagugcggccugcacgacgggcuccaggacaccagccaggacaagcaggacaacgacguccaggaggccccgcccucccacaccgcggccacccacccgccccggccccgccaccugauggacccccaggugcuggaguuccucggcagccggcugcugcacauccacuccgccgacggccagcugcaccuccugagccgcgagcaggccgcccgggcgcugucccaguuccucacccugaucuaccgccgcgcccugcccauccccgccugggagagccagccccgggagcaggcccgccucgaggagcugcccgacgaggacgaggacgccaaccuggacuga

SEQ ID NO: 35966 - RNA, 2331 nt, Artificial Sequence
  derived and/or modified sequence opt1 from RTN1__Homo_sapiens__NP_066959
auggccgcccccggcgacccccaggacgagcugcucccccuggcggggcccggcagccaguggcugcgccaccgcggggagggcgagaacgaggccgugacccccaagggggccaccccggcgccccaggccggcgagcccucccccggccucggggcccgggcccgggaggccgccagccgcgaggcgggcuccgggccggcccggcagagccccgucgccauggagacggccuccaccggcguggccggggugagcuccgcgauggaccacaccuucagcaccacguccaaggacggcgagggcagcugcuacaccucccugaucagcgacaucugcuacccgccccaggaggacuccaccuacuucaccgggauccugcagaaggagaacggccacgucacgaucagcgagucccccgaggagcucgggacccccggccccagccugcccgacgugccgggcaucgagucccgcgggcuguucagcuccgacagcggcaucgagaugacccccgccgagagcaccgaggugaacaagauccucgccgacccccuggaccagaugaaggccgaggccuacaaguacaucgacaucacgcggcccgaggaggucaagcaccaggagcagcaccacccggagcuggaggacaaggaccucgacuucaagaacaaggacaccgacaucuccaucaagcccgagggggugcgcgagcccgacaagcccgcgccgguggagggcaagaucaucaaggaccaccuccuggaggagagcaccuucgcccccuacaucgacgaccuguccgaggagcagcggcgcgcgccccagaucaccacgcccgucaagaucacccugaccgagaucgagccgagcguggagaccacgacccaggagaagacccccgagaagcaggacaucugccugaagcccuccccggacaccgugcccacggucaccgugagcgagcccgaggacgacucccccgggagcaucaccccgcccuccagcggcaccgagcccuccgccgccgagagccagggcaagggguccaucagcgaggacgagcucaucacggccaucaaggaggccaagggccuguccuacgagaccgccgagaacccccggccgguggggcagcuggccgaccgccccgaggucaaggcccggagcggcccgcccaccauccccagcccccucgaccacgaggcguccuccgccgagagcggggacagcgagaucgagcugguguccgaggaccccauggccgccgaggacgcgcugcccagcggcuacguguccuucggccacgucgggggcccgccgcccagccccgccucccccagcauccaguacuccauccuccgcgaggagcgggaggccgagcuggacagcgagcugaucaucgaguccugcgacgccagcuccgccagcgaggagucccccaagcgcgagcaggacagcccgcccaugaagcccuccgcgcucgacgccauccgggaggagaccggggugcgcgccgaggagcgggcccccagccgccggggccuggccgagcccggguccuuccuggacuacccgagcacggagccccagcccggccccgagcucccgcccggcgacggggcgcuggagcccgagacccccaugcugccgcgcaagcccgaggaggacagcuccagcaaccagucccccgccgccaccaagggccccgggccgcucggccccggcgccccgccgccccugcuguuccucaacaagcagaaggccaucgaccugcuguacuggcgcgacaucaagcagaccgggaucguguucggcagcuuccuccugcuccuguucucccugacgcaguucagcgucguguccguggucgcguaccuggcccucgccgcccugagcgcgaccaucuccuuccggaucuacaagagcgugcugcaggccguccagaagaccgacgaggggcaccccuucaaggccuaccucgagcuggagaucacccugucccaggagcagauccagaaguacaccgacugccugcaguucuacgugaacagcacgcucaaggagcugcgccggcuguuccucgugcaggaccuggucgacucccugaaguucgccgugcucauguggcugcugaccuacgugggcgcccucuucaacgggcugacccugcuccugauggcggucgugagcauguucacccugcccguggucuacgugaagcaccaggcccagaucgaccaguaccucggccuggugcgcacgcacaucaacgccgucguggccaagauccaggccaagauccccggcgcgaagcggcacgccgaguga

SEQ ID NO: 35967 - RNA, 1638 nt, Artificial Sequence
  derived and/or modified sequence opt1 from RTN2__Homo_sapiens__NP_005610
augggccaggugcugcccgucuucgcccacugcaaggaggccccgagcaccgcguccagcacccccgacuccacggagggcgggaacgacgacagcgacuuccgcgagcuccacaccgcccgggaguucuccgaggaggacgaggaggagaccaccagccaggacugggggacgccccgcgagcugaccuucuccuacaucgccuucgacggcgugguggggagcggcggccggcgcgacuccaccgcccggcgcccccggccgcaggggcgcagcgucuccgagccccgggaccagcacccccagcccagccugggcgacucccucgagagcaucccgucccugagccagucccccgagcccgggcgccggggcgaccccgacaccgccccgcccagcgagcgcccccuggaggaccuccggcugcgccuggaccaccucggguggguggcgcggggcacgggcuccggggaggacagcagcaccuccagcuccacgccccuggaggacgaggagccgcaggagcccaaccgccuggagaccggcgaggccggggaggagcucgaccugcggcugcgccucgcccagcccagcucccccgaggugcugaccccgcagcugagccccggcuccggcacgccccaggccgggacccccagcccgucccggagccgcgacuccaacagcggccccgaggagccccuccuggaggaggaggagaagcagugggggccccuggagcgggagccgguccgcggccagugccucgacuccaccgaccagcuggaguucaccguggagccccgccugcucgggaccgcgauggaguggcugaagaccagccugcuccuggccguguacaagaccguccccauccuggagcucuccccgccccuguggacggccaucggcugggugcagcggggccccacgcccccgacccccgugcugcgcguccuccugaagugggccaagagcccccgguccagcggggugcccucccugagccucggcgccgacauggggagcaagguggcggaccugcuguacuggaaggacacccgcaccuccggcgucguguucaccgggcucauggugagccugcugugccuccugcacuucuccaucgucagcguggccgcccaccuggcccuccugcugcucugcggcaccaucucccugcggguguaccgcaagguccugcaggccgugcaccggggcgacggggcgaacccguuccaggccuaccuggacguggaccucacccugacgcgcgagcagaccgagcggcugagccaccagaucaccucccgcgucgugagcgccgccacccagcuccggcacuucuuccuggucgaggaccugguggacucccucaagcuggcccuccucuucuacauccugacguucgugggcgcgaucuucaacgggcugacccuccugauccugggcgucaucgggcuguucaccaucccccugcuguaccgccagcaccaggcccagaucgaccaguacgugggccucgugaccaaccagcugagccacaucaaggccaagauccgggccaagauccccggcacgggggcccuggcguccgccgccgccgcggucagcggcuccaaggccaaggccgaguga

SEQ ID NO: 35968 - RNA, 3099 nt, Artificial Sequence
  derived and/or modified sequence opt1 from RTN3__Homo_sapiens__NP_001252518
auggccgagcccagcgccgcgacccagucccacagcaucuccagcuccagcuucggcgccgagccguccgcccccgggggcgggggcagccccggggccugccccgcccugggcaccaaguccugcagcuccagcugcgcggacuccuucgugagcuccagcuccagccagccggucucccucuucagcacgagccaggagggccuguccagccugugcuccgacgagcccagcuccgagaucaugaccagcuccuuccucagcuccagcgagauccacaacaccgggcugaccauccugcacggcgagaagucccacgugcucgggagccagcccauccuggccaaggagggcaaggaccaccuggaccuccuggacaugaagaagauggagaagccccaggggacguccaacaacgugagcgacuccagcgucucccuggccgccggcgugcacugcgaccgcccgagcauccccgcguccuuccccgagcaccccgccuuccucagcaagaagaucggccagguggaggagcagaucgacaaggagaccaagaacccgaacggggucagcucccgggaggccaagaccgcccuggacgccgacgaccgcuucacccugcucacggcgcagaagccgcccaccgaguacagcaagguggagggcaucuacaccuacucccugagccccuccaaggugagcggggacgacgucaucgagaaggacucccccgagagccccuucgaggugaucaucgacaaggccgccuucgacaaggaguucaaggacuccuacaaggagagcaccgacgacuucggcuccuggagcgugcacacggacaaggaguccagcgaggacaucuccgagaccaacgacaagcuguucccccuccggaacaaggaggccggccgcuaccccaugagcgcccugcugucccggcaguucagccacaccaacgcggcccucgaggaggucagccgcugcgugaacgacaugcacaacuucaccaacgagauccugacgugggaccuggugccgcaggucaagcagcagaccgacaaguccagcgacugcaucaccaagaccacggggcucgacauguccgaguacaacagcgagauccccguggugaaccugaagaccuccacccaccagaagacccccgucugcagcaucgacggcuccacgcccaucaccaagagcaccggggacugggccgaggccucccugcagcaggagaacgccaucaccggcaagccggugcccgacagccucaacuccacgaaggaguucagcaucaagggggugcagggcaacaugcagaagcaggacgacacccuggcggagcugcccggcagcccgcccgagaagugcgacagccucggguccggcgucgccaccgugaaggugguccugcccgacgaccaccugaaggacgagauggacuggcagagcuccgcccucggggagaucaccgaggccgacagcuccggcgagagcgacgacacggugaucgaggacaucaccgccgacaccagcuucgagaacaacaagauccaggcggagaagcccgucuccaucccgagcgccguggugaagaccggggagcgggagaucaaggagauccccuccugcgagcgcgaggagaagacgagcaagaacuucgaggagcuggucuccgacagcgagcugcaccaggaccagcccgacauccucggccggucccccgccagcgaggccgcgugcuccaaggugccggacaccaacgugagccuggaggacgucuccgagguggcccccgagaagcccaucaccaccgagaaccccaagcugccgagcaccgugucccccaacgucuucaacgagacggaguucagccucaacgugaccaccuccgccuaccuggagagccugcacggcaagaacgugaagcacaucgacgacuccagccccgaggaccucaucgccgccuucaccgagacgcgcgacaaggggaucgucgacuccgagcggaacgcguucaaggccaucagcgagaagaugaccgacuucaagaccacgcccccgguggaggugcugcacgagaacgagagcggcggguccgagaucaaggacaucggcagcaaguacuccgagcagagcaaggagaccaacggguccgagccccugggcgucuuccccacccagggcacccccguggccagccucgaccuggagcaggagcagcugaccaucaaggcccucaaggagcugggggagcgccagguggagaaguccacgagcgcccagcgggacgcggagcugccguccgaggagguccugaagcagaccuucaccuucgcccccgagagcuggccccagcgcuccuacgacauccucgagcggaacgugaagaacggcagcgaccuggggaucucccagaagcccaucaccauccgcgagacgacccggguggacgccgucagcucccugagcaagaccgagcucgugaagaagcacgugcuggcccgccugcucaccgacuucuccguccacgaccugaucuucuggcgggacgugaagaagacgggcuucguguucggcaccacccugaucaugcuccugagccuggccgcguucuccgucaucagcguggugagcuaccucauccuggcccugcucuccgucaccaucagcuuccgcaucuacaaguccgugauccaggccgugcagaaguccgaggaggggcacccguucaaggccuaccuggacgucgacaucacgcuguccagcgaggcguuccacaacuacaugaacgccgccauggugcacaucaaccgggcccucaagcugaucauccgccuguuccucguggaggaccuggucgacucccugaagcucgccguguucauguggcugaugaccuacgugggcgcggucuucaacgggaucacccugcucauccuggccgagcugcucaucuucagcgugcccaucguguacgagaaguacaagacccagaucgaccacuacgucggcaucgcccgcgaccagacgaaguccaucguggagaagauccaggccaagcugcccgggaucgccaagaagaaggcggaguga

SEQ ID NO: 35969 - RNA, 600 nt, Artificial Sequence
  derived and/or modified sequence opt1 from RTN4__Homo_sapiens__NP_008939
auggacggccagaagaagaacuggaaggacaagguggucgaccugcucuacuggcgcgacaucaagaagaccggggugguguucggcgccagccuguuccugcuccugucccugaccgucuucagcaucguguccgugacggccuacaucgcgcucgcccugcugagcgucaccaucuccuuccggaucuacaagggggugauccaggccauccagaaguccgacgagggccaccccuuccgcgccuaccucgagagcgagguggccaucagcgaggagcugguccagaaguacuccaacagcgcgcuggggcacgugaacugcaccaucaaggagcuccggcgccuguuccugguggacgaccucgucgacucccugaaguucgccgugcugauguggguguucaccuacgucggcgcccucuucaacggccugacgcugcucauccuggcccugaucagccucuucuccgugccggugaucuacgagcggcaccaggcgcagaucgaccacuaccuggggcuggccaacaagaacgucaaggacgccauggccaagauccaggccaagauccccggccucaagcgcaaggcggaguga

SEQ ID NO: 35970 - RNA, 1191 nt, Artificial Sequence
  derived and/or modified sequence opt1 from RTN4IP1__Homo_sapiens__NP_116119
auggaguuccugaagaccugcgugcuccgccggaacgccugcaccgccgucugcuucuggcgcagcaagguggugcagaagcccuccguccggcgcaucagcacgaccuccccgcggagcaccgugaugcccgcgugggugaucgacaaguacggcaagaacgagguccugcgcuucacccagaacaugaugaugcccaucauccacuaccccaacgaggugaucgugaagguccacgccgccuccgugaacccgaucgacgugaacaugcggagcggguacggcgccacggcccugaacaugaagcgcgacccccuccacgucaagaucaagggggaggaguucccccugacccugggccgggacguguccgggguggucauggagugcggccucgacgugaaguacuucaagcccggcgacgaggugugggcggccgucccgcccuggaagcaggggacccugagcgaguucgugguggucuccggcaacgaggugagccacaagcccaagucccugacccacacgcaggccgccagccuccccuacguggcgcugaccgccugguccgccaucaacaaggucgggggccugaacgacaagaacugcaccgggaagcgcgugcucauccugggcgccagcggcggggucggcaccuucgccauccaggugaugaaggcgugggacgcccacgugacggccgucugcucccaggacgccagcgagcuggugcggaagcucggggccgacgacgugaucgacuacaaguccggcagcgucgaggagcagcugaagucccugaagccguucgacuucauccucgacaacgugggcgggagcaccgagaccugggcgcccgacuuccugaagaaguggagcggcgccaccuacgugacgcuggucacccccuuccuccugaacauggaccgccuggggaucgccgacggcaugcuccagaccggggugaccgugggcuccaaggcccugaagcacuucuggaagggcguccacuaccggugggccuucuucauggcgagcgggcccugccuggacgacaucgccgagcucguggacgccggcaagauccgcccggugaucgagcagacguuccccuucuccaagguccccgaggccuuccugaagguggagcgggggcacgcccgcggcaagaccgugaucaacgucguguga

SEQ ID NO: 35971 - RNA, 1422 nt, Artificial Sequence
  derived and/or modified sequence opt1 from RTN4R__Homo_sapiens__NP_075380
augaagcgcgccagcgccggcgggucccggcugcucgcgugggugcuguggcugcaggccuggcaggucgccgcccccugcccgggcgccugcgugugcuacaacgagcccaaggugaccaccagcugcccccagcaggggcuccaggcgguccccgugggcaucccggccgccucccagcgcaucuuccugcacgggaaccggaucagccacgugcccgccgcguccuuccgcgccugccggaaccugaccauccucuggcugcacagcaacguccuggcccgcaucgacgccgccgcguucaccggccucgcccugcuggagcagcucgaccuguccgacaacgcccagcugcggagcguggaccccgccaccuuccacggccucgggcgccugcacacccugcaccucgaccggugcggccugcaggagcuggggcccggccucuuccgcgggcuggccgcgcugcaguaccucuaccugcaggacaacgcccugcaggcccucccggacgacacguuccgggaccugggcaaccugacccaccucuuccugcacggcaaccgcaucuccagcgugcccgagcgggccuuccgcgggcugcacucccucgaccggcugcugcuccaccagaaccgcgucgcccacgugcacccccacgcguuccgggaccugggccgccugaugacccucuaccuguucgccaacaaccugagcgcccuccccaccgaggcccuggccccgcugcgggcgcuccaguaccugcgccugaacgacaaccccugggugugcgacugccgggcccgcccccucugggccuggcugcagaaguuccgcggguccagcuccgagguccccugcagccugccgcagcggcuggccggccgcgaccucaagcggcuggcggccaacgaccugcagggcugcgccguggccacggggcccuaccaccccaucuggaccggccgcgccaccgacgaggagccccucgggcugccgaagugcugccagcccgacgcggccgacaaggccuccgugcuggagcccggccggcccgccagcgccgggaacgcgcucaagggccgcgucccgcccggcgacuccccgcccgggaacggcagcgggccccggcacaucaacgacagccccuucggcacccugcccggguccgccgagccgccccugacggccgugcgccccgagggcagcgagcccccgggcuuccccaccuccgggccccggcgccggcccggcugcagccgcaagaaccggacccgcucccacugccggcucgggcaggccggcagcgggggcggcgggaccggcgacuccgaggggagcggcgcccugccgucccugacgugcagccucacgccccugggccuggcgcucgugcuguggaccguccuggggcccugcuga

SEQ ID NO: 35972 - RNA, 699 nt, Artificial Sequence
  derived and/or modified sequence opt1 from RTP3__Homo_sapiens__NP_113628
auggccggcgacaccgagguguggaagcagauguuccaggagcugaugcgcgaggucaagcccuggcaccgguggacccuccgcccggacaaggggcugcugcccaacgugcucaagcccggcuggaugcaguaccagcaguggacguucgcccgguuccagugcagcuccugcagccgcaacugggcguccgcccaggugcugguccuguuccacaugaacuggagcgaggagaagucccggggccaggugaagaugcgcguguucacccagcggugcaagaagugcccccagccccucuucgaggaccccgaguucacccaggagaacaucagccgcauccugaagaaccuggucuuccggauccucaagaagugcuaccgcgggcgguuccagcugaucgaggaggugcccaugaucaaggacaucucccuggaggggccccacaacagcgacaacugcgaggccugccuccagggcuucugcgccggcccgauccaggugaccucccugccgcccagccagacgccccgcguccacuccaucuacaagguggaggagguggucaagccgugggccagcggggagaacguguacuccuacgcgugccagaaccacaucugccggaaccugagcaucuucugcugcugcgugauccucaucgucaucguggugaucgucgugaagaccgccaucuga

SEQ ID NO: 35973 - RNA, 741 nt, Artificial Sequence
  derived and/or modified sequence opt1 from RTP4__Homo_sapiens__NP_071430
augguggucgacuucuggaccugggagcagaccuuccaggagcugauccaggaggccaagccccgcgccacguggacccucaagcuggacggcaaccugcagcucgacugccuggcgcagggguggaagcaguaccagcagcgggccuucggcugguuccgcugcagcuccugccagcggagcugggccuccgcccaggugcagauccugugccacaccuacugggagcacuggaccagccagggccaggugcgcaugcggcuguucgggcagcgcugccagaagugcuccuggagccaguacgagaugccggaguucuccagcgacuccacgaugcggauccugagcaaccugguccagcacauccucaagaaguacuacgggaacggcacccgcaagucccccgagaugcccgugauccuggaggugagccuggagggcucccacgacaccgccaacugcgaggcgugcacccucgggaucugcggccaggggcucaagagcugcaugacgaagcccuccaagagccugcucccgcaccugaagaccggcaacuccagccccgggaucggcgccgucuaccuggccaaccaggccaagaaccaguccgcggaggccaaggaggccaagggcagcggguacgagaagcucggccccagccgggaccccgacccgcugaacaucugcguguucauccugcuccugguguucaucgucgugaagugcuucaccuccgaguga

SEQ ID NO: 35974 - RNA, 6681 nt, Artificial Sequence
  derived and/or modified sequence opt1 from RTTN__Homo_sapiens__NP_775901
auggugcuggccggccucauccggaagcuggggcaccagcuggccgagauccgggagcgcgcccucaagagcauccugugcaagaucgagcacaaccugaucugcuacgccgaccucauccaggagcggcagcuguuccugcaccuccuggagugguucaacuuccccagcgugcccaugaaggaggaggugcugaaccuccugagccgccuggugaaguacccgcccgccguccagcaccucguggacgugggcgccgucgaguuccuguccaagcugcggagcaacguggagcccaaccuccaggccgagaucgacgggauccuggacggccuguuccuccugccguccgaggugcccgcgcugagcuccgccagcuaccagaccaaccagaccgagcucuccaagaaccccgagauccugaccggguacuucccccaggacaagagcaacuuccagcagauggaggucccgccccgccccguggugaaccagaccgucaagugccugaaguucuccaccuuccccuggcucccgcugaccaccaccgaccggcacgugcugagcuccaacgagagcucccuccgcagcuccaaccacacccugaucuggaacacgugcgagcugcucaaggacgugaucaugcaggacuuccccgccgagaucuuccugcagcggcccaagaucguccagagccugcucucccugcugaagcucgccuucggcgacggcaagcaccgccuggcgcugcagagcgugagcugccuccagcagcugugcauguaccugcggaaccgccucaacuuccaccgggaccccggguucuucuccaacaagcacgacaccgugagccagaacuccagccuguccuacugccacgaggcccgcggcacccaccacagccagaacccgucccccgggagcuccagcccccggcccuccgucgugggccgcaccgggcagcggccgcgcggcgacggccaggacugggacgccgccagcuccagcggguccagcucccacgcccacgugaacagccggaucuccguccacagcccccuggacaugggccacaucgaccuccccgagcuggagaccgaggacacgcuggagcugcaguuccagcagcucagccugccccaguucugcguguccauccuggagagcgcggugccgcuccugcgcaccgggucccggcaggucaucauccgcgugcuggagcuccugaccgaggacaugacccugaucggcgaggccaucagcacggacaucugggacgacuccagccucuucggcaucgacaugaaggagaagcugcugcucguccugggggcccugggcgagaccaugugcuaccacaaguccagcaucucccucgagcagcccgaggugaugcuggugcaccaccgcauggccuucaucagcaucucccuguucgccguccggcuccugcagacccugcuccccguggagaaggcgagcgaguuccuguccgagcccaugagcaccgcccuguuccuccugucccuggacaugccgaucagccucgaguaccccaacauccacgaggccguggucgccuaccuggagcagcugaacuccgagaacuacagcaucuacaagcgcacggccgaggcgguguacagcaucgagugcacgugcaacuuccucuccgacaucgggaaggagggcgagaagaaccugcuggagcucguggagcuggccgaccaggcccugcggagcuucuccuaccaccagcacuucccccucaucaaggagaucaucagcaucugcuccaagaucuggaaguccgcccaggccuccccgcugcugcagggggagagccagaagguccuccugcacaugcugucccacccccucccccgcgugaaggcggagaccuaccacugcugccuggagaucaccaaggagugccugggcgugcacaacgucacgaagcccgugagcucccucugcaacggcauccacuuccugcugcacccgaaggugcucuacgagaucagcgucuucgggauccaggagcccgaguccgaggugaacaccgccgccaaggccauccugcuguaccuccugcagggccggcugaugaugaccgcgcucaccuggaacaaguucaucgagagccugugccccgugauccccauccugcagggguacgccgacacggaggacccgcucggcaacugcauccugcugcucuccaaggccagcuccgacaccgaggagaugcugcccugcaccacccgccucaagagcaugcuccggcugcugcucgucaagaagcccuccgugcgcagccuggcccugaagcuccuggccuuccaccugacgagcgaggagggggcggacaccaagcggccccucaucgacgcccgcgugcugucccgggucaccgaccuguucaucggcaagaagccgaucgagcuccgccuggacgaccggcgcgagcuggugaucaagcucgagaccguggagaaggucuacgagaucuucacgagcgacgacguggaccuggugcugcggaaguccgccgccgagcagcucgccgucaucaugcaggacaucaagaugcacgcgguggugaagaagcugugccugaucgacaagaucaucgaguaccucaacgagugcgucagccaggacggcaaggugguggagugccugguccagcccugccugacccuccugcgcaaggugcugugcggggaccccgugaugcgggucucccucagccagcaguccagccugcugaccguccuguuccgcgugucccugaucuuccacgaggacugcagcgucgugaccgaggugggcgcccuguucugccugcuccuguucgacgaggucucccggauggacauguggagcgugaaccccuccaacaagccgagccugcccuccguguucagccuccccgucuccguguuccgccgcuaccaccuccccgugcacgucaucgggcaccacgccgugagcccguacuccaucgugcugccccucagcgccgacugccuggcccugaagcccgucagcgacaugcuccggaucgcguggaaccuguccugguaccacggcagcgacaaccugcucaagcagaugaacuccgagaccaagacgcaggagauccuggacgcccugaagcucagcaccgaggacauccugacccugaagaucacccacauggccuccgggcuccaggacugccugcacagcaucgugcaggccgcgacgcaccgcgagguccgggccgccgugacccgcauguccuucuaccugcucaacgaccggcugagccugaagggcugccccggcccgugcggggugacccucaagucccuggccuggcacaccgcccugaaccgcuuccuccagguccugcccgcgugcacggaggacgagaagcugcucaucgacaucauccacuuccugaacaagcugaucaaggagcagcggaagaacagcucccucgagcugcugaacuggauccucgagcugcugcuccgccacagcgccaacccccugcuggaccuccuggugcugaccgagucccaggcccgggaggagaccgacgacauccgcaccgccgugcggcagcagcuccagaaggagcugaucgcccuguucgacacgcuccugcugaacuucauggaggucaccgaccgcaagugcagcgagcuccuguacguguuccagacccagcuggcgcucaagcugcugcagugccucaaggugaccgacgccccgcacuucuacggccugcccucccuggagcggacgcuccgcgggauggccaaccugaccgccuuccccggcuggagcucccacagcccccugaccaagccgcucgacaucugcgucaaguaccuguccggccugcucgaggugaucaccagcuucuacguggagcgcgggggcaacgccaugagcuucauggggaagggcgucacgaaguccaccauccugugccugcuccaccugagccacgagaugauggcgcaggccgggucccuggaguggaugagccucugguuccugccccugggcucccacagcgaggagcacauccccacccagcagggccucgccuggcugaucccccuguggguggaccgcgacccggaggugcgguucaccucccucgggcugggcagcgcccugacgacccucgagaccgggugcgucgcgcuggccaacuccugccagaacaucagcggcgggcuguggggcaccguggugaacauccuccuggaccaguccgagugcagcaugguccgccgggaggccgccuucauccugcagaaccuccuggugauccccaugcccacggagaucaucaaggacuacaccuggcagggccccugcgugcacgacgaggacuccgggcugagccucaucggcaagccggcccugcaggcgcugcucuaccacugccacuucuacgagcaccugaaccagauggucaagcacugcuaccuggggcgcugcauguucgaccucaacuucuccgccuucgaccggaacagcgaguccaacgaccugaacggccuggacgacagcuucaaguucuggcgcgcccccucccgcaccagccaggaccgggaccccagcucccucagcaccuccgagacgaccguggcccccagccugggguccaccgaguuccagccgcuggugcagagcaccacgcugcuccccgaggccucccacgaccaguucgucgcgcagggccaccaggagagcaccagcccccgcccgccccacgacagcucccugagcgcgccccugcccaagcucugcguguucgugacccccucccugcugagcgccaugugcucccuccuggacaaccugcucaccaucgcgccccgggacaccgccaaggccuuccgccaggcccaccugaucgagcugcucugcagcaucgccgacgccacgcugauccagaccugcguccaggagcugcgggcccuccugcccuccuccccgcccgcggagcacacccaggcccagguguccuuccugcucgaguaccugagcagccugucccgccuccugcagagcugccugcucguggagccggaccuggucauccaggacgagcuggugaagccccucaucaccaacaucaucggcauccugacgaucugcaccaaggacgugcuggacaaggagcucaucuccgccuucuaccacaccuggacccaccuguucaaccugcucgccaugcugcugcggaaggcgggggccaucacgcuccccuucgucaccguggcccuggccaagcacuggaccgccgcgaucgacauguucugcacgugcgccggccugagcgccacgugcccggcccucuacaccgccucccugcaguuccugagcgugcuccugaccgaggaggcgaaggggcaccuccaggccaaguccaagacccaccugugcugcagccccacggucgccucccugcuggacgacagccaggagaaccagaagucccucgagcagcugagcgacgugauccugcagugcuacgagggcaaguccagcaaggacauccucaagcgcguggccgccaacgcgcugaugucccugcucgccgucagccggcgcgcccagaagcacgcccugaaggcgaaccugaucgacaacugcauggagcagaugaagcacaucaacgcccagcucaaccuggacucccugcggcccgggaaggccgcccucaagaagaaggaggacggcgugaucaaggagcugagcaucgccaugcagcugcuccgcaacugccuguaccagaacgaggagugcaaggaggcggcccuggaggcccaccucgugcccguccugcacagccuguggccguggauccucauggacgacucccugaugcagaucagccugcagcuccugugcguguacaccgccaacuuccccaacggcugcuccagccugugcugguccagcugcgggcagcaccccgugcaggccacccaccggggcgcggucuccaacagccucaugcugugcauccugaagcucgccucccagaugccccuggagaacaccacggugcagcagaugguguucaugcugcucagcaaccuggcccugucccacgacugcaagggggucauccagaaguccaacuuccuccagaacuuccugucccuggcccucccgaagggcggcaacaagcaccugagcaaccugaccauccucuggcugaagcugcuccugaacaucuccagcggggaggacggccagcagaugauccugcgccucgacgggugccuggaccugcugaccgagauguccaaguacaagcacaagagcagcccccugcugccccugcucaucuuccacaacgugugcuucagccccgccaacaagccgaagauccuggcgaacgagaaggugaucaccguccuggccgccugccucgagagcgagaaccagaacgcccagcggaucggcgcggccgcccugugggcccugaucuacaacuaccagaaggccaagacggcgcucaagucccccagcgugaagcgccgggucgacgaggccuacucccuggccaagaagaccuuccccaacagcgaggccaacccccugaacgccuacuaccucaagugccuggagaaccuggugcagcuccugaacuccagcuga

SEQ ID NO: 35975 - RNA, 1803 nt, Artificial Sequence
  derived and/or modified sequence opt1 from RUFY1__Homo_sapiens__NP_001035542
augauggaggagcgcgccaaccugaugcacaugaugaagcucagcaucaaggugcugcugcaguccgcccucagccugggccggucccuggacgcggaccacgcgccccuccagcaguucuucgucgugauggagcacugccugaagcacgggcugaaggugaagaaguccuucaucggccagaacaagagcuucuucgggccgcucgagcuggucgagaagcugugccccgaggccagcgacaucgccaccuccgugcgcaaccuccccgagcugaagaccgccgugggccgggggcgcgccuggcuguaccucgcccugaugcagaagaagcuggccgacuaccucaagguccugaucgacaacaagcaccuccugagcgaguucuacgagcccgaggcccugaugauggaggaggagggcauggugaucgugggccugcucgucgggcugaacgugcuggacgcgaaccucugccugaagggcgaggaccuggacucccaggugggggucaucgacuucagccucuaccugaaggacgugcaggaccuggacggcgggaaggagcacgagcggaucacggacgugcucgaccagaagaacuacgucgaggagcugaaccgccaccuguccugcaccgugggcgaccuccagaccaagaucgacggccuggagaagaccaacagcaagcugcaggaggagcucuccgccgccacggaccggaucugcagccugcaggaggagcagcagcagcugcgcgagcagaacgagcucauccgggagcgcuccgagaaguccguggagaucaccaagcaggacaccaaggucgagcuggagaccuacaagcagacgcggcaggggcuggacgagauguacagcgacguguggaagcagcucaaggaggagaagaaggugcgccuggagcuggagaaggagcucgagcugcagaucggcaugaagaccgagauggagaucgccaugaagcugcuggagaaggacacccacgagaagcaggacacccucgucgcccugcggcagcagcuggaggaggugaaggcgaucaaccuccagauguuccacaaggcccagaacgccgagagcucccugcagcagaagaacgaggccaucacgagcuucgaggggaagaccaaccaggugaugagcuccaugaagcagauggaggagcgccugcagcacagcgagcgggcccgccagggcgcggaggagcggucccacaagcuccagcaggagcugggcgggcgcaucggcgcccugcagcuccagcugagccagcugcacgagcagugcuccagccucgagaaggagcugaaguccgagaaggagcagcggcaggcccugcagcgcgagcuccagcacgagaaggacaccagcucccugcugcggauggagcuccagcaggucgaggggcugaagaaggagcugcgcgagcuccaggacgagaaggccgagcugcagaagaucugcgaggagcaggagcaggcccugcaggagaugggccuccaccugagccaguccaagcugaagauggaggacaucaaggaggugaaccaggcgcucaaggggcacgccuggcugaaggacgacgaggccacccacugccgccagugcgagaaggaguucagcaucucccggcgcaagcaccacugccggaacugcggccacaucuucugcaacacgugcagcuccaacgagcuggcccucccgagcuaccccaagcccguccgcgugugcgacuccugccacacccugcugcuccagcggugcagcuccaccgccagcuga

SEQ ID NO: 35976 - RNA, 1863 nt, Artificial Sequence
  derived and/or modified sequence opt1 from RUFY3__Homo_sapiens__NP_001032519
augagcgcccugacgcccccgaccgacaugcccacccccaccaccgacaagaucacccaggccgcgauggagacgaucuaccucugcaaguuccgcguguccauggacggcgaguggcugugccugcgggagcucgacgacaucagccugacccccgacccggagcccacccacgaggaccccaacuaccugauggccaacgagcgcaugaaccucaugaacauggccaagcuguccaucaaggggcugaucgagagcgcccucaaccugggccggacccuggacuccgacuacgcgccccuccagcaguucuucgucgugauggagcacugccugaagcacgggcugaaggccaagaagacguuccucggccagaacaagagcuucugggggccgcuggagcugguggagaagcucguccccgaggccgccgagaucaccgccuccgugaaggaccugcccggccugaagacccccgugggccgcgggcgggcguggcuccgccuggcccugaugcagaagaagcucagcgaguacaugaaggcccugaucaacaagaaggagcugcucuccgaguucuacgagccgaacgcccugaugauggaggaggagggcgccaucaucgcggggcugcucgucggccugaacgugaucgacgccaacuucugcaugaagggggaggaccuggacagccaggugggcgucaucgacuucuccauguaccucaaggacggcaacagcuccaaggggaccgagggcgacgggcagaucacggccauccuggaccagaagaacuacguggaggagcugaaccggcaccucaacgccaccgugaacaaccugcaggccaaggucgacgcgcuggagaaguccaacaccaagcucaccgaggagcuggccguggccaacaaccgcaucaucacgcugcaggaggagauggagcgggugaaggaggagagcagcuacauccucgaguccaaccgcaagggccccaagcaggaccggaccgccgagggccaggcccugagcgaggcgcgcaagcaccugaaggaggagacccagcuccggcuggacgucgagaaggagcuggagaugcagaucuccaugcgccaggagauggagcucgccaugaagaugcuggagaaggacgugugcgagaagcaggacgcccuggugagccugcggcagcagcucgacgaccugcgcgcccugaagcacgagcucgccuucaagcugcagagcuccgaccugggggucaagcagaaguccgagcucaacagccggcuggaggagaagaccaaccagauggcggccacgaucaagcagcuggagcagcgccuccggcaggccgagcgcagccggcaguccgccgagcuggacaaccgccuguucaagcaggacuucggcgacaagaucaacagccuccagcuggagguggaggagcugacccgccagcggaaccagcucgagcuggagcugaagcaggagaaggagcgccggcuccagaacgaccgcuccauccccgggcggggcagccagaaguccgagagcaagauggacgggaagcacaagaugcaggaggagaacgugaagcugaagaagccccuggaggagucccaccgccuccagccgcaccccauggacgagcaggaccagcugcugcucagcgagaagccccagcugugccagcugugccaggaggacggcucccucaccaagaacgucugcaagaacugcagcggcaccuucugcgacgcgugcuccacgaacgagcugccccugccgagcuccaucaagcucgagcgggugugcaaccccugccacaagcaccugaugaagcaguacagcaccucccccagcuga

SEQ ID NO: 35977 - RNA, 1371 nt, Artificial Sequence
  derived and/or modified sequence opt1 from RUNDC3B__Homo_sapiens__NP_001127877
auggccagccgcucccugggcgggcucagcggcauccgcgggggcgggggcggcgggggcaagaagucccugagcgcccggaacgcggccguggagcggcgcaaccugaucaccgucugccgguucuccgugaagacccucaucgaccgcagcugcuucgagacgaucgacgacuccagccccgaguucaacaacuucgccgccauccuggagcagauccugucccaccggcucaagggccaggugaccugguucggguacgagagcccgcgcuccuucugggacuacauccgggucgccugccgcaaggugagccagaacugcaucugcuccaucgagaacauggagaacgugagcuccagccgggcgaaggggcgcgccuggauccgggucgcccugauggagaagcaccuguccgaguacaucagcaccgcccuccgcgacuucaagaccacgcggcgcuucuacgaggacggcgcgaucgugcugggcgaggaggccaacaugcuggccgggaugcuccugggccugaacgccaucgacuucuccuucugccucaagggggagggccuggacggcagcuuccccgccgugaucgacuacacccccuaccugaaguacauccagagcuccgacagcaucuccagcgacgaggaggagcuccggacccugggguccagcggcuccgagagcuccacccccgagaacgucgggccgcccuuccugauggacgagaacagcugguucaacaagugcaagcgcgugaagcagaaguaccagcucacgcuggagcagaagggcuaccuggaggagcuccugcggcugcgcgagaaccagcucuccgagagcgugucccagaacaagauccugcugcagcggaucgaggacagcgaccucgcgcacaagcuggagaaggagcagcuggaguacaucaucgucgagcuccaggaccagcugaccgugcugaagaacaacgaccuccgcucccgccaggagcugaccgcccaccugaccaaccaguggcccagccccggggcccucgacgugaacgccgucgcccuggacacgcugcucuaccggaagcacaacaagcagugguacgagaaguccuaccagagccuggaccagcuguccgcggaggugagccucagccagaccucccuggacccgggccagagccaggagggcgacgggaagcaggacacccugaacgugauguccgagggcaaggaggacacccccagccuccuggggcugugcggcucccugacgagcgucgccuccuacaagagccucaccucccucaagagcaacgacuaccuggccucccccaccaccgagaugacgagccccgggcugaccccguccuga

SEQ ID NO: 35978 - RNA, 1362 nt, Artificial Sequence
  derived and/or modified sequence opt1 from RUNX1__Homo_sapiens__NP_001001890
augcgcauccccguggacgccagcaccucccggcgcuucaccccgcccagcacggcccugucccccggcaagaugagcgaggcgcucccccugggggccccggacgccggcgccgcccuggcggggaagcuccgguccggcgaccgcagcauggucgaggugcuggccgaccaccccggggagcuggugcggaccgacucccccaacuuccucugcagcguccugcccacccacuggcgcugcaacaagacccugccgaucgccuucaaggugguggcccucggcgacguccccgacggcacgcuggugaccgugauggcggggaacgacgagaacuacuccgccgagcugcggaacgccaccgccgccaugaagaaccaggucgcgcgcuucaacgaccuccgguucgugggccgcagcgggcggggcaaguccuucacccugacgaucaccguguucaccaacccgccccaggucgccaccuaccaccgcgccaucaagaucacgguggacgggccccgggagccccgccggcaccgccagaagcuggacgaccagaccaagcccggcagccucuccuucagcgagcggcuguccgagcuggagcagcuccgccggaccgccaugcgcgugagcccccaccacccggcccccacccccaacccccgggcgucccugaaccacagcacggccuucaacccgcagccccagucccagaugcaggacacccgccagauccagcccagcccgcccuggagcuacgaccaguccuaccaguaccugggcagcaucgccucccccagcguccaccccgccacccccaucuccccggggcgcgccagcggcaugaccacgcucuccgcggagcugagcucccggcugagcaccgcccccgaccucaccgccuucuccgacccccgccaguucccggcccugcccagcaucuccgacccccggaugcacuaccccggggccuucaccuacagcccgacgcccgugaccuccggcaucggcaucgggaugagcgcgaugggcuccgccacccgcuaccacaccuaccugcccccgcccuaccccgggagcucccaggcccagggcgggcccuuccaggccagcagccccuccuaccaccucuacuacggcgcgagcgccggcuccuaccaguucagcauggucgggggcgagcgguccccgccccgcauccugccgcccugcacgaacgccagcaccggguccgcccugcucaaccccagccugcccaaccaguccgacgugguggaggccgagggcagccacuccaacagccccaccaacauggcgcccuccgcccggcuggaggaggccguguggcgcccguacuga

SEQ ID NO: 35979 - RNA, 1815 nt, Artificial Sequence
  derived and/or modified sequence opt1 from RUNX1T1__Homo_sapiens__NP_001185560
augaucagcgugaagcgcaacaccuggcgggcccugucccucgucaucggcgacugccgcaagaaggggaacuucgaguacugccaggaccggaccgagaagcacagcacgaugcccgacuccccgguggacgugaagacccagagccgccugaccccgcccaccaugcccccgccgcccacgacccagggcgcgccccggaccuccagcuucacccccacgacccugaccaacgggaccucccacagccccacggcccucaacggcgcccccuccccgcccaacggguucagcaacggccccuccagcuccagcuccagcucccuggccaaccagcagcugccgcccgccugcggcgcccgccagcucagcaagcugaagcgguuccugaccacccuccagcaguucgggaacgacaucucccccgagaucggcgagcgcguccggacccuggugcuggggcucgugaacagcacgcugaccaucgaggaguuccacagcaagcugcaggaggcgaccaacuucccccuccgccccuucgucauccccuuccugaaggccaaccugccccuccugcagcgggagcugcuccacugcgcccgccuggccaagcagaaccccgcgcaguaccuggcccagcacgagcagcuccugcuggacgccuccaccacgagccccguggacuccagcgagcuccugcuggacgugaacgagaacggcaagcggcgcacccccgaccggaccaaggagaacggguucgaccgcgagccgcuccacuccgagcaccccagcaagcggcccugcaccaucucccccggccagcgcuacagcccgaacaacggccuguccuaccagcccaacgggcugccccacccgacgcccccgccgccccagcacuaccggcucgacgacauggccaucgcccaccacuaccgcgacagcuaccggcaccccucccaccgcgaccugcgcgaccggaaccgccccaugggccugcacgggacccggcaggaggagaugaucgaccaccgccucaccgaccgggagugggcggaggaguggaagcaccuggaccaccuccugaacugcaucauggacauggucgagaagacccgccggagccugacggugcugcgccggugccaggaggccgaccgcgaggagcucaacuacuggauccggcgcuacuccgacgccgaggaccugaagaagggcggcgggagcuccagcucccacagccggcagcagucccccgugaaccccgaccccgucgcccuggacgcccaccgcgaguuccuccaccggcccgcgagcggcuacgugcccgaggagaucuggaagaaggccgaggaggccgugaacgaggucaagcgccaggccaugaccgagcugcagaaggccgugagcgaggcggagcggaaggcccacgacaugaucaccaccgagcgcgccaagauggagcggacgguggccgaggccaagcgccaggcggccgaggacgcccuggccgucaucaaccagcaggaggacuccagcgaguccugcuggaacugcgggcgcaaggcgagcgagaccugcuccggcugcaacaccgcccgguacugcgggagcuucugccagcacaaggacugggagaagcaccaccacaucugcggccagacccuccaggcccagcagcagggcgacacgccggccguguccagcuccgugacccccaacagcggggccggcucccccauggacacgcccccggcggccacgccccgcagcaccacccccgggacccccuccaccaucgagaccaccccgcgguga

SEQ ID NO: 35980 - RNA, 1500 nt, Artificial Sequence
  derived and/or modified sequence opt1 from RUNX2__Homo_sapiens__NP_001015051
auggccagcaacucccuguucagcaccgugacccccugccagcagaacuucuucugggacccguccacgagccgccgguucuccccgcccagcuccagccuccagcccggcaagauguccgacgucagccccgugguggccgcgcagcagcagcagcagcagcagcagcagcagcagcagcagcagcagcagcagcagcagcagcagcagcaggaggccgccgccgccgcggccgccgccgcggccgccgccgccgcggccgccgccgucccccgccugcggccgccccacgacaaccgcaccaugguggagaucaucgccgaccaccccgcggagcuggugcggaccgacucccccaacuuccucugcagcguccugcccucccacuggcgcugcaacaagacccugcccguggccuucaagguggucgcccucggggaggugccggacggcacgguggucaccgugauggccgggaacgacgagaacuacagcgccgagcugcggaacgcguccgccgugaugaagaaccaggucgcccgcuucaacgaccugcgguucgugggccgcagcgggcggggcaaguccuucacccucaccaucacgguguucaccaacccgccccaggucgccaccuaccaccgcgccaucaaggugaccguggacggcccccgggagccccgccggcaccgccagaagcuggacgacagcaagcccucccuguucagcgaccggcucagcgaccuggggcgcaucccccaccccuccaugcgggucggcgugccgccccagaacccccgccccagccugaacuccgcgccgagccccuucaacccccaggggcagucccagaucacggacccccggcaggcccagagcuccccgcccuggagcuacgaccaguccuaccccagcuaccucucccagaugaccagcccguccauccacagcaccacgccccuguccagcacccgcggcaccgggcugcccgccaucaccgacgugccccgccggaucuccggcgccagcgagcucggcccguucuccgacccccgccaguuccccagcaucagcucccugaccgagagccgguucuccaacccccgcaugcacuacccggcgacguucaccuacaccccgcccgucaccagcgggaugucccugggcaugagcgccacgacccacuaccacaccuaccucccgccgcccuaccccggguccagccagucccagagcggccccuuccagaccuccagcacgcccuaccuguacuacggcaccuccagcggguccuaccaguuccccauggugcccggcggggaccggagccccucccgcaugcugccgcccugcaccaccacgagcaacggcagcacccuccugaaccccaaccugcccaaccagaacgacggggucgacgccgacggcucccacagcuccagccccaccgugcucaacuccagcggccggauggacgaguccguguggcgccccuacuga

SEQ ID NO: 35981 - RNA, 1131 nt, Artificial Sequence
  derived and/or modified sequence opt1 from RUNX3__Homo_sapiens__XP_011540653
auggccagcaacuccaucuucgacagcuuccccaccuacuccccgaccuucauccgcgaccccagcacgucccggcgcuucaccccgcccagccccgccuuccccugcggcgggggcgggggcaagaugggggagaacuccggcgcgcugagcgcccaggccgccgugggccccgggggccgggcccgccccgagguccgguccaugguggacgugcucgcggaccacgccggggagcugguccgcaccgacagcccgaacuuccugugcuccgugcuccccagccacuggcggugcaacaagacccugcccguggccuucaaggucguggcccugggcgacgugcccgacgggacggucgugaccgugauggcgggcaacgacgagaacuacuccgccgagcuccgcaacgccagcgccgucaugaagaaccagguggcccgguucaacgaccugcgcuucgugggccgguccgggcgcggcaagagcuucacccugaccaucacggucuucaccaacccgacccagguggcgaccuaccaccgggccaucaaggugacggucgacgggccccgcgagccccggcgcaccuccgagcucaaccccuucagcgacccgcggcaguucgaccgcuccuuccccacccugcccacccugacggagagccgguuccccgacccgcgcaugcacuaccccggcgccaugagcgccgccuuccccuacuccgcgacccccagcggcaccuccaucagcucccucagcguggccgggaugccggccaccucccgguuccaccacacguaccugcccccgcccuaccccggcgcgccccagaaccagagcgggcccuuccaggccaacccgucccccuaccaccuguacuacggcaccagcuccgggagcuaccaguucuccaugguggccggcagcuccagcggcggggaccgcucccccacccgcaugcucgccagcugcaccuccagcgccgccagcgucgccgcgggcaaccugaugaaccccucccucgggggccagagcgacgggguggaggccgacggcucccacagcaacuccccgacggcccugagcacccccggccggauggacgaggccguguggcgccccuacuga

SEQ ID NO: 35982 - RNA, 1371 nt, Artificial Sequence
  derived and/or modified sequence opt1 from RUVBL1__Homo_sapiens__NP_003698
augaagaucgaggaggucaagagcaccaccaagacgcagcgcaucgccucccacagccacgugaagggccuggggcucgacgaguccggccuggccaagcaggcggccagcgggcuggugggccaggagaacgcccgggaggccugcggggugaucgucgagcucaucaaguccaagaagauggccggccgcgcggugcugcuggccgggcccccgggcaccggcaagaccgcccucgcccuggcgaucgcccaggagcuggggagcaaggugcccuucugccccauggucggcuccgagguguacagcaccgagaucaagaagacggaggugcucauggagaacuuccggcgcgccaucgggcugcggaucaaggagaccaaggaggucuacgagggcgaggugaccgagcugacccccugcgagacggagaacccgaugggcggguacggcaagaccaucucccacgugaucaucgggcucaagaccgccaagggcaccaagcagcugaagcuggaccccagcaucuucgagucccuccagaaggagcgcgucgaggccggcgacgugaucuacaucgaggcgaacagcggggccgugaagcggcagggccgcugcgacacguacgccaccgaguucgaccuggaggccgaggaguacgucccccugcccaagggggacgugcacaagaagaaggagaucauccaggacgugacccuccacgaccuggacgucgccaacgcgcggccgcagggcgggcaggacauccuguccaugaugggccagcucaugaagcccaagaagaccgagaucacggacaagcugcgcggcgagaucaacaagguggugaacaaguacaucgaccaggggaucgccgagcugguccccggcguccucuucguggacgaggugcacaugcuggacaucgagugcuucaccuaccugcaccgggcccucgagagcuccaucgcccccaucgugaucuucgccagcaaccgcgggaacugcgucauccggggcaccgaggacaucaccuccccgcacgggaucccccuggaccugcucgaccgcgugaugaucauccggacgaugcuguacacgccccaggagaugaagcagaucaucaagauccgcgcgcagaccgagggcaucaacaucagcgaggaggcccugaaccaccucggcgagaucgggaccaagaccacccugcgguacuccgugcagcugcucacccccgccaaccugcuggccaagaucaacggcaaggacagcaucgagaaggagcacgucgaggagaucagcgagcuguucuacgacgccaaguccagcgcgaagauccucgccgaccagcaggacaaguacaugaaguga

SEQ ID NO: 35983 - RNA, 1392 nt, Artificial Sequence
  derived and/or modified sequence opt1 from RUVBL2__Homo_sapiens__NP_006657
auggccaccgugaccgccacgaccaagguccccgagauccgcgacgugacccggaucgagcgcaucggcgcgcacagccacauccgggggcugggccucgacgacgcccuggagccgcgccaggccucccaggggauggugggccagcuggccgcccggcgcgcggccggggucgugcucgagaugauccgggagggcaagaucgccggccgcgccgugcugaucgcggggcagcccggcaccgggaagacggccaucgccaugggcauggcccaggcccuggggcccgacacccccuucaccgcgaucgccggcagcgagaucuucucccucgagaugagcaagaccgaggcccugacgcaggccuuccggcgcuccaucggcguccggaucaaggaggagaccgagaucaucgagggggaggugguggagauccagaucgaccgcccggccaccggcaccgggagcaaggucggcaagcugacgcucaagaccaccgagauggagaccaucuacgaccugggcacgaagaugaucgagucccugaccaaggacaaggugcaggcgggggacgugaucaccaucgacaaggccaccggcaagaucagcaagcucgggcgguccuucacgcgcgcccgggacuacgacgccaugggcagccagaccaaguucguccagugccccgacggggagcugcagaagcgcaaggagguggugcacaccgucucccugcacgagaucgacgugaucaacagccggacccagggcuuccucgcccuguucuccggcgacacgggggagaucaagagcgaggugcgcgagcagaucaacgcgaaggucgccgaguggcgggaggagggcaaggccgagaucauccccggggugcuguucaucgacgaggugcacaugcucgacaucgaguccuucagcuuccugaaccgcgcccuggaguccgacauggcccccguccucaucauggcgaccaaccggggcaucacccgcauccgcgggaccagcuaccaguccccgcacggcauccccaucgaccugcuggaccggcuccugaucgugagcacgacccccuacagcgagaaggacaccaagcagauccugcgcauccggugcgaggaggaggacguggagauguccgaggacgccuacaccguccucacgcgcaucggccuggagaccagccugcgguacgccauccagcucaucaccgccgcgucccuggugugccgcaagcggaaggggaccgagguccagguggacgacaucaagcgcguguacagccuguuccucgacgagucccggagcacgcaguacaugaaggaguaccaggacgccuuccuguucaacgagcugaagggcgagaccauggacaccuccuga

SEQ ID NO: 35984 - RNA, 2130 nt, Artificial Sequence
  derived and/or modified sequence opt1 from RXFP1__Homo_sapiens__NP_001240658
augaccagcggcuccguguucuucuacauccugaucuucgggaaguacuucagccacggcgggggccaggacgucaagugcucccucggguacuuccccugcggcaacaucaccaagugccugccgcagcugcuccacugcaacggcguggacgacugcgggaaccaggccgacgaggacaacugcggcgacaacaacggguggagccugcaguucgacaaguacuucgccuccuacuacaagaugacgagccaguaccccuucgaggcggagacccccgagugccuggugggcuccguccccgugcagugccucugccaggggcuggagcuggacugcgacgagaccaaccuccgcgccgugccgagcgucuccagcaacgugaccgccaugucccugcaguggaaccugauccggaagcucccgcccgacugcuucaagaacuaccacgaccugcagaagcuguaccuccagaacaacaagaucacgagcaucuccaucuacgccuuccgcggccugaacagccugaccaagcucuaccugucccacaaccggaucaccuuccugaagcccggcguguucgaggaccuccaccgccuggaguggcugaucaucgaggacaaccaccucagccggaucuccccgcccaccuucuacgggcugaacagccugauccuccugguccugaugaacaacgugcucacgcgccugcccgacaagccccugugccagcacaugccccggcuccacuggcuggaccuggagggcaaccacauccacaaccuccgcaaccugaccuucaucuccugcagcaaccugaccgugcucgucaugcggaagaacaagaucaaccaccugaacgagaacaccuucgccccgcugcagaagcucgacgaguucagccuggaggggaucgagaucuccaacauccagcagcgcauguuccggccccugaugaaccucagccacaucuacuucaagaaguuccaguacugcggcuacgcgccccacgugcgcuccugcaagcccaacacggacggcaucagcucccuggagaaccugcucgccagcaucauccagcggguguucgucugggugguguccgccgugaccugcuucgggaacaucuucgucaucugcaugcgccccuacauccggagcgagaacaagcuguacgccauguccaucaucagccugugcugcgcggacugccugaugggcaucuaccucuucgugaucgggggcuucgaccugaaguuccgcggggaguacaacaagcacgcccagcuguggauggaguccacccacugccagcucgucggcagccuggccauccuguccaccgaggugagcgugcuccugcugacguuccucacccuggagaaguacaucugcaucgucuaccccuuccggugcgugcgccccggcaagugccggaccaucaccguccugauccucaucuggaucacgggguucaucguggccuucaucccgcuguccaacaaggaguucuucaagaacuacuacggcaccaacggggugugcuucccccugcacagcgaggacaccgaguccaucggcgcccagaucuacagcgucgcgaucuuccucgggaucaaccuggccgccuucaucaucaucguguucuccuacggcagcauguucuacagcgugcaccaguccgccaucaccgccacggagauccgcaaccaggucaagaaggagaugauccuggcgaagcgguucuucuucaucguguucaccgacgcccucugcuggauccccaucuucguggucaaguuccugagccugcuccagguggagauccccggcaccaucaccuccuggguggucaucuucauccugccgaucaacagcgcccugaaccccauccucuacacgcugaccacccgccccuucaaggagaugauccaccgcuucugguacaacuaccggcagcgcaaguccauggacagcaaggggcagaagaccuacgcccccuccuucaucuggguggagauguggccgcugcaggagaugccgcccgagcucaugaagcccgaccuguucacguaccccugcgagaugagccugaucucccagagcacccggcucaacuccuacagcuga

SEQ ID NO: 35985 - RNA, 2193 nt, Artificial Sequence
  derived and/or modified sequence opt1 from RXFP2__Homo_sapiens__NP_001159530
augaucguguuccuggucuucaagcaccucuucagccugcgccugaucaccauguucuuccuccugcacuucaucgugcugaucaacgugaaggacuucgcccucacccagggcuccaugaucacgcccagcugccagaagggguacuucccgugcggcaaccugaccaagugccugccccgggccuuccacugcgacgggaaggacgacugcggcaacggggcggacgaggagaacugcggcgacaccuccggcugggccaccaucuucgggacgguccacggcaacgccaacagcguggcccucacccaggagugcuuccugaagcaguacccccagugcugcgacugcaaggagaccgagcuggagugcgugaacggggaccucaaguccguccccaugaucagcaacaacgugacccugcugucccucaagaagaacaagauccacagccugccggacaagguguucaucaaguacacgaagcugaagaagaucuuccuccagcacaacugcauccgccacaucucccggaaggccuucuucggccugugcaaccugcagauccucuaccugaaccacaacugcaucaccacccugcgccccgggaucuucaaggaccuccaccagcugaccuggcugauccucgacgacaaccccaucacgcggaucagccagcgccuguucaccggccugaacucccucuucuuccugagcauggucaacaacuaccuggaggcgcuccccaagcagaugugcgcccagaugccgcagcugaacuggguggaccuggagggcaaccggaucaaguaccucaccaacuccaccuuccugagcugcgacucccugacggugcucgaccugagcuccaacaccaucaccgagcugagcccccaccucuucaaggaccugaagcugcuccagaagcugaaccuguccagcaacccccucauguaccugcacaagaaccaguucgagagccugaagcagcugcagucccucgaccuggagcgcaucgagauccccaacaucaacacccggauguuccagccgaugaagaaccugagccacaucuacuucaagaacuuccgcuacugcuccuacgcgccccacguccggaucugcaugccccucacggacgggaucagcuccuucgaggaccugcuggccaacaacauccuccgcaucuucgugugggugaucgccuucaucacgugcuucggcaaccuguucgucaucgggaugcggagcuucaucaaggccgagaacaccacccacgccauguccaucaagauccugugcugcgccgacugccucaugggcguguaccuguucuucgugggcaucuucgacaucaaguaccgcgggcaguaccagaaguacgcccugcucuggauggagagcguccagugccggcugaugggcuuccuggcgaugcucuccaccgaggugagcgugcugcugcucaccuaccugacccuggagaaguuccucgucaucguguuccccuucuccaacauccgcccggggaagcggcagaccagcgugauccugaucugcaucuggauggccggcuuccugaucgccgucauccccuucuggaacaaggacuacuucgggaacuucuacggcaagaacggcgugugcuucccccucuacuacgaccagacggaggacaucggguccaagggcuacagccuggggaucuuccugggcgucaaccuccuggccuuccugaucaucguguucuccuacaucaccauguucugcagcauccagaagaccgcccuccagaccacggaggugcgcaacugcuucgggcgggaggucgcgguggccaaccgcuucuucuucaucguguucuccgacgccaucugcuggauccccgucuucguggugaagauccugagccuguuccgggucgagaucccggacaccaugaccuccuggaucgugaucuucuuccuccccgugaacagcgcccugaaccccauccuguacacccucacgaccaacuucuucaaggacaagcugaagcagcugcuccacaagcaccagcgcaagagcaucuucaagaucaagaagaagucccugagcaccuccaucgucuggaucgaggacagcuccagccugaagcucggcgugcugaacaagaucacccugggcgacuccaucaugaagcccgugagcuga

SEQ ID NO: 35986 - RNA, 1410 nt, Artificial Sequence
  derived and/or modified sequence opt1 from RXFP3__Homo_sapiens__NP_057652
augcagauggccgacgccgcgaccaucgccaccaugaacaaggccgccggcggggacaagcuggccgagcuguucagccucgugcccgaccugcucgaggcggccaacacguccggcaacgccagccugcagcugccggaccucuggugggagcuggggcuggagcuccccgacggcgccccgcccgggcacccgcccggcuccggcggggcggagagcgccgacaccgaggcccgcguccggauccugaucuccgugguguacugggucgugugcgcccugggccucgccgggaaccugcuggugcucuaccugaugaaguccaugcagggcuggcgcaagagcagcaucaaccuguucgucaccaaccucgcgcugaccgacuuccaguucgugcugacgcuccccuucugggccguggagaacgcccuggacuucaaguggcccuucgggaaggccaugugcaagaucgucuccauggugaccagcaugaacauguacgccuccguguucuuccugaccgcgaugagcgucacccgguaccacuccguggccagcgcccucaagucccaccgcacgcggggccacggccgcggggacugcugcggccggagccugggggacuccugcugcuucagcgccaaggcccugugcguguggaucugggcgcucgccgcccuggccucccugcccagcgccaucuucagcaccaccgucaaggugaugggcgaggagcucugccuggugcgcuuccccgacaagcugcucggccgggaccgccaguucuggcuggggcuguaccacucccagaagguccuccugggcuucgugcugccccucgggaucaucauccugugcuaccugcuccuggugcgguucaucgcggaccgccgggccgccggcaccaagggcggggccgcggucgccggcgggcgccccacgggcgccagcgcccggcgccuguccaaggugaccaagagcgugaccaucgucgugcucuccuucuuccugugcuggcugccgaaccaggcccucaccacguggagcauccugaucaaguucaacgcgguccccuucucccaggaguacuuccugugccagguguacgccuuccccgugagcgucugccuggcccacuccaacagcugccucaaccccgugcuguacugccuggugcggcgcgaguuccggaaggcccucaagucccugcuguggcgcaucgccagcccguccaucaccagcaugcggcccuucaccgcgaccacgaagcccgagcacgaggaccaggggcuccaggcccccgccccgccccacgccgccgcggagcccgaccugcuguacuacccgcccggcgucgugguguacuccgggggccgcuacgaccuccugcccagcuccagcgccuacuga

SEQ ID NO: 35987 - RNA, 1308 nt, Artificial Sequence
  derived and/or modified sequence opt1 from RXRA__Homo_sapiens__NP_001278849
auggccgcccccagccugcacccgucccucggccccgggaucggcagccccgggcagcugcacucccccaucagcacccuguccagcccgaucaacggcauggggccgcccuucuccgugaucagcucccccaugggcccccacagcauguccguccccaccacgcccacccucggcuucagcaccgggagcccccagcuguccuccccgaugaaccccgugagcuccagcgaggacaucaagccgccccugggccucaacggggugcugaagguccccgcgcaccccuccggcaacauggccagcuucaccaagcacaucugcgccaucugcggggaccgcagcuccggcaagcacuacggcguguacagcugcgaggggugcaagggcuucuucaagcggacggugcgcaaggaccugaccuacacgugccgggacaacaaggacugccucaucgacaagcgccagcggaaccgcugccaguacugccgguaccagaagugccuggccauggggaugaagcgcgaggccguccaggaggagcggcagcgcggcaaggaccggaacgagaacgagguggaguccaccagcuccgcgaacgaggacaugcccguggagcgcauccuggaggccgagcucgccgucgagcccaagaccgagaccuacguggaggccaacaugggccugaacccgagcucccccaacgaccccgugaccaacaucugccaggcggccgacaagcagcuguucacccucgucgagugggccaagcggaucccccacuucagcgagcugccgcuggacgaccaggugauccuccugcgcgccggguggaacgagcugcucaucgccuccuucagccaccgguccaucgcggugaaggacggcauccugcuggccacggggcuccacguccaccgcaacagcgcccacuccgccggcgugggggccaucuucgaccgggugcugaccgagcuggucagcaagaugcgcgacaugcagauggacaagaccgagcucggcugccugcgggcgaucgugcuguucaaccccgacuccaagggccucagcaaccccgccgagguggaggcccugcgcgagaaggucuacgccucccuggaggccuacugcaagcacaaguaccccgagcagccggggcgguucgcgaagcuccugcugcgccuccccgcccugcgcagcaucggccugaagugccucgagcaccuguucuucuucaagcugaucggggacacccccaucgacacguuccucauggagaugcuggaggccccgcaccagaugaccuga

SEQ ID NO: 35988 - RNA, 1614 nt, Artificial Sequence
  derived and/or modified sequence opt1 from RXRB__Homo_sapiens__NP_001257330
augagcugggccgcccgccccccguuccugccccagcggcacgcggccggccagugcgggcccgugggcguccgcaaggagaugcacugcgggguggccucccgguggcgccggcgccggcccuggcucgacccggccgccgcggccgccgccgcgguggccggcggggagcagcagacccccgagcccgagcccggcgaggccggccgcgacgggaugggcgacagcgggcgggacucccgcagcccggacuccagcucccccaacccccugccccagggcgucccgccccccagccccccggggcccccccugcccccguccaccgcccccagccucggcggcuccggggccccccccccgccccccaugcccccgcccccccugggcagcccguuccccgugaucuccagcuccauggggagccccggccugcccccgcccgcgccccccggcuucuccgggccggugagcuccccccagaucaacagcacggucagccuccccggcgggggcuccgggcccccggaggacgugaagccccccgugcugggcguccggggccugcacugccccccgccccccgggggccccggggccggcaagcgccucugcgccaucugcggggaccggagcuccggcaagcacuacggcguguacagcugcgaggggugcaagggcuucuucaagcgcaccauccggaaggaccugaccuacuccugccgcgacaacaaggacugcaccguggacaagcggcagcgcaaccggugccaguacugccgcuaccagaagugccuggccacggggaugaagcgggaggccguccaggaggagcgccagcgcggcaaggacaaggacggggacggcgagggcgcggggggcgccccggaggagaugcccguggaccggauccucgaggccgagcuggccguggagcagaagagcgaccagggggucgagggccccggcgggaccggcggguccggcagcucccccaacgacccggugaccaacaucugccaggccgcggacaagcagcuguucacccucguggagugggccaagcgcaucccccacuucagcucccugccccuggacgaccaggucauccuccugcgggccggguggaacgagcugcucaucgccagcuucucccaccgcagcaucgacgugcgggacggcauccugcuggccacgggccuccacgugcaccgcaacuccgcgcacagcgccggggucggcgccaucuucgaccggucccugagccgcgugcugaccgagcucguguccaagaugcgggacaugcgcauggacaagaccgagcuggggugccugcgggccaucauccucuucaacccggacgcgaagggccugagcaaccccagcgaggucgaggugcugcgcgagaaggucuacgccucccucgagaccuacugcaagcagaaguaccccgagcagcaggggcgguucgccaagcugcugcuccgccugcccgcccugcggagcaucggccucaagugccuggagcaccuguucuucuucaagcucaucggcgacacgccgaucgacaccuuccugauggagaugcuggaggccccccaccagcucgcguga

SEQ ID NO: 35989 - RNA, 1392 nt, Artificial Sequence
  derived and/or modified sequence opt1 from RXRG__Homo_sapiens__NP_008848
auguacggcaacuacagccacuucaugaaguuccccgccggguacggcggguccccgggccacaccgggagcaccuccaugagccccuccgccgcgcugagcaccggcaagcccauggacucccaccccagcuacaccgacaccccgguguccgcgccccgcacccucagcgccgucggcacgccccugaacgcccuggggucccccuaccgggugaucaccagcgccaugggcccgcccuccggggcccucgccgccccgcccggcaucaaccugguggccccgcccagcucccagcugaacgucgugaacagcguguccagcuccgaggacaucaagccccuccccgggcugcccggcaucggcaacaugaacuaccccagcaccagccccgggucccuggucaagcacaucugcgcgaucugcggcgaccgcagcuccgggaagcacuacggcguguacagcugcgagggcugcaagggguucuucaagcggaccauccgcaaggaccucaucuacacgugccgggacaacaaggacugccugaucgacaagcgccagcggaaccgcugccaguacugccgguaccagaagugccuggugaugggcaugaagcgcgaggccguccaggaggagcggcagcgcucccgggagcgcgccgagagcgaggccgagugcgccaccuccgggcacgaggacaugcccguggagcggauccucgaggcggagcuggccguggagccgaagaccgagagcuacggcgacaugaacauggagaacuccaccaacgaccccgucacgaacaucugccacgccgccgacaagcagcuguucacccucguggagugggccaagcgcaucccccacuucagcgaccugacccuggaggaccaggugauccuccugcgggcgggguggaacgagcugcucaucgccuccuucagccaccgcuccgucagcgugcaggacggcauccugcuggccaccggccuccacgugcaccgguccagcgcccacuccgccggggucggcagcaucuucgaccgcgugcugacggagcugguguccaagaugaaggacaugcagauggacaagagcgagcucgggugccugcgggcgaucguccuguucaaccccgacgccaagggccucagcaacccguccgagguggagacccugcgcgagaagguguacgccacccuggaggccuacaccaagcagaaguaccccgagcagcccgggcgcuucgccaagcuccugcugcggcuccccgcgcugcgcagcaucggccugaagugccucgagcaccuguucuucuucaagcugaucggcgacacgccgaucgacaccuuccucauggagaugcuggagacgccccugcagaucaccuga

SEQ ID NO: 35990 - RNA, 687 nt, Artificial Sequence
  derived and/or modified sequence opt1 from RYBP__Homo_sapiens__NP_036366
augaccaugggcgacaagaagucccccacccgcccgaagcggcaggccaagcccgccgcggacgagggguucugggacugcagcgugugcacguuccgcaacagcgccgaggccuucaagugcuccaucugcgacguccggaagggcaccagcacccgcaagccccggaucaacucccagcugguggcccagcaggucgcccagcaguacgcgacgcccccgccgcccaagaaggagaagaaggagaagguggagaagcaggacaaggagaagcccgagaaggacaaggagaucagccccuccgugaccaagaagaacaccaacaagaagaccaagcccaagagcgacauccucaaggacccgcccuccgaggccaacagcauccaguccgccaacgccaccacgaagaccagcgagaccaaccacaccucccgcccccggcugaagaacguggaccgcagcacggcgcagcagcuggccgucaccguggggaacgugaccgucaucaucaccgacuucaaggagaagacgcgguccagcuccaccagcuccagcaccgugaccagcuccgccggcagcgagcagcagaaccaguccagcuccgggagcgaguccacggacaagggcagcucccgcagcuccacccccaagggcgacaugagcgccgugaacgacgaguccuucuga

SEQ ID NO: 35991 - RNA, 1833 nt, Artificial Sequence
  derived and/or modified sequence opt1 from RYK__Homo_sapiens__NP_001005861
augcgcggcgccgcccggcuggggcgccccggccggagcugccucccgggggcgcgcggccugcgggcgcccccgccgccgccccugcuccugcugcucgcccugcugccccuccugcccgcccccggggccgccgccgcccccgcgccccggcccccggagcugcaguccgccagcgccggccccuccgugagccucuaccuguccgaggacgagguccgccgccugaucggccucgacgccgagcuguacuacgugcggaacgaccugaucagccacuacgcccucuccuucagccugcuggugcccuccgagaccaacuuccuccacuucaccuggcacgccaagagcaaggucgaguacaagcugggguuccagguggacaacgugcuggcgauggacaugccccaggucaacaucuccgugcagggcgaggugccgcgcacgcucagcgucuuccggguggagcuguccugcaccgggaagguggacagcgaggucaugauccugaugcagcucaaccugaccgugaacuccagcaagaacuucaccgugcugaacuucaagcgccggaagaugugcuacaagaagcucgaggaggucaagacguccgcccuggacaagaacaccagccgcaccaucuacgaccccgugcacgccgcccccaccacguccacccggguguucuacaucagcgucggcgugugcugcgccgugaucuuccuggucgcgaucauccucgccgugcugcaccuccacagcaugaagcgcaucgagcucgacgacuccaucagcgccuccagcuccagccaggggcugucccagcccagcacccagaccacgcaguaccugcgggccgacacccccaacaacgccacccccaucaccuccagccucggcuaccccacgcugcgcaucgagaagaacgaccugcgguccgugacccuccuggaggcgaagggcaaggucaaggacaucgccaucagccgcgagcggaucacccugaaggacgugcuccaggaggggaccuucggccgcaucuuccacgggauccugaucgacgagaaggaccccaacaaggagaagcaggccuucgucaagacggugaaggaccaggccuccgagauccaggugaccaugaugcugaccgagagcugcaagcuccgcggccugcaccaccggaaccugcugccgaucacccacgucugcaucgaggagggcgagaagcccauggugauccuccccuacaugaacugggggaaccugaagcuguuccuccgccagugcaagcugguggaggccaacaacccccaggcgaucucccagcaggaccugguccacauggccauccagaucgccugcggcaugagcuaccucgcccggcgcgaggugauccacaaggaccuggcggcccggaacugcgugaucgacgacacgcugcaggucaagaucaccgacaacgcccucucccgcgaccuguucccgauggacuaccacugccugggggacaacgagaaccggcccgugcgcuggauggcccucgagagccuggugaacaacgaguucuccagcgccagcgacgucugggcguucggcgugacccugugggagcucaugacccuggggcagacgcccuacguggacaucgacccguucgagauggccgccuaccugaaggacggcuaccggaucgcccagcccaucaacugccccgacgagcuguucgccgucauggcgugcugcugggcccuggaccccgaggagcgcccgaaguuccagcagcuggugcagugccucaccgaguuccacgccgcccugggcgccuacguguga

SEQ ID NO: 35992 - RNA, 15117 nt, Artificial Sequence
  derived and/or modified sequence opt1 from RYR1__Homo_sapiens__NP_000531
augggcgacgccgagggggaggacgaggugcaguuccugcgcaccgacgacgagguggugcuccagugcagcgccaccgugcugaaggagcagcugaagcucugccuggccgccgagggcuucgggaaccggcugugcuuccucgagcccaccuccaacgcccagaacgugccgcccgaccuggccaucugcugcuucgugcuggagcagagccucuccgugcgcgcccugcaggagaugcuggccaacaccgucgaggccggcguggagagcucccagggcgggggccaccggacccuccuguacgggcacgccauccugcuccgccacgcccacagccggauguaccuguccugccugaccaccagccgcuccaugaccgacaagcucgcguucgacgugggccugcaggaggacgccaccggggaggccugcugguggaccaugcaccccgccagcaagcagcgguccgagggcgagaagguccgcgugggggacgacaucauccuggugagcgucuccagcgagcgguaccuccaccuguccaccgccagcggcgagcuccagguggacgccuccuucaugcagacccucuggaacaugaaccccaucugcagccgcugcgaggagggcuucgugaccgggggccacguccugcggcuguuccacgggcacauggacgagugccucaccaucucccccgccgacagcgacgaccagcgccggcugguguacuacgagggcggcgccgugugcacccacgcccgcagccuguggcggcucgagccccugcgcaucuccuggagcgggucccaccuccgguggggccagccccuccgcguccggcacgugaccaccgggcaguaccuggcccugaccgaggaccagggccucguggucguggacgcgagcaaggcccacacgaaggccaccuccuucugcuuccgcaucagcaaggagaagcuggacguggcccccaagcgggacgucgaggggaugggcccgcccgagaucaaguacggcgagucccugugcuucgugcagcacgucgccagcgggcucuggcugaccuacgcggcccccgaccccaaggcccugcgccucggcgugcugaagaagaaggccaugcugcaccaggaggggcacauggacgacgcccucucccugacccgcugccagcaggaggagagccaggcggcccggaugauccacuccacgaacggccuguacaaccaguucaucaagagccucgacuccuucagcgggaagccccgcggcuccgggccgcccgccgggaccgcccugcccaucgagggcgugauccugagccugcaggaccucaucaucuacuucgagccgcccuccgaggaccugcagcacgaggagaagcagagcaagcugcggucccuccgcaaccggcagagccuguuccaggaggaggggaugcugagcaugguccucaacugcaucgaccgccugaacguguacaccaccgcggcccacuucgccgaguucgccggcgaggaggccgcggaguccuggaaggagaucgugaaccugcucuacgagcugcuggccagccucauccgggggaaccgcuccaacugcgcccuguucagcacgaaccuggacuggcucgucuccaagcuggaccggcuggaggccagcuccggcauccucgaggugcuguacugcgugcugaucgagagccccgagguccucaacaucauccaggagaaccacaucaaguccaucaucagccugcuggacaagcacggccgcaaccacaaggugcucgacgugcugugcucccugugcgucugcaacgggguggccgugcggagcaaccaggaccucaucaccgagaaccugcugcccggccgcgagcuccugcugcagaccaaccucaucaacuacgucaccuccauccggcccaacaucuucguggggcgcgcggagggcacgacccaguacagcaagugguacuucgaggugauggucgacgaggugacccccuuccugaccgcccaggccacgcaccuccgggugggcugggcccucaccgagggguacacccccuaccccggcgccggggagggcuggggcgggaacggcgucggggacgaccuguacuccuacggcuucgacgggcugcaccucuggaccggccacguggcgcgccccgugacgagccccgggcagcaccuccuggcccccgaggacgucaucuccugcugccucgaccugagcgugcccagcaucuccuuccggaucaacggcugccccgugcagggcgucuucgagagcuucaaccuggacgggcuguucuuccccgugguguccuucagcgccggcgucaaggugcgcuuccugcucggcgggcggcacggggaguucaaguuccugcccccgcccggguacgcccccugccacgaggcggugcugccccgcgagcgccugcaccucgagcccaucaaggaguaccggcgcgagggcccccgggggccccaccuggucggccccucccgcugccugagccacaccgacuucgugcccugccccguggacaccguccagaucgugcugccgccccaccuggagcggauccgcgagaagcuggccgagaacauccacgagcucugggcccugacccggaucgagcagggguggaccuacggccccgugcgcgacgacaacaagcggcugcaccccugccucgucgacuuccacucccugcccgagcccgagcgcaacuacaaccugcagaugagcggggagacgcucaagacccugcuggcccucggcugccacgugggcauggccgacgagaaggcggaggacaaccugaagaagaccaagcugccgaagaccuacaugauguccaacggguacaagcccgcgccccuggaccugagccacgugcggcugacgcccgcccagaccacccucgucgaccgccuggccgagaacggccacaacgugugggcccgggaccgcguggggcagggcugguccuacagcgcgguccaggacaucccggcccggcgcaacccccggcuggugcccuaccgccuccuggacgaggccaccaagcgguccaaccgcgacagccugugccaggccgugcggacgcuccugggcuacggguacaacaucgagcccccggaccaggagcccucccaggucgagaaccagagccgcugcgaccgcgugcggaucuuccgcgccgagaaguccuacaccgugcagagcggccggugguacuucgaguucgaggcggucaccaccggggagaugcgcgugggcugggcccggcccgagcugcgcccggacgucgagcucggggccgacgagcuggccuacguguucaacggccaccggggccagcgcuggcaccugggguccgagcccuucggccggcccuggcagcccggggacguggucggcugcaugaucgaccucacggagaacaccaucaucuucacccugaacggggaggugcugaugagcgacagcggcuccgagaccgcguuccgcgagaucgagaucggcgacggguuccucccggugugcagccugggccccgggcaggucggccaccugaaccucgggcaggacguguccagccugcgguucuucgccaucugcggccugcaggagggcuucgagcccuucgccaucaacaugcagcgccccgugacgaccugguucuccaaggggcucccgcaguucgagcccgucccccuggagcacccccacuacgaggugagccggguggacggcaccgucgacaccccgcccugccugcgccugacgcaccggaccugggggucccagaacagccucguggagaugcuguuccugcgccucucccugcccgugcaguuccaccagcacuuccggugcaccgccggcgccacgccccuggcgccgcccggccuccagccgcccgccgaggacgaggcccgcgccgccgagccggaccccgacuacgagaaccugcggcgcagcgccgggggcugguccgaggccgagaacgggaaggagggcacggccaaggagggggcccccggcggcacgccccaggccgggggcgaggcgcagccggcccgcgccgagaacgagaaggacgccaccaccgagaagaacaagaagcggggguuccuguucaaggccaagaaggucgcgaugaugacgcagccgcccgccacccccacccucccgcgccugccccacgacguggugcccgccgacaaccgggacgacccggagaucauccugaacaccacgaccuacuacuacagcguccgcguguucgccggccaggagcccuccugcgugugggcggggugggucacccccgacuaccaccagcacgacaugagcuucgaccucuccaaggugcggguggucaccgugacgaugggcgacgagcagggcaacgugcacagcucccugaagugcagcaacugcuacauggucuggggcggcgacuucgugucccccgggcagcagggccgcaucagccacaccgaccuggugaucgggugccucgucgaccuggccaccggccugaugaccuucaccgccaacggcaaggagagcaacacguucuuccagguggagccgaacaccaagcuguuccccgccguguucguccugcccacccaccagaacgugauccaguucgagcuggggaagcagaagaacaucaugccccucuccgccgcgauguuccagagcgagcggaagaacccggcgccccagugcccgccccggcuggagaugcagaugcugaugccgguguccuggagccggaugcccaaccacuuccuccaggucgagacccgccgggccggcgagcgccuggggugggccgugcagugccaggagccccugacgaugauggcccuccacauccccgaggagaaccggugcauggacauccuggagcuguccgagcgccucgaccugcagcgguuccacagccacacccugcgccucuaccgggcggugugcgcccugggcaacaaccgcgucgcccacgcccugugcucccacguggaccaggcccagcugcugcacgcgcuggaggacgcccaccuccccgggccccugcgggccggcuacuacgaccugcucaucagcauccaccuggaguccgccugccgcagccggcgcuccaugcugagcgaguacaucgugccccucacccccgagacccgcgcgaucacgcuguucccgcccggccgguccaccgagaacgggcacccccgccacggccugcccggggucggcgugaccaccagccuccggccgccccaccacuucagcccgcccugcuucguggccgcccugccggccgccggcgcggccgaggcccccgcccgccugagccccgccaucccgcucgaggcgcugcgggacaaggcccugcgcaugcucggggaggccguccgggacggcgggcagcacgcccgcgaccccgugggcggguccguggaguuccaguucguccccgugcugaagcuggugagcacgcuccuggucaugggcaucuucggcgacgaggacgugaagcagauccugaagaugaucgagcccgaggucuucaccgaggaggaggaggaggaggacgaggaggaggagggggaggaggaggacgaggaggagaaggaggaggacgaggaggagaccgcccaggagaaggaggacgaggagaaggaggaggaggaggcggccgagggcgagaaggaggaggggcucgaggagggccugcugcagaugaagcucccggaguccgugaagcugcagaugugccaccuccuggaguacuucugcgaccaggagcugcagcaccggguggagagccuggccgccuucgcggagcgcuacgucgacaagcuccaggccaaccagcggagccgcuacgggcugcugaucaaggccuucuccaugaccgccgccgagacggcgcggcgcacccgggaguuccgcuccccgccccaggagcagaucaacaugcuccugcaguucaaggacggcaccgacgaggaggacugcccccugccggaggagauccggcaggaccuccuggacuuccaccaggaccugcucgcccacugcggcauccagcuggacggggaggaggaggagcccgaggaggagaccacgcugggcucccgccucaugagccugcuggagaaggugcggcucgugaagaagaaggaggagaagcccgaggaggagcgcuccgccgaggagagcaagccccgcucccugcaggagcuggucagccacaugguggugcggugggcccaggaggacuucguccaguccccggagcucgugcgcgccauguucagccugcugcaccggcaguacgacgggcucggcgagcugcugcgcgcgcucccccgggccuacaccaucucccccagcuccguggaggacaccaugagccugcuggagugccucgggcagauccgcucccugcugaucguccagaugggcccccaggaggagaaccucaugauccagagcaucggcaacaucaugaacaacaagguguucuaccagcacccgaaccugaugcgggcccuggggaugcacgagaccgugauggaggucauggugaacgugcugggcgggggcgaguccaaggagauccgcuuccccaagauggucacgagcugcugccgguuccucugcuacuucugccgcaucucccggcagaaccagcgcagcauguucgaccaccugagcuaccugcucgagaacuccgggaucggccugggcaugcaggggagcacgccccuggacguggccgccgcguccgugaucgacaacaacgagcucgcccuggcccugcaggagcaggaccucgagaaggucgugagcuaccuggccggcugcgggcugcaguccugccccaugcucguggccaagggcuacccggacaucggcuggaaccccugcgggggcgagcgguaccuggacuuccugcgcuucgcggucuucgugaacggggagagcguggaggagaacgccaacgucguggugcggcuccugauccgcaagcccgagugcuucggccccgcccugcgcggggagggcggcuccgggcuccuggccgcgaucgaggaggccauccggaucagcgaggacccggcccgggacggccccgggauccgccgggaccgccgccgggagcacuucggcgaggagcccccggaggagaaccgcguccaccuggggcacgccaucauguccuucuacgccgcgcucaucgaccugcugggccggugcgcccccgagaugcaccucauccaggccggcaagggggaggcccugcgcauccgggccauccugcgcagccucgugccccuggaggaccuggugggcaucaucucccucccccugcagaucccgacccuggggaaggacggcgcgcucguccagcccaagaugagcgccuccuucgugcccgaccacaaggccagcauggugcuguuccuggaccgggucuacgggaucgagaaccaggacuuccuccugcacgugcuggacgugggcuuccuccccgacaugcgcgccgccgcgucccuggacaccgccacguucagcaccaccgagauggcccuggcccucaaccgguaccugugccuggcgguccucccgcugaucaccaagugcgcgccccuguucgccggcacggagcaccgcgccaucaugguggacuccaugcuccacaccguguaccggcugagccgcgggcggucccugaccaaggcccagcgcgacgucaucgaggacugccucaugagccugugccgguacauccgccccagcaugcugcagcaccuccugcggcgccugguguucgacgugcccauccucaacgaguucgcgaagaugccgcugaagcugcucaccaaccacuacgagcggugcuggaaguacuacugccugcccacgggcugggccaacuucggggucaccuccgaggaggagcugcaccucacccgcaagcuguucuggggcaucuucgacagccuggcccacaagaaguacgaccccgagcucuaccgcauggccaugcccugccugugcgccaucgcgggcgcccugccgcccgacuacguggacgccuccuacagcuccaaggccgagaagaaggccaccguggacgcggaggggaacuucgacccccggcccgucgagacccucaacgugaucaucccggagaagcuggacagcuucaucaacaaguucgccgaguacacgcacgagaagugggccuucgacaagauccagaacaacugguccuacggcgagaacaucgacgaggagcugaagacccaccccaugcuccgccccuacaagaccuucagcgagaaggacaaggagaucuaccgguggcccaucaaggagucccugaaggccaugaucgcgugggaguggaccaucgagaaggcccgcgagggggaggaggagaagacggagaagaagaagacccggaagaucagccaguccgcccagaccuacgacccgcgcgagggcuacaacccccagccgcccgaccugagcgccgugacccucucccgggagcugcaggccauggcggagcagcuggccgagaacuaccacaacacgugggggcgcaagaagaagcaggagcucgaggccaagggcggcgggacccacccgcugcugguccccuacgacacccucaccgccaaggagaaggcccgggaccgcgagaaggcgcaggagcugcugaaguuccuccagaugaacggcuacgccgugacgcgggggcugaaggacauggagcuggacagcuccagcaucgagaagcgcuucgccuucggcuuccuccagcagcugcugcgguggauggacaucucccaggaguucaucgcccaccucgaggccgucgugagcagcgggcgcguggagaaguccccgcacgagcaggagaucaaguucuucgcgaagauccugcugccccucaucaaccaguacuucaccaaccacugccuguacuuccugagcacccccgccaagguccucggcagcggcgggcacgccagcaacaaggagaaggagaugaucaccucccuguucugcaagcuggccgcccuggugcggcaccgcgugagccucuucggcacggacgcgcccgccgucgugaacugccugcacauccuggcccggucccucgacgcccgcaccgugaugaaguccgggcccgagaucgucaaggcgggccugcgguccuucuucgagagcgccuccgaggacaucgagaagaugguggagaaccugcgccucgggaaggugagccaggcccggacccaggucaagggcgugggccagaaccugaccuacacgaccguggcccugcucccgguccugaccacccuguuccagcacaucgcccagcaccaguucggggacgacgugauccucgacgacgugcaggucuccugcuaccgcacgcugugcagcaucuacucccugggcaccaccaagaacaccuacguggagaagcuccgccccgcgcugggggagugccuggcccggcucgccgccgccaugcccguggcguuccuggagccccagcugaacgaguacaacgccugcagcgucuacacgaccaaguccccgcgcgagcgggccauccucggccugcccaacagcguggaggagaugugccccgacauccccgugcuggagcgccucauggccgacaucgggggccuggccgaguccggcgcgcgguacaccgagaugccgcacgucaucgagaucacccugcccaugcucugcagcuaccugccccgcuggugggagcgggggcccgaggccccgcccagcgcccugcccgccggcgcgcccccgcccugcacggccgugaccuccgaccaccucaacagccugcuggggaacauccuccgcaucaucgugaacaaccugggcaucgacgaggccuccuggaugaagcggcuggccgucuucgcccagcccaucgugagccgcgcgcggcccgagcuccugcagucccacuucaucccgaccaucggccgccugcggaagcgcgccgggaagguggucagcgaggaggagcagcuccggcuggaggccaaggccgaggcccaggagggcgagcugcucgugcgcgacgaguucuccgugcugugccgggaccuguacgcgcucuacccccugcugauccgcuacgucgacaacaaccgggcccaguggcucaccgagcccaaccccagcgccgaggagcuguuccgcauggugggggagaucuucaucuacugguccaagagccacaacuucaagcgcgaggagcagaacuucgugguccagaacgagaucaacaacauguccuuccugacggccgacaacaagagcaagauggccaaggcgggcgacauccaguccgggggcagcgaccaggagcggaccaagaagaagcgccggggcgaccgcuacuccgugcagaccagccucaucguggccacccugaagaagaugcugccgaucgggcucaacaugugcgcccccacggaccaggaccugaucacccuggccaagacccgguacgcccucaaggacaccgacgaggagguccgcgaguuccugcacaacaaccugcaccuccagggcaagguggaggggucccccagccugcgguggcagauggcgcuguaccgcggcgugccggggcgggaggaggacgccgacgaccccgagaagaucguccgccgggugcaggagguguccgccguccucuacuaccuggaccagaccgagcaccccuacaagagcaagaaggccguguggcacaagcugcucagcaagcagcgccggcgcgcgguggucgccugcuuccggaugacgccccuguacaaccugccgacccaccgcgccugcaacauguuccucgaguccuacaaggccgccuggauccugaccgaggaccacagcuucgaggaccggaugaucgacgaccuguccaaggcgggcgagcaggaggaggaggaggaggagguggaggagaagaagcccgacccccuccaccagcuggugcugcacuucagccgcaccgcccucacggagaaguccaagcuggacgaggacuaccuguacauggccuacgccgacaucauggccaagagcugccaccucgaggagggcggggagaacggcgaggcggaggaggaggucgagguguccuucgaggagaagcagauggagaagcagcggcugcuguaccagcaggcccgccuccacacccgcggggccgccgagaugguccugcagaugaucagcgccugcaagggcgagaccggggcgaugguguccagcacccugaagcucggcaucuccauccugaacggcgggaacgccgaggugcagcagaagaugcuggacuaccucaaggacaagaaggaggucggcuucuuccagagcauccaggcccugaugcagacgugcuccgugcuggaccucaacgccuucgagcgccagaacaaggcggaggggcugggcauggugaacgaggacggcaccgucaucaaccgccagaacggggagaaggugauggccgacgacgaguucacccaggaccuguuccgguuccuccagcugcugugcgagggccacaacaacgacuuccagaacuaccugcgcacccagacggggaacaccaccaccaucaacaucaucaucugcacgguggacuaccuccugcggcugcaggagagcaucuccgacuucuacugguacuacagcggcaaggacgucaucgaggagcaggggaagcgcaacuucuccaaggccaugagcguggccaagcaggucuucaacucccucaccgaguacauccagggccccugcaccggcaaccagcagagccuggcccacagccggcugugggacgcggucgugggguuccuccacguguucgcccacaugaugaugaagcuggcccaggacuccagccagaucgagcugcucaaggagcugcuggaccuccagaaggacauggucgugaugcugcugucccuccuggagggcaacguggucaacgggaugaucgcccgccagaugguggacaugcugguggagagcuccagcaacgucgagaugauccucaaguucuucgacauguuccugaagcugaaggacaucgugggcuccgaggccuuccaggacuacgugaccgacccgcgggggcucaucagcaagaaggacuuccagaaggcgauggacucccagaagcaguucagcggccccgagauccaguuccugcuguccugcagcgaggccgacgagaacgagaugaucaacugcgaggaguucgccaaccgcuuccaggagcccgcccgggacaucggcuucaacgucgccgugcuccugacgaaccuguccgagcacgugccccacgacccgcgccuccacaacuuccuggagcuggcggagagcauccucgaguacuuccggcccuaccuggggcgcaucgagaucaugggcgccucccggcgcaucgagcggaucuacuucgagaucagcgagaccaaccgcgcccagugggagaugccccaggucaaggaguccaagcggcaguucaucuucgacguggugaacgagggcggcgaggccgagaagauggagcuguucgucagcuucugcgaggacaccaucuucgagaugcagaucgcggcccagaucuccgagcccgagggggagccggagaccgacgaggacgagggcgccggcgccgccgaggcgggggccgagggcgccgaggagggggccgccggccucgaggggacggcggccaccgccgccgccggcgcgaccgcccgcgugguggccgccgccggccgggcgcugcgcgggcugagcuaccgcagccuccggcgccggguccgccggcugcgccggcugaccgcccgcgaggccgccacggcgguggccgcccuccugugggccgccgugacccgggcgggcgccgccggggccggcgccgcggccggcgcccuggggcuccuguggggcucccuguucgggggcgggcucgucgagggcgccaagaaggugaccgugaccgagcugcuggccggcaugcccgaccccacgagcgacgagguccacggggagcagcccgcgggccccgggggcgacgccgacggggagggcgccuccgagggcgccggggacgcggccgagggcgccggggacgaggaggaggccgugcacgaggccggccccgggggcgcggacggcgccguggccgucaccgacgggggccccuuccgccccgagggggccggcggccucggggacaugggcgacaccaccccggccgagccgcccacgcccgaggggagcccgauccugaagcggaagcugggcguggacgggguggaggaggagcucccgcccgagcccgagcccgagcccgagcccgagcuggagccggagaaggcggacgccgagaacggcgagaaggaggagguccccgagcccacccccgagccgcccaagaagcaggcgccgcccuccccgccgcccaagaaggaggaggccggcggggaguucuggggcgagcuggaggugcagcgcgugaaguuccucaacuaccugagccggaacuucuacacccugcgcuuccucgcccuguuccuggcguucgccaucaacuucauccuccuguucuacaaggucuccgacagcccgcccggggaggacgacauggagggcuccgccgccggggacgugagcggcgcgggcuccgggggcagcuccggguggggccugggggccggcgaggaggccgagggcgacgaggacgagaacaugguguacuacuuccucgaggagagcaccggguacauggagcccgcccugcggugccugucccuccugcacacccuggucgccuuccucugcaucaucggcuacaacugccugaaggugccccuggucaucuucaagcgcgagaaggagcucgcgcggaagcuggaguucgacgggcuguacaucacggagcagcccgaggacgacgacgugaagggccagugggaccgccucgugcugaacacccccagcuuccccuccaacuacugggacaaguucgucaagcggaaggugcuggacaagcacggggacaucuacggccgcgagcggaucgccgagcuccugggcauggaccuggccacccucgagaucaccgcccacaacgagcgcaagcccaacccgccgcccgggcugcugacguggcucaugagcaucgacgugaaguaccagaucuggaaguucggcgucaucuucaccgacaacuccuuccuguaccuggggugguacauggugaugagccuccugggccacuacaacaacuucuucuucgccgcgcaccuccucgacaucgccaugggcgugaagacccugcgcaccauccugagcuccgucacgcacaacgggaagcagcucgugaugaccgugggccugcuggccgucgugguguaccucuacaccgucguggccuucaacuucuuccggaaguucuacaacaagagcgaggacgaggacgagcccgacaugaagugcgacgacaugaugaccugcuaccuguuccacauguacguggggguccgcgccggcgggggcaucggcgacgagaucgaggaccccgcgggggacgaguacgagcuguaccgggugguguucgacaucacguucuucuucuucgucaucgugauccugcucgccaucauccagggccugaucaucgacgccuucggggagcugcgcgaccagcaggagcaggucaaggaggacauggagaccaagugcuucaucugcggcaucggguccgacuacuucgacaccacgccccacggcuucgagacgcacacccucgaggagcacaaccuggccaacuacauguucuuccugauguaccucaucaacaaggacgagaccgagcacaccggccaggagagcuacgucuggaagauguaccaggagcggugcugggacuucuuccccgccggggacugcuuccgcaagcaguacgaggaccagcuguccuga

SEQ ID NO: 35993 - RNA, 14958 nt, Artificial Sequence
  derived and/or modified sequence opt1 from RYR2__Homo_sapiens__XP_006711865
auggccgacggcggggagggggaggacgagauccaguuccugcggaccgacgacgagguggugcuccagugcaccgccacgauccacaaggagcagcagaagcugugccuggccgccgagggguucggcaaccggcucugcuuccuggagagcaccagcaacagcaagaacgugccgcccgaccugagcaucugcaccuucgugcucgagcagagccugagcguccgggcccugcaggagaugcucgccaacaccguggagaaguccgagggccagguggacgucgagaaguggaaguucaugaugaagacggcccagggcggcgggcaccggacccugcuguacggccacgcgauccuccugcgccacagcuacagcgggauguaccugugcugccucagcaccagccgguccagcaccgacaagcuggccuucgacgugggccugcaggaggacacgaccggggaggccugcugguggaccauccaccccgccuccaagcagcgcagcgagggcgagaaggugcgggucggcgacgaccucauccugguguccgugagcuccgagcgcuaccugcaccucagcuacgggaacggcucccugcacgucgacgcggccuuccagcagacccuguggagcguggcccccaucagcuccgggagcgaggccgcccagggcuaccucaucggcggggacgugcugcggcugcuccacggccacauggacgagugccugacgguccccuccggggagcacggcgaggagcagcgccggaccgugcacuacgagggcggggcggugagcguccacgcccgcucccuguggcggcucgagacccugcgcguggccuggagcggcucccacauccggugggggcagcccuuccgccugcggcacgugaccacgggcaaguaccucagccugauggaggacaagaaccugcuccugauggacaaggagaaggccgacgucaaguccaccgccuucaccuuccgcagcuccaaggagaagcuggacgugggggugcggaaggaggucgacggcauggggaccagcgagaucaaguacggcgacuccgugugcuacauccagcacgucgacacgggccucuggcugaccuaccagagcguggacgugaaguccguccgcauggggagcauccagcggaaggcgaucaugcaccacgagggccacauggacgacgggaucucccugagccgcucccagcacgaggagagccgcaccgcccgggugauccgcagcaccguguuccucuucaaccgguucauccgcggccuggacgcccuguccaagaaggccaaggccagcacggucgaccuccccaucgaguccgugagccugucccugcaggaccucaucggguacuuccacccgcccgacgagcaccuggagcacgaggacaagcagaaccggcugcgcgcgcugaagaaccggcagaaccucuuccaggaggagggcaugaucaaccuggugcuggagugcaucgaccgccuccacgucuacagcuccgccgcccacuucgccgacguggccggccgggaggcgggggagagcuggaaguccauccugaacagccuguacgagcuccuggccgcccugauccgcggcaaccggaagaacugcgcccaguucuccgggagccucgacuggcugaucucccgccuggagcggcucgaggcgagcuccggcauccuggaggugcugcacugcguccucguggagagcccggaggcccugaacaucaucaaggagggccacaucaaguccaucaucagccugcucgacaagcacgggcgcaaccacaaggugcuggacguccugugcagccucugcgugugccacggcguggccguccgguccaaccagcaccugaucugcgacaaccugcuccccgggcgcgaccugcugcuccagacccggcuggugaaccacgugagcuccaugcgccccaacaucuuccugggcgucagcgagggguccgcccaguacaagaagugguacuacgagcucaugguggaccacaccgagcccuucgugaccgccgaggcgacgcaccuccgggucggcugggccagcaccgagggcuacuccccguaccccgggggcggggaggaguggggcgggaacggcgugggcgacgaccuguucagcuacggguucgacggccuccaccugugguccgggugcaucgcccgcaccgugagcucccccaaccagcaccuccugcgcaccgacgacgucaucagcugcugccuggaccuguccgcccccagcaucuccuuccggaucaacggccagccggugcaggggauguucgagaacuucaacaucgacggccucuucuuccccguggucagcuucuccgccggcaucaaggugcgcuuccugcucggcgggcggcacggggaguucaaguuccugccgccgcccggguacgcgcccugcuacgaggccgugcugcccaaggagaagcugaaggucgagcacagccgcgaguacaagcaggagcggacguacacccgcgaccuccuggggcccaccgugucccugacccaggccgccuucacgcccauccccguggacaccagccagaucguccugccgccccaccuggagcggauccgcgagaagcuggccgagaacauccacgagcucugggugaugaacaagaucgagcugggcuggcaguacggcccggugcgggacgacaacaagcgccagcaccccugccuggucgaguucagcaagcuccccgagcaggagcggaacuacaaccugcagaugucccuggagacccucaagacccugcuggcgcucgggugccacgugggcaucagcgacgagcacgccgaggacaaggugaagaagaugaagcugccgaagaacuaccagcugaccuccggguacaagcccgcccccauggaccucagcuucaucaagcugacgcccucccaggaggccauggucgacaagcuggcggagaacgcccacaacgugugggcccgcgaccggauccgccagggcuggaccuacggcauccagcaggacgugaagaaccggcgcaacccgcggcucguccccuacacccugcuggacgaccgcaccaagaaguccaacaaggacucccuccgggaggccgugcgcacgcugcugggguacggcuacaaccucgaggcccccgaccaggaccacgcggcccgggccgaggugugcagcgggaccggcgagcgcuuccgcaucuuccgggccgagaagaccuacgccgucaaggcggggcgcugguacuucgaguucgagaccgugacggccggcgacaugcgggugggcuggucccgccccgggugccagccggaccaggagcugggcagcgacgagcgggccuucgccuucgacggguucaaggcccagcgcuggcaccagggcaacgagcacuacgggcgguccuggcaggcgggcgacgucgugggcugcauggucgacaugaacgagcacaccaugauguucacccugaacggggagauccuccuggacgacagcggcuccgagcuggccuucaaggacuucgacgugggggacggcuucauccccgugugcagccucggggucgcccaggugggccgcaugaacuucggcaaggacguguccacccugaaguacuucacgaucugcgggcugcaggagggcuacgagcccuucgccgucaacaccaaccgggacaucaccauguggcucagcaagcgccugccccaguuccuccaggugccguccaaccacgagcacaucgaggugacccggaucgacgggacgaucgacagcucccccugccucaaggucacccagaaguccuucggcagccagaacuccaacaccgacaucauguucuaccgccugagcaugcccaucgagugcgcggagguguucuccaagaccguggccggcgggcugcccggcgccggccuguucggcccgaagaacgaccuggaggacuacgacgccgacagcgacuucgagguccugaugaagacggcccacgggcaccucgugcccgaccggguggacaaggacaaggaggcgaccaagcccgaguucaacaaccacaaggacuacgcccaggagaagcccucccgccugaagcagcgguuccugcuccgccggaccaagccggacuacagcaccucccacagcgcccgccugacggaggacguccuggccgacgaccgggacgacuacgacuuccugaugcagaccuccaccuacuacuacagcgugcgcaucuuccccggccaggagcccgccaacgugugggucggcuggaucaccuccgacuuccaccaguacgacacgggguucgaccucgaccgcgugcggaccgugaccgucacccugggcgacgagaaggggaaggugcacgagagcuucgcgaucgacucccugugcggcuucgggaucaagcgcagcaacugcuacauggugugcgccggcgaguccaugagccccggccaggggcggaacaacaacggccucgagaucgggugcgucguggacgccgccuccggccugcugacguucaucgccaacgggaaggagcucagcaccuacuaccagguggagccguccaccaagcuguuccccgcggucuucgcccaggccaccagccccaacguguuccaguucgagcugggccgcaucaagaacgugaugccgcucagcgccggccuguucaaguccgagcacaagaaccccgucccccagugcccgccccggcugcacgugcaguuccucagccacgugcuguggucccgcaugcccaaccaguuccugaaggucgacgugagccggaucuccgagcgccagggguggcucgugcagugccuggacccccugcaguucaugagccuccacauccccgaggagaaccgguccgucgacauccuggagcugacggagcaggaggagcuccugaaguuccacuaccacacccugcgccucuacagcgccgugugcgcgcugggcaaccaccggguggcccacgcccugugcucccacgucgacgagccccagcuccuguacgccaucgagaacaaguacaugcccgggcugcuccgcgcgggcuacuacgaccugcugaucgacauccaccucagcuccuacgccaccgcccggcugaugaugaacaacgaguacaucgugcccaugaccgaggagaccaagagcaucacgcuguuccccgacgagaacaagaagcacgggcucccgggcaucggccuguccaccagccugcgcccccggaugcaguucuccagccccuccuucgugagcaucuccaacgagugcuaccaguacagccccgaguucccgcucgacauccucaagagcaagaccauccagaugcugaccgaggccgucaaggaggggucccuccacgcccgcgaccccgugggcgggacgaccgaguuccuguucgugccccugaucaagcuguucuacacccugcugaucaugggcaucuuccacaacgaggaccucaagcacauccugcagcugaucgagcccagcgucuucaaggaggcggccaccccggaggaggaguccgacacgcucgagaaggagcugagcguggacgacgccaagcugcagggcgccggggaggaggaggccaagggcgggaagcggcccaaggagggccuccugcagaugaagcugcccgagcccgugaagcuccagaugugccugcugcuccaguaccugugcgacugccagguccgccaccggaucgaggcgaucguggccuucuccgacgacuucguggccaagcugcaggacaaccagcgcuuccgguacaacgaggucaugcaggcccucaacaugagcgccgcgcugaccgcccgcaagaccaaggaguuccgcuccccgccccaggagcagaucaacaugcugcucaacuucaaggacgacaagagcgagugccccugccccgaggagauccgggaccagcugcuggacuuccacgaggaccucaugacccacugcgggaucgagcuggacgaggacggcucccuggacggcaacagcgaccucacgauccgcgggcggcugcugucccucguggagaaggucaccuaccugaagaagaagcaggccgagaagccgguggagagcgacuccaagaaguccuccacccugcagcagcucaucagcgagaccauggugcgcugggcccaggaguccgucaucgaggaccccgagcuggugcgggcgauguucgugcugcuccaccgccaguacgacggcaucgggggccugguccgggcccugcccaagacguacaccaucaacggggugagcguggaggacaccaucaaccuccuggccucccugggccagauccgcagccuccugagcguccggaugggcaaggaggaggagaagcugaugauccgcgggcucggcgacaucaugaacaacaagguguucuaccagcacccgaaccugaugcgggcccuggggaugcacgagaccgugauggaggucauggugaacgugcucggcgggggcgaguccaaggagaucacguuccccaagauggucgccaacugcugccgcuuccugugcuacuucugccggaucagccgccagaaccagaaggcgauguucgaccaccuguccuaccuccuggagaacagcuccgugggccuggccagccccgccaugcggggguccacgccccucgacguggccgccgcgagcgucauggacaacaacgagcuggcccuggcccugcgcgagccggaccucgagaagguggugcgguaccuggccggcugcgggcugcaguccugccagaugcucgucagcaagggcuaccccgacaucggguggaaccccguggagggcgagcgcuaccuggacuuccugcgguucgccguguucugcaacggcgaguccgucgaggagaacgcgaacguggugguccgccuccugauccgccggcccgagugcuucgggccggcccugcgcggcgagggcgggaacggccuccuggccgccauggaggaggcgaucaagaucgccgaggaccccagccgggacgggcccucccccaacagcggcuccagcaagacccuggacaccgaggaggaggaggacgacacgauccacauggggaacgccaucaugaccuucuacuccgcccucaucgaccugcugggccgcugcgccccggagaugcaccucauccacgcggggaagggcgaggccauccggauccgcagcauccugcggagccugaucccccucggcgaccuggugggggugaucuccaucgccuuccagaugcccaccaucgccaaggacggcaacgucguggagcccgacaugagcgccggguucugcccggaccacaaggcggccauggugcuguuccucgaccgcgucuacggcaucgaggugcaggacuuccugcugcaccuccuggaggugggguuccugcccgaccuccgggccgccgccucccuggacaccgcggcccugagcgccacggacauggcccucgcccugaaccgcuaccugugcaccgcgguccucccccugcugacccggugcgcgccccucuucgccggcaccgagcaccacgccucccugaucgacagccugcuccacacgguguaccgccuguccaagggcugcagccugaccaaggcgcagcgggacuccaucgaggugugccuccugagcaucugcgggcagcugcgcccguccaugaugcagcaccuccugcggcgccuggucuucgacgugccccuccugaacgagcacgccaagaugccccugaagcuccugaccaaccacuacgagcggugcuggaaguacuacugccugcccggcggguggggcaacuucggggccgccagcgaggaggagcuccaccugucccgcaagcuguucuggggcaucuucgacgcccucagccagaagaaguacgagcaggagcuguucaagcuggcgcucccgugccuguccgccguggccggcgcccugccgcccgacuacauggagagcaacuacgucuccaugauggagaagcagagcuccauggacagcgaggggaacuucaacccccagccgguggacaccagcaacaucacgauccccgagaagcucgaguacuucaucaacaaguacgccgagcacucccacgacaaguggagcauggacaagcuggcgaacggcuggaucuacggggagaucuacuccgacagcuccaaggugcagccccugaugaagccguacaagcuccugagcgagaaggagaaggagaucuaccgguggcccaucaaggagucccugaagaccaugcucgccuggggcuggcgcaucgagcggacccgcgagggcgacagcauggcccuguacaaccgcacccggcgcaucucccagaccagccaggucuccguggacgccgcccacggguacagcccccgggcgaucgacauguccaacgugacgcugagccgcgaccuccacgccauggccgagaugauggccgagaacuaccacaacaucugggcgaagaagaagaagauggagcuggaguccaagggcgggggcaaccacccccugcucgucccguacgacacccugaccgccaaggagaaggccaaggaccgggagaaggcccaggacauccugaaguuccuccagaucaacggguacgccgugagccgcggcuucaaggaccuggagcuggacacccccuccaucgagaagcgguucgcguacagcuuccuccagcagcugauccgcuacguggacgaggcccaccaguacauccuggaguucgacggcgggucccggggcaagggggagcacuuccccuacgagcaggagaucaaguucuucgccaaggucgugcucccccugaucgaccaguacuucaagaaccaccgccuguacuuccucagcgccgccagccggccgcugugcuccggcgggcacgcgagcaacaaggagaaggagauggucacgucccuguucugcaagcucggcgugcuggugcgccaccggaucagccuguucggcaacgacgccaccuccaucgucaacugccuccacauccuggggcagacccuggacgcccgcaccgugaugaagacgggccucgagagcgugaaguccgcccugcgggccuuccuggacaacgcggccgaggaccuggagaagaccauggagaaccucaagcaggggcaguucacccacacccgcaaccagcccaagggcgucacgcagaucaucaacuacaccaccguggcccugcugcccaugcucagcucccuguucgagcacaucgggcagcaccaguucggcgaggaccugauccucgaggacgugcaggucagcugcuaccggauccugaccucccuguacgcccucggcacgagcaaguccaucuacguggagcgccagcggagcgcgcugggggagugccuggccgccuucgccggcgccuuccccguggcguuccucgagacccaccuggacaagcacaacaucuacuccaucuacaacaccaagagcucccgcgagcgcgccgcccugagccucccgaccaacgucgaggacgugugccccaacauccccucccuggagaagcugauggaggagaucguggagcucgccgagagcgggauccgguacacgcagaugccccacgucauggaggugauccugccgaugcugugcagcuacaugucccgcuggugggagcacggccccgagaacaaccccgagcgggccgagaugugcugcaccgcgcucaacagcgagcacaugaacacccugcuggggaacauccucaagaucaucuacaacaaccugggcaucgacgagggcgccuggaugaagcgccuggccguguucucccagcccaucaucaacaaggucaagccgcagcuccugaagacccacuuccugccccucauggagaagcugaagaagaaggccgccacgguggugagcgaggaggaccaccugaaggcggaggcccgcggggacauguccgaggccgagcuccugauccuggacgaguucaccacccucgcccgcgaccuguacgccuucuacccccugcucauccgguucgucgacuacaaccgcgcgaaguggcugaaggagcccaacccggaggccgaggagcuguuccggaugguggccgagguguucaucuacuggagcaagucccacaacuucaagcgcgaggagcagaacuucgucgugcagaacgagaucaacaacaugagcuuccucaucaccgacacgaaguccaagaugagcaaggccgcgguguccgaccaggagcggaagaagaugaagcgcaagggcgaccgguacagcaugcagaccucccugaucgucgccgcccugaagcgccuccugcccaucgggcugaacaucugcgcccccggcgaccaggagcucaucgcccuggcgaagaaccgguucagccugaaggacaccgaggacgaggugcgcgacaucauccgguccaacauccaccuccagggcaagcuggaggacccggccauccgcuggcagauggcccuguacaaggaccuccccaaccggaccgacgacacgagcgaccccgagaagaccguggagcgcguccuggacaucgccaacgugcuguuccaccucgagcagaaguccaagcggguggggcgccgccacuacugccuggucgagcacccccagcggagcaagaaggccguguggcacaagcugcucuccaagcagcgcaagcgggcgguggucgccugcuuccgcauggccccgcuguacaaccugccccggcaccgcgccgugaaccucuuccugcagggcuacgagaaguccuggaucgagaccgaggagcacuacuucgaggacaagcugaucgaggaccucgccaagcccggggcggagcccccggaggaggacgagggcaccaagcggguggacccccugcaccagcugauccuccuguucagccgcacggcccugaccgagaagugcaagcucgaggaggacuuccuguacauggccuacgccgacaucauggcgaaguccugccacgacgaggaggacgacgacggggaggaggaggucaagagcuucgaggugaccggcucccagcggagcaaggagaaggagauggagaagcagaagcugcucuaccagcaggcccgccugcacgaccggggcgccgccgagauggugcugcagaccaucuccgccagcaagggggagacgggccccauggucgcggccacccucaagcuggggaucgccauccugaacggcgggaacuccaccgugcagcagaagaugcucgacuaccugaaggagaagaaggacgugggcuucuuccagagccuggccggccucaugcaguccugcagcguccuggaccugaacgccuucgagcgccagaacaaggcggaggggcucggcauggugaccgaggagggguccggcgagaaggugcugcaggacgacgaguucacgugcgaccuguuccgguuccuccagcugcugugcgaggggcacaacagcgacuuccagaacuaccuccgcacccagaccggcaacaacaccaccgucaacaucaucaucuccacgguggacuaccugcugcgggugcaggagagcaucuccgacuucuacugguacuacagcggcaaggacgucaucgacgagcaggggcagcgcaacuucuccaaggccauccagguggccaagcaggucuucaacacccugaccgaguacauccagggccccugcaccgggaaccagcagagccucgcccacucccggcugugggacgccguggugggcuuccugcacgucuucgcgcacaugcagaugaagcucagccaggacagcucccagaucgagcugcugaaggagcucauggaccugcagaaggacaugguggugaugcugcucagcaugcuggagggcaacgucgugaacgggacgaucggcaagcagaugguggacaugcuggucgaguccagcaacaacguggagaugauccucaaguucuucgacauguuccugaagcugaaggaccucaccuccagcgacaccuucaaggaguacgacccggacgggaagggcgugaucuccaagcgcgacuuccacaaggccauggagagccacaagcacuacacccaguccgagacggaguuccugcugagcugcgccgagaccgacgagaacgagacccucgacuacgaggaguucgucaagcgguuccacgagcccgccaaggacaucggguucaacguggccgugcugcugaccaaccucuccgagcacaugcccaacgacacgcgccugcagaccuuccuggagcucgcggagagcguccugaacuacuuccagcccuuccugggccgcaucgagaucaugggcuccgccaagcggaucgagcgcguguacuucgagaucagcgaguccagccggacccagugggagaagccccaggugaaggaguccaagcgccaguucaucuucgacgucgugaacgagggcggggagaaggagaagauggagcuguucgugaacuucugcgaggacaccaucuucgagaugcagcuggccgcccagaucagcgagagcgaccugaacgagcgguccgcgaacaaggaggagagcgagaaggagcgccccgaggagcaggggccccggauggccuucuucuccauccucacgguccgcagcgcccuguucgcccugcgguacaacauccucacccugaugcgcaugcugucccucaagagccugaagaagcagaugaagaaggugaagaagaugaccgugaaggacauggucaccgccuucuucuccagcuacugguccaucuucaugacgcugcuccacuucguggcgagcguguuccggggcuucuuccgcaucaucugcucccugcugcucgggggcagccuggucgagggcgccaagaagaucaagguggccgagcugcucgccaacaugcccgacccgacccaggacgaggugcgcggggacggcgaggagggggagcgcaagccccuggaggccgcgcugcccuccgaggaccucaccgaccugaaggagcugaccgaggagagcgaccuccuguccgacaucuucggccuggaccucaagcgggagggcgggcaguacaagcugaucccccacaacccgaacgccggccugagcgaccucauguccaaccccguccccaugcccgaggugcaggagaaguuccaggagcagaaggccaaggaggaggagaaggaggagaaggaggagaccaagagcgagccggagaaggccgagggggaggacggcgagaaggaggagaaggccaaggaggacaaggggaagcagaagcugcgccagcugcacacccaccgguacggcgagcccgaggugcccgaguccgcguucuggaagaagaucaucgccuaccagcagaagcuccugaacuacuucgcccgcaacuucuacaacaugcggaugcuggcccucuucgucgcguucgccaucaacuucauccugcuguucuacaaggugagcaccagcuccguggucgaggggaaggagcucccgacccgcagcuccagcgagaacgccaaggugacgucccuggacagcuccagccaccggaucaucgccgugcacuacguccuggaggaguccagcggcuacauggagcccacccuccgcauccuggccauccugcacaccgugaucuccuucuucugcaucaucggcuacuacugccucaaggugccccuggucaucuucaagcgcgagaaggagguggcgcggaagcuggaguucgacgggcucuacaucaccgagcagcccagcgaggacgacaucaagggccagugggaccgccuggugaucaacacgcaguccuucccgaacaacuacugggacaaguucgucaagcggaaggugauggacaaguacggggaguucuacggccgcgaccggaucagcgagcugcucggcauggacaaggccgcccuggacuucuccgacgcccgcgagaagaagaagcccaagaaggacagcucccugagcgccgugcucaacuccaucgacgucaaguaccagauguggaagcugggggugguguucaccgacaacagcuuccuguaccucgcgugguacaugaccaugagcguccugggccacuacaacaacuucuucuucgccgcccaccuccucgacaucgccaugggguucaagacccugcggaccauccuguccagcgugacgcacaacggcaagcagcucguccugaccguggggcugcucgccguggucguguaccuguacaccguggucgcguucaacuucuuccgcaaguucuacaacaaguccgaggacggcgacacccccgacaugaagugcgacgacaugcugacgugcuacauguuccacauguacgugggcgugcgggccgggggcgggaucggcgacgagaucgaggaccccgccggggacgaguacgagaucuaccgcaucaucuucgacaucaccuucuucuucuucgucaucgugauccuccuggccaucauccagggccugaucaucgacgcguucggcgagcugcgggaccagcaggagcaggucaaggaggacauggagaccaagugcuucaucugcgggaucggcaacgacuacuucgacaccgucccgcacggguucgagacgcacacccuccaggagcacaaccuggccaacuaccuguucuuccucauguaccugaucaacaaggacgagaccgagcacaccggccaggagagcuacguguggaagauguaccaggagcgcugcugggaguucuuccccgccggggacugcuuccggaagcaguacgaggaccagcugaacuga

SEQ ID NO: 35994 - RNA, 14613 nt, Artificial Sequence
  derived and/or modified sequence opt1 from RYR3__Homo_sapiens__NP_001027
auggccgagggcggggagggcggggaggacgagauccaguuccugcgcaccgaggacgagguggugcuccagugcaucgccaccauccacaaggagcagcggaaguucugccuggccgccgagggccuggggaaccgccucugcuuccuggagcccaccagcgaggccaaguacaucccgcccgaccugugcgugugcaacuucgugcucgagcagagccugagcgugcgggcccugcaggagaugcucgccaacaccggcgagaacggcggggagggcgccgcccagggcggcgggcaccgcacccugcuguacgggcacgccgugcuccugcggcacuccuucagcggcauguaccugaccugccucaccaccucccgcagccagaccgacaagcuggccuucgacguggggcugcgggagcacgcgaccggcgaggccugcugguggaccauccaccccgccuccaagcagcgcagcgagggggagaaggugcggaucggcgacgaccucauccugguguccgugagcuccgagcgcuaccugcaccucagcgucuccaacggcaacauccagguggacgccagcuucaugcagacccuguggaacgugcaccccacgugcuccgggagcuccaucgaggagggcuaccugcucgggggccacgucgugcggcuguuccacgggcacgacgagugccugaccauccccagcaccgaccagaacgacucccagcaccgccggaucuucuacgaggccggcggcgcggggacccgcgcccggagccucuggcgcguggagccccugcggaucagcugguccggcagcaacauccgcugggggcaggccuuccggcugcgccaccucaccaccggccacuaccuggcccugacggaggaccaggggcucauccugcaggaccgggccaaguccgacaccaagagcaccgcguucuccuuccgcgccagcaaggagcugaaggagaagcucgacuccagccacaagcgcgacaucgagggcaugggcguccccgagaucaaguacggggacuccgugugcuucgugcagcacaucgccagcggccugugggucaccuacaaggcccaggacgccaagacgucccggcuggggccccucaagcgcaaggugauccugcaccaggagggccacauggacgacgggcugacccuccagcggugccagcgcgaggagagccaggcggcccggaucauccgcaacaccaccgcccuguucucccaguucgugagcggcaacaaccggacggccgcccccaucacccugcccaucgaggagguccuccagacccugcaggaccugaucgcguacuuccagccgcccgaggaggagaugcgccacgaggacaagcagaacaagcuccggucccugaagaaccgccagaaccuguucaaggaggagggcaugcuggcccucgugcugaacugcaucgaccggcugaacguguacaacagcgucgcccacuucgccgggaucgcgcgcgaggaguccggcauggccuggaaggagauccucaaccugcuguacaagcuccuggccgcccugauccgggggaaccgcaacaacugcgcccaguucagcaacaaccucgacuggcugaucuccaagcuggaccggcucgagagcagcuccggcauccuggaggugcugcacugcauccucaccgagagccccgaggcgcugaaccugaucgccgagggccacaucaaguccaucaucagccuccuggacaagcacgggcgcaaccacaagguccuggacauccucugcucccugugccugugcaacggcguggccgugcgggccaaccagaaccucaucugcgacaaccugcugccccgccggaaccuccugcugcagacgcgccucaucaacgacgucaccagcauccgccccaacaucuuccuggggguggccgagggcuccgcgcaguacaagaagugguacuucgagcugaucaucgaccagguggaccccuuccucaccgccgagccgacccaccuccgggucgggugggccagcuccagcggcuacgcccccuaccccggcgggggcgagggguggggcgggaacggcgugggcgacgaccuguacuccuacggguucgacggccuccaccuguggagcgggcgcaucccccgggccguggcguccaucaaccagcaccuccugcgcagcgacgacgucguguccugcugccuggaccugggcgugccgagcaucuccuuccggaucaacgggcagcccguccagggcauguucgagaacuucaacacggacggccucuucuuccccgugaugagcuucagcgccggggugaagguccgcuuccugaugggcgggcggcacggcgaguucaaguuccugcccccguccggguacgcccccugcuacgaggcccuccugcccaaggagaagaugcgccuggagcccgugaaggaguacaagcgggacgcggacggcauccgcgaccuccugggcaccacccaguuccugagccaggccuccuucaucccgugccccguggacaccagccaggucauccugccgccccaccuggagaagauccgggaccgccuggccgagaacauccacgagcucugggggaugaacaagaucgagcugggcuggacguucgggaagauccgggacgacaacaagcgccagcaccccugccugguggaguucuccaagcuccccgagaccgagaagaacuacaaccugcagaugagcaccgagacccugaagacccuccuggcccugggcugccacaucgcccacgugaaccccgcggccgaggaggaccucaagaaggucaagcugcccaagaacuacaugauguccaacggcuacaagcccgcgccccucgaccucagcgacgugaagcugcugcccccgcaggagauccucguggacaagcuggccgagaacgcccacaacgucugggcgaaggaccggaucaagcagggguggacguacggcauccagcaggaccugaagaacaagcgcaacccccggcucgugcccuacgcccugcuggacgagcgcaccaagaaguccaaccgggacagccuccgcgaggccgugcggaccuucgucggguacggcuacaacaucgagcccuccgaccaggagcuggccgacagcgccguggagaagguguccaucgacaagauccgcuucuuccgcgucgagcggagcuacgcggugcgcuccgggaagugguacuucgaguucgagguggucaccggcggcgacaugcggguggggugggcccgcccgggcugccggcccgacguggagcugggggccgacgaccaggccuucgucuucgagggcaaccgcgggcagcgguggcaccagggcagcggcuacuucgggcgcacguggcagcccggcgacgugguggggugcaugaucaaccucgacgacgcguccaugaucuucacccugaacggcgagcugcucaucaccaacaaggggagcgagcuggccuucgccgacuacgagaucgagaacggcuucguccccaucugcugccugggccucucccagaucgggcggaugaaccugggcaccgacgccagcacguucaaguucuacaccaugugcgggcugcaggagggcuucgagccguucgccgugaacaugaaccgcgacguggcgaugugguucagcaagcggcuccccaccuucgucaacgugcccaaggaccacccccacaucgaggugaugcgcaucgacggcaccauggacuccccgcccugccugaaggucacgcacaagaccuucgggacccagaacagcaacgccgacaugaucuacugccggcuguccaugcccguggagugccacagcuccuucagccacucccccugccucgacagcgaggccuuccagaagcgcaagcagaugcaggagauccugucccacaccacgacccagugcuacuacgccauccggaucuucgccggccaggacccgagcugcgugugggucgggugggugacccccgacuaccaccuguacuccgagaaguucgaccucaacaagaacugcaccgugacggucacccugggcgacgagcgcgggcgggugcacgagagcgucaagcgcuccaacugcuacaugguguggggcggcgacaucguggcgagcucccagcggagcaaccgcuccaacgucgaccuggagaucgggugccugguggaccucgccaugggcaugcugagcuucuccgccaacgggaaggagcuggggaccugcuaccagguggagcccaacaccaaggucuucccggccguguuccuccagcccacgagcaccagccuguuccaguucgagcuggggaagcucaagaacgccaugccccuguccgcggccaucuuccgcagcgaggagaagaaccccgugccgcagugcccgccccggcuggacguccagaccauccagcccgugcucuggucccgcaugccgaacagcuuccugaagguggagaccgagcgggucuccgagcgccacggcuggguggugcagugccuggagccccuccagaugauggcccugcacauccccgaggagaaccggugcgucgacauccuggagcucugcgagcaggaggaccugaugcgcuuccacuaccacacgcugcggcucuacagcgccgugugcgcccugggcaacucccgcguggcguacgcccugugcagccacgucgaccucucccagcuguucuacgccaucgacaacaaguaccugcccgggcuccugcggagcggcuucuacgaccugcucaucuccauccaccuggccagcgcgaaggagcgcaagcugaugaugaagaacgaguacaucaucccgaucaccuccaccacccggaacauccgccucuuccccgacgagagcaagcggcacgggcugcccggcguggggcugcgcacgugccucaagcccggcuuccgguucuccaccccgugcuucguggucaccggcgaggaccaccagaagcagagccccgagaucccccuggagucccugcgcaccaaggcccucagcaugcugacggaggccgugcagugcuccggggcccacauccgggaccccgugggcgggagcgucgaguuccaguucgugccggugcugaagcucaucggcacccugcuggucauggggguguucgacgacgacgacgugcgccagauccuccugcugaucgaccccagcgucuucggcgagcacuccgccggcaccgaggagggggcggagaaggaggaggugacccagguggaggagaaggccgucgaggccggcgagaaggccgggaaggaggcccccgugaagggccuccugcagacccggcugcccgagagcgugaagcuccagaugugcgagcugcuguccuaccucugcgacugcgagcugcagcaccgcgucgaggcgaucguggccuucggcgacaucuacgugagcaagcugcaggccaaccagaaguuccgguacaacgagcucaugcaggcccugaacauguccgccgcgcugacggcccgcaagaccaaggaguuccgcagcccgccccaggagcagaucaacaugcuccugaacuuccagcugggggagaacugccccugccccgaggagauccgggaggagcucuacgacuuccacgaggaccugcugcuccacugcggcgucccgcuggaggaggaggaggaggaggaggaggacaccuccuggaccgggaagcugugcgcccucguguacaagaucaaggggccgcccaagccggagaaggagcagcccacggaggaggaggagcgcugccccaccacccugaaggagcugaucagccagaccaugaucugcugggcccaggaggaccagauccaggacuccgagcucgugcggaugauguucaaccugcugcgccggcaguacgacagcaucggggagcuccugcaggcgcugcgcaagacguacaccaucucccacaccagcgucuccgacaccaucaaccuccuggccgcccugggccagauccggagccuccuguccgugcgcaugggcaaggaggaggagcugcucaugaucaacgggcugggcgacaucaugaacaacaagguguucuaccagcaccccaaccugaugcggguccucgggaugcacgagacggugauggaggugauggucaacgugcugggcaccgagaagucccagaucgccuucccgaagaugguggccuccugcugccgcuuccugugcuacuucugccggaucagccgccagaaccagaaggcgauguucgagcaccucuccuaccugcuggagaacagcagcgucgggcucgccucccccagcaugcggggcuccacgccccuggacguggccgccagcuccgucauggacaacaacgagcuggcccucagccuggaggagcccgaccuggagaagguggugaccuaccucgcgggcugcgggcugcaguccugcccgaugcugcucgccaagggcuaccccgacgucggguggaaccccaucgagggcgagcgcuaccugagcuuccugcgguucgccguguucgugaacuccgagagcgucgaggagaacgccuccgugguggucaagcugcucauccgccggcccgagugcuucgggccggcccugcgcggcgagggcgggaacggccugcucgcggccaugcagggggccaucaagaucagcgagaaccccgcccuggaccugcccucccagggcuacaagcgggaggugagcacgggggacgacgaggaggaggaggagaucgugcacaugggcaacgcgaucauguccuucuacagcgcccucaucgaccugcugggccgcugcgcccccgagaugcaccucauccagaccgggaagggcgaggccauccgcauccgguccauccugcgcagccuggucccgaccgaggaccucguggggaucaucuccaucccccugaagcugcccagccucaacaaggacggcagcguguccgagcccgacauggccgcgaacuucugcccggaccacaaggcccccaugguccuguuccuggaccggguguacggcaucaaggaccagaccuuccuccugcaccuccuggaggugggguuccugcccgaccugcgcgccagcgccucccucgacacggucagccuguccaccaccgaggccgcgcuggcccucaaccgguacaucugcagcgccgugcugccccugcucacccgcugcgccccgcuguucgccggcacggagcacugcaccucccugaucgacagcacccuccagaccaucuaccggcuguccaaggggcgcagccugacgaaggcgcagcgggacaccaucgaggagugccuccuggccaucugcaaccaccuccggcccuccaugcugcagcagcugcugcggcgccucguguucgacgucccccagcugaacgaguacugcaagaugccccugaagcuccugaccaaccacuacgagcagugcuggaaguacuacugccugccgagcggcuggggguccuacggccucgccguggaggaggagcugcaccugaccgagaagcuguucuggggcaucuucgacagccugucccacaagaaguacgaccccgaccuguuccggauggcccuccccugccugagcgccaucgcgggggcccugccgcccgacuaccucgacacgcgcaucaccgccacccuggagaagcagaucuccguggacgccgacggcaacuucgaccccaagcccaucaacaccaugaacuucagccugccggagaagcucgaguacaucgucacgaaguacgcggagcacagccacgacaagugggccugcgacaagucccagagcggguggaaguacggcaucucccuggacgagaacgugaagacccacccccugauccggcccuucaagacccucaccgagaaggagaaggagaucuaccgcuggcccgcccgggagagccugaagaccaugcuggccgugggguggacggucgagcgcaccaaggagggcgaggcccucgugcagcagcgggagaacgagaagcugcgcuccgugagccaggcgaaccagggcaacuccuacagcccggcgccccuggaccucuccaacgucgugcugagccgggagcugcaggggaugguggaggucguggccgagaacuaccacaacaucugggccaagaagaagaagcucgagcuggaguccaagggcgggggcagccacccccugcucgugcccuacgacacccugaccgccaaggagaaguucaaggaccgcgagaaggcgcaggaccuguucaaguuccuccaggucaacgggaucaucgugucccgcggcaugaaggacauggagcuggacgccagcuccauggagaagcgguucgccuacaaguuccugaagaagauccucaaguacguggacagcgcccaggaguucaucgcccaccuggaggcgaucgucuccagcggcaagacggagaaguccccgcgcgaccaggagaucaaguucuucgccaaggugcugcucccccugguggaccaguacuucaccagccacugccuguacuuccucagcagcccccugaagccccugagcuccagcggguacgccucccacaaggagaaggagauggucgccggccucuucugcaagcuggcggcccuggugcggcaccgcaucagccucuucggguccgacagcaccaccaugguguccugccugcacauccuggcccagacgcucgacacccggaccgucaugaaguccggcuccgagcuggugaaggccggccugcgcgccuucuucgagaacgcggccgaggaccuggagaagaccagcgagaaccucaagcuggggaaguucacgcacucccggacccagaucaagggcgugagccagaacaucaacuacaccaccgucgcccugcucccgauccugacguccaucuucgagcacgugacccagcaccaguucgggauggaccugcuccugggcgacgugcagaucagcugcuaccacauccugugcucccucuacagccuggggaccggcaagaacaucuacgucgagcgccagcggcccgcccugggcgagugccucgccucccuggcggccgccauccccguggccuuccuggagcccacccucaaccgcuacaacccgcugagcgucuucaacacgaagacgccccgggagcgcagcauccuggggaugcccgacaccguggaggacaugugccccgacaucccgcagcucgagggccugaugaaggagaucaacgaccuggccgaguccggggcgcgguacaccgagaugccccacgugaucgaggucauccuccccaugcugugcaacuaccugagcuacuggugggagcgcggcccggagaaccugccgcccuccacggggcccugcugcaccaaggugaccagcgagcaccugucccugauccucggcaacauccugaagaucaucaacaacaaccugggcaucgacgaggccagcuggaugaagcggaucgccguguacgcccagccgaucaucuccaaggcgcgccccgaccuccugcggagccacuucauccccacccuggagaagcucaagaagaaggccgucaagacggugcaggaggaggagcagcugaaggccgacgggaagggcgacacccaggaggccgagcugcucauccuggacgaguucgccgugcugugccgcgaccucuacgcguucuaccccaugcugauccgguacgucgacaacaaccgcuccaacuggcucaagagcccggacgccgacuccgaccagcuguuccgcaugguggccgagguguucauccuguggugcaagagccacaacuucaagcgggaggagcagaacuucgucauccagaacgagaucaacaaccuggccuuccucaccggggacuccaagagcaagauguccaaggccaugcaggucaagagcggcgggcaggaccaggagcgcaagaagaccaagcggcgcggcgaccuguacuccauccagacgagccugaucguggcggcccucaagaagaugcugcccaucggccugaacaugugcacccccggggaccaggagcucaucucccuggccaagagccgguacagccaccgcgacaccgacgaggagguccgggagcaccuccgcaacaaccuccaccuccaggagaaguccgacgaccccgccgugaaguggcagcugaaccucuacaaggacgugcucaagagcgaggagccguucaaccccgagaagaccgucgagcgggugcagcgcaucuccgccgcgguguuccaccuggagcaggucgagcagccccuccggagcaagaaggccguguggcacaagcugcuguccaagcagcgcaagcgggccguggucgccugcuuccgcauggcgccccuguacaaccugccgcggcaccgcagcaucaaccuguuccuccacggcuaccagcgguucuggaucgagacggaggaguacuccuucgaggagaagcuggugcaggaccuggccaagagccccaagguggaggaggaggaggaggaggagaccgagaagcagcccgacccccuccaccagaucauccuguacuucucccgcaacgcccugaccgagcggagcaagcucgaggacgacccgcuguacaccuccuacagcuccaugauggccaagagcugccaguccggggaggacgaggaggaggacgaggacaaggagaagacguucgaggagaaggagauggagaagcagaagacccuguaccagcaggcccgccuccacgagcggggcgcggccgagaugguccugcagaugaucagcgccuccaagggggagaugagccccauggugguggagacccugaagcucggcaucgccauccugaacggcgggaacgccggcguccagcagaagaugcuggacuaccucaaggagaagaaggacgcgggguucuuccagucccugagcggccugaugcagagcugcuccgugcucgaccugaacgccuucgagcgccagaacaaggccgagggccuggggauggugaccgaggagggcacccucaucguccgcgagcgcggcgagaaggugcugcagaacgacgaguucacgcgcgaccuguuccgguuccuccagcugcugugcgagggccacaacagcgacuuccagaacuuccuccgcacccagauggggaacaccaccacggugaacgucaucaucuccaccguggacuaccugcugcggcugcaggagagcaucuccgacuucuacugguacuacagcggcaaggacaucaucgacgaguccggccagcacaacuucagcaaggcccucgccgugaccaagcagaucuucaacucccugaccgaguacauccaggggcccugcaucggcaaccagcagagccuggcgcacucccgccucugggacgccgucgugggguuccugcacguguucgccaacaugcagaugaagcugagccaggacuccagccagaucgagcuccugaaggagcugcucgaccugcugcaggacauggucgugaugcuccugucccugcucgagggcaacguggucaacgggacgaucggcaagcagaugguggacacccugguggagagcuccaccaacgucgagaugauccugaaguucuucgacauguuccucaagcugaaggaccugaccagcuccgacacguucaaggaguacgaccccgacggcaaggggaucaucagcaagaaggaguuccagaaggccauggagggccagaagcaguacacccagagcgagaucgacuuccuccuguccugcgccgaggcggacgagaacgacauguucaacuacguggacuucguggaccgguuccacgagccggccaaggacaucggguucaacgucgccgugcugcucaccaaccugagcgagcacaugcccaacgacucccgccugaagugccuccuggaccccgccgagagcguccugaacuacuucgagcccuaccucggccggaucgagaucaugggcggcgcgaagaagaucgagcgcguguacuucgagaucuccgagagcucccggacccagugggagaagccccaggugaaggagagcaagcgccaguucaucuucgacgucgugaacgagggcggggagcaggagaagauggagcuguucgugaacuucugcgaggacacgaucuucgagaugcagcuggccucccagaucagcgaguccgacagcgccgaccggcccgaggaggaggaggaggacgaggacuccagcuacguccucgagaucgccggcgaggaggaggaggacgggucccuggagcccgccagcgcguucgccauggccugcgccuccgugaagcgcaacgugaccgacuuccugaagcgggccacccucaagaaccugcgcaagcaguaccggaacgucaagaagaugaccgcgaaggagcuggugaagguccuguucagcuucuucuggaugcuguucgucggccuguuccagcuccuguucacgauccugggcgggaucuuccagauccucuggagcaccguguucggcgggggccugguggagggggccaagaacauccgcgucaccaagauccugggcgacaugccggaccccacccaguucggcauccacgacgacacgauggaggccgagcgggccgaggugauggagcccgggaucaccaccgagcucgugcacuucaucaagggcgagaagggggacaccgacaucauguccgaccuguucggccugcaccccaagaaggaggggagccucaagcacggcccggaggucggccugggggaccuguccgagaucaucggcaaggacgagccgcccacgcucgagagcaccgugcagaagaagcgcaaggcccaggcggccgagaugaaggccgccaacgaggccgaggggaagguggaguccgagaaggcggacauggaggacggcgagaaggaggacaaggacaaggaggaggagcaggccgaguaccuguggaccgaggucaccaagaagaagaagcgccggugcgggcagaagguggagaagcccgaggccuucacggccaacuucuucaagggccuggagaucuaccagaccaagcuccugcacuaccuggcgcgcaacuucuacaaccuccgguuccuggcccuguucguggccuucgccaucaacuucauccuccuguucuacaaggucaccgaggagccgcuggaggaggagaccgaggacguggccaaccucuggaacagcuucaacgacgaggaggaggaggaggcgaugguguucuucguccugcaggaguccacgggcuacauggcccccacccugcgcgcccucgccaucauccacaccaucaucagccuggugugcguggucggguacuacugccugaaggugccccucguggucuucaagcgggagaaggagaucgcccgcaagcuggaguucgacggccuguacaucaccgagcagcccuccgaggacgacaucaaggggcagugggaccggcucgugaucaacaccccgagcuuccccaacaacuacugggacaaguucgugaagcgcaaggucaucaacaaguacggcgaccuguacggggcggagcggaucgccgagcugcucggccuggacaagaacgcccuggacuucucccccguggaggagacgaaggccgaggccgcgagccucguguccuggcugagcuccaucgacaugaaguaccacaucuggaagcugggcgucguguucaccgacaacagcuuccucuaccuggccugguacaccaccauguccgugcuggggcacuacaacaacuucuucuucgccgcccaccuccuggacaucgcgaugggcuucaagacgcugcgcaccauccucagcuccgucacccacaacgggaagcagcuggugcugaccgugggccuccuggccgucgugguguaccuguacacggucguggccuucaacuucuuccggaaguucuacaacaagagcgaggacgacgacgagcccgacaugaagugcgacgacaugaugaccugcuaccucuuccacauguacgugggcguccgcgccgggggcgggaucggcgacgagaucgaggacccggccggggaccccuacgagauguaccggaucguguucgacaucaccuucuucuucuucgucaucgugauccugcuggcgaucauccagggccugaucaucgacgccuucggcgagcuccgcgaccagcaggagcagguccgggaggacauggagaccaagugcuucaucugcgggaucggcaacgacuacuucgacacgacgccccacggguucgagacccacacccugcaggagcacaaccuggccaacuaccucuucuuccugauguaccugaucaacaaggacgagacggagcacaccggccaggagagcuacgucuggaagauguaccaggagcgcugcugggacuucuuccccgccggggacugcuuccggaagcaguacgaggaccagcucggcuga

SEQ ID NO: 35995 - RNA, 294 nt, Artificial Sequence
  derived and/or modified sequence opt1 from S100A10__Homo_sapiens__NP_002957
augcccagccagauggagcacgccauggagaccaugauguucaccuuccacaaguucgccggcgacaagggguaccugacgaaggaggaccuccgcgugcugauggagaaggaguucccgggcuuccuggagaaccagaaggacccccucgcggucgacaagaucaugaaggaccuggaccagugccgggacgggaaggugggcuuccaguccuucuucagccugaucgccgggcucaccaucgccugcaacgacuacuucgugguccacaugaagcagaagggcaagaaguga

SEQ ID NO: 35996 - RNA, 318 nt, Artificial Sequence
  derived and/or modified sequence opt1 from S100A11__Homo_sapiens__NP_005611
auggccaagaucagcucccccaccgagaccgagcgcugcaucgagagccugaucgccguguuccagaaguacgcgggcaaggacggguacaacuacacgcucuccaagaccgaguuccugagcuucaugaacaccgagcuggccgccuucaccaagaaccagaaggacccgggcguccucgaccggaugaugaagaagcuggacacgaacuccgacgggcagcuggacuucagcgaguuccucaaccugaucggcgggcuggccauggccugccacgacuccuuccucaaggcggugcccagccagaagcgcaccuga

SEQ ID NO: 35997 - RNA, 279 nt, Artificial Sequence
  derived and/or modified sequence opt1 from S100A12__Homo_sapiens__NP_005612
augaccaagcuggaggagcaccucgagggcaucgugaacaucuuccaccaguacagcguccgcaaggggcacuucgacacccuguccaagggcgagcugaagcagcuccugacgaaggagcuggccaacaccaucaagaacaucaaggacaaggccgugaucgacgagaucuuccaggggcucgacgcgaaccaggacgagcaggucgacuuccaggaguucaucagccugguggccaucgcccugaaggccgcccacuaccacacccacaaggaguga

SEQ ID NO: 35998 - RNA, 297 nt, Artificial Sequence
  derived and/or modified sequence opt1 from S100A13__Homo_sapiens__XP_011508166
auggccgccgagccccugaccgagcucgaggagagcaucgagaccguggucacgaccuucuucaccuucgcgcgccaggagggccggaaggacucccugagcgugaacgaguucaaggagcuggugacccagcagcucccgcaccuccugaaggacgucgggucccuggacgagaagaugaagucccuggacgugaaccaggacagcgagcugaaguucaacgaguacuggcgccucaucggcgagcuggccaaggagauccggaagaagaaggaccugaagauccgcaagaaguga

SEQ ID NO: 35999 - RNA, 315 nt, Artificial Sequence
  derived and/or modified sequence opt1 from S100A14__Homo_sapiens__XP_005245419
augggccagugccgcagcgccaacgccgaggacgcgcaggaguucuccgacguggagcgggccaucgagacccugaucaagaacuuccaccaguacagcgucgagggcgggaaggagacccucacgcccuccgagcugcgcgaccuggugacccagcagcucccgcaccugaugcccagcaacugcgggcuggaggagaagaucgccaaccucggcuccugcaacgacagcaagcuggaguuccgguccuucugggagcugaucggggaggccgccaagagcgugaagcucgagcgccccguccggggccacuga

SEQ ID NO: 36000 - RNA, 312 nt, Artificial Sequence
  derived and/or modified sequence opt1 from S100A16__Homo_sapiens__NP_525127
augagcgacugcuacaccgagcuggagaaggccgugaucguccucguggagaacuucuacaaguacguguccaaguacagccuggucaagaacaagaucuccaagagcuccuuccgcgagaugcugcagaaggagcucaaccacaugcugagcgacaccggcaaccggaaggccgcggacaagcugauccagaaccucgacgccaaccacgacgggcgcaucuccuucgacgaguacuggacgcugaucggcgggaucaccggccccaucgccaagcugauccacgagcaggagcagcagagcuccagcuga

SEQ ID NO: 36001 - RNA, 285 nt, Artificial Sequence
  derived and/or modified sequence opt1 from S100A1__Homo_sapiens__NP_006262
augggcagcgagcuggagaccgccauggagacccucaucaacguguuccacgcccacuccgggaaggagggcgacaaguacaagcugagcaagaaggagcugaaggagcuccugcagacggagcuguccggguuccucgacgcgcagaaggacgucgacgccguggacaaggugaugaaggagcuggacgagaacggcgacggggaggucgacuuccaggaguacguggugcuggucgccgcccucaccguggccugcaacaacuucuucugggagaacagcuga

SEQ ID NO: 36002 - RNA, 294 nt, Artificial Sequence
  derived and/or modified sequence opt1 from S100A2__Homo_sapiens__NP_005969
augugcagcucccuggagcaggcccucgccgugcuggucaccaccuuccacaaguacagcugccaggagggcgacaaguucaagcuguccaagggggagaugaaggagcuccugcacaaggagcugcccagcuucgugggcgagaagguggacgaggaggggcucaagaagcugaugggcucccuggacgagaacagcgaccagcaggucgacuuccaggaguacgcgguguuccucgcccugaucacggugaugugcaacgacuucuuccaggggugcccggaccgccccuga

SEQ ID NO: 36003 - RNA, 306 nt, Artificial Sequence
  derived and/or modified sequence opt1 from S100A3__Homo_sapiens__NP_002951
auggcccgcccccuggagcaggccguggcggccaucgucugcaccuuccaggaguacgccggccggugcggggacaaguacaagcucugccaggccgagcugaaggagcugcuccagaaggagcuggccaccuggacgcccaccgaguuccgcgagugcgacuacaacaaguucaugagcgugcuggacaccaacaaggacugcgagguggacuucgucgaguacgugcggucccucgcgugccugugccuguacugccacgaguacuucaaggacugccccagcgagccgcccugcucccaguga

SEQ ID NO: 36004 - RNA, 306 nt, Artificial Sequence
  derived and/or modified sequence opt1 from S100A4__Homo_sapiens__NP_002952
auggccugcccccuggagaaggcccucgacgugauggucagcaccuuccacaaguacuccggcaaggagggggacaaguucaagcugaacaagagcgagcugaaggagcuccugacccgcgagcugccguccuuccucggcaagcggacggacgaggcggccuuccagaagcugaugagcaaccuggacuccaaccgcgacaacgagguggacuuccaggaguacugcguguuccucagcugcaucgccaugaugugcaacgaguucuucgagggguuccccgacaagcagccccggaagaaguga

SEQ ID NO: 36005 - RNA, 279 nt, Artificial Sequence
  derived and/or modified sequence opt1 from S100A5__Homo_sapiens__NP_002953
auggagacgccccuggagaaggcccucaccaccauggugaccaccuuccacaaguacagcggccgcgagggguccaagcugacccugagccggaaggagcucaaggagcugaucaagaaggagcugugccucggcgagaugaaggaguccagcaucgacgaccugaugaagucccuggacaagaacagcgaccaggagaucgacuucaaggaguacuccgucuuccucacgaugcugugcauggccuacaacgacuucuuccuggaggacaacaaguga

SEQ ID NO: 36006 - RNA, 273 nt, Artificial Sequence
  derived and/or modified sequence opt1 from S100A6__Homo_sapiens__NP_055439
auggccugcccccuggaccaggccaucggccuccugguggcgaucuuccacaaguacagcgggcgcgagggcgacaagcacacccuguccaagaaggagcucaaggagcugauccagaaggagcugaccaucgggagcaagcuccaggacgccgagaucgcccggcugauggaggaccuggaccgcaacaaggaccaggaggucaacuuccaggaguacgugacguuccucggcgcccuggcccugaucuacaacgaggcgcucaagggguga

SEQ ID NO: 36007 - RNA, 306 nt, Artificial Sequence
  derived and/or modified sequence opt1 from S100A7A__Homo_sapiens__NP_789793
augagcaacacccaggccgagcgcuccaucaucggcaugaucgacauguuccacaaguacaccgggcgggacggcaagaucgagaagcccagccugcucacgaugaugaaggagaacuucccgaacuuccuguccgccugcgacaagaaggggauccacuaccuggcgaccguguucgagaagaaggacaagaacgaggacaagaagaucgacuucagcgaguuccucucccugcugggcgacaucgccgccgacuaccacaagcagagccacggggccgcccccugcuccggcggcagccaguga

SEQ ID NO: 36008 - RNA, 306 nt, Artificial Sequence
  derived and/or modified sequence opt1 from S100A7__Homo_sapiens__NP_002954
augagcaacacccaggccgagcgcuccaucaucggcaugaucgacauguuccacaaguacacccggcgcgacgacaagaucgagaagcccagccugcucacgaugaugaaggagaacuucccgaacuuccuguccgccugcgacaagaaggggaccaacuaccuggcggacguguucgagaagaaggacaagaacgaggacaagaagaucgacuucagcgaguuccucucccugcugggcgacaucgccaccgacuaccacaagcagagccacggggccgcccccugcuccggcgggagccaguga

SEQ ID NO: 36009 - RNA, 282 nt, Artificial Sequence
  derived and/or modified sequence opt1 from S100A8__Homo_sapiens__NP_002955
augcugaccgagcucgagaaggcccugaacagcaucaucgacguguaccacaaguacucccugaucaagggcaacuuccacgccgucuaccgcgacgaccucaagaagcugcuggagaccgagugcccccaguacauccggaagaagggggcggacgugugguucaaggagcucgacaucaacacggacggcgccgugaacuuccaggaguuccugauccuggucaucaagauggggguggccgcccacaagaagucccacgaggagagccacaaggaguga

SEQ ID NO: 36010 - RNA, 345 nt, Artificial Sequence
  derived and/or modified sequence opt1 from S100A9__Homo_sapiens__NP_002956
augaccugcaagaugagccagcuggagcgcaacaucgagaccaucaucaacacguuccaccaguacuccgugaagcucggccaccccgacacccugaaccagggggaguucaaggagcugguccggaaggaccuccagaacuuccugaagaaggagaacaagaacgagaaggugaucgagcacaucauggaggaccuggacaccaacgccgacaagcagcucagcuucgaggaguucaucaugcugauggcccgccugaccugggcgucccacgagaagaugcacgagggcgacgaggggccgggccaccaccacaagcccgggcucggcgagggcacgcccuga

SEQ ID NO: 36011 - RNA, 279 nt, Artificial Sequence
  derived and/or modified sequence opt1 from S100B__Homo_sapiens__NP_006263
augagcgagcuggagaaggccaugguggcccucaucgacgucuuccaccaguacuccggccgcgagggggacaagcacaagcugaagaaguccgagcugaaggagcucaucaacaacgagcugagccacuuccuggaggagaucaaggagcaggaggugguggacaaggucauggagacccucgacaacgacggcgacggggagugcgacuuccaggaguucauggcguucguggccauggugaccacggccugccacgaguucuucgagcacgaguga

SEQ ID NO: 36012 - RNA, 288 nt, Artificial Sequence
  derived and/or modified sequence opt1 from S100P__Homo_sapiens__NP_005971
augaccgagcuggagaccgccaugggcaugaucaucgacguguucagccgcuacuccgggagcgagggcuccacgcagacccucaccaagggggagcugaagguccugauggagaaggagcuccccggcuuccugcagagcgggaaggacaaggacgccguggacaagcugcucaaggaccuggacgcgaacggcgacgcccagguggacuucuccgaguucaucgucuucguggccgccaucaccagcgccugccacaaguacuucgagaaggcgggccugaaguga

SEQ ID NO: 36013 - RNA, 300 nt, Artificial Sequence
  derived and/or modified sequence opt1 from S100Z__Homo_sapiens__NP_570128
augcccacccagcuggagauggccauggacaccaugauccgcaucuuccaccgguacagcggcaaggagcgcaagcgguucaagcucuccaagggggagcugaagcugcuccugcagcgcgagcugacggaguuccucagcugccagaaggagacccagcugguggacaagaucguccaggaccuggacgccaacaaggacaacgagguggacuucaacgaguucguggucaugguggcggcccucaccguggccugcaacgacuacuucgucgagcagcugaagaagaagggcaaguga

SEQ ID NO: 36014 - RNA, 1062 nt, Artificial Sequence
  derived and/or modified sequence opt1 from S1PR2__Homo_sapiens__NP_004221
augggcagccuguacuccgaguaccucaaccccaacaaggugcaggagcacuacaacuacaccaaggagacccuggagacgcaggagaccaccagccgccaggucgccuccgccuucaucgugauccugugcugcgcgaucguggucgagaaccuccuggugcugaucgccguggcccggaacagcaaguuccacuccgccauguaccucuuccuggggaaccuggccgcgagcgaccuccuggccggcgucgccuucguggccaacacccugcucuccgggagcgugacgcugcgccugaccccgguccagugguucgcgcgggagggcuccgccuucaucacccucagcgccuccguguucagccugcuggccaucgccaucgagcgccacguggcgaucgccaaggucaagcucuacggguccgacaagagcugccggaugcugcugcucaucggcgccuccuggcugaucagccuggugcucggcgggcugcccauccugggcuggaacugccucgggcaccuggaggccugcuccaccgugcugccccucuacgccaagcacuacguccugugcguggugacgaucuucagcaucauccugcucgcgaucgucgcccuguacgugcgcaucuacugcgugguccgguccagccacgccgacauggccgcgccccagacccuggcccuccugaagaccgugaccaucgugcugggcgucuucaucgugugcuggcucccggccuucagcauccugcugcucgacuacgccugccccguccacuccugccccauccuguacaaggcccacuacuucuucgccgugagcacgcugaacucccuccugaaccccgugaucuacaccuggcgcagccgggaccugcgccgggagguccuccgcccgcugcagugcuggcggcccggggugggcgugcagggccgccggcgcgggggcacccccgggcaccaccuccugccccugcgguccagcuccagccuggagcgcggcaugcacaugccgaccucccccacguuccuggagggcaacaccgucguguga

SEQ ID NO: 36015 - RNA, 1137 nt, Artificial Sequence
  derived and/or modified sequence opt1 from S1PR3__Homo_sapiens__NP_005217
auggccaccgcccugcccccgcgccuccagcccgugcggggcaacgagacccugcgcgagcacuaccaguacgucgggaagcuggcgggccggcucaaggaggccagcgagggguccacgcugaccaccgugcuguuccucgugaucugcagcuucaucguccuggagaaccugauggugcucaucgccaucuggaagaacaacaaguuccacaaccgcauguacuucuucaucggcaaccuggcccugugcgaccuccuggccgggaucgcguacaaggugaacauccugauguccggcaagaagaccuucagccucucccccacggucugguuccugcgggagggcagcauguucguggcccugggggccuccacgugcagccuccuggccaucgcgaucgagcgccaccugaccaugaucaagaugcggcccuacgacgccaacaagcgccaccggguguuccuccugaucggcaugugcuggcugaucgccuucacccucggggcccugccgauccugggcuggaacugccuccacaaccugcccgacugcuccaccauccugccccucuacagcaagaaguacaucgccuucugcaucuccaucuucaccgcgauccuggucaccaucgugauccuguacgcccgcaucuacuuccucgucaagagcuccagccggaagguggccaaccacaacaacuccgagcgcagcauggcccugcugcggaccguggugaucgucguguccguguucaucgccugcuggagcccccucuucauccuguuccugaucgacgucgcgugccgcgugcaggccugcccgauccucuucaaggcccagugguucaucgugcuggccguccugaacuccgccaugaaccccgugaucuacacgcucgcgagcaaggagaugcggcgcgccuucuuccggcuggugugcaacugccugguccgcgggcggggcgcccgcgccagccccauccagcccgcccucgacccgucccggagcaaguccagcuccagcaacaacuccagccacucccccaaggugaaggaggaccugccccacaccgcgcccagcuccugcaucauggacaagaacgccgcccugcagaacggcaucuucugcaacuga

SEQ ID NO: 36016 - RNA, 1155 nt, Artificial Sequence
  derived and/or modified sequence opt1 from S1PR4__Homo_sapiens__NP_003766
augaacgccaccggcacccccguggccccggagagcugccagcagcuggcggccgggggccacucccgccucaucguccugcacuacaaccacagcgggcggcuggccggccgcgggggccccgaggacggcgggcucggcgcccugcgggggcuguccguggccgcgagcugccucgugguccuggagaaccugcucgugcuggccgccaucacgucccacaugcgcagccggcgcuggguguacuacugccuggucaacaucacccucuccgaccugcugaccggcgccgcguaccucgccaacgugcugcugagcggggcccggaccuuccgccucgcccccgcccagugguuccugcgggagggccugcuguucacggcgcuggccgccuccaccuucagccuccucuucaccgccggcgagcgcuucgccaccauggugcggcccgucgcggaguccggggccacgaagaccagccgcguguacggcuucaucgggcugugcuggcugcucgccgcccugcugggcaugcucccgcugcugggcuggaacugccucugcgccuucgaccggugcuccagccugcugccccucuacuccaagcgcuacauccuguucugccuggugaucuucgcggggguccucgccaccaucaugggccuguacggggccaucuuccggcuggugcaggccagcggccagaaggccccgcgccccgcggcccggcgcaaggcccggcgccuccugaagaccgugcugaugauccuccuggccuuccuggucugcugggggccccucuucggccugcugcuggcggacguguucggcuccaaccucugggcccaggaguaccugcgggggauggacuggauccuggcccucgccgugcugaacagcgccgucaaccccaucaucuacuccuuccgcagccgcgaggugugccgggcggugcugagcuuccucugcugcggcugccugcgccuggggaugcggggccccggggacugccucgcccgcgccgucgaggcccacuccggcgccagcacgaccgacuccagccugcggccccgcgacuccuuccggggcagccgcucccugagcuuccggaugcgcgagccgcucuccagcaucuccagcgugcgguccaucuga

SEQ ID NO: 36017 - RNA, 1197 nt, Artificial Sequence
  derived and/or modified sequence opt1 from S1PR5__Homo_sapiens__NP_001159687
auggagagcggccugcuccgccccgccccgguguccgaggucaucgugcugcacuacaacuacaccgggaagcugcggggcgcccgcuaccagcccggggcgggccuccgggccgacgccguggucugccuggccgugugcgccuucaucgugcuggagaaccucgcgguccugcuggugcucgggcgccacccccgguuccacgcccccauguuccugcugcucggcagccugacccuguccgaccuccuggccggcgccgcguacgccgccaacauccugcucagcgggccgcugacgcugaagcucucccccgcccugugguucgcccgcgagggcgggguguucgucgcgcugaccgccagcgugcucucccugcuggccaucgcccucgagcggagccugaccauggcccgccggggccccgcgcccguguccagccgcgggcggacccuggccauggccgccgccgcguggggcgucucccuccugcugggccuccugccggcccugggguggaacugccucggccgccuggacgccugcagcacggugcugccccucuacgccaaggccuacgugcuguucugcguccuggcguucguggggauccucgccgccaucugcgcccuguacgcgcggaucuacugccaggugcgcgccaacgcccggcgccugcccgcccggcccggcaccgccggcaccaccuccacgcgcgcgcggcgcaagccgcggagccucgcccugcugcgcacccucuccgucgugcugcuggccuucguggccugcugggggccccuguuccuccugcugcuccuggacgucgccugccccgcgcggaccugccccgugcugcuccaggccgacccguuccugggccuggccauggccaacagccuccugaaccccaucaucuacacccugacgaaccgcgaccuccgccacgcccugcugcggcucgugugcugcgggcgccacuccugcggccgggaccccagcgggucccagcagagcgcgagcgccgccgaggccuccggcggccugcgccggugccugcccccggggcucgacggcagcuucuccgggagcgagcgcuccagcccccagcgggacggccuggacaccuccgggagcaccggcucccccggcgcgcccaccgccgcccgcacgcuggucagcgagccggccgccgacuga

SEQ ID NO: 36018 - RNA, 369 nt, Artificial Sequence
  derived and/or modified sequence opt1 from SAA1__Homo_sapiens__NP_001171477
augaagcugcucaccggccugguguucugcagccugguccucgggguguccagccgcuccuucuucagcuuccugggcgaggccuucgacggggcccgggacauguggcgcgcguacuccgacaugcgggaggccaacuacaucggcagcgacaaguacuuccacgcccgcgggaacuacgacgccgccaagcggggccccggcggggcgugggccgccgaggugaucuccgacgcccgcgagaacauccagcgguucuucggccacggggcggaggacagccuggccgaccaggccgccaacgaguggggccgcuccgggaaggacccgaaccacuuccggcccgccggccuccccgagaaguacuga

SEQ ID NO: 36019 - RNA, 252 nt, Artificial Sequence
  derived and/or modified sequence opt1 from SAA2__Homo_sapiens__NP_001120852
augaagcugcucaccggccugguguucugcagccugguccucuccgugagcucccgcagcuucuucuccuuccugggggaggccuucgacggcgcccgggacauguggcgcgcguacagcgacaugcgggaggccaacuacaucggguccgacaaguacuuccacgcccgcggcaacuacgacgccgccaagcgggggcccggcggcgcgugggccgccgaggugaucagccuguucuccgccgagcucuga

SEQ ID NO: 36020 - RNA, 393 nt, Artificial Sequence
  derived and/or modified sequence opt1 from SAA4__Homo_sapiens__NP_006503
augcgccuguucaccggcaucguguucugcagccucgucaugggggugaccuccgagagcuggcgguccuucuucaaggaggcccugcagggcgugggggacaugggccgcgccuacugggacaucaugaucagcaaccaccagaacuccaaccgguaccuguacgcgcgcgggaacuacgacgccgcccagcggggccccggcggggucugggccgccaagcucaucagccgcucccggguguaccugcagggccugaucgacugcuaccucuucgggaacagcuccacggugcuggaggacagcaaguccaacgagaaggcggaggaguggggccgcagcgggaaggacccggaccgguuccgccccgacggccugcccaagaaguacuga

SEQ ID NO: 36021 - RNA, 1425 nt, Artificial Sequence
  derived and/or modified sequence opt1 from SAAL1__Homo_sapiens__NP_612430
auggaccgcaaccccagcccgcccccgcccggccgggacaaggaggaggaggaggagguggccgggggcgacugcaucggguccaccgucuacagcaagcacuggcuguucggcgugcucuccgggcugauccagaucgugagccccgagaacaccaaguccagcuccgacgacgaggagcagcugacggagcucgacgaggagauggagaacgagaucugccgcgucugggacaugagcauggacgaggacguggcccuguuccugcaggaguucaacgcgcccgacaucuucaugggcgugcucgccaaguccaagugcccccggcugcgcgagaucugcgucggcauccuggggaacauggccugcuuccaggagaucugcgugagcaucuccagcgacaagaaccucggccaggugcugcugcacugccucuacgacuccgacccgcccacccugcuggagaccagccggcuccugcugaccugccucucccaggccgaggucgccagcguguggguggagcgcauccaggagcaccccgcgaucuacgacuccaucugcuucaucaugagcuccagcacgaacgucgaccugcuggugaaggugggggaggucguggacaagcuguucgaccuggacgagaagcugaugcucgagugggugcggaacggcgccgcccagccccuggaccagccccaggaggagagcgaggagcagccggucuuccgccuggugcccugcauccucgaggccgcgaagcagguccgguccgagaaccccgaguggcuggacguguacaugcacauccugcagcuccugaccaccguggacgacgggauccaggccaucgugcacugccccgacaccggcaaggacaucuggaaccuccucuucgaccuggucugccacgaguucugccagagcgacgacccgcccaucauccugcaggagcagaagacggugcucgccuccgucuucagcgugcuguccgccaucuacgccagccagaccgagcaggaguaccugaagaucgagaagguggaccucccccugaucgacucccugauccgcguccuccagaacauggagcagugccagaagaagcccgagaacagcgcggaguccaacaccgaggagaccaagcggacggaccugacccaggacgacuuccaccugaagauccucaaggacauccugugcgaguuccugagcaacaucuuccaggcccucaccaaggagaccguggcccagggcgugaaggaggggcagcuguccaagcagaagugcagcuccgccuuccagaaccugcugccguucuacagccccgucguggaggacuucaucaagauccuccgcgagguggacaaggcccuggcggacgaccuggagaagaacuuccccucccucaagguccagacguga

SEQ ID NO: 36022 - RNA, 1077 nt, Artificial Sequence
  derived and/or modified sequence opt1 from SAC3D1__Homo_sapiens__NP_037431
augcccggcugcgagcugccgguggggaccugccccgacaugugccccgccgccgagcgcgcgcagcgggagcgcgagcaccggcuccaccgccuggaggucgugcccggcugccggcaggacccgccccgcgccgacccccagcgggccgugaaggaguacagccgccccgccgccgggaagccgcggcccccgcccucccagcugcgcccgcccagcguccuccuggcgaccgugcgguaccuggccggcgagguggccgaguccgccgacaucgcgcgcgccgaggucgccagcuucguggccgaccggcuccgcgccgugcugcuggaccucgcgcugcagggggccggcgacgccgaggccgccgucgugcuggaggcggcccucgccacccugcugaccguggucgcccggcucggccccgacgccgcgcgcgggcccgccgaccccgugcugcugcaggcccaggugcaggagggcuucgggucccuccggcgcugcuacgcccggggcgccgggccccacccccgccagcccgcguuccagggccuguuccugcucuacaaccugggcagcgucgaggcccugcacgaggugcuccagcugccggccgcccugcgggcgugcccgccccuccgcaaggcccuggccguggacgccgccuuccgcgaggggaacgcggcccggcuguuccgccuccugcagacccugcccuaccuccccuccugcgccguccagugccacgugggccacgcccggcgcgaggcccuggcgcgguucgcccgcgccuucagcacccccaaggggcagacgcugccccucggcuucauggugaaccugcuggcccucgacggccugcgggaggcccgcgaccugugccaggcgcacgggcucccccuggacggcgaggagcgggucguguuccugcgcgggcgguacguggaggagggccucccgcccgccuccacgugcaagguccugguggagagcaagcugcgcgggcggacccucgaggaggucgugauggccgaggaggaggacgagggcaccgaccgccccggcuccccggccuga

SEQ ID NO: 36023 - RNA, 1764 nt, Artificial Sequence
  derived and/or modified sequence opt1 from SACM1L__Homo_sapiens__NP_054735
auggccaccgccgccuacgagcagcugaagcuccacaucacccccgagaaguucuacguggaggccugcgacgacggcgccgacgacguccugacgaucgaccgcgugagcaccgaggugacccuggccgucaagaaggacgugccgcccuccgccgugacccggcccaucuucgggauccucggcacgauccaccuggucgcggggaacuaccugaucgugaucaccaagaagaucaaggugggcgaguucuucagccacgucguguggaaggccaccgacuucgacgugcucuccuacaagaagaccaugcugcaccugacggacauccagcuccaggacaacaagaccuuccuggccaugcugaaccacguccucaacguggacggguucuacuucagcaccaccuacgaccugacgcacacccugcagcgccucuccaacaccagccccgaguuccaggagaugucccugcuggagcgggccgaccagcgcuucguguggaacggccaccuccugcgggagcugagcgcgcagccggagguccaccgcuucgcccuccccgugcugcacggcuucaucaccaugcacuccugcagcaucaacgggaaguacuucgacuggauccugaucucccggcgcagcugcuuccgggccggcgugcgcuacuacguccgggggaucgacuccgagggccacgccgccaacuucguggagacggagcagaucgugcacuacaacgggagcaaggcguccuucguccagacccgcggcagcauccccguguucuggucccagcggcccaaccucaaguacaagccgcugccccagaucagcaagguggccaaccacauggacggcuuccagcgccacuucgacucccaggucaucaucuacgggaagcaggucaucaucaaccugaucaaccagaagggcagcgagaagccccucgagcagaccuucgccaccauggugagcucccuggggagcggcaugaugcgguacaucgccuucgacuuccacaaggagugcaagaacaugcgcugggaccggcuguccauccuccuggaccagguggccgagaugcaggacgagcugagcuacuuccucguggacuccgcgggccaggucguggccaaccaggaggggguguuccgcagcaacugcauggacugccuggaccggacgaacgucauccagucccugcucgcccgccggagccugcaggcccagcugcagcgccucggcgugcugcacguggggcagaagcuggaggagcaggacgaguucgagaagaucuacaagaacgccugggcggacaacgccaacgccugcgccaagcaguacgccggcaccggggcgcucaagaccgacuucacccgcacgggcaagcggacccaccugggccugaucauggacggguggaacuccaugauccgcuacuacaagaacaacuucagcgacggcuuccggcaggacuccaucgaccucuuccuggggaacuacagcgucgacgagcuggagucccacagcccccucuccgugccgcgcgacuggaaguuccuggcccugcccaucaucaugguggucgccuucagcaugugcaucaucugccugcucauggccggcgacaccuggaccgagacgcuggcguacgugcuguucuggggcguggccuccaucgggaccuucuucaucauccucuacaacggcaaggacuucgucgacgcgccccggcuggugcagaaggagaagaucgacuga

SEQ ID NO: 36024 - RNA, 13299 nt, Artificial Sequence
  derived and/or modified sequence opt1 from SACS__Homo_sapiens__NP_001264984
auggcccccuaccagggcccggcccuguacguguacaacaacgcggucuucacccccgaggacuggcacgggauccaggagaucgcccggagccggaagaaggacgacccccugaaggugggccgguucgggaucggcuucaacuccguguaccacaucaccgacguccccugcaucuucagcggggaccagaucggcaugcuggacccccaccagacccuguucggcccccacgaguccgggcagugcuggaaccugaaggacgacagcaaggagaucuccgagcugagcgaccaguucgcccccuucgugggcaucuucggguccaccaaggagaccuucaucaacggcaacuuccccgggaccuucuuccgguucccgcugcgccugcagcccagccagcuguccagcaaccuguacaacaagcagaaggugcucgagcuguucgaguccuuccgggccgacgccgacaccguccuccuguuccucaaguccgugcaggacgugucccuguacguccgcgaggcggacggcaccgagaagcucguguuccgggugaccagcuccgagagcaaggcccugaagcacgagcgccccaacuccaucaagauccugggcaccgccaucagcaacuacugcaagaagacccccuccaacaacaucacgugcgucaccuaccacgugaacaucgugcucgaggaggagagcaccaaggacgcccagaagaccagcuggcuggucugcaacuccgucgggggccgggggaucagcuccaagcuggacagccucgcggacgagcugaaguucgugccgaucaucggcaucgccaugccccuguccagccgcgacgacgaggccaagggcgccaccuccgacuucagcgggaaggccuucugcuuccucccccugcccccgggcgaggaguccagcaccgggcugcccguccacaucuccggcuucuucgggcucaccgacaaccggcgcagcaucaaguggcgggagcuggaccaguggcgcgaccccgcggcccuguggaacgaguuccucgugaugaacgugguccccaaggccuacgccacgcugauccuggacuccaucaagcggcucgagauggagaaguccuccgacuucccgcugagcguggacgugaucuacaagcuguggcccgaggccuccaaggucaaggugcacuggcagcccguccucgagccccuguucagcgagcugcuccagaacgcggugaucuacuccaucagcugcgacugggugcgccuggagcaggucuacuucagcgagcuggacgagaaccucgaguacaccaagaccgugcugaacuaccugcaguccagcggcaagcagaucgccaaggugccgggcaacgucgacgccgccgugcagcucaccgccgcguccgggacgacccccgugcggaaggucacccccgccugggugcgccaggugcugcggaagugcgcccaccugggcugcgccgaggagaagcuccaccuccucgaguucguccugagcgaccaggccuacuccgagcuccuggggcuggagcuccugccccugcagaacggcaacuucgugccguucagcuccagcguguccgaccaggacgucaucuacaucaccagcgcggaguacccccgcucccucuuccccagccuggaggggcgguucauccuggacaaccucaagccgcaccugguggccgcccugaaggaggccgcgcagacgcgcggccgccccugcacccagcuccagcugcugaaccccgagcgguucgcccgccucaucaaggaggugaugaacaccuucuggcccggccgggagcugaucguccagugguacccguucgacgagaaccgcaaccaccccuccgugagcuggcugaagaugguguggaagaaccucuacauccacuucuccgaggaccugacccuguucgacgagaugccccucaucccccggacgauccuggaggaggggcagaccugcgucgagcugauccgccuccggaucccgagccuggugauccuggacgacgaguccgaggcccagcuccccgaguuccuggccgacaucgugcagaagcugggcggguucguccucaagaagcuggacgccagcauccagcacccccugaucaagaaguacauccacagcccccucccguccgcggugcugcagaucauggagaagaugccccugcagaagcucugcaaccagaucaccagccugcugcccacccacaaggacgcccuccgcaaguuccuggccucccugacggacagcuccgagaaggagaagcggaucauccaggagcucgccaucuucaagcgcaucaaccacagcuccgaccagggcaucagcuccuacaccaagcugaaggggugcaaggugcugcaccacaccgccaagcuccccgcggaccugcggcugagcaucuccgucaucgacagcuccgacgaggccaccauccgccucgccaacaugcugaagaucgagcagcugaagacgaccagcugccucaagcuggugcugaaggacaucgagaacgccuucuacucccacgaggaggugacccagcucaugcuguggguccuggagaaccucagcucccugaagaacgagaacccgaacgugcuggaguggcucacgccccucaaguucauccagaucagccaggagcagaugguguccgccggcgagcuguucgaccccgacaucgagguccucaaggaccuguucugcaacgaggagggcaccuacuucccgcccagcguguucacgagccccgacauccugcacucccuccggcagaucgggcugaagaacgaggcgagccugaaggagaaggacgugguccagguggccaagaagaucgaggcccuccaggugggcgccugccccgaccaggacguccugcugaagaaggcgaagacccuccugcuggugcucaacaagaaccacacccugcugcaguccagcgaggggaagaugacccucaagaagaucaagugggugcccgccugcaaggagcgcccgcccaacuaccccggcucccuggucuggaagggcgaccugugcaaccucugcgccccgcccgacaugugcgacguggggcacgccauccugaucggcagcucccugccccucguggagagcauccacgucaaccuggagaaggcccuggggaucuucacgaagcccucccucagcgcggugcugaagcacuucaagaucguggucgacugguacuccagcaagaccuucuccgacgaggacuacuaccaguuccagcacauccugcucgagaucuacggcuucaugcacgaccaccugaacgaggggaaggacagcuuccgggcccugaaguucccguggguguggaccggcaagaaguucugcccccucgcccaggccgugaucaagcccauccacgaccuggaccugcagcccuaccugcacaacgucccgaagaccauggccaaguuccaccagcuguucaaggugugcggcuccaucgaggagcugacgagcgaccacaucuccauggucauccagaagaucuaccucaagagcgaccaggaccucuccgagcaggagagcaagcagaaccugcaccugaugcucaacaucauccgcuggcuguacagcaaccagauccccgcgucccccaacacccccgugccgauccaccacagcaagaaccccuccaagcugaucaugaagcccauccacgagugcugcuacugcgacaucaagguggacgaccucaacgaccugcuggaggacagcgucgagcccaucauccucgugcacgaggacaucccgaugaagaccgccgaguggcugaaggugcccugccuguccacccggcucaucaaccccgagaacaugggguucgagcagagcggccagcgcgagccccugacgguccggaucaagaacauccuggaggaguacccguccgugagcgacaucuucaaggagcuccugcagaacgccgacgacgccaacgccaccgagugcuccuuccugaucgacaugcgccgcaacauggacauccgggagaaccuccuggaccccgggauggcggccugccacggccccgcccuguggagcuucaacaacucccaguucagcgacuccgacuucgugaacaucacccgccucggggagagccugaagcggggcgaggucgacaaggugggcaaguucgggcugggcuucaacuccguguaccacaucaccgacauccccaucaucaugagccgcgaguucaugaucauguucgacccgaacaucaaccacaucuccaagcacaucaaggacaagagcaaccccgggaucaagaucaacugguccaagcagcagaagcggcuccgcaaguuccccaaccaguucaagcccuucaucgacgucuucggcugccagcugccgcugacgguggaggcccccuacagcuacaacgggacccucuuccggcugagcuuccgcacccagcaggaggcgaagguguccgaggucagcagcacgugcuacaacaccgccgacaucuacagccugguggacgaguucucccucugcggccaccggcugaucaucuucacccagagcgugaaguccauguaccugaaguaccucaagaucgaggagaccaaccccagccuggcccaggacaccgucaucaucaagaagaaguccugcagcuccaaggcccugaacacgccggugcucagcgugcugaaggaggccgcgaagcugaugaagaccugcuccagcuccaacaagaagcuccccagcgacgagcccaaguccagcugcauccugcagaucaccgucgaggaguuccaccacguguuccgccggaucgccgaccugcagagcccccuguuccgcggcccggacgacgaccccgccgcccuguucgagauggccaagagcgggcagagcaagaagcccuccgacgagcugagccagaagaccguggagugcacgaccuggcuccugugcacgugcauggacaccggcgaggcgcugaaguucucccucagcgaguccgggcggcgccugggccugguccccugcggggccgugggcgugcagcucagcgagauccaggaccagaaguggacggucaagccgcacaucggcgagguguucugcuaccugccccugcggaucaagaccgggcuccccgugcacaucaacggcugcuucgccgucaccuccaaccgcaaggagaucuggaagaccgacacgaaggggcgguggaacaccaccuucaugcgccacgugaucgugaaggccuaccugcagguccugagcgugcuccgggaccuggccaccuccggcgagcugauggacuacaccuacuacgcgguguggcccgacccggaccucguccacgacgacuucagcgugaucugccagggcuucuacgaggacaucgcccacgggaagggcaaggagcugacgaagguguucuccgacgggagcaccugggucuccaugaagaacgugcgcuuccuggacgacagcauccucaagcggcgcgacgugggcuccgccgccuucaagaucuuccugaaguaccugaagaagaccgggagcaagaaccucugcgccgucgagcugcccuccagcgugaagcugggcuucgaggaggcgggcugcaagcagauccuccuggagaacaccuucuccgagaagcaguucuucagcgagguguucuuccccaacauccaggagaucgaggccgagcugcgcgacccccucaugaucuucguccugaacgagaagguggacgaguucagcggggugcugcgggucacgccgugcauccccugcucccucgagggccacccccuggugcugcccagccgccucauccacccggaggggcggguggccaagcuguucgacaucaaggacggccgcuuccccuacggguccacccaggacuaccugaaccccaucauccucaucaagcugguccagcugggcauggccaaggacgacauccucugggacgacaugcuggagcgggcggugagcgucgccgagaucaacaaguccgaccacguggccgccugccugcgcagcuccauccuccugagccugaucgacgagaagcucaagauccgggacccccgcgccaaggacuucgcggccaaguaccagaccauccgguuccugccguuccugaccaagcccgccggcuucucccucgacuggaaggggaacagcuucaagcccgagacgauguucgccgccaccgaccuguacaccgcggagcaccaggacaucgugugccugcuccagcccauccugaacgagaacucccacagcuuccgcggcugcggguccgucagccuggccgugaaggaguuccugggccuccugaagaagccgaccguggaccuggucaucaaccagcucaaggagguggccaaguccguggacgacgggaucacgcuguaccaggagaacaucaccaacgccugcuacaaguaccugcacgaggcccucaugcagaacgagaucaccaagaugagcaucaucgacaagcugaagcccuucuccuucauccuggucgagaacgcguacguggacagcgagaaggugagcuuccaccucaacuucgaggccgcccccuaccuguaccagcugccgaacaaguacaagaacaacuuccgggagcuguucgagaccgucggcgugcgccaguccugcacgguggaggacuucgcccugguccuggagagcaucgaccaggagcggggcaccaagcagaucaccgaggagaacuuccagcucugccgccggaucaucuccgaggggaucuggagccugauccgcgagaagaagcaggaguucugcgagaagaacuacggcaagauccugcuccccgacaccaaccugaugcugcuccccgcgaagucccugugcuacaacgacugccccuggaucaaggugaaggacacgaccgugaaguacugccacgccgacaucccgcgggaggucgccgugaagcugggggccgugcccaagcgccacaaggcccucgagcgguacgcgagcaacgucugcuucaccacccugggcacggaguucggccagaaggagaagcugaccucccgcaucaagagcauccucaacgccuaccccuccgagaaggagaugcugaaggagcugcuccagaacgccgacgacgccaaggccaccgagaucugcuucguguucgacccccgccagcacccgguggaccggaucuucgacgacaagugggcgccccugcaggggcccgcccugugcgucuacaacaaccagcccuucaccgaggacgacgugcgcggcauccagaaccucgggaagggcacgaaggaggggaacccguacaagaccggccaguacggcaucggguucaacagcguguaccacaucaccgacugccccuccuucaucagcggcaacgacauccugugcaucuucgacccccacgcccgguacgcccccggggccaccuccaucagcccgggccgcauguuccgggaccuggacgcggacuuccgcacgcaguucuccgacguccucgaccuguaccuggggacccacuucaagcucgacaacugcaccauguuccgguucccccugcgcaacgccgagauggccaaggugagcgagaucuccagcgugcccgccuccgaccggaugguccagaaccugcucgacaagcugcgcagcgacggcgcggagcugcucauguuccugaaccacauggagaagaucagcaucugcgagaucgacaaguccaccggcgcccugaacgugcucuacagcgugaaggggaagaucacggacggcgaccggcugaagcgcaagcaguuccacgccuccgucaucgacagcgugaccaagaagcggcagcugaaggacauccccgugcagcagaucaccuacaccauggacaccgaggacuccgaggggaaccucacgaccuggcugaucugcaaccgcagcggcuucuccagcauggagaaggucuccaagagcgugaucuccgcccacaagaaccaggacaucacccuguucccgcgcgggggcguggccgcgugcaucacccacaacuacaagaagccccaccgcgccuucugcuuccucccccugagccuggagacgggccuccccuuccacgucaacgggcacuucgcccuggacuccgcccggcgcaaccuguggcgggacgacaacggcgugggggugcgcagcgacuggaacaacucccucaugaccgcccugaucgcgccggccuacgucgagcugcucauccagcugaagaagcgguacuuccccggcagcgaccccacccuguccgugcuccagaacaccccgauccacguggucaaggacacgcugaagaaguuccugagcuucuuccccgugaaccgccucgaccugcagcccgaccuguacugccucgugaaggcccuguacaacugcauccacgaggacaugaagcgccugcuccccgucgugcgggccccgaacaucgacggguccgaccugcacagcgccgugaucaucaccuggaucaacaugagcaccuccaacaagacccgccccuucuucgacaaccugcuccaggacgagcugcagcaccugaagaacgcggacuacaacaucacgacccggaagaccgucgccgagaacguguaccgccucaagcaccuccugcucgagaucggcuucaaccuggucuacaacugcgacgagaccgccaaccuguaccacugccucaucgacgccgacauccccgugagcuacgugacgcccgccgacauccgguccuuccugaugaccuucagcuccccggacaccaacugccacaucggcaagcugcccugccgccuccagcagaccaaccugaagcuguuccacagccucaagcugcuggucgacuacugcuucaaggacgcggaggagaacgagaucgagguggaggggcucccccugcugaucacgcuggacuccgugcuccagaccuucgacgccaagcggcccaaguuccugaccaccuaccacgagcugaucccgagccgcaaggaccucuucaugaacacgcuguaccugaaguacuccaacauccuccugaacugcaaggucgccaagguguucgacaucagcuccuucgccgaccugcucagcuccgugcugccccgggaguacaagaccaagagcugcaccaaguggaaggacaacuucgcguccgagagcuggcugaagaacgccuggcacuucaucuccgagagcgucuccgugaaggaggaccaggaggagaccaagcccacguucgacaucguggucgacacccucaaggacugggcccugcugcccggcaccaaguucaccgugagcgccaaccagcucguggucccggagggggacgugcugcugccccucagccugaugcacaucgccguguuccccaacgcgcaguccgacaaggucuuccacgcccugaugaaggccggcugcauccagcucgcccugaacaagaucugcagcaaggacuccgccuucgugccccugcucagcugccacacggcgaacaucgaguccccgaccagcauccugaaggcccugcacuacauggugcagaccuccaccuuccgcgccgagaagcucgucgagaacgacuucgaggcccugcugauguacuucaacugcaaccucaaccaccugaugagccaggacgacaucaagauccugaagucccuccccugcuacaagagcaucuccggccgguacgugagcaucgggaaguucggcacgugcuacgugcugaccaaguccauccccagcgccgaggucgagaaguggacccaguccagcuccagcgcguuccuggaggagaagauccaccucaaggagcuguacgaggugaucgggugcgugcccgucgacgaccuggagguguaccucaagcaccuccugccgaagaucgagaaccucuccuacgacgccaagcuggagcaccugaucuaccucaagaaccgccugagcagcgccgaggagcuguccgagaucaaggagcagcuguucgagaagcuggagagccugcucaucauccacgacgccaacucccggcugaagcaggcgaagcacuucuacgaccgcaccgugcgggucuucgaggugaugcugcccgagaagcuguucauccccaacgacuucuucaagaagcuggagcagcugaucaagcccaagaaccacgugacguucaugaccagcugggucgaguuccuccgcaacaucggccugaaguacauccugucccagcagcagcuccugcaguucgccaaggagaucagcgugcgggccaacaccgagaacugguccaaggagacccugcagaacaccguggacauccuccugcaccacaucuuccaggagcgcauggaccugcucagcgggaacuuccugaaggagcugucccucaucccguuccugugccccgagcgggcccccgccgaguucauccgcuuccacccgcaguaccaggaggucaacggcacgcugccccucaucaaguucaacggcgcccaggugaaccccaaguucaagcagugcgacgugcugcagcugcucuggaccagcugccccauccugccggagaaggccacgccccuguccaucaaggagcaggaggggagcgaccucggcccccaggagcagcuggagcagguccugaacaugcucaacgugaaccuggacccgccccuggacaaggugaucaacaacugccgcaacaucugcaacaucaccacgcucgacgaggagauggucaagacccgggccaaggugcugcgcuccaucuacgaguuccugagcgccgagaagcgggaguuccgcuuccagcuccgcgggguggccuucgucaugguggaggacggcuggaagcugcugaagcccgaggagguggucaucaaccucgaguacgaguccgacuucaagcccuaccuguacaagcugccccucgagcuggggaccuuccaccagcuguucaagcaccugggcaccgaggacaucaucagcacgaagcaguacguggaggugcucucccgcaucuucaagaacagcgagggcaagcagcuggacccgaacgagaugcggaccgucaagcgcguggucuccgggcuguuccggagccuccagaacgacagcgugaaggugcgcuccgaccuggagaacguccgggaccuggcgcucuaccugcccagccaggacggccgccuggugaaguccagcauccucguguucgacgacgcgccccacuacaagucccggauccaggggaacaucggcguccagaugcugguggaccugagccagugcuaccucgggaaggaccacggcuuccacaccaagcugaucaugcuguucccccagaagcuccgcccgcggcugcuguccagcauccucgaggagcagcuggacgaggagacccccaaggugugccaguucggcgcccugugcucccuccaggggcgccugcagcugcuccugagcuccgagcaguucaucacgggccugauccggaucaugaagcacgagaacgacaacgccuuccucgccaacgaggagaaggcgauccgccugugcaaggcccugcgggaggggcucaaggucagcugcuucgagaagcugcagaccacccugcgcgugaagggcuucaaccccaucccccacucccggagcgagaccuucgccuuccucaagcgcuucgggaacgccgugauccugcuguacauccagcacuccgacagcaaggacaucaacuuccuccuggcgcuggccaugacgcucaaguccgccaccgacaaccugaucagcgacaccagcuaccugaucgccaugcucggcugcaacgacaucuaccgcaucggcgagaagcuggacucccugggggucaaguacgacagcuccgagccgagcaagcucgagcugcccaugcccggcacccccaucccggccgagauccacuacacgcugcucauggaccccaugaacguguucuaccccggggaguacgugggcuaccuggucgacgcggagggcggggacaucuacggcuccuaccagcccaccuacaccuacgccaucaucgugcaggagguggagcgggaggacgccgacaacagcuccuuccuggggaagaucuaccagaucgacaucggcuacagcgaguacaagaucgucuccagccucgaccuguacaaguucucccgcccggaggagagcucccagagccgggacuccgcccccagcacccccacguccccgaccgaguuccugacccccgggcuccgcagcaucccgccccuguucuccggccgggagagccacaagaccagcuccaagcaccagagcccgaagaagcugaaggugaacucccuccccgagauccugaaggaggugacgagcgucguggagcaggccuggaagcugcccgaguccgagcgcaagaagaucauccggcgccucuaccugaaguggcaccccgacaagaacccggagaaccacgacaucgcgaacgagguguucaagcaccuccagaacgagaucaaccggcucgagaagcaggccuuccuggaccagaacgccgaccgcgccagccggcgcaccuucuccaccagcgccucccgguuccagagcgacaaguacuccuuccagcgcuucuacaccagcuggaaccaggaggcgacgucccacaagagcgagcggcagcagcagaacaaggagaagugcccgcccuccgccggccagaccuacagccagcgcuucuucgugccgcccaccuucaaguccguggggaaccccguggaggcccggcgcuggcugcggcaggcccgcgccaacuucagcgcggcccgcaacgaccuccacaagaacgccaacgagugggucugcuucaagugcuaccuguccaccaagcuggcccucaucgcggccgacuacgccgugcggggcaagagcgacaaggacgugaagcccacggcccuggcccagaagaucgaggaguacagccagcagcuggaggggcucaccaacgacguccacacccuggaggcguacggcguggacucccugaagacccgcuaccccgaccuccugcccuucccccagauccccaacgaccgguucaccagcgagguggccaugcgcgucauggagugcacggccugcaucaucaucaagcuggagaacuucaugcagcagaagguguga

SEQ ID NO: 36025 - RNA, 900 nt, Artificial Sequence
  derived and/or modified sequence opt1 from SAE1__Homo_sapiens__NP_001139185
augguggagaaggaggaggccggcgggggcaucagcgaggaggaggccgcgcaguacgaccgccagauccggcugugggggcucgaggcccagaagcgccugcgggccucccgcguccugcucgugggccugaaggggcugggcgccgagaucgccaagaaccucauccuggcgggcgugaaggggcugaccaugcucgaccacgagcaggucacccccgaggacccgggcgcccaguuccugauccggacggggagcgugggccgcaaccgggccgaggccucccuggagcgcgcgcagaaccucaaccccaugguggacgucaagguggacaccgaggacaucgagaagaagcccgagagcuucuucacccaguucgacgccgugugccugaccugcugcucccgggacgucaucgugaagguggaccagaucugccacaagaacagcaucaaguucuucacgggggacgucuucggcuaccacggcuacaccuucgccaaccugggggagcacgaguucguggaggagaagaccaagguggccaaggucucccagggcguggaggacgggcccgacaccaagcgcgccaagcucgacagcuccgagacgaccauggugaagaagaaggucguguucugcccggugaaggaggcgcuggaggucgacuggagcuccgagaaggccaaggccgcccugaagcggaccaccagcgacuacuuccuccugcagggccccguguccgccggccccagcucccagcagcugcuccugcugcgcuggcacgagggggagugggacugcggcgugcccuggccgcaggucaacagccgguucgggagcccccgcgacgcgaacugcuccaugcccacgugcauccccugcccgcuccccuccuga

SEQ ID NO: 36026 - RNA, 2862 nt, Artificial Sequence
  derived and/or modified sequence opt1 from SAFB2__Homo_sapiens__NP_055464
auggccgagacccugcccggcagcggggacuccggccccgggaccgccagccucggccccgggguggcggagacgggcacccgccggcuguccgagcugcgcgucaucgaccuccgggccgagcugaagaagcgcaaccuggacaccggcgggaacaagagcgugcucauggagcggcugaagaaggccgugaaggaggagggccaggaccccgacgagaucgggaucgagcuggaggccaccuccaagaaguccgccaagcgcugcgucaagggccucaagauggaggaggaggggacggaggacaacggccuggaggacgacagccgggacggccaggaggacauggaggcgagccuggagaaccuccagaacauggggaugauggacauguccgugcuggacgagaccgagguggccaacagcuccgcccccgacuucggcgaggacgggaccgacggccugcucgacagcuucugcgacuccaaggaguacgucgccgcgcagcugcgccagcugcccgcccagccgcccgagcacgccguggacggcgagggguucaagaacacccucgagacgagcucccugaacuucaaggugacccccgacaucgaggagagccugcucgagcccgagaacgagaagauccuggacauccugggcgagaccugcaaguccgagcccgucaaggaggagagcuccgagcucgagcagcccuucgcccaggacaccagcagcguggggcccgaccggaagcuggccgaggaggaggaccuguucgacuccgcgcacccggaggagggcgaccucgaccuggccagcgaguccacggcccacgcccagagcuccaaggccgacagccugcucgcgguggucaagcgcgagcccgccgagcagcccggggacggcgagcggaccgacugcgagcccgugggccuggagccggccguggagcaguccagcgccgccuccgagcuggcggaggccagcuccgaggagcucgccgaggcccccaccgaggcccccagccccgaggcgcgcgacuccaaggaggacgggcggaaguucgacuucgacgccugcaacgaggucccgcccgcccccaaggagagcuccaccagcgagggcgccgaccagaagauguccagcuucaaggaggagaaggacaucaagcccaucaucaaggacgagaaggggcgcgugggcuccgggagcggccggaaccugugggugagcggccuguccagcacgacccgcgcgaccgaccucaagaaccuguucuccaaguacgggaaggucgugggcgccaagguggucaccaacgcccggagcccgggggcccgcugcuacggcuucgugacgauguccaccagcgacgaggccaccaagugcaucucccaccuccaccggaccgagcugcacgggcgcaugaucagcguggagaaggcgaagaacgagcccgccggcaagaagcuguccgaccggaaggagugcgaggucaagaaggagaagcugagcuccguggaccgccaccacagcgucgagaucaagaucgagaagacggugaucaagaaggaggagaagaucgagaagaaggaggagaagaagcccgaggacaucaagaaggaggagaaggaccaggacgagcucaagcccggcccgaccaaccgcucccgggugaccaagagcgggucccgcggcauggagcggaccgucgugauggacaagagcaagggggagcccgugaucuccgucaagacgaccagccgcagcaaggagcgguccagcaagucccaggaccgcaagagcgaguccaaggagaagcgggacauccugagcuucgacaagaucaaggagcagcgcgagcgggagcgccagcggcagcgcgagcgggagauccgcgagaccgagcggcgccgggagcgcgagcagcgggagcgcgagcagcgccuggaggccuuccacgagcggaaggagaaggcccgccuccagcgggagcgccugcagcuggagugccagcggcagcgccucgagcgggagcgcauggagcgggagcgccuggagcgggagcgcaugcggguggagcgcgagcggcgcaaggagcaggagcggauccaccgcgagcgggaggagcugcgccggcagcaggagcagcugcgcuacgagcaggagcgccggcccggccgccggccguacgaccucgaccgccgggacgacgccuacuggcccgagggcaagcgcguggcgauggaggaccgguaccgcgccgacuucccccggcccgaccaccgcuuccacgacuucgaccaccgggaccgcgggcaguaccaggaccacgccaucgaccggcgcgagggcucccggccgaugaugggggaccaccgcgacggccagcacuacggggacgaccggcacggccacggcgggccgcccgagcgccacggccgggacagccgcgacggguggggcggguacggcuccgacaagcgccugagcgagggccgggggcugccgccgccgccccgcggcgggcgggacuggggcgagcacaaccagcgccucgaggagcaccaggcccgggccuggcagggggcgauggacgccggcgccgccucccgcgagcacgcgcgguggcagggcggggagcgcggccugagcgggcccuccggccccgggcacauggccagccggggcggcgucgccgggcgcggcggguucgcccagggcggccacucccaggggcacguggugcccggcgggggccuggagggcgggggcgucgccagccaggaccgggggucccgcgugccccacccccacccccacccgccgcccuacccccacuucacccggcgcuacuga

SEQ ID NO: 36027 - RNA, 2754 nt, Artificial Sequence
  derived and/or modified sequence opt1 from SAFB__Homo_sapiens__NP_001188267
auggccgagacccugagcggccucggggacuccggcgccgcgggggccgccgcccugagcuccgccagcuccgagaccggcacgcgccggcugagcgaccuccgcgugaucgaccugcgggcggagcugcgcaagcggaacgucgacuccagcgggaacaaguccgugcucauggagcgccugaagaaggccaucgaggacgagggcggcaaccccgacgagaucgagaucaccagcgaggggaacaagaagaccuccaagcggagcuccaagggccgcaagccggaggaggaggggguggaggacaacggccuggaggagaacagcggggacggccaggaggacgucgagaccucccucgagaaccugcaggacaucgacaucauggacaucagcgugcuggacgaggccgagaucgacaacggcuccguggccgacugcgucgaggacgacgacgcggacaaccuccaggagagccuguccgacagccgggagcugguggagggggagaugaaggagcuccccgagcagcugcaggagcacgccaucgaggacaaggagacgaucaacaaccuggacaccagcuccagcgacuucaccauccuccaggagaucgaggagcccucccuggagcccgagaacgagaagauccuggacauccucggcgagaccugcaagagcgagccggugaaggaggaguccagcgagcuggagcagcccuucgcccaggacacguccagcgucgggcccgaccgcaagcuggccgaggaggaggaccucuucgacuccgcccaccccgaggagggcgaccuggaccuggcgagcgaguccaccgcccacgcccagagcuccaaggccgacagccuccuggccguggugaagcgggagccggcggagcagcccggcgacggggagcgcaccgacugcgagcccgucggccuggagcccgccguggagcaguccagcgccgccuccgagcucgccgaggcgagcuccgaggagcuggccgaggccccgaccgaggcccccagccccgaggcccgggacagcaaggaggacgggcgcaaguucgacuucgacgcgugcaacgaggugcccccggcccccaaggaguccagcacguccgagggcgccgaccagaagaugagcucccccgaggacgacagcgacaccaagcggcuguccaaggaggagaaggggcgcagcuccugcggccggaacuucugggucagcggccucuccagcaccacccgcgccacggaccugaagaaccuguucuccaaguacgggaagguggugggcgcgaaggucgugaccaacgcccggagccccggggcccgcugcuacggcuucgugaccauguccaccgccgaggaggccacgaagugcaucaaccaccuccacaagaccgagcugcacgggaagaugaucagcgucgagaaggcgaagaacgagccggugggcaagaagaccuccgacaagcgggacagcgacggcaagaaggagaaguccagcaacagcgaccgcuccaccaaccugaagcgcgacgacaagugcgaccggaaggacgacgccaagaagggggacgacggcagcggggagaaguccaaggaccaggacgaccagaagcccggccccagcgagcgcucccgggccaccaagagcgggucccgcggcacggagcggaccguggucauggacaagagcaagggcgugcccgucaucuccgugaagaccagcggguccaaggagcgcgccagcaagucccaggaccgcaagagcgccucccgggagaagcggagcguggucuccuucgacaaggugaaggagccgcgcaagagccgggacagcgagucccacagccgcgugcgggagcgcuccgagcgggagcagcgcaugcaggcgcagugggagcgggaggagcgcgagcggcucgagaucgcccgcgagcgccuggccuuccagcggcagcgccuggagcgggagcgcauggagcgggagcgccucgagcgggagcgcaugcacgucgagcacgagcggcgccgggagcaggagcgcauccaccgggagcgcgaggagcugcggcgccagcaggagcugcgguacgagcaggagcgccggcccgccgugcgccggcccuacgaccucgaccgccgcgacgacgccuacuggcccgaggcgaagcgggccgcccuggacgagcgcuaccacagcgacuucaaccggcaggaccgcuuccacgacuucgaccaccgggaccgcggccgguacccggaccacuccguggaccgccgggaggggagccgcuccaugaugggcgagcgggagggccagcacuaccccgagcgccacgggggccccgagcggcacgggcgcgacagccgggacggcuggggcggguacggcuccgacaagcgcaugagcgaggggcggggccugccgcccccgccccgcgggcggcgcgacuggggcgaccacgggcgccgggaggacgaccgcuccuggcagggcacggccgacggcgggaugauggaccgggaccacaagcgcuggcagggcggggagcggagcauguccggccacagcgggcccggccacaugaugaaccgcggcgggauguccggccgggggagcuucgcgcccggcggggccucccgcggccaccccaucccccacggcgggaugcagggcggguucggcggccagagccgggggucccgcccgagcgacgcccgguucacccgccgguacuga

SEQ ID NO: 36028 - RNA, 2715 nt, Artificial Sequence
  derived and/or modified sequence opt1 from SAGE1__Homo_sapiens__NP_061136
augcaggccagcccccugcagaccucccagcccaccccgcccgaggagcugcacgccgcggccuacguguucaccaacgacggccagcagaugcgcagcgacgaggucaaccugguggccaccgggcaccaguccaagaagaagcacagccggaaguccaagcgccacagcuccagcaagcggcgcaaguccaugagcuccuggcuggacaagcaggaggacgccgccgugacccacagcaucugcgaggagcggaucaacaacggccagcccgucgcggacaacgugcucuccaccgccccgcccuggcccgacgccacgaucgcccacaacauccgcgaggagcggauggagaacgggcagagccgcaccgacaaggugcuguccaccgcgcccccgcagcugguccacauggccgccgccggcauccccagcauguccacccgggaccuccacagcacggugacccacaacauccgcgaggagcggauggagaacgggcagccccagcccgacaacgugcuguccaccggcccgaccggccugaucaacauggccgcgacgcccauccccgccaugagcgcccgcgaccucuacgccaccgucacccacaacgugugcgagcagaagauggagaacgugcagcccgccccggacaacguccugcugacccuccggccccgccggaucaacaugacggacaccgggaucagccccauguccacccgcgaccccuacgcgaccaucacguacaacgugccggaggagaagauggagaagggccagccccagcccgacaacauccugagcaccgccuccaccgggcugaucaacguggccggcgccgggacccccgccaucagcacgaacggccucuacuccaccgucccgcacaacgugugcgaggagaagauggagaacgaccagccccagcccaacaacgugcugagcaccguccagcccgugaucaucuaccugaccgcgacgggcauccccgggaugaacacccgggaccaguacgccaccaucacccacaacgugugcgaggagcgcgucgugaacaaccagccccuccccuccaacgcccugagcacggugcugccgggccucgccuaccuggccaccgcggacaugcccgccauguccacccgggaccagcacgccaccaucauccacaaccugcgcgaggagaagaaggacaacagccagcccacgcccgacaacguccucuccgccgugaccccggagcugaucaaccuggcgggggccggcaucccgcccaugagcacccgggaccaguacgccaccgucaaccaccacgugcacgaggcccgcauggagaacggccagcgcaagcaggacaacgugcucuccaacguccugagcgggcugaucaacauggccggcgcguccauccccgccaugagcucccgggaccucuacgccaccaucacgcacagcgugcgcgaggagaagauggaguccgggaagccccagaccgacaaggugaucagcaacgacgcgccccagcugggccacauggccgccgggggcauccccagcauguccaccaaggaccuguacgccaccgucacgcagaacgugcacgaggagcggauggagaacaaccagccccagccgagcuacgaccucuccaccgugcugcccggccugaccuaccucaccgucgccgggauccccgccaugagcacgcgcgaccaguacgccaccgugacccacaacgugcacgaggagaagaucaagaacggccaggcggccuccgacaacgucuucagcaccgugcccccggccuucaucaacauggccgcgacggggguguccagcauguccacccgggaccaguacgccgccgucacccacaacauccgcgaggagaagaucaacaacagccagcccgcccccggcaacauccuguccaccgcgccgcccuggcugcggcacauggccgccgccgggaucagcuccacgaucacccgcgaccucuacgugaccgccacccacagcgugcacgaggagaagaugacgaacggccagcaggcccccgacaacucccugagcaccgucccgcccggcugcaucaaccuguccggggcgggcaucagcugccggagcacccgcgaccucuacgccaccgugauccacgacauccaggaggaggagauggagaacgaccagacgccgcccgacggguuccuguccaacagcgacucccccgagcugaucaacaugaccggccacugcaugccgcccaacgcccucgacagcuucucccacgacuucaccagccuguccaaggacgagcugcucuacaagcccgacagcaacgaguucgccguggggaccaagaacuacuccgucagcgccggcgacccgcccgugacggugaugucccuggucgagaccgugcccaacacgccccagaucagccccgcgauggccaagaagaucaacgacgacaucaaguaccagcugaugaaggaggugcggcgcuucggccagaacuacgagcggaucuucauccugcucgaggagguccagggguccaugaaggugaagcgccaguucguggaguucaccaucaaggaggccgcccgguucaagaaggucgugcugauccagcagcuggagaaggcgcucaaggagaucgacagccacugccaccuccgcaaggugaagcacaugcggaagcgcuga

SEQ ID NO: 36029 - RNA, 1218 nt, Artificial Sequence
  derived and/or modified sequence opt1 from SAG__Homo_sapiens__NP_000532
auggccgccagcggcaagaccuccaagagcgagcccaaccacgugaucuucaagaagaucucccgcgacaagagcgucaccaucuaccuggggaaccgggacuacaucgaccacgugucccaggugcagccggucgacggcguggugcucgucgaccccgaccuggugaaggggaagaagguguacgucacgcugaccugcgcguuccgcuacggccaggaggacaucgacgugaucgggcucaccuuccggcgcgaccuguacuucagccgggugcaggucuacccgcccgugggcgccgccuccacccccacgaagcugcaggagagccuccugaagaagcugggcuccaacaccuaccccuuccuccugaccuuccccgacuaccugcccugcagcgugaugcuccagccggcgccccaggacuccggcaagagcugcggggucgacuucgaggugaaggccuucgccaccgacuccacggacgccgaggaggacaagauccccaagaaguccagcgugcgccugcugauccggaagguccagcacgcgccccucgagauggggccgcagccccgcgccgaggccgccuggcaguucuucaugagcgacaagccccugcaccuggccgugucccucaacaaggagaucuacuuccacggcgagcccaucccggugaccgucaccgugaccaacaacacggagaagaccgugaagaagaucaaggccuucgucgagcaggucgccaacguggugcuguacagcuccgacuacuacgugaagcccgucgcgauggaggaggcccaggagaaggugccgcccaacagcacccugaccaagacgcucacccugcugccccuccuggccaacaaccgggagcgccgggggaucgcccuggacggcaagaucaagcacgaggacaccaaccucgccagcuccaccaucaucaaggagggcaucgaccgcacggugcuggggauccuggucagcuaccagaucaaggugaagcucaccguguccggcuuccugggggagcugaccagcuccgaggucgcgaccgaggugcccuuccggcucaugcacccccagcccgaggacccggccaaggagagcuaccaggacgccaaccugguguucgaggaguucgcccgccacaaccugaaggacgccggcgaggcggaggagggcaagcgggacaagaacgacgucgacgaguga

SEQ ID NO: 36030 - RNA, 3684 nt, Artificial Sequence
  derived and/or modified sequence opt1 from SALL1__Homo_sapiens__NP_001121364
augaacgacaccgugaacaagaccgaccaggucgacugcagcgaccuguccgagcacaacggccucgaccgcgaggagagcauggagguggaggcccccguggccaacaaguccgggagcggcacguccagcgggucccacagcuccaccgccccgagcuccagcuccagcuccagcuccagcuccggcgggggcggcagcagcuccaccgggaccagcgccaucacgaccucccugccccagcugggcgaccucaccacccuggggaacuucagcgucaucaacuccaacgugaucaucgagaaccugcagagcacgaagguggccgucgcccaguucucccaggaggcccggugcggcggggcgagcggcggcaagcucgccgugcccgcccugauggagcagcugcucgcccugcagcagcagcagauccaccagcugcagcucaucgagcagauccgccaccagauccugcugcucgcgucccagaacgccgaccugcccaccagcuccagcccgucccaggggacccugcggaccagcgccaacccccucuccacgcugagcucccaccugagccagcagcucgccgccgcggccggccuggcccagucccuggccagccagagcgccuccaucagcggggugaagcagcucccgcccauccagcugccccaguccagcuccggcaacaccaucauccccagcaacuccggcagcucccccaacaugaacauccuggcggccgccgucaccacccccagcuccgagaagguggccagcuccgccggggcgagccacguguccaacccggccgucagcuccagcagcucccccgccuucgccaucagcucccuccugagccccgccuccaacccccugcucccgcagcaggcgagcgccaacuccguguuccccagcccccugcccaacaucggcacgaccgccgaggaccugaacucccucagcgcccuggcgcagcagcgcaaguccaagccgcccaacgugaccgccuucgaggccaagagcaccuccgacgaggccuucuucaagcacaagugccgguucugcgccaaggucuucgggagcgacuccgcgcugcagauccaccuccgcagccacacgggcgagcggcccuucaagugcaacaucugcgggaaccgcuucuccaccaagggcaaccugaaggugcacuuccagcggcacaaggagaaguacccccacauccagaugaacccguaccccgugcccgagcaccuggacaacauccccaccagcaccggcaucccguacgggauguccaucccgcccgagaagcccgucacgagcuggcucgacaccaagcccgugcugcccacccugaccacgagcgugggccucccccugccgcccacccugcccucccucauccccuucaucaagaccgaggagccggcccccauccccaucagccacuccgccaccagcccgcccggguccgucaagagcgacuccggcgggcccgagagcgccacgcgcaaccugggcggccugcccgaggaggccgagggguccacccugcccccgagcggcgggaaguccgaggagagcggcauggugaccaacuccgugcccaccgcgagcuccagcguccuguccagccccgccgccgacugcgggcccgccggcuccgccacgaccuucaccaacccgcugcugccccucaugagcgagcaguucaaggcgaaguuccccuucggcgggcugcuggacagcgcccaggccuccgagaccagcaagcuccagcagcugguggagaacaucgacaagaaggccaccgaccccaacgagugcaucaucugccaccggguccuguccugccagagcgcgcucaagaugcacuaccgcacgcacaccggcgagcggccguucaagugcaagaucugcgggcgcgccuucaccaccaagggcaaccugaagacgcacuacuccgugcaccgggccaugccgccccugcgcgugcagcacagcugccccaucugccagaagaaguucaccaacgccgucgugcuccagcagcacauccggaugcacaugggcgggcagauccccaacacccccgugcccgacuccuacagcgaguccauggagagcgacaccggcuccuucgacgagaagaacuucgacgaccuggacaacuucagcgacgagaacauggaggacugcccggagggguccauccccgacacgcccaagagcgccgacgcgucccaggacagccuguccagcagcccccucccgcuggagauguccagcaucgccgcccuggagaaccagaugaagaugaucaacgccggccucgccgagcagcugcaggcgucccucaagagcgucgagaacggguccaucgagggcgacgugcucaccaacgacagcuccagcgugggcggggacauggagucccagagcgccggcucccccgccaucagcgaguccaccagcuccaugcaggcccugagccccuccaacagcacccaggaguuccacaagucccccagcaucgaggagaagccgcagcgcgccguccccuccgaguucgcgaacgggcugagccccacgcccgugaacggcggggcccucgaccugaccagcucccacgccgagaagaucaucaaggaggacagccugggcauccucuucccguuccgggaccgcggcaaguucaagaacaccgccugcgacaucugcgggaagaccuucgcgugccaguccgcccuggacauccacuaccggagccacacgaaggagcgccccuucaucugcaccgugugcaaccgcggcuucuccaccaaggggaaccugaagcagcacaugcucacccaccagaugcgggaccugcccagccagcuguucgagcccuccagcaaccucggcccgaaccagaacuccgccgucauccccgccaacagccuguccagccugaucaagacggaggugaacggguucgugcacgucagcccccaggacuccaaggacacccccaccucccacgugccgagcggcccccucuccagcuccgccaccagccccgugcugcugcccgcgcucccgcgccggacgcccaagcagcacuacugcaacacgugcggcaagaccuucagcuccagcuccgcccugcagauccacgagcgcacccacaccggggagaagcccuucgccugcaccaucugcggccgggccuucaccaccaaggggaaccugaagguccacaugggcacgcacauguggaacagcaccccggcccgccgggggcgccggcucuccguggacggccccaugaccuuccugggcgggaaccccgugaaguuccccgagauguuccagaaggaccuggcggcccgcagcggcuccggggacccgagcuccuucuggaaccaguacgccgccgcccucagcaacggccuggcgaugaaggccaacgagaucuccgucauccagaacggcgggaucccgcccauccccggcagccugggguccggcaacagcucccccgugagcgggcucaccggcaaccuggagcggcugcagaacuccgagcccaacgcgccccucgccggccuggagaagauggccagcagcgagaacgggacgaacuuccgcuucacccgguucguggaggacuccaaggagaucgucaccagcuga

SEQ ID NO: 36031 - RNA, 3024 nt, Artificial Sequence
  derived and/or modified sequence opt1 from SALL2__Homo_sapiens__NP_005398
augagccgccggaagcagcgcaagccccagcagcugaucuccgacugcgagggcccgagcgccuccgagaacggggacgccagcgaggaggaccacccccaggugugcgcgaagugcugcgcccaguucaccgaccccaccgaguuccucgcccaccagaacgccugcuccacggaccccccggucauggugaucaucggcgggcaggagaaccccaacaacagcuccgccagcuccgagccccggcccgagggccacaacaacccgcaggugauggacaccgagcacagcaacccccccgacuccgggagcuccguccccaccgacccgaccuggggccccgagcgccggggcgaggagagcuccgggcacuuccugguggcggccacgggcaccgccgccgggggcgggggcggccugauccucgcgagccccaagcugggggccaccccccugccgcccgaguccacccccgcccccccgcccccccccccgcccccccccccgcccggcguggggagcggccaccucaacaucccccugauccuggaggagcuccgcguccugcagcagcggcagauccaccagaugcagaugacggagcagaucugccgccaggugcugcuccugggcucccuggggcagaccgugggcgccccggccagccccagcgagcuccccgggaccggcaccgcguccagcacgaagccccugcugccgcucuucucccccaucaagcccguccagaccagcaagacccuggccuccagcuccagcuccagcuccagcuccagcggggccgagacccccaagcaggccuucuuccaccuguaccacccgcucggcucccagcaccccuucagcgccggcggggugggccggucccacaagcccacgcccgcgccgagccccgcccugcccggguccaccgaccagcugaucgccagcccccaccucgccuucccgagcaccaccggccugcuggccgcgcagugccucggggccgcccgcggccuggaggccacggccucccccggccugcucaagcccaagaacgggagcggcgagcuguccuacggggaggugaugggcccccuggagaagccggggggccggcacaagugccgcuucugcgcgaaggucuucggcagcgacuccgcccuccagauccaccugcggagccacaccggggagcgccccuacaagugcaacgugugcggcaaccgguucaccacccgcgggaaccugaaggugcacuuccaccggcaccgcgagaaguacccccacguccagaugaacccccacccggugcccgagcaccucgacuacgugaucacguccagcggccugcccuacggcauguccgucccgcccgagaaggccgaggaggaggccgcgacccccgggggcgggguggagcggaagccccugguggccagcaccaccgcccucuccgccacggagagccugacccugcucuccaccagcgccggcaccgcgacggccccggggcugcccgccuucaacaaguucguccugaugaaggccguggagcccaagaacaaggccgacgagaacacccccccgggcuccgagggcagcgcgaucuccgggguggccgagagcagcaccgccacccgcaugcagcucuccaagcuggucacgagccugcccuccugggcccuccugaccaaccacuucaagagcaccggcuccuuccccuuccccuacgugcuggagccgcugggggccagccccuccgagaccagcaagcuccagcagcuggucgagaagaucgaccggcagggcgcgguggccgugaccuccgccgccagcggggcgcccacgaccuccgcccccgccccgagcuccagcgccuccagcggccccaaccagugcgucaucugccugcgcgugcucuccugcccccgcgcccugcggcugcacuacggccagcacgggggcgagcgccccuucaagugcaaggugugcgggcgggcguucagcacccgcggcaaccuccgggcccacuucgucgggcacaaggccuccccggccgcccgcgcgcagaacagcugccccaucugccagaagaaguucaccaacgccgugacgcugcagcagcacgugcggaugcaccugggcggccagauccccaacgggggcaccgcccuccccgaggggggcggggccgcccaggagaacggcagcgagcaguccaccgucagcggcgcgcgcuccuucccgcagcagcagagccagcagcccucccccgaggaggagcugagcgaggaggaggaggaggaggacgaggaggaggaggaggacgugaccgacgaggacucccuggccgggcggggcagcgaguccgggggcgagaaggccaucagcgugcgcggcgacuccgaggaggccagcggggcggaggaggaggucggcacgguggccgccgccgccaccgcggggaaggagauggacuccaacgagaagaccacccagcagagcucccuccccccgccccccccgcccgacagccuggaccagccccagcccauggagcagggcuccagcggggugcugggcggcaaggaggaggggggcaagccggagcgguccagcagccccgccuccgcccucacgcccgagggggaggccaccagcgucacccugguggaggagcugucccuccaggaggccaugcgcaaggagcccggcgagagcuccagccggaaggcgugcgaggugugcgggcaggccuucccgucccaggccgcccuggaggagcaccagaagacccaccccaaggagggcccccuguucacgugcgucuucugccgccagggcuuccucgagcgggccacccugaagaagcacaugcugcucgcgcaccaccaggugcagcccuucgccccgcacgggccccagaacaucgccgcccugagccuggugcccggcugcucccccagcaucaccuccaccgggcucagcccguucccccgcaaggacgaccccacgauccccuga

SEQ ID NO: 36032 - RNA, 3903 nt, Artificial Sequence
  derived and/or modified sequence opt1 from SALL3__Homo_sapiens__NP_741996
augagccgccggaagcaggccaagccccagcaccugaaguccgacgaggagcuccugccgcccgacggcgcccccgagcacgcggcccccggggagggcgccgaggacgccgacagcgggcccgagucccgcagcggcggggaggagaccuccgugugcgagaagugcugcgccgaguucuucaagugggcggacuuccuggagcaccagcggagcugcaccaagcucccgcccguccugaucgugcacgaggacgcccccgccccgccgcccgaggacuuccccgagcccucccccgccagcucccccagcgagcgcgcggaguccgaggccgccgaggaggccggcgccgagggcgcggagggggaggcccggcccguggagaaggaggccgagccgauggacgccgagcccgccggcgacacgcgcgcgccccggcccccgcccgccgcccccgcgccgcccacccccgccuacggggcccccagcaccaacgucacccuggaggcccuccuguccacgaagguggccguggcccaguucagccagggcgcccgcgcggccgggggcuccggcgccgggggcggggucgccgcggccgccgugccccugauccucgagcagcugauggcccugcagcagcagcagauccaccagcuccagcugaucgagcagauccggagccagguggcccugaugcagcggcccccgccccgccccucccucagccccgcggccgcccccuccgcccccggcccggcccccagccagcugcccggccuggcggcccucccccugagcgccggggccccggccgcggccaucgccggcuccgggcccgccgcgcccgccgccuucgagggcgcccagccccugagccgcccggaguccggggccagcacccccggcggccccgcggagcccuccgccccggccgcccccagcgccgcgcccgcccccgccgccccggcccccgcgcccgcgccccaguccgccgccagcucccagccgcagagcgccuccaccccgcccgcccucgcccccgggagccugcugggcgccgcccccgggcuccccagcccccugcugccgcagaccuccgcguccggcgucaucuuccccaacccccucgugagcaucgccgccacggccaacgcccuggacccccuguccgcgcucaugaagcaccggaaggggaagccgcccaacgugagcgucuucgagcccaaggccuccgccgaggaccccuucuucaagcacaagugccgcuucugcgccaagguguucggcagcgacagcgcccugcagauccaccuccgcucccacaccggcgagcggccguucaagugcaacaucugcgggaaccgguucagcaccaagggcaaccugaaggugcacuuccagcgccacaaggagaaguacccccacauccagaugaaccccuaccccgucccggaguaccuggacaacgugccgaccugcuccgggauccccuacggcaugagccugccgcccgagaagcccgugacgaccuggcucgacuccaagcccguccugcccaccgugcccaccagcguggggcugcagcucccgcccacgguccccggcgcgcacggcuacgccgacucccccagcgccacccccgccucccggagcccccagcgcccgucccccgccagcuccgagugcgcgagccugucccccgggcugaaccacguggagagcggcguguccgccaccgccgagagcccccagagccuccucgggggcccgccccugaccaaggccgagcccgucucccugcccugcacgaacgcgcgggccggcgacgccccggugggggcccaggccagcgcggcccccaccuccgucgacggcgcccccaccagccuggggucccccggccugccggccgugagcgagcaguucaaggcccaguuccccuucgggggccuccuggacuccaugcagaccagcgagacguccaagcugcagcagcugguggagaacaucgacaagaagaugaccgaccccaaccagugcgucaucugccaccgcgugcucagcugccaguccgcgcugaagaugcacuaccgcacccacaccggcgagcggcccuucaagugcaagaucugcgggcgcgccuucacgaccaagggcaaccugaagacccacuucggggugcaccgggccaagccgccccuccgcguccagcacagcugccccaucugccagaagaaguucaccaacgccguggugcugcagcagcacauccggaugcacaugggcgggcagauccccaacacgccgcugcccgagggcuuccaggacgccauggacuccgagcucgcguacgacgacaagaacgccgagacccugagcuccuacgacgacgacauggacgagaacagcauggaggacgacgccgagcugaaggacgccgcgaccgaccccgccaagccccuccuguccuacgccggcagcugcccgcccuccccgcccagcgucaucagcuccaucgccgcccuggagaaccagaugaagaugaucgacagcgugauguccugccagcagcucaccgggcugaaguccguggagaacggcagcggggagagcgaccgccuguccaacgacagcuccagcgcggucggcgaccucgagucccggagcgccgggucccccgcccugagcgaguccagcuccagccaggcccugucccccgcccccagcaacggcgagagcuuccgcuccaagagcccgggccucggggcgcccgaggagccccaggagaucccccugaagacggagcggccggacucccccgccgccgcccccggcagcgggggcgcccccgggcgcgcgggcaucaaggaggaggccccguucucccugcuguuccucagccgggagcgcggcaagugccccuccaccgugugcggggugugcggcaagcccuucgccugcaagagcgcccuggagauccacuaccggucccacaccaaggagcgccccuucgucugcgcgcucugccggcgcgggugcagcaccaugggcaaccugaagcagcaccuccugacccaccggcugaaggagcugccgucccagcuguucgaccccaacuucgcccucggccccagccaguccacgcccagccugaucuccagcgccgccccgaccaugaucaagauggaggugaacgggcacggcaaggccauggcgcucggggagggcccgccccugcccgccggggugcagguccccgccggcccccagaccgugaugggccccgggcuggcccccaugcucgccccgccgccccgccggacccccaagcagcacaacugccaguccugcggcaagacguucagcuccgcgagcgcccugcagauccacgagcgcacccacaccggggagaagcccuucggcugcaccaucugcgggcgcgccuucacgaccaagggcaaccugaaggugcacaugggcacccacauguggaacaacgcccccgcccggcgcgggcggcgccucagcgucgagaaccccauggcgcugcugggcggggacgcccucaaguucuccgagauguuccagaaggaccuggccgcccgggccaugaacguggacccgagcuucuggaaccaguacgcggccgccaucaccaacggccuggccaugaagaacaacgagaucuccgugauccagaacgggggcaucccccagcuccccgucagccugggcggguccgcgcugcccccgcucggcagcauggccuccgggauggacaaggcccgcacgggcagcuccccgcccaucgugagccuggacaaggccuccagcgagaccgccgcgucccggcccuucacccgcuucaucgaggacaacaaggagaucggcaucaacuga

SEQ ID NO: 36033 - RNA, 3162 nt, Artificial Sequence
  derived and/or modified sequence opt1 from SALL4__Homo_sapiens__NP_065169
augagccgccggaagcaggccaagccccagcacaucaacuccgaggaggaccagggcgagcagcagccgcagcagcagacccccgaguucgccgacgcggcccccgccgcccccgccgcgggggagcugggcgccccggugaaccaccccgggaacgacgaggucgccagcgaggacgaggccaccgugaagcgccuccggcgcgaggagacgcacgugugcgagaagugcugcgcggaguucuucuccaucagcgaguuccuggagcacaagaagaacugcaccaagaacccgcccguccugaucaugaacgacuccgagggccccgugcccagcgaggacuucuccggggccgugcucagccaccagcccaccucccccggcagcaaggacugccaccgggagaacggcggguccagcgaggacaugaaggagaagccggacgccgaguccgucguguaccugaagaccgagacggcccugccgcccacgccccaggacaucagcuaccucgccaagggcaagguggcgaacaccaacgucacccugcaggcccugcgcgggaccaagguggccgugaaccagcgguccgccgacgcccuccccgcgcccguccccggcgccaacagcauccccugggugcuggagcagauccugugccuccagcagcagcagcugcagcagauccagcugaccgagcagauccgcauccaggugaacaugugggccucccacgcccuccacagcuccggggccggcgcggacacccugaagacccugggcagccacaugagccagcaggucuccgccgccguggcccuccugagccagaaggccgggucccagggccugagccucgacgcgcugaagcaggccaagcugccgcacgccaacauccccuccgccacgagcucccucagccccgggcuggcgcccuucacccugaagccggacggcacccgggugcuccccaacgucaugucccgccugcccagcgcccugcucccccaggccccgggcuccgugcuguuccagagccccuucuccaccguggcccuggacacgagcaagaaggggaagggcaagcccccgaacaucuccgccgucgacgugaagcccaaggacgaggcggcccucuacaagcacaagugcaaguacugcagcaagguguucgggaccgacuccagccugcagauccaccuccggucccacaccggcgagcgccccuucgucugcagcgugugcgggcaccgguucaccacgaagggcaaccugaagguccacuuccaccgccacccccaggugaaggccaacccgcagcuguucgccgaguuccaggacaagguggccgcgggcaacgggauccccuacgcccugagcguccccgaccccaucgacgagccgucccucagccuggacuccaagcccgugcuggugaccaccagcgucggccucccccagaaccuguccagcgggaccaaccccaaggaccugacgggcgggucccucccgggcgaccugcagcccggccccagccccgaguccgagggcgggccgacccugcccggggugggccccaacuacaacagcccccgggccgggggcuuccagggcuccgggaccccggagcccggcagcgagacccucaagcugcagcagcugguggagaacaucgacaaggccacgaccgaccccaacgagugccugaucugccaccgcguccucuccugccagagcucccugaagaugcacuaccggacccacaccggggagcgccccuuccagugcaagaucugcggccgggccuucagcacgaagggcaaccugaagacccaccucggggugcaccgcaccaacaccuccaucaagacgcagcacagcugcccgaucugccagaagaaguucaccaacgcggugaugcugcagcagcacauccggaugcacaugggcgggcagauccccaacacgccccugccggagaaccccugcgacuucaccggcagcgagcccaugaccgucggggagaacggcuccaccggcgccaucugccacgacgacgugaucgagagcaucgacguggaggaggucuccagccaggaggcccccuccagcuccagcaaggugccgacgccccuccccuccauccacagcgccucccccacccugggguucgcgaugauggccagccuggacgccccgggcaagguggggcccgcccccuucaaccuccagcgccagggcucccgcgagaacgggagcgucgaguccgacggccugaccaacgacagcuccagccugaugggcgaccaggaguaccagucccggagccccgacauccucgagaccaccagcuuccaggcccuguccccggcgaacagccaggccgaguccaucaagagcaagucccccgacgccgggagcaaggccgaguccagcgagaacucccgcaccgagauggagggccggagcucccugcccagcaccuucauccgcgcgcccccgacguacgugaagguggagguccccgggaccuucgugggccccuccacccucagccccgggaugaccccgcugcuggccgcccagccccggcgccaggccaagcagcacggcugcacgcggugcggcaagaacuucuccagcgccuccgcccuccagauccacgagcgcacccacaccggggagaagcccuucgugugcaacaucugcggccgggcguucaccacgaaggggaaccugaagguccacuacaugacccacggcgccaacaacaacagcgcccgccgggggcgcaagcuggccaucgagaacaccauggcgcuccugggcaccgacggcaagcggguguccgagaucuuccccaaggagauccuggccccgagcgugaacgucgaccccgugguguggaaccaguacacgagcaugcucaacgggggccuggccgucaagaccaacgagaucuccgugauccagagcgggggcgugcccacccugcccgucucccucggcgccaccagcguggugaacaacgccacggucuccaagauggacgggagccaguccggcaucagcgcggacguggagaagccguccgccaccgacggggugcccaagcaccaguucccccacuuccuggaggagaacaagaucgccgucagcuga

SEQ ID NO: 36034 - RNA, 1338 nt, Artificial Sequence
  derived and/or modified sequence opt1 from SAMD14__Homo_sapiens__NP_777580
auggccagcuccaagcugcgcgagcccguggacgaggucuucgaccucgaccuggccgugcccgagaccgcgcggcuggacagcucccuccacaaggcccgcgcccagcugcuggccaagggccggcgccaccggcccagccgcucccggcuccgcgacagcgccuccagcgcggaggacggggagggcuccgacgggcccggcgggaaggugaccgacggcugcggcagcccccugcaccggcugcgcuccccgcuccacagcgggcccggcucccccgccgggggcagcuucugccuggacccgcccgggcugcggcgcucccucgacgaggacgagcccccgcccagcccccugacgcgguaccgcccccugcacaacgccgccucccacgagggccucgcggccgccagcugcuccccgccccggagcgcccccagcuccgacagcucccccagcuucguccgccggcacccccgcgccgagccccacuccgaggacgacagccgggacgcguccccgcccgagcccgccagccccaccaucggccuggacaagaagacccgccggaaguuccuggaccucggggugacccugcgccgcgccuccacgggcaagagccggaaggagaagggguccaaccgccugagcaugggcucccgggagagcguggagggcuccgggcgcagcggcggguccccguuccuccccuucagcugguucaccgacuccggcaaggggagcgccagcuccggcagcaccaccucccccacgugcagccccaagcacgagggcuucuccccgaagaaguccgccagccaggcgcagcugcuggcccacgcccaggaggcccucagcaacuccuggugccugguccaggacuucgggagcacccagaucggcauggaguccacccugagcgacgacuccaccccgcccagcuccagccccaagauccccuccgggcccuggcaggaggccaagugcagcuaccccuaccacacgcucagccaguccagcgacgaguuccuggacgagccgcugccgcccgugcaccacuggaccucccagcaggucggccaguggcuccagagccugaaccuggagcaguacgcggccgaguucgccgcccgccagguggacgggccccagcuccugcagcuggacggcuccaagcucaagagccugggccuguccaacagccacgaccgggcccucgugaagcggaagcugaaggagauggcggccgccgccgagaaggagcgcaaggcgcaggagaaggccgcccggcagcgcgagaagcugcggcgccgggagcaggaggccaagaaguccuga

SEQ ID NO: 36035 - RNA, 1617 nt, Artificial Sequence
  derived and/or modified sequence opt1 from SAMD1__Homo_sapiens__NP_612361
auggccggccccccggcccugcccccccccgagaccgcggccgccgccaccacggccgcggccgccagcuccagcgccgcguccccgcacuaccaggaguggauccucgacaccaucgacagccugcgcucccggaaggcccgccccgaccuggagcggaucugccgcauggugcggcgccggcacgggcccgagcccgagcgcacccgggccgagcucgagaagcugauccagcagcgcgccguccugcgggugagcuacaagggcuccaucagcuaccgcaacgccgcgcgggugcagccgccccgccggggggccaccccccccgccccgccccgcgccccccggggcgcccccgcggccgccgccgccgcggccccgccccccacgcccgccccgcccccccccccggcccccgucgccgcggccgcccccgcccgcgcgccccgggccgccgccgccgcggccaccgccccgcccucccccgggccggcccagcccggcccccgcgcccagcgggcggccccccucgccgccccgccccccgcccccgcggccccgcccgccguggccccccccgcgggcccgcgccgcgcccccccccccgccguggccgcccgggagccgccccugccccccccgccccagccccccgcgccgccccagcagcagcagcccccgcccccccagccccagccgccccccgaggggggcgccguccgcgccgggggcgccgcccggcccgugagccugcgcgaggugguccgguaccucgggggcuccggcggggcgggcgggcgccugacccggggccgcgugcagggccugcucgaggaggaggccgccgcccgggggcgccuggagcggacccgccugggcgcccucgcgcugccgcggggggaccgccccggccgggccccccccgccgccagcgcgcgcccgucccggagcaagcgcgggggcgaggagcgggugcuggagaaggaggaggaggaggacgacgacgaggacgaggacgaggaggacgacgucuccgagggcagcgaggugcccgaguccgaccgccccgccggggcccagcaccaccagcucaacggcgagcgcgggccccagagcgccaaggagcgggugaaggaguggacgccgugcggcccccaccaggggcaggacgagggccgcggccccgcccccggguccggcacccggcaggucuucagcauggcggccaugaacaaggaggggggcaccgccagcguggccaccgggccggacucccccagccccgugccccugccgcccggcaagcccgcccugcccggcgcggacgggacgccguucggcugcccccccgggcgcaaggagaagccguccgaccccgucgaguggaccgugauggacguggucgaguacuucaccgaggccggcuuccccgagcaggccaccgccuuccaggagcaggagaucgacggcaagagccuccugcugaugcagcggacggacgugcucaccgggcuguccauccgccugggccccgcccucaagaucuacgagcaccacaucaaggugcugcagcaggggcacuucgaggacgacgacccggacggcuuccugggguga

SEQ ID NO: 36036 - RNA, 1893 nt, Artificial Sequence
  derived and/or modified sequence opt1 from SAMD4A__Homo_sapiens__NP_001155048
augauguuccgcgaccaggugggcguccuggccgggugguucaagggcuggaacgagugcgagcagaccguggcccuccugagccugcucaagcgggugucccagacccaggcgcgcuuccugcagcugugccucgagcacagccuggccgacugcgccgagcugcacguccucgagcgggaggccaacucccccgggaucaucaaccaguggcagcaggagagcaaggacaaggugaucucccugcugcucacgcaccucccgcugcugaagcccggcaaccuggacgccaagguggaguacaugaagcugcuccccaagauccuggcgcacagcaucgagcacaaccagcacaucgaggagucccgccagcugcucagcuacgcccugauccaccccgccaccucccuggaggaccggagcgcccucgcgauguggcugaaccaccuggaggaccgcaccuccaccagcuucgggggccagaaccggggccgcuccgacagcgucgacuacgggcagacgcacuacuaccaccagcggcagaacuccgacgacaagcucaacggcuggcagaacagccgcgacuccgggaucugcaucaacgccagcaacuggcaggacaaguccaugggcugcgagaacgggcacgugccgcuguacagcagcuccagcgugcccaccaccaucaacaccaucggcacguccaccagcaccaacguccccgccuggcugaagucccuccggcugcacaaguacgccgcccuguucagccagaugaccuacgaggagaugauggcgcucacggagugccagcuggaggcccagaacgugaccaagggcgcccgccacaagaucgugaucuccauccagaagcugaaggagcggcagaaccuccucaagagccuggagcgcgacaucaucgagggcgggucccugcggaucccccugcaggagcugcaccagaugauccucaccccgaucaaggccuacagcucccccagcaccacgcccgaggcccgccggcgcgagccccaggcgccgcggcagcccucccugauggggcccgagagccagucccccgacugcaaggacggcgccgccgccaccggcgccaccgcgaccccgagcgccggggccuccggcgggcugcagccccaccagcucagcuccugcgacggcgagcuggccgucgcgccccugcccgagggggaccucccgggccaguucacgcgcgugaugggcaaggugugcacccagcugcuggucagccggcccgacgaggagaacaucagcuccuaccugcagcucaucgacaagugccugauccacgaggccuucaccgagacccagaagaagcgccugcucagcuggaagcagcagguccagaagcuguuccgcuccuucccccggaagacgcugcucgacaucagcggguaccgccagcagcggaaccgcggcuucgggcaguccaacagccugcccaccgccggcuccgucgggggcggcauggggcggcgcaacccgcggcaguaccagauccccagccgcaacgugcccuccgcccggcugggccuccuggggaccagcggcuucguguccagcaaccagcgcaacaccacggccacccccaccaucaugaagcaggggcggcagaaccugugguucgcgaacccgggcggcuccaacagcaugcccucccgcacccacagcuccgugcagcggacgcgcagccuccccgugcacaccagcccgcagaacaugcugauguuccagcagcccgaguuccagcugcccgugaccgagcccgacaucaacaaccggcucgagucccugugccugagcaugaccgagcacgcccucggggacggcguggaccgcacguccaccaucuga

SEQ ID NO: 36037 - RNA, 522 nt, Artificial Sequence
  derived and/or modified sequence opt1 from SAMD5__Homo_sapiens__NP_001025231
augugcaccaacaucguguacgaguggcugaaggcccuccagcugccccaguacgccgagagcuucgucgacaacggcuacgacgaccuggaggugugcaagcagaucggggaccccgaccucgacgccaucggcgugcuggcccccgcccaccgccggcgcauccuggaggccguccggcgccuccgggagcaggacgccaacgcggccgggcuguacuucacccuggagccccagcccgccccgcccggcccgcccgccgacgcggugccgacggggcgccggggcgagcccugcggcgggcccgcccagggcacccgcggggacucccggggccacaccaccgcgccccgcagccgggagcucguguccuacccgaagcugaagcugaagaucaugauccgcgacaagcucguccgggacgggauccaccugagcaagccgcccuacucccgcaaggugcccauggccggcauccuggaguaccucaugaacuggcccaagagcucccagagccgguga

SEQ ID NO: 36038 - RNA, 4770 nt, Artificial Sequence
  derived and/or modified sequence opt1 from SAMD9__Homo_sapiens__NP_060124
auggccaagcagcugaaccuccccgagaacaccgacgacuggaccaaggaggacgugaaccaguggcuggagagccacaagaucgaccagaagcaccgcgagauccugacggagcaggacgucaacggcgccgugcucaaguggcugaagaaggagcaccugguggacauggggaucacccacggcccggcgauccagaucgaggagcuguucaaggagcugcggaagaccgccaucgaggacuccauccagaccagcaagauggggaagcccuccaagaacgcccccaaggaccagacggucagccagaaggagcgccgggagaccuccaagcagaagcagaagggcaaggagaaccccgacauggccaacccgagcgccauguccaccaccgcgaaggggagcaagucccugaagguggagcucaucgaggacaagaucgacuacacgaaggagcgccagcccagcaucgaccugaccugcguguccuaccccuucgacgaguucagcaaccccuaccgguacaagcuggacuucucccuccagccggagaccggccccggcaaccugaucgaccccauccacgaguucaaggccuucaccaacacggccaccgccaccgaggaggacgucaagaugaaguucagcaacgagguguuccgcuucgcguccgccugcaugaacagccggaccaacgggacgauccacuucggcgugaaggacaagccccacgggaagaucgucggcaucaaggugaccaacgacaccaaggaggcccugaucaaccacuucaaccucaugaucaacaaguacuucgaggaccaccaggugcagcaggccaagaagugcauccgcgagccgcgguucgucgaggugcugcugcccaacuccacccucagcgaccgcuucgugaucgaggucgacaucaucccccaguucuccgagugccaguacgacuacuuccagaucaagaugcagaacuacaacaacaagaucugggagcagagcaagaaguucagccuguucgugcgggacgggacguccagcaaggacaucaccaagaacaagguggacuuccgcgccuucaaggcggacuucaagacccuggccgagucccggaaggccgccgaggagaaguuccgcgccaagaccaacaagaaggagcgggagggccccaagcucgucaagcugcugacgggcaaccaggaccuccuggacaacagcuacuacgagcaguacauccuggugaccaacaagugccacccggaccagaccaagcaccucgacuuccugaaggagaucaagugguucgcggugcuggaguucgaccccgaguccaacaucaacggggucgugaaggccuacaaggagagccgcguggccaaccuccacuuccccuccgucuacguggagcagaagaccacgcccaacgagaccaucagcacccugaaccuguaccaccagccguccuggaucuucugcaacggccggcucgaccuggacagcgagaaguacaagcccuucgaccccuccagcuggcagcgcgagcgggccuccgacguccgcaagcugaucagcuuccucacccacgaggacaucaugccccgggggaaguuccuggugguguuccugcuccuguccagcgucgacgacccgcgcgacccccugaucgagacguucugcgccuucuaccaggaccucaagggcauggagaacauccugugcaucugcgugcacccccacaucuuccagggcuggaaggaccugcucgaggcgcgccugaucaagcaccaggacgagaucuccagccagugcaucuccgcccugagccucgaggagaucaacgggaccauccugaagcucaagagcgugacccaguccagcaagcggcugcuccccuccaucggccugagcaccguccugcucaagaaggaggaggacaucaugacggcccuggagaucaucugcgagaacgagugcgaggggacccugcucgagaaggacaagaacaaguuccuggaguucaaggccuccaaggaggaggacuucuaccgcggcgggaaggugagcugguggaacuucuacuucuccagcgaguccuacagcuccccguucgugaagcgggacaaguacgagcgccuggaggccaugauccagaacugcgcggacagcuccaagcccaccagcaccaagaucauccaccucuaccaccaccccggcugcggcgggaccacgcuggccaugcacauccugugggagcuccggaagaaguuccgcugcgccguccugaagaacaagaccguggacuucuccgagaucggcgagcaggucaccagccugaucaccuacggggccaugaaccggcaggaguacgugccggugcuccugcugguggacgacuucgaggagcaggacaacgucuaccuccugcaguacuccauccagacggcgaucgccaagaaguacauccgcuacgagaagccccuggugaucauccucaacugcaugcggagccagaaccccgagaaguccgcccgcauccccgacagcaucgccgugauccagcagcugagcccgaaggagcagcgggccuucgagcugaagcucaaggagaucaaggagcagcacaagaacuucgaggacuucuacuccuucaugaucaugaagaccaacuucaacaaggaguacaucgagaacgucgugcgcaacauccugaagggccagaacaucuucaccaaggaggcgaagcuguucagcuuccucgcccugcugaacuccuacgugcccgacaccacgaucagccucucccagugcgagaaguuccuggggaucggcaacaagaaggccuucuggggcaccgagaaguucgaggacaagauggggaccuacagcaccauccugaucaagacggaggucaucgagugcggcaacuacugcggggugcggaucauccacucccucaucgccgaguucagccuggaggagcugaagaaguccuaccaccucaacaagagccagaucaugcuggacaugcugaccgagaaccucuucuucgacaccggcauggggaaguccaaguuccugcaggacaugcacacccugcuccugacgcgccaccgggacgagcacgagggcgagaccggcaacugguucagccccuucaucgaggcccugcacaaggacgaggggaacgaggcgguggaggccguccuccuggaguccauccaccgcuucaaccccaacgccuucaucugccaggcccuggcccggcacuucuacaucaagaagaaggacuucggcaacgcgcucaacugggccaagcaggccaagaucaucgagccggacaacagcuacaucuccgacacccugggccagguguacaagagcaagauccgcugguggaucgaggagaacgggggcaacgggaacaucuccguggacgaccugaucgcccuccuggaccuggcggagcacgccagcagcgccuucaaggagucccagcagcagagcgaggaccgggaguacgaggucaaggagcgccucuaccccaaguccaagcgccgguacgacaccuacaacaucgccggcuaccagggggagaucgaggugggccuguacacgauccagauccugcagcucauccccuucuucgacaacaagaacgagcugagcaagcgcuacauggugaacuucgucuccgggagcuccgacauccccggcgacccgaacaacgaguacaagcuggcccucaagaacuacauccccuaccugaccaagcugaaguucagccucaagaaguccuucgacuucuucgacgaguacuucgugcugcugaagccccggaacaacaucaagcagaacgaggaggcgaagacccgccggaagguggccggcuacuucaagaaguacgucgacaucuucugccuccuggaggagagccagaacaacaccgggcugggcuccaaguucagcgagccccuccagguggagcgcugccggcgcaaccugguggcccugaaggccgacaaguucuccgggcuccuggaguaccugaucaagagccaggaggacgccaucuccacgaugaagugcaucgucaacgaguacaccuuccuccuggagcagugcaccgugaagauccagagcaaggagaagcugaacuucauccucgcgaacaucauccuguccugcauccagccgaccagccggcuggugaagcccgucgagaagcucaaggaccagcugcgcgaggugcugcagcccaucggccucacguaccaguucuccgagcccuacuuccuggccagccuccuguucuggccggagaaccagcagcuggaccagcacagcgagcagaugaaggaguacgcccaggcccugaagaacuccuucaaggggcaguacaagcacaugcaccggaccaagcagcccaucgccuacuucuuccucggcaagggcaagcgccuggagcggcuggugcacaaggggaagaucgaccagugcuucaagaagacccccgacaucaacagccucuggcaguccggcgacgucuggaaggaggagaaggugcaggagcugcugcugcgccuccaggggcgggcggagaacaacugccuguacaucgaguacggcaucaacgagaagaucaccauccccaucacgccggccuuccuggggcagcuccgcagcggccgguccaucgagaaggugagcuucuaccugggcuucuccaucgggggcccccuggccuacgacaucgagaucgucuga

SEQ ID NO: 36039 - RNA, 4755 nt, Artificial Sequence
  derived and/or modified sequence opt1 from SAMD9L__Homo_sapiens__NP_001290426
augagcaagcaggucucccugcccgagaugaucaaggacuggaccaaggagcacgugaagaagugggugaacgaggaccucaagaucaacgagcaguacggccagauccugcugagcgaggaggugaccgggcucguccugcaggagcugacggagaaggaccucguggagaugggccugccgugggggcccgcccugcucaucaagcgcuccuacaacaagcugaacagcaagucccccgagagcgacaaccacgaccccggccagcuggacaacuccaagccgagcaagaccgagcaccagaagaaccccaagcacaccaagaaggaggaggagaacuccaugagcuccaacaucgacuacgacccccgggagauccgcgacaucaagcaggaggagagcauccucaugaaggagaacgugcuggacgaggucgccaacgcgaagcacaagaagaaggggaagcugaagcccgagcagcugaccugcaugccguaccccuucgaccaguuccacgacucccaccgguacaucgagcacuacacgcugcagcccgagaccggcgcccugaaccucaucgaccccauccacgaguucaaggcccugaccaacaccgagacggccaccgagguggacaucaagaugaaguucagcaacgagguguuccgcuucgccuccgcgugcaugaacagccggaccaacggcaccauccacuucggggucaaggacaagccgcacggcgagaucgugggggugaagaucacguccaaggccgccuucaucgaccacuucaacgucaugaucaagaaguacuucgaggagagcgagaucaacgaggccaagaagugcauccgcgagccccgguucguggaggugcugcuccagaacaacacccccuccgaccgcuucgucaucgagguggacaccauccccaagcacagcaucugcaacgacaaguacuucuacauccagaugcagaucugcaaggacaagaucuggaagcagaaccagaaccugagccuguucgugcgggagggcgcguccagccgcgacauccucgccaacuccaagcagcgggacgucgacuucaaggccuuccugcagaaccucaagagccucguggccucccgcaaggaggccgaggaggaguacgggaugaaggcgaugaagaaggagagcgagggccugaagcuggugaagcuccugaucggcaaccgggacucccuggacaacagcuacuacgacugguacauccucgucaccaacaagugccacccgaaccagaucaagcaccuggacuuccugaaggagaucaagugguucgccgugcucgaguucgaccccgaguccaugaucaacgggguggucaaggccuacaaggagagccgcguggccaaccugcacuuccccaaccaguacgaggacaagacgaccaacaugugggagaagaucuccacccugaaccucuaccagcagcccagcuggaucuucugcaacggccgguccgaccucaagagcgagaccuacaagccgcuggagccccaccucuggcagcgcgagcgggccuccgagguccgcaagcugauccuguuccucacggacgagaacaucaugacccgggggaaguuccuggugguguuccugcuccugagcuccgucgagagccccggcgacccccugaucgagaccuucugggcguucuaccaggcccugaagggcauggagaacaugcucugcaucuccgugaacagccacaucuaccagcgcuggaaggaccugcugcagacccggaugaagauggaggacgagcucacgaaccacagcaucuccacccugaacaucgagcuggugaacagcaccauccucaagcugaaguccgucacccgcagcucccgccgguuccugccggcccgcgggagcuccagcgugauccucgagaagaagaaggaggacgugcugacggcccuggagauccucugcgagaacgagugcaccgagaccgacaucgagaaggacaaguccaaguuccuggaguucaagaaguccaaggaggagcacuucuaccggggcgggaaggucuccugguggaacuucuacuucagcuccgagaacuacagcuccgacuucgugaagcgcgacagcuacgagaagcugaaggaccucauccacugcugggccgagucccccaagcccaucuucgcgaagaucaucaaccuguaccaccaccccggcugcgggggcaccacgcuggccaugcacgugcucugggaccugaagaagaacuuccggugcgccguccugaagaacaagaccaccgacuucgccgagaucgccgagcaggucaucaaccucgugaccuaccgcgccaagagccaccaggacuacaucccggugcugcugcucguggacgacuucgaggagcaggagaacguguacuuccugcagaacgcgauccacagcguccuggccgagaaggaccuccgguacgagaagacgcuggugaucauccugaacugcaugcgcucccggaaccccgacgagagcgccaagcucgcggacuccaucgcccugaacuaccagcugagcuccaaggagcagcgcgccuucggcgccaagcucaaggagaucgagaagcagcacaagaacugcgagaacuucuacagcuucaugaucaugaaguccaacuucgacgagaccuacaucgagaacgugguccggaacauccugaaggggcaggacguggacagcaaggaggcccagcugaucuccuuccucgcgcugcugagcuccuacgugaccgacagcaccaucuccgucagccagugcgagaucuuccucggcaucaucuacaccuccacgcccugggagccggagagccuggaggacaagauggggaccuacuccacccugcucaucaagaccgagguggccgaguacggccgcuacacgggggugcggaucauccacccccugaucgcccuguacugccucaaggagcuggagcgcagcuaccaccuggacaagugccagaucgcccucaacauccuggaggagaaccuguucuacgacuccggcaucggccgggacaaguuccagcacgacguccagacccuccugcugacccgccagcggaagguguacggggacgagaccgacacgcuguucagcccccugauggaggcccugcagaacaaggacaucgagaaggugcucagcgcgggcucccgccgguucccccagaacgccuucaucugccaggcccuggcccgccacuucuacaucaaggagaaggacuucaacaccgcccuggacugggcgcgccaggccaagaugaaggccccgaagaacagcuacaucuccgacacccucgggcaggucuacaagagcgagaucaagugguggcuggacggcaacaagaacugccgguccaucaccgugaacgaccugacgcaccuccuggaggccgcggagaaggccagccgcgccuucaaggagucccagcggcagaccgacagcaagaacuacgagaccgagaacuggagcccccagaagucccagcgccgguacgacauguacaacaccgccugcuuccugggggagaucgaggugggccucuacacgauccagauccugcagcugacccccuucuuccacaaggagaacgagcucagcaagaagcacaugguccaguuccugagcggcaaguggaccaucccgcccgacccccgcaacgagugcuaccuggcccucuccaaguucaccagccaccugaagaaccugcaguccgaccucaagcggugcuucgacuucuucaucgacuacauggugcugcugaagaugcgcuacacgcagaaggagaucgcggagaucaugcucagcaagaaggugucccggugcuuccgcaaguacaccgagcuguucugccaccuggaccccugccuccugcagagcaaggagucccagcugcuccaggaggagaacugccggaagaagcuggaggcccugcgcgccgaccgguucgccgggcuccuggaguaccugaaccccaacuacaaggacgccaccaccauggagagcaucgucaacgaguacgcguuccuccugcagcagaacagcaagaagccgaugacgaacgagaagcagaacuccauccuggccaacaucauccucagcugccugaagcccaacuccaagcugauccagccccugaccacccucaagaagcagcugcgcgaggugcugcaguucgugggccucagccaccaguaccccgggccguacuuccuggccugccuccuguucuggcccgagaaccaggagcuggaccaggacuccaagcugaucgagaaguacgucagcucccucaaccggagcuuccgcggccaguacaagcggaugugccgcuccaagcaggccagcacccuguucuaccugggcaagcggaaggggcucaacuccaucgugcacaaggccaagaucgagcaguacuucgacaaggcgcagaacacgaacagccuguggcacuccggcgacguguggaagaagaacgaggucaaggaccugcuccgccggcugaccgggcaggccgagggcaagcugaucagcguggaguacgggaccgaggagaagaucaagauccccgugaucuccgucuacagcggcccccuccgcuccggccgcaacaucgagcgggugagcuucuaccugggguucuccaucgagggcccgcuggccuacgacaucgaggugaucuga

SEQ ID NO: 36040 - RNA, 1881 nt, Artificial Sequence
  derived and/or modified sequence opt1 from SAMHD1__Homo_sapiens__NP_056289
augcagcgcgccgacagcgagcagcccuccaagcggccgcgcugcgacgacagcccccggacccccuccaacacccccagcgccgaggcggacugguccccgggccuggagcuccaccccgacuacaagacgugggggcccgagcaggucugcagcuuccugcgccggggcggguucgaggagcccgugcugcucaagaacauccgcgagaacgagaucaccggcgcccugcugccgugccucgacgagucccgguucgagaaccugggggugagcucccugggcgagcgcaagaagcuccugagcuacauccagcggcuggugcagauccacgucgacaccaugaaggugaucaacgaccccauccacggccacaucgagcuccacccccugcuggugcgcaucaucgacacgccccaguuccagcggcuccgcuacaucaagcagcucgggggcggguacuacgucuucccgggcgccucccacaaccgguucgagcacagccugggggugggcuaccucgccggcugccuggugcacgcccugggggagaagcagcccgagcuccagaucuccgagcgcgacguccugugcgugcagaucgcgggccugugccacgaccucgggcacggccccuucagccacauguucgacggccgguucaucccccuggcccgcccggaggugaaguggacccacgagcagggguccgucaugauguucgagcaccugaucaacagcaacggcaucaagcccgugauggagcaguacgggcucauccccgaggaggacaucugcuucaucaaggagcagaucgugggcccccuggaguccccggucgaggacagccuguggcccuacaaggggcggcccgagaacaaguccuuccucuacgagaucgugagcaacaagcgcaacggcaucgacguggacaagugggacuacuucgcccgggacugccaccaccugggcauccagaacaacuucgacuacaagcgcuucaucaaguucgcccgggucugcgagguggacaacgagcugcgcaucugcgcgcgcgacaaggagguggggaaccucuacgacauguuccacacccggaacagccugcaccgccgggccuaccagcacaaggucggcaacaucaucgacaccaugaucaccgacgccuuccugaaggccgacgacuacaucgagaucacgggggccggcgggaagaaguaccgcaucuccaccgcgaucgacgacauggaggccuacaccaagcucaccgacaacaucuuccuggagauccuguacagcacggaccccaagcucaaggacgcccgggagauccugaagcagaucgaguaccgcaaccuguucaaguacgugggcgagacccagccgaccggccagaucaagaucaagcgggaggacuacgagucccuccccaaggagguggccagcgccaagcccaagguccugcuggacgugaagcucaaggcggaggacuucaucgucgacgugaucaacauggacuacgggaugcaggagaagaaccccaucgaccacguguccuucuacugcaagaccgccccgaaccgcgccauccggaucacgaagaaccaggucagccagcugcugcccgagaaguucgccgagcagcucauccgcguguacugcaagaagguggaccggaagucccuguacgccgcgcgccaguacuucguccaguggugcgccgaccggaacuucaccaagccccaggacggcgacgugaucgccccgcugaucacgccccagaagaaggaguggaacgacagcaccuccgugcagaaccccacccgccugcgggaggccagcaagucccgcguccagcuguucaaggacgaccccauguga

SEQ ID NO: 36041 - RNA, 1410 nt, Artificial Sequence
  derived and/or modified sequence opt1 from SAMM50__Homo_sapiens__NP_056195
augggcaccgugcacgcccgcagccuggagccccucccguccagcgggcccgacuucggcgggcugggcgaggaggccgaguucgucgagguggagcccgaggcgaagcaggagauccuggagaacaaggacguggucgugcagcacgugcacuucgacgggcucggccggaccaaggacgacaucaucaucugcgagaucggcgacgucuucaaggccaagaaccugaucgaggugaugcgcaagucccacgaggcccgggagaagcugcuccgccuggggaucuuccgccagguggacguccugaucgacacgugccagggcgacgacgcccuccccaacgggcuggacgugaccuucgaggugaccgagcugcggcggcucaccggcagcuacaacacgauggucgggaacaacgagggcuccauggugcugggccugaagcucccgaaccugcuggggcgcgccgagaaggugaccuuccaguucagcuacggcaccaaggagaccuccuacgggcucagcuucuucaagccccggcccggcaacuucgagcgcaacuucuccgucaaccuguacaaggugacgggccaguuccccuggagcucccugcgggagaccgaccgcgggaugagcgcggaguacuccuucccgaucuggaagaccagccacaccgugaagugggagggcgucuggcgggagcucgggugccugucccgcacggccagcuucgccgugcggaaggaguccggccacagccugaaguccagccucagccacgccauggugaucgacucccgcaacagcuccauccugccccggcgcggggcgcugcucaaggucaaccaggagcuggccggcuacaccggcggggacgugagcuucaucaaggaggacuucgagcugcagcucaacaagcagcugaucuucgacuccguguucagcgccuccuucuggggcgggaugcugguccccaucggcgacaagcccagcuccaucgccgaccgguucuaccucgggggcccgaccagcauccgcggcuucuccaugcacagcaucgggccccaguccgagggcgacuaccucgggggcgaggccuacugggccgggggccugcaccuguacacgccccugcccuuccggccgggccagggcggguucggggagcuguuccgcacccacuucuuccucaacgcgggcaaccugugcaaccugaacuacggcgaggggcccaaggcccacauccgcaagcucgccgagugcauccgguggagcuacggcgccgggaucgugcugcgccugggcaacaucgcgcggcucgagcugaacuacugcguccccaugggggugcagaccggcgaccgcaucugcgacggcgugcaguucggggccggcauccgguuccuguga

SEQ ID NO: 36042 - RNA, 1326 nt, Artificial Sequence
  derived and/or modified sequence opt1 from SAMSN1__Homo_sapiens__NP_001243299
auggagauccgccuggacacccucagcgccucccugggccggagcuccacccugaacaacugcaaccucgaggacaagcuggccugguacgagggggaggcguacauguggcaccacuggaagcccuucccggagaacccccuguggacgugccucgacuuccagaucgcccaggugggccccugggaccacugcagcuccugcauccgccacacccggcucaagagcuccugcagcgacauggaccugcugcacuccuggcgcagcuccagcuucgggaacuucgaccgguuccgcaacaacucccugagcaagcccgacgacuccaccgaggcccacgagggcgacccgaccaacgggagcggcgagcaguccaagacgagcaacaacggcgggggccuggggaagaagaugcgggccaucuccuggaccaugaagaagaaggucggcaagaaguacaucaaggcccucagcgaggagaaggacgaggaggacggggagaacgcgcaccccuaccgcaacagcgaccccgugaucggcacccacaccgagaaggugucccugaaggccagcgacuccauggacagccuguacuccggccagagcuccagcuccgggaucacgagcugcuccgacggcaccagcaaccgggacuccuuccgccucgacgacgacgggcccuacagcggcccguucugcggccgggcccgcguccacaccgacuucacccccucccccuacgacacggacagccugaagaucaagaagggggacaucaucgacaucaucugcaagacccccaugggcauguggaccgggaugcugaacaacaaggugggcaacuucaaguucaucuacguggacgucaucuccgaggaggaggccgcgccgaagaagaucaaggccaaccggcgcagcaacuccaagaaguccaagacccuccaggaguuccuggagcggauccaccuccaggaguacacgagcacccugcugcugaacggguacgagacccucgaggaccugaaggacaucaaggagagccaccugaucgagcucaacaucgagaaccccgacgaccgccggcgccugcugagcgccgccgagaacuuccucgaggaggagaucauccaggagcaggagaacgagcccgagccccugucccugagcuccgacaucagccucaacaagucccagcuggacgacugcccgcgggacagcggcugcuacaucuccagcggcaacuccgacaacgggaaggaggaccuggagagcgagaaccucuccgacauggugcacaagaucaucaucaccgagcccagcgacuga

SEQ ID NO: 36043 - RNA, 879 nt, Artificial Sequence
  derived and/or modified sequence opt1 from SAP30BP__Homo_sapiens__NP_001288768
auggccggcaagaagaacgugcugagcucccucgccgucuacgcggaggacagcgagcccgaguccgacggggaggccggcaucgaggccguggggagcgccgccgaggagaagggcgggcugguguccgacgcguacggcgaggacgacuucagccgccugggcggggacgaggacggcuacgaggaggaggaggacgagaacucccggcagagcgacaacaccgaggccgagaagcgcgacccgcaggagcucgucgccuccuucagcgagcgggugcgcaacaugucccccgacgagaucaagaucccgcccgagccgcccgggcggugcagcaaccaccuccaggacaagauccagaagcuguacgagcgcaagaucaaggagggcauggacaugaacuacaucauccagcggaagaaggaguuccgcaaccccuccaucuacgagaagcugauccaguucugcgccaucgacgagcuggggaccaacuaccccaaggacauguucgacccccacggcuggagcgaggacuccuacuacgaggcgcuggccaaggcccagaagaucgagauggacaagcucgagaaggccaagaaggagcggacgaagaucgaguucgugaccggcaccaagaaggggaccacgaccaacgccaccagcaccacgaccaccaccgcguccacggccgucgccgacgcccagaagcgcaagagcaagugggacuccgccauccccgugaccaccaucgcgcagcccaccauccugacgaccaccgccacccugcccgccguggucacggugaccaccagcgccagcggcuccaagaccacggugaucagcgccgucgggaccaucgugaagaaggcgaagcaguga

SEQ ID NO: 36044 - RNA, 429 nt, Artificial Sequence
  derived and/or modified sequence opt1 from SAP30L__Homo_sapiens__NP_001124534
augaacggcuucagcaccgaggaggacucccgcgaggggcccccggccgcccccgcggccgccgcccccggcuacgggcagagcugcugccugaucgaggacggcgagcggugcgugcgccccgccgggaacgcguccuucagcaagcggguccagaaguccaucagccagaagaagcucaagcuggacaucgacaaguccguggaccuguuccagcuccaggugaacacccugcgccgguacaagcgccacuacaagcugcagacgcggccgggcuucaacaaggcccagcucgccgagaccgucagccgccacuuccggaacauccccgugaacgagaaggagacccuggccuacuucaucuacauggugaaguccaacaagagccgccuggaccagaaguccgagggcgggaagcagcucgaguga

SEQ ID NO: 36045 - RNA, 537 nt, Artificial Sequence
  derived and/or modified sequence opt1 from SAPCD1__Homo_sapiens__NP_001034740
augggcagccagggguccggcggggugccccugguccaggccccguacaccgugcuccugcugccccucggcaccagccgccaggaccccggggcccaguccuucuuccuguggcugcggcgcaugcaggcgcucgagcgggagcaggacgcccuguggcagggccuggagcuccugcagcacggccaggccugguucgaggaccaccuccgcgaggcccagcggcagcagcugcaccugggggcccugggcgagaacuuccucacggaccugcacagcgagcccgggcgcccgccccuggcgcagauccagaaggugaacaucugccuccagaaccugauccacgagaaguucucccccagcccccugaacaaggccuccagcugcaccacccaggacuccaaggagcggcgccgggagcagaaccucuggcagcagcaggagcugagccgccagcagaagggcgucacccagccgaaggaggagauggcccagcgggggugcacgaagggcccccgcggccccacccggguguga

SEQ ID NO: 36046 - RNA, 1185 nt, Artificial Sequence
  derived and/or modified sequence opt1 from SAPCD2__Homo_sapiens__NP_848543
auggccggcgccgcgauggccgagcgcgggcgggugcccccgcccgcccccgcccccagcaccgagggccugccgcgcgccuuccuccagucccugcggacccuguucgacauccucgacgaccgccggcgcgggugcguccaccuccgggagaucgagagccgcuggcagggcacggacgcgcgggagcugccccgcggggugcucgagggccugcgccagguggcccccgccuccggcuaccugaccuucgagcgguucgucgccgggcuccggaccagccugcuguccgcggacggcgggccccgcgacccgacccgggcccccgcccgccccggcgaccagcccccgcccccgccccagcggcucguguucgcccccgccgacgagccccgcacggugcuggagcggaagccccugccccucgggguccgcgcgccccuggccggccccagcgccgccgcccggucccccgagcagcugugcgcgcccgccgaggccgccccgugccccgccgagcccgagcgcagccaguccgcggcccucgagcccagcuccagcgccgacgccggcgccguggcgugccgcgcccuggaggccgacuccggggacgcccggcgcgcgccgcgggcccgcggcgagcggcgccggcacaccaucgccagcgggguggacugcggccugcucaagcagaugaaggagcuggagcaggagaaggagguccugcuccagggccuggagaugauggcccgcgggcgggacugguaccagcagcagcugcagcgcgugcaggagcggcagcgccggcucggccagucccgcgccagcgcggacuucggggccgccggcagcccccggccccuggggcgccugcucccgaaggugcaggaggucgcccggugccugggcgagcugcucgccgcggccugcgccagccgcgcccugccgcccuccagcagcgggccgcccugccccgcccugaccuccaccagcccgcccguguggcagcagcagacgauccucaugcugaaggagcagaaccggcugcucacccaggaggugaccgagaaguccgagcgcaucacccagcuggagcaggagaaguccgcgcugaucaagcagcuguucgaggcccgcgcccugucccagcaggacggcggcccccuggacagcacguucaucuga

SEQ ID NO: 36047 - RNA, 597 nt, Artificial Sequence
  derived and/or modified sequence opt1 from SAR1A__Homo_sapiens__NP_001136120
augagcuucaucuucgaguggaucuacaacggcuucuccagcgugcugcaguuccucgggcuguacaagaaguccggcaagcuggucuuccucgggcuggacaacgccggcaagaccacccugcuccacaugcugaaggacgaccgccuggggcagcacgugcccacgcuccacccgaccagcgaggagcugaccaucgccggcaugaccuucacgaccuucgaccugggcgggcacgagcaggcgcggcgcguguggaagaacuaccuccccgccaucaacggcaucgucuuccugguggacugcgccgaccacucccggcugguggagagcaaggucgagcucaacgcccugaugaccgacgagaccaucuccaacgugcccauccugauccucgggaacaagaucgaccgcacggacgccaucagcgaggagaagcugcgggagaucuucggccuguacgggcagaccaccggcaagggcaacgugacccucaaggagcugaacgcgcgccccauggaggucuucaugugcuccgugcugaagcggcagggguacggcgagggguuccgcuggcucagccaguacaucgacuga

SEQ ID NO: 36048 - RNA, 597 nt, Artificial Sequence
  derived and/or modified sequence opt1 from SAR1B__Homo_sapiens__NP_001028675
augagcuucaucuucgacuggaucuacuccggcuucagcuccgugcugcaguuccucgggcuguacaagaagaccggcaagcuggucuuccucgggcuggacaacgccggcaagaccacgcugcuccacaugcugaaggacgaccgccuggggcagcacgugcccacccuccacccgaccagcgaggagcugaccaucgccggcaugacguucaccaccuucgaccugggcgggcacgugcaggcgcggcgcgucuggaagaacuaccuccccgccaucaacggcaucguguuccugguggacugcgccgaccacgagcggcugcucgaguccaaggaggagcuggacagccugaugaccgacgagacgaucgccaacguccccauccucauccuggggaacaagaucgaccgccccgaggccaucuccgaggagcggcugcgcgagauguucggccucuacgggcagaccaccggcaagggcagcaucucccugaaggagcugaacgcgcggccgcucgagguguucaugugcagcgugcugaagcgccagggguacggcgagggguuccgguggauggcccaguacaucgacuga

SEQ ID NO: 36049 - RNA, 2757 nt, Artificial Sequence
  derived and/or modified sequence opt1 from SARDH__Homo_sapiens__NP_001128179
auggccagccugucccgcgcccuccggguggcggccgcccacccccgccagagcccgacccggggcauggggcccugcaaccuguccagcgccgccggccccaccgcggagaaguccguccccuaccagcgcacccugaaggaggggcagggcaccagcgugguggcccaggggccgucccggccccuccccagcaccgccaacgucguggugaucggcggcgggucccugggcugccagacccuguaccaccucgccaagcuggggaugagcggcgcgguccugcucgagcgcgagcggcugacguccgggaccaccuggcacaccgccggccugcucuggcagcugcgccccagcgacguggagguggagcugcucgcccacacgcggcgcgucgugucccgggagcuggaggaggagaccggccugcacaccggguggauccagaacggcggccucuucaucgccagcaaccgccagcggcuggacgaguacaagcgccugaugucccucgggaaggccuacggcguggagagccacguccuguccccggcggagaccaagacgcuguacccccucaugaacguggacgaccuguacgggacccuguacgugccccacgacggcaccauggaccccgccgggaccugcacgacccucgcccgggccgccagcgcgcgcggcgcccaggucaucgagaacugcccggugaccgggauccggguguggaccgacgacuucggcguccgccggguggccggcguggagacgcagcacggguccauccagacccccugcgucgugaacugcgccggcgugugggccagcgcggucgggcgcauggccggcgugaaggucccccugguggccaugcaccacgccuacguggucaccgagcggaucgaggggauccagaacaugcccaacgugcgcgaccacgacgccagcguguaccugcgccuccagggcgacgcgcuguccgucggcggguacgaggccaacccgaucuucugggaggaggugagcgacaaguucgccuucggccuguucgaccucgacugggagguguucacccagcacaucgagggggccaucaaccggguccccgugcuggagaagacgggcaucaaguccaccgugugcgggcccgagagcuucacccccgaccacaagccgcugaugggcgaggcgcccgagcuccgcggcuucuuccuggggugcggcuucaacuccgccgggaugaugcugggcggcgggugcggccaggagcucgcccacuggaucauccacgggcggcccgagaaggacaugcacggcuacgacauccgccgguuccaccacagccugaccgaccacccccgcuggauccgggagcgcucccacgagagcuacgccaagaacuacuccgucguguucccgcacgacgagccccuggccgggcggaacaugcgccgggacccccuccacgaggagcugcugggccagggcugcguguuccaggagcgccacgggugggagcggcccggcugguuccacccgcgcgggcccgcgcccguccucgaguacgacuacuacggcgccuacgggagccgggcccacgaggacuacgccuaccgccggcugcuggccgacgaguacacguucgcguucccgccccaccacgacaccaucaagaaggagugccucgccugccgcggcgccgccgccguguucgacauguccuacuucggcaaguucuaccugguggggcuggacgcgcggaaggccgccgacuggcuguucagcgccgacgucucccgcccgcccggcagcaccguguacacgugcaugcucaaccaccgcgggggcaccgaguccgaccugaccgugagccggcuggcgcccucccaccaggccagcccccucgcccccgccuucgagggggacggcuacuaccuggccaugggcggggcggucgcccagcacaacuggucccacaucaccaccgugcugcaggaccagaagucccagugccagcucaucgacagcagcgaggaccugggcaugaucagcauccaggggcccgccucccgcgccauccugcaggaggugcucgacgccgaccugagcaacgaggcguucccguucuccacgcacaagcugcuccgggccgccggccaccugguccgcgccaugcggcugagcuucgugggggagcucggcugggagcugcacauccccaaggccuccugcgugcccgucuaccgcgcggugauggccgccggcgccaagcacgggcugaucaacgcgggcuaccgggccaucgacagccucuccaucgagaagggguaccgccacuggcacgccgaccugcggcccgacgacagcccgcuggaggccggccucgccuucacgugcaagcugaagucccccgugcccuuccugggccgcgaggcgcucgagcagcagcgggccgccgggcugcgccggcgccuggucugcuucaccauggaggacaaggugcccauguucggccucgaggccaucuggcggaacggccagguggucgggcacgugcgccgggccgacuucggguucgcgaucgacaagaccaucgccuacggcuacauccacgacccgagcggcgggcccgugucccuggacuucgucaagagcggcgacuacgcccuggagcgcaugggggugaccuacggcgcccaggcccaccucaagucccccuucgaccccaacaacaagcgggugaaggggaucuacuga

SEQ ID NO: 36050 - RNA, 2175 nt, Artificial Sequence
  derived and/or modified sequence opt1 from SARM1__Homo_sapiens__NP_055892
auggugcugacccuccugcugagcgccuacaagcucugccgcuucuucgccauguccggcccccggccgggggcggagcgccuggccguccccggccccgacgggggcgggggcaccggccccuggugggccgccgggggccgggggccgcgcgaggugagccccggcgccgggacggaggugcaggacgcgcuggagcgggcccuccccgagcugcagcaggcccuguccgcccucaagcaggcgggcggcgcccgcgccgucggggccggccuggccgagguguuccagcugguggaggaggcguggcuccugcccgccgucgggcgggagguggcccagggccugugcgacgccauccgccucgacggcgggcuggaccugcuccugcggcugcuccaggccccggagcuggagacccgcgugcaggcggcccggcugcucgagcagauccuggucgccgagaaccgcgaccggguggcccgcaucggccugggggugauccucaaccuggccaaggagcgggagcccgucgagcuggcgcgcagcguggccggcauccucgagcacauguucaagcacuccgaggagaccugccagcggcugguggccgccgggggccuggacgccguccucuacuggugccgccggaccgaccccgcgcugcugcgccacugcgcccucgcccugggcaacugcgcccugcacgggggccaggcggugcagcggcgcaugguggagaagcgcgccgccgaguggcuguucccccuggccuucagcaaggaggacgagcugcuccggcugcacgccugccuggcggucgccgugcucgccacgaacaaggagguggagcgcgaggucgagcgguccgggacccuggcccugguggagccgcucguggccagccuggaccccggccgcuucgcgcggugccuggucgacgccuccgacaccagccaggggcgcggccccgacgaccugcagcggcucgugccccugcuggacuccaaccgccucgaggcccagugcaucggcgccuucuaccugugcgccgaggcggccaucaagagccugcaggggaagaccaaggucuucuccgacaucggcgccauccagagccucaagcggcugguguccuacagcacgaacgggaccaaguccgcccuggcgaagcgcgcccuccggcugcugggcgaggaggugccgcgccccauccuccccagcguccccuccuggaaggaggccgaggugcagaccuggcugcagcagaucggguucagcaaguacugcgagagcuuccgggagcagcaggucgacggcgaccugcuccugcgccugaccgaggaggagcuccagacggaccugggcaugaaguccgggaucacccggaagcgcuucuuccgggagcugaccgagcucaagaccuucgccaacuacagcacgugcgaccgcuccaaccuggccgacuggcugggcagccucgacccgcgguuccgccaguacaccuacgggcugguguccugcggccuggaccgcagccuccugcaccggguguccgagcagcagcugcucgaggacugcggcauccaccugggggugcaccgcgcgcggauccugaccgccgcccgcgagaugcuccacagcccccugcccugcaccggcgggaagcccuccggcgacacgccggacgucuucaucagcuaccggcgcaacuccgggagccagcuggccucccuccugaaggugcaccuccagcuccacggcuucagcguguucaucgacgucgagaagcuggaggccggcaaguucgaggacaagcugauccaguccgugaugggggcgcggaacuucgugcucguccugagccccggcgcccuggacaagugcaugcaggaccacgacugcaaggacugggugcacaaggagaucgugaccgcccucuccugcgggaagaacaucguccccaucaucgacggcuucgaguggcccgagccccaggugcugccggaggacaugcaggccgugcugaccuucaacgggaucaaguggagccacgaguaccaggaggccaccaucgagaagaucauccgcuuccuccagggccgguccagccgcgacagcuccgcgggcagcgacacgucccuggagggggccgcccccaugggcccgaccuga

SEQ ID NO: 36051 - RNA, 633 nt, Artificial Sequence
  derived and/or modified sequence opt1 from SARNP__Homo_sapiens__NP_149073
auggccaccgagaccguggagcugcacaagcucaagcuggccgagcugaagcaggagugccucgcgcgcggccuggagacgaaggggaucaagcaggaccugauccaccggcuccaggccuaccuggaggagcacgccgaggaggaggccaacgaggaggacguccugggcgacgagaccgaggaggaggagaccaagcccaucgagcucccggugaaggaggaggagccgcccgagaagaccguggacgucgccgcggagaagaagguggugaagaucacgagcgagaucccccagaccgagcgcaugcagaagcgggccgagcgcuucaacguccccgugucccuggagagcaagaaggccgcccgggcggcccgcuucgggaucuccagcgugcccaccaagggccuguccagcgacaacaagcccauggucaaccucgacaagcugaaggagcgggcccagcgcuucgggcugaacguguccagcaucucccgcaagagcgaggacgacgagaagcucaagaagcggaaggagcgguucggcaucgugaccuccagcgccggcacggggaccaccgaggacaccgaggccaagaagcgcaagcgggcggagcgcuucggcaucgccuga

SEQ ID NO: 36052 - RNA, 1563 nt, Artificial Sequence
  derived and/or modified sequence opt1 from SARS2__Homo_sapiens__NP_001139373
auggccgccagcauggcgcgccggcuguggccccuccugacccgccggggcuuccgcccgcgcgggggcugcaucuccaacgacagcccccggcgguccuucaccacggagaagcgcaaccggaaccugcucuacgaguacgcccgcgagggguacagcgcccugccccagcuggacaucgagcgguucugcgccugccccgaggaggccgcgcacgcccucgagcugcgcaagggcgagcugcgguccgccgaccucccggccaucaucagcaccuggcaggagcugcgccagcugcaggagcagauccggucccucgaggaggagaaggcggccgugaccgaggccguccgcgcccugcuggccaaccaggacagcggggaggugcagcagguccggcucgaccccggcgcgggcuccaucuucgggcccaccuuccugcccuucccgggccagcugagccuccugguggaggcccagcuggaggagcaguucuaccuccaggcccugaagcugcccaaccagacgcaccccgacgugcccgugggggacgagucccaggcccgcguccuccacauggugggcgacaagccgguguucagcuuccagccccgggggcaccuggagaucggcgagaagcuggacaucauccgccagaagcggcucucccacgucagcggccaccgcuccuacuaccugcgcggggccggcgcgcugcuccagcacgggcuggugaacuucaccuucaacaagcugcuccggcgcggcuucacccccaugaccgugcccgaccugcugcggggcgccgucuucgaggggugcggcaugacgccgaacgccaaccccagccagaucuacaacaucgaccccgcccgcuucaaggaccucaaccuggccgggaccgcggaggugggccuggccggguacuucauggaccacaccguggccuuccgggaccuccccguccgcauggugugcuccagcacgugcuaccgggccgagaccaacaccggccaggagccgcgcggccuguaccgggugcaccacuucaccaaggucgagauguucggggugaccggccccgggcuggagcaguccagccagcuccuggaggaguuccugagccuccagauggagauccugacggagcugggccuccacuuccgcgugcuggacaugcccacccaggagcuggggcugcccgccuaccggaaguucgacaucgaggcguggaugccgggccgcggccgguucggggaggucaccuccgccagcaacugcaccgacuuccagucccgccggcuccacaucauguuccagacggaggccggcgagcugcaguucgcccacaccgugaacgcgaccgccugcgccgugccccgccugcucaucgcccugcuggagagcaaccagcagaaggacggguccguccucgugccgcccgcccugcagagcuaccugggcaccgaccggaucacggcgcccacccacgucccccuccaguacaucgggcccaaccagccgcgcaagcccggccugcccggccagcccgccguguccuga

SEQ ID NO: 36053 - RNA, 2403 nt, Artificial Sequence
  derived and/or modified sequence opt1 from SART1__Homo_sapiens__NP_005137
augggcagcuccaagaagcaccgcggggagaaggaggccgccggcaccaccgcggccgccgggacgggcggggccaccgagcagcccccgcggcaccgcgagcacaagaagcacaagcaccggagcggcggcuccgggggcagcgggggcgagcgccggaagcgcucccgggagcgcgggggcgagcggggcagcgggcgccggggcgccgaggcggaggcccgcuccagcacccacgggcgggagcgcucccaggccgagcccagcgagcggcgcgugaagcgggagaagcgcgacgacggcuacgaggccgcggccuccagcaagaccuccagcggcgacgccuccagccuguccaucgaggagacgaacaagcuccgggccaagcuggggcugaagccccucgaggucaacgccaucaagaaggaggcgggcaccaaggaggagcccgugaccgccgacgugaucaacccgauggcccugcgccagcgggaggagcugcgcgagaagcucgccgccgcgaaggagaagcgccugcugaaccagaagcucgggaagaucaagacccugggcgaggacgaccccuggcuggacgacacggccgccuggaucgagcggagccgccagcuccagaaggagaaggaccuggccgagaagcgggccaagcugcucgaggagauggaccaggaguucggggucuccacccugguggaggaggaguucggccagcgccggcaggaccuguacagcgcgcgcgaccuccagggccugaccguggagcacgccaucgacagcuuccgggagggggagaccaugauccugacgcucaaggacaagggcguccugcaggaggaggaggacgugcuggugaacgucaaccucguggacaaggagcgcgccgagaagaacguggagcugcggaagaagaagcccgacuaccugcccuacgccgaggacgaguccgucgacgaccucgcccagcagaagccgcgcagcauccuguccaaguacgacgaggagcuggagggggagcggccccacagcuuccgccucgagcagggcgggaccgcggacggccugcgggagcgcgagcuggaggagauccgggccaagcuccgccugcaggcccagucccugagcaccgugggcccccggcucgccuccgaguaccugacccccgaggagauggugacguucaagaagaccaagcgccgggucaagaagauccgcaagaaggagaaggagguggugguccgcgcggacgaccugcucccgcugggggaccagacccaggacggcgacuucgggagccggcugcgcggccgggggcgccggcgcguguccgagguggaggaggagaaggagcccgucccccagccccucccgagcgacgacacccggguggagaacauggacaucuccgacgaggaggagggcggcgccccgccgcccgggagcccccaggugcuggaggaggacgaggccgagcuggagcuccagaagcagcuggagaagggccgccggcugcgccagcuccagcagcugcagcagcugcgggacuccggggagaaggucguggagaucgucaagaagcuggagagccgccagcggggcugggaggaggacgaggaccccgagcgcaagggcgccaucguguucaacgccacguccgaguucugccggacccucggggagauccccaccuacggccuggcggggaaccgcgaggagcaggaggagcugauggacuucgagcgggacgaggagcgcagcgccaacggcggguccgagagcgacggcgaggagaacaucggcugguccaccgugaaccucgacgaggagaagcagcagcaggacuucagcgccagcuccacgaccauccuggacgaggagcccaucgucaaccgggggcuggccgccgcgcuccugcugugccagaacaagggccuccuggagaccaccgugcagaagguggcccgcgucaaggcccccaacaagagccugcccuccgccguguacugcaucgaggacaagauggccaucgacgacaaguacagccggcgcgaggaguaccgcggguucacgcaggacuucaaggagaaggacggcuacaagcccgacgugaagaucgaguacgucgacgagaccgggcggaagcucacccccaaggaggcguuccgccagcugucccaccgguuccacggcaagggcagcgggaagaugaagaccgagcgccggaugaagaagcuggacgaggaggcccuccugaagaagauguccagcuccgacacgccgcugggcaccguggcccuccugcaggagaagcagaaggcccagaagacccccuacaucgugcugagcggguccggcaagagcaugaacgcgaacaccaucacgaaguga

SEQ ID NO: 36054 - RNA, 2892 nt, Artificial Sequence
  derived and/or modified sequence opt1 from SART3__Homo_sapiens__NP_055521
auggccaccgccgcggagaccagcgccuccgagcccgaggccgagagcaaggccggcccgaaggccgacggggaggaggacgaggugaaggcggcccgcacgcggcgcaagguccugucccgggccguggccgcggccaccuacaagaccaugggccccgccugggaccagcaggaggagggggugagcgaguccgacggcgacgaguacgccauggccagcuccgcggagagcucccccggggaguacgagugggaguacgacgaggaggaggagaagaaccagcucgagaucgagcgccuggaggagcagcugagcaucaacgucuacgacuacaacugccacguggaccucauccggcugcugcgccucgagggcgagcugaccaaggugcggauggcccgccagaagauguccgagaucuucccccugacggaggagcucuggcuggaguggcugcacgacgagaucagcauggcccaggacggccucgaccgggagcacgucuacgaccuguucgagaaggccgugaaggacuacaucugcccgaacaucuggcuggaguacgggcaguacuccgugggcgggaucggccagaagggcgggcucgagaagguccgcagcguguucgagcgggcccuguccagcgugggccugcacaugaccaaggggcucgcgcugugggaggccuaccgcgaguucgaguccgccaucgucgaggccgcccggcuggagaaggugcacagccucuuccgccggcagcuggcgaucccccuguacgacauggaggccaccuucgccgaguacgaggagugguccgaggaccccauccccgagagcgugauccagaacuacaacaaggcccuccagcagcuggagaaguacaagccguacgaggaggcccugcuccaggcggaggcgccccgccuggccgaguaccaggccuacaucgacuucgagaugaagaucggcgaccccgcccggauccagcugaucuucgagcgcgcccucgucgagaacugccuggugcccgaccuguggauccgguacagccaguaccucgaccgccagcugaaggugaaggaccugguccucuccgugcacaaccgggccauccgcaacugcccguggaccguggcccuguggagccgcuaccugcucgccauggagcggcacggggucgaccaccaggugaucuccgugacguucgagaaggcgcugaacgccggcuucauccaggccaccgacuacgucgagaucuggcaggccuaccuggacuaccuccgccggcgcguggacuucaagcaggacagcuccaaggagcuggaggagcugcgggccgcguucacccgcgcccucgaguaccugaagcaggaggucgaggagcgguucaacgagagcggcgaccccuccugcgugaucaugcagaacugggcccgcaucgaggcccggcugugcaacaacaugcagaaggcccgcgagcucugggacagcaucaugacccgggggaacgcgaaguacgccaacauguggcuggaguacuacaaccuggagcgcgcccacggcgacacgcagcacugccggaaggcccugcaccgcgcggugcagugcaccuccgacuaccccgagcacgucugcgaggugcuccugaccauggagcggaccgaggggagccuggaggacugggacaucgccgugcagaagacggagacccgccucgcccgggucaacgagcagcgcaugaaggccgccgagaaggaggcggcccuggugcagcaggaggaggagaaggccgagcagcggaagcgcgcccgcgccgagaagaaggcgcugaagaagaagaagaagauccggggccccgagaagcgcggggccgacgaggacgacgagaaggaguggggcgacgacgaggaggagcagccguccaagcggcgccggguggagaacagcauccccgccgccggcgagacccagaacgucgagguggccgcggggcccgccggcaagugcgccgccguggacgucgagcccccguccaagcagaaggagaaggcggccagccucaagcgcgacaugcccaaggugcugcacgacuccagcaaggacuccaucaccguguucgucagcaaccugcccuacuccaugcaggagcccgacacgaagcuccggccgcuguucgaggccugcggggagguggugcagauccgccccaucuucagcaaccggggcgacuuccgcggguacugcuacgucgaguucaaggaggagaaguccgcccugcaggcccucgagauggaccgcaagagcguggagggccggcccauguucgugagccccugcgucgacaaguccaagaacccggacuucaagguguuccgguacagcaccucccuggagaagcacaagcuguucaucagcggccuccccuucuccugcaccaaggaggagcuggaggagaucugcaaggcgcacgggaccgugaaggaccugcgccucgucacgaaccgggccggcaagcccaaggggcuggccuacguggaguacgagaacgagagccaggccucccaggccgugaugaagauggacggcaugaccaucaaggagaacaucaucaaggucgcgaucagcaacccgccccagcgcaaggugcccgagaagcccgagacccggaaggcccccgggggcccgaugcugcucccccagaccuacggcgcccgcgggaagggccggacgcagcugucccugcucccccgcgcccugcagcggccgagcgccgcggcgccccaggccgagaacgggcccgccgccgcccccgccguggccgccccggcggccaccgaggcccccaagauguccaacgccgacuucgccaagcuguuccuccgcaaguga

SEQ ID NO: 36055 - RNA, 3744 nt, Artificial Sequence
  derived and/or modified sequence opt1 from SASH1__Homo_sapiens__NP_056093
auggaggacgccggcgccgcggggcccggcccggagcccgagcccgagcccgagccggagcccgagcccgcccccgagccggagcccgagcccaagcccggggccggcaccagcgaggccuucucccgccuguggaccgacgugauggggauccucgacggcagccugggcaacaucgacgaccuggcccagcaguacgcggacuacuacaacacgugcuucuccgacgucugcgagcggauggaggagcuccgcaagcggcgcgugagccaggaccuggagguggagaagccggacgccucccccaccagccugcagcuccggucccagaucgaggagagccugggguucugcuccgccgucagcacccccgagguggagcgcaagaacccccugcacaaguccaacagcgaggacuccagcgugggcaagggggacuggaagaagaagaacaaguacuucuggcagaacuuccggaagaaccagaagggcaucaugcgccagaccuccaagggggaggacgucggcuacguggccagcgagaucacgauguccgacgaggagcggauccagcucaugaugauggugaaggagaagaugaucaccaucgaggaggcgcuggcccgccugaaggaguacgaggcccagcaccggcagagcgccgcccucgacccggcggacuggcccgacggcuccuaccccaccuucgacgggagcagcaacugcaacucccgcgagcagagcgacgacgagaccgaggaguccgucaaguucaagcggcugcacaagcuggugaacagcacgcgccgggugcgcaagaagcucauccgggucgaggagaugaagaagcccuccaccgagggcggggaggagcacguguucgagaacagcccggugcuggacgagcgcuccgcccuguacagcggcguccacaagaagccccucuucuucgacggcucccccgagaagcccccggaggacgacagcgacucccugaccaccagccccuccagcuccagccuggacacguggggggccggccggaagcucgugaagaccuucuccaagggggagagccgcggccugaucaagccccccaagaagauggggaccuucuucuccuacccggaggaggagaaggcccagaaggugagccggagccugaccgagggcgagaugaagaagggccucgggucccugagccacggccgcacgugcuccuucgggggcuucgaccugaccaaccgcagccuccacgucggguccaacaacagcgaccccaugggcaaggagggcgacuucguguacaaggaggugaucaagucccccaccgccagccggaucucccuggggaagaaggucaagagcgugaaggagaccaugcgcaagcggauguccaagaaguacagcuccagcguguccgagcaggacagcggccuggacgggaugccgggcucccccccccccagccagccggaccccgagcaccucgacaagcccaagcugaaggcggggggcagcgucgagucccugcgcagcucccucagcggccaguccagcauguccgggcagacggugagcaccaccgacuccagcaccuccaaccgggagagcgucaaguccgaggacggcgacgacgaggagcccccguaccgcgggcccuucugcggccgggcccgcgugcacacggacuucacccccagccccuacgacaccgacucccugaagcugaagaagggcgacaucaucgacaucaucagcaagccgcccauggggaccuggaugggccuccugaacaacaagguggggacguucaaguucaucuacgucgacgugcuguccgaggacgaggagaagcccaagcggcccacccgccggcgccggaagggccgcccgccccagcccaagagcguggaggaccuccuggaccggaucaaccugaaggagcacaugcccaccuuccucuucaacggguacgaggaccuggacaccuucaagcugcucgaggaggaggaccuggacgagcugaacauccgcgacccggagcaccgggccguccuccugacggccguggagcugcugcaggaguacgacuccaacagcgaccagagcggcucccaggagaagcuccugguggacagccagggccuguccgggugcagcccccgcgacuccggcugcuacgagagcuccgagaaccucgagaacgggaagacccggaaggccagccugcuguccgcgaagagcuccaccgagcccagccucaaguccuucagccgcaaccagcugggcaacuaccccacccugccgcucaugaaguccggggacgcccugaagcagggccaggaggagggccgccuggggggcgggcucgcccccgacacgagcaaguccugcgaccccccgggcgucaccgggcugaacaagaaccggcgcagccugcccguguccaucugccggagcugcgagacccucgagggcccccagaccguggacaccuggccccgcagccacucccuggacgaccugcaggucgagccgggcgccgagcaggacgugcccacggaggugaccgagccccccccgcagaucguccccgaggugccccagaagaccaccgccagcuccacgaaggcgcagccccucgagcaggacagcgccguggacaacgcccugcugcucacccaguccaagcgguucagcgagccgcagaagcugaccaccaagaagcuggagggguccaucgccgcgagcggccgcgggcucucccccccccagugccugccccggaacuacgacgcccagccgcccggcgccaagcacgggcuggcccgcacgccccucgagggccaccggaagggccacgaguucgaggggacccaccacccccugggcaccaaggagggggucgacgccgagcagcgcaugcagccgaagauccccagccagccccccccggugcccgcgaagaagucccgggagcgccuggccaacggccuccaccccgugcccaugggcccgagcggggcccugcccucccccgacgccccgugccugcccgucaagcggggcagccccgccucccccaccagcccguccgacugcccccccgcgcucgccccccgcccgcugagcgggcaggcccccggcuccccccccagcacgcggccgccccccuggcugagcgagcuccccgagaacaccucccugcaggagcacggggugaagcugggcccggcccucacccgcaaggugagcugcgcccggggcgucgaccuggagacccugacggagaacaagcuccacgcggaggggaucgaccugaccgaggagcccuacuccgacaagcacggccgcugcgggauccccgaggcccuggugcagcgguacgccgaggaccucgaccagcccgagcgcgacguggccgcgaacauggaccagauccgggucaagcagcugcgcaagcagcaccgcauggccaucccgagcggcgggcugaccgagaucugccggaagcccgugucccccggcugcaucagcuccgugagcgacuggcucaucuccaucggccugcccauguacgccgggacccugagcacggccggcuucuccacccucagccaggucccgucccugagccacaccugccugcaggaggccgggaucaccgaggagcgccacauccggaagcuccuguccgcggcccgccuguucaagcucccccccggccccgaggccauguga

SEQ ID NO: 36056 - RNA, 1143 nt, Artificial Sequence
  derived and/or modified sequence opt1 from SASH3__Homo_sapiens__NP_061863
augcugcgccggaagcccagcaacgccuccgagaaggagccgacccagaagaagaagcucagccugcagcgcuccagcuccuucaaggacuucgccaagagcaagcccuccagccccguggucuccgagaaggaguucaaccuggacgacaacauccccgaggacgacagcggcgugccgacccccgaggacgcggggaaguccggcaagaagcucgggaagaaguggcgggccgugaucagccgcacgaugaaccggaagaugggcaagaugauggucaaggcccuguccgaggagauggccgacacccuggaggaggggagcgccucccccaccagccccgacuacucccucgacagcccgggccccgagaagauggcgcuggccuucuccgagcaggaggagcacgagcugcccgugcucagccgccaggccagcaccggcuccgagcugugcagccccuccccggggagcggcuccuucggggaggagccgcccgcgccccaguacacgggccccuucugcgggcgggcccgcgugcacaccgacuucacccccagccccuacgaccacgacucccugaagcuccagaagggcgacgucauccagaucaucgagaagcccccggugggcaccuggcuggggcugcucaacggcaagguggggagcuucaaguucaucuacgucgacgugcugcccgaggaggccgugggccacgcccggcccucccgccggcagagcaagggcaagcgccccaagccgaagacgcugcacgagcuccuggagcggaucgggcuggaggagcacaccuccacccuccugcugaacggcuaccagacccucgaggacuucaaggagcugcgcgagacgcaccugaacgagcucaacaucauggacccccagcaccgggccaagcugcugaccgccgcggagcuccugcuggacuacgacaccgggagcgaggaggccgaggagggcgccgaguccagccaggagcccgucgcccacaccguguccgagcccaagguggacaucccgcgcgacagcgggugcuucgagggcuccgagagcggccgggacgacgccgagcucgcggggacggaggagcagcugcagggccugucccucgccggggcccccuga

SEQ ID NO: 36057 - RNA, 516 nt, Artificial Sequence
  derived and/or modified sequence opt1 from SAT1__Homo_sapiens__NP_002961
auggccaaguucgugauccgccccgccaccgcggccgacugcagcgacauccugcggcucaucaaggagcuggccaaguacgaguacauggaggagcaggucauccugaccgagaaggaccuccuggaggacggcuucggggagcacccguucuaccacugccugguggccgaggugcccaaggagcacuggacgcccgagggccacuccaucgucggguucgccauguacuacuucaccuacgaccccuggaucggcaagcuccuguaccuggaggacuucuucgugaugagcgacuaccgcggguucggcaucggcuccgagauccucaagaaccugagccagguggcgaugcggugccgcugcuccagcaugcacuuccuggucgccgaguggaacgagccguccaucaacuucuacaagcggcgcggggccagcgaccucuccagcgaggagggcuggcggcuguucaagaucgacaaggaguaccugcucaagauggccaccgaggaguga

SEQ ID NO: 36058 - RNA, 513 nt, Artificial Sequence
  derived and/or modified sequence opt1 from SAT2__Homo_sapiens__NP_597998
auggccagcgugcgcauccgggaggccaaggagggcgacugcggggacauccugcgccucauccgggagcuggcggaguucgagaagcuguccgaccaggucaagaucagcgaggaggcccuccgcgccgacggcuucggggacaaccccuucuaccacugccugguggccgagauccugccggcccccggcaagcuccuggggcccugcguggucggcuacggcaucuacuacuucaucuacuccaccuggaaggggcggaccaucuaccuggaggacaucuacgugaugcccgaguaccgcggccaggggaucggcagcaagaucaucaagaagguggcggaggucgcccucgacaaggggugcucccaguuccggcuggccgugcuggacuggaaccagcgcgccauggaccucuacaaggcgcugggcgcccaggaccugacggaggccgagggcuggcacuucuucugcuuccagggggaggccacccggaagcucgccggcaaguga

SEQ ID NO: 36059 - RNA, 2388 nt, Artificial Sequence
  derived and/or modified sequence opt1 from SATB1__Homo_sapiens__NP_001182399
auggaccaccugaacgaggccacccagggcaaggagcacagcgagauguccaacaacgugagcgaccccaaggggccgcccgccaagaucgcgcgccucgagcagaacggcagcccccuggggcggggccgccugggguccaccggcgccaagaugcagggcgucccccucaagcacuccgggcaccugaugaagacgaaccugcggaagggcaccaugcucccgguguucugcguggucgagcacuacgagaacgccaucgaguacgacugcaaggaggagcacgccgaguucgugcuggugcgcaaggacaugcuguucaaccagcucaucgagauggcccugcugagccucggguacucccacagcuccgcggcccaggccaagggccugauccaggucgggaaguggaaccccgugccccugagcuacgugaccgacgcccccgacgcgaccgucgccgacaugcuccaggacguguaccacguggucacgcugaagauccagcugcacuccugcccgaagcucgaggaccugccgcccgagcaguggagccacaccaccgugcggaacgcccugaaggaccuccugaaggacaugaaccaguccagccuggccaaggagugcccccucucccagagcaugaucuccagcaucgugaacuccaccuacuacgccaacgucagcgcggccaagugccaggaguucggccgcugguacaagcacuucaagaagacgaaggacaugaugguggagauggacagccuguccgagcugagccagcagggcgccaaccacgugaacuucgggcagcagcccguccccggcaacaccgccgagcagccgcccucccccgcccagcucagccacgggucccagcccagcgugcggacgccccugcccaaccugcacccgggccucguguccacccccaucagcccccagcuggucaaccagcagcuggugauggcgcagcuccugaaccagcaguacgccgugaaccgccugcucgcccagcagucccugaaccagcaguaccugaaccacccgccgcccgucagccgguccaugaacaagccccucgagcagcaggucagcaccaacaccgagguguccagcgagaucuaccagugggugcgcgacgagcugaagcgggccggcaucucccaggccguguucgcgcgcgucgccuucaaccggacccaggggcugcucagcgagauccugcgcaaggaggaggaccccaagaccgccucccagagccugcucgugaaccugcgggccaugcagaacuuccugcagcuccccgaggccgagcgcgaccggaucuaccaggacgagcgcgagcggucccugaacgcggccagcgccaugggccccgcgccccugaucagcacgccgcccucccgcccgccccaggugaagaccgccaccaucgccaccgagcggaacgggaagcccgagaacaacacgaugaacaucaacgccagcaucuacgacgagauccagcaggagaugaagcgcgccaaggucucccaggcccuguucgcgaagguggccgccaccaagagccagggcuggcucugcgagcugcugcgcuggaaggaggaccccucccccgagaaccggacccucugggagaaccugagcaugauccgccgguuccugucccucccccagccggagcgcgacgccaucuacgagcaggagagcaacgccgugcaccaccacggggaccggccgccccacaucauccacguccccgcggagcagauccagucccccagccccaccacgcugggcaagggcgagucccgcgggguguuccugcccggccuccccaccccggcccccuggcugggggccgcgccccagcagcagcagcagcagcagcagcagcagcagcagcagcagcaggcgcccccgccgccccagccccagcagcagccccagaccggcccccggcugcccccgcgccagcccaccguggccagccccgccgaguccgacgaggagaaccggcagaagacgcgcccccggaccaagaucagcgucgaggcccucgggauccugcaguccuucauccaggacgugggccuguacccggacgaggaggccauccagacccucagcgcccagcuggaccugcccaaguacaccaucaucaaguucuuccagaaccagcgcuacuaccucaagcaccacggcaagcugaaggacaacuccgggcuggagguggacgucgccgaguacaaggaggaggagcuccugaaggaccuggaggagagcgugcaggacaagaacacgaacacccucuucagcgugaagcuggaggaggagcuguccgucgagggcaacaccgacaucaacaccgaccucaaggacuga

SEQ ID NO: 36060 - RNA, 2028 nt, Artificial Sequence
  derived and/or modified sequence opt1 from SATB2__Homo_sapiens__XP_005246453
augauccccguguucugcgucguggagcagcuggacggcagccucgaguacgacaaccgcgaggagcacgccgaguucgugcugguccggaaggacgugcuguucucccagcucguggagaccgcccugcuggcgcucggguacagccacuccagcgccgcccaggcccagggcaucaucaagcuggggcgcuggaacccccugccccucuccuacgucaccgacgcccccgacgcgacgguggccgacaugcugcaggacguguaccacgucgugacccugaagauccagcuccagagcugcuccaagcuggaggaccugcccgccgagcaguggaaccacgccaccgugcggaacgcgcucaaggagcugcugaaggagaugaaccagagcacccucgccaaggagugcccgcugucccagagcaugaucuccagcaucgucaacuccacguacuacgccaacgugagcgccaccaagugccaggaguucggccgcugguacaagaaguacaagaagaucaagguggagcgggucgagcgcgagaaccuguccgacuacugcgugcucgggcagcggcccaugcaccuccccaacaugaaccagcuggccagccugggcaagaccaacgagcagagcccccacucccagauccaccacuccaccccgauccgcaaccaggugcccgcgcugcagcccaucaugagccccggccugcucagcccgcagcugagcccccagcugguccggcagcagaucgccauggcccaccucaucaaccagcagaucgccgugucccgccugcuggcccaccagcacccccaggcgaucaaccagcaguuccucaaccacccgcccaucccccgggccgugaagcccgagcccacgaacuccagcgucgagguguccccggacaucuaccagcagguccgcgacgagcugaagcgggccagcgugucccaggccguguucgcccgcgucgcguucaaccggacccaggggcugcucagcgagauccugcgcaaggaggaggacccccggaccgccucccagagccugcucgugaaccugcgcgccaugcagaacuuccugaaccuccccgagguggagcgggaccgcaucuaccaggacgagcgggagcgcuccaugaaccccaacgucagcaugguguccagcgccuccagcuccccgagcuccagccgcacgccccaggccaagaccagcacccccaccaccgaccugcccaucaagguggacggcgcgaacaucaacaucacggccgccaucuacgacgagauccagcaggagaugaagcgggccaaggucucccaggcgcuguucgccaagguggccgccaacaagagccagggguggcucugcgagcugcugcgcuggaaggagaacccgucccccgagaaccggacccucugggagaaccugugcaccauccgccgguuccugaaccugccccagcacgagcgcgacgugaucuacgaggaggagagccggcaccaccacuccgagcgcaugcagcacgucgugcagcucccgcccgagcccgugcagguccugcaccggcagcagagccagcccgccaaggaguccagcccgccccgcgaggaggcgcccccgcccccgccgcccaccgaggacuccugcgccaagaagccccggagccgcacgaagaucucccuggaggcccucggcauccugcagagcuucauccacgacguggggcuguaccccgaccaggaggccauccacacccucuccgcccagcuggaccugcccaagcacaccaucaucaaguucuuccagaaccagcgguaccacgugaagcaccacggcaagcucaaggagcaccugggcagcgcggucgacguggccgaguacaaggacgaggagcugcucaccgaguccgaggagaacgacagcgaggagggguccgaggagauguacaagguggaggccgaggaggagaacgccgacaagagcaaggccgcgcccgccgagaucgaccagcgcuga

SEQ ID NO: 36061 - RNA, 1899 nt, Artificial Sequence
  derived and/or modified sequence opt1 from SATL1__Homo_sapiens__NP_001012998
augaaccagagcggcaccaaccaguccagccuguccgacagcaaccaggccgggaucaaccagcccuccaccaacagccucggcaugaaccagauggacaugaaccagggguccgccagccuguacgagaugaaccagguggacaugaagcagccguccaugagccaggcgggcaugcgccaguccgggacgaaccugcccgacaucaaccagcccgacaugaagcagcccgacaccuggcagcucggccggagccagccgggcaugcugcagcaggagcugucccagcucguccugagcaaggccgggaucucccagcccgaccccagccagcccggcccgucccagagcgggcccucccagagccgcaugcggcagaucggcaccaaccagagcgggaugucccagcccgugaugcagcagcuggacagccaguccggcggcagccagcccuccaugcgccagguggggaccagccagcucggcacgucccagaucgggaugagccagccgggcaccuggcagaccggccugucccagcccguccugcggcagcccaacaugagcccgcccgggauguggcagcccggcgugcagcagcccgggaucucccagcagguccccagccacccggacaugucccagcccggcaugagccagcagguccccucccagcccgggauccgccagccggacaccagccaguccugcaagaaccagacggacaugagccagcccgacgccaaccaguccagccucagcgacuccaaccagaccggcaucauccagcccagccccucccugcugggcaugaaccagauggacaugaaccaguggagcgccucccucuacgagaugaaccagguggacaugaagcagccgagcaugucccaggccgggaugcggcagagcggcaccaaccugcccgacaucaaccagcccgggaugaagcagccgggcaccuggcagcuggggcgcucccagcccggcauguggccccagagccucuccgagcuggugcugagcgaggcguccaucagccagcccggcccgccccagcgggcccccucccagagcgggccccgccaguccagcacgagccaggccggcaccaaccaguccgggaucagccagccggugauguggcagcucgacaugcggcaguccggcgggagccagcccuccaugcgccaggugggcaccagccaguccggcaccagccagaucgggaugucccagcccggcacguggcagaccgggcugagccagcccgugccgcggcagcccaacaaguccccgcccggcauguggcagcgcggcauguggcagcccgggaugagccagcagguccccucccagcugggcaugcggcagcccgggaccagccaguccagcaagaaccagaccggcaugucccaccccgggcgcggccagccgggcaucugggagcccgggcccagccagcccggccucucccagcaggaccugaaccagcuggugcucagccagccggggcugagccagcccggccggucccagcccagcgugucccagauggggaugcgccagacgagcauggacuacuuccagauccggcacgccgaggcgggcgacugcccggagauccugcgccucaucaaggagcuggccgccugcgagaacaugcuggacgccauggagcucaccgccgcggaccugcugcgggacggcuucggggacaacccccucuucuacugccugaucgccgaggucaacgaccagcagaagcccuccggcaagcugaccgugggguucgccauguacuacuucaccuacgacagcuggacgggcaaggugcucuaccuggaggacuucuacgucacccaggccuaccaggacucccaccacaacagcauguga

SEQ ID NO: 36062 - RNA, 1152 nt, Artificial Sequence
  derived and/or modified sequence opt1 from SAV1__Homo_sapiens__NP_068590
augcugagccgcaagaagaccaagaacgagguguccaagcccgccgagguccagggcaaguacgugaagaaggagaccagcccgcuccugcggaaccugaugcccuccuucauccgccacgggcccacgaucccccggcgcaccgacaucugccucccggacagcucccccaacgccuucagcaccuccggcgacguggucagccggaaccaguccuuccugcgcacccccauccagcggacgccccacgagaucaugcgccgggagagcaaccgccuguccgcgccgagcuaccucgcccggucccuggccgacgugccccgcgaguacgggagcucccagagcuucgugaccgaggucuccuucgccguggagaacggcgacagcgggucccgguacuacuacagcgacaacuucuucgacggccagcgcaagcggccccugggcgaccgcgcccacgaggacuaccgguacuacgaguacaaccacgaccucuuccagcgcaugccccagaaccaggggcggcacgcgagcggcaucgggcgcguggccgccaccucccugggcaaccugaccaaccacgggagcgaggaccucccgcugccgcccggcugguccgucgacuggacgaugcggggccgcaaguacuacaucgaccacaacaccaacaccacccacuggagccacccccuggagcgcgaggggcucccgcccggcugggagcggguggaguccagcgaguucgggacguacuacguggaccacaccaacaagaaggcccaguaccgccaccccugcgcgcccuccgucccccgguacgaccagcccccgcccgugaccuaccagccccagcagaccgagcgcaaccagagccugcuggugcccgccaaccccuaccacacggccgagauccccgacuggcuccaggucuacgcccgggccccggugaaguacgaccacauccugaagugggagcuguuccagcucgcggaccuggacaccuaccagggcaugcugaagcuccuguucaugaaggagcuggagcagaucgugaagauguacgaggccuaccgccaggcccuccugaccgagcuggagaaccggaagcagcgccagcagugguacgcccagcagcacggcaagaacuucuga

SEQ ID NO: 36063 - RNA, 753 nt, Artificial Sequence
  derived and/or modified sequence opt1 from SBDS__Homo_sapiens__NP_057122
augagcaucuucacccccaccaaccagauccgccugacgaacguggccgucgugcggaugaagcgcgccggcaagcgguucgagaucgcgugcuacaagaacaagguggucggguggcgcuccggcguggagaaggaccucgacgaggugcugcagacccacagcgucuucgugaacguguccaaggggcaggucgccaagaaggaggaccugaucagcgccuucggcaccgacgaccagaccgagaucugcaagcagauccucacgaagggggagguccagguguccgacaaggagcggcacacccagcuggagcagauguuccgcgacaucgccaccaucguggccgacaagugcgugaacccggagaccaagcggcccuacacggugauccugaucgagcgcgcgaugaaggacauccacuacagcgucaagaccaacaaguccaccaagcagcaggcccucgaggugaucaagcagcugaaggagaagaugaagaucgagcgggcccacaugcgccugcgguucauccuccccgugaacgagggcaagaagcugaaggagaagcugaagccccucaucaaggucaucgagagcgaggacuacggccagcagcuggagaucgugugccugaucgacccggggugcuuccgcgagaucgacgagcucaucaagaaggagaccaagggcaaggggucccuggaggugcugaaccucaaggacgucgaggagggcgacgagaaguucgaguga

SEQ ID NO: 36064 - RNA, 5682 nt, Artificial Sequence
  derived and/or modified sequence opt1 from SBF1__Homo_sapiens__NP_002963
auggcccgccuggccgacuacuucgugcugguggccuucggcccccacccccggggguccggcgaggggcagggccagauccugcagcgcuuccccgagaaggacugggaggacaaccccuucccccaggggaucgagcuguucugccagcccuccggcuggcagcugugccccgagcggaacccgcccaccuucuucguggccgugcugaccgacaucaacagcgagcgccacuacugcgccugccugaccuucugggagcccgccgagcccucccaggagaccacccgggucgaggacgccaccgagcgcgaggaggagggcgacgagggcgggcagacgcaccugagccccaccgcccccgcccccuccgcccagcuguucgcccccaagacccuggugcucgugagccggcuggaccacaccgaggucuuccgcaacucccuggggcucaucuacgccauccacguggagggccugaacgugugccuggagaacgucaucgggaaccuccugacgugcaccgugccccuggccggcggcagccagcggaccaucucccucggggccggcgaccgccaggugauccagacgccccucgccgacagccugcccgucucccggugcagcguggcccuccuguuccgccagcuggggaucacgaacgugcucucccuguucugcgcggcccugaccgagcacaagguccucuuccugagccgguccuaccagcgccuggccgacgccugccggggccuccuggcccuccuguucccccugcgcuacagcuucaccuacgugcccauccugcccgcgcagcuccuggaggugcuguccaccccgacgcccuucaucaucggcgucaacgccgccuuccaggccgagacccaggagcuccuggacgugaucguggccgaccuggacgggggcaccgucaccauccccgagugcgugcacaucccgccgcuccccgagccccugcagagccagacgcacuccgugcugagcaugguccucgaccccgagcuggagcuggcggaccucgccuucccgccgcccaccaccagcaccuccagccugaagaugcaggacaaggagcugcgggccguguuccugcgccucuucgcccagcugcugcagggguaccgguggugccuccacgucgugcgcauccacccggagcccgugauccgguuccacaaggccgcguuccugggccagcgcgggcuggucgaggacgacuuccucaugaaggugcuggagggcauggccuucgccggcuucguguccgagcgcgggguccccuaccggcccacggaccuguucgacgagcucguggcccacgagguggcgcgcaugcgggccgacgagaaccacccgcagcgcguccugcggcacgugcaggagcuggccgagcagcucuacaagaacgagaaccccuaccccgccguggccaugcacaagguccagcgccccggcgagagcucccaccuccggcgcgugccgcggcccuucccccgccuggacgaggggaccgugcaguggaucgucgaccaggcggccgccaagaugcagggcgcgccgcccgccgugaaggcggagcggcgcaccaccgugcccagcgggccgcccaugacggccauccucgagcggugcuccggccugcacgucaacagcgcccgccggcuggagguggugcgcaacugcaucuccuacgucuucgagggcaagaugcucgaggccaagaagcugcugcccgccgugcuccgggcgcugaaggggcgcgccgcccggcgcugccuggcccaggagcuccaccuccacgugcagcagaaccgcgcgguccuggaccaccagcaguucgacuucguggugcggaugaugaacugcugccuccaggacugcaccagccuggacgagcacggcaucgccgccgcccugcucccccuggucaccgccuucugccgcaagcugucccccggggugacccaguucgcguacagcugcgugcaggagcacgucgugugguccacgccccaguucugggaggccauguucuacggcgacgugcagacccacauccgggcccucuaccuggagccgaccgaggaccuggcccccgcccaggaggucggggaggcgcccagccaggaggacgagcgcuccgcccucgacguggccagcgagcagcggcgccuguggcccacccugucccgggagaagcagcaggagcucgugcagaaggaggagagcacggucuucucccaggccauccacuacgccaaccgcaugagcuaccugcugcucccgcuggacagcuccaagagccggcugcuccgcgagcgggcgggccugggcgaccuggaguccgccagcaacucccucgugaccaacagcauggccggguccguggccgagagcuacgacaccgaguccggcuucgaggacgcggagaccugcgacgucgccggggccguggugcgcuucaucaaccgguucgucgacaaggugugcaccgagagcggcgugacguccgaccaccugaagggccugcacgucauggugcccgacaucgugcagaugcacaucgagacccucgaggccguccagcgcgagagccggcgccugcccccgauccagaagcccaagcugcuccggccccgccugcugcccggggaggagugcgugcucgacggccugcggguguaccugcucccggacgggcgcgaggagggcgccgggggcuccgcgggcgggcccgcccugcugcccgccgagggcgccgucuuccucaccaccuaccgggugaucuucacggggaugcccaccgacccgcuggucggcgagcaggucgugguccgcagcuuccccguggccgcgcugaccaaggagaagcgcaucuccgugcagacccccgucgaccagcuccugcaggacgggcugcagcuccggagcugcacguuccagcugcugaagauggccuucgacgaggaggugggcuccgacagcgccgagcuguuccgcaagcagcugcacaagcugcgguacccgcccgacauccgcgccaccuucgccuucacccucggcagcgcgcacacccccgggcggccgccccgcgugacgaaggacaagggccccucccugcggacccugagccgcaaccucgucaagaacgccaagaagaccaucgggcggcagcacgugacccgcaagaaguacaacccgcccuccugggagcaccggggccagcccccgcccgaggaccaggaggacgagaucagcguguccgaggagcuggagcccagcacgcugacccccuccagcgcccucaagccguccgaccgcaugaccaugagcucccuggucgagcgggccugcugccgcgacuaccagcggcuggggcucggcacccugagcuccagccugucccgcgccaagagcgagcccuuccggaucucccccgugaaccgcauguacgcgaucugccggagcuaccccggccuccugaucgugccgcaguccguccaggacaacgcccugcagcgcgugagccgcugcuaccggcagaaccgcuuccccguggucugcuggcggagcgggcgcuccaaggccgugcuccugcggagcggcgggcugcacggcaaggggguggucggccucuucaaggcccagaacgcgcccuccccgggccagagccaggccgacuccagcucccuggagcaggagaaguaccugcaggccguggugagcuccaugccccgcuacgccgacgccagcgggcggaacacgcuguccggcuucagcuccgcgcacauggggagccacguccccagcccccgcgcccgggugaccacccucagcaacccgauggccgccuccgccagccgccggaccgcgccccgcggcaaguggggcuccgugcggacgagcgggcgcagcuccggccuggggaccgacgucggcagccggcuggccgggcgcgacgcccucgcgccgccccaggccaacggcggcccgcccgaccccggguuccugcggccccagcgcgcggcccuguacauccucggcgacaaggcccagcugaagggggugcgguccgacccgcugcagcagugggagcucgugcccaucgaggucuucgaggcccgccaggugaaggcgagcuucaagaagcugcugaaggccugcgugcccggcugccccgccgccgagccgucccccgccagcuuccuccggucccuggaggacagcgaguggcugauccagauccacaagcuccugcaggucuccgugcugguggucgagcuccuggacagcggguccagcgugcuggugggccucgaggacggcugggacaucaccacccaggucgugucccuggugcagcugcucagcgaccccuucuaccgcacgcuggagggguuccgccugcucgucgagaaggaguggcuguccuucggccaccgguucagccaccgcggggcgcacacccuggccggccaguccagcggguucacccccguguuccuccaguuccuggacugcgugcaccagguccaccuccaguucccgauggaguucgaguucucccaguucuaccucaaguuccugggcuaccaccacgugagccggcgcuuccggaccuuccugcucgacagcgacuacgagcgcaucgagcugggccugcucuacgaggagaagggggagcggcgcggccaggugcccugccgguccgucugggaguacguggaccgccugagcaagcggacgcccguguuccacaacuacauguacgcccccgaggacgccgagguccugcgcccguacuccaacgugagcaaccucaaggucugggacuucuacaccgaggagacccuggccgaggggccgcccuacgacugggagcuggcgcagggcccgcccgagccgcccgaggaggagcgguccgacggcggggcgccccagagccgccggcgcgugguguggcccugcuacgacuccugcccccgggcccagcccgacgccaucagccgccuccuggaggagcugcagcggcucgagaccgagcugggccagcccgccgagcgcuggaaggacacgugggaccgcgucaaggccgcccagcggcuggaggggcgccccgacggccgggggacccccuccagccuccugguguccaccgcgccccaccaccgccggagccugggcguguaccuccaggagggcccggucggguccacccugagccugucccucgacagcgaccaguccagcggcuccaccacgagcgggagccgccaggccgcgcggcgcuccaccagcacccuguacucccaguuccagaccgccgagagcgagaaccgguccuacgagggcacgcuguacaagaagggggccuucaugaagcccuggaaggcccgcugguucgugcucgacaagaccaagcaccagcugcgguacuacgaccaccgcguggacaccgagugcaagggcgucaucgaccuggccgagguggaggcgguggcccccggcacccccacgaugggggccccgaagaccgucgacgagaaggccuucuucgacgugaagaccacccggcgcguguacaacuucugcgcccaggacguccccagcgcgcagcaguggguggaccggauccaguccugccucagcgacgccuga

SEQ ID NO: 36065 - RNA, 5550 nt, Artificial Sequence
  derived and/or modified sequence opt1 from SBF2__Homo_sapiens__NP_112224
auggcccgccuggccgacuacuucaucguggugggcuacgaccacgagaagcccgggagcggcgaggggcucggcaagaucauccagcgguucccccagaaggacugggacgacacccccuucccccaggggaucgagcuguucugccagcccggcggcuggcagcugagccgcgagcggaagcagcccaccuucuucguggugguccucacggacaucgacagcgaccgccacuacugcuccugccugaccuucuacgaggccgagaucaaccugcaggggaccaagaaggaggagaucgagggcgaggccaaggugagcgggcucauccagcccgccgagguguucgcccccaagucccugguccuggugagccggcucuacuaccccgagaucuuccgcgccugccugggccugaucuacaccguguacgucgacucccucaacgugagccuggagucccugaucgcgaaccucugcgccugccuggugcccgccgccgggggcagccagaagcuguucucccucggcgcgggggaccggcagcugauccagacgccccugcacgacagccuccccaucaccggcaccuccgucgcccugcuguuccagcagcucgggauccagaacgugcugagccuguucugcgccgugcucaccgagaacaagguccuguuccacuccgccagcuuccagcgccuguccgacgccugccgggcgcucgagagccugauguucccccugaaguacuccuaccccuacauccccauccuccccgcccagcugcuggaggugcucagcagccccacgccguucaucaucggcgugcacuccgucuucaagaccgacgugcacgagcugcuggacgugaucaucgccgaccucgacggcgggaccaucaagauccccgagugcauccaccugagcucccugcccgagccccuccugcaccagacccagagcgcccugucccucauccugcacccggaccuggaggucgccgaccacgcguucccgccgccccgcacggcccucagccacuccaagaugcuggacaaggaggugcgggccguguuccugcgccuguucgcccagcuguuccagggcuaccggagcugccugcagcugauccgcauccacgccgagccggucauccacuuccacaagaccgcguuccucgggcagcggggccugguggagaacgacuuccugaccaagguccucuccgggauggccuucgccggcuucgugagcgagcgcgggccgcccuaccgguccugcgaccuguucgacgagcugguggccuucgaggucgagcgcaucaagguggaggagaacaaccccgugaagaugaucaagcacguccgggagcucgccgagcagcuguucaagaacgagaacccgaacccccacauggcguuccagaaggugccccgcccgaccgaggggagccaccuccgggugcacauccuccccuuccccgagaucaacgaggcccgcguccaggagcugauccaggagaacguggccaagaaccagaacgcgccgcccgcgacgcgcaucgagaagaagugcgugguccccgccgggccgcccgugguguccaucauggacaaggucaccaccguguucaacagcgcccagcggcuggaggugguccgcaacugcaucuccuucaucuucgagaacaagauccucgagaccgagaagacgcugcccgccgcccugcgggcgcucaaggggaaggccgcccgccagugccugaccgacgagcugggccuccacgugcagcagaaccgggccauccuggaccaccagcaguucgacuacaucauccgcaugaugaacugcacccugcaggacugcagcucccucgaggaguacaacaucgccgcggcccugcugccccucaccagcgccuucuaccggaagcuggcccccggggugucccaguucgccuacacgugcguccaggaccaccccaucuggaccaaccagcaguucugggagaccaccuucuacaacgcggugcaggagcagguccgcagccuguaccucagcgccaaggaggacaaccacgccccgcaccugaagcagaaggacaagcugcccgacgaccacuaccaggagaagacggccauggaccucgcggccgagcagcugcggcuguggcccacccucuccaagagcacccagcaggagcugguccagcacgaggaguccaccguguucagccaggccauccacuucgccaaccugauggugaaccuccuggucccccuggacacguccaagaacaagcuccugcgcaccagcgccccgggcgacugggaguccggcagcaacuccaucgugaccaacagcaucgcgggguccguggccgagagcuacgacaccgaguccggcuucgaggacagcgagaacacggacaucgccaacuccgucgugcgguucaucacccgcuucaucgacaaggugugcaccgagagcggggucacccaggaccacaucaagucccugcacugcaugauccccggcaucguggccaugcacaucgagacccucgaggccgugcaccgggagagccgccggcugccgcccauccagaagccgaagauccugcgccccgcgcuccugcccggggaggagaucgucugcgagggccugcgggugcuccuggaccccgacggccgcgaggaggccaccggcggccugcucgggggcccgcagcugcugcccgccgagggcgcccucuuccugaccaccuaccggauccuguuccgcgggacgccccacgaccagcucgugggcgagcagacggucgugcgcagcuucccgaucgccuccaucaccaaggagaagaagaucaccaugcagaaccagcugcagcagaacaugcaggaggggcugcagaucaccagcgcguccuuccagcucaucaagguggccuucgacgaggaggucagccccgaggugguggagaucuucaagaagcagcugaugaaguuccgguacccccaguccaucuucagcacguucgccuucgccgcgggccagaccacgccccagaucauccugccgaagcagaaggagaagaacaccuccuuccgcaccuucagcaagaccaucgucaagggggccaagcgggccggcaagaugaccaucggccgccaguaccuccugaagaagaagaccgggacgaucguggaggagcgggugaaccgccccggcuggaacgaggacgacgacgucuccgugagcgacgaguccgagcugcccaccagcaccacccucaaggccuccgagaaguccacgauggagcagcugguggagaaggccugcuuccgggacuaccagcgccuggggcucggcaccaucuccgggagcuccagccggucccgccccgaguacuuccggaucaccgcgagcaaccgcauguacagccugugccgguccuacccgggccugcucgucgugccccaggccguccaggacagcucccugccccgcguggcccggugcuaccgccacaaccggcugcccguggucugcuggaagaacagccgcuccggcacccuccugcugcggagcgggggcuuccacgggaagggcguggugggccuguucaagucccagaacagcccgcaggccgcccccacguccagccuggaguccagcuccagcaucgagcaggagaaguaccugcaggcgcuccugaacgccgucuccgugcaccagaagcugcgcggcaacagcacccucaccgugcggcccgccuucgcccugucccccggcgucugggccagccugcgcuccagcacccgccucaucagcuccccgacgagcuucaucgacgugggggcgcggcuggccggcaaggaccacuccgccagcuucuccaacagcuccuaccugcagaaccagcuccugaagcgccaggccgcccuguacaucuucggggagaagucccagcugcggaacuucaagguggaguucgcgcucaacugcgaguucguccccguggaguuccacgagauccgccaggugaaggccuccuucaagaagcugaugcgggccugcauccccagcaccauccccaccgacuccgaggucaccuuccugaaggcccucggcgacagcgagugguucccgcagcugcaccgcaucaugcagcuggcggugguggucuccgaggugcucgagaacgggagcuccgugcuggucugccuggaggagggcugggacaucacggcccaggugaccagccucgugcagcugcuguccgaccccuucuaccggacccucgagggcuuccagaugcuggucgagaaggaguggcugagcuucgggcacaaguucucccagcgcagcagccucacccugaacugccagggcuccggguucgcccccguguuccugcaguuccucgacugcgugcaccagguccacaaccaguaccccacggaguucgaguucaaccuguacuaccugaaguuccucgccuuccacuacgugagcaaccgguucaagaccuuccugcuggacuccgacuacgagcgccucgagcacggcacccuguucgacgacaagggcgagaagcacgccaagaagggggugugcaucugggagugcaucgaccggaugcacaagcgcagcccgaucuucuucaacuaccuguacagcccccucgagaucgaggcgcugaagcccaacgucaacgugagcucccugaagaagugggacuacuacaucgaggagacccucagcaccggccccuccuacgacuggaugaugcugacgccgaagcacuuccccagcgaggacuccgaccuggccggggaggccggcccccggagccagcgccggaccguguggccgugcuacgacgacgucuccugcacccagcccgacgcccucaccagccuguucuccgagaucgagaagcuggagcacaagcucaaccaggcccccgagaaguggcagcagcugugggagcgcgugacgguggaccugaaggaggagccccggaccgaccgcagccagcggcaccucucccgcagcccggggaucgucuccaccaaccugcccagcuaccagaagcgcagccugcuccaccuccccgacuccagcaugggcgaggagcagaacuccagcaucucccccagcaacggcguggagcggcgcgcggccacccuguacucccaguacacgagcaagaacgacgagaaccgguccuucgaggggacccucuacaagcgcggcgcccugcugaagggguggaagccgcggugguucgugcucgacgucaccaagcaccagcugcgcuacuacgacagcggcgaggacaccuccugcaaggggcacaucgaccuggccgagguggagauggugauccccgccggccccagcaugggcgcgcccaagcacacguccgacaaggccuucuucgaccucaagaccagcaagcgggucuacaacuucugcgcccaggacgggcaguccgcccagcaguggauggacaagauccagagcugcaucuccgacgcguga

SEQ ID NO: 36066 - RNA, 4182 nt, Artificial Sequence
  derived and/or modified sequence opt1 from SBNO1__Homo_sapiens__NP_001161328
augguggagcccggccaggaccugcuccuggccgcccugagcgaguccgggaucagcccgaacgaccucuucgacaucgacggcggggacgcgggccuggccacccccaugcccacccccuccguccagcagagcgugccgcuguccgcccucgagcuggggcuggagacggaggccgccgugcccgucaagcaggagcccgagaccgugcccaccccggcgcuccugaacgugcgccagcagccgcccagcaccacgaccuucguccugaaccagaucaaccaccucccgccccugggcuccaccaucgugaugaccaagacgccgcccgugaccaccaaccggcagaccaucacgcugaccaaguucauccagaccaccgccagcacgcgccccuccgucagcgcccccaccgugcggaacgccaugaccuccgcgcccagcaaggaccaggugcagcucaaggaccugcugaagaacaacucccucaacgagcugaugaagcugaagccgcccgccaacaucgcccagcccgucgccaccgccgcgacggacgugagcaacggcaccgugaagaaggaguccagcaacaaggagggggcccgcauguggaucaacgacaugaagaugcgguccuucagccccaccaugaagguccccguggugaaggaggacgacgagcccgaggaggaggacgaggaggagaugggccacgccgagaccuacgccgaguacaugcccaucaagcucaagaucgggcugcgccaccccgacgccgucguggagacguccagccugagcuccgugaccccgcccgacgucugguacaagaccagcaucuccgaggagaccaucgacaacggcuggcucagcgcgcugcagcuggaggccaucacguacgccgcccagcagcacgagaccuuccuccccaacggggaccgggccggcuuccugaucggcgacggggcgggcguggggaagggccgcaccaucgccggcaucaucuacgagaacuaccugcucucccggaagcgcgcccugugguucagcguguccaacgaccugaaguacgacgccgagcgggaccuccgcgacaucggggccaagaacauccugguccacagccugaacaaguucaaguacggcaagaucuccagcaagcacaacggguccgugaagaagggcgucaucuucgcgaccuacagcucccucaucggggagagccaguccggcggcaaguacaagacgcggcugaagcagcugcuccacuggugcggggacgacuucgacggcgugaucguguucgacgagugccacaaggccaagaaccugugccccgucgggagcuccaagcccaccaagaccggccuggccgugcucgagcugcagaacaagcugccgaaggcccgcguggucuacgcgagcgccaccggggccuccgagccccggaacauggccuacaugaaccgccucggcaucuggggcgaggggacgcccuuccgggaguucagcgacuucauccaggccguggagcgccggggcgugggggcgauggagaucgucgccauggacaugaagcugcgcggcauguacaucgcccggcagcugagcuucaccggggugaccuucaagaucgaggaggugcuccugucccagagcuacgucaagauguacaacaaggccgugaagcugugggugaucgcccgcgagcgcuuccagcaggcggccgaccugaucgacgccgagcagcggaugaagaaguccauguggggccaguucuggagcgcccaccagcgcuucuucaaguaccucugcaucgccuccaaggucaagcggguggugcagcuggcgcgcgaggagaucaagaacggcaagugcgucgugaucgggcugcagagcaccggcgaggcccggacccucgaggcccuggaggagggcgggggcgagcugaacgacuucguguccacggccaaggggguccuccagagccugaucgagaagcacuuccccgcgccggaccgcaagaagcuguacucccuccugggcaucgaccugaccgcccccagcaacaacuccagcccccgggacucccccugcaaggagaacaagaucaagaagcgcaagggggaggagaucacccgggaggccaagaaggcccgcaaggugggcgggcucaccggcagcuccagcgacgacuccggcagcgagagcgacgccuccgacaacgaggagagcgacuacgaguccagcaagaacauguccagcggggacgacgacgacuucaacccguuccuggacgaguccaacgaggacgacgagaacgaccccuggcugauccggaaggaccacaagaagaacaaggagaagaagaagaagaaguccaucgaccccgacagcauccagagcgcgcuccuggccuccggccuggggagcaagcgccccuccuucagcuccacgccggugaucagccccgcccccaacuccacccccgccaacagcaacaccaacuccaacagcagccucaucaccucccaggacgccgucgagcgggcgcagcagaugaagaaggaccugcuggacaagcucgagaagcuggccgaggaccugccgcccaacacgcucgacgagcugaucgacgagcugggcgggcccgagaacguggccgagaugaccggccgcaagggccggguggucagcaacgacgacggguccaucagcuacgagucccgcagcgagcucgacgugcccguggagauccugaacaucaccgagaagcagcgguucauggacggcgacaagaacaucgccaucaucuccgaggccgcgagcuccgggaucagccugcaggccgaccgccgggccaagaaccagcgccgccggguccacaugacccucgagcugccgugguccgccgaccgcgcgauccagcaguucggccggacgcaccgcagcaaccaggugaccgcccccgaguacguguuccugaucuccgagcucgccggggagcagcgguucgccagcaucgucgccaagcgccuggagucccugggcgcgcucacccacggcgaccggcgcgccaccgagagccgggaccugucccgcuucaacuucgacaacaaguacgggcggaacgcccuggagaucgugaugaaguccaucgugaaccucgacagccccauggucagcccgccgcccgacuaccccggcgaguucuucaaggacgugcgccaggggcugaucggcguggggcugaucaacgucgaggaccggagcggcauccucacgcuggacaaggacuacaacaacaucggcaaguuccugaaccgcauccucgggauggaggugcaccagcagaacgcccuguuccaguacuucgccgacacccugaccgcggugguccagaacgccaagaagaacggccgguacgacauggggauccucgaccugggcuccggcgacgagaaggugcgcaagagcgacgugaagaaguuccugacccccggguacuccacgagcggccacgucgagcucuacaccaucuccguggagcgggggaugagcugggaggaggccaccaagaucugggccgagcugaccggccccgacgacggguucuaccugucccuccagauccgcaacaacaagaagacggccauccuggugaaggaggucaaccccaagaagaagcuguuccucguguaccggcccaacaccggcaagcagcugaagcuggagaucuacgcggaccucaagaagaaguacaagaagguggucagcgacgacgcccugaugcacuggcuggaccaguacaacuccagcgccgacacgugcacccacgccuacuggcgcggcaacugcaagaaggccucccucgggcuggugugcgagaucggccugcggugccgcaccuacuacguccucugcgggagcgugcuguccguguggaccaaggucgagggcgugcuggcgagcguguccgggaccaacgucaagaugcagaucgugcgccuccggaccgaggacggccagcgcaucgugggccugaucaucccggccaacugcgucagcccccuggugaaccuccuguccacgagcgaccagucccagcagcuggccgugcagcagaagcagcucuggcagcagcaccacccccagagcaucaccaaccugagcaacgccuga

SEQ ID NO: 36067 - RNA, 3930 nt, Artificial Sequence
  derived and/or modified sequence opt1 from SBNO2__Homo_sapiens__NP_001093592
augcgcgagccccugccgggcagcgccuccugggggacccccggcccccccagcgccgggaccaugucccagcuccagcuguggcugcaguucgaggcgcucaacaaggacagcuccuacuucgaggacuucagcaacaucuccaucuucagcuccagcguggacucccugagcgacaucgucgacacgccggacuuccugcccgccgacucccucaaccaggugagcaccaucugggacgacaaccccgcccccuccacccacgacaagcuguuccagcugagccggccguucgccggcuucgaggacuuccuccccucccacagcaccccccugcugguguccuaccaggagcagagcguccagagccagcccgaggaggaggacgaggccgaggaggaggaggcggaggagcucgggcacacggagaccuacgccgacuacgugccguccaagagcaagaucggcaagcagcaccccgaccgcguggucgagaccuccacccugagcuccgugccccccccggacaucacguacacccuggcccuccccagcgacuccggcgcccugagcgcgcugcagcucgaggccaucaccuacgccugccagcagcacgaggugcugcugcccuccgggcagcgggccggcuuccucaucggggacggcgccggggucggcaagggccgcaccguggcgggggugauccuggagaaccaccugcggggccgcaagaaggcccucugguucagcgucuccaacgaccugaaguacgacgccgagcgggaccugcgcgacaucgaggccacggggaucgccgugcacgcgcucagcaagaucaaguacggcgacaccaccaccuccgagggcgugcuguucgccacguacagcgcccugaucggggagucccaggccggcgggcagcaccggacccgccuccggcagauccuggacuggugcggcgaggccuucgagggggucaucguguucgacgagugccacaaggcgaagaacgccggcagcaccaagaugggcaaggccgugcuggaccuccagaacaagcugccccuggcccgcgucguguacgccuccgcgaccggggccagcgagccgcggaacaugaucuacaugucccgccucggcaucuggggggagggcacgcccuuccggaacuucgaggaguuccugcacgccaucgagaagcgcggggugggcgccauggagaucgucgcgauggacaugaaggugagcggcauguacaucgcccggcagcugagcuucuccggggugaccuuccgcaucgaggagaucccccucgcccccgccuucgagugcgucuacaaccgggccgcgcugcugugggccgaggcccucaacguguuccagcaggccgccgacuggaucggccuggagagccgcaagucccugugggggcaguucuggagcgcgcaccagcgguucuucaaguaccucugcaucgccgccaagguccgccgccugguggagcuggcccgggaggagcucgcccgcgacaagugcguggucaucggccugcaguccaccggggaggcgcggacccgcgaggugcugggcgagaacgacggccaccugaacugcuucgugagcgccgccgagggggucuuccucucccugauccagaagcacuucccgagcacgaagcggaagcgcgaccggggcgccggguccaagcgcaagcggcgcccccggggccgcggcgcgaaggccccccggcuggccugcgagaccgccggggugauccgcaucagcgacgacuccagcaccgaguccgaccccggccucgacagcgacuucaacuccagcccggagucccugguggacgacgacgucgugaucguggacgccgucgggcugcccagcgacgaccggggcccccucugccugcugcagcgcgacccgcacgggcccggcgugcucgagcggguggagcgccugaagcaggaccugcucgacaagguccggcgccugggccgcgagcugcccgugaacacccucgacgagcugaucgaccagcuggggggcccccagcggguggcggagaugacggggcgcaagggccgggucgugagccgcccggacgggaccguggccuucgagucccgggccgagcagggccucagcaucgaccacgucaaccugcgcgagaagcagcgguucauguccggcgagaagcugguggccaucaucagcgaggccuccagcuccggggugagccuccaggcggaccgccggguccagaaccagcgccggcgcgugcacaugacccuggagcugcccugguccgccgaccgggccauccagcaguucggccgcacccaccggagcaaccagguguccgcccccgaguacgucuuccucaucagcgagcuggccggggagcgccgguucgcguccaucguggccaagcgccuggagagccucggcgcccugacgcacggggaccggcgcgccaccgagucccgggaccugagcaaguacaacuucgagaacaaguacggcacccgcgcgcuccacugcgugcugaccacgauccugucccagaccgagaacaagguccccgugccgcagggcuaccccgggggcgugcccaccuucuuccgcgacaugaagcaggggcuccugagcgucggcaucgggggccgggagucccgcaacggcugccuggacguggagaaggacugcagcaucaccaaguuccucaaccggauccuggggcuggaggugcacaagcagaacgcccucuuccaguacuucagcgacaccuucgaccaccugaucgagauggacaagcgcgagggcaaguacgacauggggauccuggaccucgcccccggcaucgaggagaucuacgaggagucccagcaggucuuccuggccccgggccacccccaggacgggcaggugguguucuacaagaucagcgucgaccggggccugaagugggaggacgccuucgcgaagucccucgcccugacggggcccuacgacggcuucuaccugagcuacaaggugcgcgggaacaagcccuccugccuccuggccgagcagaaccggggccaguucuucaccguguacaagccgaacaucggccgccagagccagcuggaggcccucgacucccugcggcgcaaguuccaccgggucaccgccgaggaggcgaaggagcccugggagagcggguacgcccugucccucacccacugcagccacuccgccuggaaccgccacugccggcuggcccaggagggcaaggacugccugcaggggcuccgccugcggcaccacuacaugcugugcggcgcccuccugcgcgugugggggcggaucgcggccgugauggccgacgucagcuccagcuccuaccugcagaucgugcgccucaagacgaaggaccggaagaagcaggugggcaucaagauccccgagggcugcguccgccgcgugcugcaggagcugcggcucauggacgccgacgugaagcgccggcaggcccccgcgcuggggugcccggccccccccgccccccgcccgcuggcccuccccugcggccccggggagguccuggaccugaccuacagcccgcccgcggaggccuucccccccccgccccacuucuccuuccccgccccccucagccuggacgccggcccggggguggucccccugggcacccccgacgcccaggcggaccccgccgcccucgcccaccagggcugcgacaucaacuucaaggaggugcuggaggacaugcugcggucccuccacgccgggccgcccagcgagggcgcgcugggggagggcgccggcgccgggggcgccgccgggggcgggcccgagcgccagagcgugauccaguucucccccccguuccccggcgcgcaggccccccuguga

SEQ ID NO: 36068 - RNA, 1773 nt, Artificial Sequence
  derived and/or modified sequence opt1 from SBSN__Homo_sapiens__NP_001159506
augcaccuggcccgccucgugggcagcugcucccugcugcuccugcugggggcccucagcggcugggcggccuccgacgaccccaucgagaaggucaucgaggggaucaaccggggccugagcaacgccgagcgcgagguggggaaggcccuggacggcaucaacuccggcaucacccacgccgggcgggagguggagaaggucuucaacggccucagcaacauggggucccacaccggcaaggagcuggacaagggggugcagggccugaaccacggcauggacaagguggcgcacgagaucaaccacgggaucggccaggccgggaaggaggccgagaagcucggccacggcgucaacaacgccgcgggccagguggggaaggaggccgacaagcugauccaccacggggugcaccacggcgccaaccaggccgggagcgaggccggcaaguucggccagggggucgacaacgcggccggccaggccgggaacgaggccggccgcuucgggcagggcgugcaccacgccgcgggccaggccgggaacgaggccggccgguucgggcagggcgugcaccacgccgccgggcaggcgggcaacgaggccggccgcuucgggcagggcgcccaccacgggcuguccgagggcuggaaggagaccgagaaguucggccaggggauccaccacgccgccggccaggucgggaaggaggcggagaaguucggccagggggcccaccacgccgccggccaggcgggcaacgaggccgggcgguucggccagggggugcaccacggccucagcgagggguggaaggagaccgagaaguucggccagggcgugcaccacaccgccgggcaggucggcaaggaggccgagaaguucgggcagggcgcccaccacgcggccgggcaggccggcaacgaggccggccgcuucgggcagggcgcccaccacgcggccgggcaggccggcaacgaggccgggcgguucggccagggcgugcaccacgggcuguccgagggcuggaaggagaccgagaaguucgggcagggcgugcaccacgccgcgagccaguucggcaaggagacggagaagcuggggcacggcguccaccacggggugaacgaggccuggaaggaggccgagaaguucggccagggggugcaccacgccgcgucccaggucggcaaggaggaggaccgcguggugcagggccuccaccacggggucagccaggccggccgggaggccgggcaguucggccacgacauccaccacaccgccgggcaggccggcaaggagggcgacaucgcggugcacgggguccagccgggcgugcacgaggccgggaaggaggccggccaguucgggcagggcgugcaccacacccuggagcaggccggcaaggaggccgacaaggcgguccagggguuccacaccggcgugcaccaggccgggaaggaggccgagaagcugggccagggcgugaaccacgccgccgaccaggcggggaaggaggucgagaagcucggccagggggcccaccacgccgccggccaggcggggaaggagcugcagaacgcccacaacggcgugaaccaggccuccaaggaggccaaccagcugcucaacggcaaccaccagagcggguccagcucccaccagggcggggccacgaccacgccccuggcgagcggcgccagcgugaacacccccuucaucaaccugcccgcccucuggcgcuccgucgccaacaucaugccguga

SEQ ID NO: 36069 - RNA, 900 nt, Artificial Sequence
  derived and/or modified sequence opt1 from SC5D__Homo_sapiens__NP_008849
auggaccuggugcuccgcgucgccgacuacuacuucuucacccccuacguguacccggccaccuggcccgaggacgacaucuuccggcaggcgaucagccugcugaucgugacgaacgucggcgccuacauccucuacuucuucugcgccacccuguccuacuacuucguguucgaccacgcccugaugaagcacccccaguuccucaagaaccaggugcgccgggagaucaaguucaccguccaggcccugcccuggaucagcauccugaccguggcccucuuccugcuggagauccgcggguacuccaagcuccacgacgaccugggcgaguucccguacgggcuguucgagcucguggucagcaucaucuccuuccuguucuucacggacauguucaucuacuggauccaccggggccugcaccaccgccucguguacaagcggcugcacaagccccaccacaucuggaagauccccacccccuucgcgagccacgccuuccacccgaucgacggguuccugcagucccuccccuaccacaucuaccccuucaucuucccccugcacaagguggucuaccugagccucuacauccuggugaacaucuggaccaucuccauccacgacggcgacuuccgcgugccgcagauccugcagcccuucaucaacggcagcgcccaccacaccgaccaccacauguucuucgacuacaacuacgggcaguacuucacgcucugggaccggaucggcggguccuucaagaaccccagcuccuucgagggcaaggggccccugagcuacgucaaggagaugaccgagggcaagcgcuccagccacuccggcaacgggugcaagaacgagaagcuguucaacggcgaguucaccaagaccgaguga

SEQ ID NO: 36070 - RNA, 4392 nt, Artificial Sequence
  derived and/or modified sequence opt1 from SCAF11__Homo_sapiens__NP_004710
augaagaagaagaccgugugcacccugaacaugggcgacaagaaguacgaggacauggagggggaggagaacggcgacaacacgaucagcaccgggcuccuguacuccgaggccgaccgcugccccaucugccugaacugccuccuggagaaggaggucggcuucccggagagcugcaaccacguguucugcaugaccugcauccugaagugggccgagacccucgcguccugccccaucgaccggaagcccuuccaggccguguucaaguucagcgcccuggagggguacgucaaggugcaggugaagaagcagcugcgcgagacgaaggacaagaagaacgagaacuccuucgagaagcaggucagcugccacgagaacuccaagagcugcauccggcgcaaggccaucgugcgggaggaccuccuguccgccaaggugugcgaccugaaguggauccaccgcaacagccucuacuccgagaccggcggcaagaagaacgcggccaucaagaucaacaagccccagcggagcaacugguccaccaaccagugcuuccgcaacuucuucagcaacauguucuccagcgucucccacagcggggaguccagcuucaccuaccgggccuacugcacggaguucaucgaggccagcgagaucuccgcgcugauccgccagaagcggcacgagcuggagcucagcugguucccggacacccugcccggcaucgggcgcaucggcuucauccccuggaacguggagaccgaggugcugccccucaucuccagcguccugccgcggaccaucuuccccacguccaccaucagcuucgagcacuucgggaccuccugcaagggcuacgcccuggcccacacccaggagggcgaggagaagaagcagacgagcgggaccuccaacacccgcggcagccggcgcaagcccgccaugaccacgcccacccggcgcuccacccggaacacccgcgccgagacggcgagccagucccagcggagcccgaucuccgacaacagcgggugcgacgcccccggcaacuccaaccccagccucuccgugcccagcagcgccgaguccgagaagcagacccgccaggccccgaagcgcaagagcgugcggcgcggccggaagcccccccugcugaagaagaagcuccgcuccagcgucgccgcgcccgagaaguccagcuccaacgacagcguggacgaggagaccgccgaguccgacaccagcccggugcuggagaaggagcaccagcccgacgucgacuccagcaacaucugcacggugcagacccacguggagaaccaguccgccaacugccugaagagcugcaacgagcagaucgaggaguccgagaagcacaccgccaacuacgacaccgaggagcgggucgggagcuccagcagcgaguccugcgcccaggaccuccccgugcuggugggcgaggagggggaggucaagaagcuggagaacacgggcaucgaggcgaacgugcucugccuggagagcgagaucuccgagaacauccuggagaaggggggcgacccccucgagaagcaggaccagaucagcggccugucccagagcgaggucaagaccgacgugugcaccgugcaccugccgaacgacuuccccaccugccucacguccgagagcaaggucuaccagcccguguccugcccccugagcgaccuguccgagaacguggagagcgucgugaacgaggagaagaucaccgaguccagccucguggagaucaccgagcacaaggacuucacccugaagaccgaggagcugaucgaguccccgaagcucgagagcuccgagggggagaucauccagacggucgaccgccagagcgugaagucccccgaggugcagcugcugggccacgucgagaccgaggacguggagaucaucgccaccugcgacaccuucgggaacgaggacuucaacaacauccaggacagcgagaacaaccuccugaagaacaaccugcucaacacgaagcuggagaagagccuggaggagaagaacgagucccugaccgagcacccccggagcaccgagcucccgaagacccacaucgagcagauccagaagcacuucuccgaggacaacaacgagaugauccccauggagugcgacagcuucugcuccgaccagaacgagagcgagguggagcccuccgucaacgccgaccugaagcagaugaacgagaacagcgugacgcacugcuccgagaacaacaugcccagcuccgaccuggccgacgagaagguggagaccgucagccagccguccgagagccccaaggacaccaucgacaagaccaagaagccccgcacgcggcgcucccgguuccacagccccuccaccaccuggagcccgaacaaggacaccccccaggagaagaagcgcccccagucccccagcccgcggcgcgagacgggcaaggagagccggaagucccagagccccucccccaagaacgagagcgcccgcgggcggaagaagucccgcagccagucccccaagaaggacaucgcgcgggagcgccgccagagccagucccggagcccgaagcgcgacaccacccgggagucccgccggagcgagucccucagcccccgccgggagaccucccgcgagaacaagcggagccagccccgcgugaaggacuccagccccggcgagaagucccggagccagagccgcgagcgggaguccgaccgcgacggccagcggcgcgagcgggagcgccggacgcgcaaguggagccggucccgcagccacucccgcagcccgucccggugccgcaccaagagcaaguccagcuccuucgggcggaucgaccgcgacagcuacuccccccgguggaagggccgcugggccaacgacggguggcggugcccccgcggcaacgaccgguaccgcaagaacgaccccgagaagcagaacgagaacacccggaaggagaagaacgacauccaccuggacgccgacgacccgaacagcgccgacaagcaccgcaacgacugccccaacuggaucaccgagaagaucaacuccgggcccgacccgcggacgcgcaaccccgagaagcugaaggagagccacugggaggagaaccggaacgagaacuccggcaacagcuggaacaagaacuucggcuccgggugggugagcaaccgcggccgggggcgcggcaaccggggccgcgggaccuaccgcagcuccuucgcguacaaggaccagaacgagaaccgguggcagaaccgcaagccccucagcggcaacuccaacagcuccgggagcgaguccuucaaguucgucgagcagcagagcuacaagcggaaguccgagcaggaguucagcuucgacacccccgccgaccgcuccggcuggaccagcgccuccagcugggccgugcggaagacgcugccggccgacgugcagaacuacuacucccgccgggggcgcaacagcuccggcccccagagcggcuggaugaagcaggaggaggagaccuccgggcaggacagcagccugaaggaccagaccaaccagcaggucgacggcucccagcuccccaucaacaugaugcagccccagaugaacgugaugcagcagcagaugaacgcgcagcaccagccgaugaacaucuuccccuaccccguggggguccacgccccccugaugaacauccagcggaacccguucaacauccacccccagcugccccuccaccugcacaccggcgugccccugaugcagguggccacgccgaccagcgucucccaggggcuccccccccccccgcccccccccccgcccagccagcaggugaacuacaucgccucccagcccgacggcaagcagcugcagggcauccccagcuccagccacguguccaacaacaugagcaccccgguccugcccgcccccaccgcggccccggggaacacgggcauggugcaggggcccuccagcggcaacaccuccagcuccagccacuccaaggccagcaacgccgccgugaagcucgcggagagcaaggucuccguggccguggaggccagcgccgacuccagcaagaccgacaagaagcugcagauccaggagaaggcggcccaggaggucaagcuggccaucaagcccuucuaccagaacaaggacaucaccaaggaggaguacaaggagaucgugcgcaaggccguggacaaggucugccacuccaagagcggggaggugaacuccaccaagguggccaaccucgucaaggcguacguggacaaguacaaguacagccggaagggcucccagaagaagacgcuggaggagcccgugagcaccgagaagaacaucggcuga

SEQ ID NO: 36071 - RNA, 3939 nt, Artificial Sequence
  derived and/or modified sequence opt1 from SCAF1__Homo_sapiens__NP_067051
auggaggaggaggacgagagccgcggcaagaccgaggaguccggggaggaccggggcgacgggcccccggaccgcgaccccacccugagccccuccgccuucauccuccgggccauccagcaggcggugggcagcucccugcagggggaccugcccaacgacaaggacggcagccgcugccacggccuccgguggcgccggugccgcuccccgcggagcgagccccgcucccaggagagcgggggcacggacaccgccaccguccuggacauggccaccgacuccuuccuggccgggcucgugagcgugcuggacccccccgacacgugggucccgucccggcuggaccuccgccccggcgagagcgaggacaugcuggagcugguggccgaggugcggaucggggaccgcgaccccaucccccucccgguccccucccugcugccccggcuccgcgcguggcggaccggcaagaccgugagcccccaguccaacagcucccgcccgaccugcgcccggcaccugacgcugggcaccggggacggcgggcccgccccccccccggcccccagcagcgcguccagcucccccagccccuccccgagcuccagcucccccagcccccccccgccccccccgccccccgcccccccggccccccccgccccccgcuucgacaucuacgacccguuccaccccaccgacgaggccuacuccccccccccggcgcccgagcagaaguacgaccccuucgagcccaccggcagcaacccguccagcuccgccggcacgcccagccccgaggaggaggaggaggaggaggaggaggaggaggaggaggaggaggacgaggaggaggaggaggggcucucccagagcaucucccggaucagcgagacccuggccggcaucuacgacgacaacagccugucccaggacuuccccggggacgagagcccgcgccccgacgcccagcccacccagcccaccccggcccccggcacgcccccgcagguggacuccacccgcgcggacggggccaugcggcgccgggucuucguggugggcaccgaggccgaggccugccgcgagggcaaggucagcguggagguggucaccgccgggggcgcggcccucccccccccccugcugccgcccggggacuccgagaucgaggagggcgagaucgugcagcccgaggaggagccccggcucgcccugagccuguuccgcccggggggccgggccgcccgccccacgcccgcggccuccgccacccccaccgcccagccgcucccccagccccccgcgccgcgggcccccgagggcgacgacuuccugagccugcacgccgaguccgacggggagggcgcccuccagguggaccugggggagcccgcccccgcgccgcccgccgccgacagccgcuggggcgggcuggaccuccggcgcaagauccugacccagcggcgcgagcgguaccgccagcggucccccagccccgccccggcccccgcgcccgccgccgccgccggccccccgacgcgcaagaagucccggcgcgagcgcaagcggagcggcgaggcgaaggaggccgccuccagcuccagcgggacccagcccgcccccccggcgcccgccagccccugggacuccaagaagcaccgcagccgggaccgcaagcccggcucccacgccagcuccagcgcccggcgccggucccgcagccggucccgcagccgguccacccgccggcgcagccgguccaccgaccgccggcgcgggggcagccggcgcucccggagccgcgagaagcgccggcgccggcgccgguccgccagcccgccccccgcgacguccagcagcuccagcucccgccgggagcgccaccggggcaagcaccgcgacgggggcgggagcaagaagaagaagaagcggucccgcagccggggcgagaagcgcuccggggacggcagcgagaaggcccccgccccggcccccccccccuccggcagcaccuccugcggggaccgggacagccgccggcgcggcgccgucccgcccuccauccaggaccugaccgaccacgaccucuucgcgaucaagcggaccaucacgguggggcgccuggacaagagcgacccccgcggccccuccccggcccccgccagcucccccaagcgggaggugcuguacgacagcgaggggcucuccggcgaggagcgcggcgggaagagcagccagaaggaccggcgccgguccggcgccgccagcuccagcuccagcucccgcgagaaggggagccggcgcaaggcgcuggacggcggggaccgggaccgcgaccgggaccgcgaccgggaccgcgaccgguccagcaagaaggcccgccccccgaaggaguccgcccccagcuccggcccccccccgaagccccccgucagcuccggcagcggguccagcuccagcagcuccagcugcuccagccggaaggugaagcugcaguccaagguggccguccucauccgcgagggcgugagcuccaccacccccgcgaaggacgccgccagcgccgggcugggcuccaucggggucaaguucagccgggaccgcgagucccggagcccguuccugaagcccgacgagcgcgcccccaccgagauggcgaaggccgccccgggcuccacgaagcccaagaagaccaaggugaaggccaaggccggcgcgaagaagaccaaggggaccaagggcaagaccaagcccagcaagacgcgcaagaaggugcgguccgggggcggcagcgggggcuccgggggccaggucagccucaagaaguccaaggccgacagcugcagccaggccgccgggaccaagggcgccgaggagaccuccuggagcggcgaggagcgcgcggccaaggugcccuccaccccgccccccaaggccgcccccccgccccccgcccugacgcccgacagccagaccguggacuccagcugcaagaccccggaggucuccuuccugcccgaggaggcgaccgaggaggccggggugcggggcggggccgaggaggaggaggaggaggaggaggaggaggaggaggaggaggaggaggaggagcagcagcccgccacgaccaccgcgaccagcacggccgccgccgcccccuccaccgcgccgagcgccggcuccaccgccggggacagcggcgccgaggacggccccgccucccgcgugagccagcuccccacccugcccccgcccaugcccuggaaccugcccgcgggggucgacugcacgaccuccggcgugcuggcccucaccgcccugcuguucaagauggaggaggccaaccucgccagccgggcgaaggcccaggagcugauccaggccaccaaccagauccugucccaccgcaagccgcccagcucccucgggaugacgcccgccccggugcccaccagccugggccugccccccgggccgagcuccuaccuccugcccggcagccugccccucggcgggugcggcuccacccccccgacccccacggggcuggcggccaccagcgacaagcgggagggcuccagcuccagcgagggccgcggggacaccgacaaguaccugaagaagcuccacacccaggagcgggccgucgaggaggugaagcuggccaucaagcccuacuaccagaagaaggacaucacgaaggaggaguacaaggacauccugcgcaaggccgugcacaagaucugccacuccaagagcggcgagaucaaccccgucaagguguccaaccucgugcgggcguacguccagcgcuaccgguacuuccgcaagcacgggcggaagccgggcgacccccccgggcccccgcgcccccccaaggagcccggcccgcccgacaagggcgggcccggccugccccugccgccccucuga

SEQ ID NO: 36072 - RNA, 3399 nt, Artificial Sequence
  derived and/or modified sequence opt1 from SCAF4__Homo_sapiens__NP_001138916
auggacgccgugaacgccuucaaccaggagcuguucagccucauggacaugaagcccccgaucucccgcgcgaagaugauccugaucaccaaggccgccaucaaggccaucaagugcaagcccgaguacaagguccccggccuguacgugaucgacagcaucgugcggcagucccgccaccaguucgggaccgacaaggacgucuucggcccccgguucagcaagaacaucacggccaccuuccaguaccucuaccugugcccguccgaggacaagagcaagaucgugcgcgugcugaaccucuggcagaagaacggggucuucaagaucgagaucauccagccccugcuggacauggcggccggcaccuccaacgccgcccccguggcggagaacgugaccaacaacgaggggagccccccgccccccgucaagguguccagcgagcccccgacgcaggccacccccaacuccgugcccgccgucccccagcucccgagcuccgacgccuucgccgcgguggcccagcuguuccagaccacccagggccagcagcugcagcagauccuccagacguuccagcagccccccaagccccagagcccggcccuggacaacgccgugauggcccagguccaggcgaucaccgcccagcugaagaccacccccacgcagcccuccgagcagaaggccgccuuccccccgcccgagcagaagaccgccuucgacaagaagcuccuggaccgguucgacuacgacgacgagcccgaggcgguggaggagagcaagaaggaggacaccaccgccgugacgaccaccgcccccgccgccgcggucccgcccgcccccaccgccacggugccggccgcggccgcccccgccgccgcguccccccccccgccccaggcccccuucggcuuccccggggacggcaugcagcagccggccuacacccagcaccagaacauggaccaguuccagccccgcaugauggggauccagcaggaccccaugcaccaccaggugccccugccgcccaacggccagaugcccggguucggccuccugcccaccccgcccuucccccccauggcccagccggucaucccccccacccccccggugcagcagcccuuccaggccagcuuccaggcgcagaacgagccccugacgcagaagccgcaccagcaggagauggagguggagcagcccugcauccaggaggucaagcggcacauguccgacaaccgcaagagccggagccgcuccgccagccggucccccaagcgccggcgcagccgguccggcagccgcucccggcgcagccggcaccgccggucccgcagccgcucccgggaccgccggcgccacagcccccggucccgcagccaggagcggcgcgaccgggagaaggagcgcgagcggcgccagaaggggcucccgcaggugaagcccgagaccgccuccgucugcagcaccacccugugggugggccagcuggacaagcggacgacccagcaggacguggccucccuccuggaggaguucgggcccaucgagagcaucaacaugauccccccgcgcggcugcgccuacaucgucauggugcaccggcaggacgcguaccgcgcccugcagaagcucucccggggcaacuacaaggugaaccagaagagcaucaagaucgccugggcccugaacaaggggaucaaggcggacuacaagcaguacugggacgucgagcugggcgugaccuacauccccugggacaaggugaagcccgaggagcucgagagcuucugcgaggggggcaugcuggacuccgacacccugaaccccgacuggaaggggaucccgaagaagcccgagaacgaggucgcccagaacggcggcgccgagacgagccacaccgagcccgugucccccaucccgaagccccuccccgugcccgucccgcccauccccgugcccgccccgaucaccgugccccccccccaggucccgccccaccagcccgggccgcccguggugggcgcccugcagccccccgcguucaccccgccccuggggaucccccccccgggcuucgggcccggcgucccccccccgcccccccccccgcccuuccuccgccccggcuucaaccccaugcaccugccgcccggguuccugccccccggcccgcccccccccaucacgccgcccgugagcauccccccgccccacaccccccccaucuccaucccgaacagcaccaucgccgggaucaacgaggacaccaccaaggaccucuccaucggcaaccccauccccacgguggucagcggggcccggggcaacgccgaguccggcgacagcgugaagauguacggguccgccgugcccccggcggcccccaccaaccugcccacccccccggucacccagcccgugagccugcucggcacgcaggggguggcccccggccccgucaucggccugcaggccccguccaccgggcugcucggcgcccgccccgggcugaucccccugcagcgccccccgggcaugccccccccccaccuccagcgguucccgcugaugcccccccgcccgaugcccccccacaugaugcaccgggggcccccgcccggccccggcggguucgcgaugcccccgccccacggcaugaaggggcccuuccccccgcacggccccuucgugcgccccgggggcaugcccggccuggggggcccggggcccggccccgggggccccgaggaccgggacggccgccagcagccgccccagcagccccagcagcagccccagccgcaggccccccagcagccccagcagcagcagcagcagcagcccccgcccagccagcagcccccgcccacccagcagcagccccagcaguuccggaacgacaaccgccagcaguucaacuccgggcgggaccaggagcgcuucggccggcgcagcuucgggaaccggguggagaacgaccgcgagcgguacggcaaccgcaacgacgaccgggacaacuccaaccgcgaccggcgcgagugggggcggcgcagccccgaccgcgaccggcaccgcgaccuggaggagcggaaccgccggagcuccggccaccgcgaccgggagcgcgacagccgggaccgcgagucccggcgcgagaaggaggaggcccggggcaaggagaagccggaggucaccgaccgcgccgggggcaacaagacgguggagccccccaucagccagguggggaacgucgacaccgcguccgagcucgagaagggcgugagcgaggccgccgugcugaagcccuccgaggagcugccggccgaggccaccagcuccgucgagcccgagaaggacagcggcuccgcggccgaggccccccgguga

SEQ ID NO: 36073 - RNA, 4014 nt, Artificial Sequence
  derived and/or modified sequence opt1 from SCAF8__Homo_sapiens__NP_001273118
augccccagccgcugcuccccgcccugcccccccugagcuccccgagcggcgccggguccugcggccccagcgggggcgagugcuccgggcgccggcucuuccgccggcgcgcgcggggccugcgcagcgacaacauggaggccgugaagaccuucaacuccgaggacugcgccagcacccccgccugcacggacugcuucuccagcuccauggacacccggagcauccuguacucccucaacgacuacaagcccccgaucagcaaggccaagaugacccagaucaccaaggcggccaucaaggccaucaaguucuacaagcacgucgugcaguccguggagaaguucauccagaagugcaagcccgaguacaagguccccggccuguacgugaucgacagcaucgugcgccagucccggcaccaguucgggcaggagaaggacgucuucgccccccgcuucagcaacaacaucaucuccacguuccagaaccuguaccggugcccgggcgacgacaagagcaagaucgugcgcgugcucaaccuguggcagaagaacaacgucuucaagagcgagaucauccagccccugcucgacauggcggccgggaucccccccccgguggugacccccguccuggccuccaccaccacggccaugagcaacacccccggcacccccgugaccccggugacgcccgccaacgucgugcaggggcugcccgaccccugggugucccagaucaccaacaccgacacccucgcggccgucgcccagauccugcagagcccgcagggccagcagcugcagcagcucauccagacgcugcagauccagcagcagaagccccagcccuccauccugcaggcccucgacgccggccugguggugcagcugcaggcgcucaccgcccagcugaccgccgccgccgcggccgccaacacccugacgccccucgagcagggggucagcuucaacaagaagcugauggaccgguucgacuucggcgaggacuccgagcacagcgaggagccgaagaaggagauccccgccucccagcugagccacguguccgagagcgugaacaacuccaucuuccaccagaucgccgagcagcuccagcagcagaaccuggagcaccugcgccagcagcuccuggagcagcagcagccccagaaggcgaccccgcaggacagccaggaggggaccuucggcuccgagcacagcgccucccccagccagggcuccagccagcagcacuuccuggagcccgaggucaaccucgacgacagcaucgacauccagcagcaggacauggacaucgacgaggggcaggacggcguggaggaggaggucuucgagcaggaggccaagaagguggccgugcggucccgcagccggacccacucccgcagccggucccgcagcccccggaagcgccgcucccggagccgcuccgggagccggaagcgcaagcaccggaagcgcucccggagccgcucccgggagcgcaagcggaagagcucccgcagcuacuccagcgagcggcgcgcgcgggagcgcgagaaggagcggcagaagaagggccugccgcccauccgcagcaagacgcuguccgucugcagcaccacccucuggguggggcagguggacaagaaggccacccagcaggaccugacgaaccuguucgaggaguucggccagaucgaguccaucaacaugauccccccccggggcugcgccuacgucugcauggugcaccgccaggacgccuuccgcgcccuccagaagcugagcuccgggagcuacaagaucggcuccaaggugaucaagaucgcgugggcccugaacaagggggucaagaccgaguacaagcaguucugggacguggaccucggcgugaccuacaucccgugggagaaggucaagguggacgaccuggagggguucgccgagggcggcaugaucgaccaggagaccgugaacacggagugggagaccgucaagagcuccgagcccgugaaggagaccgugcagaccacgcagagccccacccccgucgagaaggagaccguggugaccacccaggccgaggucuucccgccccccguggccaugcugcagauccccguggcgccggccguccccacggugucccucgugccccccgccuucccggucagcaugcccgugccccccccgggguucucccccauccccccgccccccuuccugcgggccagcuucaaccccucccagccgccccccggcuucaugcccccgcccgugccccccccggucgugcccccccccaccaucccgcccgugguccccaccagccuggugcagcccucccugagcaugaccccggagacggugaaggacgucggguucggcucccucgugauccccgggggcagcguggccagcaaccuggcgaccuccgcccugcccgccggcaacgucuucaacgcccccaccaagcaggcggagccggaggagaaggugccccaccucaucgaccaccagaucagcuccggggagaacacccgcagcgugauccccaacgacaucuccagcaacgccgccauccugggcgggcagcccccgaacgucacguccaacagcggcauccugggcgugcagcggcccaacguguccagcaacuccgagauccucgggguccgccccagcaacguguccagcuccagcggcaucaucgccgcccagccgcccaacauccugaacaacuccgggauccugggcauccagccccccagcguguccaacagcagcgggcuccugggcguccugccgcccaacauccccaacaacuccggccucgugggggugcagcccccgaacguccccaacacccccggccugcuggggacccagcccccggcgggcccccagaaccuccccccccugagcaucccgaaccagcggaugcccaccaugcccaugcuggacauccgccccgggcucaucccgcaggcccccggcccccgguucccccugauccagccgggcauccccccccagcgcgggauccccccgcccuccgugcuggacagcgcccuccaccccccgccccggggccccuuccccccgggggacaucuucucccagcccgagcgccccuuccuggcccccggccggcagagcgucgacaacgugacgaacccggagaagcgcaucccccuggggaacgacaacauccagcaggagggcgaccgggacuaccgcuucccccccaucgagacccgggaguccaucagccgcccgccccccguggacguccgggacguggugggccgccccaucgacccgcgggaggggcccggccgccccccccucgacgggcgggaccacuucggccgcccgcccgucgacauccgcgagaaccuggugcggcccgggaucgaccaccugggccgccgggaccacuucggcuucaaccccgagaagccgugggggcaccgcggcgacuucgacgagcgggagcaccgcgugcuccccgucuacgggggccccaagggccugcacgaggagcgggggcgcuuccgguccggcaacuaccgcuucgacccgcggagcgggcccuggaaccgcggcuucgggcaggaggugcaccgggacuucgacgaccgccggcgccccugggagcggcagcgcgaccgggacgaccgcgacuucgacuucugccgcgagaugaacggcaaccggcugggccgcgaccggauccagaacaccugggugcccccgccccacgcccgcgucuucgacuacuucgagggggcgaccucccagcggaagggcgacaacgugccccaggugaacggggagaacacggagcgccacgcccagcccccgcccauccccguccagaacgaccccgagcucuacgagaagcugaccagcuccaacgagaucaacaaggagaagagcgacaccguggccgacaucgaguccgagccgguggucgagagcaccgagacggagggcaccuga

SEQ ID NO: 36074 - RNA, 1821 nt, Artificial Sequence
  derived and/or modified sequence opt1 from SCAI__Homo_sapiens__NP_001138349
auggugcgcggcgcccggcagccccagcagccgcgcagccggcuggcgccccgccucaccgggaccgucgagaagccgccccggaagcgccggucccgcacggaguucgcccugaaggagaucaugagcuccggcggggccgaggacgacaucccccagggcgagcggaagaccgugaccgacuucugcuaccugcucgacaagagcaagcagcuguucaacgggcugcgcgaccucccccaguacggccagaagcaguggcaguccuacuucggccggaccuucgacguguacacgaagcuguggaaguuccagcagcagcaccgccagguccuggacaaccgguacgggcucaagcgcuggcagaucggcgagaucgccagcaagaucgggcagcuguacuaccacuacuaccugcggaccuccgagaccagcuaccucaacgaggccuucuccuucuacagcgccauccgccagcgguccuacuacagccaggugaacaaggaggaccgccccgagcugguggucaagaagcugcgguacuacgcgcgcuucaucguggugugccuccugcugaacaagauggacgucgugaaggaccucgugaaggagcuguccgacgagaucgaggacuacacccaccgguucaacacggaggaccaggucgaguggaaccuggugcuccaggagguggccgccuucaucgaggccgaccccgucauggugcugaacgacgacaacaccaucgugaucaccagcaaccgccuggcggagaccggcgccccgcuccuggagcaggggaugaucgucggccagcugucccucgccgacgcccugaucaucggcaacugcaacaaccaggugaaguucagcgagcugacgguggacauguuccgcaugcuccaggcccuggagcgggagcccaugaaccuggcgucccagaugaacaagcccgggaugcaggagagcgccgacaagcccacccgccgggagaacccgcacaaguaccuccuguacaagcccaccuucucccagcuguacaccuuccucgccgccagcuucaaggagcugcccgccaacagcguccugcucaucuaccuguccgcgacgggcguguuccccaccgggcgcagcgacuccgagggcccguacgacuucggcggggugcugaccaacagcaaccgggacaucaucaacggcgacgccauccacaagcgcaaccagucccacaaggagaugcacugccuccaccccggggaccuguaccccuucacccggaagccccuguucaucaucgucgacagcuccaacagcguggccuacaagaacuucacgaaccucuucggccagccgcuggucugccugcucucccccaccgccuaccccaaggcccugcaggaccagagccagcgcgggucccuguucacccuguuccucaacaacccccugauggcguuccuguucgugagcggccucuccagcaugcggcgcggccugugggagaagugccaggaguaccugcggaagaucaaccgcgacaucgcccagcuccugacccacucccggagcaucgaccaggccuuccugcaguucuucggggacgaguuccuccgccugcugcucacgcgguucaucuucugcuccgccaccaugcgcaugcacaagaucuuccgggagacccgcaacuacccggagagcuacccccagcugccccgggacgagaccguggagaacccccaccuccagaagcacauccuggagcuggccuccauccuggacguccgcaacguguucuucgagaacacgaucgacgacuacuga

SEQ ID NO: 36075 - RNA, 990 nt, Artificial Sequence
  derived and/or modified sequence opt1 from SCAMP2__Homo_sapiens__NP_005688
augagcgccuucgacaccaaccccuucgccgacccgguggacgucaaccccuuccaggaccccuccgugacccagcugacgaacgcgccccagggcgggcucgccgaguucaacccguucagcgagaccaacgccgccaccaccgugcccgucacgcagcugcccggcuccagccagcccgccgugcugcagccguccguggagcccacccagcccacgccccaggcggucgugagcgccgcccaggccgggcuccugcgccagcaggaggagcuggaccggaaggcggccgagcucgagcgcaaggagcgggagcugcagaacaccguggccaaccugcacguccgccagaacaacuggccgccccuccccuccuggugccccgugaagccgugcuucuaccaggacuucagcaccgagauccccgccgacuaccagcggaucugcaagaugcuguacuaccuguggaugcuccacuccgugacccuguuccugaaccuccuggccugccuggcgugguucagcggcaacuccagcaagggggucgacuucggccucuccauccugugguuccugaucuucacccccugcgccuuccucugcugguaccgccccaucuacaaggccuuccggagcgacaacuccuucagcuucuucguguucuucuucguguucuucugccagaucggcaucuacaucauccagcuggucgggaucccgggccugggggacuccggcuggaucgccgcccucagcacccuggacaaccacucccuggcgaucagcgugaucaugaugguggucgccggguucuucacgcucugcgccgugcugagcguguuccugcuccagcgcguccacucccuguaccggcgcaccggcgccagcuuccagcaggcccaggaggaguucucccagggcaucuucagcucccggaccuuccaccgcgcggccagcuccgccgcccagggggccuuccagggcaacuga

SEQ ID NO: 36076 - RNA, 762 nt, Artificial Sequence
  derived and/or modified sequence opt1 from SCAMP5__Homo_sapiens__XP_006720483
auggaguuccgcaccaagcggugcggccaggccaccgggcccgccggcaacaucauggcggagaaggugaacaacuucccgccccugcccaaguucaucccccucaagccgugcuucuaccaggacuucgaggccgacaucccgccccagcacgucagcaugacgaagcgccuguacuaccuguggaugcucaacuccgugacccuggccgugaaccuggucgggugccucgccuggcugaucggcgggggcggcgccaccaacuucgggcuggcguuccucuggcugauccuguucacccccugcagcuacgugugcugguuccggcccaucuacaaggccuucaagacggacuccagcuucuccuucauggccuucuucuucaccuucauggcccagcucgugaucagcaucauccaggcggucggcauccccggguggggcgugugcggguggaucgccaccaucuccuucuucggcaccaacaucggcagcgccguggucaugcugauccccacggugauguucaccgugauggccgucuucuccuucaucgcccugagcauggugcacaaguucuaccgcggguccggcgggagcuucuccaaggcgcaggaggaguggaccaccggcgccuggaagaacccccacgugcagcaggccgcccagaacgccgcgaugggcgccgcccagggggccaugaaccagccgcagacgcaguacagcgccacccccaacuacaccuacuccaacgagauguga

SEQ ID NO: 36077 - RNA, 3465 nt, Artificial Sequence
  derived and/or modified sequence opt1 from SCAPER__Homo_sapiens__NP_001139395
augaagaccaaguacaucuucugcaacaucaccgagcgcaaggacgccgagggcugggagacggugcagcgggggcgccccauccggagccgcuccaccgccgucaugccgaaggugagccuggcgaccgaggccacccgguccaaggacgacagcgacaaggagaacgugugccuccugcccgacgaguccauccagaagggccaguucgucggggacggcacgagcaacaccaucgagucccaccccaaggacagccugcacuccugcgaccacccccucgccgagaagacccaguucaccgugagcacgcuggacgacgugaagaacuccgggagcauccgcgacaacuacguccggaccuccgagaucagcgccgugcacaucgacaccgagugcguguccgucaugcugcaggccggcaccccgccccuccaggugaacgaggagaaguuccccgcggagaaggcccgcaucgagaacgagauggaccccagcgacaucuccaacagcauggccgaggugcuggccaagaaggaggagcuggcggaccggcucgagaaggccaacgaggaggccaucgccuccgccaucgcggaggaggagcagcugacgcgcgagaucgaggccgaggagaacaacgacaucaacaucgagaccgacaacgacagcgacuucagcgccuccaugggcagcggguccgucagcuucugcggcauguccauggacuggaacgacgugcuggccgacuacgaggcccgggagagcuggcgccagaacaccuccuggggcgacaucguggaggaggagccggcgcggccgcccgggcacgggauccacaugcacgagaagcucagcucccccagccgcaagcggaccaucgccgaguccaagaagaagcacgaggagaagcagaugaaggcccagcagcugcgcgagaagcugcgggaggagaagacgcucaagcugcagaagcugcucgagcgcgagaaggacguccggaaguggaaggaggagcugcuggaccagcgccggcgcaugauggaggagaagcuccugcacgccgaguucaagcgcgaggugcagcugcaggccaucgugaagaaggcgcaggaggaggaggccaaggucaacgagaucgccuucaucaacacccucgaggcccagaacaagcggcacgacgugcugagcaagcugaaggaguacgagcagcgccucaacgagcugcaggaggagcggcagcgccggcaggaggagaagcaggcccgcgacgaggcggugcaggagcggaagcgcgcccuggaggccgagcggcaggcccgcgucgaggagcuccugaugaagcggaaggagcaggaggcgcgcaucgagcagcagcggcaggagaaggagaaggcccgcgaggacgccgcccgggagcgcgcccgggaccgcgaggagcggcuggcggcccucaccgccgcccagcaggaggccauggaggagcugcagaagaagauccagcugaagcacgacgaguccauccgccgccacauggagcagaucgagcagcggaaggagaaggcggccgagcucagcuccggccgccacgccaacaccgacuacgcccccaagcugacgcccuacgagcggaagaagcagugcagccugugcaacgugcucaucuccagcgagguguaccuguucucccacgucaagggccgcaagcaccagcaggccgugcgggagaacaccagcauccaggggcgcgagcugagcgacgaggaggucgagcaccucucccugaagaaguacaucaucgacaucgugguggagagcaccgcgcccgccgaggcccugaaggacggcgaggagcggcagaagaacaagaagaaggccaagaagaucaaggcgcgcaugaacuuccgggccaaggaguacgagucccucauggagaccaagaacagcggguccgacagccccuacaaggccaagcugcagcgccuggccaaggaccuccugaagcagguccaggugcaggacuccggcagcugggccaacaacaagguguccgcgcuggaccggacgcugggcgagaucacccgcauccucgagaaggagaacgucgccgaccagaucgccuuccaggccgccgggggccugaccgcgcuggagcacauccuccaggccguggugccggccaccaacgucaacacggugcugcggaucccgcccaagagccugugcaacgccaucaacguguacaaccugaccugcaacaacugcuccgagaacugcagcgacguccuguucuccaacaagaucaccuuccugauggaccuccugauccaccagcugaccguguacgugcccgacgagaacaacacgauccucgggcgcaacaccaacaagcaggucuucgagggccugaccaccgggcugcucaaggugagcgccgugguccugggcugccugaucgcgaaccggcccgacggcaacugccagcccgccacgcccaagauccccacccaggagaugaagaacaagccgucccagggggaccccuucaacaaccgcgugcaggaccucaucagcuacguggucaacaugggccugaucgacaagcugugcgccugcuuccucuccgugcaggggcccguggacgagaaccccaagauggccaucuuccugcagcacgcggccggccugcuccacgccaugugcacccugugcuucgccgucaccgggcggagcuacagcaucuucgacaacaaccgccaggacccgaccggccugacggccgcgcuccaggccaccgaccuggccggcgugcugcacaugcucuacugcgugcuguuccacgggaccauccuggaccccuccaccgccagccccaaggagaacuacacgcagaacaccauccaggucgccauccagucccuccgguucuucaacagcuucgcggcccugcaccucccggccuuccaguccaucgugggcgccgaggggcucagccuggccuuccgccacauggcguccagccugcucggccacugcucccaggugagcugcgagucccugcugcacgaggucaucgugugcgugggguacuucaccgucaaccaccccgacaaccaggugaucgugcagagcggccggcaccccaccguccuccagaagcugugccagcugcccuuccaguacuucuccgacccgcgccucaucaaggugcuguuccccagccugaucgccgccugcuacaacaaccaccagaacaagaucauccucgagcaggagauguccugcgugcugcuggccacguucauccaggaccucgcccagacccccggccaggcggagaaccagcccuaccagccgaaggggaagugccugggcagccaggacuaccuggagcucgccaaccgcuucccccagcaggccugggaggaggcccggcaguucuuccugaagaaggagaagaaguga

SEQ ID NO: 36078 - RNA, 3840 nt, Artificial Sequence
  derived and/or modified sequence opt1 from SCAP__Homo_sapiens__NP_036367
augacccugaccgagcgccuccgggagaagaucagccgcgccuucuacaaccacggccugcugugcgccuccuaccccaucccgaucauccucuucacgggguucugcauccuggcgugcugcuacccccugcucaagcugccccugcccggcaccgggccgguggaguucaccacccccgucaaggacuacagcccccccccgguggacuccgaccggaagcagggcgagcccacggagcagcccgagugguacgugggggcccccgucgccuacgugcagcagaucuucgugaagagcuccgucuucccguggcacaagaaccuccuggccguggacguguuccgcagcccccugucccgggccuuccagcucgucgaggagauccgcaaccacgugcugcgggacagcuccggcauccgcagccuggaggagcucugccugcaggugaccgaccugcuccccggccugcggaagcugcgcaaccuccugcccgagcacgggugccugcuccuguccccgggcaacuucuggcagaacgacugggagcgguuccacgcggaccccgacaucaucgggaccauccaccagcacgagcccaagacccugcagacgagcgccacccucaaggaccugcuguucggcguccccgggaaguacuccggcgugagccucuacacccgcaagcggaugguguccuacaccaucacgcuggucuuccagcacuaccacgccaaguuccugggcagccuccgcgcccggcugaugcugcuccacccgucccccaacugcagccugcgcgcggagucccuggugcacgugcacuucaaggaggagaucggggucgccgagcucaucccccuggugaccaccuacaucauccuguucgccuacaucuacuucagcacccggaagaucgacauggugaagagcaaguggggccucgcccuggccgcggucgugacggugcuguccagccuccugauguccgucgggcugugcacccucuucggccugacccccacccugaacggcggggagaucuucccguaccugguggucgugaucggccucgagaacgugcugguccugacgaagagcgugguguccacccccgucgaccucgaggugaagcugcgcaucgcccaggggcugagcuccgagagcugguccaucaugaagaacauggccaccgagcucggcaucauccugaucggguacuucacccuggugcccgccauccaggaguucugccucuucgccgucgugggccuggugagcgacuucuuccugcagaugcucuucuucacgaccguccuguccaucgacauccggcgcauggagcuggcggaccucaacaagcggcugcccccggaggccugccugcccagcgccaagcccgugggccagccgacccgcuacgagcgccagcucgccgugcggcccuccaccccccacacgaucacccugcagcccagcuccuuccgcaaccugcggcucccgaagcgccugcgggucguguacuuccuggcccgcacccggcucgcgcagcgccugaucauggccgggaccguggucuggaucggcauccugguguacacggaccccgccgggcuccggaacuaccuggccgcccaggugaccgagcagagcccccugggcgagggggcgcucgcccccaugccgguccccuccggcaugcugccccccagccacccggaccccgccuucuccaucuucccccccgacgccccgaagcugcccgagaaccagaccagccccggcgagagccccgagcgcgggggcccggcggagguggugcacgacucccccguccccgaggugaccugggggcccgaggacgaggagcucuggcggaagcugagcuuccgccacuggccgacgcuguucuccuacuacaacaucacccucgccaagcgguacaucagccugcugcccgugauccccgucacccuccgccugaacccgcgggaggcccuggagggccgccacccccaggacgggcgguccgccuggccccccccgggccccauccccgccggccacugggaggcggggcccaagggcccggggggcgugcaggcccacggcgacgugacccucuacaaggucgccgcccuggggcuggccaccggcaucgugcucgugcugcugcuccugugccuguaccgcguccucugcccccggaacuacgggcagcugggcgggggccccggccgccgccggcgcggggagcugcccugcgacgacuacggcuacgcgccgcccgagacggagaucgugccccucgugcugcgggggcaccugauggacaucgagugccucgccagcgacggcaugcugcuggucuccugcugccucgccgggcacgugugcgugugggacgcccagaccggcgacugccugacccgcaucccccggccgggccgccagcggcgcgacagcggggucggcuccgggcuggaggcccaggagagcugggagcggcucuccgacggcgggaaggcgggccccgaggagcccggcgacagccccccgcugcgccaccggccccgcgggccccccccgcccucccuguucggcgaccagcccgaccucaccugccugaucgacacgaacuucagcgcccagccccgguccagccagccgacccagcccgagccccgccaccgggccgugugcgggcgcucccgggacagcccgggcuacgacuucagcugccuggugcagcgcgucuaccaggaggaggggcucgccgcggugugcacccccgcccugcggccccccuccccgggccccgugcugagccaggcccccgaggacgagggcgggucccccgagaagggcagcccgucccucgccugggcccccagcgcggagggguccaucuggagccuggagcugcagggcaaccucaucgucgugggccgcuccagcgggcggcuggaggugugggacgccaucgagggcguccugugcugcuccagcgaggagguguccagcgggaucaccgcccucguguuccuggacaagcgcaucgucgccgcccgccugaacggcucccucgacuucuucagccuggagacgcacaccgcgcuguccccccuccaguuccgggggacccccggccgcggcagcuccccggccagccccguguacagcuccagcgacaccgucgccugccaccugacgcacaccgugcccugcgcccaccagaagcccaucaccgcccugaaggcggccgccgggcggcucgugaccggcucccaggaccacacgcugcgcgucuuccggcuggaggacagcugcugccucuucacccugcaggggcacuccggcgccaucaccaccguguacaucgaccagacgauggugcuggcgagcgggggccaggacggcgccaucugccucugggacguccugaccgggucccgcgugagccacguguucgcccaccggggcgacgucaccucccugaccugcacgaccagcugcgugaucuccagcgggcuggacgaccucaucuccaucugggaccgcagcaccggcaucaaguucuacuccauccagcaggaccuggggugcggcgccagccugggcgugaucuccgacaaccuccuggucaccgggggccaggggugcgugagcuucugggaccugaacuacggcgaccuccugcagacgguguaccugggcaagaacuccgaggcccagccggcgcggcagauccucguccuggacaacgccgccaucgugugcaacuucgggagcgagcugagccucguguacguccccuccgugcuggagaagcuggacuga

SEQ ID NO: 36079 - RNA, 1821 nt, Artificial Sequence
  derived and/or modified sequence opt1 from SCARA3__Homo_sapiens__NP_057324
augaaggugcgcagcgccggcggggacggcgacgcccugugcgucaccgaggaggaccucgcgggggacgacgaggacaugcccaccuuccccugcacgcagaagggccggcccgggccccgcugcucccggugccagaagaaccugagccugcacaccuccgugcgcauccucuaccuguuccuggcccuccugcugguggccgucgccgugcucgccagccugguguuccggaaggucgacucccugagcgaggacaucucccucacccagagcaucuacgacaagaagcuggugcugaugcagaagaaccuccagggccuggaccccaaggcgcugaacaacugcuccuucugccacgaggccggccagcucgggccggagauccgcaagcugcaggaggagcuggagggcauccagaagcuccugcuggcccaggaggugcagcucgaccagacccugcaggcccaggagguccugagcacgaccucccggcagaucagccaggagaugggguccugcagcuucuccauccaccaggugaaccagagccucggccuguuccuggcccaggugcgcggguggcaggcgaccaccgccggccucgaccugucccugaaggaccucacgcaggagugcuacgacgucaaggccgccgugcaccagaucaacuucaccgugggccagaccagcgaguggauccacgggauccagcggaagaccgacgaggagacgcugacccugcagaagaucgucaccgacuggcagaacuacacccgccucuucuccggccugcggacgaccagcaccaagaccggggaggcggugaagaacauccaggccacgcugggcgccagcucccagcgcaucagccagaacuccgagagcaugcacgaccucgugcugcaggucaugggccugcagcuccagcuggacaacaucuccagcuuccuggacgaccacgaggagaacaugcacgaccuccaguaccacacccacuacgcccagaaccggaccguggagcgcuucgagucccuggaggggcggauggccagccacgagaucgagaucggcaccaucuucacgaacaucaacgcgaccgacaaccacgugcacuccaugcugaaguaccucgacgacguccgccugagcugcacccugggguuccacacccacgccgaggagcuguacuaccucaacaaguccgugagcaucaugcugggcacgaccgaccugcuccgggagcgcuucucccugcugagcgcccggcucgaccugaacgugcgcaaccuguccaugaucgucgaggagaugaaggccguggacacccagcacggggagauccuccggaacgucaccauccugcgcggcgcccccggcccgcccgggccccgcggcuucaagggggacaugggcgugaaggggcccgugggcggccgggggcccaagggcgaccccgggagccugggcccgcucgggccccagggcccccagggccagcccggggaggcgggcccggucggggagcgcggccccgugggcccccggggguuccccggccugaagggguccaagggcagcuucgggacgggcggcccgcgcgggcagcccggccccaagggggacaucgggcccccggggcccgagggcccgcccggcucccccgggcccagcggcccccaggggaagccgggcaucgccgggaagaccggcagccccggccagcggggcgccaugggccccaagggggagcccggcauccaggggccgcccggccugcccgggcccccgggcccgcccggcucccagagcuucuacuga

SEQ ID NO: 36080 - RNA, 1488 nt, Artificial Sequence
  derived and/or modified sequence opt1 from SCARA5__Homo_sapiens__NP_776194
auggagaacaaggccauguaccugcacaccgugagcgacugcgacaccuccagcaucugcgaggacuccuucgacggccgcagccucuccaagcugaaccugugcgaggacgggcccugccacaagcggcgcgccagcaucugcugcacgcagcucggcucccugagcgcgcugaagcacgccguccucgggcuguaccugcucguguuccugauccuggugggcaucuucauccucgccgucucccggccgcgcagcucccccgacgaccugaaggcccugacccggaacgugaaccgccucaacgagagcuuccgggaccugcagcugcgccuccugcaggcgccccugcaggccgaccucaccgagcaggucuggaaggugcaggacgcccugcagaaccaguccgacagccugcucgcccuggccggggcggugcagcggcuggagggcgcccucuggggccugcaggcccaggccgugcagaccgagcaggccgucgcgcugcuccgcgaccggacggggcagcaguccgacaccgcccagcuggagcuguaccagcuccagguggagagcaacuccagccagcugcugcuccgccggcacgccggccugcuggacgggcucgcccgccgggugggcauccugggggaggagcuggccgacgucggcggcgugcuccgcgggcugaaccacucccugagcuacgacguggcgcuccaccggacccgccugcaggaccugcggguccucgugagcaacgccuccgaggacacccgccggcugcgccuggcccacgugggcauggagcugcagcucaagcaggagcuggccaugcugaacgccgucacggaggaccuccgccugaaggacugggagcacagcaucgcgcugcggaacaucucccucgccaaggggcccccgggccccaagggcgaccagggggacgagggcaaggaggggcgccccggcauccccgggcugccgggccugcggggccuccccggggagcgcggcacccccgggcugcccggcccgaagggggacgacggcaagcugggcgccaccgggcccaugggcaugcggggguucaagggcgaccgcgggcccaagggcgagaagggcgagaagggggaccgggccggcgacgccagcgggguggaggcgcccaugaugauccgccucgugaacggcuccggcccgcacgaggggcgggucgagguguaccacgaccgccgguggggcaccgugugcgacgacgggugggacaagaaggacggcgacgucgugugccgcaugcugggguuccggggcgucgaggagguguaccgcacggcccgguucggccaggggaccggccgcaucuggauggacgacguggccugcaaggggaccgaggagaccaucuuccggugcagcuucuccaaguggggcgucacgaacugcgggcacgccgaggacgcgagcgugaccugcaaccgccacuga

SEQ ID NO: 36081 - RNA, 1521 nt, Artificial Sequence
  derived and/or modified sequence opt1 from SCARB1__Homo_sapiens__NP_001076428
augggcugcagcgccaaggcccgcugggcggccggggcccugggcguggccgggcuccugugcgccguccugggcgcggugaugaucgugaugguccccucccucaucaagcagcagguccugaagaacgugcgcaucgaccccagcucccugagcuucaacauguggaaggagauccccauccccuucuaccucuccguguacuucuucgacgugaugaaccccagcgagauccugaagggggagaagccccaggugcgcgagcggggccccuacgucuaccgcgaguuccggcacaaguccaacaucaccuucaacaacaacgacaccgugagcuuccuggaguaccgcacguuccaguuccagcccuccaagagccacggcuccgagagcgacuacaucgugaugcccaacauccucguccugggggccgccgugaugauggagaacaagccgaugacccugaagcucaucaugacccuggccuucaccacgcugggcgagcgggcguucaugaaccgcaccgugggggagaucauguggggcuacaaggacccccucgucaaccugaucaacaaguacuuccccgggauguuccccuucaaggacaaguucggccuguucgccgagcucaacaacuccgacagcggccuguucaccguguucaccggggugcagaacaucucccggauccaccuggucgacaaguggaacggccucagcaagguggacuucuggcacuccgaccagugcaacaugaucaacgggacgagcggccagauguggccgcccuucaugacccccgaguccagccuggaguucuacagccccgaggccugccgcuccaugaagcugauguacaaggagagcggcguguucgaggggaucccgaccuaccgguucgucgcccccaagacccucuucgccaacggcuccaucuacccgcccaacgagggguucugcccgugccuggagagcggcauccagaacguguccacgugccgcuucagcgcgccccuguuccucucccacccccacuuccugaacgccgaccccgugcuggccgaggccgucaccgggcuccacccgaaccaggaggcccacagccuguuccuggacauccaccccgugaccggcauccccaugaacugcuccgucaagcuccagcugagccuguacaugaaguccguggcgggcaucgggcagaccggcaagaucgagcccgugguccucccgcugcugugguucgccgagagcggggccauggagggcgagacgcuccacaccuucuacacccagcuggugcugaugcccaaggugaugcacuacgcccaguacguccuccuggcccuggggugcgugcuccugcuggugcccgucaucugccagauccggucccagggcccggaggacaccgugagccagcccggccucgcggccgggcccgaccggcccccgucccccuacacgccccugcugcccgacagcccguccggccagccgcccagccccaccgccuga

SEQ ID NO: 36082 - RNA, 1008 nt, Artificial Sequence
  derived and/or modified sequence opt1 from SCARB2__Homo_sapiens__NP_001191184
augggccgcugcugcuucuacaccgccgggacccugagccuccugcugcucgugacguccgucacccugcugguggcccggguguuccagaaggcggucgaccagagcaucgagaagaagaucgugcuccgcaacggcaccgaggccuucgacuccugggagaagcccccgcugcccguguacacccaguucuacuucuucaacgucacgaaccccgaggagauccugcgcggggagacgccccggguggaggaggugggcccguacaccuaccggagccucgacugguggaucaccgacaagugcaacaugaucaacgggaccgacggcgacuccuuccacccccugaucaccaaggacgagguccuguacguguuccccagcgacuucugccgcuccguguacaucaccuucagcgacuacgaguccguccagggccuccccgccuuccgguacaaggugccggccgagauccuggccaacaccagcgacaacgcgggguucugcauccccgagggcaacugccugggguccggcgugcucaacgucagcaucugcaagaacggggcccccaucaucauguccuucccccacuucuaccaggccgacgagcgcuucgugagcgccaucgagggcaugcacccgaaccaggaggaccacgagacguucguggacaucaacccccugaccggcaucauccugaaggcggccaagcgguuccagaucaacaucuacgucaagaagcucgacgacuucguggagaccggggacauccgcaccaugguguuccccgucauguaccugaacgaguccgugcacaucgacaaggagacggccagccggcugaaguccaugaucaacaccacccucaucaucaccaacauccccuacaucaucauggcccugggcguguucuucgggcuggucuucacguggcucgccugcaagggccagggcagcauggacgaggggaccgcggacgagcgcgccccgcugauccggaccuga

SEQ ID NO: 36083 - RNA, 2616 nt, Artificial Sequence
  derived and/or modified sequence opt1 from SCARF2__Homo_sapiens__NP_699165
auggagggcgccgggccccgcggcgccgggccggcgcggcgccggggcgccgggggcccgcccagcccccugcuccccucccugcugcuccugcugcuccuguggaugcugcccgacaccgucgcgccccaggagcucaacccccgcggccggaacgucugccgcgccccggggagccaggugccgaccugcugcgccggcuggcggcagcagggggacgagugcggcaucgccgugugcgaggggaacuccacgugcagcgagaacgaggucugcgugcgccccggcgagugccggugccgccacggcuacuucggggccaacugcgacaccaagugcccccggcaguucuggggcccggacugcaaggagcugugcuccugccacccccacgggcagugcgaggacgugaccggccagugcacgugccacgcccgccgguggggcgcccgcugcgagcacgcgugccagugccagcacgggacgugccacccccggagcggcgccugccgcugcgagcccgggugguggggcgcccagugcgccuccgccugcuacugcagcgcgaccucccggugcgacccgcagaccggggccugccugugccacgccggcugguggggccgcagcugcaacaaccagugcgccugcaacuccagccccugcgagcagcaguccgggcggugccagugccgcgagcggaccuucggcgcccgcugcgaccgcuacugccagugcuuccgggggcgcugccaccccgucgacggcacgugcgcgugcgagcccggguaccggggcaaguacugccgcgagccgugccccgccggcuucuacgggcucggcugccggcgccggugcgggcagugcaagggccagcagcccugcaccguggccgaggggcgcugccugaccugcgagcccggcuggaacggcaccaagugcgaccagcccugcgccaccggguucuacggcgaggggugcagccaccggugcccgcccugccgcgacggccacgccugcaaccacgugaccggcaagugcacccggugcaacgcgggguggaucggcgaccgcugcgagaccaagugcagcaacgggacguacggcgaggacugcgccuucgucugcgccgacugcgggagcggccacugcgacuuccaguccggccggugccugugcagccccggggugcacggcccccacugcaacgugaccugcccgcccgggcuccacggcgccgacugcgcccaggcgugcuccugccacgaggacacgugcgaccccgucaccggggccugccaccuggagaccaaccagcgcaagggcgugaugggcgccggggcccugcucgugcugcuggucugccuccugcugagccuccugggcugcugcugcgcgugccgggggaaggaccccacccgccggccccgcccccggcgcgagcugagccucggccgcaagaaggccccgcaccggcugugcgggcgcuucucccggaucagcaugaagcugccccgcaucccccuccggcgccagaagcugcccaaggugguggucgcccaccacgaccuggacaacacccucaacugcuccuuccuggagccgcccagcggccuggagcagcccucccccagcugguccagccgggccuccuucagcuccuucgacaccacggacgagggcccgguguacugcgugccccacgaggaggcccccgcggagagccgcgaccccgaggucccgaccgugcccgccgaggcccccgcccccuccccggugccccucaccacccccgccagcgcggaggaggccaucccccugccggccuccagcgacuccgagcggagcgccuccagcgucgaggggcccggcggggcccuguacgcgcgcguggcccggcgcgaggcccggcccgcccgcgcgcggggcgagaucgggggccucagccuguccccgagccccgagcgccggaagccgccgccgcccgaccccgccacgaagcccaaggucuccuggauccacggcaagcacagcgccgccgccgcggggcgcgcccccagcccgcccccgcccggcuccgaggccgcccccucccccagcaagcggaagcgcacccccuccgacaagagcgcccacaccguggagcacgggagcccccggacccgcgaccccacgccccggccgcccggccugcccgaggaggcgaccgcccucgccgcccccagcccgccccgcgcccgcgcgcggggccgcgggcccggccugcuggagcccaccgacgccggcgggccgccccgguccgcccccgaggccgcguccaugcucgccgccgagcugcgcgggaagacccggucccugggccgcgccgagguggcccucggcgcgcaggggccccgggagaagcccgccccgccccagaaggccaagcgcagcgugccgcccgccucccccgcccgggcgccgcccgccacggagacccccggccccgagaaggccgccaccgaccugcccgcccccgagacgccccgcaagaagacccccauccagaagccgccccggaagaagucccgcgaggcggccggggagcugggccgggccggggcccccacccuguga

SEQ ID NO: 36084 - RNA, 1290 nt, Artificial Sequence
  derived and/or modified sequence opt1 from SCCPDH__Homo_sapiens__NP_057086
auggccaccgagcagcgccccuuccaccugguggucuucggcgccagcggguucaccggccaguucgugacggaggagguggcgcgggagcaggucgacccggagcgcuccagccggcuccccugggccguggccgggcgcucccgggagaagcugcagcgcgugcuggagaaggccgcccucaagcugggccggcccacccugagcuccgaggucgggaucaucaucugcgacaucgcgaaccccgccagccucgacgagauggccaagcaggccaccguggugcugaacugcgucggcccguaccgcuucuacggcgagcccgugaucaaggcgugcaucgagaacggggccuccugcaucgacaucagcggcgagccccaguuccuggagcucaugcagcugaaguaccacgagaaggccgccgacaaggggguguacaucaucggcuccagcggguucgacuccauccccgccgaccugggcgucaucuacacccggaacaagaugaacggcacgcucaccgcgguggagagcuuccugaccauccacuccgggccggagggccugagcauccacgacgggaccuggaaguccgccaucuacggcuucggcgaccagagcaaccuccgcaagcugcggaacguguccaaccugaagcccgucccccucaucgggcccaagcugaagcgccgguggccgaucagcuacugccgcgagcugaagggcuacuccauccccuucauggggagcgacgugagcgugguccggcgcacgcagcgguaccucuacgagaaccuggaggagucccccgugcaguacgccgccuacgugaccgucggcgggaucaccagcgugaucaagcugauguucgccggccucuucuuccuguucuucgugcgcuucggcaucgggcggcagcugcucaucaaguuccccugguucuucuccuucggcuacuucagcaagcaggggccgacccagaagcagaucgacgcggccuccuucacgcugaccuucuucggccagggguacagccagggcaccggcaccgacaagaacaagcccaacaucaagaucugcacgcaggucaaggggcccgaggccggcuacguggccacccccaucgccaugguccaggcggccaugacccugcucuccgacgccagccaccucccgaaggccgggggcguguucacccccggggccgcguucuccaagacgaagcugaucgaccgccugaacaagcacggcaucgaguucagcgugaucuccagcuccgaggucuga

SEQ ID NO: 36085 - RNA, 993 nt, Artificial Sequence
  derived and/or modified sequence opt1 from SCD5__Homo_sapiens__NP_001032671
augcccggcccggccaccgacgccgggaagauccccuucugcgacgcgaaggaggagauccgcgccggccuggagagcuccgagggcgggggcgggcccgagcggcccggcgcccgcgggcagcggcagaacaucguguggcgcaacgucgugcucaugagccugcugcaccucggcgccguguacucccugguccugaucccgaaggccaagccccucacccugcugugggcguacuucugcuuccuccuggccgcccugggggugacggccggcgcgcaccggcucuggagccaccgcuccuaccgggccaagcugccccugcgcaucuuccucgccguggccaacagcauggccuuccagaacgacaucuucgaguggucccgggaccaccgcgcgcaccacaaguacagcgagaccgacgccgacccccacaacgcccggcgcggguucuucuucucccacaucggcuggcuguucguccggaagcaccgcgacgugaucgagaagggccggaagcuggacgugaccgaccuccuggccgacccggucgugcgcauccagcggaaguacuacaagaucagcgugguccugaugugcuucguggugcccacccucguccccugguacaucuggggcgagucccuguggaacagcuacuuccuggccuccauccuccgcuacacgaucagccugaacaucuccuggcuggugaacagcgcggcccacauguacgggaaccggcccuacgacaagcacaucuccccgcgccagaacccccucguggcccugggggccaucggcgagggcuuccacaacuaccaccacaccuuccccuucgacuacagcgccuccgaguucgggcugaacuucaaccccaccaccugguucaucgacuucaugugcuggcucggccuggcgacggaccggaagcgcgccaccaagccgaugaucgaggcccgcaaggcccggaccggggacagcagcgccuga

SEQ ID NO: 36086 - RNA, 1080 nt, Artificial Sequence
  derived and/or modified sequence opt1 from SCD__Homo_sapiens__NP_005054
augcccgcccaccuccugcaggacgacaucagcuccagcuacaccaccacgaccaccaucaccgccccgcccucccgcgugcugcagaacggcggggacaagcuggagacgaugccccucuaccuggaggacgacauccggcccgacaucaaggacgacaucuacgacccgaccuacaaggacaaggagggccccagccccaaggucgaguacguguggcgcaacaucauccugaugucccuccugcaccugggggcgcucuacggcaucacccugaucccgaccugcaaguucuacacguggcuguggggcguguucuacuacuucgucagcgcccucgggaucaccgccggcgcccaccggcuguggucccaccgcagcuacaaggcccggcugccccuccgccuguuccugaucaucgcgaacaccauggccuuccagaacgacguguacgagugggcccgggaccaccgcgcccaccacaaguucuccgagacccacgcggacccccacaacagccggcgcggguucuucuucucccacgugggcuggcuccugguccggaagcaccccgccgugaaggagaaggggagcacgcuggaccucuccgaccuggaggccgagaagcuggugauguuccagcgccgguacuacaagcccggccuccugaugaugugcuucauccugccgacccucguccccugguacuucuggggcgagaccuuccagaacagcguguucguggccaccuuccugcgcuacgccgucgugcugaacgcgacguggcucgugaacuccgccgcccaccuguucggguaccggcccuacgacaagaacaucagcccccgcgagaacauccuggucucccucggcgccgugggggagggcuuccacaacuaccaccacagcuucccguacgacuacuccgccagcgaguaccgguggcacaucaacuucaccaccuucuucaucgacugcauggcggcccuggggcuggccuacgaccgcaagaaggugagcaaggccgccauccucgcgcggaucaagcgcaccggcgacggcaacuacaaguccggguga

SEQ ID NO: 36087 - RNA, 1653 nt, Artificial Sequence
  derived and/or modified sequence opt1 from SCFD1__Homo_sapiens__NP_001244305
augcccaccgaggagaacaucgaccgcaugugccaggaccugcggaaccagcucuacgagagcuacuaccugaacuucaucuccgccaucagccgcuccaagcuggaggacaucgccaacgcggcccucgccgccagcgccgugacccaggucgcgaagguguucgaccaguaccugaacuucaucacgcuggaggacgacauguucgugcucugcaaccagaacaaggagcuggucuccuaccgggccaucaaccgcccggacaucaccgacaccgagauggagaccgugauggacacgaucguggacagccuguucugcuucuucgucacccucggcgccgugcccaucauccggugcucccgcgggaccgccgcggagaugguggccgucaagcuggacaagaagcugcgggagaaccuccgcgacgcccggaacagccuguucaccggcgacacgcugggggccggccaguucuccuuccagcgcccccuccuggugcugguggaccggaacaucgaccucgccacgccccugcaccacaccuggaccuaccaggcgcugguccacgacgugcucgacuuccaccugaaccgcgugaaccuggaggagagcuccggggucgagaacagcccggccggcgcccggcccaagcgcaagaacaagaaguccuacgaccucacccccguggacaaguucuggcagaagcacaagggcagccccuucccggagguggccgaguccguccagcaggagcuggagagcuaccgggcccaggaggacgaggugaagcgccugaaguccaucauggggcucgagggcgaggacgagggggcgaucagcaugcuguccgacaacaccgccaagcugaccagcgccgugagcucccuccccgagcugcuggagaagaagcggcucaucgaccugcacaccaacgucgccacggccgugcuggagcacaucaaggcgcgcaagcucgacguguacuucgaguacgaggagaagaucaugagcaagaccacccuggacaagucccugcucgacaucaucagcgaccccgacgccggcacccccgaggacaagaugcggcuguuccugaucuacuacaucuccacgcagcaggccccgagcgaggccgaccucgagcaguacaagaaggcccugaccgacgcggggugcaaccugaacccccuccaguacaucaagcaguggaaggccuucaccaagauggccuccgcccccgcgagcuacggcuccaccacgaccaagcccaugggccugcugagccgcgucaugaacaccgggucccaguucgugauggagggcgucaagaaccucgugcugaagcagcagaaccugccggugacccggauccuggacaaccucauggagaugaaguccaaccccgagacggacgacuaccgcuacuucgaccccaagaugcugcgcgggaacgacagcagcgucccccggaacaagaacccguuccaggaggccaucguguucguggucggcggcgggaacuacaucgaguaccagaaccugguggacuacaucaagggcaagcaggggaagcacauccucuacggcugcuccgagcuguucaacgccacccaguucaucaagcagcugagccagcucgggcagaaguga

SEQ ID NO: 36088 - RNA, 2055 nt, Artificial Sequence
  derived and/or modified sequence opt1 from SCFD2__Homo_sapiens__NP_689753
augagcgccuccggcgugcugagcuucacccagcaggggugggagcagguccucgccaaggugaagcgcgcgguggucuaccuggacgccgccugcgccgagucccugcacuggggcugcgggagcacccggcuccuggaggccgugggcgggcccgacugccaccuccgcgaguucgagccggacgcgaucggcggcggggccaagcagcccaaggccguguucguccucuccugccugcugaagggccggacgguggagauccuccgcgacaucaucugccggagccacuuccaguacugcguggucgugaccaccgugucccacgccguccaccugaccgcgaaccacgugcccgccgccgccgccgcggagauggaggggcagcagcccguguucgagcagcuggaggagaagcucugcgaguggaugggcaacaugaacuacacggccgaggucuuccacgugccgcugcugcucgcccccguggcgccccacuucgcccugacccccgccuucgccagccuguucccgcuccugccccaggacguccaccuccugaacuccgcccgccccgacaagcggaagcuggggagccugggcgacguggacuccaccacccucacgcccgagcugcugcuccagauccgcugccuggugagcggccuguccagccucugcgagcaccuggggguccgggaggagugcuucgccgugggcucccugagccaggugaucgccgcggaccucgccaacuacgccccggccaagaaccgcaagaagaccgccgcggggcgggccuccgucguguucgucgaccgcacccuggaccugaccggcgccgugggccaccacggggacaaccucguggagaagaucaucagcgcccugccccagcugcccggccacacgaacgacgucauggugaacaugaucgcgcucaccgcccugcacaccgaggaggagaacuacaacguggucgcccccgggugccugucccagagcagcgacaccacggccaaggcccucugggaggcgcugcugaacaccaagcacaaggaggccgugauggaggugcggcgccaccucgucgaggccgccucccgggagaaccugccgaucaagaugagcaugggccgcgugacccccgggcagcugauguccuacauccagcuguucaagaacaaccugaaggcccugaugaaccacugcggccugcuccagcugggccuggcgaccgcccagacgcucaagcacccccagaccgccaagugggacaacuuccuggccuucgagcggcugcuccugcagagcaucggggaguccgccaugagcgugguccugaaccagcuccugcccaugaucaagccggugacccagcgcaccaacgaggacuacucccccgaggagcugcucauccugcugaucuacaucuacagcgugacgggcgagcucaccgucgacaaggaccugugcgaggcggaggagaaggugaagaaggcccuggcccagguguucugcgaggaguccgggcucagcccccugcugcagaagaucaccgacugggacuccagcaucaaccucaccuuccacaaguccaagaucgccgucgacgagcuguucacgagccugcgggacaucgcgggcgcccgcucccuccugaagcaguucaagagcguguacgugcccgggaaccacacccaccaggccuccuacaagccgcugcucaagcaggucguggaggagaucuuccaccccgagcggcccgacagcguggacaucgagcacauguccagcggccugaccgaccugcucaagaccggcuucagcauguucaugaaggucucccgcccccacccgagcgacuacccccugcugauccucuucguggucgggggcgugacgguguccgaggugaagauggucaaggaccugguggccagccugaagcccgggacccaggugaucguccucuccacccgccugcugaagccgcucaacauccccgagcugcuguucgccaccgaccggcuccaccccgaccugggcuucuga

SEQ ID NO: 36089 - RNA, 1854 nt, Artificial Sequence
  derived and/or modified sequence opt1 from SCG2__Homo_sapiens__NP_003460
auggccgaggccaagacccacuggcugggcgcggcccucagccugaucccccugaucuuccucaucuccggggccgaggccgccagcuuccagcgcaaccagcugcugcagaaggagccggaccuccggcuggagaacgugcagaaguuccccucccccgagaugauccgcgcgcuggaguacaucgagaaccuccggcagcaggcccacaaggaggagagcucccccgacuacaacccguaccagggcgucagcgugccccugcagcagaaggagaacggggacgagucccaccuccccgagcgcgacagccuguccgaggaggacuggaugcggaucauccuggaggcccugcgccaggccgagaacgagccccagagcgcgccgaaggagaacaagcccuacgcccucaacuccgagaagaacuuccccauggacaugagcgacgacuacgagacccagcaguggcccgagcggaagcugaagcacaugcaguucccgcccauguacgaggagaacucccgcgacaaccccuucaagcggacgaacgagaucguggaggagcaguacacgccccagagccuggccacccucgaguccgucuuccaggagcugggcaagcugaccgggccgaacaaccagaagcgcgagcggauggacgaggagcagaagcucuacaccgacgacgaggacgacaucuacaaggccaacaacaucgccuacgaggacguggugggcggcgaggacuggaaccccgucgaggagaagaucgagagccagacccaggaggaggugcgcgacuccaaggagaacaucgagaagaacgagcagaucaacgacgagaugaagcggagcgggcagcugggcauccaggaggaggaccugcgcaaggaguccaaggaccagcucagcgacgacgugagcaaggucaucgcguaccugaagcggcuggugaacgccgccggguccggccgccuccagaacgggcagaacggcgagcgggccacccgccuguucgagaagccccuggacagccaguccaucuaccagcucaucgagaucagccggaaccugcagaucccgcccgaggaccugaucgagaugcucaagaccggcgagaagcccaacggguccguggagcccgagcgcgagcuggaccugcccgucgaccucgacgacaucagcgaggccgaccuggaccacccggaccuguuccagaaccggaugcucuccaagagcggcuaccccaagacgcccgggcgcgcgggcaccgaggcccugcccgacggccuguccguggaggacauccucaaccugcuggggauggagagcgccgccaaccagaagaccuccuacuucccgaaccccuacaaccaggagaaggugcucccccgccugccguacggcgccgggcggagccgcuccaaccagcugcccaaggcggccuggaucccccacgucgagaaccggcagauggccuacgagaaccucaacgacaaggaccaggagcugggcgaguaccuggcccgcaugcuggugaaguaccccgagaucaucaacagcaaccaggugaagcgggucccggggcagggcuccagcgaggacgaccuccaggaggaggagcagaucgagcaggccaucaaggagcaccugaaccagggcuccagccaggagaccgacaagcuggcgcccguguccaagcgcuuccccguggggcccccgaagaacgacgacacgcccaaccggcaguacugggacgaggaccuccugaugaagguccuggaguaccucaaccaggagaaggccgagaagggccgcgagcacaucgccaagcgggccauggagaacauguga

SEQ ID NO: 36090 - RNA, 711 nt, Artificial Sequence
  derived and/or modified sequence opt1 from SCG3__Homo_sapiens__NP_001158729
auggccgccauccaggacggccuggcgaagggggagaacgacgagaccgugagcaacacccucacgcugaccaacggccuggagcgccggaccaagaccuacuccgaggacaacuucgaggagcuccaguacuuccccaacuucuacgcccugcucaagagcaucgacuccgagaaggaggccaaggagaaggagacgcucaucaccaucaugaagacccugaucgacuucgucaagaugauggugaaguacgggaccaucagcccggaggagggcguguccuaccuggagaaccucgacgagaugaucgcccugcagacgaagaacaagcuggagaagaacgccaccgacaacaucagcaagcuguuccccgcgcccuccgagaagucccacgaggagaccgacagcaccaaggaggaggccgccaagauggagaaggaguacgggagccugaaggacuccacgaaggacgacaacagcaaccccggcggcaagaccgacgagccgaaggggaagaccgaggccuaccuggaggcgauccgcaagaacaucgaguggcucaagaagcacgacaagaagggcaacaaggaggacuacgaccuguccaagaugcgggacuucaucaacaagcaggccgacgccuacgucgagaaggggauccuggacaaggaggaggccgaggccaucaagcgcaucuacagcucccucuga

SEQ ID NO: 36091 - RNA, 639 nt, Artificial Sequence
  derived and/or modified sequence opt1 from SCG5__Homo_sapiens__NP_001138229
auggugagccgcauggucuccaccaugcugagcggccuccuguucuggcuggccuccggguggacccccgccuucgcguacagcccgcggacgcccgaccgcguguccgaggccgacauccagcggcuccugcacggcgugauggagcagcuggggaucgcccgcccccgggucgaguaccccgcccaccaggccaugaaccucgugggcccgcagagcaucgagggcggggcgcacgagggccugcagcaccuggggcccuucggcaacauccccaacaucguggccgagcucaccggggacaacauccccaaggacuucuccgaggaccagggcuacccggacccgcccaaccccugccccgucgggaagaccgccgacgacggcugccuggagaacacccccgacacggccgaguucagccgcgaguuccagcugcaccagcaccucuucgaccccgagcacgacuaccccggccuggggaaguggaacaagaagcugcucuacgagaagaugaagggcggggagcggcgcaagcggcgcuccgugaacccguaccugcagggccagcggcuggacaacguggucgcgaagaaguccgugccccacuucagcgacgaggacaaggaccccgaguga

SEQ ID NO: 36092 - RNA, 276 nt, Artificial Sequence
  derived and/or modified sequence opt1 from SCGB1A1__Homo_sapiens__NP_003348
augaagcuggccgugacccucacccuggucacgcuggcccucugcugcagcuccgcgagcgccgagaucugccccuccuuccagcgcgugaucgagacccugcugauggacaccccgagcuccuacgaggccgccauggagcuguucagccccgaccaggacaugcgggaggccggcgcgcagcucaagaagcugguggacacccucccccagaagccccgcgaguccaucaucaagcugauggagaagaucgcccagagcucccugugcaacuga

SEQ ID NO: 36093 - RNA, 273 nt, Artificial Sequence
  derived and/or modified sequence opt1 from SCGB1D1__Homo_sapiens__NP_006543
augcgccugagcgugugccuccugcugcucacccuggcccugugcugcuaccgggccaacgcggucgugugccaggcccucggcuccgagaucaccggguuccugcuggccggcaagcccguguucaaguuccagcucgccaaguucaaggccccgcuggaggcggucgccgccaagauggaggugaagaagugcguggacacgauggccuacgagaagcgcguccugaucaccaagacccucgggaagaucgcggagaagugcgaccgguga

SEQ ID NO: 36094 - RNA, 273 nt, Artificial Sequence
  derived and/or modified sequence opt1 from SCGB1D2__Homo_sapiens__NP_006542
augaagcugagcgugugccuccugcuggucacccucgcccugugcugcuaccaggccaacgcggaguucugccccgcccugguguccgagcuccuggacuucuucuucaucagcgagccccuguucaagcucucccuggccaaguucgacgccccgcccgaggccguggcggccaagcugggcgucaagcgcugcaccgaccagaugagccuccagaagcggucccugaucgccgaggugcuggugaagauccucaagaagugcagcgucuga

SEQ ID NO: 36095 - RNA, 288 nt, Artificial Sequence
  derived and/or modified sequence opt1 from SCGB2A1__Homo_sapiens__NP_002398
augaagcugcucauggugcugaugcuggccgcccuccugcugcacugcuacgcggacagcggcugcaagcuccuggaggacauggucgagaagaccaucaacagcgacaucagcauccccgaguacaaggagcugcuccaggaguucaucgacuccgacgccgccgccgaggccauggggaaguucaagcagugcuuccugaaccagagccaccgcacccugaagaacuucggccucaugaugcacacgguguacgacuccaucuggugcaacaugaaguccaacuga

SEQ ID NO: 36096 - RNA, 282 nt, Artificial Sequence
  derived and/or modified sequence opt1 from SCGB2A2__Homo_sapiens__NP_002402
augaagcugcucauggugcugaugcuggccgcccucagccagcacugcuacgcgggcuccgggugcccgcugcuggagaacgucaucagcaagaccaucaacccccagguguccaagaccgaguacaaggagcuccugcaggaguucaucgacgacaacgccacgaccaacgccaucgacgagcugaaggagugcuuccucaaccagaccgacgagacccugagcaacguggaggucuucaugcagcugaucuacgacuccagccucugcgaccuguucuga

SEQ ID NO: 36097 - RNA, 291 nt, Artificial Sequence
  derived and/or modified sequence opt1 from SCGB2B2__Homo_sapiens__NP_001020762
augcgcgugaccagcgcgaccugcgcccugcuccuggcccugaucugcuccguccagcucggcgacgccugccuggacaucgacaagcugcucgccaacgugguguucgacgucagccaggaccugcugaaggaggagcucgcccgguacaaccccuccccgcugacggaggagagcuuccugaacgugcagcagugcuucgccaacguguccgucaccgagcgcuucgcgcacagcguggugaucaagaagauccuccaguccaacgacugcaucgaggccgccuucuga

SEQ ID NO: 36098 - RNA, 315 nt, Artificial Sequence
  derived and/or modified sequence opt1 from SCGB3A1__Homo_sapiens__NP_443095
augaagcuggccgcccuccugggccugugcguggcgcucagcugcuccagcgccgccgccuuccuggucggguccgccaagcccguggcgcagccgguggccgcccuggagagcgccgcggaggccggcgccgggacccucgccaacccccugggcacccugaacccccucaagcugcugcucuccagccuggggauccccgucaaccaccugaucgagggcucccagaagugcguggccgagcucggcccgcaggcggugggggccgucaaggcccugaaggcccugcucggcgcccugacgguguucggguga

SEQ ID NO: 36099 - RNA, 282 nt, Artificial Sequence
  derived and/or modified sequence opt1 from SCGB3A2__Homo_sapiens__NP_473364
augaagcuggugaccaucuuccuccuggucaccaucagccugugcuccuacagcgccacggccuuccucaucaacaaggugccccugccgguggacaagcuggcgccccucccccuggacaacauccugcccuucauggacccgcucaagcugcugcucaagacccugggcaucuccgucgagcaccugguggaggggcuccgcaagugcgugaacgagcugggccccgaggccagcgaggccgucaagaagcugcucgaggcccugucccaccugguguga

SEQ ID NO: 36100 - RNA, 831 nt, Artificial Sequence
  derived and/or modified sequence opt1 from SCGN__Homo_sapiens__NP_008929
auggacagcagccgcgagcccacccugggccggcucgacgccgccggguucuggcaggucuggcagcgcuucgacgcggacgagaagggcuacaucgaggagaaggagcuggacgccuucuuccugcacaugcucaugaagcuggggaccgacgacacggugaugaaggccaaccugcacaaggugaagcagcaguucaugaccacccaggacgccagcaaggacggccggauccgcaugaaggagcucgccgggauguuccuguccgaggacgagaacuuccugcuccuguuccggcgcgagaacccgcuggacagcuccguggaguucaugcagaucuggcggaaguacgacgcggacagcuccggcuucaucagcgccgccgagcuccgcaacuuccugcgggaccuguuccuccaccacaagaaggccaucuccgaggcgaagcuggaggaguacaccggcacgaugaugaagaucuucgaccgcaacaaggacgggcggcuggaccucaacgaccuggcccgcauccuggcccuccaggagaacuuccugcugcaguucaagauggacgccugcagcaccgaggagcggaagcgcgacuucgagaagaucuucgccuacuacgacgucuccaagaccggcgcgcucgaggggcccgagguggacggcuucgugaaggacaugauggagcugguccagcccagcaucuccgggguggaccuggacaaguuccgggagauccuccugcgccacugcgacgugaacaaggacggcaagauccagaaguccgagcuggcccucugccugggccugaagaucaaccccuga

SEQ ID NO: 36101 - RNA, 1425 nt, Artificial Sequence
  derived and/or modified sequence opt1 from SCHIP1__Homo_sapiens__NP_001184036
auggagcgcagcggccagcgggugaccaccugggacugcgaccaggggaagcacuccgacagcgacuaccgcgaggacggcauggaccugggguccgacgccggcagcuccagcuccagcucccgggccagcucccagagcaacuccacgaaggucacccccugcagcgagugcaaguccagcuccagccccgggggcucccucgaccuggugagcgcgcuggaggacuacgaggagcccuuccccguguaccagaagaaggucaucgacgagugggcccccgaggaggacggcgaggaggaggaggaggaggacgagcgcgaccagcggggguaccgcgacgaccggagcccggcccgcgagcccggcgacguguccgcccggacccgcagcgggggcgggggcggccgguccgccaccacggcgaugccgcccccggugcccaacgggaaccuccaccagcacgacccccaggaccugcgccacaacggcaacgucgugguggccgggcggcccagcugcucccgcggcccgcggcgcgccauccagaagccccagcccgccggcgggcggcgcagcggccgggggcccgcggccggcgggcugugccuccagccgcccgacggcgggaccugcguccccgaggagcccccggugccgcccauggacugggaggcccuggagaagcaccuggccggccuccaguuccgcgagcaggaggcccagaagaacgagcgggaguccauccgccagaagcuggcgcugggcagcuucuucgacgacgggcccggcaucuacaccuccugcagcaaguccgggaagcccagccucuccagccgccugcaguccggcaugaaccugcagaucugcuucgugaacgacagcggcuccgacaaggacagcgacgccgacgacuccaagaccgagacgagccucgacacgccccugagccccauguccaagcagagcuccagcuacuccgaccgggacaccaccgaggaggagagcgagucccuggacgacauggacuuccucacccgccagaagaagcugcaggccgaggccaagauggcccuggcgauggccaagcccauggccaagaugcaggucgagguggagaagcagaaccggaagaaguccccgguggccgaccuccugccccacaugccccacaucagcgagugccugaugaagcgcagccucaagccgaccgaccugcgggacaugaccaucgggcagcugcaggucaucgugaacgaccuccacucccagaucgagagccugaacgaggagcuggugcagcuccugcugauccgcgacgagcuccacaccgagcaggacgccaugcuggucgacaucgaggaccugacgcggcacgcggagucccagcagaagcacauggccgagaagaugcccgccaaguga

SEQ ID NO: 36102 - RNA, 2148 nt, Artificial Sequence
  derived and/or modified sequence opt1 from SCIN__Homo_sapiens__NP_001106177
auggcccgcgagcuguaccacgaggaguucgcccgggcgggcaagcaggccgggcuccagguguggcgcaucgagaagcuggagcugguccccgugccccagagcgcccacggcgacuucuacgugggggacgccuaccucguccugcacaccgccaagaccucccggggcuucacguaccaccuccacuucuggcuggggaaggagugcagccaggacgaguccaccgcggccgccaucuucaccgugcagauggacgacuaccugggcggcaagcccgugcagaaccgcgagcugcagggguacgagagcaacgacuucgucuccuacuucaagggcgggcucaaguacaaggccggcgggguggcgagcggccugaaccacgugcugaccaacgaccucacggccaagcggcugcugcacgucaagggccgccggguggugcgcgccaccgaggucccccucuccugggacagcuucaacaagggggacugcuucaucaucgaccugggcaccgagaucuaccaguggugcggguccagcugcaacaaguacgagcggcugaaggccaaccagguggccaccggcauccgcuacaacgagcggaagggccgcuccgagcucaucguggucgaggaggggagcgagcccuccgagcugaucaaggugcugggcgagaagccggagcuccccgacgggggcgacgacgacgacaucaucgcggacaucagcaaccggaagauggccaagcuguacaugguguccgacgccagcggguccaugcgcgucacggugguggccgaggagaaccccuucagcauggccaugcugcucuccgaggagugcuucauccuggaccacggcgcggccaagcagaucuucgucuggaagggcaaggacgccaacccccaggagcggaaggccgccaugaagaccgcggaggaguuccugcagcagaugaacuacagcaagaacacccagauccaggugcucccggagggcggggagacccccaucuucaagcaguucuucaaggacuggcgcgacaaggaccagagcgacggguucggcaagguguacgucacggagaagguggcccagaucaagcagauccccuucgacgccuccaagcugcacagcagcccccagauggccgcccagcacaacauggucgacgacggguccggcaagguggagaucuggcggguggagaacaacggccgcauccaggucgaccagaacuccuacggggaguucuacggcggggacugcuacaucauccuguacaccuacccgcggggccagaucaucuacaccuggcagggggcgaacgccacccgcgacgagcucacgaccagcgccuuccugaccgugcagcuggaccggucccucggcggccaggccgugcagauccgcgucagccaggggaaggagcccgugcaccuccugucccuguucaaggacaagccccugaucaucuacaagaacggcaccagcaagaagggcgggcaggcgcccgccccgcccacgcgccuguuccaggugcggcgcaaccucgccuccaucacccggaucgucgagguggacguggacgccaacagccugaacuccaacgacgucuucgugcugaagcucccccagaacagcggcuacaucuggguggggaagggcgccucccaggaggaggagaagggggcggaguacgucgccagcgugcugaagugcaagacccugcgcauccaggagggcgaggagcccgaggaguucuggaacucccucgggggcaagaaggacuaccagaccagcccgcugcuggagacgcaggccgaggaccacccgccccggcucuacggcugcuccaacaagaccgggcgcuucgugaucgaggagauccccggcgaguucacccaggacgaccuggccgaggacgacgucaugcugcuggacgccugggagcagaucuucaucuggaucgggaaggacgcgaacgagguggagaagaaggagagccucaagagcgccaagauguaccuggagaccgaccccuccggccgggacaagcgcacgcccaucgugaucaucaagcaggggcacgagccgcccaccuucaccggcugguuccugggcugggacagcuccaagugguga

SEQ ID NO: 36103 - RNA, 240 nt, Artificial Sequence
  derived and/or modified sequence opt1 from SCLT1__Homo_sapiens__NP_001287826
auggccgccgagaucgacuuccugcgcgagcagaaccggcgccucaacgaggacuuccggcgcuaccagauggagagcuucuccaaguacagcuccgugcagaaggccgucugccagggcgagggggacgacaccuucgagaaccugguguucgaccagagcuuccuggcgccccucgugaccgaguacgacaagcaccugggcgagcugaacgggcagcucaaguacuaccaggccuga

SEQ ID NO: 36104 - RNA, 1362 nt, Artificial Sequence
  derived and/or modified sequence opt1 from SCLY__Homo_sapiens__NP_057594
augcccggcagcuccggggccggcauggaggccgcgguggccccggggcgcgacgcccccgcccccgccgcgagccagcccuccggcugcgggaagcacaacagcccggagcggaaggucuacauggacuacaacgccaccacgccccuggagcccgaggugauccaggccaugaccaaggccaugugggaggcguggggcaaccccuccagcccguacuccgccggccgcaaggccaaggacaucaucaacgccgcccgggagagccucgcgaagaugaucgggggcaagccccaggacaucaucuucaccuccgggggcaccgagagcaacaaccuggugauccacuccgucgugaagcacuuccacgccaaccagaccagcaaggggcacacgggcggccaccacucccccgugaagggggccaagccccacuucaucaccagcuccgucgagcacgacagcauccgccugccgcucgagcaccugguggaggagcaggucgccgccgugaccuucgugcccguguccaaggucagcggccaggcggagguggacgacauccuggccgccgugcggcccaccacgcgccucgucaccaucaugcuggccaacaacgagaccgggaucgugaugcccgugccggagaucucccagcggaucaaggcccugaaccaggagcgcgucgcggccggccucccgcccauccuggugcacaccgacgccgcccaggcccugggcaagcagcggguggacgucgaggaccucgggguggacuuccugacgaucgugggccacaaguucuacgggccccgcaucggcgcgcuguacauccgggggcucggcgaguucacgccccuguaccccaugcuguucggcgggggccaggagcgcaacuuccggcccgggaccgagaacacccccaugaucgccggccucgggaaggccgccgagcuggucacccagaacugcgaggcguacgaggcccacaugcgcgacgugcgggacuaccuggaggagcgccucgaggccgaguucggccagaagcggauccaccugaacagccaguucccgggcacccagcgccugcccaacacgugcaacuucagcauccgggggccccgccuccagggccacgucgugcuggcccagugccgggugcugauggccuccgucggggcggccugccacagcgaccacggcgaccagcccuccccggugcuccugagcuacggggugcccuucgacgucgcccgcaacgcccugcgccucuccgugggccggagcaccacccgcgccgagguggaccuggucgugcaggaccugaagcaggcgguggcccagcucgaggaccaggccuga

SEQ ID NO: 36105 - RNA, 2103 nt, Artificial Sequence
  derived and/or modified sequence opt1 from SCML2__Homo_sapiens__NP_006080
augggccagaccgugaacgaggacagcauggacgucaagaaggagaaccaggagaagacgccccaguccagcaccuccagcgugcagcgcgacgacuuccacugggaggaguaccugaaggagaccggguccaucagcgccccguccgagugcuuccggcagagccagaucccgcccgugaacgacuucaaggucggcaugaagcucgaggcccgcgacccccggaacgcgaccuccgugugcaucgccaccgugaucgggaucacgggcgcccgccugcggcugcgccucgacgggagcgacaaccggaacgacuucuggcgccuggucgacucccccgacauccagcccguggggaccugcgagaaggagggcgaccugcuccagccgccccugggcuaccagaugaacaccagcuccuggcccauguuccugcucaagacccugaacggcagcgagauggccuccgccacgcuguucaagaaggagccgcccaagccgccccucaacaacuucaagguggggaugaagcuggaggcgaucgacaagaagaaccccuaccugaucugccccgccaccaucggcgacgucaagggggacgaggugcacaucaccuucgacggcuggagcggcgccuucgacuacuggugcaaguacgacucccgggacaucuuccccgccggguggugccgccucaccggcgacgugcugcagccgcccgggacgagcguccccaucgugaagaacaucgcgaagaccgaguccagccccagcgaggccucccagcacagcaugcagagcccccagaagaccacccugauccuccccacgcagcagguccggcgcuccucccggaucaagccgcccggccccaccgccgugcccaagcgcagcuccagcgugaagaacaucacgccccggaagaagggccccaacuccgggaagaaggagaagccgcugcccgugaucugcagcaccuccgccgccagccugaagucccucacccgcgaccggggcaugcuguacaaggacgucgcgagcgggcccugcaagaucgugauguccaccgugugcgucuacgugaacaagcacggcaacuucgggccgcaccuggaccccaagcgcauccagcagcuccccgaccacuucggccccggcccggugaacgucgugcugcggcgcaucguccaggccugcguggacugcgcccuggagaccaagaccguguucggguaccucaagcccgacaaccggggcggggaggucaucacggccagcuucgacggcgagacccacuccauccagcugccgcccgugaacagcgccuccuucgcgcugcgcuuccucgagaacuucugccacagccugcagugcgacaaccugcucagcucccagcccuucagcuccagccgcgggcacacccacuccagcgccgagcacgacaagaaccaguccgccaaggaggacgugaccgagcggcagagcacgaagcgcagcccccagcagaccguccccuacguggugccccuguccccgaagcugcccaagaccaaggaguacgccuccgagggcgagccccucuucgccggcgggagcgcgauccccaaggaggagaaccuguccgaggacagcaaguccagcucccugaacagcggcaacuaccucaacccggccugccggaaccccauguacauccacaccagcgucucccaggacuucagccgcuccgugcccgggacgaccagcagcccccuggugggcgacaucuccccgaaguccagcccccacgaggucaaguuccagaugcagcggaaguccgaggcccccagcuacaucgccgugcccgacccguccgugcugaagcagggguucagcaaggaccccuccaccuggagcgucgacgaggugauccaguucaugaagcacaccgacccccagaucuccggcccgcucgccgaccuguuccgccagcacgagaucgacggcaaggcgcuguuccuccucaagagcgacgugaugaugaaguacauggggcugaagcugggccccgcccugaagcugugcuacuacaucgagaagcugaaggaggggaaguacuccuga

SEQ ID NO: 36106 - RNA, 1245 nt, Artificial Sequence
  derived and/or modified sequence opt1 from SCML4__Homo_sapiens__NP_932347
augcagagccagcgcauccccggccggaagcgcgggcggccgucccugcacagcacccccaugaagauggccgugcacaaccucuacuccgccagcgcgggcucccugcccgccgucaagauccccaagaagcgcgggcggaagccgggcuacaagaucaagagccgcgugcugaugacgccccucgcccuguccccgccccggagcacccccgagcccgaccuguccagcaucccccaggacgccgccaccgugcccucccucgcggccccgcaggcccugaccgucugccuguacaucaacaagcaggccaacgcggggcccuaccucgagcgcaagaaggugcagcagcugcccgagcacuucggccccgagcggccgagcgccgugcugcagcaggccguccaggccugcaucgacugcgcccaccagcagaagcucguguucucccuggugaagcagggcuacgggggcgagauggucagcguguccgcgagcuucgacgggaagcagcaccuccgcucccugcccguggucaacagcaucggcuacgugcugcgguuccuggccaagcucugccgcucccugcugugcgacgaccucuucagccaccagcccuucccccgggggugcagcgccuccgagaaggugcaggagaaggaggagggccgcauggagagcgucaagaccgugacgaccgaggaguaccuggugaacccggucggcaugaaccgguacuccguggacaccagcgccuccaccuucaaccaccgcgggagccugcaccccuccagcucccucuacugcaagcggcagaacagcggcgacucccaccucgggggcggccccgccgcgacggccgggggcccccgcaccagcccgauguccagcgggggccccuccgcccccgggcugcggcccccggccagcucccccaagcgcaacaccaccagccuggagggcaaccggugcgccuccagccccagccaggacgcgcaggacgcccgccgcccgcggucccgcaaccccagcgccuggacgguggaggacgucgugugguucgugaaggacgccgacccccaggcccugggcccccacgucgagcuguuccggaagcacgagaucgacgggaacgcgcuccugcugcucaaguccgacauggugaugaaguaccugggccugaagcucgggccggcccugaagcugugcuaccacaucgacaagcucaagcaggccaaguucuga

SEQ ID NO: 36107 - RNA, 5871 nt, Artificial Sequence
  derived and/or modified sequence opt1 from SCN10A__Homo_sapiens__NP_006505
auggaguuccccaucggcagccuggagaccaacaacuuccgccgguucaccccggagucccucguggagaucgagaagcagaucgccgccaagcaggggacgaagaaggcgcgcgagaagcaccgggagcagaaggaccaggaggagaagccccgcccccagcuggaccugaaggccugcaaccagcuccccaaguucuacggcgagcugccggccgagcugaucggggagccccucgaggaccuggaccccuucuacagcacccaccggaccuucaugguccugaacaagggccgcaccaucucccgguucagcgccacgcgcgcccucuggcuguucucccccuucaaccugauccggcgcaccgcgaucaaggugagcgugcacuccugguucagccucuucaucaccgucaccauccuggugaacugcgugugcaugacgcggaccgaccugccggagaagaucgaguacgucuucaccgugaucuacaccuucgaggcccucaucaagauccuggcccgcggguucugccugaacgaguucacguaccuccgggaccccuggaacuggcuggacuucuccgugaucacccuggccuacgucggcaccgcgaucgaccuccgcggcaucagcgggcugcggaccuuccgcgugcugcgggcccucaagacgguguccgucauccccggccugaaggugaucgugggggcccugauccacagcgucaagaagcucgccgacgugaccauccugaccaucuucugccuguccguguucgcccucgucggccugcagcuguucaaggggaaccucaagaacaagugcgugaagaacgacauggcggugaacgagaccacgaacuacagcucccaccgcaagcccgacaucuacaucaacaagcggggcaccagcgacccgcugcugugcggcaacggguccgacagcggccacugccccgacggguacaucugccucaagaccuccgacaaccccgacuucaacuacaccagcuucgacagcuucgccugggccuuccugucccuguuccgccucaugacgcaggacagcugggagcggcuguaccagcagacccugcgcaccuccggcaagaucuacaugaucuucuucguccucgugaucuuccugggcagcuucuaccuggugaaccucauccuggccgucgugaccauggccuacgaggagcagaaccaggcgacgaccgacgagaucgaggccaaggagaagaaguuccaggaggcccuggagaugcuccgcaaggagcaggagguccuggccgcccuggggaucgacaccaccucccugcacagccacaacggcuccccccucacgagcaagaacgcguccgagcggcgccaccggaucaagccgcgcgugagcgagggguccaccgaggacaacaagagcccccgguccgaccccuacaaccagcgccggaugagcuuccugggccuggccuccgggaagcgccgggccagccacggcuccguguuccacuuccgcagccccggccgggacaucucccucccggagggggucaccgacgacggcguguuccccggggaccacgagagccaccgcggcagccugcugcucgggggcggcgccgggcagcagggcccccugccccgguccccgcugccccagcccagcaaccccgacucccgccacggggaggacgagcaccagccgccccccaccagcgagcucgccccgggcgcgguggacgucuccgccuucgacgccgggcagaagaagacguuccugagcgccgaguaccuggacgagcccuuccgggcgcagcgcgccauguccguggugagcaucaucaccuccguccucgaggagcuggaggagagcgagcagaagugcccccccugccugaccucccucagccagaaguaccugaucugggacugcugcccgaugugggugaagcugaagaccauccucuucggccuggugaccgaccccuucgccgagcugacgaucacccucugcaucgucgugaacaccaucuucauggccauggagcaccacggcaugucccccaccuucgaggccaugcugcagaucgggaacaucguguucacgaucuucuucaccgcggagauggucuucaagaucaucgccuucgaccccuacuacuacuuccagaagaaguggaacaucuucgacugcaucaucgugaccgugagccugcucgagcugggcgucgccaagaaggggucccugagcgugcuccgguccuuccgccugcugcggguguucaagcucgccaagagcuggccgacccugaacacgcugaucaagaucaucggcaacagcgucggcgcccucgggaaccugaccaucauccuggcgaucaucguguucguguucgcccucgucggcaagcagcugcugggggagaacuaccgcaacaaccgcaagaacaucuccgccccccacgaggacuggccccgguggcacaugcacgacuucuuccacagcuuccucaucguguuccgcauccugugcggcgaguggaucgagaacaugugggccugcauggagguggggcagaaguccaucugccugauccucuuccugaccgucauggugcugggcaaccucgugguccugaaccuguucaucgcccuccugcugaacagcuucuccgcggacaaccucaccgcccccgaggacgacggcgaggugaacaaccugcagguggcccuggcccggauccaggucuucgggcaccgcacgaagcaggcgcucugcagcuucuucucccggagcugcccguucccccagcccaaggccgagcccgagcugguggugaagcugccgcucuccagcuccaaggccgagaaccacaucgccgccaacaccgcgcgcggcagcuccgggggccugcaggccccccgggggccccgcgacgagcacagcgacuucaucgccaaccccaccgucuggguguccgugccgaucgccgagggcgagagcgaccuggacgaccucgaggacgacggcggggaggacgcccaguccuuccagcaggaggucauccccaagggccagcaggagcagcugcagcagguggagcggugcggggaccaccugaccccccgcagccccggcacggggaccuccagcgaggaccucgcgccgagccugggcgagaccuggaaggacgaguccgugccccagguccccgccgagggcguggacgacaccagcuccagcgagggguccacgguggacugccuggacccggaggagauccuccggaagauccccgagcuggccgacgaccuggaggagcccgacgacugcuucaccgagggcugcauccgccacugccccugcugcaagcucgacaccaccaagagcccgugggacgucggguggcaggugcggaagacgugcuaccgcaucguggagcacuccugguucgagagcuucaucaucuucaugauccugcuguccagcggcucccucgccuucgaggacuacuaccuggaccagaagcccaccgucaaggcccugcucgaguacaccgaccggguguucaccuucaucuucguguucgagaugcugcugaagugggucgcguacggguucaagaaguacuucacgaacgccuggugcuggcucgacuuccugaucgugaacaucagccugaucucccucaccgccaagauccuggaguacagcgaggucgcccccaucaaggcgcugcgcacccuccgggcccugcgcccccugcgggcccucucccgcuucgagggcaugcgggugguggucgacgcccuggugggcgccaucccgagcaucaugaacgugcugcucgucugccugaucuucuggcugaucuucuccaucaugggggugaaccucuucgcgggcaaguucuggcgcugcaucaacuacaccgacggggaguucagccuggugccccuguccaucgucaacaacaagagcgacugcaagauccagaacagcacgggcuccuucuucugggugaacgugaaggucaacuucgacaacguggccaugggcuaccuggcccuccugcagguggccaccuucaagggguggauggacaucauguacgccgcggucgacagccgcgaggugaacaugcagcccaagugggaggacaacguguacauguaccuguacuucgucaucuucaucaucuucggcggguucuucacccucaaccuguucgugggcgugaucaucgacaacuucaaccagcagaagaagaagcuggggggccaggacaucuucaugaccgaggagcagaagaaguacuacaacgccaugaagaagcucggcuccaagaagccccagaagccgaucccccggccccugaacaaguuccagggguucgucuucgacaucgugacgcgccaggccuucgacaucaccaucauggugcugaucugccucaacaugaucaccaugauggucgagaccgacgaccagagcgaggagaagaccaagauccugggcaagaucaaccaguucuucguggccguguucacgggggagugcgucaugaagauguucgcccugcggcaguacuacuucaccaacggcuggaacguguucgacuucaucguggucgugcucuccaucgcgagccugaucuucuccgccauccugaagagccuccaguccuacuucagccccacccuguuccgcgugauccggcuggcccgcaucgggcggauccuccgccugauccgggccgccaagggcauccgcacccugcucuucgcgcugaugaugucccugccggcccucuucaacaucggccugcugcucuuccuggucauguucaucuacagcaucuucgggauguccagcuucccccacgugcggugggaggccggcaucgacgacauguucaacuuccagacguucgccaacuccaugcugugccucuuccagaucaccaccagcgcggggugggacggccugcugucccccauccucaacaccgggcccccguacugcgaccccaaccugcccaacagcaacggcacgcgcggcgacugcgggucccccgccgugggcaucaucuucuucaccaccuacaucaucaucagcuuccugaucgucgugaacauguacaucgccgugauccucgagaacuucaacgucgccaccgaggagagcacggagccgcuguccgaggacgacuucgacauguucuacgagaccugggagaaguucgaccccgaggccacccaguucaucaccuucagcgcgcuguccgacuucgccgacacgcucagcgggccccugcggauccccaagccgaaccgcaacauccugauccagauggaccucccccuggugcccggcgacaagauccacugccuggacauccucuucgccuucaccaagaacgugcugggcgaguccggggagcuggacagccucaaggccaacauggaggagaaguucauggccaccaaccuguccaagagcuccuacgagccgaucgcgaccacgcugcgguggaagcaggaggacaucagcgccaccgucauccagaaggccuaccgcuccuacgugcuccaccggagcauggcccuguccaacacccccugcgugccccgcgccgaggaggaggcggccagccugcccgacgagggcuucgucgccuucaccgccaacgagaacugcgugcucccggacaaguccgagacggcgagcgccaccuccuucccccccagcuacgaguccgugacccgggggcugagcgaccgcgucaacaugcgcaccagcuccagcauccagaacgaggacgaggccacguccauggagcugaucgcccccggcccguga

SEQ ID NO: 36108 - RNA, 5376 nt, Artificial Sequence
  derived and/or modified sequence opt1 from SCN11A__Homo_sapiens__XP_011531622
auggacgaccgcugcuaccccgugaucuucccggacgagcggaacuuccgccccuucaccagcgacucccuggccgccaucgagaagcggaucgcgauccagaaggagaagaagaagagcaaggaccagaccggcgaggucccccagccccgcccgcagcucgaccugaaggccucccggaagcugcccaagcucuacggggacaucccccgcgagcugaucggcaagccccuggaggaccucgacccguucuaccggaaccacaagacguucauggugcugaaccgcaagcggaccaucuaccgcuucagcgccaagcacgcccuguucaucuucgggcccuucaacuccauccggagccucgccauccgcguguccguccacagccuguucuccauguucaucaucggcaccgugaucaucaacugcguguucauggcgaccgggcccgccaagaacagcaacuccaacaacacggacaucgccgagugcgucuucaccggcaucuacaucuucgaggcccugaucaagauccucgcgcggggcuucauccuggacgaguucagcuuccugcgcgaccccuggaacuggcucgacuccaucgugaucgggaucgccaucgugagcuacaucccgggcaucaccaucaagcugcugccccuccggaccuuccgcgucuuccgggcccugaaggccaucuccguggugagccgccugaaggucaucgugggggcccuccugcgguccgugaagaagcuggucaacgugaucauccucacguucuucugccugagcaucuucgcgcuggugggccagcagcucuucauggggucccugaaccugaagugcaucagccgcgacugcaagaacaucagcaaccccgaggccuacgaccacugcuucgagaagaaggagaacucccccgaguucaagaugugcggcaucuggaugggcaacagcgccugcuccauccaguacgagugcaagcacaccaagaucaacccggacuacaacuacaccaacuucgacaacuucggguggagcuuccucgccauguuccggcugaugacccaggacuccugggagaagcuguaccagcagacgcuccgcaccaccggccuguacagcgucuucuucuucaucguggugaucuuccugggguccuucuaccucaucaaccugacccuggccgucgugacgauggcguacgaggagcagaacaagaacguggccgccgagaucgaggccaaggagaagauguuccaggaggcccagcagcuccugaaggaggagaaggaggcgcuggucgccaugggcaucgaccgcagcucccucaccagccuggagaccuccuacuucacccccaagaagcggaagcuguucggcaacaagaagcgcaagagcuucuuccuccgggaguccgggaaggaccagccccccggcagcgacuccgacgaggacugccagaagaagccgcagcugcuggagcagacgaagcgccucagccagaaccugucccuggaccacuucgacgagcacggggacccccugcagcggcagcgcgcccucagcgccguguccauccugaccaucaccaugaaggagcaggagaagagccaggagcccugccugcccugcggcgagaaccucgccagcaaguaccuggucuggaacugcugcccgcaguggcugugcgugaagaaggugcuccggaccgucaugacggaccccuucaccgagcuggcgaucaccaucugcaucaucaucaacaccguguuccuggccauggagcaccacaagauggaggccuccuucgagaagaugcucaacaucgggaaccugguguucacgagcaucuucaucgccgagaugugccugaagaucaucgcgcucgaccccuaccacuacuuccgccggggcuggaacaucuucgacuccaucgucgcccugcugagcuucgccgacgugaugaacugcgugcuccagaagcgcuccuggcccuuccugcggagcuuccgcguccugcggguguucaagcucgccaaguccuggccgacccugaacacccugaucaagaucaucggcaacagcgugggggcccucggcucccugaccgucgugcuggugaucgucaucuucaucuucagcgugguggggaugcagcucuucggccgcuccuucaacagccagaagucccccaagcugugcaaccccacggggccgaccgucagcugccugcggcacuggcacaugggcgacuucuggcacuccuuccucgugguguuccgcauccugugcggcgaguggaucgagaacaugugggagugcaugcaggaggcgaacgccagcuccagccugugcgucaucguguucauccucaucaccgugaucgggaagcuggucgugcugaaccucuucaucgcccugcugcucaacagcuucuccaacgaggagcggaacggcaaccuggagggggaggcccgcaagaccaaggugcagcuggcccucgaccgguuccgccgcgcguucugcuucguccggcacacgcuggagcacuucugccacaaguggugccgcaagcagaaccugccccagcagaaggagguggccggcgggugcgccgcccagagcaaggacaucaucccccucgugauggagaugaagcggggcuccgagacccaggaggagcugggcauccugaccagcguccccaagacccucggggugcgccacgacuggaccuggcuggccccgcuggcggaggaggaggacgacguggaguucuccggcgaggacaacgcccagcggaucacgcagcccgagcccgagcagcaggccuacgagcuccaccaggagaacaagaagcccaccagccagcgcguccaguccguggagaucgacauguucagcgaggacgagccgcaccugaccauccaggacccccggaagaaguccgacgugaccagcauccuguccgagugcagcacgaucgaccuccaggacggguucggcuggcugcccgagaugguccccaagaagcagccggagcgcugccugcccaagggcuucgggugcugcuuccccugcugcuccguggacaagcggaagcccccgugggugaucugguggaaccuccgcaagaccugcuaccagaucgucaagcacagcugguucgaguccuucaucaucuucgugauccugcugagcuccggcgcccucaucuucgaggacgugcaccuggagaaccagcccaagauccaggagcugcucaacugcaccgacaucaucuucacccacaucuucauccuggagaugguccugaaguggguggcguucggguucggcaaguacuucacgagcgccuggugcugccucgacuucaucaucgugaucgucuccgugaccacccugaucaaccugauggagcucaagagcuuccggacccugcgcgcccugcggccccuccgcgcccugagccaguucgaggggaugaagguggucgugaacgcccugaucggcgcgauccccgccauccucaacgugcugcuggucugccucaucuucuggcugguguucugcauccugggcgucuacuucuucuccgggaaguucggcaagugcaucaacgggacggacagcgugaucaacuacaccaucaucaccaacaagucccagugcgagagcggcaacuucuccuggaucaaccagaaggugaacuucgacaacgucgggaacgccuaccucgcccugcugcagguggccaccuucaagggcuggauggacaucaucuacgcggccguggacagcacggagaaggagcagcagccggaguucgaguccaacagccucggcuacaucuacuucgucguguucaucaucuucggguccuucuucacccugaaccuguucaucggcgugaucaucgacaacuucaaccagcagcagaagaagcucgggggccaggacaucuucaugaccgaggagcagaagaaguacuacaacgccaugaagaagcuggggagcaagaagccccagaagcccaucccccggccgcugaacaagugccagggccucgucuucgacaucgugaccucccagaucuucgacaucaucaucaucagccugaucauccugaacaugaucuccaugauggccgagagcuacaaccagcccaaggccaugaaguccauccucgaccaccugaacuggguguucgucgugaucuucacgcuggagugccucaucaagaucuucgcgcugcgccaguacuacuucaccaacggcuggaaccuguucgacugcguggucgugcugcucagcaucguguccaccaugaucagcacccuggagaaccaggagcacauccccuucccgcccacgcuguuccggaucguccgccucgcccggaucgggcgcauccugcggcuggugcgcgccgcccgcggcauccggacccuccuguucgcgcugaugaugucccuccccagccuguucaacaucgggcugcuccuguuccugaucauguucaucuacgccauccucggcaugaacugguucagcaaggugaaccccgaguccgggaucgacgacaucuucaacuucaagaccuucgccagcuccaugcugugccuguuccagaucagcaccuccgccggcugggacagccuccuguccccgaugcugcgcagcaaggaguccugcaacagcuccagcgagaacugccaccuccccggcaucgccacguccuacuucgucagcuacaucaucaucuccuuccugaucguggugaacauguacaucgcggucauccuggagaacuucaacaccgccaccgaggagagcgaggacccccucggggaggacgacuucgacaucuucuacgaggugugggagaaguucgaccccgaggccacccaguucaucaaguacuccgcccugagcgacuucgccgacgcgcugccggagccccuccggguggccaagcccaacaaguaccaguuccuggucauggaccugcccaugguguccgaggaccgccuccacugcauggacauccuguucgccuucacggcccgggugcugggcgggagcgacggccucgacagcaugaaggccaugauggaggagaaguucauggaggcgaacccgcugaagaagcuguacgagcccaucgucaccaccaccaagcgcaaggaggaggagcggggcgccgccaucauccagaaggccuuccgcaaguacaugaugaaggugacgaagggggaccagggcgaccagaacgaccucgagaacgggccccacuccccccugcagacccugugcaacggcgaccucagcuccuucgggguggccaagggcaagguccacugcgacuga

SEQ ID NO: 36109 - RNA, 6030 nt, Artificial Sequence
  derived and/or modified sequence opt1 from SCN1A__Homo_sapiens__NP_001159435
auggagcagaccgugcuggugccgcccggccccgacagcuucaacuucuucacccgcgagucccucgccgccaucgagcggcgcaucgcggaggagaaggccaagaaccccaagcccgacaagaaggacgacgacgagaacgggcccaagcccaacagcgaccuggaggccggcaagaaccugcccuucaucuacggggacaucccgcccgagauggugagcgagccccucgaggaccuggaccccuacuacaucaacaagaagacguucaucgugcugaacaagggcaaggccaucuuccgguucagcgccaccuccgcgcucuacauccugacccccuucaacccgcugcgcaagaucgccaucaagauccucguccacagccuguucuccaugcugaucaugugcaccauccucacgaacugcguguucaugaccaugagcaacccgcccgacuggaccaagaacguggaguacaccuucacggggaucuacaccuucgagucccugaucaagaucaucgcccggggcuucugccuggaggacuucaccuuccuccgcgaccccuggaacuggcuggacuucaccgucaucacguucgccuacgugaccgaguucguggaccugggcaacgucagcgcgcuccggaccuuccgcgugcugcgggcccugaagaccaucuccgugauccccgggcucaagacgaucgucggcgcccugauccagagcgugaagaagcuguccgacgugaugauccucaccgucuucugccugagcguguucgcccugaucgggcuccagcuguucaugggcaaccugcgcaacaagugcauccaguggccgcccaccaacgccucccucgaggagcacagcaucgagaagaacaucaccgugaacuacaacgggacgcugaucaacgagaccgucuucgaguucgacuggaaguccuacauccaggacagccgguaccacuacuuccuggagggcuuccucgacgcgcugcugugcggcaacuccagcgacgccgggcagugccccgagggcuacaugugcgugaaggccgggcgcaaccccaacuacggcuacaccagcuucgacaccuucuccugggccuuccucagccuguuccggcugaugacgcaggacuucugggagaaccucuaccagcugacccugcgcgccgcgggcaagaccuacaugaucuucuucgugcucgucaucuuccugggguccuucuaccugaucaaccucauccuggccgugguggccauggccuacgaggagcagaaccaggccacccuggaggaggcggagcagaaggaggccgaguuccagcagaugaucgagcagcucaagaagcagcaggaggccgcccagcaggccgcgacggccaccgccagcgagcacucccgggagcccagcgccgcgggccgccuguccgacagcuccagcgaggccuccaagcugagcuccaagagcgccaaggagcggcgcaaccggcgcaagaagcggaagcagaaggagcaguccgggggcgaggagaaggacgaggacgaguuccagaaguccgaguccgaggacagcauccgccgcaagggguuccgguucuccaucgagggcaaccgccugaccuacgagaagcgguacagcagcccccaccagucccuccugagcauccgcggcucccuguucagcccccggcgcaacucccggaccagccucuucuccuuccgcgggcgggccaaggacgucggcagcgagaacgacuucgccgacgacgagcacuccacguucgaggacaacgagagccgccgggacucccuguucgugccccgccggcacggggagcgccggaacagcaaccugucccagaccagccgcuccagccggaugcucgcggucuuccccgccaacggcaagaugcacuccaccguggacugcaacgggguggucagccuggugggcggccccagcgugcccaccuccccggucgggcagcugcuccccgaggugaucaucgacaagcccgccacggacgacaacggcaccaccaccgagaccgagaugcgcaagcggcgcagcuccagcuuccacguguccauggacuuccuggaggaccccagccagcgccagcgggccauguccaucgccagcauccugacgaacaccgucgaggagcucgaggagucccgccagaagugcccgcccugcugguacaaguucagcaacaucuuccugaucugggacugcucccccuacuggcugaaggugaagcacguggucaaccucguggugauggacccguucgucgaccuggcgaucaccaucugcaucgugcugaacacccucuucauggccauggagcacuaccccaugacggaccacuucaacaacgugcugaccgucgggaaccugguguucaccggcaucuucaccgccgagauguuccucaagaucaucgccauggaccccuacuacuacuuccaggagggguggaacaucuucgacggcuucaucgugacgcugagccuggucgagcucggccuggccaacguggaggggcuguccgugcuccggagcuuccgccugcugcgggucuucaagcucgcgaaguccuggcccacccugaacaugcugaucaagaucaucggcaacagcgugggggcccucggcaaccugacccuggugcucgccaucaucgucuucaucuucgccguggugggcaugcagcuguucgggaaguccuacaaggacugcgucugcaagaucgcgagcgacugccagcugccgcgcuggcacaugaacgacuucuuccacuccuuccucaucguguuccgggugcugugcggcgaguggaucgagaccaugugggacugcauggaggucgccgggcaggccaugugccugacgguguucaugauggugauggucaucggcaaccucguggugcugaaccuguuccucgcccugcugcucagcagcuucuccgccgacaaccuggcggccaccgacgacgacaacgagaugaacaaccugcagaucgccgucgaccgcaugcacaaggggguggccuacgugaagcggaagaucuacgaguucauccagcagagcuucauccgcaagcagaagauccucgacgagaucaagccccuggacgaccugaacaacaagaaggacuccugcaugagcaaccacaccgccgagaucggcaaggaccucgacuaccugaaggacgucaacggcaccacguccgggaucggcaccgggagcuccguggagaaguacaucaucgacgagagcgacuacauguccuucaucaacaaccccagccugaccgugaccguccccaucgcggugggcgaguccgacuucgagaaccucaacacggaggacuucagcuccgagagcgaccuggaggaguccaaggagaagcugaacgagagcuccagcuccagcgaggggagcaccguggacaucggcgccccggucgaggagcagcccgugguggagcccgaggagacccucgagcccgaggccugcuucaccgagggcugcguccagcgguucaagugcugccagaucaacguggaggaggggcgcggcaagcagugguggaaccugcggcgcacgugcuuccggaucgucgagcacaacugguucgagaccuucaucguguucaugauccugcucuccagcggggcccuggccuucgaggacaucuacaucgaccagcgcaagaccaucaagaccaugcuggaguacgcggacaagguguucacguacaucuucauccucgagaugcugcugaagugggucgccuacggcuaccagaccuacuucaccaacgccuggugcuggcucgacuuccugaucguggacgugucccuggucagccucaccgccaacgcgcugggguacuccgagcugggcgccaucaagagccuccggacgcugcgcgcccugcggccgcuccgcgcccugucccgguucgagggcaugcgcgugguggucaacgcccugcucggggcgauccccagcaucaugaacgugcugcuggugugccucaucuucuggcugaucuucuccaucaugggcgucaaccuguucgccgggaaguucuaccacugcaucaacaccaccaccggcgaccgcuucgacaucgaggacgugaacaaccacacggacugccucaagcugaucgagcggaacgagaccgcccgcuggaagaacgugaaggucaacuucgacaacgugggguucggcuaccugagccuccugcaggucgccaccuucaagggcuggauggacaucauguacgccgcggucgacucccggaacguggagcugcagcccaaguacgaggagagccucuacauguaccuguacuucgugaucuucaucaucuucggguccuucuucacccugaaccuguucaucggcgucaucaucgacaacuucaaccagcagaagaagaaguucgggggccaggacaucuucaugaccgaggagcagaagaaguacuacaacgccaugaagaagcucggcagcaagaagccccagaagccgaucccccgccccgggaacaaguuccagggcaugguguucgacuucgugacgcggcaggucuucgacaucuccaucaugauccugaucugccugaacauggugaccaugaugguggagaccgacgaccagagcgaguacgucaccacgauccucucccgcaucaaccugguguucaucgugcuguucaccggggagugcguccucaagcugaucagccugcggcacuacuacuucaccaucggcuggaacaucuucgacuucgugguggucauccucuccaucguggggauguuccuggccgagcugaucgagaaguacuucgugagccccacccucuuccgcgucauccggcuggcccgcaucggccggauccugcgccucaucaagggcgccaaggggauccggacgcugcuguucgcgcucaugaugagccugccggcccuguucaacaucggccuccugcuguuccucgugauguucaucuacgccaucuucgggauguccaacuucgccuacgugaagcgcgaggucggcaucgacgacauguucaacuucgagaccuucgggaacagcaugaucugccuguuccagaucaccaccuccgccggcugggacggccugcucgcgcccauccugaacagcaagcccccggacugcgaccccaacaaggugaaccccggguccagcgugaagggcgacugcgggaaccccuccgucggcaucuucuucuucgugagcuacaucaucaucuccuuccugguggucgugaacauguacaucgccgugauccucgagaacuucagcgucgccacggaggaguccgccgagccgcugagcgaggacgacuucgagauguucuacgaggugugggagaaguucgaccccgacgcgacccaguucauggaguucgagaagcugucccaguucgccgccgcccucgagccgccccugaaccugccgcagcccaacaagcuccagcugaucgccauggaccugcccauggugagcggggaccggauccacugccucgacauccuguucgcguucaccaagcgcguccugggcgaguccggcgagauggacgcccuccggauccagauggaggagcgcuucauggccagcaaccccuccaaggugagcuaccagccgaucaccacgacccugaagcggaagcaggaggaggucuccgccgugaucauccagcgcgccuaccgccggcaccuccugaagcgcaccgugaagcaggcgagcuucaccuacaacaagaacaagaucaagggcggggccaaccugcugaucaaggaggacaugaucaucgaccggaucaacgagaacagcaucacggagaagaccgaccucaccauguccaccgccgccugcccgcccagcuacgaccgcgucacgaagcccaucguggagaagcacgagcaggaggggaaggacgagaaggccaagggcaaguga

SEQ ID NO: 36110 - RNA, 657 nt, Artificial Sequence
  derived and/or modified sequence opt1 from SCN1B__Homo_sapiens__NP_001028
augggccgccugcucgcccugguggucggggccgcgcuggugagcuccgccugcggcgggugcguggaggucgacagcgagaccgaggccguguacggcaugaccuucaagauccucugcaucuccugcaagcggcgcagcgagacgaacgccgagaccuucaccgaguggaccuuccggcagaaggggacggaggaguucgugaagauccugcgcuacgagaacgagguccugcagcucgaggaggacgagcgguucgagggccgcgugguguggaacggcucccgggggaccaaggaccugcaggaccugagcaucuucaucaccaacgucaccuacaaccacuccggcgacuacgagugccacguguaccgccuccuguucuucgagaacuacgagcacaacacgagcguggucaagaagauccacaucgaggugguggacaaggccaaccgggacauggcguccaucgucagcgagaucaugauguacgugcugaucgugguccucaccaucuggcugguggccgagaugaucuacugcuacaagaagaucgccgccgcgaccgagaccgccgcccaggagaacgccuccgaguaccuggccaucacgagcgaguccaaggagaacugcaccggggugcaggucgcggaguga

SEQ ID NO: 36111 - RNA, 6018 nt, Artificial Sequence
  derived and/or modified sequence opt1 from SCN2A__Homo_sapiens__XP_005246807
auggcccagagcgugcucgugccgcccggccccgacuccuuccgcuucuucacccgggagagccucgccgcgaucgagcagcgcaucgccgaggagaaggccaagcggcccaagcaggagcgcaaggacgaggacgacgagaacgggcccaagcccaacuccgaccuggaggccggcaagagccugcccuucaucuacggggacaucccgcccgagaugguguccgugccccucgaggaccuggaccccuacuacaucaacaagaagaccuucaucguccugaacaagggcaaggccaucagccgguucuccgcgacgcccgcccucuacauccugacccccuucaacccgauccgcaagcuggccaucaagauccucgugcacagccuguucaacaugcugaucaugugcaccauccucaccaacugcguguucaugacgauguccaacccgcccgacuggaccaagaacgucgaguacaccuucaccgggaucuacacguucgagagccugaucaagauccuggcccggggcuucugccucgaggacuucaccuuccugcgcgaccccuggaacuggcuggacuucaccgugaucaccuucgcguacgugacggaguucgucgaccucggcaacguguccgcccugcggaccuuccgcgugcugcgggcccucaagaccaucagcgucaucccggggcugaagaccaucgugggcgcccugauccaguccgugaagaagcucagcgacgucaugauccugacgguguucugccuguccguguucgcccucaucgggcugcagcuguucaugggcaaccuccgcaacaagugccugcaguggccgcccgacaacagcuccuucgagaucaacaucaccagcuucuucaacaacucccuggacgggaacggcaccaccuucaaccggacggucagcaucuucaacugggacgaguacaucgaggacaagagccacuucuacuuccucgagggccagaacgacgcgcugcugugcgggaacuccagcgacgccggccagugccccgagggguacaucugcgugaaggccggccgcaacccgaacuacggcuacaccuccuucgacaccuucagcugggccuuccucucccuguuccggcugaugacccaggacuucugggagaaccucuaccagcugacgcugcgcgccgcggggaagaccuacaugaucuucuucgugcucgucaucuuccugggcagcuucuaccugaucaaccucauccuggccgugguggccauggccuacgaggagcagaaccaggccacccuggaggaggcggagcagaaggaggccgaguuccagcagaugcucgagcagcugaagaagcagcaggaggaggcccaggccgccgcggccgccgccuccgcggagagccgggacuucuccggggccggcgggaucggcgucuucagcgaguccagcuccguggccagcaagcuguccagcaaguccgagaaggagcugaagaaccgccggaagaagaagaagcagaaggagcagagcggcgaggaggagaagaacgaccgcguccggaaguccgagagcgaggacagcauccgccgcaagggguuccgguucucccucgagggcagccgccugaccuacgagaagcgguucuccagcccccaccagucccugcucagcauccgcgggucccuguucagcccccggcgcaacucccgggccagccuguucuccuuccgcggccgggccaaggacaucgggagcgagaacgacuucgcggacgacgagcacuccacguucgaggacaacgacagccgccgggacucccucuucgugccccaccgccacggcgagcggcgccacagcaacgugucccaggccagccgggccagccgcguccugccgauccugcccaugaacggcaagaugcacuccgccguggacugcaacgggguggucagccucgugggcgggcccuccacccugaccagcgccggccagcugcuccccgaggggaccacgaccgagaccgagauccggaagcgccgguccagcuccuaccacgugagcauggaccugcuggaggacccgaccucccgccagcgcgcgaugagcaucgccuccauccucacgaacaccauggaggagcuggaggagagccggcagaagugcccgcccugcugguacaaguucgccaacaugugccugaucugggacugcugcaagccguggcucaaggucaagcaccuggugaaccugguggucauggaccccuucguggaccucgccaucaccaucugcaucgugcugaacacccuguucauggccauggagcacuaccccaugaccgagcaguucuccagcguccucuccgugggcaaccugguguucacgggcaucuucaccgcggagauguuccugaagaucaucgccauggaccccuacuacuacuuccaggagggguggaacaucuucgacggcuucaucgucagccucucccugauggagcuggggcucgccaacguggagggccugagcgugcugcgcuccuuccggcuccugcgcgucuucaagcuggccaagagcuggccgacccucaacaugcugaucaagaucaucggcaacagcgugggggcgcugggcaaccucacccuggugcuggccaucaucgucuucaucuucgccgugguggggaugcagcuguucggcaaguccuacaaggagugcgucugcaagaucagcaacgacugcgagcugccccgguggcacaugcacgacuucuuccacuccuuccugaucguguuccgcgugcucugcggggaguggaucgagacgaugugggacugcauggaggucgccggccagaccaugugccugaccguguucaugauggugauggucaucggcaaccugguggugcucaaccuguuccuggcccuccugcugagcuccuucagcuccgacaaccucgcggccaccgacgacgacaacgagaugaacaaccugcagaucgccgucgggcggaugcagaagggcaucgacuucgugaagcgcaagauccgggaguucauccagaaggccuucgugcgcaagcagaaggcccuggacgagaucaagccccucgaggaccugaacaacaagaaggacagcugcaucuccaaccacacgaccaucgagaucgggaaggaccugaacuaccucaaggacggcaacgggaccaccagcggcaucggcuccagcgucgagaaguacgugguggacgaguccgacuacaugagcuucaucaacaaccccucccugacggucaccgugccgaucgcggugggggagagcgacuucgagaaccugaacaccgaggaguucuccagcgaguccgacauggaggagagcaaggagaagcucaacgccaccagcuccagcgagggcuccacggucgacaucggggcccccgccgagggcgagcagcccgagguggagcccgaggagagccuggagccggaggccugcuucaccgaggacugcgugcggaaguucaagugcugccagaucuccaucgaggaggggaagggcaagcugugguggaaccuccgcaagaccugcuacaagaucgucgagcacaacugguucgagaccuucaucguguucaugauccugcugagcuccggcgcgcucgccuucgaggacaucuacaucgagcagcggaagacgaucaagaccaugcuggaguacgccgacaagguguucaccuacaucuucauccuggagaugcuccugaagugggucgccuacggguuccagguguacuucaccaacgcguggugcuggcuggacuuccucaucgucgacgugagccuggugucccugacggccaacgcccucggcuacagcgagcugggggccaucaagucccugcgcacccuccgggcccugcgcccccugcgggcgcucagccgcuucgagggcaugcgggucguggugaacgcccugcugggggccauccccuccaucaugaacguccuccuggugugccugaucuucuggcucaucuucagcaucaugggcgugaaccuguucgccggcaaguucuaccacugcaucaacuacaccaccggggagauguucgacgucuccguggugaacaacuacagcgagugcaaggcccugaucgaguccaaccagacggcgcgcuggaagaacgucaaggugaacuucgacaacgugggccucggguaccugagccugcugcaggucgccaccuucaagggcuggauggacaucauguacgccgccguggacucccggaacguggagcuccagcccaaguacgaggacaaccuguacauguaccuguacuucgucaucuucaucaucuucggcagcuucuucacccucaaccuguucaucggggugaucaucgacaacuucaaccagcagaagaagaaguucggcgggcaggacaucuucaugaccgaggagcagaagaaguacuacaacgccaugaagaagcugggcagcaagaagccgcagaagcccaucccccgccccgcgaacaaguuccaggggaugguguucgacuucgucacgaagcaggucuucgacaucuccaucaugauccucaucugccugaacauggugaccaugauggucgagaccgacgaccagagccaggagaugaccaacauccuguacuggaucaaccucguguucaucgugcuguucacgggcgagugcguccugaagcucaucucccugcgcuacuacuacuucaccaucggcuggaacaucuucgacuucgugguggucauccugagcaucguggggauguuccucgccgagcugaucgagaaguacuucguguccccgacccuguuccgggucauccgccucgcccggaucggccgcauccugcggcugaucaagggggccaagggcauccgcacccuccuguucgcccugaugaugagccuccccgcgcuguucaacaucgggcugcuccuguuccuggugauguucaucuacgccaucuucggcauguccaacuucgccuacgugaagcgggaggucggcaucgacgacauguucaacuucgagaccuucgggaacagcaugaucugccucuuccagaucacgaccuccgccggcugggacgggcugcuggcgcccauccucaacagcggcccgcccgacugcgaccccgacaaggaccaccccggguccagcgugaagggcgacugcggcaaccccuccguggggaucuucuucuucgucagcuacaucaucaucuccuuccuggugguggucaacauguacaucgccgugauccuggagaacuucagcguggccaccgaggaguccgccgagccccucagcgaggacgacuucgagauguucuacgaggucugggagaaguucgaccccgacgccacccaguucaucgaguucgcgaagcuguccgacuucgccgacgcccuggacccgccccuccugaucgccaagcccaacaaggugcagcugaucgccauggaccuccccauggugagcggcgaccgcauccacugccuggacauccuguucgcguucacgaagcggguccucggggagagcggcgagauggacgcccugcgcauccagauggaggagcgguucauggccuccaaccccagcaagguguccuacgagcccaucaccaccacccugaagcgcaagcaggaggaggugagcgccaucaucauccagcgggccuaccgccgguaccuccugaagcagaaggucaagaagguguccagcaucuacaagaaggacaagggcaaggagugcgacgggacgcccaucaaggaggacacccugaucgacaagcucaacgagaacuccacccccgagaagaccgacaugacgcccagcaccaccuccccgcccagcuacgacuccgucaccaagcccgagaaggagaaguucgagaaggacaagagcgagaaggaggacaagggcaaggacauccgcgaguccaagaaguga

SEQ ID NO: 36112 - RNA, 648 nt, Artificial Sequence
  derived and/or modified sequence opt1 from SCN2B__Homo_sapiens__NP_004579
augcaccgcgacgccuggcugccccggcccgccuucagccucaccggccugucccuguucuucagccucgugccgcccgggcgcuccauggaggucaccgugcccgcgacgcugaacgugcugaacggcagcgacgcccggcuccccugcaccuucaacuccugcuacaccgucaaccacaagcaguucagccugaacuggaccuaccaggagugcaacaacugcuccgaggagauguuccugcaguuccgcaugaagaucaucaaccucaagcuggagcgguuccaggaccgcguggaguucagcgggaaccccuccaaguacgacgugagcgucaugcugcggaacgugcagcccgaggacgagggcaucuacaacugcuacaucaugaacccgcccgaccgccaccgggggcacggcaagauccaccuccaggugcugauggaggagccgcccgagcgcgacuccacggucgccgugaucgugggcgccagcgucgggggcuuccuggccguggugauccucguccugaugguggugaagugcguccggcgcaagaaggagcagaagcuguccaccgacgaccucaagaccgaggaggaggggaagaccgacggcgaggggaaccccgacgacggcgcgaaguga

SEQ ID NO: 36113 - RNA, 5856 nt, Artificial Sequence
  derived and/or modified sequence opt1 from SCN3A__Homo_sapiens__NP_001075145
auggcccaggcccugcucgugccgcccggccccgaguccuuccgccuguucacccgggagucccuggcggccaucgagaagcgcgccgccgaggagaaggccaagaagcccaagaaggagcaggacaacgacgacgagaacaagcccaagcccaacagcgaccucgaggccgggaagaaccugcccuucaucuacggcgacaucccgcccgagaugguguccgagccccuggaggaccucgaccccuacuacaucaacaagaagaccuucaucgugaugaacaaggggaaggccaucuuccgguucagcgccaccuccgcccuguacauccugacgccccucaaccccgugcgcaagaucgcgaucaagauccugguccacagccuguucuccaugcucaucaugugcaccauccugaccaacugcguguucaugacgcugagcaacccgcccgacuggaccaagaacguggaguacaccuucaccggcaucuacacguucgagucccucaucaagauccuggcccggggguucugccuggaggacuucaccuuccuccgcgaccccuggaacuggcuggacuucagcgucaucgugauggccuacgugaccgaguucgucgaccugggcaacguguccgcccuccggaccuuccgcgugcugcgggcccugaagacgaucagcgucauccccggccucaagaccaucgugggggcgcugauccaguccgugaagaagcugagcgacgucaugauccucaccguguucugccuguccguguucgcccugaucggccuccagcuguucauggggaaccugcgcaacaagugccuccaguggccgcccagcgacuccgccuucgagaccaacacgaccagcuacuucaacggcaccauggacuccaacgggaccuucgucaacgugacgaugagcaccuucaacuggaaggacuacaucggcgacgacagccacuucuacgugcuggacggccagaaggacccccugcucugcgggaacggcuccgacgccgggcagugccccgagggcuacaucugcgucaaggccggccggaaccccaacuacggguacaccagcuucgacaccuucuccugggcguuccugagccuguuccgccucaugacgcaggacuacugggagaaccuguaccagcugacccuccgggccgccggcaagaccuacaugaucuucuucgugcuggugaucuuccugggguccuucuaccucgucaaccugauccuggccguggucgccauggcguacgaggagcagaaccaggccacccucgaggaggccgagcagaaggaggccgaguuccagcagaugcuggagcagcugaagaagcagcaggaggaggcccaggcgguggccgccgccagcgcggccucccgcgacuucagcggcaucgggggccugggcgagcuccuggaguccagcuccgaggccagcaagcuguccagcaaguccgccaaggaguggcggaaccgccggaagaagcgccggcagcgcgagcaccucgaggggaacaacaagggcgagcgggacagcuuccccaaguccgagagcgaggacuccgugaagcgcagcagcuuccuguucuccauggacgggaaccgccugacgagcgacaagaaguucugcagcccccaccagagccuccuguccauccggggcagccuguucagcccccgccggaacagcaagaccuccaucuucagcuuccgcgggcgggccaaggacgucggcuccgagaacgacuucgcggacgacgagcacagcaccuucgaggacuccgagagccgccgggacucccucuucgugccccaccgccacggcgagcggcgcaacagcaacgggaccacgaccgagaccgaggugcggaagcgccggcuguccagcuaccagaucagcauggagaugcuggaggacuccagcggccgccagcgggccgucuccaucgccagcauccucaccaacacgauggaggagcuggaggagucccgccagaagugcccgcccugcugguaccgguucgccaacguguuccugaucugggacugcugcgacgccuggcucaaggugaagcaccuggucaaccugaucgugauggaccccuucguggaccucgcgaucaccaucugcaucguccugaacacccuguucauggccauggagcacuaccccaugaccgagcaguucagcuccgugcucaccguggggaaccuggucuucacgggcaucuucaccgccgagauggugcugaagaucaucgccauggaccccuacuacuacuuccaggagggguggaacaucuucgacggcaucaucgugagccucucccugauggagcugggccucagcaacgucgaggggcuguccgugcugcgcagcuuccggcuccugcgcguguucaagcuggccaaguccuggcccacccucaacaugcugaucaagaucaucggcaacagcgucggggcgcugggcaaccucacccuggugcuggccaucaucguguucaucuucgccgucgugggcaugcagcuguucgggaaguccuacaaggagugcgugugcaagaucaacgacgacugcacgcugccgcgcuggcacaugaacgacuucuuccacagcuuccugaucgucuuccgggugcucugcggcgaguggaucgagaccaugugggacugcauggagguggccgggcagaccaugugccugaucgucuucaugcuggugauggugaucggcaaccucgucgugcugaaccuguuccucgcgcugcugcucuccagcuucuccagcgacaaccuggccgccaccgacgacgacaacgagaugaacaaccugcagaucgccguggggcgcaugcagaagggcaucgacuacgucaagaacaagaugcgggagugcuuccagaaggccuucuuccgcaagcccaaggugaucgagauccacgagggcaacaagaucgacagcugcauguccaacaacacggggaucgagaucagcaaggagcucaacuaccugcgggacggcaacgggaccaccuccggcguggggaccggcagcuccgucgagaaguacgugaucgacgagaacgacuacaugagcuucaucaacaaccccucccugacggugaccguccccaucgcggugggcgagagcgacuucgagaaccucaacaccgaggaguucuccagcgaguccgagcuggaggagagcaaggagaagcugaacgccaccuccagcuccgaggggagcacgguggacgucgugcucccgcgcgagggcgagcaggccgagaccgagcccgaggaggaccugaagcccgaggccugcuucaccgaggggugcaucaagaaguuccccuucugccagguguccaccgaggagggcaaggggaagaucugguggaaccugcggaagacgugcuacagcaucgucgagcacaacugguucgagaccuucaucguguucaugauccuccuguccagcggcgcccuggcguucgaggacaucuacaucgagcagcgcaagaccaucaagaccaugcucgaguacgccgacaagguguucacguacaucuucauccuggagaugcugcucaagugggucgccuacggcuuccagaccuacuucaccaacgccuggugcuggcuggacuuccugaucguggacgucagccucgugucccugguggccaacgcgcugggguacagcgagcucggcgccaucaagucccugcggacccugcgcgcccuccggccgcugcgcgcccugagccgguucgaggggaugcgcgucguggugaacgcgcucgucggcgccauccccuccaucaugaacgugcugcuggugugccucaucuucuggcugaucuucagcaucaugggggucaaccuguucgccggcaaguucuaccacugcgugaacaugacgaccggcaacauguucgacaucuccgacgugaacaaccucagcgacugccaggcccuggggaagcaggcccgguggaagaacgucaaggugaacuucgacaacgugggcgcgggguaccuggcccuccugcaggucgccaccuucaagggcuggauggacaucauguacgccgccguggacucccgcgacgugaagcugcagcccgucuacgaggagaaccucuacauguaccuguacuucgugaucuucaucaucuucggcagcuucuucacccugaaccuguucaucggggugaucaucgacaacuucaaccagcagaagaagaaguucggcgggcaggacaucuucaugacggaggagcagaagaaguacuacaacgcgaugaagaagcucggcuccaagaagccccagaagccgaucccccggcccgccaacaaguuccaggggauggucuucgacuucgugacccgccagguguucgacaucagcaucaugauccugaucugccugaacauggucaccaugaugguggagaccgacgaccagggcaaguacaugacgcucgugcugucccggaucaaccuggucuucaucguccucuucaccggcgaguucgugcugaagcuggucagccuccgccacuacuacuucaccaucggguggaacaucuucgacuucgugguggucauccuguccaucgugggcauguuccuggccgagaugaucgagaaguacuucgugagccccacccucuuccgggucauccgccuggcccgcaucgggcggauccugcgccucaucaagggcgccaaggggauccggacccugcuguucgcgcucaugaugucccugccggcccuguucaacaucggccuccugcuguuccucgugauguucaucuacgccaucuucggcaugagcaacuucgccuacgugaagaaggaggccgggaucgacgacauguucaacuucgagacguucggcaacuccaugaucugccuguuccagaucaccaccagcgcggggugggacggccugcucgcccccauccugaacagcgcgccgcccgacugcgacccggacaccauccaccccggguccagcgucaagggcgacugcggcaaccccuccguggggaucuucuucuucgugagcuacaucaucaucuccuuccuggucguggugaacauguacaucgccgucauccucgagaacuucagcguggcgacggaggaguccgccgagccccugagcgaggacgacuucgagauguucuacgaggugugggagaaguucgacccggacgccacccaguucaucgaguucuccaagcugagcgacuucgccgccgcgcucgacccgccccuccugaucgccaagccgaacaagguccagcucaucgccauggaccugcccaugguguccggcgaccgcauccacugccuggacauccucuucgccuucaccaagcgggugcugggggagagcggcgagauggacgcccugcgcauccagauggaggaccgguucauggcguccaaccccagcaaggucuccuacgagcccaucaccacgacccucaagcgcaagcaggaggaggugagcgccgccaucauccagcggaacuuccgcugcuaccugcugaagcagcggcucaagaacaucuccagcaacuacaacaaggaggccaucaagggccgcaucgaccugccgaucaagcaggacaugaucaucgacaagcugaacgggaacuccacccccgagaagaccgacggcagcagcuccacgaccuccccgcccuccuacgacagcgucaccaagccggacaaggagaaguucgagaaggacaagcccgagaaggaguccaaggggaaggaggugcgggagaaccagaaguga

SEQ ID NO: 36114 - RNA, 648 nt, Artificial Sequence
  derived and/or modified sequence opt1 from SCN3B__Homo_sapiens__XP_011541199
augcccgccuucaaccgccuguucccgcucgccagccuggugcugaucuacugggucuccgugugcuuccccgugugcgucgaggugcccagcgagaccgaggcggugcagggcaaccccaugaagcuccggugcaucuccugcaugaagcgcgaggaggucgaggccaccacggugguggagugguucuaccggccggagggcgggaaggacuuccugaucuacgaguaccgcaacgggcaccaggaggucgagagccccuuccagggccggcugcaguggaacggguccaaggaccuccaggacgugagcaucaccgugcugaacgucacccugaacgacuccggccucuacacgugcaacgugagccgcgaguucgaguucgaggcccaccggcccuucgugaagaccacccgccugaucccccugcgggucaccgaggaggccggcgaggacuucaccuccguggugagcgagaucaugauguacauccuccuggucuuccugacgcucuggcugcugaucgagaugaucuacugcuaccgcaagguguccaaggccgaggaggcggcccaggagaacgccagcgacuaccucgccaucccguccgagaacaaggagaacagcgcggugcccgucgaggaguga

SEQ ID NO: 36115 - RNA, 5511 nt, Artificial Sequence
  derived and/or modified sequence opt1 from SCN4A__Homo_sapiens__NP_000325
auggcccgccccagccugugcacccucgugccccugggccccgagugccugcggcccuucacccgcgagucccucgccgcgaucgagcagcgggccgucgaggaggaggcccgccugcagcggaacaagcagauggagaucgaggagcccgagcgcaagccccggagcgaccuggaggccgggaagaaccuccccaugaucuacggcgacccgccgcccgaggugaucgggaucccccuggaggaccuggaccccuacuacuccaacaagaagacguucaucgugcucaacaagggcaaggccaucuuccgcuucagcgccacccccgcccuguaccugcucucccccuucagcgucgugcggcgcggggccaucaaggugcugauccacgcccuguucuccauguucaucaugaucaccauccucaccaacugcgucuucaugacgaugagcgacccgccgcccugguccaagaacguggaguacaccuucaccggcaucuacaccuucgagagccugaucaagauccuggcgcggggcuucugcguggacgacuucacguuccuccgcgaccccuggaacuggcuggacuucuccgucaucaugauggccuaccugaccgaguucguggaccucgggaacaucagcgcccugcggaccuuccgcgugcugcgggcccucaagaccaucacggucauccccggccugaagaccaucgugggggcccugauccaguccgugaagaagcucagcgacgucaugauccugaccguguucugccuguccguguucgcgcucgucggccugcagcuguucauggggaaccuccgccagaagugcgugcgguggcccccgcccuucaacgacaccaacacgaccugguacagcaacgacaccugguacggcaacgacaccugguacggcaacgagaugugguacgggaacgacuccugguacgccaacgacacguggaacagccacgccuccugggccaccaacgacaccuucgacugggacgccuacaucagcgacgagggcaacuucuacuuccuggaggggagcaacgacgcgcugcucugcggcaacuccagcgacgccggccacugccccgagggguacgagugcaucaagaccggccgcaaccccaacuacggguacacguccuacgacaccuucagcugggccuuccuggcccuguuccggcucaugacccaggacuacugggagaaccuguuccagcugacccuccgcgccgcgggcaagacguacaugaucuucuucguggucaucaucuuccugggguccuucuaccugaucaaccucauccuggccgugguggccauggccuacgccgagcagaacgaggcgacccuggccgaggacaaggagaaggaggaggaguuccagcagaugcucgagaaguucaagaagcaccaggaggagcuggagaaggccaaggccgcgcaggcccuggagggcggcgaggccgacggggaccccgcccacggcaaggacugcaacgggagccuggacaccucccagggcgagaagggggcgccccggcagagcuccagcggcgacuccggcaucagcgacgccauggaggagcucgaggaggcccaccagaagugcccgcccuggugguacaagugcgcccacaagguccugaucuggaacugcugcgcccccuggcugaaguucaagaacaucauccaccucaucgugauggaccccuucgucgaccuggggaucaccaucugcaucgugcugaacacgcuguucauggccauggagcacuaccccaugaccgagcacuucgacaacgugcugaccgucggcaaccugguguucaccgggaucuucacggcggagauggugcucaagcugaucgccauggaccccuacgaguacuuccagcagggcuggaacaucuucgacuccaucaucgucacccugagccucguggagcuggggcuggccaacgugcagggccucuccguccugcgcagcuuccgccugcuccggguguucaagcuggccaaguccuggcccacccugaacaugcucaucaagaucaucggcaacagcgugggggcccugggcaaccugacccucguccuggcgaucaucguguucaucuucgccguggucgggaugcagcuguucggcaaguccuacaaggagugcgugugcaagaucgcccucgacugcaaccugccccgcuggcacaugcacgacuucuuccacagcuuccugaucguguuccggauccucugcggcgaguggaucgagaccaugugggacugcauggaggucgccgggcaggcgaugugccugacgguguuccugauggugauggucaucggcaaccucguggugcugaaccuguuccucgcccugcugcucagcuccuucagcgccgacucccuggccgccagcgacgaggacggggagaugaacaaccugcagaucgcgaucggccgcaucaagcucgggaucggcuucgccaaggccuuccugcugggccuccugcacgggaagauccugucccccaaggacaucaugcucagccugggcgaggccgacggggccggcgaggcgggggaggccggcgagaccgcccccgaggacgagaagaaggagccgcccgaggaggaccugaagaaggacaaccacauccucaaccacaugggccuggccgacgggccgcccuccagccuggagcucgaccaccugaacuucaucaacaacccguaccugaccauccagguccccaucgccuccgaggagagcgaccucgagaugcccaccgaggaggagacggacaccuucuccgagcccgaggacagcaagaagccgccccagccccuguacgacggcaacuccagcgugugcuccaccgcggacuacaagcccccggaggaggaccccgaggagcaggccgaggagaaccccgagggggagcagcccgaggagugcuucaccgaggccugcgugcagcgguggccgugccuguacgucgacaucagccagggccgcgggaagaagugguggacgcuccggcgcgccugcuucaagaucguggagcacaacugguucgagaccuucaucguguucaugauccugcuguccagcggcgcgcucgccuucgaggacaucuacaucgagcagcggcgcgucauccggaccauccuggaguacgccgacaagguguucaccuacaucuucaucauggagaugcugcucaaguggguggccuacggcuucaaggucuacuucacgaacgccuggugcuggcuggacuuccugaucguggacgugagcaucaucucccucgucgcgaacuggcugggguacagcgagcugggccccaucaagucccuccgcacccugcgggcccugcgcccccuccgggcccugagccgcuucgaggggaugcgggugguggucaacgcccugcucggcgccauccccuccaucaugaacgugcugcuggugugccucaucuucuggcugaucuucagcaucaugggggucaaccuguucgcgggcaaguucuacuacugcaucaacaccaccacguccgagcgcuucgacaucagcgaggugaacaacaaguccgagugcgagagccucaugcacaccggccaggugcgguggcugaacgucaaggugaacuacgacaacguggggcugggcuaccucucccugcugcaggucgccaccuucaagggguggauggacaucauguacgccgccguggacagccgcgagaaggaggagcagccgcaguacgaggugaaccucuacauguaccuguacuucgucaucuucaucaucuucggcuccuucuucacccugaaccucuucaucggcgugaucaucgacaacuucaaccagcagaagaagaagcucgggggcaaggacaucuucaugacggaggagcagaagaaguacuacaacgccaugaagaagcuggggagcaagaagccccagaagcccaucccgcgcccccagaacaagauccagggcauggucuacgaccuggugaccaagcaggcguucgacaucaccaucaugauccucaucugccugaacauggugaccaugauggucgagacggacaaccagucccagcugaagguggacauccucuacaacaucaacaugaucuucaucaucaucuucaccggggagugcgugcugaagaugcuggcccuccggcaguacuacuucaccgucggcuggaacaucuucgacuucgugguggucauccugagcaucgugggccuggcccucuccgaccugauccagaaguacuucgugagccccacccuguuccgcgucauccggcucgcccgcaucgggcgggugcugcgccugauccggggcgccaaggggauccgcacgcuccuguucgcgcugaugaugucccuccccgcccuguucaacaucggccugcuccuguuccuggugauguucaucuacagcaucuucgggaugagcaacuucgccuacgucaagaaggaguccggcaucgacgacauguucaacuucgagaccuucggcaacagcaucaucugccucuucgagaucaccaccuccgccgggugggacggccugcugaacccgauccucaacagcgggccgcccgacugcgaccccaaccuggagaacccgggcacguccgugaagggggacugcggcaaccccagcaucggcaucugcuucuucugcuccuacaucaucaucagcuuccugaucguggucaacauguacaucgcgaucauccucgagaacuucaacguggccaccgaggaguccagcgagccccugggggaggacgacuucgagauguucuacgagaccugggagaaguucgaccccgacgccacccaguucaucgccuacucccggcugagcgacuucguggacacgcuccaggagccgcugcgcaucgccaagcccaacaagaucaagcugaucacccucgaccugcccaugguccccggcgacaagauccacugccuggacauccucuucgcgcugaccaaggaggugcugggggacuccggcgagauggacgcccucaagcagaccauggaggagaaguucauggccgccaacccgagcaagguguccuacgagcccaucaccacgacccugaagcggaagcacgaggaggucugcgccaucaagauccagcgcgcguaccggcgccaccuccugcagcggagcaugaagcaggccuccuacauguaccgccacagccacgacggcuccggggacgacgcccccgagaaggagggccugcuggccaacaccaugagcaagauguacgggcacgagaacggcaacagcuccagccccuccccggaggagaagggggaggccggcgacgcgggccccaccauggggcucaugcccaucagccccuccgacacggccuggccgcccgcgccgccgcccggccagaccgugcggcccggggugaaggagagccuggucuga

SEQ ID NO: 36116 - RNA, 285 nt, Artificial Sequence
  derived and/or modified sequence opt1 from SCN4B__Homo_sapiens__NP_001135820
augcccggcgccggggacggcgggaaggcccccgcgcgcuggcugggcaccgggcuccugguggaggaggucgacaacaccgugacgcugaucauccucgccguggucggcggcgugaucgggcugcugauccucauccugcugaucaagaagcucaucaucuucauccugaagaagacccgggagaagaagaaggagugccuggugagcuccagcggcaacgacaacaccgagaacgggcuccccggcuccaaggccgaggagaagccgcccagcaaggucuga

SEQ ID NO: 36117 - RNA, 6048 nt, Artificial Sequence
  derived and/or modified sequence opt1 from SCN5A__Homo_sapiens__NP_000326
auggccaacuuccugcugccccgcggcaccagcuccuuccggcgcuucacccgggagucccuggccgccaucgagaagcgcauggccgagaagcaggcccggggcuccacgacccugcaggagagccgcgagggccugcccgaggaggaggcgccccggccccagcuggaccugcaggccuccaagaagcugcccgaccuguacggcaacccgccccaggagcugaucggcgagccccucgaggaccuggaccccuucuacagcacccagaagaccuucaucgugcugaacaaggggaagacgaucuuccgcuucuccgcgaccaacgcccucuacguccugagccccuuccaccccauccggcgcgccgccgugaagauccuggugcacucccucuucaacaugcugaucaugugcaccauccugaccaacugcgucuucauggcgcagcacgacccgccgcccuggacgaaguacguggaguacaccuucaccgccaucuacaccuucgagagccucgugaagauccuggcccggggcuucugccugcacgccuucacguuccuccgcgaccccuggaacuggcuggacuucuccgucaucaucauggccuacaccaccgaguucguggaccugggcaacgugagcgcgcuccggaccuuccgcguccugcgggcccugaagacgaucuccgugaucagcgggcucaagaccaucgugggcgcccugauccaguccgucaagaagcuggccgacgugauggugcucaccgucuucugccugagcguguucgcccugaucgggcuccagcuguucaugggcaaccugcgccacaagugcgugcggaacuucaccgcgcucaacgggacgaacggcuccgucgaggccgacggccuggugugggagagccuggaccucuaccuguccgaccccgagaacuaccugcucaagaacgggaccagcgacgugcugcugugcggcaacagcuccgacgccgggaccugccccgagggcuaccgcugccucaaggccggcgagaaccccgaccacggguacaccagcuucgacuccuucgccugggcguuccuggcccuguuccggcucaugacgcaggacugcugggagcgccuguaccagcagacccugcggagcgccggcaagaucuacaugaucuucuucaugcuggucaucuuccucggguccuucuaccuggugaaccugauccucgccguggucgccauggcguacgaggagcagaaccaggccaccaucgccgagaccgaggagaaggagaagcgcuuccaggaggccauggagaugcugaagaaggagcacgaggcgcugacgauccgcggcguggacaccgucagccgguccagccucgagaugagcccccucgcccccgugaacucccacgagcgccgguccaagcgccggaagcgcaugagcuccgggaccgaggagugcggcgaggaccggcugcccaagagcgacuccgaggacggcccccgcgccaugaaccaccucagccugacccgggggcugucccgcacgagcaugaagccccgguccagccgcggcagcaucuucaccuuccggcgccgggaccucggguccgaggccgacuucgccgacgacgagaacagcaccgcgggcgaguccgagagccaccacaccucccugcuggugcccuggccccuccgccggacgagcgcccaggggcagcccucccccggcaccagcgcccccggccacgcccugcacgggaagaagaacuccaccgucgacugcaacggcguggugagccugcucggggccggcgaccccgaggcgaccucccccgggagccaccuccugcgccccgucaugcucgagcacccgcccgacaccacgacccccuccgaggagcccggcggcccccagaugcugaccagccaggccccgugcguggacggguucgaggagcccggcgcccggcagcgcgcccuguccgccgugagcguccucaccuccgcgcuggaggagcuggaggagagccgccacaagugcccgcccugcuggaaccggcucgcccagcgcuaccugaucugggagugcugcccgcuguggaugagcaucaagcagggggugaagcucguggucauggaccccuucacggaccugaccaucaccaugugcaucgugcugaacacccucuucauggcccuggagcacuacaacaugacguccgaguucgaggagaugcuccaggugggcaaccucgucuucaccggcaucuucaccgccgagaugaccuucaagaucaucgcgcuggaccccuacuacuacuuccagcagggguggaacaucuucgacagcaucaucgugauccugucccucauggagcugggccugagccggauguccaaccucagcgugcugcgcuccuuccggcugcuccgcgucuucaagcuggccaagagcuggcccacgcugaacacccucaucaagaucaucgggaacuccgugggcgcccuggggaaccugacccucgugcuggccaucaucgucuucaucuucgccguggugggcaugcagcuguucggcaagaacuacagcgagcuccgggacuccgacagcgggcugcugccgcgcuggcacaugauggacuucuuccacgcguuccucaucaucuuccggauccugugcggcgaguggaucgagaccaugugggacugcauggaggucuccgggcagagccugugccuccugguguuccugcucgugauggucaucggcaaccugguggugcugaaccucuuccuggcccugcuccuguccagcuucuccgccgacaaccugacggcccccgacgaggaccgcgagaugaacaaccuccagcuggcccuggcgcggauccagcgcgggcuccgguucgucaagcgcaccaccugggacuucugcugcggccugcugcggcagcgcccccagaagcccgccgcccucgccgcccagggccagcugccgagcugcaucgcgacccccuacagcccgcccccgcccgagacggagaaggugccgcccacccggaaggagacccgcuucgaggagggggagcagcccggccaggggacccccggcgaccccgagccggugugcguccccaucgccguggccgagagcgacacggacgaccaggaggaggacgaggagaacagccuggggaccgaggaggaguccagcaagcaggagucccagcccgugagcggcggccccgaggccccgcccgacucccggaccuggagccaggucuccgcgaccgccagcuccgaggccgaggccagcgccucccaggcggacuggcgccagcaguggaaggccgagccccaggcccccgggugcggcgagacgccggaggacagcugcuccgaggggagcaccgccgacaugaccaacaccgccgagcuccuggagcagauccccgaccugggccaggacgugaaggaccccgaggacugcuucacggaggggugcgugcggcgcugccccugcugcgcggucgacaccacccaggccccgggcaaggugugguggcgccuccggaagaccugcuaccacaucguggagcacuccugguucgagacguucaucaucuucaugauccugcugagcuccggcgcccucgccuucgaggacaucuaccuggaggagcgcaagaccaucaagguccugcucgaguacgccgacaagauguucaccuacguguucgugcuggagaugcugcucaagugggucgcguacggguucaagaaguacuucaccaacgccuggugcuggcuggacuuccugaucguggacgugagccuggucucccucguggccaacacccugggcuucgccgagauggggcccaucaagagccugcggacgcuccgcgcccugcggccccugcgcgcgcucagccgguucgagggcaugcgcguggucgugaacgcccuggucggcgccauccccuccaucaugaacgugcugcucgugugccugaucuucuggcugaucuucagcaucaugggggucaaccucuucgccggcaaguucgggcggugcaucaaccagaccgagggcgaccugccgcugaacuacaccaucgugaacaacaagucccagugcgagagccucaaccugaccggggagcuguacuggacgaaggugaaggucaacuucgacaacgugggcgcgggcuaccucgcccugcuccagguggccaccuucaagggguggauggacaucauguacgccgccgucgacucccgcggcuacgaggagcagccccagugggaguacaaccucuacauguacaucuacuucgugaucuucaucaucuucgggagcuucuucacccugaaccuguucaucggcgugaucaucgacaacuucaaccagcagaagaagaagcucgggggccaggacaucuucaugaccgaggagcagaagaaguacuacaacgcgaugaagaagcugggcuccaagaagccccagaagcccaucccgcggccccugaacaaguaccagggguucaucuucgacaucgucacgaagcaggccuucgacgugaccaucauguuccucaucugccugaacauggugaccaugauggucgagaccgacgaccagagccccgagaagaucaacauccuggccaagaucaaccuccuguucguggccaucuucacgggcgagugcaucgugaagcuggccgcgcuccgccacuacuacuucaccaacuccuggaacaucuucgacuucgucguggugauccugagcaucgucgggaccgugcuguccgacaucauccagaaguacuucuucagccccacccucuuccgggugauccgccuggcccggaucggccgcauccugcggcucauccgcggggccaagggcauccggacgcugcuguucgcccucaugaugucccugccggcccuguucaacaucggccuccugcuguuccucgucauguucaucuacagcaucuucgggauggcgaacuucgccuacgugaagugggaggccggcaucgacgacauguucaacuuccagaccuucgccaacuccaugcugugccuguuccagaucaccaccagcgcggggugggacggccuccugucccccauccugaacacggggccgcccuacugcgacccgacccuccccaacagcaacgggucccgcggcgacugcgggagccccgccgugggcauccuguucuucaccaccuacaucaucaucagcuuccugaucgucgugaacauguacaucgccaucauccucgagaacuucuccguggccacggaggagagcaccgagccgcuguccgaggacgacuucgacauguucuacgagaucugggagaaguucgaccccgaggccacccaguucaucgaguacagcguccuguccgacuucgcggacgcccucagcgagccccugcgcaucgccaagcccaaccagaucucccugaucaacauggaccucccgauggugagcggggaccggauccacugcauggacauccuguucgccuucaccaagcgcgugcugggcgaguccggcgagauggacgcccucaagauccagauggaggagaaguucauggcggccaaccccagcaagaucuccuacgagcccaucacgaccacccugcggcgcaagcacgaggaggucagcgccauggugauccagcgggccuuccgccggcaccuccugcagcgcucccugaagcacgccagcuuccuguuccggcagcaggcgggguccggccugagcgaggaggacgcccccgagcgcgaggggcugaucgccuacgugauguccgagaacuucagccggccgcuggggccgcccuccagcagcuccaucagcuccaccagcuucccgcccuccuacgacagcgucacgcgcgccaccuccgacaaccuccaggugcgggggagcgacuacucccacagcgaggaccuggcggacuucccgcccucccccgaccgcgaccgggagagcaucguguga

SEQ ID NO: 36118 - RNA, 5049 nt, Artificial Sequence
  derived and/or modified sequence opt1 from SCN7A__Homo_sapiens__NP_002967
augcuggccagccccgagccgaagggccuggugcccuucacgaaggagagcuucgagcugaucaagcagcacaucgccaagacccacaacgaggaccacgaggaggaggaccugaagcccacgcccgaccuggaggucgggaagaagcugccguucaucuacggcaaccugagccaggggauggugagcgagccccucgaggacguggaccccuacuacuacaagaagaagaacaccuucaucguccugaacaagaaccggaccaucuuccgguucaacgcggccagcauccugugcacccucucccccuucaacugcauccgccggacgaccaucaaggugcuggugcacccguucuuccagcuguucauccucaucagcguccugaucgacugcguguucaugucccugaccaaccuccccaaguggcgccccgugcuggagaacacccugcucggcaucuacacguucgagauccuggucaagcuguucgcccgcggggugugggccggcagcuucuccuuccucggcgaccccuggaacuggcuggacuucagcgugaccgucuucgaggugaucauccgcuacuccccgcuggacuucauccccacccuccagaccgcccggacgcugcgcauccugaagaucaucccccucaaccaggggcucaagagccuggugggcguccucauccacugccugaagcagcugaucggggugaucauccucacccuguucuuccuguccaucuucagccucaucggcauggggcuguucaugggcaaccugaagcacaagugcuuccgguggccccaggagaacgagaacgagacccuccacaaccgcaccggcaacccguacuacauccgggagacggagaacuucuacuaccuggagggggagcgcuacgcgcugcucugcggcaaccggaccgacgccgggcagugccccgagggcuacgugugcgucaaggccggcaucaaccccgaccagggguucaccaacuucgacuccuucggcugggcccuguucgcgcuguuccgccucauggcccaggacuaccccgaggugcuguaccaccagauccuguacgccagcgggaagguguacaugaucuucuucgucgugguguccuuccucuucagcuucuacauggccucccuguuccugggcauccuggccauggcguacgaggaggagaagcagcgggucggggagaucagcaagaagaucgagccgaaguuccagcagaccggcaaggagcuccaggagggcaacgagacggacgaggccaagaccauccagaucgagaugaagaagcgcagccccaucuccaccgacaccagccuggacgugcuggaggacgccacgcuccggcacaaggaggagcuggagaaguccaagaagaucugcccccuguacugguacaaguucgccaagaccuuccucaucuggaacugcagccccugcuggcugaagcugaaggaguucguccaccgcaucaucauggccccguucaccgaccucuuccugaucaucugcaucauccugaacgugugcuuccucacccuggagcacuaccccauguccaagcagacgaacacccugcucaacaucgggaaccugguguucaucggcaucuucaccgcggagaugaucuucaagaucaucgccaugcaccccuacggguacuuccaggucggcuggaacaucuucgacagcaugaucguguuccacgggcugaucgagcucugccuggccaacguggccggcauggcccugcuccggcuguuccgcaugcugcggaucuucaagcucggcaaguacuggcccaccuuccagauccugauguggucccugagcaacuccugggucgcgcucaaggaccuggugcugcuccuguucacguucaucuucuucagcgccgccuucgggaugaagcuguucggcaagaacuacgaggaguucgugugccacaucgacaaggacugccagcucccgcgcuggcacaugcacgacuucuuccacuccuuccugaacgucuuccgcauccugugcggggaguggguggagacccucugggacugcauggagguggccggccagagcuggugcauccccuucuaccugauggucauccugaucgggaaccuccuggugcuguaccucuuccuggcccugguguccagcuucuccagcugcaaggacgucaccgcggaggagaacaacgaggccaagaaccuccagcuggccguggcccggaucaagaagggcaucaacuacgugcugcucaagauccugugcaagacccagaacguccccaaggacacgauggaccacgugaacgagguguacgucaaggaggacaucuccgaccacacccugagcgagcucuccaacacccaggacuuccugaaggacaaggagaaguccagcggcaccgagaagaacgcgaccgagaacgagucccagagccugaucccgucccccagcguguccgagacggugcccaucgccagcggggaguccgacaucgagaaccucgacaacaaggagauccagagcaaguccggcgacgggggcagcaaggagaagaucaagcaguccagcuccagcgagugcuccaccgucgacaucgccaucagcgaggaggaggagauguucuacggcggggagcgcuccaagcaccugaagaacggcugccggcgcgggagcagccugggccagaucuccggggccagcaagaagggcaagaucuggcagaacauccggaagaccugcugcaagaucguggagaacaacugguucaagugcuucaucggccucgugacccugcuguccacggggacccucgccuucgaggacaucuacauggaccagcgcaagaccaucaagauccugcuggaguacgcggacaugaucuucaccuacaucuucauccucgagaugcugcugaaguggauggccuacggcuucaaggccuacuucagcaacgggugguaccggcucgacuucgucguggugaucgucuucugccugucccugaucggcaagacgcgcgaggagcucaagccccugaucagcaugaaguuccugcggccgcuccgcgugcugucccaguucgagcggaugaagguggucgugcgcgcccugaucaagaccacccuccccacccugaacguguuccuggucugccucaugaucuggcugaucuucagcaucauggggguggaccuguucgccggccgguucuacgagugcaucgaccccacguccggcgagcgcuuccccagcuccgaggugaugaacaagagccggugcgagucccuccuguucaacgagagcaugcugugggagaacgcgaagaugaacuucgacaacgucgggaacggcuuccucucccugcuccagguggccaccuucaacggguggaucaccaucaugaacagcgccaucgacuccguggccgucaacauccagccgcacuucgaggugaacaucuacauguacugcuacuucaucaacuucaucaucuucggcguguuccucccccugagcaugcugaucaccgucaucaucgacaacuucaacaagcacaagaucaagcucgggggcuccaacaucuucaucacggugaagcagcgcaagcaguaccggcgccugaagaagcugauguacgaggacagccagcggcccgugccccgcccgcucaacaagcugcagggcuucaucuucgacgucgugaccagccaggccuucaacgugaucgucauggugcugaucugcuuccaggcgaucgccaugaugaucgacaccgacguccagucccugcagaugagcaucgcccucuacuggaucaacuccaucuucgugaugcuguacaccauggagugcauccugaagcucaucgccuuccgcugcuucuacuucacgaucgcguggaacaucuucgacuucaugguggucaucuucagcaucaccgggcugugccugcccaugaccgugggcuccuaccucgugccgcccagccugguccagcugauccuccugucccggaucauccacaugcugcgccucgggaagggcccgaagguguuccacaaccugaugcugccccucaugcugagccugcccgcccuccugaacaucauccugcucaucuuccuggugauguucaucuacgccgucuucgggauguacaacuucgccuacgugaagaaggaggccggcaucaacgacguguccaacuucgagaccuucggcaacagcaugcugugccucuuccaggucgcgaucuucgccgggugggacggcaugcuggacgccaucuucaacuccaaguggagcgacugcgaccccgacaagaucaacccggggacccaggugcggggcgacugcggcaaccccuccguggggaucuucuacuucgucagcuacauccugaucuccuggcucaucaucgugaacauguacaucguggucgugauggaguuccugaacaucgccagcaagaagaagaacaagacccuguccgaggacgacuuccgcaaguucuuccagguguggaagcgguucgaccccgaccgcacccaguacaucgacagcuccaagcucagcgacuucgccgcggcccuggacccgccccuguucauggccaagcccaacaagggccagcucaucgcccuggaccugcccauggccgucggggaccggauccacugccucgacauccugcuggcguucaccaagcgcgugaugggccaggacgugcggauggagaaggucgugagcgagaucgaguccggguuccuccuggccaaccccuucaagaucacgugcgagcccaucaccaccacccugaagcgcaagcaggaggccgugagcgccacgaucauccagcgggcguacaagaacuaccgccuccggcgcaacgacaagaacaccuccgacauccacaugaucgacggcgaccgggacguccacgccaccaaggagggcgccuacuucgacaaggccaaggagaagucccccauccagucccagaucuga

SEQ ID NO: 36119 - RNA, 5820 nt, Artificial Sequence
  derived and/or modified sequence opt1 from SCN8A__Homo_sapiens__NP_001171455
auggccgcccgccugcucgcgcccccgggccccgacuccuucaagcccuucacccccgagucccuggccaacaucgagcggcgcaucgccgagagcaagcugaagaagccgcccaaggccgacgggucccaccgggaggacgacgaggacagcaagcccaagcccaacuccgaccucgaggccggcaagagccugcccuucaucuacggggacaucccccagggccugguggcggucccccucgaggacuucgaccccuacuaccugacccagaagaccuucguggugcugaaccgcgggaagacccucuuccgguucuccgccaccccggcccuguacauccugagccccuucaaccucauccgccggaucgccaucaagauccugauccacuccgucuucagcaugaucaucaugugcaccauccugaccaacugcguguucaugaccuucuccaacccgcccgacuggagcaagaacguggaguacaccuucaccggcaucuacacguucgagucccucgucaagaucaucgcgcgcggcuucugcaucgacggguucaccuuccugcgggacccguggaacuggcuggacuucagcgugaucaugauggccuacaucaccgaguucgugaaccucggcaacgucuccgcccugcgcaccuuccgggugcugcgcgcccucaagacgaucagcgugauccccgggcugaagaccaucgucggcgcccugauccaguccgugaagaagcucagcgacgugaugauccugaccgucuucugccuguccguguucgcgcucaucgggcugcagcuguucaugggcaaccuccggaacaagugcguggucuggcccaucaacuucaacgagagcuaccuggagaacggcaccaagggguucgacugggaggaguacaucaacaacaagacgaacuucuacaccgugcccggcaugcuggagccgcuccugugcgggaacagcuccgacgccggccagugccccgagggcuaccagugcaugaaggccgggcgcaaccccaacuacggcuacaccagcuucgacaccuucuccugggccuuccuggcccucuuccggcugaugacgcaggacuacugggagaaccuguaccagcucacccugcgcgcggccgggaagaccuacaugaucuucuucgugcuggucaucuucgugggcagcuucuaccucgugaaccugauccuggccgucguggccauggccuacgaggagcagaaccaggcgacccucgaggaggccgagcagaaggaggccgaguucaaggccaugcuggagcagcugaagaagcagcaggaggaggcccaggcggccgccauggccacguccgcggggaccgucagcgaggacgccaucgaggaggagggcgaggagggcgggggcagcccccggagcuccagcgagaucuccaagcucagcuccaagagcgccaaggagcgccggaaccgccggaagaagcgcaagcagaaggagcuguccgagggggaggagaagggcgacccggagaagguguucaagagcgaguccgaggacgggaugcgccggaaggccuuccgccugcccgacaaccggaucggccgcaaguucagcaucaugaaccagucccugcucagcauccccggcagccccuuccugucccggcacaacagcaaguccagcaucuucuccuuccgcgggccgggccgguuccgcgaccccgggagcgagaacgaguucgccgacgacgagcacuccaccguggaggagagcgagggccggcgcgacucccuguucauccccauccgggcgcgcgagcggcgcagcuccuacagcggguacuccggcuacagccagggcucccggagcucccgcaucuucccgagccuccggcgcagcgucaagcggaacuccaccguggacugcaacgggguggucagccugaucggcgggcccggcucccacaucggcgggcgccugcuccccgaggccacgaccgagguggagaucaagaagaagggccccgggagccugcugguguccauggaccagcucgccagcuacggccgcaaggaccggaucaacuccaucaugagcgucgugaccaacacccugguggaggagcuggaggagucccagcgcaagugcccgcccugcugguacaaguucgccaacacguuccucaucugggagugccaccccuacuggaucaagcugaaggagaucgucaaccugaucgugauggaccccuucguggaccucgccaucaccaucugcaucguccugaacacccuguucauggcgauggagcaccacccgaugacgccccaguucgagcacgugcucgccguggggaaccuggucuucacgggcaucuucaccgccgagauguuccugaagcucaucgccauggaccccuacuacuacuuccaggagggcuggaacaucuucgacggguucaucgugagccugucccugauggagcucagccuggccgacguggagggccuguccguccuccggagcuuccgccugcugcggguguucaagcucgcgaaguccuggcccacccugaacaugcugaucaagaucaucgggaacagcgugggcgcccucgggaaccugacccugguccucgccaucaucguguucaucuucgccguggucggcaugcagcuguucggcaaguccuacaaggagugcgugugcaagaucaaccaggacugcgagcugccgcgcuggcacaugcacgacuucuuccacagcuuccucaucguguuccggguccugugcggggaguggaucgagaccaugugggacugcauggagguggcgggccaggccaugugccugaucguguucaugauggucauggugaucgggaaccucgugguccugaaccuguuccucgcccugcugcucuccagcuucagcgccgacaaccuggccgcgacggacgacgacggcgagaugaacaaccugcagaucuccgugauccgcaucaagaaggggguggccuggaccaagcucaagguccacgccuucaugcaggcccacuucaagcagcgggaggccgacgaggugaagccccuggacgagcuguacgagaagaaggcgaacugcaucgccaaccacaccggcgccgacauccaccgcaacggcgacuuccagaagaacgggaacggcaccacgagcgggaucggcuccagcguggagaaguacaucaucgacgaggaccacauguccuucaucaacaaccccaaccucaccguccgggugcccaucgccgugggggagagcgacuucgagaaccugaacaccgaggacgucuccagcgaguccgacccggagggcagcaaggacaagcuggacgacaccuccagcuccgagggcagcacgaucgacaucaagcccgagguggaggaggugcccgucgagcagcccgaggaguaccucgacccggacgccugcuucaccgaggggugcgugcagcgcuucaagugcugccaggugaacaucgaggagggccuggggaaguccugguggauccugcggaagaccugcuuccucaucgucgagcacaacugguucgagaccuucaucaucuucaugauccugcugagcuccggcgcgcucgccuucgaggacaucuacaucgagcagcgcaagacgauccggaccauccuggaguacgccgacaagguguucaccuacaucuucauccuggagaugcuccugaaguggaccgccuacggcuucgucaaguucuucacgaacgcguggugcuggcuggacuuccucaucguggccguggucgugaacgcccuggugggggccauccccagcaucaugaacguccugcucgugugccugaucuucuggcugaucuucuccaucaugggcgugaaccucuucgccgggaaguaccacuacugcuucaacgagaccagcgagauccgcuucgagaucgaggacgucaacaacaagaccgagugcgagaagcugauggagggcaacaacaccgagauccgguggaagaacgugaagaucaacuucgacaacgugggggcgggcuaccuggcccuccugcaggucgccacguucaagggcuggauggacaucauguacgccgccguggacagccgcaagcccgacgagcagcccaaguacgaggacaacaucuacauguacaucuacuucgugaucuucaucaucuucggguccuucuucacccugaaccucuucaucggcgucaucaucgacaacuucaaccagcagaagaagaaguucgggggccaggacaucuucaugaccgaggagcagaagaaguacuacaacgcgaugaagaagcuggggagcaagaagccgcagaagcccaucccccggccgcugaacaagauccagggcaucguguucgacuucgugacccagcaggccuucgacaucgucaucaugaugcucaucugccugaacauggugacgaugaugguggagaccgacacccaguccaagcagauggagaacauccuguacuggaucaaccucgucuucgugaucuucuucacgugcgagugcgugcugaagauguucgcccugcgccacuacuacuucacgaucggcuggaacaucuucgacuucgucguggugauccucagcaucgucgggauguuccuggccgacaucaucgagaaguacuucgugucccccacccuguuccgggugauccgccucgcccgcaucggccggauccugcgccugaucaagggggcgaagggcauccggacccuccuguucgcccugaugaugagccugcccgcccucuucaacaucgggcugcuccuguuccuggucauguucaucuucuccaucuucggcaugagcaacuucgccuacgugaagcacgaggccggcaucgacgacauguucaacuucgagaccuucgggaacuccaugaucugccuguuccagaucacgaccagcgcgggcugggacgggcuccugcugcccauccucaaccgcccgcccgacugcucccuggacaaggagcaccccggcagcggcuucaagggggacugcggcaaccccuccguggggaucuucuucuucgucagcuacaucaucaucuccuuccugaucguggugaacauguacaucgccaucauccucgagaacuucagcgucgccaccgaggaguccgccgacccgcugagcgaggacgacuucgagaccuucuacgagaucugggagaaguucgaccccgacgcgacgcaguucaucgaguacugcaagcuggccgacuucgccgacgcccucgagcacccccugcgggugcccaagccgaacaccaucgagcugaucgccauggaccuccccaugguguccggcgaccgcauccacugccuggacauccuguucgcguucaccaagcggguccucggggacagcggcgagcuggacauccugcgccagcagauggaggagcgguucguggccagcaaccccuccaaggugagcuacgagcccaucaccaccacgcuccgccggaagcaggaggaggucuccgccguggugcugcagcgcgccuaccggggccaccuggcccgccggggguucaucugcaagaagaccaccagcaacaagcucgagaacggcgggacccaccgcgagaagaaggaguccacgccgagcaccgcgucccugcccagcuacgacuccgucaccaagcccgagaaggagaagcagcagcgggccgaggagggccgccgggagcgcgccaagcgccagaaggaggugcgggagagcaagugcuga

SEQ ID NO: 36120 - RNA, 5934 nt, Artificial Sequence
  derived and/or modified sequence opt1 from SCN9A__Homo_sapiens__NP_002968
auggcgaugcugcccccgcccggcccccagagcuucgugcacuucaccaagcagucccucgcccugaucgagcagcggaucgcggagcggaaguccaaggagcccaaggaggagaagaaggacgacgacgaggaggcccccaagcccuccagcgaccuggaggccgggaagcagcuccccuucaucuacggcgacaucccgcccgggauggucuccgagccccuggaggaccuggaccccuacuacgccgacaagaagaccuucaucgugcucaacaagggcaagacgaucuuccgcuucaacgccacccccgcgcuguacaugcugagccccuucagcccccuccggcgcaucagcaucaagauccuggugcacucccuguucagcaugcucaucaugugcaccauccugaccaacugcaucuucaugaccaugaacaacccgcccgacuggaccaagaacgucgaguacaccuucaccgggaucuacacguucgagucccuggugaagauccucgcccggggcuucugcgugggcgaguucaccuuccugcgcgacccguggaacuggcuggacuucgucgugaucguguucgccuaccucaccgaguucgucaaccuggggaacgugagcgcccugcggaccuuccgcgugcuccgggcgcugaagacgaucuccgucauccccggccugaagaccaucgugggggcccucauccagagcgugaagaagcuguccgacgucaugauccugaccguguucugccucagcguguucgcccugaucggccugcagcuguucauggggaaccugaagcacaagugcuuccgcaacucccuggagaacaacgagacccucgagagcaucaugaacacgcuggaguccgaggaggacuuccggaaguacuucuacuaccuggagggcagcaaggacgcccuccugugcggcuucagcaccgacuccgggcagugccccgagggcuacacgugcgucaagaucgggcgcaaccccgacuacggcuacaccagcuucgacacguucuccugggccuuccuggcccucuuccggcugaugacccaggacuacugggagaaccuguaccagcagacccuccgcgccgccggcaagaccuacaugaucuucuucgugguggucaucuuccuggggagcuucuaccugaucaaccucauccuggccgugguggccauggcguacgaggagcagaaccaggccaacaucgaggaggccaagcagaaggagcuggaguuccagcagaugcucgaccggcugaagaaggagcaggaggaggccgaggccaucgcggccgccgccgccgaguacacguccauccgccggagccgcaucaugggccuguccgagagcuccagcgagaccuccaagcugagcuccaagagcgcgaaggagcggcgcaaccggcgcaagaagaagaaccagaagaagcucuccagcggggaggagaagggcgacgccgagaagcuguccaagagcgaguccgaggacagcauccgccgcaagagcuuccaccugggggucgagggccaccgccgggcccacgagaagcgccucuccaccccgaaccagagcccccuguccauccggggcagccuguucuccgcccgccggagcucccgcaccagccucuucuccuucaaggggcggggccgcgacaucgggagcgagacggaguucgcggacgacgagcacuccaucuucggcgacaacgagagccggcgcgggucccuguucgugccccaccggccccaggagcgccggagcuccaacaucagccaggccucccgcagcccgcccaugcugcccgucaacggcaagaugcacagcgccguggacugcaacggcguggucucccucguggacgggcggagcgcccugaugcugcccaacggccagcuccugccggaggggaccaccaaccagauccacaagaagcgccggugcuccagcuaccugcucuccgaggacaugcugaacgaccccaaccugcgccagcgcgccaugagccgggcguccauccucaccaacacgguggaggagcuggaggagagccgccagaagugcccgcccuggugguaccgguucgcccacaaguuccugaucuggaacugcucccccuacuggaucaaguucaagaagugcaucuacuucaucgucauggaccccuucguggaccucgccaucaccaucugcaucgugcugaacacccuguucauggccauggagcaccaccccaugaccgaggaguucaagaacguccucgccaucggcaaccugguguucacggggaucuucgcggccgagauggugcugaagcucaucgccauggaccccuacgaguacuuccaggucggcuggaacaucuucgacagccugaucgugacccugucccucguggagcuguuccuggccgacgucgagggccucagcgugcugcgcuccuuccggcugcuccgcguguucaagcuggccaagagcuggcccacccugaacaugcucaucaagaucaucgggaacuccgucggcgcgcuggggaaccugacccucgugcuggccaucaucguguucaucuucgccgucgugggcaugcagcuguucggcaagagcuacaaggagugcgugugcaagaucaacgacgacugcacccucccccgguggcacaugaacgacuucuuccacuccuuccugaucgucuuccgcgugcugugcggggaguggaucgagacgaugugggacugcauggagguggccggccaggcgaugugccucaucgucuacaugauggugauggugaucgggaaccuggucgugcugaaccucuuccuggcccugcuccugagcuccuucagcagcgacaaccugaccgccaucgaggaggaccccgacgccaacaaccuccagaucgccgugacccggaucaagaagggcaucaacuacgucaagcagacccugcgcgaguucauccugaaggcguucuccaagaagccgaagaucagccgggagauccgccaggccgaggaccucaacacgaagaaggagaacuacaucuccaaccacacccuggccgagaugagcaaggggcacaacuuccugaaggagaaggacaagaucuccggcuucggcagcuccguggacaagcaccucauggaggacagcgacgggcaguccuucauccacaaccccagccugaccgugaccguccccaucgcccccggcgaguccgaccuggagaacaugaacgccgaggagcucagcuccgacagcgacuccgaguacagcaaggugcggcugaaccgcuccagcuccagcgagugcagcacgguggacaacccgcugcccggggagggcgaggaggcggaggccgagcccaugaacuccgacgagcccgaggccugcuucaccgacgggugcguccggcgcuucagcugcugccaggugaacaucgaguccggcaagggcaagaucugguggaacauccggaagaccugcuacaagaucguggagcacagcugguucgaguccuucaucguccucaugauccugcugagcuccggggcccucgccuucgaggacaucuacaucgagcgcaagaagaccaucaagaucauccuggaguacgcggacaagaucuucacguacaucuucauccuggagaugcuccugaaguggaucgccuacggcuacaagaccuacuucaccaacgccuggugcuggcuggacuuccucaucguggacgugagccuggucacccugguggccaacacgcucggguacuccgaccugggcccgaucaagagccugcggacccuccgcgcgcugcggccccugcgcgcccucucccgcuucgaggggaugcggguggucgugaacgcccugaucggcgccauccccagcaucaugaacgugcugcucgucugccugaucuucuggcugaucuucuccaucaugggcgugaaccucuucgccgggaaguucuacgagugcaucaacaccaccgacggcagccgcuuccccgcgucccaggucccgaaccggagcgagugcuucgcccugaugaacgugucccagaacgugcgcuggaagaaccugaaggucaacuucgacaacguggggcugggcuaccucagccugcuccagguggccacguucaagggguggaccaucaucauguacgccgccgucgacuccgugaacguggacaagcagcccaaguacgaguacagccucuacauguacaucuacuucgucguguucaucaucuucggcagcuucuucacccugaaccuguucaucggcgugaucaucgacaacuucaaccagcagaagaagaagcucgggggccaggacaucuucaugaccgaggagcagaagaaguacuacaacgcgaugaagaagcugggguccaagaagccccagaagcccaucccgcggcccggcaacaagauccagggcugcaucuucgaccuggucacgaaccaggccuucgacaucagcaucauggugcucaucugccugaacauggugaccaugauggucgagaaggaggggcagucccagcacaugaccgaggugcuguacuggaucaacguggucuucaucauccucuucaccggcgagugcgugcugaagcugaucagccuccgccacuacuacuucacggugggguggaacaucuucgacuucgucguggugaucaucuccaucgucggcauguuccuggccgaccugaucgagaccuacuucgugagccccacccucuuccgggugauccgccuggcccggaucgggcgcauccugcggcucgucaagggcgccaagggcauccgcacccugcuguucgcgcucaugaugucccugccggcccuguucaacaucgggcuccugcuguuccucgugauguucaucuacgccaucuucggcaugagcaacuucgccuacgugaagaaggaggacgggaucaacgacauguucaacuucgagacguucggcaacuccaugaucugccuguuccagaucaccaccagcgccgggugggacggccugcucgcgcccauccugaacuccaagccgcccgacugcgacccgaagaagguccaccccggcagcuccguggagggggacugcggcaaccccagcguggggaucuucuacuucgucuccuacaucaucaucagcuuccuggugguggucaacauguacaucgccgugauccucgagaacuucuccguggccaccgaggagagcacggagccccuguccgaggacgacuucgagauguucuacgaggucugggagaaguucgacccggacgccacccaguucaucgaguucagcaagcugagcgacuucgcggccgcccucgacccgccccugcugaucgccaagcccaacaaggugcagcucaucgccauggaccugccgaugguguccggcgaccggauccacugccuggacauccucuucgcguucaccaagcgcguccugggggagagcggcgagauggacucccugcggagccagauggaggagcgcuucauguccgccaaccccagcaagguguccuacgagcccaucaccaccacgcucaagcggaagcaggaggacgugagcgccaccgucauccagcgcgccuaccggcgcuaccgccugcggcagaacgugaagaacaucuccagcaucuacaucaaggacggcgaccgcgacgacgaccugcucaacaagaaggacauggccuucgacaacgugaacgagaacuccagccccgagaagaccgacgcgaccuccagcacgaccuccccgcccagcuacgacuccgucaccaagcccgacaaggagaaguacgagcaggaccggaccgagaaggaggacaaggggaaggacagcaaggaguccaagaaguga

SEQ ID NO: 36121 - RNA, 588 nt, Artificial Sequence
  derived and/or modified sequence opt1 from SCNM1__Homo_sapiens__NP_001191785
augcugcgcgacggccgguucgccugcgccaucugcccccaccgcccggugcucgacacccuggcgaugcugaccgcccaccgggccgggaagaagcaccucagcucccugcagcuguucuacggcaagaagcagcccgggaaggagcgcaagcagaaccccaagcaccagaacgagcuccggcgcgaggagacgaaggccgaggcgccccugcugacccagacccggcucaucacccagagcgcccugcaccgcgccccgcacuacaacuccugcugccggcgcaaguaccggcccgaggcccccggccccagcgucucccugagcccgaugccgcccuccgaggugaagcuccagagcgggaagaucucccgcgagcccgagcccgccgcgggcccccaggccgaggagagcgccacgguguccgcccccgcccccaugagcccgacccggcgccgggcgcuggaccacuaccugacccuccgcuccagcggcuggauccccgacgggcggggccgcugggucaaggacgagaacguggaguucgacuccgacgaggaggagccgcccgaccugccccuggacuga

SEQ ID NO: 36122 - RNA, 2010 nt, Artificial Sequence
  derived and/or modified sequence opt1 from SCNN1A__Homo_sapiens__NP_001029
auggagggcaacaagcuggaggagcaggacuccagcccgccccaguccacccccgggcugaugaagggcaacaagcgcgaggagcaggggcugggccccgagcccgccgccccgcagcagcccaccgcggaggaggaggcccugaucgaguuccaccgguccuaccgcgagcuguucgaguucuucugcaacaacaccaccauccacggggccauccggcuggugugcagccagcacaaccgcaugaagaccgccuucugggccguccuguggcucugcaccuucggcaugauguacuggcaguucggccugcuguucggggaguacuucuccuaccccgugagccucaacaucaaccugaacuccgacaagcugguguuccccgcggucacgaucugcacccucaacccguaccgguaccccgagaucaaggaggagcuggaggagcuggaccgcaucaccgagcagacccucuucgaccuguacaaguacagcuccuucacgacccugguggccggcagccggucccgccgggaccuccgcgggacccugccccacccccugcagcggcuccgcgugccgcccccgccccacggcgcccggcgcgcccggagcgucgcguccagccugcgcgacaacaacccccagguggacuggaaggacuggaagaucggguuccagcucugcaaccagaacaagagcgacugcuucuaccagaccuacagcuccggcguggacgccguccgggagugguaccgcuuccacuacaucaacauccucagccggcugcccgagacgcugcccucccucgaggaggacacccugggcaacuucaucuucgccugccgcuucaaccaggugagcugcaaccaggccaacuacagccacuuccaccaccccauguacgggaacugcuacaccuucaacgacaagaacaacuccaaccuguggaugagcuccaugccgggcaucaacaacgggcucagccugaugcugcgggccgagcagaacgacuucaucccccuccuguccaccgugacgggcgcgcgcgucauggugcacggccaggacgagcccgccuucauggacgacgggggcuucaaccugcgccccgggguggagaccagcaucuccaugcggaaggagacccucgaccgccugggcggggacuacggcgacugcaccaagaacggcagcgacgucccgguggagaaccuguaccccuccaaguacacgcagcaggucugcauccacagcugcuuccaggaguccaugaucaaggagugcgggugcgccuacaucuucuacccccggccccagaacguggaguacugcgacuaccgcaagcacagcuccuggggcuacugcuacuacaagcuccagguggacuucagcuccgaccaccuggggugcuucaccaagugccggaagccgugcagcgugaccuccuaccagcugagcgccggcuacucccgcuggcccagcgucaccagccaggaguggguguuccagaugcucucccggcagaacaacuacacggugaacaacaagcgcaacggggucgccaaggugaacaucuucuucaaggagcugaacuacaagaccaacagcgagucccccagcgucaccauggugacccugcucuccaaccugggcagccaguggucccugugguucggcagcuccgugcucagcgucguggagauggcggagcugguguucgaccugcuggucaucauguuccucaugcugcugcggcgcuuccggucccgcuacuggagcccggggcggggcgggcgcggcgcccaggagguggccuccacgcucgccagcuccccgcccagccacuucugcccccaccccaugucccugagccugagccagcccgggcccgcccccuccccggcgcucaccgccccgccgcccgccuacgccacccugggcccccggcccagccccggcggguccgccggcgcgagcuccagcacgugcccccucgggggccccuga

SEQ ID NO: 36123 - RNA, 1923 nt, Artificial Sequence
  derived and/or modified sequence opt1 from SCNN1B__Homo_sapiens__NP_000327
augcacgugaagaaguaccugcucaagggccugcaccgccugcagaaggggcccggcuacaccuacaaggagcuccuggucugguacugcgacaacaccaacacgcacgggcccaagcggaucaucugcgagggccccaagaagaaggccaugugguuccugcucacccugcuguucgccgcccucgugugcuggcagugggggaucuucauccgcaccuaccugagcugggagguguccgucagccuguccgugggcuucaagaccauggacuuccccgccgugacgaucugcaacgccagccccuucaaguacuccaagaucaagcaccuccugaaggaccuggacgagcucauggaggccguccuggagcggauccuggccccggagcucagccacgcgaacgccacccgcaaccugaacuucuccaucuggaaccacacgccccuggugcucaucgacgagcggaacccccaccaccccauggugcuggaccuguucggcgacaaccacaacgggcucaccagcuccagcgccuccgagaagaucugcaacgcccacggcugcaagauggcgaugcgccugugcagccugaaccggacccagugcaccuuccgcaacuucaccuccgccacccaggcccucacggagugguacauccugcaggccaccaacaucuucgcccaggucccgcagcaggagcugguggagaugagcuaccccggggagcagaugauccucgcgugccuguucggcgccgagcccugcaacuaccggaacuucaccuccaucuucuacccccacuacgggaacugcuacaucuucaacuggggcaugaccgagaaggcccugccgagcgccaaccccggcacggaguucgggcucaagcugauccuggacaucggccaggaggacuacgugcccuuccucgccuccaccgcggggguccgccugaugcugcacgagcagcggagcuaccccuucauccgcgacgagggcaucuacgccauguccggcaccgagaccagcaucggggugcucguggacaagcugcagcggaugggcgagccguacagccccugcacggucaacggguccgaggugcccgugcagaacuucuacagcgacuacaacaccaccuacuccauccaggccugccugcgcagcugcuuccaggaccacaugauccggaacugcaacugcggccacuaccucuacccccugccgcgcggggagaaguacugcaacaaccgggacuuccccgacugggcccacugcuacuccgaccugcagaugagcgucgcccagcgcgagaccugcaucggcaugugcaaggaguccugcaacgacacgcaguacaagaugaccaucagcauggcggacuggcccuccgaggccagcgaggacuggaucuuccacgugcucucccaggagcgggaccagagcaccaacaucacccugucccgcaagggcaucgugaagcugaacaucuacuuccaggaguucaacuaccggacgaucgaggagagcgccgccaacaacaucgucuggcuccuguccaaccugggcggccaguucggguucuggaugggcgggagcgugcugugccucaucgaguucggcgagaucaucaucgacuucguguggaucaccaucaucaagcuggucgcccuggcgaagucccuccgccagcgccgggcccaggccagcuacgccgggcccccgcccaccguggcggagcuggucgaggcccacaccaacuucggguuccagcccgacacggcgccccgcuccccgaacaccggccccuaccccagcgagcaggcccugccgauccccgggaccccgccgcccaacuacgacagccuccggcugcagccccuggacgugaucgaguccgacagcgagggcgacgccaucuga

SEQ ID NO: 36124 - RNA, 2688 nt, Artificial Sequence
  derived and/or modified sequence opt1 from SCNN1D__Homo_sapiens__XP_011540201
augcccggcgccugccaccuccaggggagcgccgugaccgaggacaacaccgcgccgucccuccccgucgcccgcccgccccagcggcccaaggaggugagcucccagcccugcagcgugaacggcgccuggcccuccuuccugggggagagccgcggcauggggcccaagggcgcccgggacgccugcccgucccugcucagcuuccgccugacgugguccuggugcagcgaccaccggaccccgaccugccgcgagcugggcagcccccaccccaccccgugcacggggcccgcgcggggcuggccccgccgcgggggcgggcccugcggcuucaccuccgccggccacguccucugcggguacccgcugugccugcucuccggccccauccaggggugcggcaccggcgccgcccacgcgcagagcugccccgacguggugggggagaagccccaggccugcgccgucuccggcgggccggccgccgaccuguggggccugugcgacaucagcaagccgcccgcggccucccucgagcggcaccccagccccaucuggcacucccgcaagagcgcccagcgcgggcggcaccgcuggcagcugcugcccagccgggccggccgccaggaggcccggggcuccauccuccugcagagcugccagcugccgccccaguggcucuccaccgaggcguggacgggggaguggaagcagccccacggcggggcccugaccagccgcucccccggccccguggccccgcagcggcccugccaccugaagggguggcagcaccgccccacccagcacaacgccgccugcaagcagggccaggcggccgcccagacgcccccgcggcccggcccgcccagcgcgcccccgccgccgcccaaggaggggcaccaggagggccugguggagcugcccgccuccuuccgggagcugcucaccuucuucugcaccaacgccaccauccacggggccauccgccuggucugcagccggggcaaccgccugaagaccacguccugggggcuccugagccugggcgcccucguggcccugugcuggcagcugggccuccuguucgagcggcacuggcaccgccccgugcugauggcggucuccgugcacagcgagcggaagcuccugccccuggugacccucugcgacgggaacccccgccggcccucccccguccugcgccaccuggagcuccuggacgaguucgcccgggagaacaucgacagccuguacaacgugaaccucuccaagggccgcgccgcccugagcgccaccgugccccggcacgagccgcccuuccaccuggaccgcgagauccggcuccagcgccugucccacagcgggucccggguccgcgugggcuuccggcugugcaacagcaccggcggggacugcuucuaccgcggcuacacgagcgggguggcggccguccaggacugguaccacuuccacuacguggacauccuggcccuccugcccgccgccugggaggacucccacggcagccaggacgggcacuucgugcuguccugcagcuacgacggccucgacugccaggcgcggcaguuccgcaccuuccaccaccccaccuacggcuccugcuacaccgucgacgggguguggacggcccagcgccccggcaucacccacggggucggccuggugcugcggguggagcagcagccccaccucccccugcugagcacccucgccgggauccgcgucauggugcacggccggaaccacacccccuuccugggccaccacuccuucagcgugcgccccgggacggaggccaccaucuccauccgggaggacgagguccaccgccugggcagccccuacgggcacugcaccgccggcggggagggcguggagguggagcuccugcacaacaccuccuacacgcggcaggcgugccuggucagcugcuuccagcagcucaugguggagaccugcuccugcggcuacuaccugcacccccugccggccggggccgaguacugcagcuccgcccgccaccccgcguggggccacugcuucuaccggcucuaccaggaccuggagacccaccgccugcccugcaccagccggugcccccgcccgugccgggaguccgccuucaagcucagcacggggaccagccgcuggcccuccgccaagagcgccggcuggacccuggccacccugggggagcagggccucccccaccagucccaccggcagcgcagcucccuggcgaagaucaacaucguguaccaggagcugaacuaccggagcgucgaggaggcccccguguacuccgugccgcagcuccugagcgccaugggcucccugugcagccucugguucggggccuccguccugagccugcucgagcugcuggagcuccugcuggacgccuccgcgcucacccuggugcugggcgggcgccggcuccgccgggccugguucagcuggccccgcgccucccccgccagcggcgccuccagcaucaagcccgaggcgucccagaugccgccgcccgccggcgggacgagcgacgaccccgagcccagcggcccccaccucccccgcgugaugcugcccgggguccuggccggcguguccgccgaggagagcugggcggggccgcagccccuggagacccuggacaccuga

SEQ ID NO: 36125 - RNA, 1950 nt, Artificial Sequence
  derived and/or modified sequence opt1 from SCNN1G__Homo_sapiens__NP_001030
auggcccccggcgagaagaucaaggccaagaucaagaagaaccugcccgugaccgggccccaggcgcccaccaucaaggagcucaugcgcugguacugccugaacacgaacacccacggcugccggcgcaucgucgugagccgggggcgccugcggcgccuccuguggaucggcuucacccugaccgccguggcccucauccuguggcagugcgcccugcucgucuucuccuucuacacggugagcguguccaucaagguccacuuccggaagcuggacuuccccgccgugaccaucugcaacaucaacccguacaaguacagcaccgugcgccaccuccuggcggaccuggagcaggagacccgggaggcccugaagucccucuacggguuccccgagagccgcaagcggcgcgaggccgaguccuggaacagcgucuccgagggcaagcagccccgguucagccaccgcaucccccugcugaucuucgaccaggacgagaagggcaaggcccgggacuucuucacggggcgcaagcggaaggugggcggguccaucauccacaaggcgagcaacgugaugcacaucgaguccaagcaggucgugggcuuccagcucugcagcaacgacaccuccgacugcgccaccuacaccuucagcuccgggaucaacgccauccaggagugguacaagcugcacuacaugaacaucauggcccaggugccgcuggagaagaagaucaacaugagcuacuccgccgaggagcuccuggucacgugcuucuucgacggcgugagcugcgacgcgcgcaacuucacccuguuccaccaccccaugcacggcaacugcuacaccuucaacaaccgggagaacgagaccauccucagcacguccaugggcgggagcgaguacgggcuccaggugauccuguacaucaacgaggaggaguacaaccccuuccuggucuccagcaccggcgccaaggugaucauccaccgccaggacgaguaccccuucguggaggacgucggcaccgagaucgagaccgccauggugacguccaucgggaugcaccugaccgagagcuucaagcuguccgagccguacagccagugcaccgaggacggcuccgacgugcccauccggaacaucuacaacgccgccuacagccuccagaucugccugcacuccugcuuccagaccaagauggucgagaagugcgggugcgcgcaguacagccagccccugcccccggccgccaacuacugcaacuaccagcagcaccccaacuggauguacugcuacuaccagcuccaccgcgccuucgugcaggaggagcugggcugccaguccgucugcaaggaggccugcagcuucaaggaguggacgcugaccaccucccucgcgcaguggcccagcgugguguccgagaaguggcugcugcccguccucaccugggaccaggggcgccaggugaacaagaagcugaacaagacggaccuggccaagcuccugaucuucuacaaggaccugaaccagcggagcaucauggaguccccggccaacagcaucgagaugcuccugagcaacuucggcggccagcuggggcucuggauguccugcagcguggucugcgugaucgagaucaucgagguguucuucaucgacuucuucuccaucaucgcccgccggcaguggcagaaggccaaggaguggugggcguggaagcaggccccgcccugccccgaggcgccccgcagcccccagggccaggacaaccccgcccuggacaucgacgacgaccugcccaccuucaacuccgcccugcaccucccgcccgcccuggggacccagguccccggcaccccgccgcccaaguacaacacgcugcggcucgagcgcgccuucagcaaccagcugaccgacacccagaugcuggacgagcucuga

SEQ ID NO: 36126 - RNA, 906 nt, Artificial Sequence
  derived and/or modified sequence opt1 from SCO1__Homo_sapiens__NP_004580
auggccaugcuggugcucguccccggccgcgugaugcggccgcucgggggccagcuguggcgcuuccugccccgggggcuggaguucuggggccccgccgaggggaccgcgcgcgugcugcuccggcaguucugcgcccgccaggccgaggccuggcgggccagcggccgccccggcuacugccuggggacccggccgcuguccacggcgcgcccgcccccgcccuggagccagaagggccccggggacuccacccggcccagcaagcccggccccgucuccuggaagucccucgccaucaccuucgccaucgggggcgcccugcuggcgggcaugaagcacgugaagaaggagaaggccgagaagcucgagaaggagcgccagcggcacaucgggaagccccugcugggcgggcccuucagccucaccacgcacaccggcgagcgcaagaccgacaaggacuaccugggccaguggcugcucaucuacuucggguucacccacugccccgacgugugcccggaggagcuggagaagaugauccaggucguggacgagaucgacagcaucacgacccugcccgaccucacgccccuguucaucuccaucgaccccgagcgggacaccaaggaggccaucgccaacuacgugaaggaguucagcccgaagcuggucggccucaccgggacccgcgaggagguggaccagguggcccgggcguaccgcgucuacuacucccccggccccaaggacgaggacgaggacuacaucguggaccacaccaucaucauguaccugaucgggcccgacggcgaguuccuggacuacuucggccagaacaagcggaagggggagaucgccgccagcaucgccacccacaugcgcccguaccggaagaaguccuga

SEQ ID NO: 36127 - RNA, 801 nt, Artificial Sequence
  derived and/or modified sequence opt1 from SCO2__Homo_sapiens__NP_001162582
augcugcuccugacccgcagccccaccgccuggcaccggcugucccagcucaagccgcgcgugcugcccggcacgcucgggggccaggcccugcaccuccggagcuggcugcugucccgccaggggcccgcggagaccggcgggcagggccagccccagggcccggggcugcggacccgccugcucaucaccggccuguucggggccggccucgggggcgccuggcuggcccugcgggccgagaaggagcgccugcagcagcagaagcggacggaggcgcuccgccaggccgccgucggccagggggacuuccaccuccuggaccaccggggccgcgcccggugcaaggcggacuuccgcgggcagugggugcugauguacuucggcuucacccacugccccgacaucugccccgacgagcuggagaagcuggugcaggucgugcggcagcucgaggccgagcccggccugccgcccgugcagcccgucuucaucaccguggaccccgagcgcgacgacguggaggccauggcccgguacguccaggacuuccacccgcgccugcucgggcugaccggcagcacgaagcaggucgcccaggcgucccacagcuaccggguguacuacaacgccgggcccaaggacgaggaccaggacuacaucguggaccacuccaucgccaucuaccugcucaaccccgacggccuguucaccgacuacuacgggcgcagccgguccgccgagcagaucagcgacuccgugcgccgccacauggccgcguuccggagcgugcuguccuga

SEQ ID NO: 36128 - RNA, 471 nt, Artificial Sequence
  derived and/or modified sequence opt1 from SCP2D1__Homo_sapiens__NP_848578
auguggaagcgcagcgaccaccagcccaagaucaaggccgaggacggcccgcugguggggcaguucgagguccucggcuccgugcccgagcccgccaugccccacccgcuggagcugagcgaguucgaguccuuccccguguuccaggacauccggcuccacauccgcgaggucggggcgcagcuggugaagaaggugaacgccgucuuccagcuggacaucaccaagaacggcaagaccauccuccgguggacgaucgaccugaagaacgggagcggcgacauguaccccggccccgcccgccugccggccgacaccguguucaccauccccgaguccguguucauggagcucguccuggggaagaugaacccccagaaggccuuccuggcgggcaaguucaaggugagcgggaaggugcuccuguccuggaagcuggagcgggucuucaaggacugggccaaguucuga

SEQ ID NO: 36129 - RNA, 1359 nt, Artificial Sequence
  derived and/or modified sequence opt1 from SCPEP1__Homo_sapiens__NP_067639
auggagcuggcccuccgccggagccccgugccgcgcuggcugcugcuccugccccugcuccugggccugaacgccggggcggucaucgacuggcccaccgaggagggcaaggaggugugggacuacgugaccguccggaaggacgccuacauguucugguggcucuacuacgccacgaacuccugcaagaacuucagcgagcugccccuggugauguggcuccagggcgggcccgggggcuccagcaccggcuucgggaacuucgaggagaucggcccgcuggacuccgaccugaagccccgcaagaccaccuggcuccaggccgccagccugcuguucguggacaaccccgucgggacgggcuucuccuacgugaacgggagcggcgcguacgccaaggaccucgccaugguggccuccgacaugaugguccugcugaagaccuucuucagcugccacaaggaguuccagaccgugccguucuacaucuucuccgagagcuacggcgggaagauggcggccggcaucgggcucgagcuguacaaggccauccagcggggcaccaucaagugcaacuucgccggcguggcccugggggacuccuggaucagccccgucgacuccgugcucagcuggggccccuaccuguacuccaugagccugcucgaggacaaggggcuggcggagguguccaaggucgccgagcagguccugaacgccgugaacaagggccucuaccgcgaggccacggagcugugggggaaggccgagaugaucaucgagcagaacaccgacggcgugaacuucuacaacauccugaccaagagcacccccacgagcaccauggaguccagccucgaguucacccagucccaccuggugugccugugccagcggcacgugcgccaccuccagcgggacgcgcugagccagcugaugaacggcccgauccgcaagaagcucaagaucauccccgaggaccaguccuggggcgggcaggccaccaacgucuucgugaacauggaggaggacuucaugaagcccgugaucagcaucgucgacgagcugcuggaggccgggaucaacgugacggucuacaacggccagcucgaccugaucguggacaccauggggcaggaggccugggugcggaagcugaaguggcccgagcucccgaaguucucccagcugaaguggaaggcccuguacagcgaccccaagucccucgagaccagcgcguucgucaaguccuacaagaaccuggccuucuacuggauccugaaggccggccacauggugcccagcgaccagggcgacauggcccugaagaugaugcgccucgugacccagcaggaguga

SEQ ID NO: 36130 - RNA, 4893 nt, Artificial Sequence
  derived and/or modified sequence opt1 from SCRIB__Homo_sapiens__NP_056171
augcugaagugcaucccccucuggcgcugcaaccggcacguggagagcgucgacaagcgccacugcucccugcaggccgugccggaggagaucuaccgguacagccgcucccuggaggagcuccugcuggacgccaaccagcuccgggagcugcccaagcccuucuuccgccugcucaaccugcggaagcugggccucagcgacaacgagauccagcgccugcccccggagguggcgaacuucaugcagcuggucgagcucgacgugucccggaacgacauccccgagauccccgagagcaucaaguucugcaaggcccuggagaucgccgacuucuccgggaacccccugagccgccucccggacggcuucacccagcugcggucccuggcccaccucgcccugaacgacgugagccugcaggcgcuccccggggacgucggcaaccuggccaaccuggugacccucgagcugcgcgagaaccugcucaagucccugcccgccagccuguccuuccucgugaagcuggagcagcuggaccucgggggcaacgaccuggagguccugcccgacacgcucggcgcccugccgaaccugcgggagcucuggcuggaccgcaaccagcugagcgcgcucccccccgagcuggggaaccugcggcgccucgugugccuggacguguccgagaaccggcuggaggagcugcccgccgagcucggcgggcugguccugcucaccgaccugcugcucagccagaaccugcugcgccggcucccggacggcaucgggcagcugaagcagcuguccauccucaagguggaccagaaccgccugugcgaggugaccgaggccaucggcgacugcgagaaccugagcgagcucauccugaccgagaaccugcucauggcccugccccggucccugggcaagcucacgaagcugaccaaccugaacgucgaccgcaaccaccucgaggcccugccccccgagaucgggggcugcguggcgcugagcgugcucagccugcgcgacaaccggcuggccguccucccgcccgagcuggcccacaccaccgagcugcacgugcucgacguggccgggaaccgccugcagucccugcccuucgcccucacgcaccugaaccugaaggcgcucuggcuggccgagaaccaggcccagcccaugcugcgguuccagaccgaggacgacgcccgcaccggcgagaagguccucaccugcuaccugcugccgcagcagcccccccccagccucgaggacgccggccagcaggggucccugagcgagacgugguccgacgcgccgcccagccggguguccgugauccaguuccuggaggcccccaucggcgacgaggacgccgaggaggccgccgcggagaagcgcgggcuccagcggcgcgccaccccgcaccccagcgagcugaaggucaugaagcgguccaucgagggccgccggagcgaggccugccccugccagcccgacuccgggagcccgcugcccgccgaggaggagaagcgccucuccgcggagagcggccuguccgaggacagccggcccuccgccagcaccguguccgaggccgagcccgagggcccgagcgccgaggcccaggggggcagccagcaggaggcgaccacggccgggggcgaggaggacgccgaggaggacuaccaggagcccaccguccacuucgccgaggacgcccugcuccccggggacgaccgcgagaucgaggagggccagcccgaggcgccguggacccugcccggcgggcggcagcgccugauccggaaggacaccccccacuacaagaagcacuucaagaucuccaagcucccccagccggaggccgugguggcccugcugcagggcaugcagcccgacggggagggccccgucgcccccgggggcuggcacaacggcccgcacgcccccugggcgccccgcgcccagaaggaggaggaggaggaggaggaggggagcccccaggaggaggaggaggaggaggaggaggagaaccgggccgaggaggaggaggccuccacggaggaggaggacaaggagggcgcgguggugagcgccccguccgucaagggggugagcuucgaccaggccaacaaccuccugaucgagcccgcccgcaucgaggaggaggagcugacccucaccauccugcgccagaccggcggccuggggaucuccaucgccggcgggaagggcagcacgcccuacaagggggacgacgagggcaucuucaucucccgggugagcgaggagggcccggcggcccgcgccgggguccgggugggcgacaagcuccuggaggugaacggggucgcccugcagggcgccgagcaccacgaggcgguggaggcccuccgcggggccggcaccgccgugcagaugcgggucuggcgcgagcggaugguggagcccgagaacgccgugaccaucaccccccugcgccccgaggacgacuacuccccgcgggagcgccggggcgggggccugcgccucccccugcugccccccgagagcccggggccccuccggcagcgccacgucgcgugccuggcccgguccgagcgcggccugggguucagcaucgccggcggcaagggguccacgcccuaccgggccggcgacgcggggaucuucgugagccgcaucgccgagggcggggccgcccaccgggccggcacccuccaggugggcgaccgcguccuguccaucaacgggguggacgugaccgaggcgcggcacgaccacgccgucagccugcucaccgccgccagccccacgaucgcccugcugcucgagcgcgaggcgggcgggccgcugccccccuccccccugccgcacagcuccccccccaccgccgccguggccaccaccagcaucacgaccgccacccccggcgugccgggccuccccucccuggcgcccagccugcucgccgccgcccuggaggggcccuacccggucgaggagauccgccugccccgggccggcgggccccucggccuguccaucguggggggcagcgaccacuccagccaccccuucggcgugcaggagccgggggucuucaucuccaaggugcugccccgcggccuggcggcccggagcgggcuccgcgugggcgaccggauccuggccgucaacgggcaggacgugcgcgacgccacccaccaggaggcgguguccgcccugcuccggcccugccuggagcugagccuccugguccgccgggacccggccccccccggccugcgcgagcucugcauccagaaggcccccggcgagcggcuggggaucuccauccgcggcggggcccggggccacgcggggaacccgcgcgaccccaccgacgagggcaucuucaucagcaaggugucccccacgggcgccgccgggcgggacggccgccugcggguggggcuccgccugcuggaggucaaccagcagagccuccugggccugacccacggcgaggccgugcagcuccugcgguccgugggggacacccugaccguccucgugugcgacggcuucgaggccagcacggacgcggcccuggaggugagccccggggucaucgccaacccguucgccgccggcaucgggcaccgcaacucccuggagagcaucuccagcaucgaccgcgagcucucccccgagggccccggcaaggagaaggagcugcccgggcagacccugcacuggggcccggaggcgaccgaggccgccgggcggggccuccagccccugaagcuggacuaccgcgcccucgcggccgugcccagcgccggguccgugcagcggguccccagcggcgccgccggcgggaagauggcggaguccccgugcagccccuccggccagcagccccccagcccgcccucccccgacgagcugcccgccaacgugaagcaggccuaccgcgccuucgccgcggugccgaccagccacccccccgaggacgcccccgcccagccgcccacgcccgggccggccgccucccccgagcagcugagcuuccgggagcgccagaaguacuucgagcucgagguccgggugccccaggcggagggccccccgaagcgcgucucccuggugggggccgacgaccugcggaagaugcaggaggaggaggcccgcaagcuccagcagaagcgggcccagaugcugcgcgaggcggccgaggccggcgccgaggcccggcuggcgcucgacggcgagacccugggggaggaggagcaggaggacgagcagccccccugggccagccccuccccgaccagccgccagagccccgccuccccccccccgcugggcgggggcgcccccgugcggaccgccaaggcggagcgccggcaccaggagcgccuccggguccagagccccgagcccccggcccccgagcgcgcccugucccccgccgagcugcgggcccucgaggcggagaagcgcgcccuguggcgcgccgcccggaugaagagccuggagcaggacgcccuccgcgcgcagauggugcugucccggagccaggaggggcgcggcacgcggggcccccuggagcgccucgccgaggccccgucccccgcccccacccccagcccgacccccguggaggaccuggggccccagaccuccacgagcccgggccggcugucccccgacuucgcggaggagcuccgcagccuggagcccucccccagcccggggccccaggaggaggacggcgaggucgcccuggugcuccugggccggcccucccccggggccgugggcccggaggacgucgcccugugcagcucccgccggcccgugcgccccgggcggcgcggccucgggcccgugccgagcuga

SEQ ID NO: 36131 - RNA, 1305 nt, Artificial Sequence
  derived and/or modified sequence opt1 from SCRN1__Homo_sapiens__NP_001138986
auggugcaggacggcaccuucaagacccgcgacagcacguggaccugcgaguccacccggauggccgccgcgcccccgagcuacugcuucgucgccuucccgccccgcgccaaggacgggcuggugguguucggcaagaacuccgcccggccccgcgacgagguccaggaggugguguacuucagcgccgcggaccacgagcccgaguccaaggucgagugcaccuacaucagcaucgaccaggugccccggacguacgccaucaugaucucccgccccgccuggcucuggggcgccgagaugggggcgaacgagcacggggugugcaucgccaacgaggccaucaacacccgggagcccgccgccgagaucgaggcgcugcugggcauggaccucguccgccugggccuggagcgcggggagaccgccaaggaggcccucgacgugaucgugagccugcuggaggagcacggccagggcgggaacuacuucgaggacgccaacuccugccacagcuuccaguccgccuaccucaucgucgaccgggacgaggcgugggugcuggagaccaucgggaaguacugggccgccgagaaggugacggagggcguccggugcaucugcagccagcugucccucaccaccaagauggacgccgagcacccggagcugcgcagcuacgcccagucccagggcugguggaccggggagggcgaguucaacuucagcgagguguucucccccguggaggaccaccuggacugcggggcgggcaaggacagccucgagaagcaggaggaguccaucacgguccagaccaugaugaacacccugcgggacaaggccagcggcgugugcaucgacagcgaguucuuccugaccacggccuccggggugagcguccucccccagaaccgcuccagccccugcauccacuacuucaccggcaccccggaccccucccggagcaucuucaagcccuucaucuucguggacgacgugaagcugguccccaagacccaguccccgugcuucggggacgacgaccccgccaagaaggagccccgcuuccaggagaagcccgaccggcgccacgagcuguacaaggcccacgagugggcgcgggccaucaucgagagcgaccaggagcagggccgcaagcuccgguccacgaugcuggagcuggagaagcaggggcucgaggccauggaggagauccugaccagcuccgagccgcuggaccccgccgaggugggcgaccucuucuacgacugcgucgacaccgagaucaaguucuucaaguga

SEQ ID NO: 36132 - RNA, 366 nt, Artificial Sequence
  derived and/or modified sequence opt1 from SCT__Homo_sapiens__XP_011518583
auggcgccccgcccgcugcuccugcugcuccugcugcucggcgggagcgccgcccggcccgccccgccccgcgcccggcgccacuccgacggcaccuucaccagcgagcugucccggcugcgcgagggggcccggcuccagcgccugcugcagggccucguggggaagcggagcgagcaggacgccgagaacuccauggcguggacgcgccugagcgccggccugcucugccccuccggcagcaacaugcccauccugcaggccuggaugccccuggacgggaccuggucccccuggcucccgcccggccccauggucagcgagcccgccggggcggccgccgagggcacccugcggccgcgcuga

SEQ ID NO: 36133 - RNA, 1323 nt, Artificial Sequence
  derived and/or modified sequence opt1 from SCTR__Homo_sapiens__NP_002971
augcgcccccaccugagcccgccccuccagcagcugcugcuccccgugcugcuggccugcgccgcgcacuccaccggcgcccucccccggcugugcgacguccuccaggugcucugggaggagcaggaccagugccugcaggagcugagccgcgagcagaccggggaccucggcacggagcagccggugcccgggugcgagggcaugugggacaacaucuccugcuggcccagcuccguccccgggcggaugguggagguggagugcccgcgcuuccugcggaugcugaccagccgcaacggcucccucuuccggaacugcacccaggacggcuggagcgagaccuucccccgccccaaccuggccugcggggucaacgugaacgacuccagcaacgagaagcggcacuccuaccugcucaagcugaaggugauguacacggucggcuacagcuccagccuggugaugcuccugguggcccuggggauccucugcgccuuccgccggcugcacugcacccgcaacuacauccacaugcaccuguucgucuccuucauccuccgggcgcugagcaacuucaucaaggacgccgugcuguucuccagcgacgacgugaccuacugcgacgcccaccgcgccggcugcaagcucgucauggugcuguuccaguacugcaucauggcgaacuacuccuggcugcucguggaggggcuguaccugcacacccuccuggccaucagcuucuucagcgagcggaaguaccugcagggcuucgucgccuucggcugggggucccccgccaucuucguggcccucugggcgaucgcccgccacuuccuggaggacgugggcugcugggacaucaacgccaacgccagcaucugguggaucauccgggggccggucauccuguccauccucaucaacuucauccuguucaucaacauccugcgcauccucaugcggaagcugcgcacgcaggagacccggggcaacgaggugagccacuacaagcgccuggcccgcuccacccuccugcugaucccccuguucggcauccacuacaucguguucgcguucagccccgaggacgccauggagauccagcuguucuucgagcuggcccugggguccuuccagggccucgucguggccguccuguacugcuuccugaacggggaggugcagcucgaggugcagaagaaguggcagcaguggcaccuccgggaguucccccugcacccggucgccagcuucuccaacagcaccaaggcgucccaccuggagcagagccagggcacgugccgcaccuccaucaucuga

SEQ ID NO: 36134 - RNA, 2967 nt, Artificial Sequence
  derived and/or modified sequence opt1 from SCUBE1__Homo_sapiens__NP_766638
augggcgccgccgcggugcgcuggcaccugugcguccuccuggcccuggggacccggggccgccucgccgggggcagcgggcugcccggcuccguggacguggacgagugcagcgagggcaccgacgacugccacaucgacgccaucugccagaacacgccgaaguccuacaagugccugugcaagcccggguacaagggcgaggggaagcagugcgaggacaucgacgagugcgagaacgacuacuacaacggcgggugcguccacgagugcaucaacauccccggcaacuaccggugcaccugcuucgacggcuucaugcucgcccacgacgggcacaacugccuggacguggacgagugccaggacaacaacggcgggugccagcagaucugcgugaacgcgaugggcagcuacgagugccagugccacuccggcuucuuccugagcgacaaccagcacaccugcauccaccgcuccaacgaggggaugaacugcaugaacaaggaccacggcugcgcccacaucugccgggagacccccaaggggggcgucgccugcgacugccgcccgggguucgaccucgcccagaaccagaaggacugcacgcugaccugcaacuacggcaacggcgggugccagcacagcugcgaggacaccgacaccggccccacgugcgggugccaccagaaguacgcgcugcacuccgacggccggaccugcaucgagaccugcgccgugaacaacgggggcugcgaccgcaccugcaaggacacggccaccggcgugcggugcagcugccccgucggguucacccuccagcccgacggcaagaccugcaaggacaucaacgagugccuggugaacaacgggggcugcgaccacuucugccgcaacacggugggguccuucgagugcggcugccggaagggcuacaagcugcucaccgacgagcgcaccugccaggacaucgacgagugcagcuucgagcggaccugcgaccacaucugcaucaacuccccggggagcuuccagugccugugccaccgcggcuacauccuguacgggacgacccacugcggcgacgucgacgagugcuccaugagcaacggcuccugcgaccaggggugcgugaacaccaagggcagcuacgagugcgugugcccccccgggcggcgccuccacuggaacggcaaggacugcgucgagaccgggaagugccugucccgggccaagacgagcccccgcgcccagcugagcugcuccaaggcgggcggcguggagagcugcuuccucuccugcccggcccacacccuguucgugcccgacagcgagaacuccuacguccugagcugcggggugcccggcccccaggggaaggcccuccagaagcggaacggcaccuccagcgggcugggcccguccugcagcgacgcccccaccacgcccaucaagcagaaggcccgcuucaagauccgggacgcgaagugccaccugcgcccccacucccaggcccgcgccaaggagaccgcccggcagccgcuccuggaccacugccacgugaccuucgucacccugaagugcgacagcuccaagaagcgccggcgcggccggaagagccccuccaaggaggugagccacaucacggccgaguucgagaucgagaccaagauggaggaggcguccgacaccugcgaggccgacugccuccgcaagcgggccgagcagagccugcaggccgccaucaagacccugcgcaaguccaucgggcggcagcaguucuacgugcaggucagcggcacggaguacgagguggcgcagcgccccgccaaggcccucgaggggcagggcgccugcggggcgggccagguccugcaggacagcaagugcguggccugcggccccgggacccacuucggcggggagcugggccagugcguguccugcaugccggggaccuaccaggacauggagggccagcucagcugcacccccugccccuccagcgacggccuggggcugcccggcgcccggaacgucuccgagugcgggggccagugcagcccgggcuucuucuccgccgacggguucaagcccugccaggccugccccgugggcaccuaccagccggagcccgggcgcacgggcugcuuccccugcgggggcggccuccugaccaagcacgaggggaccaccagcuuccaggacugcgaggcgaaggugcacugcucccccggccaccacuacaacacgaccacccaccggugcauccgcugcccggucgggaccuaccagcccgaguucggccagaaccacugcaucacgugccccgggaacaccagcaccgacuucgacggcuccaccaacgugacgcacugcaagaaccagcacugcggcggggagcugggcgacuacaccggguacaucgagagccccaacuacccgggcgacuaccccgccaacgccgagugcguguggcacaucgccccccccccgaagcggcgcauccucaucgucgugcccgagaucuuccugcccaucgaggacgagugcggggacgugcuggucaugcggaaguccgccagccccaccuccaucaccacguacgagaccugccagaccuacgagcgcccgaucgcguucaccagccggucccgcaagcucuggauccaguucaagagcaacgagggcaacagcggcaagggguuccaggugcccuacgugacguacgacgaggacuaccagcagcugaucgaggacaucguccgcgacggccggcuguacgccuccgagaaccaccaggagauccucaaggacaagaagcugaucaaggcccuguucgacgugcuggcccacccccagaacuacuucaaguacaccgcccaggagagcaaggagauguucccccgcuccuucaucaagcuccugcggagcaaggugucccgcuuccugcggccguacaaguga

SEQ ID NO: 36135 - RNA, 2424 nt, Artificial Sequence
  derived and/or modified sequence opt1 from SCUBE2__Homo_sapiens__NP_001164161
augggcguggccgggcgcaaccggcccggcgccgcgugggccguccugcuccugcugcuccugcugccgccccuccugcugcucgccggggccgugccgcccggccgcgggcgggccgcgggcccccaggaggacguggacgagugcgcccagggccuggacgacugccacgccgacgcccugugccagaacacccccaccagcuacaagugcuccugcaagcccggguaccagggcgaggggcgccagugcgaggacaucgacgagugcggcaacgagcucaacgggggcugcguccacgacugccugaacauccccggcaacuaccggugcacgugcuucgacggguucaugcuggcgcacgacggccacaacugccucgacguggacgagugccuggagaacaacgggggcugccagcacacgugcgugaacgucaugggcagcuacgagugcugcugcaaggagggguucuuccuguccgacaaccagcacacgugcauccaccgcagcgaggagggccucuccugcaugaacaaggaccacgggugcagccacaucugcaaggaggccccgcggggcuccguggccugcgagugccgccccggguucgagcuggccaagaaccagcgggacugcauccugaccugcaaccacggcaacggcgggugccagcacagcugcgacgacaccgccgacggccccgagugcuccugccacccccaguacaagaugcacaccgacgggcgcagcugccucgagcgggaggacaccgugcuggaggucaccgaguccaacaccaccagcgugguggacggcgacaagcgcgucaagcggcgccugcucauggagaccugcgcggugaacaacgggggcugcgaccggaccugcaaggacacguccaccggcgugcacugcagcugcccggucggguucacccugcagcuggacggcaagaccugcaaggacaucgacgagugccagacgcgcaacgggggcugcgaccacuucugcaagaacaucgugggguccuucgacugcggcugcaagaagggcuucaagcuccugaccgacgagaaguccugccaggacguggacgagugcagccuggaccggaccugcgaccacagcugcaucaaccaccccgggaccuucgccugcgccugcaaccgcggcuacacgcucuacggguucacccacugcggcgacaccaacgagugcuccaucaacaacggcgggugccagcaggucugcgugaacaccgugggcagcuacgagugccagugccaccccggguacaagcugcacuggaacaagaaggacugcgucgccagcugcgaccuguccugcaucgugaagcggacggagaagcgccuccggaaggccauccgcacccugcgcaaggcggugcaccgggagcaguuccaccuccagcugagcggcaugaaccuggacgucgccaagaagcccccgcgcaccuccgagcggcaggccgagagcugcggggugggccagggccacgccgagaaccagugcgucuccugccgcgccgggaccuacuacgacggcgcgcgggagcgcugcauccugugccccaacgggacguuccagaacgaggagggccagaugaccugcgagcccugcccccggccggggaacagcggcgcccucaagacccccgaggccuggaacauguccgagugcggcgggcugugccagcccggcgaguacagcgccgacggguucgcccccugccagcugugcgcgcucggcaccuuccagccggaggccgggcgcacguccugcuuccccugcggcggcgggcuggccaccaagcaccagggcgccaccagcuuccaggacugcgagacccgggugcagugcucccccgggcacuucuacaacacgaccacccaccgcugcauccggugccccgugggcaccuaccagccggaguucgggaagaacaacugcgucagcugccccggcaacaccacgaccgacuucgacggcuccaccaacaucacccagugcaagacgagcuccaacagcgugaccaccuacgagaccugccagacguacgagcgccccaucgcguucaccucccggagcaagaagcuguggauccaguucaaguccaacgaggggaacagcgcccgcggcuuccaggugccguacgucaccuacgacgaggacuaccaggagcucaucgaggacaucgugcgggacgggcgccuguacgccagcgagaaccaccaggagauccugaaggacaagaagcucaucaaggcccuguucgacgugcuggcccacccccagaacuacuucaaguacaccgcgcaggagucccgggagauguucccccgcagcuucauccggcugcuccgcuccaaggucagccgcuuccugcggcccuacaaguga

SEQ ID NO: 36136 - RNA, 2982 nt, Artificial Sequence
  derived and/or modified sequence opt1 from SCUBE3__Homo_sapiens__NP_689966
augggcagcgggcgcgugcccggccugugccuccugguccugcucgugcacgcccgggccgcgcaguacuccaaggccgcccaggacguggacgagugcgucgaggggaccgacaacugccacaucgacgccaucugccagaacaccccgcgcagcuacaagugcaucugcaaguccggcuacacgggggacggcaagcacugcaaggacguggacgagugcgagcgggaggacaacgccggcugcgugcacgacugcgucaacauccccgggaacuaccgcugcacgugcuacgacggcuuccaccuggcgcacgacgggcacaacugccuggacguggacgagugcgccgagggcaacgggggcugccagcagagcugcgugaacaugaugggcuccuacgagugccacugccgggagggguucuuccucagcgacaaccagcacacgugcauccagcgccccgaggagggcaugaacugcaugaacaagaaccacgggugcgcccacaucugccgggagacccccaagggcggcaucgccugcgagugccgcccgggguucgagcugaccaagaaccagcgggacugcaagcugaccugcaacuacggcaacgggggcugccagcacacgugcgacgacaccgagcaggggccccgcugcggcugccacaucaaguucguccuccacaccgacggcaagaccugcaucgagaccugcgcggugaacaacgggggcugcgacuccaagugccacgacgccgccaccggggugcacugcacgugccccgucggcuucaugcugcagcccgaccggaagaccugcaaggacaucgacgagugccgccugaacaacgggggcugcgaccacaucugccggaacaccgugggcagcuucgagugcuccugcaagaagggguacaagcuccugaucaacgagcgcaacugccaggacaucgacgagugcagcuucgaccggaccugcgaccacaucugcgugaacaccccgggcuccuuccagugccugugccaccgcggguaccuccuguacggcaucacccacugcggggacgucgacgagugcagcaucaaccggggcggcugccgcuucgggugcaucaacacccccggcuccuaccagugcacgugccccgccgggcagggccggcugcacuggaacggcaaggacugcaccgagccccucaagugccaggggagcccgggcgccuccaaggcgaugcugagcugcaaccgcuccgggaagaaggacacgugcgcccugaccugccccagccgggcccgcuuccuccccgaguccgagaacggcuucaccgugagcugcgggacccccagcccgcgcgccgcccccgcgcgggccggccacaacggcaacuccaccaacagcaaccacugccacgaggccgccgugcuguccaucaagcagcgcgccagcuucaagaucaaggacgcgaagugccggcugcaccuccgcaacaaggggaagaccgaggaggccggccggaucaccgggcccggcggggcccccugcuccgagugccaggucacguucauccaccugaagugcgacagcucccgcaagggcaagggccggcgcgcccggaccccgcccgggaaggaggugacccgccugacccucgagcuggaggccgaggugcgggcggaggagacgaccgccagcugcggccugcccugccuccgccagcggauggagcgccggcugaaggggucccugaagaugcuccgcaagagcaucaaccaggaccgguuccugcugcgccucgccggccuggacuacgagcuggcccacaagcccgggcucgucgcgggcgagcgggccgagccgauggaguccugccgccccggccagcaccgcgccgggaccaagugcgugagcugcccccagggcaccuacuaccacgggcagacggagcagugcgugcccugcccggccggcaccuuccaggagcgggaggggcagcuguccugcgaccugugccccggcagcgacgcccacggcccccucggggcgaccaacgucacgaccugcgccggccagugcccgcccgggcagcacuccguggacggcuucaagcccugccagcccugcccgcgcggcaccuaccagcccgaggccgggcggacccugugcuuccccugcggcgggggccugaccaccaagcacgagggggccaucagcuuccaggacugcgacacgaagguccagugcucccccggccacuacuacaacaccagcauccaccgcugcauccggugcgccaugggcuccuaccagccggacuuccgccagaacuucugcagccggugccccgggaacaccagcaccgacuucgacggcuccacgagcguggcgcagugcaagaaccgccagugcgggggcgagcucggggaguucaccggcuacaucgagucccccaacuaccccggcaacuacccggccgggguggagugcaucuggaacaucaacccgccgcccaagcggaagauccugaucgucgugcccgagaucuuccugcccagcgaggacgagugcggcgacgugcucgucaugcgcaagaacuccagccccuccagcaucaccaccuacgagacgugccagaccuacgagcggcccaucgccuucaccgcccgcucccggaagcuguggaucaacuucaagaccagcgaggccaacuccgcgcgcggguuccagauccccuacgugacguacgacgaggacuacgagcagcugguggaggacaucguccgggacggccgccuguacgccagcgagaaccaccaggagauccucaaggacaagaagcugaucaaggccuucuucgaggugcuggcccacccccagaacuacuucaaguacaccgagaagcacaaggagaugcuccccaaguccuucaucaagcugcugcggagcaagguguccagcuuccuccgccccuacaaguga

SEQ ID NO: 36137 - RNA, 2376 nt, Artificial Sequence
  derived and/or modified sequence opt1 from SCYL1__Homo_sapiens__NP_001041683
augugguucuucgcccgcgaccccgugcgggacuucccguucgagcugauccccgagccgcccgagggcgggcuccccggccccugggcccugcaccgcgggcggaagaaggcgaccggcagccccgucuccaucuucguguacgacgugaagcccggggccgaggagcagacccaggucgccaaggccgccuucaagcgcuucaagacgcugcggcacccgaacauccucgcguacaucgacggccuggagaccgagaagugccugcacguggugaccgaggccgucacgccccucggcaucuaccugaaggcccgcguggaggccgggggccugaaggagcucgagaucagcugggggcugcaccagaucgugaaggcgcuguccuuccucgucaacgacugcagccugauccacaacaacgugugcauggccgccguguucgucgaccgggccggcgaguggaagcucgggggccuggacuacauguacuccgcccagggcaacgggggcgggccgccccgcaagggcauccccgagcuggagcaguacgacccgcccgagcuggcggacagcuccggccggguggugcgcgagaaguggagcgccgacauguggcggcucgggugccugaucugggaggucuucaacggcccccugccccgcgccgccgcccuccggaaccccgggaagauccccaagacccuggugccccacuacugcgagcuggugggcgcgaacccgaagguccgccccaaccccgcccgguuccuccagaacugccgcgcccccgggggcuucauguccaaccgguucguggagaccaaccuguuccuggaggagauccagaucaaggagccggccgagaagcagaaguucuuccaggagcucagcaagucccuggacgccuuccccgaggacuucugccgccacaaggugcugccccagcuccugaccgcguucgaguucggcaacgccggggccgucgugcugacgccccucuucaaggugggcaaguuccugagcgccgaggaguaccagcagaagaucaucccggucguggucaagauguucuccagcaccgaccgggccaugcgcauccggcugcuccagcagauggagcaguucauccaguaccuggacgagcccaccgugaacacccagaucuucccccacgugguccacggguuccuggacaccaacccggcgauccgcgagcagacggugaaguccaugcuccugcuggcccccaagcucaacgaggccaaccugaacguggagcugaugaagcacuucgcccgccuccaggcgaaggacgagcagggccccauccggugcaacaccaccgucugccuggggaagaucggcagcuaccuguccgccagcacccgccaccgggugcucacguccgccuucagccgcgccacccgggaccccuucgccccgagccgcguggcgggcguccugggguucgccgccacccacaaccuguacuccaugaacgacugcgcccagaagauccugcccgugcucugcggccugaccguggaccccgagaaguccguccgggaccaggccuucaaggcgauccgcagcuuccugagcaagcucgaguccgugagcgaggaccccacgcagcuggaggagguggagaaggacguccacgccgccuccagcccggggaugggcggggccgccgcguccugggccggcugggccgugaccggcgugagcucccugaccagcaagcucauccggucccaccccaccacggcccccaccgagaccaacaucccccagcgcccgacccccgaggggcacugggagacgcaggaggaggacaaggacaccgcggaggacagcuccaccgccgaccggugggacgacgaggacuggggcagccuggagcaggaggccgaguccguccuggcccagcaggacgacuggagcaccgggggccaggugucccgcgccagccaggugagcaacuccgaccacaagagcuccaagagccccgaguccgacuggagcuccugggaggcggagggcagcugggagcagggguggcaggagcccuccagccaggagccgccgcccgacggcacgcggcucgccuccgaguacaacuggggcgggcccgagagcuccgacaagggggaccccuucgccacccugagcgcccgccccuccacccagccccggcccgacagcuggggcgaggacaacugggagggccuggagaccgacucccgccaggucaaggccgagcucgcgcggaagaagcgcgaggagcggcgccgcgagauggaggccaagcgggccgagcgcaagguggccaaggggccgaugaagcugggcgcccggaagcuggacuga

SEQ ID NO: 36138 - RNA, 2067 nt, Artificial Sequence
  derived and/or modified sequence opt1 from SCYL3__Homo_sapiens__NP_065156
augggcagcgagaacuccgcccucaagagcuacacccugcgcgagcccccguucacccugcccuccgggcuggccguguaccccgcgguccuccaggacggcaaguucgccagcguguucguguacaagcgggagaacgaggacaaggucaacaaggccgccaagcaccugaagacgcugcgccaccccugccuccugcgguuccuguccugcaccguggaggccgacgggauccaccucgugaccgagcgcguccagccgcuggagguggcgcuggagacccucagcuccgccgaggugugcgccggcaucuacgacauccugcuggcccucaucuuccugcacgaccgggggcaccugacgcacaacaacgucugccucagcuccguguucgugagcgaggacggccacuggaagcugggcgggauggagaccgucugcaaggugucccaggcgacccccgaguuccugcgcagcauccaguccauccgggaccccgccagcaucccgcccgaggagaugucccccgaguucaccacgcuccccgagugccacggccacgcccgcgacgccuucagcuucgggacccugguggagucccugcucaccauccugaacgagcaggucagcgccgacgugcuguccagcuuccagcagacccuccacagcacgcugcugaaccccaucccgaagugccggcccgcgcucugcacccugcugucccacgacuucuuccgcaacgacuuccucgagguggucaacuuccucaagagccugacccugaaguccgaggaggagaagaccgaguucuucaaguuccugcuggaccgggugagcugccucuccgaggagcugaucgccagccgccuggugccccuccugcugaaccagcucgucuucgccgagcccguggccgugaaguccuuccugccguaccugcucggccccaagaaggaccacgcccagggggagacgcccugccugcugagccccgcgcuguuccagucccgggucaucccggugcuccugcagcuguucgagguccacgaggagcacgugcgcauggugcuccugagccacaucgaggccuacgucgagcacuucacccaggagcagcugaagaaggugauccucccccaggugcugcugggccuccgggacaccuccgacagcaucgucgccaucacccugcacucccuggccgugcucgugagccugcugggccccgaggucguggucgggggcgagcgcacgaagaucuucaagcggaccgcccccuccuucaccaagaacaccgaccucagccuggagggggacccguucucccagcccaucaaguuccccaucaacggccugagcgacgugaagaacacguccgaggacagcgagaacuuccccagcuccagcaagaaguccgaggaguggccggacuggagcgagcccgaggagcccgagaaccagaccgugaacauccagaucuggccgcgcgagcccugcgacgacgugaagucccagugcaccacccucgacgucgaggagagcuccugggacgacugcgagcccagcucccuggacacgaaggugaaccccggcgggggcaucaccgcgaccaagccggugaccagcggggagcagaagcccauccccgcccugcucucccugacggaggagagcaugcccuggaaguccagccugccgcagaagaucucccucguccagcggggcgacgacgccgaccagaucgagccgcccaaggugagcucccaggagcgcccccugaaggugcccagcgagcuggggcucggcgaggaguucaccauccaggucaagaagaagcccgugaaggaccccgagauggacugguucgccgacaugauccccgagaucaagccgagcgccgcguuccugauccugcccgagcuccggaccgagauggugcccaagaaggacgacgucucccccgugaugcaguucagcuccaaguucgccgccgccgagaucaccgagggcgaggcggaggggugggaggaggagggcgagcugaacugggaggacaacaacugguga

SEQ ID NO: 36139 - RNA, 933 nt, Artificial Sequence
  derived and/or modified sequence opt1 from SDC1__Homo_sapiens__NP_001006947
augcgccgggccgcccuguggcucuggcugugcgcgcuggcccucagccugcagcccgcccugccgcagaucguggccaccaaccucccgcccgaggaccaggacggcuccggggacgacagcgacaacuucuccggcagcggggccggcgcgcugcaggacaucacccugucccagcagacgcccagcaccuggaaggacacccagcuccugaccgccauccccacgucccccgagcccaccgggcuggaggccaccgccgcgagcaccuccacgcuccccgccggcgagggcccgaaggagggggaggccgucgugcugcccgagguggagcccggccugaccgcccgcgagcaggaggccacgccccggccgcgcgagaccacccagcuccccaccacccaccaggcgagcaccacgaccgccaccaccgcccaggagcccgccacgucccacccccaccgggacaugcagccggggcaccacgagaccagcacccccgccggccccucccaggcggaccugcacacgccccacaccgaggacgggggcccgagcgccaccgagcgcgccgccgaggacggcgccuccagccagcugcccgcggccgagggguccggcgagcaggacuucaccuucgagaccagcggggagaacacggccgucguggccguggagcccgaccggcgcaaccagucccccgucgaccagggcgccaccggcgcgagccaggggcuccuggaccggaaggaggugcugggcggggugaucgccggcgggcucgucggccugaucuucgccgugugccuggugggcuucaugcucuaccgcaugaagaagaaggacgaggggagcuacucccuggaggagccgaagcaggccaacggcggggcguaccagaagcccaccaagcaggaggaguucuacgccuga

SEQ ID NO: 36140 - RNA, 606 nt, Artificial Sequence
  derived and/or modified sequence opt1 from SDC2__Homo_sapiens__NP_002989
augcgccgggccuggauccugcucacccugggccugguggccugcgucagcgcggagucccgcgccgagcucaccagcgacaaggacauguaccuggacaacuccagcaucgaggaggccuccgggguguaccccaucgacgacgacgacuacgccagcgccuccggcagcggggcggacgaggacguggaguccccggagcugacgaccagccggccccuccccaagauccugcugaccuccgccgcccccaaggucgagaccacgacccucaacauccagaacaagaucccggcccagaccaagagccccgaggagaccgacaaggagaaggugcaccuguccgacagcgagcgcaagauggaccccgcggaggaggacacgaacguguacaccgagaagcacuccgacagccuguucaagcggaccgagguccucgccgccgugaucgccggcggggugaucggcuuccuguucgccaucuuccugauccuccugcuggucuaccgcaugcggaagaaggacgagggcuccuacgaccucggggagcgcaagcccagcuccgcggccuaccagaaggccccgaccaaggaguucuacgccuga

SEQ ID NO: 36141 - RNA, 1332 nt, Artificial Sequence
  derived and/or modified sequence opt1 from SDC3__Homo_sapiens__XP_011540764
augcccacccagaugcuguucccgcuccacggccuguuccuguacagcuccgugaacagcuacaccuccagcaagacgcagcaccgcugccuccugcugugggaguccaacaacgaccccagcuaccagccgcccuccaccgcccagcgguggcgcagcgagaacuucgagcggcccgucgaccucgagggguccggcgacgacgacagcuuccccgacgacgagcuggacgaccuguacuccgggagcggcuccggguacuucgagcaggagagcggcaucgagaccgccaugcgcuucucccccgacguggcgcucgccgugagcaccacgcccgccguccugccgaccaccaacauccagcccgugggcacccccuucgaggagcugcccuccgagcggccgacgcucgagcccgccaccagcccccugguggucaccgaggugcccgaggagccgucccagcgcgccaccacggugagcaccaccauggcgaccacggccgccaccagcaccggggaccccaccgucgccacggugcccgcgaccguggccaccgccacccccuccacgccggccgccccgcccuucaccgcgaccaccgccgucauccggacgaccggcgugcgccggcugcucccccugccccugaccaccguggccacggcccgcgccaccacccccgaggcgcccagcccgcccaccacggccgccguccucgacaccgaggcccccacgccccggcugguguccaccgccaccagccgcccgcgggcgcugccccgccccgccaccacccaggagcccgacaucccggagcgguccacccucccccuggggaccacggcccccggccccaccgagguggcccagaccccgacccccgagacguuccugaccaccauccgcgacgagcccgagguccccgugagcgggggcccguccggcgacuucgagcuccccgaggaggagaccacgcagcccgacaccgccaacgagguggucgcggucgggggcgccgccgccaaggcgagcuccccgcccgggacccugcccaagggcgcccggcccggccccgggcugcucgacaacgccaucgacagcggcuccagcgccgcccagcugccgcagaaguccauccuggagcgcaaggaggugcucguggcggugaucgucgggggcguggugggggcccuguucgccgccuuccuggucacccuccugaucuaccggaugaagaagaaggacgagggcagcuacacgcuggaggagcccaagcaggccuccgugaccuaccagaagcccgacaagcaggaggaguucuacgcguga

SEQ ID NO: 36142 - RNA, 597 nt, Artificial Sequence
  derived and/or modified sequence opt1 from SDC4__Homo_sapiens__NP_002990
auggcccccgcccgccuguucgcgcuccugcuguucuucgugggcggggucgccgagagcauccgggagaccgaggugaucgacccgcaggaccuccuggagggccgcuacuucuccggggcccugcccgacgacgaggacguggucggccccgggcaggagagcgacgacuucgagcucuccggcagcggcgaccuggacgaccuggaggacuccaugaucgggcccgagguggugcacccgcucgucccccuggacaaccacauccccgagcgggccggcagcgggucccaggugcccaccgagccgaagaagcuggaggagaacgaggugauccccaagcgcaucagccccgucgaggaguccgaggacgugagcaacaagguguccaugagcuccacgguccagggcagcaacaucuucgagcggaccgaggugcucgccgcgcugaucgucgggggcaucgugggcauccuguucgccguguuccucauccugcugcucauguaccgcaugaagaagaaggacgagggguccuacgaccugggcaagaagcccaucuacaagaaggccccgaccaacgaguucuacgccuga

SEQ ID NO: 36143 - RNA, 879 nt, Artificial Sequence
  derived and/or modified sequence opt1 from SDCBP2__Homo_sapiens__NP_001186713
augagcucccuguaccccagccucgaggaccugaagguggaccaggccauccaggcccagguccgcgcguccccgaagaugcccgcccugcccgugcaggccaccgccaucagcccgccgcccgugcucuaccccaaccuggccgagcuggagaacuacaugggccucucccugagcucccaggagguccaggagagccugcuccagauccccgagggggacuccaccgcggugagcggccccgggcccggccagaugguggcccccgucacgggguacucccugggcgugcggcgcgccgagaucaagcccggcgugcgggagauccaccugugcaaggacgagcgcgggaagaccggccuccggcugcgcaaggucgaccaggggcuguucgugcagcucgugcaggccaacaccccggcgagccuggucggccugcgguucggggaccagcuccugcagaucgacggccgcgacugcgccggcugguccagccacaaggcccaccagguggugaagaaggccuccggggacaagaucgucguggugguccgggaccgccccuuccagcggaccgugacgaugcacaaggacagcaugggccacgugggguucgucaucaagaagggcaagaucgugucccuggugaagggcagcuccgccgcgcgcaacgggcuccugaccaaccacuacgucugcgagguggacggccagaacgucaucgggcugaaggacaagaagaucauggagauccucgccaccgccggcaacguggugacccugacgaucauccccagcgucaucuacgagcacauggugaagaagcugcccccggugcuccugcaccacaccauggaccacagcauccccgacgccuga

SEQ ID NO: 36144 - RNA, 879 nt, Artificial Sequence
  derived and/or modified sequence opt1 from SDCBP__Homo_sapiens__NP_001007069
augagccuguaccccagccucgaggaccugaaggcccagaccgccuucagcgcgaacccggccaaccccgccauccuguccgaggccagcgcccccaucccccacgacggcaaccucuacccgcgccuguaccccgagcugucccaguacauggggcucagccugaacgaggaggagauccgggcgaacguggccgucguguccggcgcgccccugcaggggcagcucguggcccgccccagcuccaucaacuacauggucgccccggugaccggcaacgacguggggauccggcgcgccgagaucaagcagggcauccgggaggucauccugugcaaggaccaggacggcaagaucgggcugcgccucaagagcaucgacaacggcaucuucgugcagcuggugcaggccaacucccccgccagccuggucgggcuccgguucggcgaccaggugcugcagaucaacggggagaacugcgccggcugguccagcgacaaggcgcacaaggugcugaagcaggccuucggcgagaagaucacgaugaccauccgcgaccggcccuucgagcgcaccaucaccaugcacaaggacuccacggggcacgucggcuucaucuucaagaacgggaagaucaccagcaucgugaaggacuccagcgccgcccggaacggccuccugaccgagcacaacaucugcgagaucaacggccagaacgugaucgggcugaaggacucccagaucgccgacauccucagcaccagcggcacggucgugaccaucaccaucaugcccgcguucaucuucgagcacaucaucaagcgcauggccccguccaucaugaagucccugauggaccacaccauccccgagguguga

SEQ ID NO: 36145 - RNA, 1308 nt, Artificial Sequence
  derived and/or modified sequence opt1 from SDCCAG3__Homo_sapiens__NP_001034796
augagcggcuaccagcgccggcccggggccaccccgcugucccgcgcccggagccucgcgauccccgacgcccccgccuucuacgagcgccgguccugccugccccagcugaacugcgagcgcccgcacggccgggaccucgacagccccuucuucgggauccgccccgccuucaugugcuacgugcccuccccgguccuggccagcgugggcgacaccgacuucggguacggcaagggcaagugcuccaagcagagccccuccggggcgcacggcacgcacuucggggacgaccgguucgaggaccuggaggaggccaaccccuucagcuuccgcgaguuccucaagaccaagaaccugggccuguccaaggaggaccccgccagccggaucuacgccaaggaggcgucccgccacagccucgggcuggaccacaacuccccgcccagccagaccggcggcuacgggcuggaguaccagcagcccuucuucgaggaccccaccggcgccggggaccuccuggacgaggaggaggacgaggacacgggcugguccggcgccuaccugccgagcgccaucgagcagacccaccccgagcgggugcccgccgggaccucccccugcagcaccuaccucagcuucuucuccacgccgagcgagcuggcgggccccgagucccugcccagcugggcccucuccgacaccgacagccgcgucucccccgccagcccggccgggucccccagcgccgacuucgcggugcacggcgagucccugggggaccggcaccuccgcacccugcagaucagcuacgacgcccugaaggacgagaacuccaagcugcggcgcaagcucaacgaggugcagagcuucuccgaggcccagaccgagaugguccggacgcuggagcgcaagcuggaggccaagaugaucaaggaggagagcgacuaccacgaccucgaguccguggugcagcaggucgagcagaaccuggagcugaugaccaagcgggccgugaaggcggagaaccacguggucaagcucaagcaggagaucagccugcugcaggcccagguguccaacuuccagcgcgagaacgaggcccuccgcugcggccagggcgccagccugaccguggucaagcagaacgccgacguggcgcugcagaaccuccggguggucaugaacagcgcccaggccuccaucaagcagcuggugagcggggccgagacccugaaccucguggcggagauccugaaguccaucgaccgcaucagcgaggucaaggacgaggaggaggacuccuga

SEQ ID NO: 36146 - RNA, 2142 nt, Artificial Sequence
  derived and/or modified sequence opt1 from SDCCAG8__Homo_sapiens__NP_006633
auggccaagagccccgagaacuccacccuggaggagauccucggccaguaccagcgcagccugcgggagcacgccucccgcagcauccaccagcugaccugcgcgcucaaggagggggacgugacgaucggcgaggacgccccgaaccuguccuucagcaccuccgucgggaacgaggacgcccggaccgccuggcccgagcugcagcagagccacgccgugaaccagcucaaggaccugcugcgccagcaggcggacaaggaguccgaggugagccccucccggcgccggaagaugagcccccuccgcucccuggagcacgaggagaccaacaugccgacgaugcacgaccugguccacaccaucaacgaccagagccaguacauccaccaccucgaggccgaggugaaguucugcaaggaggagcuguccggcaugaagaacaagauccagguggucgugcuggagaacgaggggcuccagcagcagcucaagagccagcggcaggaggagacccugcgcgagcagacccugcuggacgccuccggcaacaugcacaacagcuggaucacgaccggcgaggacuccggggugggcgagaccagcaagcggcccuucagccacgacaacgccgacuucgggaaggcggccuccgccggcgagcagcuggagcucgagaagcugaagcugaccuacgaggagaagugcgagaucgaggagagccagcucaaguuccugcgcaacgaccuggccgaguaccagcggacgugcgaggaccucaaggagcagcugaagcacaaggaguuccugcucgccgcgaacacgugcaaccgcgucgggggccugugccugaagugcgcccagcacgaggccgugcucucccagacccacaccaacgugcacaugcagaccaucgagcggcuggucaaggagcgcgacgaccugaugagcgcccucguguccgugcggagcucccuggccgacacccagcagcgcgaggcgagcgccuacgagcaggucaagcagguccugcagaucuccgaggaggccaacuucgagaagaccaaggcccucauccagugcgaccagcugcggaaggagcuggagcgccaggccgagcggcucgagaaggagcuggcgagccagcaggagaagcgcgccaucgagaaggacaugaugaagaaggagaucaccaaggagcgcgaguacaugggcuccaagaugcugauccucagccagaacaucgcccagcuggaggcccagguggagaaggugacgaaggagaagaucuccgccaucaaccagcuggaggagauccagagccagcucgcgucccgggagauggacgugaccaaggugugcggggagaugcgcuaccagcugaacaagaccaacauggagaaggacgaggccgagaaggagcaccgggaguuccgcgccaagaccaaccgggaccuggagaucaaggaccaggagaucgagaagcugcgcaucgagcucgacgagagcaagcagcaccuggagcaggagcagcagaaggccgcgcuggcccgggaggagugccuccgccugacggagcugcucggcgaguccgagcaccagcugcaccugacccggcaggagaaggacagcauccagcaguccuucagcaaggaggccaaggcccaggcccuccaggcgcagcagcgcgagcaggagcugacccagaagauccagcagauggaggcccagcacgacaagaccgagaacgagcaguaccugcuccugacgagccagaacaccuuccugaccaagcucaaggaggagugcugcacccuggccaagaagcuggagcagaucucccagaagacgcggagcgagaucgcccagcucucccaggagaagcgcuacaccuacgacaagcuggggaagcugcagcggcgcaacgaggagcucgaggagcagugcguccagcacggccgggugcacgagaccaugaagcagcgccugcggcagcuggacaagcacagccaggccaccgcgcagcagcucgugcagcugcuguccaagcagaaccagcuccugcuggagcgccagagccucuccgaggaggucgaccggcugcgcacgcagcugcccagcaugccccaguccgacugcuga

SEQ ID NO: 36147 - RNA, 636 nt, Artificial Sequence
  derived and/or modified sequence opt1 from SDF2__Homo_sapiens__NP_008854
auggccguggucccccugcuccugcugggcgggcucuggagcgccgugggcgcguccagccuggggguggugaccugcggcuccgucgugaagcugcucaacacccgccacaacguccggcugcacagccacgacgugcgcuacggguccggcagcggccagcaguccgugacgggggucaccagcguggacgacuccaacagcuacuggcggauccgcggcaaguccgccaccgugugcgagcgggggaccccgaucaagugcggccagcccauccgccugacgcacgucaacaccgggcggaaccuccacagccaccacuucaccagcccccuguccggcaaccaggagguguccgccuucggcgaggagggggagggcgacuaccuggacgacuggaccgugcucugcaacgggcccuacuggguccgcgacggcgaggugcgguucaagcacagcuccacggaggugcugcugagcgucaccggcgagcaguacgggcgcccgaucuccggccagaaggaggugcacgggauggcccagcccagccagaacaacuacuggaaggccauggagggcaucuucaugaagcccagcgagcuccugaaggcggaggcccaccacgccgagcuguga

SEQ ID NO: 36148 - RNA, 666 nt, Artificial Sequence
  derived and/or modified sequence opt1 from SDF2L1__Homo_sapiens__NP_071327
auguggagcgccggccgcgggggcgccgcguggcccgugcugcucgggcugcugcucgcccugcuggucccgggcgggggcgccgccaagaccggcgccgagcucgugaccugcggguccgugcugaagcugcucaacacgcaccaccggguccgccugcacagccacgacaucaaguacggcuccgggagcggccagcaguccgugaccgggguggaggcgagcgacgacgccaacuccuacuggcggauccgcggcggcagcgagggcgggugcccccgggggucccccguccgcugcggccaggccgugcggcugacccacgugcucaccggcaagaaccugcacacgcaccacuuccccagcccgcuguccaacaaccaggaggucagcgccuucggggaggacggcgagggggacgaccucgaccuguggaccgugcgcugcuccggccagcacugggagcgggaggcggccgugcgcuuccagcacgucgggaccagcguguuccuguccgugaccggcgagcaguacggcagccccauccgggggcagcacgagguccacggcaugcccuccgccaacacgcacaacaccuggaaggccauggaggggaucuucaucaagcccagcguggagccguccgccggccacgacgagcucuga

SEQ ID NO: 36149 - RNA, 609 nt, Artificial Sequence
  derived and/or modified sequence opt1 from SDF4__Homo_sapiens__XP_011539858
augguguggcccugggucgccauggccagccgcuggggcccgcugaucgggcucgcgcccugcugccuguggcugcucggcgccgugcugcugauggacgccuccgcccggcccgccaaccacagcuccacccgcgagcggguggcgaaccgcgaggagaacgagauccugcccccggaccaccucaacggggucaagcuggagauggacggccaccucaaccggggguuccaccaggagguguuccugggcaaggaccugggcggguucgacgaggacgccgagccccgccggagccgccggaagcucauggugaucuucuccaaggucgacgugaacaccgaccgcaagaucagcgccaaggagaugcagcgguggaucauggagaagacggccgagcacuuccaggaggcgauggaggaguccaagacccacuuccgcgccguggaccccgacggcgacgggcacgucagcugggacgaguacaaggugaaguuccuggccuccaagggccacagcgagaaggagguggccgacgccauccggcugaacgaggagcucaaggucgacgaggagcgccacgggcccccgggcccccgggcgcuguga

SEQ ID NO: 36150 - RNA, 348 nt, Artificial Sequence
  derived and/or modified sequence opt1 from SDHAF1__Homo_sapiens__NP_001036096
augagccgccacucccggcugcagcgccaggugcucagccuguaccgggaccugcuccgcgccggccgggggaagcccggcgccgaggcgcgcguccgggccgaguuccgccagcacgccgggcugccgcgguccgacgugcugcgcaucgaguaccucuaccggcgcggccggcgccagcugcagcugcuccggagcgggcacgccaccgccaugggcgcguucgugcgcccccgggcccccaccggcgagcccgggggcgucgggucccagccggacgacggcgacagcccccgcaacccccacgacuccacgggggcccccgagacccggccggacggccgcuga

SEQ ID NO: 36151 - RNA, 501 nt, Artificial Sequence
  derived and/or modified sequence opt1 from SDHAF2__Homo_sapiens__NP_060311
auggccgugagcaccgucuucuccaccagcucccugaugcucgcccugagccgccacucccugcucagcccccugcuguccgugacgagcuuccggcgcuucuaccggggcgacuccccgaccgacagccagaaggacaugaucgagaucccccucccgcccuggcaggagcgcaccgacgaguccaucgagaccaagcgggcgcgccugcuguacgagagccggaagcgcgggaugcucgagaacugcauccugcugucccucuucgccaaggagcaccuccagcacaugacggagaagcagcugaaccuguacgaccggcugaucaacgagcccagcaacgacugggacaucuacuacugggccaccgaggccaagcccgcccccgagaucuucgagaacgaggugauggcgcugcuccgcgacuucgccaagaacaagaacaaggagcagcggcugcgcgcccccgaccuggaguaccucuucgagaagccgcgguga

SEQ ID NO: 36152 - RNA, 327 nt, Artificial Sequence
  derived and/or modified sequence opt1 from SDHAF4__Homo_sapiens__NP_660310
augacccccagccgccugccguggcuccuguccugggugagcgccaccgccuggcgggcggcccgcagcccccugcucugccacagccugcggaagacguccagcucccagggcgggaaguccgagcuggucaagcagucccucaagaagcccaagcugcccgagggccgcuucgacgccccggaggacagccaccuggagaaggagccccucgagaaguuccccgacgacgugaaccccgugaccaaggagaagggcgggccgcgggggcccgagcccacccgcuacggcgacugggagcggaagggccgcugcaucgacuucuga

SEQ ID NO: 36153 - RNA, 1851 nt, Artificial Sequence
  derived and/or modified sequence opt1 from SDHA__Homo_sapiens__NP_001281261
augagcggcgugcgcgggcugucccggcuccugagcgcccgccggcuggcccucgcgaaggccuggcccaccguccugcagaccggcacgcgcggguuccacuucaccguggacggcaacaagcgggccuccgccaaggugagcgacuccaucagcgcccaguaccccgucguggaccacgaguucgacgcgguggucgugggggccggcggcgccgggcugcgcgccgcguucggccucuccgaggccggguucaacaccgccugcgugaccaagcuguuccccacgcggagccacaccgucgccgcccagcuggagaacuacggcaugcccuucucccgcaccgaggacgggaagaucuaccagcgggcguucggcggccagagccucaaguucgggaagggcgggcaggcccaccgcugcugcugcguggccgaccggaccggccacucccugcugcacacgcucuacggccgcagccugcgguacgacaccuccuacuucguggaguacuucgcccuggaccuccugauggagaacggggagugccgcggcgucaucgcccugugcaucgaggacgggagcauccaccggauccgcgcgaagaacaccgugguggccaccggcggguacggccggacguacuucuccugcaccagcgcccacaccuccaccggcgacgggacggccaugaucacccgcgccggccuccccugccaggaccuggaguucguccaguuccacccgaccgggaucuacggcgcggggugccugaucaccgagggcugccggggcgagggcgggauccucaucaacagccagggggagcgcuucauggagcgguacgcccccguggccaaggaccuggccucccgcgacguggucagccgcagcaugacgcuggagauccgggagggccgcgggugcggccccgagaaggaccacguguaccuccagcugcaccaccucccgcccgagcagcuggccacccggcugcccggcaucuccgagaccgcgaugaucuucgccgggguggacgucaccaaggagcccauccccgugcugccgacggugcacuacaacaugggcgggauccccaccaacuacaagggccagguccuccgccacgugaacggccaggaccagaucguccccgggcuguacgccugcggcgaggccgcgugcgccagcgugcacggggccaaccggcugggcgccaacucccuccuggaccugguggucuucgggcgcgccugcgcgcucagcaucgaggaguccugccggcccggcgacaaggugccgcccaucaagcccaacgccggcgaggagagcgugaugaaccuggacaagcugcgcuucgccgacggguccauccggaccagcgagcuccgccuguccaugcagaaguccaugcagaaccacgccgccgucuuccgggugggcagcgugcugcaggaggggugcggcaagaucagcaagcucuacggggaccugaagcaccugaagaccuucgaccgcggcauggucuggaacacggaccucguggagacccuggagcugcagaaccucaugcugugcgcgcugcagaccaucuacggcgccgaggcccggaaggagucccgcggggcccacgcccgggaggacuacaaggugcgcaucgacgaguacgacuacagcaagcccauccagggccagcagaagaagccguucgaggagcacuggcggaagcacacccuguccuacgucgacguggggacgggcaaggugacccucgaguaccgccccgucaucgacaagacccugaacgaggcggacugcgccaccgugccgcccgccauccggagcuacuga

SEQ ID NO: 36154 - RNA, 453 nt, Artificial Sequence
  derived and/or modified sequence opt1 from SDHC__Homo_sapiens__NP_001030588
auggccgcccugcuccugcgccacgugggccggcacugccugcgcgcgcacuucagcccccagcucugcauccggaacgccgucccgcuggggaccaccgccaaggaggagauggagcgcuucuggaacaagaacaucggcuccaaccggccccugagcccccacaucacgaucuacuccuggagccuccccauggccauguccaucugccaccgcgggaccggcaucgcccugagcgcggacguggggccgcggaagcgccccgaggacucccccgccauccccguguggagcggcugcccgggcuccuacugcgucgugcuguacggggccggcagccacgugaagaagggcgggucccagcaccaccuccccacccacuacuacauccaccccagcuucugccuguccuuccugagccccgccugggagaaguucucccucuucgucuga

SEQ ID NO: 36155 - RNA, 480 nt, Artificial Sequence
  derived and/or modified sequence opt1 from SDHD__Homo_sapiens__NP_002993
auggccgugcuguggcgccucagcgccgucugcggcgcgcucgggggccgggcccugcugcugcgcacccccguggugcggccggcccacaucuccgccuuccugcaggaccgccccauccccgaguggugcgggguccagcacauccaccucagccccucccaccacagcggcuccaaggccgcgagccugcacuggaccuccgagcggguggugagcguccugcuccuggggcugcucccggccgccuaccugaaccccugcuccgccauggacuacagccuggcggccgcccucacgcugcacggccacuggggccugggccagguggugaccgacuacguccacggggacgcccuccagaaggccgcgaaggccgggcugcuggcccucuccgcccugaccuucgccggccugugcuacuucaacuaccacgacguggggaucugcaaggcgguggccaugcucuggaagcuguga

SEQ ID NO: 36156 - RNA, 6642 nt, Artificial Sequence
  derived and/or modified sequence opt1 from SDK1__Homo_sapiens__NP_689957
auggcccgcggcgcccggcccagcgccgccgggggcgggggcgggggcgccgagccgcccgagcgcgccggccccgggcggccccgcggcuccccgcccgggcgggcccgccccagccuggcgccccggcccggccccgagcccucccgcccccgggccgcccccgagaccagcgggggcgacaccgccggcgccgggcgcugcggcgggcggcgcgccgccaagcucggccccggccggcgcggguggugggcccugcuggcccuccagcugcaccuccugcgggcccuggcccaggacgacguggcccccuacuucaagaccgagcccggccugccccagauccaccucgaggggaaccgccuggugcugaccugccucgccgagggcuccuggccccuggaguucaaguggaugcgggacgacagcgagcugaccaccuacuccagcgaguacaaguacaucauccccucccuccagaagcuggacgccggguucuaccgcugcguggugcggaaccgcaugggcgcccugcuccagcggaaguccgagguccagguggccuacaugggcuccuucauggacaccgaccagcgcaagaccgugagccaggggcgcgccgccauccugaaccugcuccccaucaccuccuacccgcggccccaggugaccugguuccgcgagggccacaagaucauccccagcaaccggaucgccaucacccuggagaaccagcuggugauccucgcgaccaccaccuccgacgccggggccuacuacgugcaggccgucaacgagaagaacggcgagaacaagacgagccccuucauccaccuguccaucgcccgcgacguggggaccccggagaccauggcgcccaccaucguggugccgcccggcaaccggagcgugguggccggcuccagcgagaccacccuggagugcaucgccagcgcccgcccggucgaggaccucuccgugaccuggaagcggaacggggugcgcaucaccagcggccugcacuccuucgggcggcgccugaccaucagcaaccccaccuccgcggacaccggccccuacgucugcgaggccgcccucccggggagcgccuucgagcccgcccgggcgaccgccuuccuguucaucaucgagccgcccuacuucacggccgagccggagucccgcaucagcgccgagguggaggagaccguggacaucggcugccaggccaugggcgucccccugcccacccuccagugguacaaggacgcgaucuccaucagccggcugcagaacccccgcuacaaggugcuggccuccgggggccuccggauccagaagcugcgcccggaggacagcgggaucuuccagugcuucgccuccaacgagggcggcgagauccagacccacacguaccuggacgugaccaacaucgcccccgucuucacccagcggcccguggacaccacggucaccgacgggaugaccgccauccuccgcugcgaggugagcggcgcgcccaagccggccaucaccuggaagcgggagaaccacauccuggccuccgggagcgugcgcaucccccgcuucaugcugcucgaguccggcgggcugcagaucgcccccgucuucauccaggacgcgggcaacuacacgugcuacgccgccaacaccgagggcagccugaacgccuccgccacccucaccguguggaaccggaccagcaucgugcacccgcccgaggaccacgucgugaucaaggggacgaccgcgacccugcacugcggcgccacccacgacccccgcgugagccugcgguacgucuggaagaaggacaacguggcccucacgcccuccagcaccucccgcaucguggucgagaaggacgggagccugcugaucucccagaccuggagcggcgacaucggggacuacuccugcgagaucgugagcgagggcggcaacgacucccggauggcccgccuggaggugaucgagcucccccacagcccccagaaccugcuggucucccccaacagcucccacagccacgccguggugcucuccuggguccggcccuucgacgggaacagccccauccuguacuacaucguggagcuguccgagaacaacagcccguggaaggugcaccucagcaacgucggccccgagaugaccggggugacgguguccggccugacccccgcgcgcaccuaccaguuccgggucugcgccgugaacgagguggggcgcggccaguacagcgccgagaccucccggcugaugcucccggaggagccgcccagcgcgccgcccaagaacaucgucgccuccggccgcacgaaccagagcaucauggugcaguggcagcccccgcccgagaccgagcacaacggggugcugcggggcuacauccugcgcuaccggcucgcggggcugccgggcgaguaccagcagcgcaacaucaccucccccgaggucaacuacugccuggugaccgaccucaucaucuggacgcaguacgagauccagguggccgccuacaacggggccggccugggcgucuucagccgggcggugaccgaguacacccugcagggggugcccaccgcgccgccccagaacguccagacggaggccgugaacuccaccaccauccaguuccucuggaacccgccgccccagcaguucaucaacggcaucaaccagggguacaagcugcuggccuggcccgccgacgcgcccgaggccgugaccgucgugacgaucgcccccgacuuccacggcgugcaccacggccacaucaccaaccucaagaaguucaccgccuacuucaccagcguccugugcuucacgacccccggggacggcccgcccuccacgccccagcugguguggacccaggaggacaagcccggggccgugggccaccucagcuucacggagauccuggacaccucccugaaggucagcuggcaggagccccucgagaagaacgggaucaucaccggcuaccagaucuccugggagguguacggccgcaacgacagccggcugacccacacgcugaacuccaccacccacgaguacaagauccaggggcucagcucccugaccaccuacacgaucgacguggcggccgucaccgccgugggcaccgggcuggugaccagcagcacgaucuccagcggcgugccgcccgaccuccccggggcccccuccaaccuggugaucagcaacaucagcccccgcagcgccacccugcaguuccggcccggcuacgacggcaagaccuccaucagccgcuggaucgucgagggccaggucggcgcgaucggggacgaggaggagugggugacccucuacgaggaggagaacgagccggacgcccagaugcuggagauccccaaccugacgcccuacacccacuaccgcuuccggaugaagcaggucaacaucgugggccccuccccguacagccccuccagccgcgugauccagacccuccaggcgccgcccgacgucgccccgaccuccgugacggugcggaccgccagcgagaccucccugcgccugcggugggucccccuccccgacagccaguacaacgggaaccccgaguccgugggcuaccgcaucaaguacuggcggagcgaccugcaguccagcgcgguggcccaggucgugagcgaccgccuggagcgggaguucaccaucgaggagcucgaggaguggauggaguacgagcugcagaugcaggccuucaacgccgugggcgcggggccgugguccgaggucgugcgcggccggacgcgcgagagcgugcccuccgccgcccccgagaacgucagcgccgaggccguguccagcacccagauccugcucaccuggaccuccgugcccgagcaggaccagaacgggcugauccugggcuacaagauccucuuccgggcgaaggaccuggacccggagccccgcagccacaucguccggggcaaccacacgcaguccgcccugcucgccgggcugcgcaaguucgugcuguacgagcuccaggugcuggccuucacccggaucggcaacgggguccccagcacgccccugauccucgagcgcaccaaggacgacgccccggggccgcccgugcggcugguguuccccgagguccgccugacguccgugcgcaucguguggcagccgcccgaggagcccaacgggaucauccucggcuaccagaucgcguaccggcuggccagcuccagcccccacaccuucaccaccgucgaggugggcgccacggugcgccaguucaccgccaccgaccuggccccggaguccgcguacaucuuccggcucagcgccaagacccgccagggguggggcgagccccuggaggccacggucaucaccaccgagaagcgggagcgccccgccccgccccgggagcugcucgugccccaggcggaggugaccgcccgcucccugcggcugcaguggguccccgggagcgacggcgccuccccgauccgcuacuucacgaugcagguccgggagcucccccgcggggaguggcagaccuacagcagcuccaucagccacgaggccaccgccugcguggucgaccggcugcgccccuucaccuccuacaagcugcggcucaaggcgaccaacgacaucggcgacagcgacuucuccagcgagacggaggccgugaccacccugcaggacgugcccggcgagccgcccggguccgucagcgccacgccccacacgaccuccagcgugcugauccaguggcagcccccgcgcgacgagucccucaacggccugcugcagggguaccggaucuacuaccgcgagcucgaguacgaggccggcagcgggaccgaggccaagacccugaagaaccccaucgcgcugcacgccgagcucacggcccaguccagcuucaagaccgugaacuccagcuccaccagcaccaugugcgagcugacgcaccugaagaaguaccggcgcuacgaggucaucaugaccgccuacaacaucaucggcgagucccccgccagcgcgcccguggagguguucgucggcgaggccgccccggccauggcgccccagaacguccaggugacgccccucaccgccagccagcuggaggucacgugggacccgcccccgcccgagucccagaacgggaacauccagggcuacaagaucuacuacugggaggccgacagccagaacgagaccgagaagaugaaggugcuguuccuccccgagcccgucgugcggcugaagaaccugaccucccacaccaaguaccucgugagcaucuccgccuucaacgccgcgggggacggccccaagagcgacccccagcaggggcgcacgcaccaggccgcccccggcgcccccuccuuccuggccuucagcgagaucaccuccaccacccugaacgucagcuggggcgagcccgcggccgccaacgggauccugcagggcuaccgcgugguguacgagccccucgccccgguccaggggguguccaagguggucacgguggaggugcggggcaacuggcagcgcuggcugaagguccgggaccugaccaagggcgugaccuacuucuuccgcgugcaggcccggaccaucacguacgggcccgagcuccaggcgaacaucaccgccggccccgccgaggggagccccggcuccccgcgcgacguccuggugaccaagagcgccuccgagcugacccuccaguggacggaggggcacagcggcgacacccccaccaccggcuacgugaucgaggcccggcccuccgacgaggggcugugggacauguucgucaaggacaucccccgcagcgcgacguccuacacccugagccucgacaagcugcggcagggcgugaccuacgaguuccgcguggucgccgugaacgaggccggguacggcgagccgagcaaccccuccaccgccgugagcgcgcaggucgaggcccccuucuacgaggaguggugguuccugcucgugauggcccuguccagccugaucgugauccuccuggucguguucgcccuggugcuccacgggcagaacaagaaguacaagaacugcuccacgggcaagggcaucagcaccauggaggaguccgucacccuggacaacgggggcuucgccgcgcuggagcucagcucccggcaccugaacgucaagagcaccuucuccaagaagaacgggacccgcagcccgccccggcccucccccggcgggcugcacuacagcgacgaggacaucugcaacaaguacaacggcgccgugcucacggaguccgucagccugaaggagaaguccgccgacgccagcgagagcgaggccaccgacuccgacuacgaggacgcgcugcccaagcacagcuucgugaaccacuacauguccgaccccaccuacuacaacagcuggaagcgccgggcccagggccgcgcccccgcgccccaccgguacgaggccguggcgggguccgaggccggcgcccagcuccaccccgucaucaccacgcagagcgccgggggcguguacaccccggcggggcccggcgcccgcacgccccugaccggcuucuccagcuucguguga

SEQ ID NO: 36157 - RNA, 6519 nt, Artificial Sequence
  derived and/or modified sequence opt1 from SDK2__Homo_sapiens__NP_001138424
augugggggcugcucaucuggacccugcuggcccuccaccagauccgcgccgcccgggcccaggacgacgugagccccuacuucaagaccgagcccgugcgcacccaggugcaccuggaggggaaccggcuggugcugaccugcauggccgagggcuccuggccccuggaguucaaguggcugcacaacaaccgcgagcucaccaaguucucccuggaguaccgguacaugaucaccucccuggaccgcacccacgccggguucuaccggugcaucgugcgcaaccggaugggcgcccuccugcagcgccagaccgagguccagguggcguacauggggagcuucgaggagggcgagaagcaccaguccgugagccacggcgaggccgccgugauccgggccccgcgcaucgcguccuucccccagccccaggugaccugguuccgggacgggcgcaagaucccgcccagcucccggaucgccaucacccuggagaacacccucgucauccugagcaccguggcccccgacgccggccgcuacuacgugcaggccgucaacgacaagaacggggacaacaagaccucccagcccaucacccugaccguggagaacgugggcgggcccgcggaccccaucgcccccaccaucaucaucccgcccaagaacaccagcgucguggccggcaccuccgaggugacccucgagugcgucgccaacgcccggccccugaucaagcugcacaucaucuggaagaaggacggcgugcuccugagcgggggcaucuccgaccacaaccgccggcugaccauccccaaccccaccgggagcgacgcgggcuacuacgagugcgaggccgugcuccgcuccagcuccguccccagcguggugcggggcgccuaccugagcguccuggagccgccccaguucgugaaggagcccgagcgccacaucaccgccgagauggagaaggucguggacauccccugccaggccaagggggugccgccgcccuccaucacgugguacaaggacgcggccgucguggagguggagaagcucacccgcuuccggcagcgcaacgacggcgggcugcagaucagcggccugguccccgacgacaccgggauguuccagugcuucgcccggaacgccgccggcgaggugcagaccuccacguaccucgcggugaccagcaucgcccccaacaucacccgcggcccccuggacuccaccgucaucgacgggaugagcguggugcuggccugcgagacguccggcgcgccccggcccgccaucaccuggcagaagggggagcgcauccucgccagcggcuccguccagcugccccgguucaccccgcuggagagcgggucccuccugaucagccccacccacaucuccgacgccggcacguacacgugccuggccaccaacagccgcggcguggacgaggccuccgcggaccucguggucugggcccggacccgcaucacgaagccgccccaggaccagagcgugaucaaggggacccaggccuccauggugugcggcgucacccacgacccccgggugaccauccgcuacaucugggagaaggacggggccacccugggcacggagagccacccccggauccgccuggaccggaacgggucccuccacaucagccagaccuggagcggcgacaucggcaccuacacgugccgcgugaucuccgccgggggcaacgacagccgguccgcgcaccuccgcguccggcagcugccccacgcccccgagcaccccguggccacgcucagcaccguggagcgccgcgccaucaaccugaccuggaccaagcccuucgacgggaacagcccccugauccgguacauccucgagaugagcgagaacaacgcccccuggacgguccugcuggcguccguggacccgaaggccaccagcgugaccgucaagggccuggugcccgcccgcuccuaccaguuccggcucugcgccgugaacgacgucggcaaggggcaguucagcaaggacaccgagcgcgugucccugcccgaggagccgcccacggcgccgccccagaacgugaucgccagcggccggaccaaccaguccaucaugauccaguggcagcccccgcccgagagccaccagaacgggauccugaagggcuacaucauccgcuacugccucgccgggcugcccgucggcuaccaguucaagaacaucaccgacgccgacgugaacaaccugcuccuggaggaccugaucaucuggaccaacuacgagaucgagguggccgcguacaacuccgccggccucggggucuacagcuccaaggugacggaguggacccugcagggcgugcccaccgucccgcccgggaacgugcacgccgaggccaccaacagcacgaccauccgguucaccuggaacgcccccagcccccaguucaucaacggcaucaaccagggguacaagcugaucgcgugggagcccgagcaggaggaggaggugaccauggucacggcccgccccaacuuccaggacuccauccacgugggcuucgugagcggccucaagaaguucaccgaguacuucaccuccguccugugcuucaccacgcccggggacggcccccggagcacgccccagcuggugcgcacccacgaggacgugcccgggcccgucggccaccucuccuucagcgagauccuggacaccucccugaaggugagcuggcaggagcccggggagaagaacggcauccucacgggcuaccggaucuccugggaggaguacaaccgcaccaacacccgggugacccacuaccugcccaacgucacgcuggaguaccgcgugaccgggcucaccgcccugaccaccuacacgaucgaggucgccgccaugaccagcaagggccagggccagguguccgcgagcaccaucuccagcggcgugccgcccgagcugccggggccgcccaccaaccucggcaucuccaacaucggcccccggagcgucacgcugcaguuccgcccgggguacgacggcaagaccuccaucagccgguggcugguggaggcccaggugggggucgugggcgagggcgaggaguggcuccugauccaccagcuguccaacgagcccgacgcccgcagcauggaggugcccgaccucaaccccuucacgugcuacagcuuccggaugcgccaggucaacaucguggggaccuccccgcccagccagcccucccggaagauccagacgcugcaggcgccgcccgacauggcgcccgccaacgugagccugcgcaccgccuccgagaccagccucuggcugcgcuggaugccccugcccgagauggaguacaacggcaaccccgaguccgucggguacaagaucaaguacagccgguccgacggccacgggaagacccucagccacguggugcaggaccgcgucgagcgggacuacacgaucgaggaccuggaggaguggaccgaguaccgcguccaggugcaggccuucaacgccaucggcuccggccccuggagccagaccgucguggggcggacccgcgaguccgugcccagcuccggcccgacgaacgucagcgcgcuggccaccaccuccagcuccaugcucgugcgguggagcgaggugcccgaggccgaccgcaacgggcugguccugggcuacaaggugauguacaaggagaaggacagcgacacccagccccgguucuggcucguggaggggaacuccagccgcuccgcccagcugacgggccugggcaaguacguccucuacgagguccaggugcuggccuucacccggaucggggacggcagccccucccacccgcccauccuggagcgcacccucgacgacguccccgggcccccgaugggcauccuguuccccgaggugcggaccacgagcgugcgccugaucuggcagccgcccgcggccccgaacgggaucauccucgccuaccagaucacccaccggcugaacaccaccacggccaacaccgccaccgucgaggugcuggcgcccuccgcccgccaguacaccgccacgggccucaagcccgagagcguguaccuguuccggaucaccgcccagacccgcaagggcuggggcgaggccgcggaggcccuggucgugaccacggagaagcgggaccgcccccagccgcccucccgccccauggugcagcaggaggacguccgggcccgcagcgugcuccuguccugggagcccggcagcgacgggcuguccccggugcgguacuacaccauccagacccgcgagcuccccagcggccggugggcccugcacuccgcgagcgucucccacaacgccagcuccuucaucguggaccgccugaagcccuucaccagcuacaaguuccgggugaaggccaccaacgacaucggcgacagcgaguucuccgaggagagcgagucccucacgacccugcaggccgcccccgacgaggcgccgaccauccugagcgucacgccccacacgaccaccuccgugcucauccgcuggcagccgcccgccgaggacaagaucaacgggauccugcugggcuuccggauccgcuaccgggagcuccuguacgaggggcugcgcggcuucacccuccgggggaucaacaacccgggcgccacgugggccgagcugaccagcauguacuccaugcgcaaccugagccggcccucccucacccaguacgagcuggacaaccugaacaagcaccgccgguacgagauccgcaugagcguguacaacgccgucggcgaggggcccuccagcccgccccaggagguguucgugggcgaggcgguccccaccgccgcgccccggaacguggucgugcacggggccacggccacccagcucgacgugaccugggagccgccgccccuggacucccagaacggcgacauccagggguacaagaucuacuucugggaggcgcagcgcggcaaccugaccgagcgggucaagacccucuuccuggccgagaacagcgugaagcugaagaaccucaccggcuacaccgccuacaugguguccgucgccgcguucaacgccgccggggacggcccccgcagcaccccgacgcaggggcagacccagcaggccgcccccuccgcgcccagcuccgugaaguucagcgagcugaccaccacgagcgugaacgucuccugggaggcgccccaguucccgaacggcauccuggagggguaccgccucguguacgagcccugcagccccguggacggcgucuccaagaucgugaccguggacgucaagggcaacagcccccuguggcugaaggugaaggaccucgccgagggggugaccuaccgguuccgcauccgggccaagaccuucacguacggcccggagaucgaggccaacgucaccaccgggcccggcgagggggcccccgggccgcccggcgugcccaucaucgugcgcuacuccagcgccaucgccauccacugguccagcggggaccccggcaaggggcccaucacccgguacgucaucgaggcccgccccuccgacgagggccugugggacauccugaucaaggacauccccaaggaggugagcuccuacacguucagcauggacauccucaagcccggcguguccuacgacuuccgggucaucgccgugaacgacuacggguucggcaccccgagcucccccagccaguccgugcccgcgcagaaggccaaccccuucuacgaggaguggugguuccuggucgugaucgcccugguggggcugaucuucauccuccugcuggucuucgugcucaucauccgcggccagagcaagaaguacgccaagaagaccgacuccgggaacagcgccaaguccggcgcccugggccacuccgagaugaugagccuggacgaguccagcuucccggcccucgagcugaacaaccggcgccuguccgugaagaacagcuucugccggaagaacgggcucuacacccgcagcccgccccggcccagcccgggcucccugcacuacagcgacgaggacgucacgaaguacaacgaccugauccccgccgaguccagcucccucaccgagaagcccagcgagaucuccgacagccagggguccgacagcgaguacgagguggacagcaaccaccagaaggcccacuccuucgugaaccacuacaucagcgaccccaccuacuacaacuccuggcgccggcagcagaagggcaucagccgcgcgcaggccuacuccuacaccgagagcgacuccggggagccggaccacacgaccgucaccaacagcaccuccacccagcagggcagccuguuccggcccaaggccucccgcacgcccacgccccagaacccgcccaacccgcccagccagcaguccacccuguaccggccgcccagcucccucgcccccggcagccgcgcccccaucgcgggguucuccagcuucguguga

SEQ ID NO: 36158 - RNA, 1278 nt, Artificial Sequence
  derived and/or modified sequence opt1 from SDPR__Homo_sapiens__NP_004648
augggcgaggacgccgcccaggcggagaaguuccagcaccccgggagcgacaugcgccaggagaagccguccagccccucccccaugcccagcuccaccccgagccccucccugaaccugggcaacaccgaggaggccauccgggacaacagccaggugaacgccgucacggugcugacccugcucgacaagcuggugaacaugcuggacgccguccaggagaaccagcacaagauggagcagcgccagaucucccucgaggggagcgugaagggcauccagaacgaccugaccaagcuguccaaguaccaggccagcaccuccaacacggugagcaagcuccuggagaagucccggaaggucagcgcgcacacccgcgccgugaaggagcggauggaccgccagugcgcccaggugaagcggcuggagaacaaccacgcccagcuccugcgccggaaccacuucaagguccugaucuuccaggaggagaacgagauccccgcguccguguucgugaagcagcccgucagcggggccguggagggcaaggaggagcucccggacgagaacaagucccuggaggagacccugcacaccguggaccucagcagcgacgacgaccugccccacgacgaggaggcccuggaggacuccgccgaggagaaggucgaggagagccgcgccgagaagaucaagcgguccagccucaagaagguggacucccugaagaaggcguucagccgccagaacaucgagaagaagaugaacaagcugggcacgaagaucguguccgucgagcggcgcgagaagaucaagaagucccucaccagcaaccaccagaagaucagcuccggcaagagcucccccuucaaggugagcccccugaccuucgggcggaagaaggugcgcgagggggagucccacgccgagaacgagaccaagagcgaggaccugccguccagcgagcagaugcccaacgaccaggaggaggaguccuucgccgagggccacagcgaggccagccucgccuccgcgcuggucgagggggagaucgccgaggaggccgccgagaaggccacgagccggggcuccaacagcggcauggacuccaacaucgaccugaccaucguggaggacgaggaggaggagagcguggcgcucgagcaggcccagaagguccgcuacgagggguccuacgcccugaccagcgaggaggccgagcgguccgacggcgaccccgugcagcccgccguccuccaggugcaccagaccagcuga

SEQ ID NO: 36159 - RNA, 1182 nt, Artificial Sequence
  derived and/or modified sequence opt1 from SDR42E1__Homo_sapiens__XP_011521772
auggaccccaagcgcagccagaaggaguccgugcugaucaccggcgggagcggcuacuucggguuccggcucggcugcgcccugaaccagaacgggguccacgugauccuguucgacaucuccagcccggcccagaccauccccgagggcaucaaguucauccagggcgacauccgccaccucuccgacguggagaaggcguuccaggacgccgacgucacgugcguguuccacaucgccagcuacgggauguccggccgggagcagcugaaccgcaaccugaucaaggaggugaacguccgggggaccgacaacauccuccaggugugccagcgccggcgcgugccccggcuggucuacaccagcaccuucaacgugaucuucggcggccaggugauccgcaacggggacgagucccugcccuaccucccgcugcaccuccaccccgaccacuacagccggacgaaguccaucgccgagcagaagguccuggaggccaacgcgacgccccuggaccgcggcgacggggugcugcggaccugcgcccuccgccccgccggcaucuacgggccgggcgagcagcggcaccucccccgcaucgugagcuacaucgagaagggccuguucaaguucgucuacggggacccccggucccugguggaguucgugcacgucgacaaccuggugcaggcccacauccuggcgagcgaggcccuccgcgccgacaagggccacaucgccuccgggcagcccuacuucaucagcgacggccggccggugaacaacuucgaguucuuccgcccccuggucgaggggcugggcuacaccuuccccuccacccggcucccccugacccugguguacugcuucgccuuccucaccgagauggugcacuucauccugggccgccuguacaacuuccagccguuccucacccgcacggaggucuacaagaccggggugacccacuacuucagccuggagaaggcgaagaaggagcugggcuacaaggcccagcccuucgaccuccaggaggccgucgagugguucaaggcccacgggcacggccgguccagcgggagccgcgacuccgagugcuucgugugggacggccugcugguguuccuccugaucaucgccguccugauguggcuccccagcuccgugauccugagccuguga

SEQ ID NO: 36160 - RNA, 942 nt, Artificial Sequence
  derived and/or modified sequence opt1 from SDR9C7__Homo_sapiens__NP_683695
auggccgcccugaccgaccucagcuucauguaccgcugguucaagaacugcaaccuggugggcaaccuguccgagaaguacgucuucaucaccgggugcgacagcggcuucgggaaccuccuggcgaagcagcugguggaccggggcaugcagguccucgccgccugcuucacggaggaggggucccagaagcugcagcgcgacaccagcuaccggcugcagaccacccuccuggacgugacgaaguccgagagcaucaaggccgccgcgcagugggugcgcgacaaggugggcgagcagggccugugggcccucgucaacaacgccggggugggccugcccuccgggccgaacgaguggcugaccaaggacgacuucgugaaggucaucaacgugaaccucgugggccugaucgaggucacccugcacaugcuccccauggugaagcgggcccgcgggcggguggucaacaugagcuccagcggcggccgcguggcggugaucgggggcggguacugcgucuccaaguucggcguggaggccuucagcgacuccauccggcgcgagcuguacuacuucggcgugaaggucugcaucaucgagcccgggaacuaccggaccgccauccugggcaaggagaaccucgagagccgcaugcggaagcugugggagcgccugccccaggagacgcgggacuccuacggggaggacuacuuccgcaucuacaccgacaagcucaagaacaucaugcaggucgccgagccgcgggugcgcgacgugaucaacagcauggagcacgccaucgugucccggagcccccgcauccgguacaaccccggccuggacgcgaagcugcucuacaucccccuggccaagcugccgacccccgucaccgacuucauccucucccgcuaccugccccgccccgccgacagcguguga

SEQ ID NO: 36161 - RNA, 987 nt, Artificial Sequence
  derived and/or modified sequence opt1 from SDS__Homo_sapiens__NP_006834
augaugagcggcgagccccugcacgugaagaccccgauccgcgacuccauggcccucagcaagauggccgggaccuccgucuaccugaagauggacagcgcgcagcccuccggcagcuucaagauccgggggaucggccacuucugcaagcgcugggccaagcaggggugcgcccacuucgugugcuccagcgccggcaacgccggcauggcggccgccuacgccgcgcggcagcugggggugcccgccacgaucgucgugcccuccaccaccccggcccucaccaucgagcgccugaagaacgagggcgccacggugaaggucgugggggagcugcucgacgaggccuucgagcuggcgaaggcccuggccaagaacaaccccggcuggguguacaucccgcccuucgacgacccccucaucugggaggggcacgccagcaucgucaaggagcugaaggagacccugugggagaagcccggcgccaucgcgcucuccgugggcgggggcgggcugcugugcggcgugguccagggccuccaggaggugggguggggcgacgugcccgucaucgccauggagaccuucggggcccacagcuuccacgccgccaccacggcgggcaagcuggugucccugcccaagaucaccagcguggccaaggcccucggggucaagaccgugggcgcccaggcccugaagcuguuccaggagcacccgaucuucuccgaggugaucagcgaccaggaggcggucgccgccaucgagaaguucguggacgacgagaagauccucguggagcccgccugcggcgcggcccuggccgccgucuacucccacgugauccagaagcugcagcucgaggggaaccugcggacgccccugcccagccucgucgugaucgugugcggcggguccaacaucagccuggcccagcugcgcgcgcucaaggagcagcugggcaugaccaaccggcugccgaaguga

SEQ ID NO: 36162 - RNA, 462 nt, Artificial Sequence
  derived and/or modified sequence opt1 from SEC11A__Homo_sapiens__NP_001258847
augaucgugagcuccgcccugaugaucuggaagggccucauggucaucaccgggagcgagucccccaucguggugguccugagcggcuccauggagccggccuuccaccgcggggaccuccuguuccugaccaaccggguggaggaccccauccgcgugggcgagaucgucguguuccggaucgaggggcgcgagauccccaucgugcaccggguccugaagauccacgagaagcagaacggccacaucaaguuccucacgaagggcgacaacaacgcgguggacgaccgcgggcuguacaagcagggccagcacuggcuggagaagaaggacguggucgggcgggcccgcggcuucgugcccuacaucgggaucgugaccauccucaugaacgacuacccgaaguucaaguacgccguccuguuccugcucggccuguucgugcuggugcaccgggaguga

SEQ ID NO: 36163 - RNA, 579 nt, Artificial Sequence
  derived and/or modified sequence opt1 from SEC11C__Homo_sapiens__NP_150596
auggugcgcgccggcgccgucggggcgcaccuccccgccagcggccucgacaucuucggggaccugaagaagaugaacaagcggcagcuguacuaccaggugcucaacuucgccaugaucguguccagcgcccugaugaucuggaagggccugaucguccucaccggguccgagagcccgaucguggugguccuguccggcagcauggagcccgccuuccaccgcggcgaccugcuguuccugaccaacuuccgggaggaccccauccgcgcgggggagaucgugguguucaaggucgagggccgggacauccccaucgugcaccgcgugaucaagguccacgagaaggacaacggggacaucaaguuccugacgaagggcgacaacaacgagguggacgaccgggggcucuacaaggagggccagaacuggcuggagaagaaggacguggucggccgcgcccggggguuccugccguacgugggcauggugaccaucaucaugaacgacuaccccaaguucaaguacgcccuccuggccgucaugggggcguacgugcugcucaagcgcgaguccuga

SEQ ID NO: 36164 - RNA, 1107 nt, Artificial Sequence
  derived and/or modified sequence opt1 from SEC13__Homo_sapiens__NP_001129498
augcgcgagcccgugcugaccuggugcgucccgcucgagcugcugugcagccacccccucccccuguccgccuuccucaagagccaggugaagcuguacaccuaccgggccugcgcgggcaaggacgagauggggaagaugguguccgucaucaacacgguggacaccagccacgaggacaugauccacgacgcccagauggacuacuacggcacccgccuggcgaccugcuccagcgaccgguccgugaagaucuucgacguccgcaacgggggccagauccugaucgccgaccuccgggggcacgagggccccguguggcaggucgccugggcccacccgauguacggcaacauccuggccagcugcuccuacgaccgcaaggugaucaucuggcgggaggagaacgggacgugggagaagucccacgagcacgccggccacgacagcagcgugaacuccgugugcugggcgccccacgacuacgggcugauccucgccugcggcagcuccgacggggccaucagccugcugaccuacaccggcgagggccagugggaggucaagaagaucaacaacgcccacaccaucgggugcaacgccguguccugggcccccgcggugguccccggcagccucaucgaccacccguccgggcagaagcccaacuacaucaagcgcuucgccagcggcggcugcgacaaccugaucaagcuguggaaggaggaggaggacgggcaguggaaggaggagcagaagcucgaggcccacagcgacugggugcgggacguggccugggcccccuccaucggccugcccacgagcaccaucgcguccugcagccaggacgggcgcgucuucaucuggaccugcgacgacgccuccagcaacaccugguccccgaagcugcuccacaaguucaacgacgugguguggcacgucagcugguccaucacggccaacauccuggccgugagcggcggggacaacaaggugacccuguggaaggaguccgucgacggccagugggugugcaucagcgacgucaacaagggccagggguccgugagcgccuccgugaccgagggccagcagaacgagcaguga

SEQ ID NO: 36165 - RNA, 2148 nt, Artificial Sequence
  derived and/or modified sequence opt1 from SEC14L1__Homo_sapiens__NP_001137470
auggugcagaaguaccagagccccguccgcguguacaaguacccguucgagcugaucauggccgccuacgagcggcgcuucccgaccugcccccucauccccauguucgugggcuccgacaccgucaacgaguucaagagcgaggacggggcgauccacgugaucgagcggcgcugcaagcuggacguggacgccccgcggcugcucaagaagaucgccggcgucgacuacguguacuucgugcagaagaacucccugaacagccgcgagcggacgcugcacaucgaggccuacaacgagaccuucuccaaccgcgucaucaucaacgagcacugcugcuacaccgugcaccccgagaacgaggacuggaccugcuucgagcagagcgccucccucgacaucaagagcuucuucggguucgaguccacgguggagaagaucgcgaugaagcaguacaccagcaacaucaagaagggcaaggagaucaucgaguacuaccugcggcagcuggaggaggaggggaucaccuucgucccccgcugguccccgcccagcaucacccccuccagcgagacguccagcuccagcuccaagaagcaggccgccagcauggccguggugauccccgaggcggcccucaaggagggccugagcggcgacgcccuguccagccccuccgcccccgagcccgucguggggacccccgacgacaagcucgacgccgacuacaucaagcgguaccugggcgaccugacgccccuccaggagagcugccugauccgccugcggcaguggcuccaggagacccacaaggggaagaucccgaaggacgagcacauccugcgcuuccugcgggcgcgcgacuucaacaucgacaaggcccgggagaucaugugccagucccucaccuggcgcaagcagcaccagguggacuacauccuggagaccuggaccccgccccagguccugcaggacuacuacgccggcggguggcaccaccacgacaaggacggccggccccucuacgugcugcgccugggccagauggacaccaaggggcucgugcgggcccugggcgaggaggcccugcuccgcuacguccugagcaucaacgaggaggggcugcgccggugcgaggagaacacgaagguguucggccgccccaucuccagcuggaccugccucguggaccuggagggccugaacaugcggcaccucuggcgccccggggucaaggcgcugcugcggaucaucgagguggucgaggccaacuaccccgagacccucggccgccugcugauccuccgggcgccccgcguguucccggugcuguggacccuggucucccccuucaucgacgacaacacgcggcgcaaguuccucaucuacgccgggaacgacuaccagggccccgggggccugcuggacuacaucgacaaggagaucauccccgacuuccucagcggcgagugcaugugcgaggugccggagggcgggcuggugcccaagucccuguaccggaccgccgaggagcuggagaacgaggaccucaagcuguggaccgagaccaucuaccagagcgccuccgucuucaagggggcgccccacgagauccugauccagaucguggacgccagcuccgugaucacgugggacuucgacgucugcaagggcgacaucguguucaacaucuaccacagcaagcgcuccccgcagccgcccaagaaggacagccucggggcccacuccaucaccagccccggcggcaacaacgugcagcugaucgacaaggucuggcagcuggggcgggacuacagcaugguggagagcccccucaucugcaaggagggcgaguccgugcaggggucccacgucacccgcuggcccggcuucuacauccugcaguggaaguuccacagcaugcccgccugcgccgccuccagccugccccggguggacgacgugcucgccucccugcaggucagcucccacaagugcaaggugauguacuacaccgaggugaucgggagcgaggacuuccgcggcuccaugacgagccuggaguccagccacuccggcuucagccagcucuccgccgcgaccaccagcagcucccagagccacuccagcuccaugaucagccgguga

SEQ ID NO: 36166 - RNA, 963 nt, Artificial Sequence
  derived and/or modified sequence opt1 from SEC14L2__Homo_sapiens__NP_001191133
augagcggccgcgugggggaccugagcccccggcagaaggaggcccucgccaaguuccgcgagaacguccaggacgugcugccggcgcugcccaaccccgacgacuacuuccuccugcgguggcugcgcgcccgguccuucgaccuccagaaguccgaggccaugcugcgcaagcugggccggaagguggagaccaucaccaucaucuacgacugcgaggggcucggccugaagcaccuguggaagcccgccgucgaggccuacggggaguuccucugcauguucgaggagaacuacccggagacgcugaagcgccuguucguggugaaggcgcccaagcuguuccccgucgccuacaaccucaucaagcccuuccugagcgaggacacccggaagaagaucauggugcucggcgccaacuggaaggaggugcugcugaagcacaucuccccggaccagguccccguggaguacggcgggaccaugaccgaccccgacggcaaccccaagugcaagagcaagaucaacuacgggggcgacaucccgcgcaaguacuacgugcgggaccaggucaagcagcaguacgagcacuccgugcagaucagccgcggguccagccaccagguggaguacgagauccucuuccccggcugcguccugcgguggcaguucauguccgacggcgccgacgugggguucggcaucuuccugaagacgaagaugggggagcgccagcgggcgggcgagaugaccgaggugcuccccaaccagcgcuacaacagccaccugguccccgaggacggcacccugaccugcuccgacccggggaucuacgugcuccgguucgacaacacguacagcuucauccacgccaagaaggugaacuucaccgucgaggugcugcugcccgacaaggccuccgaggagaagaugaagcagcucggcgccgggacccccaaguga

SEQ ID NO: 36167 - RNA, 972 nt, Artificial Sequence
  derived and/or modified sequence opt1 from SEC14L3__Homo_sapiens__NP_001244307
auggugauccagaaguacaugcccggcgggcugugcggcuacgaccgcgacgggugcccggucugguacgacaucaucggcccccucgaccccaaggggcugcuguucagcgugaccaagcaggaccuccugaagaccaagaugcgggacugcgagcgcauccugcacgagugcgaccuccagacggagcggcugggcaagaagaucgagaccaucgugaugaucuucgacugcgagggccuggggcucaagcacuucuggaagccccuggucgagguguaccaggaguucuucggccugcucgaggagaacuacccggagacccugaaguucaugcugaucgugaaggccaccaagcuguuccccgucggguacaaccucaugaagcccuuccuguccgaggacacgcgccggaagaucaucgugcucggcaacaacuggaaggaggggcugcugaagcucaucagccccgaggagcugccggcccaguucggcggcacccugaccgaccccgacgggaaccccaagugccucaccaagaucaacuacggcggggagauccccaaguccauguacgugcgcgaccaggucaagacgcaguacgagcacagcgugcagaucaaccggggcuccagccaccagguggaguacgagauccuguucccgggcugcguccugcgcuggcaguucuccagcgacggggcggacaucggcuucgggguguuccucaagaccaagaugggcgagcggcagcgcgccggggagaugaccgacgugcugcccucccagcgguacaacgcccacaugguccccgaggacggcaaccugaccugcagcgaggccggcguguacgugcuccgcuucgacaacacguacuccuucguccacgccaagaaggugagcuucaccguggagguccugcugcccgacgaggggaugcagaaguacgacaaggagcucaccccgguguga

SEQ ID NO: 36168 - RNA, 3183 nt, Artificial Sequence
  derived and/or modified sequence opt1 from SEC16B__Homo_sapiens__NP_149118
auggagcugugggcgccccagcgccucccgcagacccggggcaaggccaccgcccccagcaaggaccccgaccgcggguuccggcgcgacggccaccaccggcccgugccgcacuccuggcacaacggggagcgcuuccaccaguggcaggacaaccggggcagcccccagccccagcaggagccccgcgccgaccaccagcagcagccgcacuacgccucccggcccggggacuggcaccagcccgucagcggcguggacuacuacgagggcggguaccgcaaccagcuguacucccggcccggcuacgagaacagcuaccaguccuaccagagcccgacgaugcgcgaggaguacgccuacggguccuacuacuaccacggccacccccaguggcugcaggaggagcgggugccccgccagcggagccccuacaucuggcacgaggacuaccgcgagcagaaguaccucgacgagcaccacuacgagaaccagcacuccccguucgggaccaacagcgagacccacuuccaguccaacagccggaaccccugcaaggacucccccgccagcaacuccggccaggaguggcccggcgagcuguucccggggagccugcucgcggaggcccagaagaacaagcccucccuggccagcgagagcaaccugcuccagcagcgcgaguccggccugagcuccagcuccuacgagcugagccaguacauccgggacgcccccgagcgcgacgacccgcccgcguccgccgccuggagccccguccaggccgacguguccagcgccgggcccaaggcgcccaugaaguucuacaucccgcacgugcccgucuccuucggccccggcgggcagcucgugcacgugggcccgagcucccccaccgacgggcaggccgcccuggucgagcugcacagcauggaggugauccucaacgacuccgaggagcaggaggagaugcggagcuucuccggcccccugauccgcgaggacgugcacaaggucgacaucaugacguucugccagcagaaggccgcccagagcugcaaguccgagacccuggggagccgcgacagcgcgcuccuguggcagcugcucgugcugcugugccggcagaacggcuccauggugggcagcgacaucgccgagcuccugaugcaggacugcaagaagcuggagaaguacaagcgccagcccccggucgccaaccucaucaaccugaccgacgaggacuggcccgugcuguccagcgggacccccaaccuccugacgggcgagaucccgcccuccguggagacccccgcccagaucgucgagaaguucacccggcugcucuacuacgggcgcaagaaggaggcccuggagugggcgaugaagaaccaccuguggggccacgcccucuuccugagcuccaagauggacccccagaccuacagcugggugauguccggguucacgagcacccuggcccucaacgacccccugcagacccuguuccagcucauguccggccggaucccgcaggccgcgaccugcugcggcgagaagcaguggggcgacuggcgcccccaccuggccgugauccugagcaaccaggccggggaccccgagcucuaccagcgggccaucgucgccaucggggacacgcuggcgggcaaggggcugguggaggccgcccacuucugcuaccucauggcccacgugcccuucggccacuacaccgucaagaccgaccaccuggugcugcugggcuccagccacucccaggaguuccucaaguucgccaccacggaggcgauccagcgcaccgagaucuucgaguacugccagaugcuggggcggcccaagagcuucaucccguccuuccaggucuacaagcugcucuacgccagccgccuggccgacuacggccuggugagccaggcccuccacuacugcgaggccaucggggcggccgugcugucccagggcgagagcucccaccccguccugcucguggagcugaucaagcuggccgagaagcucaagcugagcgacccccuggugcucgagcggcgcuccggcgaccgggaccuggagccggacuggcuggcccagcuccgccggcagcuggagcagaaggucgccggggacaucggcgacccccaccccacccgcagcgacaucuccggggcgggcgggaccacgaccgagaacaccuucuaccaggacuucagcggcugccagggcuacuccgaggcccccggguaccggagcgcccuguggcucaccccggagcagacgugccugcugcagcccagcccccagcagccguucccccuccagcccggcuccuaccccgccgggggcggggcgggccagaccggcaccccgcgccccuucuacuccgugcccgagacccaccuccccgggacgggcagcuccguggccgucaccgaggccaccgggggcaccgugugggaggagaugcugcagacgcaccuggggccgggcgagaacaccgugagccaggagaccucccagccgcccgacggccaggaggucaucagcaagccccagacgccccuggccgcccggccccgcuccaucagcgagagcuccgcgagcuccgccaaggaggacgagaaggagagcuccgacgaggccgacaagaacagcccccgcaacaccgcccagcgggggaagcugggcgacgggaaggagcacaccaaguccagcggcuucgggugguucuccugguuccgcagcaagcccaccaagaacgccuccccggcgggcgacgaggacagcuccgacagccccgacuccgaggagacgccccgggccagcagcccccaccaggccggccucgggcugucccugaccccgucccccgagagcccgccccuccccgacgugagcgccuucucccgcggccgcgggggcggcgaggggcggggcagcgccuccagcgggggcgcggccgccggggccggcgugggcgggcuguccggccccgagagcgucuccuucgagcugugcagcaaccccggggugcuccugcccccgcccgcgcugaagggcgccgugccccucuacaacccgucccaggucccccagcugcccaccgccaccagccugaaccggcccaaccgccucgcccagcggcgcuacccgacccagcccugcuga

SEQ ID NO: 36169 - RNA, 2298 nt, Artificial Sequence
  derived and/or modified sequence opt1 from SEC23A__Homo_sapiens__NP_006355
augaccaccuaccuggaguucauccagcagaacgaggagcgcgacggcgugcgguucagcuggaacgucuggcccuccagccgccucgaggccacgcggaugguggugccggucgccgcgcuguucacgccccugaaggagcgccccgaccugcccccgauccaguacgagcccgugcugugcucccggacgaccugccgcgccgugcugaacccccucugccaggucgacuaccgggccaagcugugggccugcaacuucugcuaccagcgcaaccaguucccgccgagcuacgccgggaucuccgagcugaaccagcccgcggagcuccugccccaguucagcuccaucgaguacguggugcugcggggcccccagaugccgcucaucuuccuguacgucguggacacgugcauggaggacgaggaccugcaggcccucaaggagagcaugcagaugucccugagccugcucccgcccaccgcccugguggggcugaucaccuucggccgcaugguccaggugcacgagcucgggugcgagggcaucuccaagagcuacguguuccggggcaccaaggaccuguccgccaagcagcugcaggagaugcucgggcugagcaaggucccccugacccaggcgacccgcggcccccaggugcagcagcccccgcccuccaaccgguuccuccagcccgugcagaagaucgacaugaaccugaccgaccugcucggggagcugcagcgcgaccccuggcccgucccccagggcaagcggccccugcgcagcuccgggguggcccucagcaucgccgugggccugcuggagugcaccuuccccaacaccggcgcccggaucaugauguucaucgggggccccgccacccaggggcccggcauggucgugggcgacgagcucaagaccccgauccgcuccuggcacgacaucgacaaggacaacgcgaaguacgugaagaaggggaccaagcacuucgaggcccuggccaaccgggccgccacgaccggccacgucaucgacaucuacgcgugcgcccuggaccagaccgggcuccuggagaugaagugcugccccaaccugaccggcggguacauggugaugggcgacagcuucaacacgagccucuucaagcagaccuuccagcgcgucuucaccaaggacaugcacggccaguucaagaugggguucggcgggacccuggagaucaagacgucccgggagaucaagaucagcggcgccaucgggcccugcgugucccugaacagcaagggcccgugcguguccgagaacgagaucggcaccgggggcacgugccaguggaagaucugcgggcucagccccaccaccacccuggccaucuacuucgaggucgugaaccagcacaacgcccccaucccccagggcgggcgcggcgcgauccaguucgugacccaguaccagcacuccagcggccagcgccggauccgcgucaccacgaucgcccggaacugggccgacgcccagacccagauccagaacaucgccgcguccuucgaccaggaggccgccgccauccugauggcgcgccucgccaucuaccgggccgagaccgaggaggggccggacgugcugcgcuggcuggaccggcagcugauccgccucugccagaaguucggcgaguaccacaaggacgaccccagcuccuuccgguucagcgagaccuucucccuguacccccaguucauguuccaccuccgccggagcuccuuccuccagguguucaacaacagccccgacgaguccagcuacuaccgccaccacuucaugcggcaggaccugacgcagucccugaucaugauccagccgauccucuacgccuacagcuucagcgggccgcccgagcccguccugcuggacuccagcuccauccucgccgaccgcauccugcugauggacaccuucuuccagauccucaucuaccacggcgagaccaucgcgcaguggcgcaagagcggcuaccaggacaugcccgaguacgagaacuuccggcaccuccugcaggcccccguggacgacgcccaggagauccugcacucccgguuccccaugccccgcuacaucgacaccgagcacgggggcagccaggcccgguuccugcuguccaaggugaacccgagccagacccacaacaacauguacgccugggggcaggaguccggcgcgcccauccucacggacgacgucagccuccagguguucauggaccaccugaagaagcuggccguguccagcgccgccuga

SEQ ID NO: 36170 - RNA, 2250 nt, Artificial Sequence
  derived and/or modified sequence opt1 from SEC23B__Homo_sapiens__NP_001166217
auggccaccuaccuggaguucauccagcagaacgaggagcgcgacggcgugcgguucagcuggaacgucuggcccuccagccgccucgaggccacccggaugguggugccgcuggcgugccugcucacgccccugaaggagcgccccgaccugcccccgguccaguacgagcccgugcucugcucccggcccacgugcaaggccgugcugaacccccugugccaggucgacuaccgcgccaagcucugggccugcaacuucugcuuccagcggaaccaguucccgcccgccuacgggggcaucagcgaggugaaccagcccgcggagcugaugccccaguucuccaccaucgaguacgugauccaggaggacgaccugcaggcccucaaggagagccugcagaugucccugagccuccugccgcccgacgcccuggucgggcucaucaccuucggccgcaugguccaggugcacgagcuguccugcgaggggaucagcaaguccuacguguuccggggcaccaaggaccugaccgccaagcagauccaggacaugcucggccugaccaagcccgcgaugcccaugcagcaggcccgcccggcccagccccaggagcaccccuucgccagcucccgguuccugcagcccgugcacaagaucgacaugaaccucaccgaccugcugggggagcuccagcgcgacccguggcccgugacgcagggcaagcggccccugcgcagcaccggggucgcccuguccaucgcggugggccuccuggaggggaccuuccccaacaccggcgcccggaucaugcuguucacgggcgggccgcccacccagggccccgggaugguggucggcgacgagcucaagauccccauccgcagcuggcacgacaucgagaaggacaacgcccgguucaugaagaaggccaccaagcacuacgagaugcuggccaaccgcaccgcggccaacggccacugcaucgacaucuacgccugcgcccuggaccagacggggcuccuggagaugaagugcugcgccaaccugaccggcggguacauggugaugggcgacuccuucaacaccagccucuucaagcagaccuuccagcggaucuucacgaaggacuucaacggggacuuccgcauggcguucggcgccacccuggacgugaagaccucccgggagcugaagaucgccggcgccaucgggccgugcgucagccucaacgugaagggccccugcgugagcgagaacgagcugggggucggcgggaccucccaguggaagaucugcggccuggaccccacgagcacccucggcaucuacuucgagguggucaaccagcacaacaccccgaucccccagggcgggcgcggggccauccaguucgugacccacuaccagcacuccagcacgcagcgccggauccgcgugaccaccaucgcgcggaacugggccgacguccagucccagcugcgccacaucgaggccgccuucgaccaggaggcggccgccgugcugauggcccggcucggcguguuccgcgccgagagcgaggaggggcccgacguccugcgguggcuggaccgccagcugauccggcucugccagaaguucggccaguacaacaaggaggaccccaccuccuuccgccugagcgacuccuucagccuguacccgcaguucauguuccaccuccggcgcucccccuuccuccagguguucaacaacagccccgacgaguccagcuacuaccggcaccacuucgcgcgccaggaccugacgcagucccugaucaugauccagcccauccuguacagcuacuccuuccacggcccgcccgagcccgugcugcucgacagcuccagcauccuggccgaccggauccugcucauggacaccuucuuccagaucgucaucuaccugggggagaccaucgcccaguggcgcaaggccggcuaccaggacaugcccgaguacgagaacuucaagcaccuccugcaggccccgcuggacgacgcgcaggagauccugcaggcccgguuccccaugccccgcuacaucaacaccgagcacgggggcagccaggcccgguuccuccuguccaaggugaaccccagccagacgcacaacaaccuguacgccuggggccaggagaccggggccccgauccucaccgacgacgugucccugcaggucuucauggaccaccugaagaagcucgcggugagcuccgccugcuga

SEQ ID NO: 36171 - RNA, 3003 nt, Artificial Sequence
  derived and/or modified sequence opt1 from SEC23IP__Homo_sapiens__NP_009121
auggccgagcgcaagcccaacggcgggagcggcggggccuccaccagcuccagcggcaccaaccuccucuucuccagcuccgcgacggaguucagcuucaacgugccguucauccccgucacccaggccuccgccagccccgccucccugcugcuccccggggaggacagcaccgacgugggcgaggaggacuccuuccugggccagaccagcauccacacguccgccccgcagaccuucagcuacuucucccaggugagcuccagcagcgaccccuucgggaacaucggccagagcccccugaccaccgcggccacguccgucgggcaguccggcuuccccaagccgcucaccgcccugcccuucaccaccgggagccaggacguguccaacgccuucagccccuccaucagcaaggcgcagcccggcgccccgcccuccagccugaugggcaucaacuccuaccuccccagccagcccuccagccugccgcccuccuacuucgggaaccagccccagggcaucccccagccgggguacaaccccuaccggcacacgcccggcagcucccgcgccaaccccuacaucgccccgccccagcugcagcagugccagacccccgggcccccggcccacccgccgcccagcggcccgcccgugcagauguaccagaugccgcccggcucccucccgcccguccccagcagcgugcagucccccgcgcagcagcagguccccgcccggcccggggcccccagcguccaggugcccucccccuuccugcugcagaaccaguacgagcccgugcagccccacugguucuacugcaaggaggucgaguacaagcagcucuggaugccguucagcguguucgacucccugaaccuggaggagaucuacaacagcgugcagcccgaccccgaguccgucgugcucggcaccgacgggggccgcuacgacguguaccuguacgaccggauccgcaaggccgccuacugggaggaggagcccgcggaggugcggcgcugcaccugguucuacaagggcgacacggacagccgguucauccccuacaccgaggaguucuccgagaagcuggaggccgaguacaagaaggccgugaccaccaaccaguggcaccgccggcuggaguuccccagcggggagacgaucgugaugcacaaccccaaggucaucgugcaguuccagcccuccagcgugccggacgaguggggcaccacccaggacgggcagacccgcccccgggucgugaagcgcggcaucgacgacaaccuggacgagauccccgacggggagaugccgcaggucgaccaccugguguucgugguccacggcaucggccccgugugcgaccuccgguuccgcuccaucaucgagugcguggacgacuuccgggucgugagccugaagcugcuccgcacgcacuucaagaagucccuggacgacgggaaggugagccgggucgaguuccugcccgugcacuggcacuccagccucggcggggacgccaccggcguggaccgcaacaucaagaagaucacccugcccagcaucgggcgguuccgccacuucaccaacgagacgcugcucgacauccuguucuacaacuccccgaccuacugccagaccaucgucgagaaggugggcauggagaucaaccaccuccacgcccuguucaugagccgcaaccccgacuucaagggcgggguguccgucgcgggccacagccuggggucccugauccucuucgacauccugagcaaccagaaggaccugaaccucuccaagugccccggcccccuggccguggccaacggcguggucaagcagcugcacuuccaggagaagcagaugccggaggagcccaagcucacccuggacgagagcuacgaccuggugguggagaacaaggagguccucacgcugcaggagacccuggaggcccugucccucagcgaguacuucuccaccuucgagaaggagaagaucgacauggagagccugcugaugugcaccguggacgaccucaaggagauggggaucccccugggcccccggaagaagaucgccaacuucguggagcacaaggcggccaagcugaagaaggccgccuccgagaagaaggcggucgccgccacgagcaccaaggggcaggagcaguccgcccagaagaccaaggacauggccagccucccguccgagagcaacgagcccaagcgcaagcugcccgugggcgcgugcguguccagcgucugcgugaacuacgagagcuucgaggugggggccggccaggucuccguggccuacaacagccuggacuucgagcccgagaucuucuucgcccucggcuccccgaucgccauguuccugaccauccgcgggguggaccggaucgacgagaacuacagccugccgaccugcaagggcuucuucaacaucuaccacccccucgaccccgucgcguaccggcuggagcccaugaucgugcccgaccuggaccucaaggccgugcugaucccccaccacaaggggcgcaagcggcugcaccucgagcugaaggagucccugagccgcaugggcuccgaccucaagcagggguucaucagcucccucaagagcgccuggcagacgcugaacgaguucgcccgggcccacaccuccagcacccagcugcaggaggagcuggagaaggucgcgaaccagaucaaggaggaggaggagaagcaggucguggaggccgagaaggugguggagucccccgacuucagcaaggacgaggacuaccugggcaaggugggcaugcucaacgggggccgccggaucgacuacguccugcaggagaagccgaucgaguccuucaacgaguaccuguucgcccuccagagccaccugugcuacugggaguccgaggacaccgcccugcuccugcugaaggagaucuaccgcacgaugaacaucagccccgagcagccccagcacuga

SEQ ID NO: 36172 - RNA, 1842 nt, Artificial Sequence
  derived and/or modified sequence opt1 from SEC24A__Homo_sapiens__NP_001239160
augagccagcccggcaucccggccuccgggggcgcccccgcgagccugcaggcccagaacggggccgcccucgccuccggcagccccuacaccaacgggcccgugcagaacgcgcugcuguccagccaggaguccgucagccagggcuacaacuuccagcucccgggcuccuacccccaccccauccccgccaagacccugaacccggugagcgggcaguccaacuacggcgggagccagggcuccgggcagacgcugaaccgcccgcccguggccagcaaccccgucacccccucccuccacagcggccccgcgccccggaugccccugccggccucccagaaccccgccaccacccccaugcccagcuccagcuuccugccggaggccaaccucccgccgccccugaacuggcaguacaacuaccccagcacggccucccagaccaaccacugcccccgcgccagcucccagcccaccgugagcggcaacaccucccugacgaccaaccaccaguacgugagcuccggguaccccagccuccagaacuccuucaucaagagcggccccuccgucccgccccuggugaacccgccccugcccaccaccuuccagcccggggcgccccacggcccgccgcccgccggcgggcccccgcccgugcgggcccucacgccccugaccagcuccuaccgcgacgucccccagccccuguucaacagcgccgugaaccaggagggcaucaccuccaacaccaacaacgggagcauggugguccacuccagcuacgacgagaucgagggcgggggccuccuggccacgccccagcugaccaacaagaaccccaagaugucccggagcgugggcuacagcuaccccucccucccgcccggguaccagaacaccaccccgcccggcgcgaccggggugccgcccagcucccugaacuaccccagcggcccccaggccuucacccagacgccccugggggccaaccaccucaccaccuccaugagcggccugucccugcagcccgagggccuccgcgucgugaaccugcugcaggagcggaacaugcuccccagcacgccccugaagccgcccgugcccaaccugcacgaggacauccagaagcucaacugcaaccccgagcuguuccgcugcacccugaccuccaucccccagacccaggcccuccugaacaaggccaagcugccccucgggcugcugcuccacccguucaaggaccugguccagcugcccguggugaccagcuccaccaucguccggugccgcagcugccggaccuacaucaaccccuucguguccuuccucgaccagcgccgguggaagugcaaccugugcuaccgcgugaacgacguccccgaggaguuccuguacaacccgcucacgcggguguacggcgagccccaccgccggcccgagguccagaacgcgaccaucgaguucauggcccccagcgaguacaugcugcgcccgccccagccgcccguguaccuguucguguucgacgucucccacaacgccguggagaccggguaccugaacagcgugugccagucccuccuggacaaccuggaccuccugcccggcaacacccggacgaagaucggguucaucaccuucgacagcaccauccacuucuacggccugcaggagagccucucccagccccagaugcugaucgucagcgacaucgaggacguguucauccccaugcccgagaaccugcucgugaaccugaacgaguccaaggagagcgucaucggcguguccagcgaggagacccugaucacgugccucgagaucgccaugcgcuga

SEQ ID NO: 36173 - RNA, 3702 nt, Artificial Sequence
  derived and/or modified sequence opt1 from SEC24B__Homo_sapiens__NP_001036199
augagcgcccccgccggcuccagccacccggcggccuccgcccgcaucccgcccaaguucgggggcgccgccgugagcggggcggccgcccccgccggccccggggcgggccccgcgccccaccagcagaacggccccgcccagaaccagaugcaggucccguccggguacggccugcaccaccagaacuacaucgcccccagcgggcacuacucccagggccccgggaagaugaccagccucccccuggacacccagugcggcgacuacuacuccgcccuguacacggugccgacccagaacgugacccccaacaccgucaaccagcagcccggcgcccagcagcucuacagccgggggcccccggcgccccacaucgugggcuccacgcuggggagcuuccagggcgccgccuccagcgccucccaccuccacaccagcgccucccagcccuacagcuccuucgugaaccacuacaacagccccgccauguacagcgccuccagcuccgucgccagccagggcuucccguccacgugcgggcacuacgccaugagcaccguguccaacgcggccuaccccagcguguccuaccccagccugcccgccggcgacaccuacgggcagauguucaccucccagaacgccccgaccguccgccccgugaaggacaacagcuucuccggccagaacaccgccaucagccaccccagcccccugccgccccugcccucccagcagcaccaccagcagcagucccucagcggguacuccacgcugaccuggagcagcccgggccugcccuccacccaggacaaccucauccggaaccacaccggcagccuggcgguggccaacaacaaccccacgaucaccgucgccgacucccugagcugccccgugaugcagaacgugcagccgcccaaguccagccccgucguguccaccgugcucagcggguccagcggcuccagcuccacccgcacgcccccgaccgccaaccaccccgucgagcccgugaccagcgugacccagcccuccgagcugcugcagcagaagggggucgacagcuccagcacgaccagcuccgcgagcccgaugcccaacuccuacgacgcccucgagggcgggagcuaccccgacaugcuguccagcuccgccagcucccccgccccggaccccgcccccgagcccgacccggcgagcgcccccgcccccgccuccgcccccgcgccgguggugccccagcccagcaagauggccaagccguucggcuacggcuaccccacccugcagcccggguaccagaacgccaccgcgccccucaucuccggcguccagccgagcaaccccguguacuccggguuccagcaguacccccagcaguaccccggcgucaaccagcugagcuccagcaucgggggccugucccuccagagcagcccgcagcccgagucccugcggcccgugaaccugacgcaggagcgcaacauccuccccaugaccccggugugggcccccguccccaaccugaacgccgaccugaagaagcucaacugcagccccgacuccuuccggugcacccugaccaacaucccgcagacgcaggcccugcucaacaaggccaagcugccccugggccuccugcugcaccccuuccgcgaccucacccagcugcccgugaucaccagcaacaccaucgugcggugccgcuccugccggacguacaucaacccguucgucagcuucaucgaccagcgccgguggaagugcaaccugugcuaccgcgugaacgacgugcccgaggaguucauguacaacccccucacccgguccuacggggagccccacaagcgcccggagguccagaacagcaccguggaguucaucgccuccagcgacuacaugcugcggccgccccagcccgcgguguaccuguucguccucgacgugucccacaacgccguggaggccggcuaccugaccauccugugccagagccuccuggagaaccuggacaagcugcccggggacucccgcacccggaucggcuucaugacguucgacagcaccauccacuucuacaaccuccaggagggccugucccagccccagaugcugaucgucagcgacaucgacgacguguuccuccccaccccggacucccugcuggugaaccucuacgagagcaaggagcugaucaaggaccugcucaacgcccugcccaacauguucaccaacacgcgcgagacccacuccgcccuggggcccgcgcuccaggccgccuucaagcugaugagccccaccggcgggcgggucagcguguuccagacccagcugccgucccucggcgccgggcugcugcagagccgcgaggaccccaaccagcgcuccagcacgaaggugguccagcaccucggccccgccaccgacuucuacaagaagcuggcgcuggacugcuccggccagcagaccgccguggaccucuuccugcugagcucccaguacagcgaccucgccucccuggccugcaugagcaaguacuccgccgggugcaucuacuacuaccccagcuuccacuacacccacaacccgucccaggcggagaagcugcagaaggaccucaagcgguaccugacgcgcaagaucggcuucgaggccgugaugcggauccgcugcaccaaggggcugagcaugcacaccuuccacggcaacuucuucguccgguccaccgaccuccugagccuggccaacaucaaccccgacgccggguucgcggugcagcucuccaucgaggagagccugacggacaccucccuggugugcuuccagaccgcccuccuguacaccagcagcaagggcgagcgccggauccgcguccacacgcugugccuccccgugguguccagccuggccgacgucuacgccggcguggacgugcaggccgcgaucugccugcucgccaacauggccgucgaccgguccgugagcuccagccuguccgacgcccgcgacgcccuggugaacgcggucguggacagccucuccgccuacgggagcaccguguccaaccugcagcacagcgcccugauggcccccuccagccucaagcuguucccgcuguacguccucgcccugcugaagcagaaggcguuccggaccggcaccuccacgcgccucgacgaccggguguacgccaugugccagaucaagagccagccccuggugcaccugaugaagaugauccaccccaaccucuaccgcaucgaccggcugaccgacgagggggccguccacgugaacgaccgcaucgugccccagccgccccugcagaagcucuccgccgagaagcugacccgggagggcgccuuccugauggacugcgggagcgucuucuacaucugggugggcaagggcugcgacaacaacuucaucgaggacgugcucggguacaccaacuucgcguccaucccccagaagaugacgcaccuccccgagcuggacacccugagcagcgagcgcgcccgguccuucaucaccuggcugcgcgacagccgcccgcugucccccauccuccacaucgucaaggacgagagccccgccaaggccgaguucuuccagcaccugaucgaggaccggaccgaggcggccuucuccuacuacgaguuccugcuccacgugcagcagcagaucugcaaguga

SEQ ID NO: 36174 - RNA, 3285 nt, Artificial Sequence
  derived and/or modified sequence opt1 from SEC24C__Homo_sapiens__NP_940999
augaacgugaaccagagcguccccccggugccccccuucggccagccccagccgaucuaccccggguaccaccaguccagcuacggcgggcaguccggcagcaccgcccccgccauccccuacggggcguacaacggcccggugcccggcuaccagcagacccccccccaggggaugucccgcgccccgcccagcuccggcgccccccccgccagcacggcccaggcgccgugcgggcaggccgccuacggccaguucgggcagggcgacguccagaacggccccuccagcaccgugcagaugcagcggcugcccgggucccagcccuucggcagcccgcucgcccccguggggaaccagccccccguccugcagccguacggccccccccccaccuccgcgcagguggccacccagcugagcggcaugcagaucuccggggccguggccccggccccccccagcuccggccucggguucggcccgcccacgagccuggcguccgccagcgggagcuuccccaacuccggccuguacggcagcuacccccaggggcaggccccgccccucucccaggcccagggccaccccgggauccagaccccccagcgcagcgccccgucccaggcgagcuccuucaccccccccgccagcggcgggccccggcugccguccaugaccggcccccugcuccccggccagagcuucgggggccccuccgucagccagccgaaccacguguccagccccccccaggcccugcccccggggacgcagaugaccggcccccuggggccccuccccccgaugcacuccccccagcagcccggcuaccagccgcagcagaacggcagcuucgggcccgcccgcggcccccaguccaacuacgggggccccuacccggccgcgcccaccuucggcagccagcccgggcccccgcagccccugccccccaagcggcuggacccggacgccauccccucccccauccaggugaucgaggacgaccgcaacaaccggggcaccgagcccuucgucacgggggugcgcggccaggugccgccccucgucaccaccaacuuccuggugaaggaccaggggaacgccagcccccgguacauccgcugcaccagcuacaacauccccugcacguccgacauggccaagcaggcccaggugccgcuggcggccgucaucaagccccucgcccggcugccccccgaggaggccagcccguacgugguggaccacggcgaguccggcccccugcgcugcaaccggugcaaggcguacaugugccccuucaugcaguucaucgaggggggccgccgguuccagugcugcuucugcagcugcaucaacgacguccccccgcaguacuuccagcaccucgaccacaccgggaagcgcguggacgccuacgaccggcccgagcugucccugggcagcuacgaguuccucgccaccguggacuacugcaagaacaacaaguuccccuccccgcccgccuucaucuucaugaucgacgucagcuacaacgccauccgcaccgggcuggugcggcugcucugcgaggagcugaagucccugcucgacuuccugccccgcgagggcggcgcggaggagagcgccauccgggucggguucgugacguacaacaaggugcugcacuucuacaacgucaaguccagccucgcccagccccagaugauggugguguccgacgucgccgacauguucgugccgcugcuggacggcuuccucgugaacgucaacgagagccgcgccgugaucaccucccugcuggaccagauccccgagauguucgcggacacccgcgagaccgagacgguguucguccccgugauccaggccgggauggaggcccucaaggccgccgagugcgcgggcaagcuguuccuguuccacaccagccuccccaucgccgaggccccggggaagcugaagaaccgggacgaccgcaagcugaucaacaccgacaaggagaagacccucuuccagccccagacgggcgccuaccagacccuggcgaaggagugcguggcccagggcugcugcgucgaccuguuccucuuccccaaccaguacguggacguggccacccuguccgucgugccccagcugaccgggggcagcguguacaaguacgccagcuuccaggucgagaacgaccaggagcgguuccuguccgaccuccgccgggacgugcagaagguggucggguucgacgccgugaugcgcgugcggacgagcaccggcauccgcgcggucgacuucuucggggccuucuacauguccaacaccaccgacguggagcuggccggccuggacggcgacaagacggugaccgucgaguucaagcacgacgaccggcucaacgaggagagcggggcccugcugcagugcgcccuccuguacaccuccugcgcgggccagcgccggcugcgcauccacaaccucgcccugaacugcugcacccagcuggccgaccucuaccggaacugcgagaccgacacgcugaucaacuacauggccaaguucgccuaccgcggggugcugaacagcccggugaaggcgguccgggacacccucaucacccagugcgcccagauccuggccugcuaccgcaagaacugcgccucccccagcuccgcgggccagcugauccuccccgagugcaugaagcugcugcccguguaccucaacugcgugcugaagagcgacguccugcagccgggcgccgaggugaccacggacgaccgggccuacgugcgccagcucgucaccuccauggacgugaccgagaccaacguguucuucuacccccggcugcugccccucacgaagagccccgucgaguccaccaccgagccgcccgccgugcgcgccagcgaggagcgccuguccaacggggacaucuaccugcucgagaacggccugaaccuguuccucugggugggggcgagcguccagcagggcguggugcagucccuguucagcgucuccagcuucagccagaucaccuccgggcugagcgugcuccccgugcuggacaacccccuguccaagaagguccggggccucaucgacagccugcgcgcccagcggucccgcuacaugaagcugacgguggucaagcaggaggacaagauggagaugcucuucaagcacuuccugguggaggacaagagccuguccggcggggccagcuacguggacuuccucugccacaugcacaaggagauccggcagcugcuguccuga

SEQ ID NO: 36175 - RNA, 3321 nt, Artificial Sequence
  derived and/or modified sequence opt1 from SEC31A__Homo_sapiens__NP_001070674
augaagcugaaggagguggaccgcaccgccaugcaggccuggagccccgcgcagaaccacccgaucuaccucgccaccggcacguccgcccagcagcuggacgccaccuucagcaccaacgccucccuggagaucuucgagcucgaccugagcgaccccucccuggacaugaaguccugcgcgaccuucuccagcucccaccgguaccacaagcucaucugggggcccuacaagauggacagcaagggcgacgucuccggggugcugaucgccggcggggagaacggcaacaucauccuguacgaccccagcaagaucaucgccggcgacaaggagguggucaucgcccagaacgacaagcacacggggccggugcgcgcgcucgacgugaacaucuuccagaccaaccuggucgccuccggcgccaacgagagcgagaucuacaucugggaccugaacaacuucgccacccccaugacccccggggccaagacgcagcccccggaggacaucuccugcaucgcguggaaccgccaggugcagcacauccucgccagcgccucccccagcggccgggccaccgugugggaccugcggaagaacgagcccaucaucaaggucuccgaccacagcaaccgcaugcacugcagcgggcuggccuggcaccccgacguggcgacccagauggugcucgccuccgaggacgaccggcugccggucauccagaugugggaccugcgcuucgccagcagcccccuccgggugcuggagaaccacgcccgcggcauccuggccaucgcguggagcauggccgaccccgagcuccugcuguccugcggcaaggacgccaagauccucugcagcaaccccaacaccggggaggugcuguacgagcugccgacgaacacccaguggugcuucgacauccaguggugcccccggaaccccgccguccucuccgccgcgagcuucgacggccgcaucuccguguacagcaucaugggcggguccaccgacggccugcggcagaagcaggucgacaagcugagcuccagcuucgggaaccucgaccccuucggcaccgggcagccgcugccgccccugcagaucccccagcagacggcccagcacuccaucgugcucccccugaagaagccgcccaaguggauccgccggcccgugggcgccagcuucuccuucgggggcaagcuggugaccuucgagaacguccgcaugcccagccaccagggcgccgagcagcagcagcagcagcaccacguguucaucucccagguggucaccgagaaggaguuccucagccggagcgaccagcugcagcaggcggugcagucccagggguucaucaacuacugccagaagaagaucgacgccagccagaccgaguucgagaagaacgucugguccuuccugaaggugaacuucgaggacgacagccgcggcaaguaccucgagcugcugggguaccggaaggaggaccucggcaagaagaucgcccuggcccugaacaagguggacggggccaacgucgcgcucaaggacuccgaccagguggcccagagcgacggcgaggagucccccgccgccgaggagcagcugcugggcgagcacaucaaggaggagaaggaggagagcgaguuccuccccuccagcgggggcacguucaacaucuccgugagcggggacaucgacggccugaucacccaggcccugcugaccgggaacuucgaguccgcggucgaccucugccugcacgacaaccgcauggccgacgccaucauccuggccaucgccggcggccaggagcuccuggcgcggacccagaagaaguacuucgccaagagccaguccaagaucacgcgccugaucaccgccguggugaugaagaacuggaaggagaucgucgagagcugcgaccucaagaacuggcgcgaggcccuggcggccgugcugaccuacgccaagccggacgaguucuccgcccucugcgaccugcuggggacccggcucgagaacgagggcgacagccugcugcagacgcaggccugccucugcuacaucugcgcggggaacguggagaagcuggucgccugcuggaccaaggcccaggacggcagccacccccugucccuccaggaccugaucgagaagguggugauccugcgcaaggccguccagcucacccaggccauggacaccagcacggugggcgugcugcuggcggccaagaugucccaguacgccaaccuccuggccgcccaggggagcaucgcggccgcccuggccuuccuccccgacaacaccaaccagcccaacaucaugcagcugcgggaccgccugugccgggcgcagggcgagccggucgccgggcacgagucccccaagauccccuacgagaagcagcagcuccccaagggccgcccggggcccguggccggccaccaccagaugccccgggugcagacccagcaguacuacccccacggcgagaacccgcccccgcccggguucaucaugcacggcaacgucaaccccaacgccgccgggcagcugcccaccagccccggccacaugcacacccaggugcccccguacccccagccccagcgcccccagaacggguggaacgacccgcccgcgcugaaccgggugcccaagaagaagaagaugccggagaacuucaugccgcccguccccaucacgucccccaucaugaacccccucggcgacccccagagccagaugcugcagcagcagcccuccgccccggugccccugagcucccagagcuccuucccccagccccaccucccgggcgggcagcccuuccacggcgugcagcagccccuggggcagaccggcaugcccccgagcuucuccaagcccaacaucgagggggcccccggcgcccccaucggcaacaccuuccagcacguccagagccugccgaccaagaagaucacgaagaagcccauccccgacgagcaccucauccugaagaccaccuucgaggaccugauccagcgcugccucuccagcgccaccgacccccagacgaagcggaagcuggacgacgcguccaagcgccuggaguuccucuacgacaagcugcgggagcagacccugagcccgaccaucaccagcgggcuccacaacaucgcccgcuccaucgagacgcggaacuacagcgagggccugaccaugcacacccacaucguguccaccagcaacuucuccgagacgagcgccuucaugcccgugcugaaggucgugcucacccaggccaacaagcuggggguguga

SEQ ID NO: 36176 - RNA, 1431 nt, Artificial Sequence
  derived and/or modified sequence opt1 from SEC61A1__Homo_sapiens__NP_037468
auggccaucaaguuccuggaggugaucaagcccuucugcgucauccucccggagauccagaagcccgagcgcaagauccaguucaaggagaaggugcuguggaccgccaucacccuguucaucuuccucgugugcugccagaucccccuguucggcaucaugagcuccgacagcgcggaccccuucuacuggaugcgggucauccuggccuccaaccgcgggacgcucauggagcugggcaucagcccgaucgugaccuccgggcugaucaugcagcuccuggccggcgccaagaucaucgaggugggggacacccccaaggaccgggcccuguucaacggcgcgcagaagcuguucggcaugaucaucaccaucgggcagagcaucgucuacgugaugacgggcauguacggggaccccuccgagaugggcgccgggaucugccugcugaucaccauccagcuguucguggccggccucaucguccugcuccuggacgagcugcuccagaagggcuacgggcugggcagcgggaucucccuguucaucgccaccaacaucugcgagaccaucguguggaaggcguucagccccacgaccgugaacaccggccgcggcauggaguucgagggggccaucaucgcccucuuccaccuccuggccacccggacggacaagguccgcgcccuccgggaggcguucuaccgccagaaccugccgaaccugaugaaccucaucgccaccaucuucguguucgccguggucaucuacuuccagggcuuccggguggaccugcccaucaaguccgcccgcuaccgggggcaguacaacaccuaccccaucaagcuguucuacaccagcaacauccccaucauccuccaguccgcccuggugagcaaccuguacgucaucucccagaugcucagcgcgcgcuucuccggcaaccugcuggugagccuccuggggacgugguccgacaccagcagcggcggcccggcccgggccuaccccgucgggggccugugcuacuaccucuccccgcccgagagcuucggguccgugcuggaggaccccgugcacgccguggucuacaucguguucaugcugggcagcugcgccuucuucuccaagaccuggaucgaggucagcggguccagcgcgaaggacguggccaagcagcucaaggagcagcagauggugaugcgcggccaccgggagaccuccaugguccacgagcugaaccgcuacauccccacggccgccgccuucggcgggcugugcaucggcgcgcucagcgugcuggccgacuuccugggggccaucggcuccgggaccggcauccugcucgccgugaccaucaucuaccaguacuucgagaucuucgucaaggagcagagcgaggugggcuccaugggggcgcugcuguucuga

SEQ ID NO: 36177 - RNA, 207 nt, Artificial Sequence
  derived and/or modified sequence opt1 from SEC61G__Homo_sapiens__NP_055117
auggaccaggugaugcaguucguggagcccagccgccaguucgugaaggacuccauccggcuggugaagcgcugcaccaagccggaccggaaggaguuccagaagaucgccauggccaccgcgaucggcuucgccaucaugggguucaucggcuucuucgucaagcucauccacauccccaucaacaacaucaucgucgggggcuga

SEQ ID NO: 36178 - RNA, 1200 nt, Artificial Sequence
  derived and/or modified sequence opt1 from SEC62__Homo_sapiens__NP_003253
auggccgagcgccggcgccacaagaagcggauccaggaggugggcgagcccagcaaggaggagaaggccgucgcgaaguaccugcgcuucaacugcccgaccaaguccaccaacaugauggggcaccggguggacuacuucaucgccagcaaggccguggacugccuccuggacuccaagugggccaaggccaagaagggcgaggaggcgcuguucacgacccgcgagagcgucguggacuacugcaaccggcuccugaagaagcaguucuuccaccgcgcccugaaggugaugaagaugaaguacgacaaggacaucaagaaggagaaggacaaggggaaggccgaguccggcaaggaggaggacaagaaguccaagaaggagaacaucaaggacgagaagaccaagaaggagaaggagaagaagaaggacggggagaaggaggagagcaagaaggaggagacccccggcacgcccaagaagaaggagaccaagaagaaguucaagcucgagccccacgacgaccaggucuuccuggacggcaacgagguguacguguggaucuacgacccgguccacuucaagaccuucgugauggggcugauccucgugaucgccgucaucgcggccacccuguucccccuguggcccgccgagaugcgggugggcguguacuaccucagcgucggggccggcugcuucguggccuccauccugcugcucgcgguggcccgcugcauccuguuccugaucaucuggcucaucaccgggggccggcaccacuucugguuccugcccaaccugacggccgacgucggcuucaucgacagcuuccgcccgcucuacacccacgaguacaaggggcccaaggccgaccugaagaaggacgagaaguccgagaccaagaagcagcagaaguccgacagcgaggagaaguccgacagcgagaagaaggaggacgaggagggcaagguggggcccggcaaccacggcacggaggggagcggcggggagcggcacuccgacaccgacagcgaccgccgggaggacgaccgcucccagcacagcagcggcaacgggaacgacuucgagaugaucaccaaggaggagcuggagcagcagaccgacggcgacugcgaggaggacgaggaggaggagaacgacggcgagacgcccaaguccagccacgagaaguccuga

SEQ ID NO: 36179 - RNA, 2283 nt, Artificial Sequence
  derived and/or modified sequence opt1 from SEC63__Homo_sapiens__NP_009145
auggccggccagcaguuccaguacgacgacagcgggaacaccuucuucuacuuccugaccuccuucgugggccucaucgucauccccgccacguacuaccuguggccgcgcgaccagaacgcggagcagauccggcugaagaacauccgcaagguguacgggcggugcaugugguaccgccuccggcugcugaagccccagcccaacaucauccccaccgugaagaagaucguccuccuggccggcugggcccuguuccucuuccuggccuacaaggugagcaagaccgaccgcgaguaccaggaguacaacccguacgaggugcugaaccucgaccccggggccaccgucgcggagaucaagaagcaguaccggcugcugucccucaaguaccaccccgacaagggcggcgacgaggugauguucaugcgcaucgccaaggccuacgccgcgcugacggacgaggagagccggaagaacugggaggaguucgggaaccccgacggcccgcaggccaccuccuucgggaucgcccugcccgccuggaucguggaccagaagaacagcauccucguccugcugguguacggccucgccuucauggugauccugcccgucguggugggguccuggugguaccgcagcauccgguacuccggcgaccagauccugauccgcaccacccagaucuacacguacuucgucuacaagacccggaacauggacaugaagcgccucaucauggugcuggcgggcgccagcgaguucgacccccaguacaacaaggacgccaccucccggccgaccgacaacauccugaucccccagcucauccgcgagaucgggagcaucaaccugaagaagaacgagccgccccugacgugccccuacucccucaaggcccgggugcugcugcucagccaccuggcccgcaugaagauccccgagacccuggaggaggaccagcaguucaugcucaagaagugccccgcgcugcugcaggagauggucaacgugaucugccagcucaucgugauggcccggaaccgcgaggagcgggaguuccgcgcccccacccuggccucccuggagaacugcaugaagcucagccagauggccguccagggccugcagcaguucaaguccccgcugcuccagcugccccacaucgaggaggacaaccugcgccgggugagcaaccacaagaaguacaagaucaagaccauccaggaccucgugucccugaaggagagcgaccgccacacgcugcugcacuuccucgaggacgagaaguacgaggaggucauggcggugcuggggagcuuccccuacgucaccauggacaucaagucccaggugcuggacgacgaggacagcaacaacaucaccgugggcucccucgucaccgugcuggugaagcugacgcggcagaccauggccgaggucuucgagaaggagcagagcaucugcgccgccgaggagcagcccgccgaggacggccagggggagaccaacaagaaccgcaccaagggcggguggcagcagaaguccaagggcccgaagaagacggccaagagcaagaagaagaagccccucaagaagaagcccacccccgugcugcugccgcaguccaagcagcagaagcagaagcaggcgaacgggguggucggcaacgaggccgccgugaaggaggacgaggaggaggugagcgacaagggcuccgacagcgaggaggaggagaccaaccgggacucccagagcgagaaggacgacggguccgaccgcgacagcgaccgggagcaggacgagaagcagaacaaggacgacgaggcggaguggcaggagcuccagcaguccauccagcgcaaggagcgggcccugcuggagaccaagagcaagaucacgcaccccgucuacucccucuacuuccccgaggagaagcaggaguggugguggcuguacaucgccgaccgcaaggagcagacccugaucagcaugccguaccacgugugcacccucaaggacaccgaggagguggagcugaaguuccccgcccccggcaagcccgggaacuaccaguacacggucuuccugcgguccgacagcuacaugggccucgaccagaucaagccgcugaagcuggaggugcacgaggccaagcccgugcccgagaaccacccccagugggacaccgcgaucgagggggacgaggaccaggaggacagcgagggcuucgaggacuccuucgaggaggaggaggaggaggaggaggacgacgacuga

SEQ ID NO: 36180 - RNA, 2565 nt, Artificial Sequence
  derived and/or modified sequence opt1 from SECISBP2__Homo_sapiens__NP_076982
auggccagcgagggcccccgcgagccggaguccgaggggaucaagcugagcgccgacgugaagcccuucgucccccgguucgcgggccucaacguggccuggcuggaguccagcgaggccugcguguuccccuccagcgccgccaccuacuacccguucguccaggagccgcccgugaccgagcagaagaucuacacggaggacauggcguucggggccuccaccuucccgccccaguaccugagcuccgagaucacccuccaccccuacgccuacagccccuacacccuggacuccacgcagaacguguacagcguccccggcucccaguaccuguacaaccagcccagcugcuaccgcggguuccagaccgugaagcaccggaacgagaacacgugcccccucccccaggagaugaaggcccuguucaagaagaagaccuacgacgagaagaagaccuacgaccagcagaaguucgacuccgagcgcgcggacggcaccaucagcuccgagaucaagagcgcccggggcucccaccaccugagcaucuacgccgagaacagccucaaguccgacggguaccacaagcgcaccgaccgcaagagccggaucaucgccaagaacguguccaccagcaagcccgaguucgaguucacgacccuggacuucccggagcugcagggcgccgagaacaacauguccgagauccagaagcagcccaagugggggcccguccacagcguguccaccgacaucagccuccugcgggagguggucaagcccgcggccgugcuguccaagggcgagaucguggucaagaacaacccgaacgagagcgugaccgccaacgccgccacgaacucccccagcugcacccgcgagcucuccuggacccccaugggguacgugguccggcagacccugagcacggagcuguccgcggcccccaagaacgugaccagcaugaucaaccucaagaccaucgccuccagcgccgacccgaagaacguguccauccccagcagcgaggcccuguccagcgaccccuccuacaacaaggagaagcacaucauccaccccacccagaaguccaaggcgagccagggcagcgaccuggagcagaacgaggccucccgcaagaacaagaagaagaaggagaaguccacgagcaaguacgagguccucaccgugcaggagccgccccggaucgaggacgccgaggaguuccccaaccuggccguggccagcgagcgccgggaccgcaucgagaccccgaaguuccaguccaagcagcagccccaggacaacuucaagaacaacgucaagaagucccagcugcccgugcagcucgaccugggcgggaugcugaccgcgcucgagaagaagcagcacagccagcacgccaagcagagcuccaagcccgucguggugagcgucggcgccgugccggugcuguccaaggagugcgccagcggggagcggggccgccggaugagccagaugaagacgccccacaacccccuggacuccagcgcgccccucaugaagaagggcaagcagcgcgagaucccgaaggccaagaagcccaccucccugaagaagaucauccugaaggagcggcaggagcgcaagcagcgccuccaggagaacgccgucagccccgccuucaccuccgacgacacccaggacggggagagcggcggggacgaccaguuccccgagcaggccgagcuguccggcccggaggggauggacgagcugaucagcacgcccuccguggaggacaagagcgaggagccgcccggcaccgagcuccagcgggacaccgaggcgucccaccuggcccccaaccacaccacguuccccaagauccacagccgccgguuccgcgacuacugcucccagaugcugagcaaggagguggacgccugcgucaccgaccuccugaaggagcuggugcgguuccaggaccgcauguaccagaaggaccccgugaaggccaagaccaagcggcgccucguccugggccugcgggaggugcucaagcaccugaagcugaagaagcucaagugcgugaucaucucccccaacugcgagaagauccagagcaagggcgggcuggacgacacccugcacaccaucaucgacuacgccugcgagcagaacaucccguucgucuucgcgcugaaccgcaaggcccucgggcggucccugaacaaggccgugcccgugagcgucgugggcaucuucuccuacgacggggcccaggaccaguuccacaagaugguggagcugacggucgccgcgcgccaggccuacaagaccaugcucgagaacgugcagcaggagcuggugggcgagccccggccccaggccccgcccagccugcccacccagggcccgagcugccccgccgaggacgggccgcccgcgcucaaggagaaggaggagccccacuacaucgagaucuggaagaagcaccuggaggccuacuccggcugcacccuggagcucgaggagagccuggaggccuccacgagccagaugaugaaccugaaccucuga

SEQ ID NO: 36181 - RNA, 3306 nt, Artificial Sequence
  derived and/or modified sequence opt1 from SECISBP2L__Homo_sapiens__NP_001180418
auggaccgcgcccccaccgagcagaacgugaagcugagcgccgaggucgagccguucaucccccagaagaagucccccgacaccuucaugauccccauggcgcucccgaacgacaacggcagcguguccgggguggagcccacgcccauccccagcuaccugaucacgugcuacccguucguccaggagaaccaguccaaccggcaguucccccuguacaacaacgacauccgcuggcagcagcccaaccccaacccgaccggccccuacuucgccuaccccaucaucagcgcccagcccccgguguccaccgaguacaccuacuaccagcucaugcccgcccccugcgcccaggugaugggguucuaccaccccuucccgacccccuacagcaacaccuuccaggcggccaacaccgucaacgccaucacgaccgagugcaccgagcggcccucccagcugggccagguguucccccugagcucccaccgcagccggaacuccaaccgcgggagcguggucccgaagcagcagcuccugcagcagcacaucaaguccaagcggccccuggugaagaacguggccacccagaaggagacgaacgcggccggccccgacagccgcuccaagaucguccuccugguggacgccagccagcagaccgacuuccccuccgacaucgccaacaagagccugagcgagaccaccgccacgaugcucuggaaguccaagggccggcgccggcgcgcgagccacccgaccgccgaguccagcuccgagcagggggccagcgaggccgacaucgacuccgacagcggcuacugcucccccaagcacagcaacaaccagcccgccgcgggggcccugcggaacccggacuccggcaccaugaaccacguggagagcuccaugugcgccgggggcgucaacuggagcaacgugaccugccaggccacgcagaagaagcccuggauggagaagaaccagaccuucucccgcggcgggcggcagaccgagcagcgcaacaacagccaggugggcuuccggugccgcgggcacuccaccagcuccgagcggcgccagaaccugcagaagcggcccgacaacaagcaccucagcagcucccagagccaccgcuccgaccccaacagcgagucccuguacuucgaggacgaggacggcuuccaggagcugaacgagaacggcaacgccaaggacgagaacauccagcagaagcucagcuccaagguccuggacgaccugccggagaacagccccaucaacaucgugcagacgcccauccccaucaccaccuccgugccgaagcgcgccaagagccagaagaagaaggcgcucgccgccgcccuggcgaccgcccaggaguacuccgagaucagcauggagcagaagaagcugcaggaggcccucuccaaggccgcggggaagaagaacaagacgcccguccagcuggaccugggcgacaugcucgccgcccuggagaagcagcagcaggccaugaaggcccggcagaucaccaacacccgcccccugagcuacaccguggugacggcggccuccuuccacaccaaggacagcaccaaccggaagccccucaccaagucccagccgugccugacgagcuucaacagcgucgacaucgccuccagcaaggccaagaaggggaaggagaaggagaucgccaagcugaagcgccccaccgcgcucaagaaggugauccugaaggagcgggaggagaagaagggccgccugaccgucgaccacaaccuccugggguccgaggagcccaccgagaugcaccuggacuucaucgacgaccucccccaggagaucgugagccaggaggacaccggccuguccaugccgagcgacacgucccugagccccgccucccagaacagccccuacugcaugacccccgugucccagggcagcccggccuccagcgggaucggcucccccauggccagcuccaccaucaccaagauccacagcaagcgguuccgcgaguacugcaaccagguccucugcaaggagaucgacgagugcgugacgcugcugcuccaggagcugguguccuuccaggagcggaucuaccagaaggaccccguccgcgccaaggcgcggcgccggcuggugauggggcuccgcgaggugaccaagcacaugaagcugaacaagaucaagugcgucaucaucagccccaacugcgagaagauccagagcaagggcgggcuggacgaggcccuguacaacgugaucgccauggcccgggagcaggagaucccguucguguucgcgcucggccgcaaggcccugggccggugcgucaacaagcuggugcccguguccgucguggggaucuucaacuacuucggcgccgagagccucuucaacaagcugguggagcugaccgaggaggcccgcaaggccuacaaggacauggucgcggccauggagcaggagcaggccgaggaggcccucaagaacgugaagaaggugccccaccacauggggcacucccggaacccgagcgccgcguccgccaucagcuucugcuccgucaucagcgagcccaucuccgaggugaacgagaaggaguacgagaccaacuggcgcaacaugguggagacgagcgacggccuggaggccuccgagaacgagaaggaggucagcugcaagcacuccaccagcgagaagcccuccaagcugcccuucgacaccccgcccaucgggaagcagcccagccucguggccaccggcuccacgaccagcgccaccuccgcgggcaagagcaccgccagcgacaaggaggaggugaagcccgacgaccuggagugggccucccagcagagcacggagaccgggucccuggacggcagcugccgcgaccuccugaacuccagcaucaccuccaccacgagcacccuggucccggggaugcucgaggaggaggaggacgaggacgaggaggaggaggaggacuacacccacgagcccaucuccguggaggugcagcugaacagccggaucgaguccugggucagcgagacccagcgcacgauggagacccugcagcucggcaagacccugaacggcuccgaggaggacaacguggagcagagcggggaggaggaggccgaggcgcccgaggugcuggagcccggcauggacuccgaggccuggaccgccgaccagcaggccagcccggggcagcagaaguccagcaacugcuccagccucaacaaggagcacagcgacuccaacuacacgacccagaccaccuga

SEQ ID NO: 36182 - RNA, 747 nt, Artificial Sequence
  derived and/or modified sequence opt1 from SECTM1__Homo_sapiens__NP_002995
augcagaccugcccccuggccuucccgggccacgugucccaggcccucgggacccugcuguuccucgcggccucccugagcgcccagaacgagggcugggacucccccaucugcaccgagggggucgugagcguguccuggggcgagaacaccgucaugagcugcaacaucuccaacgccuucagccacgugaacaucaagcugcgcgcccacgggcaggaguccgcgaucuucaacgagguggcccccggcuacuucagccgggacggcuggcagcuccagguccagggcgggguggcccagcuggugaucaagggggcccgcgacucccacgcgggccuguacauguggcaccucgucgggcaccagcggaacaaccgccaggugacccuggaggugagcggcgccgagccccaguccgccccggacaccggcuucuggcccguccccgccguggugacggccgucuucauccugcucguggcgcuggugauguucgccugguaccggugccgcugcagccagcagcggcgcgagaagaaguucuuccugcucgagccccagaugaaggucgccgcccugcgggccggggcgcagcagggccugucccgcgccagcgccgagcucuggaccccggacuccgagcccacgccccggccccuggcccugguguucaagccgagcccccucggggcccuggagcugcucagcccccagccccuguucccguacgcggccgaccccuga

SEQ ID NO: 36183 - RNA, 906 nt, Artificial Sequence
  derived and/or modified sequence opt1 from SEL1L__Homo_sapiens__NP_001231913
augcgcgugcggaucggccugacccuccugcugugcgccguccuccugagccuggccuccgcgagcuccgacgaggaggggagccaggacgagucccucgacagcaagaccacgcugaccuccgacgagagcgugaaggaccacaccaccgccggccgcguggucgccgggcagaucuuccuggacuccgaggagagcgagcucgaguccagcauccaggaggaggaggacucccucaagagccaggagggcgaguccgugacggaggacaucagcuuccuggagucccccaacccggagaacaaggacuacgaggagcccaagaaggugcggaagcccgcccugaccgccaucgaggggaccgcgcacggcgagcccugccacuucccguuccuguuccuggacaaggaguacgacgagugcaccagcgacggccgcgaggacgggcggcucuggugcgccacgaccuacgacuacaaggccgacgagaaguggggcuucugcgagaccgaggaggaggccgcgaagcgccggcagaugcaggaggccgagaugauguaccagaccgggaugaagauccugaacggcuccaacaagaagucccagaagcgcgaggccuaccgguaccugcagaaggccgccagcaugaaccacacgaaggcgcucgagcgcgucagcuacgcccugcuguucggggacuaccucccccagaacauccaggccgcccgggagauguucgagaagcugaccgaggagggcagccccaagggccagaccgcccugggguuccucuacgcguccggccugggggugaacagcucccaggccaaggcccugguguacuacaccuucggcgcccucggcgggaaccugaucgcccacaugguccuggugagccgccucuga

SEQ ID NO: 36184 - RNA, 1833 nt, Artificial Sequence
  derived and/or modified sequence opt1 from SELE__Homo_sapiens__NP_000441
augaucgccagccaguuccuguccgcccucacccuggugcugcucaucaaggagagcggcgcgugguccuacaacaccagcacggaggccaugaccuacgacgaggccuccgccuacugccagcagcgcuacacccaccuggucgccauccagaacaaggaggagaucgaguaccugaacagcauccucuccuacagccccuccuacuacuggaucgggauccggaaggugaacaacgugugggucugggugggcacccagaagccgcugacggaggaggcgaagaacugggcccccggggagcccaacaaccgccagaaggacgaggacugcguggagaucuacaucaagcgggagaaggacgucggcauguggaacgacgagcgcugcagcaagaagaagcuggcccucugcuacaccgccgcgugcaccaacaccuccugcagcgggcacggcgagugcguggagacgaucaacaacuacacgugcaagugcgaccccggcuucuccgggcugaagugcgagcagaucgugaacugcaccgcccuggagagcccggagcacggcucccucgucugcagccacccccuggggaacuucuccuacaacagcuccugcagcaucagcugcgaccggggcuaccugcccuccagcauggagaccaugcagugcauguccagcggggagugguccgcccccaucccggccugcaacgugguggagugcgacgccgucaccaaccccgcgaacggcuucguggagugcuuccagaaccccggcagcuuccccuggaacacgaccugcaccuucgacugcgaggagggguucgagcucaugggcgcccagucccugcagugcaccagcuccgggaacugggacaacgagaagccgaccugcaaggccgugaccugccgcgccguccggcagccccagaacggcagcgugcgcugcucccacagccccgccggcgaguucaccuucaaguccagcugcaacuucacgugcgaggagggguucaugcugcagggccccgcccagguggagugcaccacccaggggcaguggacccagcagaucccggucugcgaggcguuccagugcacggcccucuccaaccccgagcggggcuacaugaacugccugcccagcgccuccgggagcuuccgcuacggcuccagcugcgaguucagcugcgagcagggcuucgugcugaagggguccaagcggcuccagugcggccccaccggggagugggacaacgagaagccgaccugcgaggccgugcgcugcgacgcgguccaccagccgcccaagggccuggugcggugcgcccacagccccaucggggaguucaccuacaaguccagcugcgccuucuccugcgaggagggcuucgagcugcacggcagcacgcagcucgagugcaccucccaggggcaguggaccgaggaggugcccagcugccaggucgugaagugcuccagccuggccguccccggcaagaucaacauguccugcagcggggagcccguguucggcaccgugugcaaguucgccugccccgagggguggacgcugaacggcuccgcggcccggaccugcggcgccaccgggcacuggagcggccuccugccgaccugcgaggcccccacggaguccaacaucccccuggucgcggggcucagcgccgccggccugucccugcucacccuggccccguuccugcucuggcugcgcaagugccugcgcaaggccaagaaguucgugcccgcgagcagcugccagucccucgagagcgacggcuccuaccagaagcccagcuacauccuguga

SEQ ID NO: 36185 - RNA, 1233 nt, Artificial Sequence
  derived and/or modified sequence opt1 from SELENBP1__Homo_sapiens__NP_001245217
auggccaccaagugcggcaacugcgggcccggcuacagcaccccgcuggaggccaugaaggggccccgcgaggagaucguguaccuccccugcaucuaccggaacacgggcaccgaggcgcccgacuaccuggccaccgucgacguggacccgaaguccccgcaguacugccaggugaucgagcccaaggacauccacgccaagugcgagcuggccuuccuccacaccagccacugccuggccuccggggaggucaugaucagcucccugggcgacgugaagggcaacgggaagggcggguucgugcuccuggacggcgagacguucgaggucaaggggaccugggagcgccccggcggcgcggccccgcugggguacgacuucugguaccagccccggcacaacgugaugaucagcaccgagugggccgcccccaacgugcuccgcgacggcuucaaccccgcggacgucgaggccgggcuguacggcucccaccuguacgugugggacuggcagcggcacgagaucgugcagacccucagccugaaggacggccugaucccgcucgagauccgcuuccugcacaaccccgacgccgcccagggguucgucggcugcgcccuguccagcacgauccagcgguucuacaagaacgagggcgggaccugguccguggagaaggugauccaggucccgcccaagaaggugaagggguggcuccugcccgagaugcccggccugaucaccgacauccuccugagccuggacgaccgcuuccucuacuucuccaacuggcugcacggcgaccugcggcaguacgacaucagcgacccccagcgcccccggcucaccgggcagcuguuccugggcggguccaucgugaagggcgggccgguccaggugcucgaggacgaggagcucaagagccagcccgagccccugguggucaagggcaagcgcguggcgggcgggccccagaugauccagcugucccuggacggcaagcggcuguacaucacgaccagccucuacuccgccugggacaagcaguucuacccggaccugauccgcgaggggagcgugaugcugcaggucgacguggacaccgucaagggcgggcucaagcugaaccccaacuuccugguggacuucggcaaggagccccucggccccgcccuggcccacgagcugcgguaccccgggggcgacugcagcuccgacaucuggaucuga

SEQ ID NO: 36186 - RNA, 1158 nt, Artificial Sequence
  derived and/or modified sequence opt1 from SELL__Homo_sapiens__NP_000646
augggcugccgccggacccgcgaggggcccagcaaggccaugaucuucccguggaagugccaguccacccagcgggaccuguggaacaucuucaagcucuggggcuggacgaugcugugcugcgacuuccuggcccaccacgggaccgacugcuggaccuaccacuacagcgagaagcccaugaacuggcagcgcgcgcggcgcuucugccgggacaacuacaccgaccucguggccauccagaacaaggccgagaucgaguaccuggagaagacgcugcccuucucccgcagcuacuacuggaucggcauccggaagaucgggggcaucuggaccugggucggcaccaacaagucccucaccgaggaggccgagaacuggggcgacggggagcccaacaacaagaagaacaaggaggacugcguggagaucuacaucaagcgcaacaaggacgccgggaaguggaacgacgacgcgugccacaagcugaaggccgcccugugcuacacggccagcugccagccgugguccugcagcggccacggggagugcguggagaucaucaacaacuacacgugcaacugcgacgucggcuacuacggcccccagugccaguucgugauccagugcgagccccucgaggcgcccgagcuggggaccauggacugcacccacccgcugggcaacuucuccuucagcucccagugcgccuucagcugcuccgaggggaccaaccucaccggcaucgaggagacgaccugcggccccuucgggaacuggagcucccccgagccgaccugccaggugauccagugcgagccccugagcgcccccgaccugggcaucaugaacugcucccacccccucgccagcuucuccuucaccagcgccugcaccuucaucugcagcgaggggaccgagcugaucggcaagaagaagacgaucugcgaguccagcgggaucugguccaaccccagcccgaucugccagaagcuggacaaguccuucagcaugaucaaggagggcgacuacaacccccucuucauccccgucgcggugauggugaccgccuucuccggccuggccuucaucaucuggcuggcccggcgccucaagaaggggaagaaguccaagcggagcaugaacgaccccuacuga

SEQ ID NO: 36187 - RNA, 2493 nt, Artificial Sequence
  derived and/or modified sequence opt1 from SELP__Homo_sapiens__NP_002996
auggccaacugccagaucgccauccuguaccagcgcuuccagcggguggucuucggcaucagccagcuccugugcuucuccgcgcugaucagcgagcucaccaaccagaaggagguggccgccuggaccuaccacuacuccacgaaggccuacagcuggaacaucucccgcaaguacugccagaaccgguacaccgaccugguggccauccagaacaagaacgagaucgacuaccugaacaagguccuccccuacuacagcuccuacuacuggaucgggauccgcaagaacaacaagaccuggaccugggugggcacgaagaaggcgcugaccaacgaggccgagaacugggccgacaacgagccgaacaacaagcggaacaacgaggacugcguggagaucuacaucaagagccccuccgcccccgggaaguggaacgacgagcacugccugaagaagaagcacgcgcucugcuacaccgccagcugccaggacauguccugcagcaagcagggcgagugccuggagaccaucgggaacuacacgugcuccugcuaccccggcuucuacggcccggagugcgaguacguccgcgagugcggggagcuggagcucccccagcacgugcugaugaacugcagccacccccugggcaacuucuccuucaacagccagugcuccuuccacugcaccgacggguaccaggugaacggccccagcaagcucgagugccuggccuccgggaucuggaccaacaagccgccccagugccuggccgcccagugcccgccccucaagauccccgagcggggcaacaugaccugccugcacagcgcgaaggccuuccagcaccagagcuccugcagcuucuccugcgaggagggcuucgcccuggucgggcccgagguggugcagugcacggccagcggcgucuggaccgcccccgcgcccgugugcaaggccgugcagugccagcaccucgaggccccguccgaggggaccauggacugcguccacccccugaccgccuucgccuacggcagcuccugcaaguucgagugccagcccggcuaccgcgugcgggggcuggacaugcuccgcugcaucgacagcggccacugguccgcgccccugccgacgugcgaggccaucagcugcgagccccuggagucccccgugcacgggagcauggacugcucccccagccuccgggccuuccaguacgacaccaacugcuccuuccgcugcgccgagggcuucaugcugcgcggggccgacaucguccggugcgacaaccugggccaguggaccgcgccggcccccgugugccaggcccuccagugccaggaccugcccgugcccaacgaggcccgggucaacugcagccacccguucggcgcguuccgcuaccaguccgugugcagcuucacgugcaacgaggggcugcuccuggugggcgccuccguccugcagugccucgccaccgggaacuggaacagcgugccgcccgagugccaggccauccccugcaccccgcugcugagcccccagaacggcaccaugaccugcguccagccccucggguccagcuccuacaagagcacgugccaguucaucugcgacgagggcuacucccugagcggccccgagcggcuggacugcacccgcuccgggcgguggaccgacagcccgcccaugugcgaggccaucaagugccccgagcuguucgcgcccgagcagggcucccucgacugcagcgacacccgcggggaguucaacgugggcuccacgugccacuucagcugcgacaacggguucaagcuggagggccccaacaacguggagugcaccaccuccggccgguggagcgccaccccgcccacgugcaaggggaucgccucccuccccacccccggcguccagugccccgcccugaccacccccgggcagggcacgauguacugccgccaccacccgggcaccuucggguucaacacgaccugcuacuucggcugcaacgccggguucacccugaucggcgacagcacccucuccugccgccccagcgggcaguggaccgcggugacccccgccugccgggccgugaagugcagcgagcugcacgucaacaagcccaucgccaugaacugcuccaaccuguggggcaacuucagcuacggcuccaucugcagcuuccacugccuggaggggcagcuccugaacggcuccgcccagaccgcgugccaggagaacgggcacuggagcacgaccgugccgaccugccaggccggcccccugaccauccaggaggcccucacguacuucgggggcgccguggcguccaccaucggccugaucaugggcgggacccugcucgcccugcugcgcaagcgguuccgccagaaggacgacgggaagugcccccucaacccccacagccaccugggcaccuacggggucuucacgaacgccgccuucgacccgucccccuga

SEQ ID NO: 36188 - RNA, 1287 nt, Artificial Sequence
  derived and/or modified sequence opt1 from SELPLG__Homo_sapiens__NP_001193538
auggccgugggcgccagcgggcuggagggcgacaagauggcgggggccaugccccuccagcugcugcuccugcugauccuccugggcccggggaacucccugcagcucugggacaccugggccgacgaggccgagaaggcccugggcccccugcucgcgcgcgaccggcgccaggccaccgaguacgaguaccuggacuacgacuuccugcccgagacggagcccccggagaugcuccggaacagcaccgacaccacgccccugaccggccccgggacccccgaguccaccaccgucgagccggccgcccgccggagcacgggccuggacgccgggggcgcggugaccgagcucaccaccgagcuggccaacauggggaaccuguccacggacagcgccgccauggagauccagaccacccagcccgcggccaccgaggcccagacgacccagcccgugcccaccgaggcccagaccacgccgcucgccgcgaccgaggcccagaccacccgccugacggccaccgaggcccagaccacgccccuggccgcgaccgaggcccagaccaccccgcccgccgccaccgaggcccagacgacccagcccaccggccucgaggcgcagaccacggcccccgccgccauggaggcgcagaccaccgcccccgccgccauggaggcccagaccacgcccccggcggccauggaggcccagaccacccagaccaccgccauggaggcccagacgaccgcgcccgaggccaccgaggcccagaccacgcagcccaccgccaccgaggcccagaccacgccccuggcggccauggaggcccuguccaccgagccgagcgccaccgaggcgcucuccauggagcccaccacgaagcggggccuguucauccccuucagcgucuccagcgugacccacaaggggauccccauggccgccuccaaccugagcgugaacuacccggucggcgcccccgaccacaucuccgugaagcagugccuccuggccauccugauccucgcgcugguggccaccaucuucuucgucugcaccguggugcuggccguccgccucagccggaaggggcacauguaccccgugcgcaacuacuccccgacggagauggugugcaucagcucccugcugcccgacggcggcgaggggcccagcgccaccgccaacggcgggcucagcaaggcgaagucccccggccugaccccggagccccgggaggaccgcgagggggacgaccugacccuccacagcuuccugcccuga

SEQ ID NO: 36189 - RNA, 2316 nt, Artificial Sequence
  derived and/or modified sequence opt1 from SEMA3A__Homo_sapiens__XP_006715902
augggcuggcugacccgcaucgugugccuguucuggggcgugcugcugaccgcccgggccaacuaccagaacgggaagaacaacgugccccgccucaagcugagcuacaaggagaugcuggaguccaacaacgugaucacguucaacgggcucgcgaacagcuccagcuaccacaccuuccugcuggacgaggagcggucccgccucuacgucggcgccaaggaccacaucuucagcuucgaccuggugaacaucaaggacuuccagaagaucguguggccggucuccuacacccggcgcgacgagugcaagugggccgggaaggacauccugaaggagugcgccaacuucaucaaggugcucaaggccuacaaccagacccaccuguacgcgugcggcacgggcgccuuccaccccaucugcaccuacaucgagaucgggcaccaccccgaggacaacaucuucaagcuggagaacagccacuucgagaacggccgggggaagucccccuacgacccgaagcuccugaccgccagccugcucaucgacggcgagcuguacuccgggaccgccgcggacuucaugggccgcgacuucgccaucuuccggacgcugggccaccaccaccccauccgcaccgagcagcacgacagccgguggcucaacgaccccaaguucaucuccgcccaccugaucagcgaguccgacaaccccgaggacgacaagguguacuucuucuuccgcgagaacgccaucgacggggagcacagcggcaaggccacccacgcgcggaucgggcagaucugcaagaacgacuucggcggccaccgcucccuggucaacaaguggaccacguuccucaaggcccggcugaucugcagcgugccggggcccaacggcaucgacacccacuucgacgagcugcaggacguguuccucaugaacuucaaggaccccaagaaccccgucguguacgggguguucaccaccuccagcaacaucuucaagggcagcgccgucugcauguacuccaugagcgacgugcgccggguguuccuggggccguacgcccaccgcgacggccccaacuaccaguggguccccuaccagggccgggugcccuacccgcgccccgggacgugccccuccaagaccuucggcggguucgacagcaccaaggaccugcccgacgacgugaucaccuucgcccggucccacccggcgauguacaaccccgucuuccccaugaacaaccgccccaucgugaucaagacggacgugaacuaccaguucacccagaucgucguggaccgcgucgacgccgaggacggccaguacgacgugauguucaucgggaccgacgugggcaccguccucaagguggugagcaucccgaaggagacgugguacgaccuggaggagguccugcucgaggagaugaccguguuccgggagcccaccgccaucuccgccauggagcugagcaccaagcagcagcagcuguacaucggcuccacggccgggguggcgcagcucccccugcaccgcugcgacaucuacggcaaggccugcgccgagugcugccuggcccgggaccccuacugcgccugggacgggagcgcgugcucccgcuacuucccgaccgccaagcggcgcacccggcgccaggacauccggaacggcgacccccucacccacugcagcgaccugcaccacgacaaccaccacgggcacucccccgaggagcgcaucaucuacggcgucgagaacagcuccacguuccuggagugcagcccgaagucccagcgggcccucguguacuggcaguuccagcgccggaacgaggagcgcaaggaggagauccggguggacgaccacaucauccgcaccgaccagggccugcugcuccggagccugcagcagaaggacuccgggaacuaccugugccacgccgucgagcacggcuucauccagacccuccugaaggugacccuggaggugaucgacacggagcaccuggaggagcuccugcacaaggacgacgacggggacggcagcaagaccaaggagaugagcaacuccaugacccccagccagaaggucugguaccgcgacuucaugcagcugaucaaccaccccaaccucaacaccauggacgaguucugcgagcaggucuggaagcgggaccgcaagcagcgccggcagcgccccggccacaccccggggaacuccaacaaguggaagcaccuccaggagaacaagaagggccggaaccgccggacgcacgaguucgagcgcgcgccccggagcguguga

SEQ ID NO: 36190 - RNA, 2250 nt, Artificial Sequence
  derived and/or modified sequence opt1 from SEMA3B__Homo_sapiens__NP_001276989
augggccgcgccggggccgcggccgugauccccggccuggcccuccugugggccgucgggcugggcagcgccgcgccguccccgccccggcuccgccugagcuuccaggagcugcaggccuggcacgggcuccagaccuucucccuggagcggaccugcugcuaccaggcccugcucguggacgaggagcgcggccggcuguucgugggcgccgagaaccacgucgcgagccugaaccucgacaacaucuccaagcgcgccaagaagcuggccuggcccgcccccguggaguggcgggaggagugcaacugggccgggaaggacaucggcacggagugcaugaacuucgugaagcugcuccacgcguacaaccgcacccaccuccuggccugcgggaccggcgccuuccacccgaccugcgccuucgucgagguggggcaccgggccgaggagcccgugcugcgccuggaccccggccggaucgaggacggcaagggcaagagccccuacgacccccgccaccgggcggccuccguccuggugggggaggagcucuacagcgggguggccgccgaccugaugggccgcgacuucacgaucuuccggucccugggccagcgccccagccuccggaccgagccccacgacucccgcuggcugaacgagccgaaguucgucaagguguucuggauccccgagagcgagaaccccgacgacgacaagaucuacuucuucuuccgggagaccgccguggaggcggcccccgcccuggggcgccucuccgucagccgggugggccagaucugccgcaacgacgucgggggccagcgcucccuggugaacaaguggaccacguuccugaaggcccggcucgugugcagcgugccgggggucgagggcgacacccacuucgaccagcugcaggacguguuccugcucuccagccgcgaccaccggacgccccugcuguacgccguguucuccaccagcagcuccaucuuccagggcagcgcggucugcguguacuccaugaacgacguccgccgggccuuccucgggcccuucgcccacaaggagggccccaugcaccagugggugagcuaccaggggcgcgugccguacccccggcccggcaugugccccuccaagaccuucgggaccuucagcuccaccaaggacuucccggacgacgucauccaguucgcccgcaaccacccccugauguacaacagcgugcugcccaccggcggccggccccucuuccuccaggugggggcgaacuacacguucacccagaucgccgccgaccgcgucgccgccgcggacggccacuacgacgugcuguucaucgggaccgacgugggcaccguccugaaggugaucuccgugccgaaggggagccggcccuccgccgagggccugcugcucgaggagcugcacgucuucgaggacagcgccgccgugacguccaugcagaucagcuccaagcgccaccagcuguacguggccagccgguccgcggucgcccagaucgcccuccaccgcugcgccgcccacggccgggugugcaccgagugcugccuggcgcgcgaccccuacugcgccugggacgggguggccugcacccgguuccagccgagcgccaagcgccgguuccgccgccaggacguccggaacggcgaccccuccacccugugcagcggggacagcucccgccccgcgcugcucgagcacaagguguucggcguggagggcagcuccgccuuccuggagugcgagccccggagccugcaggcccgcgucgaguggacguuccagcgggccggggugaccgcccacacccaggugcucgcggaggagcgcaccgagcggacggcccgcggccugcugcuccggcgccugcggcgccgggacuccggggucuaccugugcgccgccguggagcagggcuucacccagccgcuccgccggcugagccugcacgugcucuccgccacccaggcggagcgccuggcccgggccgaggaggccgcccccgcggccccgcccgggcccaagcugugguaccgcgacuuccuccagcuggucgagcccggcggcgggggcagcgccaacucccugcggaugugccgcccccagcccgcccuccagagccugccgcuggagucccggcgcaaggggcgcaaccggcgcacccacgcgcccgagccccgggccgagcgcggcccccggagcgccacgcacugguga

SEQ ID NO: 36191 - RNA, 2256 nt, Artificial Sequence
  derived and/or modified sequence opt1 from SEMA3C__Homo_sapiens__NP_006370
auggccuuccgcaccaucugcgugcuggucggcguguucaucugcagcaucugcgugaagggguccagccagccccaggcccgggucuaccucaccuucgacgagcugcgcgagacgaagaccuccgaguacuucagccugucccaccacccgcucgacuaccggauccugcugauggacgaggaccaggaccgcaucuacgugggcagcaaggaccacauccucucccugaacaucaacaacaucagccaggaggcgcuguccguguucuggcccgccagcaccaucaaggucgaggagugcaagauggccgggaaggaccccacccacggcugcgggaacuucgugcgggugauccagacguucaaccgcacccaccucuacgucugcggcuccggcgccuucagccccgugugcaccuaccugaaccgggggcgccgguccgaggaccagguguucaugaucgacagcaagugcgaguccggcaaggggcgcugcagcuucaacccgaacgucaacaccguguccgugaugaucaacgaggagcuguucagcggcauguacaucgacuucauggggacggacgccgcgaucuuccggucccucaccaagcgcaacgccguccggaccgaccagcacaacagcaaguggcugagcgagcccauguucguggacgcccacgugauccccgacggcaccgaccccaacgacgccaaggucuacuucuucuucaaggagaagcugacggacaacaaccgcuccaccaagcagauccacagcaugaucgcgcggaucugcccgaacgacaccggcgggcuccgcucccuggugaacaaguggaccacguuccugaaggcccggcucgugugcagcgucaccgacgaggacggccccgagacccacuucgacgagcuggaggacguguuccugcucgagaccgacaacccccgcacgacccugguguacgggaucuucaccaccuccagcuccgucuucaagggcagcgccgugugcgucuaccaccuguccgacauccagacgguguucaacggccccuucgcccacaaggaggggccgaaccaccagcucaucagcuaccagggccggauccccuacccccgccccgggaccugcccgggcggggccuucacccccaacaugcggaccacgaaggaguuccccgacgacguggucaccuucauccgcaaccacccccugauguacaacuccaucuacccgauccacaagcgcccccugaucgugcggaucggcaccgacuacaaguacaccaagaucgcgguggaccgcgucaacgccgccgacggccgguaccacguccucuuccuggggacggaccgcggcaccgugcagaaggugguggugcugcccaccaacaacagcgucuccggggagcucauccuggaggagcuggagguguucaagaaccacgcccccaucaccacgaugaagaucagcuccaagaagcagcagcucuacgugagcuccaacgagggcgucagccaggugucccugcaccggugccacaucuacgggaccgccugcgcggacugcugccuggcccgcgacccguacugcgccugggacggccacagcugcagccgguucuaccccaccggcaagcgccggucccgccggcaggacgugcgccacgggaacccccucacccagugccggggcuucaaccugaaggccuaccgcaacgccgcggagaucguccaguacggggugaagaacaacaccacguuccuggagugcgcccccaagagcccgcaggccuccaucaaguggcuccugcagaaggacaaggaccggcgcaaggaggugaagcugaacgagcggaucaucgccaccagccagggccuccugauccgcuccguccaggggagcgaccagggccuguaccacugcaucgccaccgagaacuccuucaagcagaccaucgcgaagaucaacuucaaggugcucgacagcgagaugguggccgucgugacggacaaguggucccccuggaccugggccagcuccgugcgggcccugcccuuccacccgaaggacaucaugggcgcguucagccacuccgagaugcagaugaucaaccaguacugcaaggacacccgccagcagcaccagcagggggacgagagccagaagaugcgcggcgacuacgggaagcugaaggcccucaucaacucccgcaagagccggaaccggcgcaaccagcugcccgaguccuga

SEQ ID NO: 36192 - RNA, 2334 nt, Artificial Sequence
  derived and/or modified sequence opt1 from SEMA3D__Homo_sapiens__NP_689967
augaacgccaacaaggacgagcgccugaaggcccggagccaggacuuccaccucuuccccgcgcugaugaugcuguccaugaccaugcuguuccucccggugaccggcacgcugaagcagaacaucccccgccucaagcugaccuacaaggaccugcuccugagcaacuccugcauccccuuccuggggagcuccgagggccucgacuuccagacccugcugcucgacgaggagcgggggcgccugcugcucggcgccaaggaccacaucuuccugcugagccucgucgaccugaacaagaacuucaagaagaucuacuggcccgccgccaaggagcggguggagcugugcaagcucgccgggaaggacgcgaacaccgagugcgccaacuucauccgcgugcugcagccguacaacaagacgcacaucuacgucugcggcaccggcgccuuccaccccaucugcggguacaucgaccugggcguguacaaggaggacaucaucuucaagcucgacacccacaaccuggaguccgggcggcugaagugccccuucgacccccagcagccguucgccagcgugaugaccgacgaguaccucuacuccggcacggcgagcgacuuccuggggaaggacaccgccuucacccgcucccugggccccacccacgaccaccacuacauccggacggacaucagcgagcacuacuggcucaacggcgccaaguucaucgggaccuucuucauccccgacaccuacaaccccgacgacgacaagaucuacuucuucuuccgcgaguccagccaggagggcuccaccagcgacaagacgauccugucccgggucgggcgcgugugcaagaacgacgugggcggccagcggagccugaucaacaaguggaccaccuuccucaaggcccgccugaucugcuccaucccggggagcgacggcgccgacaccuacuucgacgagcugcaggacaucuaccuccugcccacgcgggacgagcgcaaccccgucguguacgggguguucaccaccaccagcuccaucuucaagggcagcgcggucugcguguacuccauggccgacauccgggccguguucaacgggcccuacgcccacaaggagagcgccgaccaccgcuggguccaguacgacggccggaucccguacccccgccccggcacgugccccuccaagaccuacgacccgcugaucaagagcacccgggacuuccccgacgacgugaucuccuucaucaagcgccacagcgugauguacaaguccgucuaccccguggccgggggccccaccuucaagcgcaucaacguggacuaccggcucacgcagaucgucguggaccacgugaucgcggaggacgggcaguacgacgucauguuccugggcaccgacaucgggaccgugcugaaggucgugagcaucuccaaggagaaguggaacauggaggaggugguccucgaggagcugcagaucuucaagcacagcuccaucauccugaacauggagcucagccugaagcagcagcagcuguacaucggcucccgcgacggccuggugcagcucagccugcaccggugcgacaccuacgggaaggccugcgccgacugcugccuggcccgcgacccguacugcgcgugggacggcaacgccugcucccgguacgcccccacgagcaagcgccgggcccgccggcaggacgugaaguacggggaccccaucacccagugcugggacaucgaggacuccaucagccacgagaccgccgacgagaaggucaucuucggcaucgaguucaacagcaccuuccucgagugcauccccaagucccagcaggcgacgaucaagugguacauccagcgcagcggggacgagcaccgggaggagcugaagccggacgagcgcaucaucaagaccgaguacggccugcucauccggucccugcagaagaaggacagcggcauguacuacugcaaggcccaggagcacaccuucauccacaccaucgugaagcugacccucaacgugaucgagaacgagcagauggagaacacgcagcgcgccgagcacgaggaggggaaggucaaggaccugcuggccgagucccggcuccgcuacaaggacuacauccagauccugagcucccccaacuucagccuggaccaguacugcgagcagauguggcaccgggagaagcgccggcagcgcaacaagggcgggcccaaguggaagcacaugcaggagaugaagaagaagcgcaaccggcgccaccaccgggaccucgacgagcugccgcgcgcgguggccaccuga

SEQ ID NO: 36193 - RNA, 2148 nt, Artificial Sequence
  derived and/or modified sequence opt1 from SEMA3E__Homo_sapiens__NP_001171600
augcugcucgacgaguaccaggagcgccuguucgugggcgggcgggaccuggucuacagccucucccuggagcgcaucagcgacggcuacaaggagauccacuggcccuccaccgcccugaagauggaggagugcaucaugaaggggaaggacgccggcgagugcgcgaacuacgugcgggugcuccaccacuacaaccgcacccaccuccugacgugcgggaccggcgccuucgacccggucugcgccuucauccgggugggcuaccaccucgaggacccccuguuccaccuggagagcccccgcuccgagcgggggcgcggccggugccccuucgacccgagcuccagcuucaucuccacccucaucgggagcgagcuguucgccggccuguacuccgacuacuggagccgcgacgccgcgaucuuccgguccauggggcgccucgcccacauccggaccgagcacgacgacgagcgccugcugaaggagcccaaguucgugggcagcuacaugauccccgacaacgaggaccgggacgacaacaaggucuacuucuucuucacggagaaggcccucgaggccgagaacaacgcgcacgccaucuacacccgcgugggccggcugugcgugaacgacgucgggggccagcgcauccuggugaacaagugguccaccuuccucaaggcccggcuggugugcagcguccccgggaugaacggcaucgacaccuacuucgacgagcuggaggacguguuccuccugccgacgcgcgaccacaagaaccccgugaucuucggccuguucaacaccaccuccaacaucuuccgggggcacgccaucugcgucuaccacaugagcuccauccgcgccgcguucaacggccccuacgcccacaaggaggggcccgaguaccacuggagcguguacgagggcaaggugccguacccccgccccgggagcugcgccuccaaggucaacggcggccgguacgggaccacgaaggacuaccccgacgacgccauccgcuucgcccggagccacccgcucauguaccaggcgaucaagcccgcccacaagaagcccauccuggugaagaccgacggcaaguacaaccugaagcagaucgccguggaccgcgucgaggccgaggacgggcaguacgacgugcuguucaucggcaccgacaacgggaucgugcugaaggucaucaccaucuacaaccaggagauggaguccauggaggaggugauccuggaggagcuccagaucuucaaggaccccgucccgaucaucagcauggagaucuccagcaagcggcagcagcuguacaucggcuccgccagcgcgguggcccaggugcgcuuccaccacugcgacauguacggcuccgccugcgccgacugcugccuggcccgggaccccuacugcgcgugggacgggaucagcugcucccgcuacuaccccacgggcacccacgccaagcggcgcuuccggcgccaggacguccggcacgggaacgccgcccagcagugcuucggccagcaguucgugggggacgcgcucgacaagaccgaggagcaccuggccuacggcaucgagaacaacagcacccugcucgagugcacgccccgcucccugcaggccaaggugaucugguucguccagaagggccgggagacccgcaaggaggaggugaagaccgacgaccggguggucaagauggaccuggggcuccuguuccugcgccuccacaagagcgacgccggcaccuacuucugccagacgguggagcacuccuucgugcacaccguccggaagaucacccuggaggugguggaggaggagaaggucgaggacauguucaacaaggacgacgaggaggaccgccaccaccgcaugccgugccccgcccagagcuccaucagccagggggcgaagcccugguacaaggaguuccugcagcucaucggcuacuccaacuuccagcggguggaggaguacugcgagaagguguggugcaccgaccgcaagcggaagaagcugaagaugagccccagcaaguggaaguacgccaacccgcaggagaagaagcugcgcuccaagcccgagcacuaccggcugccccgccacacgcucgacagcuga

SEQ ID NO: 36194 - RNA, 2358 nt, Artificial Sequence
  derived and/or modified sequence opt1 from SEMA3F__Homo_sapiens__NP_004177
augcugguggccggccuccugcugugggccagccuccugaccggggccuggcccuccuuccccacccaggaccaccuccccgccacgccccgcguccggcucagcuucaaggagcugaaggccaccggcaccgcccacuucuucaacuuccugcucaacaccacggacuaccgcauccugcugaaggacgaggaccacgaccggauguacgugggguccaaggacuacgugcucagccuggaccugcacgacaucaaccgcgagccccucaucauccacugggccgcgagcccccagcggaucgaggagugcguccuguccggcaaggacgugaacggggagugcggcaacuucgugcgccugauccagcccuggaaccggacccaccucuacgucugcggcaccggggccuacaaccccaugugcaccuacgugaaccgcggccggcgcgcccaggccacgcccuggacccagacccaggcggugcgggggcgcggcucccgggccaccgacggggcccugcgcccgaugcccacggcgccccggcaggacuacaucuucuaccuggagcccgagcgccucgagagcggcaagggcaagugcccguacgaccccaagcuggacaccgccuccgcccugaucaacgaggagcucuacgccggggucuacaucgacuucaugggcaccgacgccgccaucuuccggacccuggggaagcagacggccaugcgcaccgaccaguacaacagccgguggcugaacgaccccuccuucauccacgcggagcucauccccgacagcgccgagcgcaacgacgacaagcuguacuucuucuuccgggagcgcuccgccgaggccccgcagagccccgccguguacgcgcgcaucggccggaucugccugaacgacgacggcgggcacugcugccuggugaacaagugguccaccuuccugaaggcccgccuggucugcagcgugcccggcgaggacgggaucgagacccacuucgacgagcuccaggacguguucguccagcagacgcaggacgugcggaaccccgugaucuacgccgucuucaccuccagcggcuccguguuccgcgggagcgccgugugcgucuacagcauggccgacauccggaugguguucaacggcccguucgcgcacaaggagggccccaacuaccaguggaugcccuucuccgggaagaugcccuacccgcgccccgggaccugccccggcggcaccuucacgcccagcaugaaguccaccaaggacuacccggacgaggugaucaacuucaugcggagccacccccugauguaccaggccgucuacccccugcagcgccggccgcucgugguccgcaccggggcccccuaccggcugaccacgaucgccguggaccagguggacgcggccgacggccgcuacgagguccuguuccucggcaccgaccgggggaccgugcagaaggugaucguccugcccaaggacgaccaggagcuggaggagcucaugcuggaggagguggagguguucaaggaccccgccccggucaagaccaugacgaucuccagcaagcgccagcagcuguacguggccuccgccgugggcgucacccaccucagccugcaccggugccaggcguacggggccgccugcgccgacugcugccuggcccgcgaccccuacugcgcgugggacggccaggccugcucccgguacaccgccagcuccaagcgccggagccgccgccaggacgugcggcacgggaaccccauccgccagugccggggcuucaacuccaacgccaacaagaacgccguggagagcguccaguacggcguggcgggguccgccgccuuccucgagugccagccccgcagcccgcaggccaccgugaaguggcuguuccagcgggaccccggcgaccgccggcgcgagauccgggcggaggaccgcuuccugcggacggagcaggggcugcuccugcgcgcccugcagcucuccgaccggggccuguacagcugcaccgccaccgagaacaacuucaagcacgucgugacccgcgugcagcugcacguccucggccgggacgccgugcacgccgcgcuguucccgccccuguccaugagcgcgcccccgccgcccggggccggcccgcccaccccgcccuaccaggagcucgcccagcugcuggcccagcccgagguggggcucauccaccaguacugccagggcuacuggcgccacgucccgcccagcccccgggaggcccccggggcgccccgcucccccgagccccaggaccagaagaagccccggaaccgccggcaccacccgcccgacacguga

SEQ ID NO: 36195 - RNA, 2349 nt, Artificial Sequence
  derived and/or modified sequence opt1 from SEMA3G__Homo_sapiens__NP_064548
auggcccccagcgccugggcgaucugcuggcugcucggcgggcugcugcuccacggcgggagcagcggcccgucccccgggcccagcgugccccgccugcggcuguccuaccgcgaccuccugagcgccaaccgguccgccaucuuccugggcccgcagggcagccucaaccugcaggccauguaccuggacgaguaccgcgaccggcuguuccucgggggccuggacgcccucuacucccugcgccuggaccaggcguggcccgacccccgggagguccucuggcccccgcagcccgggcagcgcgaggagugcgugcggaagggccgcgacccccugaccgagugcgccaacuucgugcggguccugcagccccacaaccgcacccaccuccuggccugcgggaccggcgccuuccagccgaccugcgcgcugaucaccgugggccaccgcggggagcacgugcuccaccuggagcccggcagcgucgaguccgggcggggccggugcccccacgagcccagccgcccguucgccuccaccuucaucgacggcgagcuguacacggggcucaccgccgacuuccugggccgggaggccaugaucuuccgcagcgggggcccccggcccgcccugcgcuccgacagcgaccagucccuccugcacgacccccgguucgugauggcggcccgcaucccggagaacagcgaccaggacaacgacaagguguacuucuucuucuccgagaccguccccagccccgacgggggcagcaaccacgugaccgugucccgcgucggccgggugugcgugaacgacgccgggggccagcgcguccuggugaacaaguggagcacguuccucaaggcccggcuggugugcuccguccccgggccgggcggggccgagacccacuucgaccagcuggaggacguguuccuccuguggcccaaggcgggcaagagccuggagguguacgcccucuucuccaccgucagcgccguguuccagggcuucgccgugugcgucuaccacauggccgacaucugggagguguucaacgggcccuucgcgcaccgcgacggcccccagcaccagugggggccguacggcgggaagguccccuucccccggccgggcgugugccccuccaagaugaccgcccagcccggccgccccuucgggagcacgaaggacuacccggacgaggugcugcaguucgcccgggcccacccccugauguucuggcccguccgcccccggcacggccgcccggugcucgugaagacccaccuggcccagcagcugcaccagaucgucguggaccggguggaggcggaggacgggaccuacgacgucaucuuccucggcaccgacuccggcagcgugcugaaggugaucgcccugcaggccgggggcuccgccgagcccgaggaggucgugcucgaggagcuccagguguucaagguccccacgcccaucaccgagauggagaucagcgugaagcgccagaugcuguacguggggucccggcugggcgucgcgcagcugcgccugcaccagugcgagaccuacgggaccgccugcgccgagugcugccuggcccgggacccguacugcgccugggacggcgcgagcugcacgcacuaccgccccucccucggcaagcggcgcuuccggcgccaggacauccgccacgggaaccccgcccugcagugccugggccagagccaggaggaggaggccguggggcucguggccgccaccauggucuacggcaccgagcacaacuccaccuuccuggagugccugcccaagagcccgcaggcggccgugcgguggcuccugcagcgccccggggacgagggccccgaccaggugaagacggacgagcggguccugcacaccgagcgcggccuccuguuccggcgccugucccgguucgacgccgggaccuacacgugcaccacccucgagcacggcuucagccagaccguggugcgccuggcccuggucgugaucguggccagccagcucgacaaccuguucccgcccgagcccaagcccgaggagcccccggcgcgcgggggccuggccuccaccccgcccaaggccugguacaaggacauccuccagcugaucggguucgccaaccugccccgggucgacgaguacugcgagcggguguggugccgcggcacgaccgagugcagcggcugcuuccggucccgcagccgggggaagcaggcgcgcggcaaguccugggccgggcucgagcugggcaagaagaugaagucccgggugcacgccgagcacaaccgcacgccccgggaggucgaggccaccuga

SEQ ID NO: 36196 - RNA, 1890 nt, Artificial Sequence
  derived and/or modified sequence opt1 from SEMA4A__Homo_sapiens__NP_001180231
augauccccuggccggccagcgaccgcaagaaguccgagugcgccuucaagaagaaguccaacgaggagcugcaggacagcuaccuccugcccaucagcgaggacaaggugauggagggcaaggggcagucccccuucgaccccgcgcacaagcacaccgccguccugguggacggcaugcucuacagcgggaccaugaacaacuuccugggcuccgagccgauccugaugcggacgcucgggagccagcccgugcugaagaccgacaacuuccugcgcuggcuccaccacgacgccuccuucgucgccgccauccccagcacccaggugguguacuucuucuucgaggagaccgcguccgaguucgacuucuucgagcggcugcacacgagccgcgucgcccgggugugcaagaacgacgugggcggcgagaagcugcuccagaagaaguggaccaccuuccugaaggcccagcugcucugcacccagcccgggcagcugccguucaacgucauccgccacgccgugcugcuccccgcggacucccccacggcgccccacaucuacgccguguucaccagccaguggcaggucggcgggacccgguccagcgccgugugcgccuucucccugcuggacaucgagcgcguguucaagggcaaguacaaggagcucaacaaggagaccagccgguggacgaccuaccgcgggccggagaccaacccccggcccggcuccugcagcgucggccccagcuccgacaaggcccugaccuucaugaaggaccacuuccugauggacgagcaggucguggggacgccgcuccuggucaagagcggcguggaguacacccgccuggccguggagaccgcccaggggcucgacggccacucccaccuggugauguaccugggcaccacgaccgggagccuccacaaggccgugguguccggcgacagcuccgcccaccuggucgaggagauccagcuguuccccgaccccgagcccgugcggaaccuccagcuggcgccgacccagggggccgucuucgugggcuucagcgggggcguguggcgcgucccccgggccaacugcuccguguacgagagcugcguggacugcguccuggcccgcgacccccacugcgccugggaccccgagucccggaccugcugccuccugagcgcgccgaaccugaacuccuggaagcaggacauggagcgcggcaaccccgagugggccugcgccagcgggcccaugucccggagccuccgcccccagucccggccgcagaucaucaaggaggugcuggccgugcccaacagcauccuggagcuccccugcccgcaccuguccgcccuggcgagcuacuacuggagccacggccccgccgccguccccgaggccuccagcacgguguacaacgggucccuccugcugaucgugcaggacggcgucgggggccucuaccagugcugggcgaccgagaacggcuucagcuaccccgugaucuccuacuggguggacagccaggaccagacccuggcccuggacccggagcuggccgggaucccccgcgagcacgucaaggugccccucacccgcguguccggcggggccgcccuggcggcccagcagagcuacuggccccacuucgucacggugaccgugcuguucgcccucguccuguccggcgcccugaucauccucguggccagcccgcugcgggcgcugcgcgcccgggggaaggugcagggcugcgagacccuccgccccggcgagaaggcgccccugucccgggagcagcaccuccagagccccaaggagugccgcaccuccgccagcgacgucgacgccgacaacaacugccuggggacggagguggccuga

SEQ ID NO: 36197 - RNA, 2514 nt, Artificial Sequence
  derived and/or modified sequence opt1 from SEMA4B__Homo_sapiens__NP_064595
augcugcgcaccgccaugggccuccggagcuggcuggccgcgcccuggggcgcccugccgccccgcccgccccuccugcugcuccugcugcuccugcugcuccugcagcccccgccgcccaccugggcccugagcccccggaucucccucccccugggguccgaggagcgccccuuccugcgguucgaggccgagcacaucagcaacuacacggcccuccugcugucccgcgacgggcggacccucuacgugggcgcgcgcgaggcccuguucgcccugagcuccaaccucagcuuccugcccgggggcgaguaccaggagcugcucuggggcgccgacgcggagaagaagcagcagugcuccuucaaggggaaggacccccagcgggacugccagaacuacaucaagauccugcugccccucagcggcucccaccuguucacgugcgggaccgccgccuucagccccaugugcacguacaucaacauggagaacuucacccuggcccgcgacgagaagggcaacguccuccuggaggacgggaagggccggugccccuucgacccgaacuucaaguccaccgcccuggugguggacggcgagcucuacaccgggacggucagcuccuuccagggcaacgaccccgcgaucagccgcucccagagccugcggcccaccaagaccgaguccagccugaacuggcuccaggaccccgccuucguggccagcgccuacaucccggagucccuggggagccugcagggcgacgacgacaagaucuacuucuucuucuccgagaccggccaggaguucgaguucuucgagaacacgaucgugagccgcaucgcccggaucugcaagggggacgagggcggggagcgcguccuccagcagcgguggaccuccuuccugaaggcgcagcugcucugcagccgccccgacgacggcuuccccuucaacgugcugcaggacguguucacccugucccccagcccgcaggacuggcgggacacccucuucuacggggucuucaccucccaguggcaccgcggcaccaccgagggcagcgccgugugcguguucaccaugaaggacguccagcggguguucuccgggcuguacaaggaggugaaccgcgagacgcagcagugguacaccgucacccaccccgugcccacgccccgcccgggcgccugcaucaccaacagcgcccgggagcgcaagaucaacuccagccugcagcugcccgaccgggugcucaacuuccugaaggaccacuuccugauggacgggcagguccgcucccggaugcuccugcugcagccccaggcccgcuaccagcggguggcggugcaccgcgucccgggccuccaccacaccuacgacgugcuguuccuggggaccggcgacggccggcuccacaaggccgugagcgucgggccccgcgugcacaucaucgaggagcugcagaucuucuccagcggccagcccguccagaaccugcuccuggacacccaccgggggcugcucuacgccgccucccacagcggcguggugcagguccccauggccaacugcagccuguaccgcuccugcggggacugccugcucgcgcgggacccguacugcgccuggagcggcuccagcugcaagcacgugucccuguaccagccccagcuggccacgcgccccuggauccaggacaucgagggcgccagcgcgaaggaccucugcuccgccagcuccguggucagccccuccuucgugccgaccggggagaagcccugcgagcagguccaguuccagcccaacaccgugaacacccuggccugcccccugcucagcaaccuggccacgcggcuguggcuccgcaacggcgccccggugaacgcguccgccagcugccacgugcugcccaccggggaccugcuccuggucggcacccagcagcugggcgaguuccagugcuggucccucgaggagggguuccagcagcugguggccagcuacugccccgagguggucgaggacggcguggccgaccagaccgacgagggcggguccgugcccgucaucaucagcacgagccggguguccgccccggccgggggcaaggcgagcuggggcgccgaccgcuccuacuggaaggaguuccuggugaugugcacccucuucguccuggccgugcugcuccccgugcuguuccugcucuaccggcaccgcaacagcaugaaggucuuccugaagcagggggagugcgccuccgugcaccccaagaccugccccgugguccugccgcccgagacccgcccccucaacggccuggggcccccgagcacgccccuggaccaccggggcuaccagucccucagcgacagcccgcccgggucccgcguguucaccgaguccgagaagcggccccugagcauccaggacuccuucguggaggucagccccgugugcccccgcccgcgggugcgccugggcuccgagauccgggacagcgucguguga

SEQ ID NO: 36198 - RNA, 2589 nt, Artificial Sequence
  derived and/or modified sequence opt1 from SEMA4D__Homo_sapiens__XP_005251711
augcgcaugugcacccccauccggggccugcucauggcccuggccgugauguucgggaccgcgauggccuucgccccgaucccccgcaucacgugggagcaccgggagguccaccuggugcaguuccacgagcccgacaucuacaacuacagcgcccuccugcuguccgaggacaaggacacccucuacaucggcgcccgcgaggcgguguucgccgucaacgcccugaacaucagcgagaagcagcacgagguguacuggaagguguccgaggacaagaaggccaagugcgcggagaagggcaagagcaagcagaccgagugccugaacuacauccggguccuccagccccuguccgccaccagccuguacgugugcgggacgaacgccuuccagccggccugcgaccaccucaaccugaccuccuucaaguuccuggggaagaacgaggacggcaagggccgcugccccuucgaccccgcccacagcuacaccuccgugauggucgacggggagcucuacagcggcaccuccuacaacuuccuggggagcgagcccaucaucucccggaacagcucccacagcccgcugcgcacggaguacgcgauccccuggcucaacgagcccuccuucguguucgccgacgugauccgcaagagccccgacuccccggacggcgaggacgaccgggucuacuucuucuucaccgaggugagcguggaguacgaguucgucuuccgggugcugaucccccgcaucgcccgggugugcaagggggaccagggcggccugcgcacccuccagaagaaguggaccagcuuccugaaggcccggcugaucugcucccgccccgacagcgggcucgucuucaacgugcugcgggacguguucguccugcgcucccccggccucaaggugccgguguucuacgcccuguucacgccccagcugaacaacgucgggcucagcgcggugugcgccuacaaccuguccaccgccgaggaggucuucagccacggcaaguacaugcaguccaccaccguggagcagagccacacgaagugggugcgguacaacggccccguccccaagccgcgccccggggccugcaucgacuccgaggcccgggcggccaacuacaccagcucccugaaccuccccgacaagacccugcaguucgugaaggaccacccccugauggacgacagcgugaccccgaucgacaaccgcccccgccucaucaagaaggacgucaacuacacgcagaucgugguggaccggacccaggcccuggacggcaccgucuacgacgugauguucguguccaccgaccgcggggcccugcacaaggccaucagccucgagcacgcgguccacaucaucgaggagacgcagcuguuccaggacuucgagcccgugcagacccugcuccuguccagcaagaagggcaaccgguucguguacgccggguccaacagcggcgucgugcaggcgccccuggccuucugcggcaagcacgggaccugcgaggacugcgugcucgcccgcgacccguacugcgccugguccccgcccaccgccacgugcgucgcccugcaccagaccgagagccccagccggggccugauccaggagauguccggggacgccagcgugugccccgacaaguccaagggcagcuaccgccagcacuucuucaagcacgggggcaccgcggagcucaagugcucccagaaguccaaccuggcccggguguucuggaaguuccagaacggcguccugaaggccgagagccccaaguacgggcugaugggccgcaagaaccuccugaucuucaaccugagcgagggggacuccggcguguaccagugccucagcgaggagcgggugaagaacaagaccgucuuccaggugguggccaagcacguccuggaggugaaggugguccccaagccggugguggcccccacgcuguccgucgugcagaccgaggggagccgcaucgcgaccaaggugcucgucgccuccacccagggcagcuccccgcccacgcccgccgugcaggccaccagcuccggcgccaucacccugccgcccaagcccgcgcccaccgggaccagcugcgagcccaagaucgugaucaacacggucccccagcugcacagcgagaagaccauguaccucaaguccagcgacaaccggcugcugaugucccucuuccuguucuucuucgugcuguuccucugccuguucuucuacaacugcuacaagggcuaccugccccgccagugccucaaguuccggagcgcccugcugaucgggaagaagaagccgaaguccgacuucugcgaccgcgagcagagccucaaggagacccugguggagcccggcuccuucagccagcagaacggcgagcaccccaagcccgcccuggacaccggguacgagacggagcaggacaccaucaccuccaaggucccgaccgaccgggaggacagccagcgcaucgacgaccucuccgcccgggacaagcccuucgacgugaagugcgagcugaaguucgcggacagcgacgccgacggcgacuga

SEQ ID NO: 36199 - RNA, 1848 nt, Artificial Sequence
  derived and/or modified sequence opt1 from SEMA4F__Homo_sapiens__NP_001258590
augcccgccagcgccgcgcgcccccggcccggccccgggcagcccaccgccuccccguucccccugcuccugcuggccgugcucagcggccccgucuccgggcgcgugccccggagcgugccgcgcaccucccugcccaucagcgaggccgacuccugccugacgcgguucgccgucccccacaccuacaacuacagcgugcuccugguggaccccgcgucccacacccuguacgucggcgcccgcgacaccaucuucgcccucagccugccguucuccggggagcggccccgccggaucgacuggauggugcccgaggcccaccgccagaacugccggaagaagggcaagaaggagggcgaccucgggggccgcaagacgcugcagcagcgguggaccaccuuccugaaggcggaccugcucugccccgggccggagcacggccgcgccagcuccgugcugcaggacgucgccgugcugcggcccgagcucggggccggcacccccaucuucuacggcaucuucagcucccagugggagggggccacgaucagcgcggugugcgccuuccgcccccaggacauccggaccguccugaacggcccguuccgcgagcugaagcacgacugcaaccgggggcuccccgugguggacaacgacgucccccagccccgcccgggcgagugcaucaccaacaacaugaagcugcggcacuucggcuccagccugucccuccccgaccgcgugcugaccuucauccgcgaccacccccugauggaccggcccguguucccggccgacgggcacccccuccuggucacgaccgacaccgccuaccugcgcgugguggcccaccgggucaccagccucagcggcaaggaguacgacgugcuguaccuggggacggaggacggccaccuccaccgcgcggugcggaucggggcccagcuguccguccuggaggaccucgcccuguuccccgagccgcagcccguggagaacaugaagcuguaccacagcuggcuccuggucggcucccgcaccgaggugacccaggugaacaccacgaacugcggccggcugcagagcugcuccgagugcauccucgcccaggaccccgucugcgccuggagcuuccgccuggacgagugcguggcgcacgccggggagcaccggggccuggugcaggacaucgaguccgccgacgucagcucccucugccccaaggagccgggggagcgccccgugguguucgagguccccguggccaccgccgcgcacgugguccugcccugcagcccguccagcgccugggccuccugcguguggcaccagcccagcggcgugaccgcccugacgccccggcgcgacgggcucgaggucguggugacccccggcgcgaugggcgccuacgccugcgagugccaggagggcggggccgcccacgucguggcggccuacucccuggugugggggagccagcgggacgccccgucccgcgcccacaccgucggcgccgggcuggcgggcuucuuccugggcauccucgccgccagccugacccugauccucaucgggcggcgccagcagcggcgccggcagcgcgagcugcuggcccgcgacaaggugggccucgaccugggggccccgcccuccggcaccacgagcuacagccaggacccgcccucccccagccccgaggacgagcggcugccccucgcgcuggccaagcgcggcuccggguucggcggguucagcccgcccuuccugcucgaccccugccccucccccgcccacauccggcugaccggcgccccgcuggcgaccugcgacgagaccagcaucuga

SEQ ID NO: 36200 - RNA, 2109 nt, Artificial Sequence
  derived and/or modified sequence opt1 from SEMA4G__Homo_sapiens__NP_001190173
auguggggccgccuguggccccuccugcugagcauccucaccgccaccgccgugccggggcccucccugcggcgccccagccgggagcuggacgcgacgccccgcaugaccaucccguacgaggagcucuccggcacccggcacuucaaggggcaggcccagaacuacagcacccugcugcucgaggaggccuccgcccgccugcuggucggcgcccgcggggcgcuguucagccuguccgccaacgacaucggcgacggcgcccacaaggagauccacugggaggccagccccgagaugcaguccaagugccaccagaaggggaagaacaaccagacggagugcuucaaccacgugcgguuccugcagcggcucaacagcacccaccuguacgcgugcggcacccacgccuuccagccccugugcgccgccaucgacgccgaggcguucacccuccccacguccuucgaggaggggaaggagaagugcccguacgaccccgcccgcggcuucaccgggcugaucaucgacggcggccuguacaccgccacccgguacgaguuccgcagcauccccgacauccggcgcucccggcacccccacagccuccgcacggaggagaccccgaugcacuggcugaacgacgccgaguucguguucuccguccuggugcgggagagcaaggccuccgcggugggggacgacgacaaggucuacuacuucuucaccgagcgcgccaccgaggagggcagcggguccuucacgcagagccggagcucccaccgcguggcccggguggcccgcgucugcaagggcgaccucggcgggaagaagauccugcagaagaaguggaccagcuuccugaaggcccgccucaucugccacaucccccuguacgagacccugcggggcgugugcucccucgacgcggagaccagcucccgcacgcacuucuacgccgccuucacccugagcacccaguggaagacccuggaggccuccgccaucugccgguacgaccucgcggagauccaggccguguucgccgggcccuacauggaguaccaggacggcagccgccggugggggcgcuacgagggcggcguccccgagccgcggcccggguccugcaucacggacagccugcgcucccagggcuacaacagcucccaggaccugcccagccucgugcuggacuucgugaagcugcacccccucauggcccggccggucgugcccacccgcgggcggccccugcugcucaagcgcaacauccgguacacccaccugaccggcacgcccgugaccaccccggcggggcccaccuacgaccuccucuuccugggcacggccgacggcuggauccacaaggccgucgugcugggguccggcaugcacaucaucgaggagacccagguguuccgcgagagccaguccgucgagaaccucgugaucagccugcugcagcacucccuguacgugggggcccccagcggcgucauccagcucccccugagcuccugcagccgguaccgcuccugcuacgacugcauccuggcccgggacccguacugcgggugggaccccggcacccacgcgugcgccgccgccaccacgaucgccaaccgcagccagggcucccggaccgcgcucauccaggacaucgagcgcgggaaccgcggcugcgagagcucccgggacaccgggcgcgcccuccaggugcacaugggcagcauguccccgcccagcgccuggcccugcguccuggacggccccgagacccggcaggaccugugccagcccccgaagcccugcgugcacucccacgcccacauggaggagugccugagcgccgggcugcagugcccccacccccaccuccugcuggugcacuccugcuucaucccggcgagcggccucgggguccccucccagcugccccaccccaucuggagcuccagcccggcccccugcggcgaccuguucgucaagagccucgggaccggccagcccggcgaggugcgccugcaccacuccccgccccugcccagcugcguggcccucgugaaccagccgccccacucccccuggagcuucucccggguguga

SEQ ID NO: 36201 - RNA, 3225 nt, Artificial Sequence
  derived and/or modified sequence opt1 from SEMA5A__Homo_sapiens__NP_003957
augaaggggaccugcgugaucgccuggcuguucagcucccucggccuguggcgccuggcccaccccgaggcgcagggcaccacgcagugccagcggaccgagcacccggucaucagcuacaaggagaucgggcccuggcuccgcgaguuccgggccaagaacgccguggacuucucccagcugaccuucgaccccggccagaaggagcugguggucggggcccgcaacuaccucuuccggcugcagcuggaggaccucagccugauccaggccguggagugggagugcgacgaggcgaccaagaaggccugcuacuccaagggcaagagcaaggaggagugccagaacuacauccgcgugcugcucgucggcggggaccggcuguucacgugcggcaccaacgccuucacccccgugugcaccaaccgcucccugagcaaccucacggagauccacgaccagaucuccgggauggcccggugcccguacagcccccagcacaacuccaccgcgcugcugaccgccggcggggagcucuacgccgccaccgccauggacuuccccggccgcgaccccgcgaucuaccggagccugggcauccugccgccccuccgcacggcccaguacaacuccaaguggcugaacgagcccaacuucgugagcuccuacgacaucgggaacuucaccuacuucuucuuccgggagaacgccgucgagcacgacugcggcaagaccguguucagccgcgccgcccgggugugcaagaacgacaucgggggccgcuuccugcucgaggacaccuggacgaccuucaugaaggcgcggcugaacugcucccgccccggcgaggucccguucuacuacaacgagcugcagagcaccuucuuccuccccgagcuggaccugaucuacgggaucuucaccacgaacgugaacuccaucgccgccagcgccgugugcgucuucaaccucagcgccaucgcgcaggccuucuccggccccuucaaguaccaggagaacagccgguccgccuggcugcccuacccgaaccccaacccccacuuccagugcgggaccguggaccagggccuguacgugaaccucaccgagcgcaaccugcaggacgcccagaaguucauccugaugcacgaggucgugcagcccgugaccacggucccgagcuucauggaggacaacucccgguucagccacguggccguggacgucgugcaggggcgcgaggcgcucguccacaucaucuaccuggccaccgacuacggcaccaucaagaaggugcgcgugccccugaaccagaccuccagcuccugccuccuggaggagaucgagcuguuccccgagcggcgccgggagcccauccgcagccuccagauccugcacucccagagcguccuguucgugggccuccgggagcacguggucaagaucccgcugaagcgcugccaguucuaccggacgcgcuccacgugcaucggggcccaggaccccuacugcggcugggacguggugaugaagaagugcaccagccuggaggagucccucagcaugacccagugggagcaguccaucagcgccugccccacccggaaccugaccgucgacgggcacuucggcguguggucccccuggaccccgugcacccacacggacgggagcgcggugggcagcugccugugccgcacccgguccugcgacagccccgcgccccagugcggcggguggcagugcgagggcccggggauggagaucgccaacugcucccgcaacggcggguggacccccuggaccagcuggucccccugcagcaccacgugcggcaucggcuuccagguccggcagcgcuccugcagcaaccccaccccgcggcacgggggccgcgugugcguggggcagaaccgggaggagcgcuacugcaacgagcaccuccugugcccgccccacauguucuggaccggcuggggccccugggagcggugcaccgcccagugcgggggcgggauccaggcccgccgccggaucugcgagaacggccccgacugcgccgggugcaacgucgaguaccaguccugcaacacgaaccccugccccgagcugaagaagaccacccccuggaccccguggacgcccgugaacaucagcgacaacggcggccacuacgagcagcgcuuccgguacacgugcaaggcccgccuggccgaccccaaccuccuggagguggggcggcagcgcaucgagaugcgguacugcuccagcgacggcaccuccgggugcagcaccgacggccuguccggggacuuccuccgcgccggccgguacagcgcccacaccgucaacggcgcgugguccgccuggaccagcuggagccagugcucccgcgacugcagccgggggauccgcaaccggaagcgcgugugcaacaaccccgagccgaaguacggcgggaugcccugccugggccccucccuggaguaccaggagugcaacauccuccccugcccgguggacggggucuggagcugcuggucccccuggaccaagugcagcgcgaccugcggcggcgggcacuacaugcggacgcgcuccugcagcaaccccgcccccgccuacggcggggacaucugccugggccugcacaccgaggaggcccucugcaacacccagccgugccccgaguccuggagcgagugguccgacuggagcgagugcgaggccuccgggguccaggugcgggcccgccagugcauccugcuguuccccaugggcagccagugcuccggcaacaccacggagagccggccgugcguguucgacuccaacuucauccccgaggugagcguggcccgcuccagcagcgucgaggagaagcggugcggggaguucaacauguuccacaugaucgcggugggccucuccagcuccauccuggggugccugcucacccugcugguguacaccuacugccagcgcuaccagcagcagagccacgacgccaccgucauccaccccgugucccccgccccgcucaacacgagcaucaccaaccacaucaacaagcuggacaaguacgacuccguggaggccaucaaggccuucaacaagaacaaccugauccucgaggagcgcaacaaguacuucaacccccaccugaccggcaagaccuacagcaacgcguacuucacggaccugaacaacuacgacgaguacuga

SEQ ID NO: 36202 - RNA, 3456 nt, Artificial Sequence
  derived and/or modified sequence opt1 from SEMA5B__Homo_sapiens__NP_001026872
augcccugcggcuucagcccgucccccguggcccaccaccugguccccgggcccccggacacccccgcccagcagcuccgcugcggcuggaccgucgggggcuggcugcugagccucgugcgggggcugcugcccugccugcccccgggcgcgcgcacggccgagggccccaucauggugcuggccgggccccuggccgugucccuccugcugcccagccucacccugcuggugucccaccucagcuccagccaggacgucuccagcgagccguccagcgagcagcagcugugcgcccuguccaagcaccccaccguggcguucgaggaccuccagcccugggugagcaacuucaccuaccccggcgcccgggacuucucccagcuggcccuggacccgagcgggaaccagcucaucgucggcgcccgcaacuaccuguuccggcugucccucgcgaacgugagccugcugcaggccacggagugggccuccagcgaggacacccgccggagcugccaguccaaggggaagaccgaggaggagugccagaacuacgugcgcguccucaucguggccggccggaagguguucaugugcggcaccaacgccuucagccccaugugcacgucccgccaggucgggaaccugagccggaccaucgagaagaucaacggcguggcgcgcugccccuacgacccccggcacaacuccaccgccgugaucagcucccagggggagcuguacgccgccaccgucaucgacuucagcggccgcgacccggccaucuaccggucccucggcagcgggccgccccugcgcacggcgcaguacaacuccaaguggcugaacgagcccaacuucguggccgccuacgacaucggccucuucgccuacuucuuccugcgggagaacgccguggagcacgacugcgggcgcaccgucuacagccggguggcgcgcgugugcaagaacgacgucggcgggcgguuccugcucgaggacaccuggaccacguucaugaaggcccgccugaacugcucccgccccggcgaggugcccuucuacuacaacgagcugcagagcgccuuccaccuccccgagcaggaccugaucuacggcgucuucaccaccaacgugaacuccaucgccgccagcgcggugugcgccuucaaccuguccgccaucagccaggccuucaacgggcccuuccgguaccaggagaacccgcgcgcggccuggcuccccaucgccaaccccaucccgaacuuccagugcggcacccugcccgagacggggcccaacgagaaccugaccgagcggucccuccaggacgcccagcgccuguuccugaugagcgaggccguccagcccgugaccccggagcccugcgugacccaggacagcguccgguucucccaccucgugguggaccugguccaggcgaaggacacgcuguaccacgugcuguacaucggcaccgagagcgggaccauccucaaggcccuguccaccgccagccgcucccugcacggcugcuaccucgaggagcugcacgugcugccgcccggccggcgcgagccccuccggagccugcgcauccugcacuccgcccgggcccucuucgucgggcugcgcgacggcgugcugcgggugccccucgagcgcugcgcggccuaccggagccagggggccugccugggcgcccgcgaccccuacugcgggugggacggcaagcagcagcggugcuccacgcuggaggacagcuccaacaugagccucuggacccagaacaucaccgccugccccguccgcaacgugacccgggacggcggguucggcccguggucccccuggcagcccugcgagcaccuggacggggacaacagcggcuccugccugugccgcgcgcgcagcugcgacagcccccggccgcgcugcggcgggcucgacugccugggccccgccauccacaucgccaacugcagccggaacggggccuggacgcccuggagcuccugggcgcugugcagcaccuccugcggcaucggguuccaggugcgccagcggagcugcuccaaccccgccccgcgccacggcggccggaucugcgucgggaagucccgcgaggagcgguucugcaacgagaacacccccugccccgugcccaucuucugggccuccuggggcagcugguccaagugcagcuccaacugcgggggcgggaugcagagccgccggcgcgccugcgagaacggcaacuccugccucggcugcgggguggaguucaagaccugcaacccggagggcugccccgagguccggcgcaacacgcccuggaccccguggcugcccgugaacgugacccagggcggggcccggcaggagcagcgcuuccgguucacgugccgcgcgccccuggccgacccccacgggcuccaguucggccggcgccggaccgagacccggaccugcccggccgacggcagcggguccugcgacaccgacgcccuggucgaggugcugcuccgcagcggcuccaccagcccccacacgguguccgggggcugggccgcgugggggcccuggagcagcugcucccgcgacugcgagcugggcuuccgcguccggaagcggaccugcaccaaccccgagccgcgcaacggcgggcugcccugcgugggcgacgccgccgaguaccaggacugcaacccccaggccugccccgugcgcggggccuggagcugcuggaccuccuggagcccgugcuccgcgagcugcggcggcgggcacuaccagcggacgcgcuccugcaccagccccgcccccucccccggcgaggacaucugccucgggcugcacaccgaggaggcccugugcgccacccaggcgugcccggagggcuggagccccugguccgaguggagcaagugcacggacgacggggcccagucccggagccgccacugcgaggagcuccugcccggcuccagcgccugcgccggcaacuccagccagucccggcccugcccguacagcgagauccccgucauccugcccgccagcuccauggaggaggcgaccgacugcgccggguucaaccucauccaccugguggccaccggcaucagcugcuuccugggguccggccuccugacccuggccguguaccucagcugccagcacugccagcgccagucccaggagagcacgcugguccaccccgccaccccgaaccaccuccacuacaagggcgggggcacccccaagaacgagaaguacacccccauggaguucaagacgcucaacaagaacaaccugauccccgacgaccgggcgaacuucuacccgcugcagcagaccaacguguacaccaccacguacuaccccagcccccucaacaagcacuccuuccgcccggaggccucccccgggcagcggugcuuccccaacagcuga

SEQ ID NO: 36203 - RNA, 3144 nt, Artificial Sequence
  derived and/or modified sequence opt1 from SEMA6A__Homo_sapiens__NP_001287709
augcgcagcgaggcccugcuccuguacuucacccugcuccacuucgccggcgcgggguuccccgaggacuccgagccgaucagcaucucccacggcaacuacaccaagcaguaccccguguucgucgggcacaagcccggccggaacacgacccagcgccaccggcuggacauccagaugaucaugaucaugaacgggacccuguacaucgccgcccgcgaccacaucuacaccguggacaucgacacgagccacaccgaggagaucuacugcuccaagaagcucaccuggaagagccggcaggccgacguggacaccugccgcaugaagggcaagcacaaggacgagugccacaacuucaucaagguccugcugaagaagaacgacgacgcccucuucgugugcggcacgaacgcguucaaccccuccugccggaacuacaagauggacacccuggagccguucggggacgaguucagcggcauggcccgcugccccuacgacgccaagcacgccaacguggcgcuguucgccgacgggaagcucuacuccgccaccgucaccgacuuccuggccaucgacgccgugaucuaccggagccugggcgagucccccacgcuccgcaccgugaagcacgacagcaaguggcugaaggagcccuacuucguccaggcgguggacuacggggacuacaucuacuucuucuuccgggagaucgccguggaguacaacaccaugggcaaggucguguucccgcgcguggcccaggucugcaagaacgacaugggcgggucccagcgggugcuggagaagcaguggaccagcuuccucaaggcccgccugaacugcuccgugcccggcgacagccacuucuacuucaacauccugcaggccgucacggacgugauccggaucaacgggcgcgacgugguccucgcgaccuucuccacccccuacaacagcauccccggcuccgccgugugcgccuacgacaugcuggacaucgccagcguguucaccggccgguucaaggagcagaagagcccggacuccacguggacccccguccccgacgagcgcgugcccaagccgcggcccgggugcugcgccggcagcuccagccuggagcgcuacgcgaccuccaacgaguuccccgacgacacccucaacuucaucaagacgcacccccugauggacgaggccgucccgagcaucuucaaccggcccugguuccugcgcaccauggugcgcuaccggcucaccaagaucgccguggacaccgccgccgggcccuaccagaaccacacggucguguuccugggcuccgagaaggggaucauccugaaguuccucgcgcgcaucggcaacagcggcuuccugaacgacucccuguuccucgaggagaugagcguguacaacuccgagaagugcagcuacgacggggucgaggacaagcggaucaugggcaugcagcuggaccgcgccuccagcucccuguacguggccuucagcaccugcgugaucaaggucccccucgggcggugcgagcgccacggcaagugcaagaagaccugcaucgccucccgggacccguacugcggguggaucaaggagggcggcgcgugcagccaccugucccccaacagccgccugaccuucgagcaggacaucgagcgggggaacacggacggccucggggacugccacaacagcuucguggcccugaacgacaucuccaccccccugcccgacaacgagaugagcuacaacaccguguacggccacuccagcucccuccugccgagcaccacgaccuccgacagcaccgcccaggagggguacgagucccgcggcggcaugcuggacuggaagcaccuccuggacagccccgacuccaccgacccccugggggccgucagcucccacaaccaccaggacaagaagggcgugauccgggagagcuaccucaaggggcacgaccagcuggugccggucacccugcuggccaucgcggugauccucgccuucgugaugggcgccgucuucuccggcaucacgguguacugcgugugcgaccaccgccggaaggacgucgccguggugcagcgcaaggagaaggagcugacccacagccggcgcggguccaugagcagcgucaccaagcuguccggccucuucggggacacccagagcaaggaccccaagcccgaggccauccugacgccccugaugcacaacggcaagcucgcgaccccggggaacaccgccaagaugcugaucaaggccgaccagcaccaccuggaccucaccgcccugcccacgcccgaguccacccccacccugcagcagaagcggaagccgagccgcggcucccgggagugggagcgcaaccagaaccucaucaacgccugcaccaaggacaugccccccaugggcagccccgugaucccgacggaccugccccugcgcgcgucccccagccacauccccuccguggucgugcucccgaucacccagcagggguaccagcacgaguacguggaccagcccaagaugagcgaggucgcccagauggcccuggaggaccaggccgcgacccuggaguacaagaccaucaaggagcaccucuccagcaagucccccaaccacggcgugaaccugguggagaaccuggacagccuccccccgaaggucccccagcgggaggccucccuggggccccccggcgccagccugucccagacggggcucagcaagcgccuggagaugcaccacuccagcagcuacggcguggacuacaagcgguccuacccgaccaacagccugacccgcucccaccaggccaccacgcucaagcggaacaacaccaacagcuccaacagcucccaccugagccgcaaccaguccuucggccggggggacaacccccccccggccccccagcgcguggacagcauccagguccacuccagccagcccuccggccaggcggugaccgugagccggcagcccucccugaacgccuacaacagccucacccgcuccgggcugaagcggacgccgagccugaagcccgacgucccccccaagccguccuucgccccccucagcaccagcaugaagcccaacgacgccugcaccuga

SEQ ID NO: 36204 - RNA, 2667 nt, Artificial Sequence
  derived and/or modified sequence opt1 from SEMA6B__Homo_sapiens__NP_115484
augcagacgccccgcgccagcccgccccggcccgcccugcuccugcugcuccugcugcucggcggggcgcacggccuguuccccgaggagccgccgccccuguccguggcgccccgcgacuaccucaaccacuaccccgucuucguggggagcggccccgggcggcugacccccgccgagggcgccgacgaccugaacauccagcgcgugcuccgggucaaccgcacgcuguucaucggcgaccgggacaaccuguaccgcguggagcucgagcccccgaccuccaccgagcugcgguaccagcgcaagcugaccuggcggagcaaccccuccgacaucaacgugugccgcaugaaggggaagcaggagggcgagugccggaacuucgucaaggugcuccugcugcgcgacgagagcacccucuucgugugcggguccaacgccuucaaccccgucugcgccaacuacagcaucgacacccugcagcccgugggcgacaacaucuccgggauggcccggugcccguacgaccccaagcacgccaacguggcccuguucagcgacggcaugcuguucaccgcgaccgucacggacuuccuggccaucgacgccgugaucuaccgcucccugggcgaccggcccacccuccgcaccgugaagcacgacagcaagugguucaaggagcccuacuucguccacgccguggagugggggucccacguguacuucuucuuccgggagaucgccauggaguucaacuaccuggagaaggucguggugagccgcgucgcgcgggugugcaagaacgacgugggcggguccccgcgcguccuggagaagcaguggaccagcuuccucaaggcccgccugaacugcuccgugcccggcgacagccacuucuacuucaacguccugcaggccgugacgggcguggucucccucgggggccggcccguggugcuggccgucuucagcacccccagcaacuccaucccggggagcgccgugugcgcguucgaccugacccagguggccgccgucuucgagggccgcuuccgggagcagaagucccccgagagcaucuggacccccgugcccgaggaccaggugccgcgcccccggcccgggugcugcgccgccccgggcaugcaguacaacgcguccagcgcccuccccgacgacauccugaacuucgucaagacgcacccccugauggacgaggccgugcccucccucggccacgccccguggauccugcgcacccugaugcggcaccagcucacccgcguggccgucgacgugggggcgggccccugggggaaccagaccguggucuuccugggcagcgaggccgggacggugcugaaguuccucgugcggcccaacgccuccaccagcggcaccuccggccugagcgucuuccuggaggaguucgagaccuaccgccccgaccggugcgggcgcccgggcgggggcgagacggggcagcggcuccugucccuggagcuggacgccgcgagcggcggccuccuggccgccuucccccgcugcguggugcggguccccguggcccgcugccagcaguacuccgggugcaugaagaacugcaucggcagccaggaccccuacugcgggugggccccggacggcuccugcaucuuccugagccccggcacccgggcggccuucgagcaggacguguccggggccagcaccagcggccucggggacugcaccggccugcugcgcgccucccucagcgaggaccgggccgggcuggucuccgugaaccugcucgugacgagcuccgucgcggccuucguggugggcgccgucgugagcggcuucuccguggggugguucgucggccugcgcgagcgccgggagcuggcccgccggaaggacaaggaggccauccucgcgcacggggccggcgaggccgugcugagcgugucccgccugggggagcggcgcgcccagggccccggcgggcggggcgggggcgggggcggcggggcgggcgugcccccggaggcccuccuggcgccccugaugcagaacgggugggccaaggccacccuccugcagggcgggccccacgaccuggacagcggccuccugcccaccccggagcagacgccccugccccagaagcgccuccccaccccgcacccccacccccacgcccugggcccgcgggccugggaccacgggcacccccugcuccccgccuccgccagcuccagccugcugcuccuggcccccgcgcgcgccccggagcagccgcccgcccccggcgagcccacccccgacgggcggcuguacgccgcccgccccggccgggcgucccacggcgacuucccccucaccccgcacgccagccccgaccgccggcgcgucguguccgcccccaccgggccccuggacccggccagcgcggccgacggccugccccggcccuggagcccgccgcccacggggucccuccgccggccccugggcccccacgccccgcccgccgccacccugcgccggacccacaccuucaacagcggggaggcgcgccccggcgaccgccaccggggcugccacgcccgccccgggaccgaccucgcccaccuccugcccuacggcggggccgaccggacggccccgcccguccccuga

SEQ ID NO: 36205 - RNA, 3036 nt, Artificial Sequence
  derived and/or modified sequence opt1 from SEMA6D__Homo_sapiens__NP_001185928
augcgcguguuccugcucugcgccuacauccugcugcucauggucagccagcugcgggccguguccuuccccgaggacgacgagccgcugaacaccguggacuaccacuacagccgccaguaccccgucuuccggggccgccccuccgggaacgagagccagcaccggcucgacuuccagcugaugcugaagauccgcgacacccucuacaucgcgggccgggaccagguguacacggugaaccugaacgagaugcccaagaccgaggucaucccgaacaagaagcugaccuggcgcucccggcagcaggaccgcgagaacugcgccaugaaggggaagcacaaggacgagugccacaacuucaucaagguguucgugccccggaacgacgagauggucuucgugugcggcaccaacgccuucaaccccaugugccgcuacuaccggcucagcacgcuggaguacgacggggaggagaucuccggccuggcccgcugccccuucgacgcccggcagaccaacguggcgcucuucgccgacggcaagcuguacagcgccaccgucgccgacuuccuggcguccgacgccgugaucuaccgcagcaugggggacggcuccgcccuccggaccaucaaguacgacagcaaguggaucaaggagccgcacuuccugcacgccaucgaguacgggaacuacguguacuucuucuuccgcgagaucgccgucgagcacaacaaccugggcaaggcgguguacucccggguggcccgcaucugcaagaacgacauggggggcagccagcggguccucgagaagcacuggacguccuuccugaaggcccgccugaacugcagcgugcccggcgacuccuucuucuacuucgacgugcuccagagcaucaccgacaucauccagaucaacgggauccccaccgucgugggcguguucaccacgcagcugaacuccauccccgggagcgccgucugcgccuucagcauggacgacaucgagaagguguucaagggccgcuucaaggagcagaagaccccggacuccgucuggaccgcggugcccgaggacaaggugcccaagccccggccgggcugcugcgccaagcacgggcuggccgaggccuacaagaccagcaucgacuuccccgacgagacgcucuccuucaucaagagccacccccugauggacuccgccguccccccgaucgcggacgagcccugguucaccaagacccgcgugcgguaccgccugaccgccaucagcguggaccacuccgccggccccuaccagaacuacacggucaucuucguggggagcgaggccggcauggugcucaagguccuggccaagaccucccccuucagccugaacgacuccgugcuccuggaggagaucgaggcguacaaccacgccaagugcagcgccgagaacgaggaggacaagaaggugaucucccugcagcucgacaaggaccaccacgcccuguacgucgcguucagcuccugcaucauccggaucccgcugagccgcugcgagcgguacggguccugcaagaagagcugcaucgccucccgcgaccccuacugcggcuggcucagccagggcagcugcgggcgggugacccccggcaugcugcugcucaccgaggacuucuucgccuuccacaaccacuccgccgagggguacgagcaggacacggaguucggcaacaccgcccaccugggggacugccacggcgugcgcugggagguccagagcggcgaguccaaccagauggugcacaugaacgugcugaucaccugcgucuucgcggccuucgugcucggggccuucaucgccggcguggccgucuacugcuaccgggacauguucgugcgcaagaaccggaagauccacaaggacgcggagagcgcccaguccugcaccgacagcuccgggagcuucgccaagcugaacggccuguucgacucccccgugaaggaguaccagcagaacaucgacagcccgaagcucuacuccaaccugcugacgagccgcaaggagcugccccccaacggggacaccaaguccauggucauggaccaccggggccagccgcccgagcucgccgcccugcccacccccgagagcaccccggugcugcaccagaagacgcuccaggcgaugaagucccacagcgagaaggcccacggccacggggccucccgcaaggagaccccccaguucuuccccagcagccccccgccccacuccccccugagccacggccacauccccuccgccaucgugcugccgaacgcgacccacgacuacaacaccagcuucuccaacagcaacgcccacaaggccgagaagaagcuccagaacaucgaccacccccugacgaaguccagcuccaagcgggaccaccgccggagcgucgacucccgcaacacccugaacgaccuccugaagcaccugaacgaccccaacagcaaccccaaggccaucaugggggacauccagauggcccaccagaaccucaugcuggacccgaugggcuccaugagcgaggugccccccaaggugcccaaccgcgaggcgucccuguacagcccgcccuccacccucccccggaacagccccaccaagcgcgucgacgugccgaccacgcccggcgugcccaugaccucccuggagcggcagcgcggguaccacaagaacagcagccagcggcacuccaucagcgccaugccgaagaaccugaacucccccaacggcguccuccugagccgccagcccuccaugaaccgggggggcuacaugcccaccccgaccggggccaagguggacuacauccagggcacgcccgugagcguccaccugcagcccucccucagccgccaguccagcuacaccuccaacggcacccugccccggaccgggcugaagcgcacgccgagccucaagcccgacgugccccccaagccguccuucgugccccagacccccagcguccggccccugaacaaguacaccuacuga

SEQ ID NO: 36206 - RNA, 1959 nt, Artificial Sequence
  derived and/or modified sequence opt1 from SEMA7A__Homo_sapiens__NP_001139501
augacgcccccgccgcccggccgcgccgcccccagcgcgccccgggcccgcgugcccgggccgcccgcccggcugggccucccccugcgccugcggcuccugcugcuccugugggccgccgcggccuccgcccaggggcaccuccgcagcggcccccggaucuucgccgucuggaaggggcacgugggccaggaccgcguggacuucggccagaccgagccccacaccguccucuuccacgagcccggguccagcuccgugugggugggcgggcggggcaaggucuaccuguucgacuucccggaggggaagaacgcgagcgugcgcaccgacugcgagaacuacaucacccugcucgagcggcgcuccgagggccugcuggccugcggcaccaacgcccggcaccccagcugcuggaaccucgugaacgggacggucgugccccugggcgagaugcgcggguacgcccccuucuccccggacgagaacagccuggugcuguucgagggcgacgaggucuacuccaccauccggaagcaggaguacaacggcaagaucccccgcuuccggcgcauccgcggggagagcgagcuguacaccuccgacaccgugaugcagaacccccaguucaucaaggccacgaucgugcaccaggaccaggcguacgacgacaagaucuacuacuucuuccgggaggacaaccccgacaagaacccggaggcgccccugaacgucagccggguggcccagcucugccgcggcgaccagggcggggaguccagccuguccgugagcaaguggaacaccuuccugaaggccaugcucgucugcuccgacgccgccaccaacaagaacuucaaccgccugcaggacguguuccugcuccccgaccccagcgggcaguggcgggacacccgcguguacggcgucuucagcaacccguggaacuacuccgccgugugcguguacagccugggcgacaucgacaaggucuuccggacguccagccugaagggguaccacuccagccuccccaacccccgccccggcaagugccugccggaccagcagcccauccccaccgagaccuuccagguggccgaccggcacccggaggucgcccagcgcguggagcccauggggccccugaagacgccccucuuccacuccaaguaccacuaccagaagguggccguccaccggaugcaggcgagccacggcgagaccuuccacgugcuguaccugaccaccgaccgcgggaccauccacaagguggucgagccgggcgagcaggagcacuccuucgccuucaacaucauggagauccagcccuuccggcgcgccgccgccauccagacgaugagccucgacgcggagcggcgcaagcuguacguguccagccagugggaggugucccaggucccccuggaccucugcgagguguacggcgggggcugccacgggugccugaugagccgggaccccuacugcggcugggaccaggggcgcugcaucuccaucuacagcuccgagcggagcgugcugcaguccaucaacccggccgagccccacaaggagugccccaaccccaagccggacaaggcgccccuccagaaggucagccuggcccccaacagccgcuacuaccuguccugccccauggagagccggcacgccaccuacuccuggcgccacaaggagaacguggagcagagcugcgagccgggccaccagucccccaacugcauccucuucaucgagaaccugaccgcccagcaguacggccacuacuucugcgaggcccaggaggggagcuacuuccgggaggcccagcacuggcagcugcuccccgaggacggcaucauggccgagcaccuccuggggcacgcgugcgcccuggccgccucccuguggcugggcgugcugcccacccucacgcugggccugcucguccacuga

SEQ ID NO: 36207 - RNA, 1389 nt, Artificial Sequence
  derived and/or modified sequence opt1 from SEMG1__Homo_sapiens__NP_002998
augaagcccaacaucaucuucgugcugagccuccugcugauccucgagaagcaggccgccgucaugggccagaagggcggguccaaggggcgccugccgagcgaguucucccaguucccccacggccagaaggggcagcacuacagcggccagaagggcaagcagcagaccgaguccaaggggagcuucuccauccaguacaccuaccacguggacgcgaacgaccacgaccagagccggaagucccagcaguacgaccugaacgcccuccacaagacgaccaagagccagcgccaccugggcgggucccagcagcugcuccacaacaagcaggagggccgggaccacgacaagagcaaggggcacuuccaccgcguggucauccaccacaagggcggcaaggcccaccgggggacccagaaccccucccaggaccagggcaacagccccuccgggaagggcaucagcucccaguacagcaacaccgaggagcgccugugggugcacggccuguccaaggagcagacgagcgugagcggggcccagaagggccggaagcagggcgggucccagagcuccuacguccuccagaccgaggagcugguggccaacaagcagcagcgcgagaccaagaacagccaccagaacaaggggcacuaccagaacguggucgaggugcgggaggagcacuccagcaaggugcagaccucccugugcccggcgcaccaggacaagcuccagcacggcagcaaggacaucuucuccacgcaggacgagcugcuggucuacaacaagaaccagcaccagaccaagaaccucaaccaggaccagcagcacggccgcaaggccaacaagaucagcuaccaguccagcuccaccgaggagcggcgccugcacuacggggagaacggcgugcagaaggacgugagccaguccagcaucuacucccagaccgaggagaaggcccagggcaagagccagaagcagaucacgauccccucccaggagcaggagcacagccagaaggccaacaagaucagcuaccaguccagcuccaccgaggagcggcgccugcacuacggggagaacgggguccagaaggacgugagccagcgguccaucuacagccagaccgagaagcucguggcgggcaagucccagauccaggcccccaaccccaagcaggagccguggcacggcgagaacgccaagggggagagcggccaguccaccaaccgcgagcaggaccugcugagccacgagcagaaggggcggcaccagcacggcucccacgggggccucgacaucgucaucaucgagcaggaggacgacagcgaccgccaccuggcccagcaccugaacaacgaccggaacccccucuucacguga

SEQ ID NO: 36208 - RNA, 1749 nt, Artificial Sequence
  derived and/or modified sequence opt1 from SEMG2__Homo_sapiens__NP_002999
augaaguccaucauccuguucgugcucagccugcugcucauccuggagaagcaggccgccgucaugggccagaagggcgggagcaaggggcagcugcccuccggcagcucccaguucccgcacgggcagaagggccagcacuacuucggccagaaggaccagcagcacaccaagagcaagggguccuucagcauccagcacaccuaccacguggacaucaacgaccacgacuggacgcgcaagucccagcaguacgaccucaacgcgcugcacaaggccaccaagagcaagcagcaccugggcgggucccagcagcuccugaacuacaagcaggagggccgggaccacgacaagagcaaggggcacuuccacaugaucgugauccaccacaagggcggccaggcccaccacgggacccagaaccccucccaggaccagggcaacagccccuccgggaagggccugagcucccagugcagcaacaccgagaagcgccucuggguccacggccuguccaaggagcaggccagcgccagcggggcgcagaagggccggacgcagggcgggucccagagcuccuacgugcugcagaccgaggagcucguggucaacaagcagcagcgcgagaccaagaacagccaccagaacaaggggcacuaccagaacgugguggacguccgggaggagcacuccagcaagcugcagaccucccugcaccccgcccaccaggaccgccuccagcacggcccgaaggacaucuucacgacccaggacgagcugcugguguacaacaagaaccagcaccagaccaagaaccucagccaggaccaggagcacggccggaaggcccacaagaucuccuaccccagcucccgcaccgaggagcggcagcugcaccacggggagaaguccgugcagaaggacgucagcaagggcagcaucuccauccagacggaggagaagauccacggcaagagccagaaccaggugaccauccacucccaggaccaggagcacgggcacaaggagaacaagaucagcuaccaguccagcagcaccgaggagcgccaccugaacugcggggagaagggcauccagaagggcguguccaaggggagcaucuccauccagaccgaggagcagauccacggcaagagccagaaccagguccggauccccucccaggcccaggaguacgggcacaaggagaacaagaucagcuaccaguccagcuccacggaggagcgccggcucaacagcggcgagaaggacgugcagaaggggguguccaagggcagcaucuccauccagaccgaggagaagauccacggcaagagccagaaccaggucaccauccccucccaggaccaggagcacgggcacaaggagaacaagaugagcuaccaguccagcagcaccgaggagcgccggcugaacuacggcgggaaguccacgcagaaggacgugagccaguccagcaucuccuuccagaucgagaagcugguggagggcaagagccagauccagaccccgaaccccaaccaggaccagugguccggccagaacgcgaagggcaagagcgggcaguccgccgacagcaagcaggaccuccugucccacgagcagaaggggcgcuacaagcaggagagcuccgagagccacaacaucgucaucaccgagcacgagguggcccaggacgaccaccugacccagcaguacaacgaggaccggaaccccaucuccacguga

SEQ ID NO: 36209 - RNA, 1935 nt, Artificial Sequence
  derived and/or modified sequence opt1 from SENP1__Homo_sapiens__NP_001254524
auggacgacaucgccgaccgcaugcggauggacgccggcgaggugacccuggucaaccacaacagcguguucaagacccaccuccugccccagacgggguucccggaggaccagcugucccucagcgaccagcagauccuguccagccgccagggccaccuggaccgguccuucacgugcagcacccgcuccgcggccuacaaccccagcuacuacuccgacaaccccagcuccgacagcuuccucggguccggcgaccugcggaccuucgggcagagcgccaacggccaguggcgcaacuccacccccagcuccagcuccagccugcagaagucccggaacagccgcagccucuaccuggagacccggaagaccuccagcggccuguccaacagcuucgccgggaaguccaaccaccacugccacgugagcgccuacgagaaguccuucccgaucaagcccguccccagccccuccuggagcggcuccugccgccggagccuccuguccccgaagaagacccagcgccggcacgugagcacggcggaggagaccgugcaggaggaggagcgcgagaucuaccggcagcugcuccagauggucaccgggaagcaguucaccaucgccaagcccacgacccacuucccccugcaccugucccgcugccucagcuccagcaagaacacccugaaggacagccuguucaagaacggcaacuccugcgccagccagaucaucggguccgacaccagcuccagcggcuccgccagcauccucacgaaccaggagcagcugucccacagcguguacucccugagcuccuacacccccgacguggcguucggcagcaaggacuccgggacccuccaccacccgcaccaccaccacagcgucccccaccagcccgacaaccuggccgccuccaacacccagagcgagggcagcgacuccgugauccugcucaaggugaaggacagccagacgcccaccccguccagcaccuucuuccaggccgagcuguggaucaaggagcugaccuccgucuacgacagccgggcccgcgagcggcuccgccagaucgaggagcagaaggcgcuggcccugcagcuccagaaccagcggcugcaggagcgcgagcacuccgugcacgacagcguggagcugcaccuccgcgucccccuggagaaggagauccccgugacggugguccaggagacccagaagaaggggcacaagcugaccgacuccgaggacgaguuccccgagaucaccgaggagauggagaaggagaucaagaacguguuccggaacggcaaccaggacgaggugcucagcgaggccuuccgccugacgaucacccggaaggacauccagacccugaaccaccucaacuggcugaacgacgagaucaucaacuucuacaugaacaugcugauggagcgcuccaaggagaagggccucccgagcguccacgccuucaacaccuucuucuucacgaagcugaagaccgccggguaccaggcggugaagcgguggaccaagaagguggacgucuucuccguggacauccugcucguccccauccaccugggcgugcacuggugccuggccguggucgacuuccgcaagaagaacaucaccuacuacgacagcaugggcgggaucaacaacgaggccugccggauccugcuccaguaccugaagcaggaguccaucgacaagaagcgcaaggaguucgacacgaacggguggcagcuguucagcaagaagucccaggagaucccccagcagaugaacggcagcgacugcggcauguucgccugcaaguacgccgacugcaucaccaaggaccggcccaucaacuucacccagcagcacaugccguacuuccgcaagcggauggugugggagauccuccaccgcaagcugcuguga

SEQ ID NO: 36210 - RNA, 1770 nt, Artificial Sequence
  derived and/or modified sequence opt1 from SENP2__Homo_sapiens__NP_067640
auguaccgcuggcuggugcggauccucggcaccaucuuccgcuucugcgaccggagcgugcccccggcccgcgcccugcugaagcggcgccgguccgacagcacccucuucuccacggucgacaccgacgagauccccgcgaagcgcccccggcuggacugcuucauccaccaggugaagaacagccuguacaacgccgccucccucuucggguuccccuuccagcugaccaccaagccgauggucacgagcgccugcaacggcacccgcaacguggcccccuccggggagguguucagcaacuccagcuccugcgagcugaccggcagcggguccuggaacaacaugcucaagcugggcaacaagagccccaacggcaucuccgacuaccccaagauccgggucaccgugacgcgcgaccagccgcggcgcgugcugcccagcuucggguucacccucaacuccgagggcugcaaccggcgccccgggggccggcgccacagcaaggggaaccccgaguccagccugauguggaagccgcaggagcaggcggucaccgagaugaucagcgaggaguccggcaagggccugcggcgcccccacugcaccguggaggagggggugcagaaggaggagcgggagaaguaccgcaagcuccuggagcgccugaaggagagcggccacgggaacuccgucugccccgugacgagcaacuaccacuccagccagcggucccagauggacacccucaagaccaagggcuggggcgaggagcagaaccacggggugaagaccacgcaguucguccccaagcaguaccgccugguggagacccggggcccgcugugcagccuccgcuccgagaagcggugcagcaaggggaagaucaccgacaccgagacgauggugggcauccgcuucgagaacgagucccggcgcggguaccagcuggagcccgaccugagcgaggaggucuccgcccggcuccgccugggcagcggcuccaacgggcugcuccggcgcaaggugagcaucaucgagaccaaggagaagaacugcuccggcaaggagcgggaccgccggaccgacgaccugcuggagcucaccgaggacauggagaaggagaucagcaacgcccuggggcacggcccccaggacgagauccuguccagcgccuucaagcuccgcaucacgcgcggggacauccagacccugaagaacuaccacuggcugaacgacgaggugaucaacuucuacaugaaccuccuggucgagcggaacaagaagcagggcuaccccgcgcugcacguguucagcaccuucuucuacccgaagcucaaguccggcggguaccaggccgugaagcgguggaccaagggcgucaaccuguucgagcaggagaucauccuggugcccauccaccgcaagguccacuggagccucguggugaucgaccugcgcaagaagugccugaaguaccucgacuccauggggcagaagggccaccggaucugcgagauccugcugcaguaccuccaggacgagagcaagacgaagcgcaacuccgaccugaaccugcuggaguggacccaccacagcaugaagccccacgagaucccccagcagcucaacggguccgacugcggcauguucacgugcaaguacgccgacuacaucagccgggacaagccgaucaccuucacccagcaccagaugccccuguuccgcaagaagauggucugggagauccugcaccagcagcuccuguga

SEQ ID NO: 36211 - RNA, 1725 nt, Artificial Sequence
  derived and/or modified sequence opt1 from SENP3__Homo_sapiens__NP_056485
augaaggagaccauccagggcaccgggagcuggggccccgagccgcccgggcccggcaucccgcccgccuacuccagcccccgccgggagcgccugcgguggccgccgccgcccaagccccgccucaaguccgggggcggcuucgggcccgaccccggcagcgggacgaccgugcccgcccggcgccugcccgucccccggcccuccuucgacgcgagcgccuccgaggaggaggaggaggaggaggaggaggaggacgaggacgaggaggaggagguggccgccuggcgccugccgccccgguggagccagcucggcaccucccagcgcccccggcccagccgccccacccaccggaagacgugcucccagcgccggcgccgggccaugcgcgcguuccggaugcugcuguacagcaaguccaccagccucaccuuccacuggaagcugugggggcgccaccggggccgccgccggggccuggcccaccccaagaaccaccucagcccccagcagggcggggccacgccccaggugcccucccccugcugccgcuucgacagcccccgggggccgccgcccccgcgccugggccugcucggcgcccugauggcggaggacgggguccggggcuccccgcccgugcccuccgggccgcccauggaggaggacggccugcgcuggacccccaagagcccccucgaccccgacagcgggcugcuguccugcacccuccccaacggcuucggcgggcagagcggccccgagggggagcggucccuggcgcccccggacgccagcauccugaucuccaacgugugcagcaucggcgaccacgucgcccaggagcuguuccagggguccgaccucggcauggccgaggaggccgagcgccccggcgagaaggccgggcagcacagcccccugcgggaggagcacgugaccugcgugcaguccauccucgacgaguuccugcagaccuacggcagccugaucccccucuccacggacgaggucguggagaagcuggaggacaucuuccagcaggaguucagcaccccgucccgcaaggggcuggugcuccagcugauccagagcuaccagcggaugcccggcaacgccaugguccgcggguuccggguggccuacaagcgccacgugcugaccauggacgaccucggcacccuguacggccagaacuggcugaacgaccaggucaugaacauguacggggaccucgugauggacacggugcccgagaagguccacuucuucaacuccuucuucuacgacaagcugcggaccaagggcuacgacggggugaagcgcuggaccaagaacguggacaucuucaacaaggagcugcuccugauccccauccaccuggagguccacuggagccucaucuccguggacgugcggcgccggaccaucacguacuucgacagccagcgcacccugaaccgccggugcccgaagcacaucgccaaguaccugcaggcggaggccgucaagaaggaccgccucgacuuccaccagggcuggaagggcuacuucaagaugaacguggcccggcagaacaacgacuccgacugcggggccuucguccugcaguacugcaagcaccuggcccucagccagcccuucagcuucacccagcaggacaugcccaagcugcgccggcagaucuacaaggagcugugccacugcaagcugaccguguga

SEQ ID NO: 36212 - RNA, 2268 nt, Artificial Sequence
  derived and/or modified sequence opt1 from SENP5__Homo_sapiens__NP_689912
augaagaagcagcgcaagauccuguggcggaagggcauccaccucgccuucagcgagaaguggaacaccggguucggcggguucaagaaguucuacuuccaccagcaccugugcauccugaaggccaagcucggccgccccgugaccuggaaccggcagcugcgccacuuccaggggcggaagaaggcgcugcagauccagaagacguggaucaaggacgagccgcucugcgccaagaccaaguucaacgucgccacccagaacguguccacccugagcuccaaggugaagcgcaaggacgccaagcacuucaucagcuccagcaagacgcugcuccggcugcaggccgagaagcugcucuccagcgcgaagaacuccgaccacgaguacugccgcgagaagaaccugcugaaggccgucaccgacuuccccagcaacuccgcccucggccaggccaacggccaccggccccgcaccgacccccagccgagcgacuuccccaugaaguucaacggggagucccagagccccggcgaguccgggaccaucguggugacgcugaacaaccacaagcggaagggcuucugcuacgggugcugccagggccccgagcaccaccgcaacggcgggccgcugauccccaagaaguuccagcucaaccagcaccggcgcaucaagcugagcccccugaugauguacgagaagcucuccaugauccgguuccgcuaccggauccugcgcagccagcacuuccggaccaaguccaaggucugcaagcugcgcaaggcgcagcggagcugggugcagaaggugaccggcgaccaccaggagacccgccgcgagaacggggagggcggcagcugcucccccuucccgagccccgagcccaaggaccccuccugccggcaccagccguacuuccccgacauggacagcuccgccgucgugaaggggacgaacagccacgugcccgacugccacaccaagggcuccagcuuccucgggaaggagcugucccuggacgaggccuuccccgaccagcagaacggcagcgccaccaacgccugggaccaguccagcugcuccagcccgaagugggagugcaccgagcucauccacgacaucccccugcccgagcaccgcuccaacacgauguucaucagcgagaccgagcgggagaucaugacccuggggcaggagaaccagaccuccagcgucuccgacgaccgcgugaagcucagcgugagcggcgcggacacguccgucagcuccguggacggccccgugagccagaaggccguccagaacgagaacuccuaccagauggaggaggacgggagccugaagcaguccauccugagcuccgagcuccuggaccacccguacugcaagagcccccuggaggcgccccucgugugcuccggccugaagcuggagaaccaggucgggggcgggaagaacagccagaaggccucccccguggacgacgagcagcucagcgugugccuguccggcuuccuggacgaggugaugaagaaguacggcagccucgucccgcuguccgagaaggaggugcuggggcggcucaaggacgucuucaacgaggacuucagcaaccgcaagcccuucaucaaccgggagaucaccaacuaccgcgcccggcaccagaagugcaacuuccgcaucuucuacaacaagcacaugcuggacauggacgaccuggccacccucgacggccagaacuggcugaacgaccaggugaucaacauguacggggagcugaucauggacgccgugcccgacaagguccacuucuucaacagcuucuuccaccggcagcuggugaccaagggcuacaacggggugaagcgcuggacgaagaaggucgaccucuucaagaagucccugcugcucaucccgauccaccuggaggugcacuggagccugaucaccgugacccucuccaaccggaucaucagcuucuacgacucccagggcauccacuucaaguucugcgucgagaacauccgcaaguaccugcugaccgaggcccgggagaagaaccgccccgaguuccuccagggcuggcagacggccgugaccaagugcaucccccagcagaagaacgacagcgacugcgggguguucguccugcaguacugcaagugccuggcccucgagcagcccuuccaguucucccaggaggacaugccgcgggugcgcaagcggaucuacaaggagcugugcgagugccgccugauggacuga

SEQ ID NO: 36213 - RNA, 3318 nt, Artificial Sequence
  derived and/or modified sequence opt1 from SENP6__Homo_sapiens__NP_001093879
auggccgccggcaagagcgggggcuccgccggggagaucaccuuccuggaggcccucgcccgcagcgaguccaagcgggacggcggguucaagaacaacuggagcuucgaccacgaggaggaguccgagggcgacaccgacaaggacggcacgaaccugcugagcguggacgaggacgaggacuccgagaccagcaaggggaagaagcucaaccgccgguccgagaucgucgccaacagcuccggcgaguucauccugaagaccuacgugcgccggaacaagagcgaguccuucaagacccugaaggggaaccccaucggccucaacaugcugagcaacaacaagaagcuguccgagaacacgcagaacaccagccucugcuccgggaccgugguccacggccgccgguuccaccacgcccacgcgcagauccccguggugaagaccgccgcccagcgcaaggaguacccgccccacguccagaagguggagaucaaccccgugcggcugagccgccugcagggcgucgagcggaucaugaagaagacggaggaguccgagagccagguggagcccgagaucaagcgcaaggugcagcagaagcggcacugcagcaccuaccagcccaccccgccccucucccccgccagcaagaagugccugacccaccuggaggaccuccagcgcaacugccggcaggcgaucacgcugaacgaguccaccgggccccugcuccgcaccagcauccaccagaacuccggcgggcagaagucccagaacaccggccugacgaccaagaaguucuacggcaacaacgucgagaaggugcccaucgacaucaucgugaacugcgacgacuccaagcacaccuaccugcagaccaacgggaaggucauccuccccggcgccaagaucccgaagaucacgaaccugaaggagcggaagaccagccuguccgaccucaacgaccccaucauccugagcuccgacgacgacgacgacaacgaccgcaccaaccggcgcgagagcaucagcccccagcccgccgacuccgccugcuccagcccggcccccuccaccgggaagguggaggcggcccugaacgagaacacgugccgggccgagcgcgagcuccgcagcauccccgaggacagcgagcugaacaccgugacccugccccggaaggcccgcaugaaggaccaguucggcaacagcaucaucaacaccccgcucaagcggcgcaaggucuucagccaggagccgcccgacgcccuggcgcuguccugccagagcuccuucgacagcgugauccucaacugccgguccauccgcguggggacgcuguuccggcugcucaucgagcccgucaucuucugccuggacuucaucaagauccagcuggacgagcccgaccacgaccccguggagaucauccucaacaccagcgaccugaccaagugcgaguggugcaacgugcgcaagcugcccgucguguuccuccaggccauccccgccgucuaccagaagcuguccauccagcugcagaugaacaaggaggacaagguguggaacgacugcaagggcgugaacaagcucaccaaccuggaggagcaguacaucauccugaucuuccagaacggccucgacccgcccgccaacauggucuucgagagcaucaucaacgagaucgggaucaagaacaacaucuccaacuucuucgccaagauccccuucgaggaggcgaacggccggcugguggccugcacgcgcaccuacgaggagagcaucaagggguccugcggccagaaggagaacaagaucaagaccgugagcuucgaguccaagauccagcugcggagcaagcaggaguuccaguucuucgacgaggaggaggagaccggggagaaccacacgaucuucaucggcccggucgagaagcugaucguguacccgccgccgcccgccaagggcgggaucuccgugaccaacgaggaccuccacugccugaacgagggcgaguuccugaacgacgucaucaucgacuucuaccucaaguaccuggugcuggagaagcucaagaaggaggacgccgaccgcauccacaucuucagcuccuucuucuacaagcggcugaaccagcgcgagcggcgcaaccacgagaccaccaaccugagcauccagcagaagcggcacgggcgcgugaagaccuggacgcggcacgucgacaucuucgagaaggacuucaucuucgugccccucaacgaggccgcgcacugguuccuggccguggucugcuuccccggccuggagaagcccaaguacgagcccaacccccacuaccacgagaacgccgugauccagaagugcagcaccguggaggacuccugcaucagcuccagcgccuccgagauggagagcugcucccagaacagcuccgcgaagcccgucaucaagaagaugcucaacaagaagcacugcaucgccgugaucgacagcaaccccgggcaggaggaguccgacccccgcuacaagcgcaacaucugcagcgugaaguacuccgucaagaagaucaaccacaccgccagcgagaacgaggaguucaacaagggcgaguccaccagccagaagguggccgaccggacgaaguccgagaacggccugcagaacgagagccuguccagcacccaccacaccgacgggcucagcaagauccgccugaacuacuccgacgagagccccgaggccggcaagaugcuggaggacgagcucguggacuucuccgaggaccaggacaaccaggacgacagcuccgacgacggguuccuggcggacgacaacugcagcuccgagaucggccaguggcaccugaagcccaccaucugcaagcagcccugcauccuccugauggacagccugcggggcccgucccgcagcaacgucgugaagauccuccgggaguaccuggagguggagugggaggucaagaagggguccaagcgcagcuucuccaaggacgugaugaagggcagcaaccccaaggugccccagcagaacaacuucuccgacugcggggucuacgugcugcaguacguggagagcuucuucgagaaccccauccucuccuucgagcugccgaugaaccuggccaacugguucccgccgccccggaugcgcacgaagcgggaggagauccgcaacaucauccucaagcugcaggaggaccagagcaaggagaagcggaagcacaaggacaccuacuccaccgaggcgccccugggcgaggggaccgagcaguacgucaacagcaucagcgacuga

SEQ ID NO: 36214 - RNA, 639 nt, Artificial Sequence
  derived and/or modified sequence opt1 from SENP8__Homo_sapiens__NP_001165580
auggaccccgugguccugagcuacauggacucccuccugcgccagagcgacgugucccugcucgacccgcccagcuggcugaacgaccacaucaucggcuucgccuucgaguacuucgccaacucccaguuccacgacugcagcgaccacguguccuucaucagccccgaggucacccaguucaucaagugcaccuccaaccccgcggagaucgccauguuccuggagccgcucgaccugcccaacaagcgggugguguuccuggccaucaacgacaacagcaaccaggccgccgggggcacgcacuggucccuccuggucuaccugcaggacaagaacagcuucuuccacuacgacucccacagccgcuccaacagcgugcacgcgaagcaggucgccgagaagcucgaggccuuccuggggcggaagggcgacaagcuggccuucguggaggagaaggcgcccgcccagcagaacuccuacgacugcgggauguacgugaucugcaacaccgaggcccucugccagaacuucuuccgccagcagaccgagagccugcugcagcuccugacccccgccuacaucacgaagaagcggggcgaguggaaggaccugaucaccacccucgccaagaaguga

SEQ ID NO: 36215 - RNA, 978 nt, Artificial Sequence
  derived and/or modified sequence opt1 from SEPHS1__Homo_sapiens__NP_001182531
auggacacgugcgugaucccccugcgccacggcgggcucagccugguccagaccaccgacuacaucuacccgaucguggacgaccccuacaugaugggccggaucgccugcgccaacgugcuguccgaccucuacgcgaugggggucaccgagugcgacaacaugcugaugcugcucggcgugagcaacaagaugaccgaccgcgagcgggacaaggugaugccccugaucauccagggguucaaggacgccgccgaggaggccggcaccuccgucacgggcgggcagaccgugcugaaccccuggaucgugcucggcggggucgccaccaccgugugccagccgaacgaguucaucaugcccgacaacgcggugcccggcgacguccuggugcugacgaagccccucgggacccagguggccgucgccgugcaccaguggcuggacaucccggagaaguggaacaagaucaagcugguggucacccaggaggacguggagcucgccuaccaggaggcgaugaugaacauggcccgccugaaccggaccgccgccggccugaugcacacguucaacgcccacgcggccaccgacaucaccggcuucgggauccucggccacgcccagaaccuggccaagcagcagcgcaacgaggugagcuucgucauccacaaccugcccgugcucgccaagauggcggccguguccaaggccugcgggaacauguucggccugaugcacgggaccugccccgagacgagcggcggccugcucaucugccugccccgggagcaggccgcccgcuucugcgcggagaucaaguccccgaaguacggggagggccaccaggccuggaucaucgggaucgucgagaagggcaaccggaccgcccgcaucaucgacaagccccggaucaucgagguggcgccccaggucgccacccagaacgugaaccccaccccgggcgccacgagcuga

SEQ ID NO: 36216 - RNA, 1506 nt, Artificial Sequence
  derived and/or modified sequence opt1 from SEPSECS__Homo_sapiens__NP_058651
augaaccgcgagagcuucgccgccggcgagcggcuggugucccccgcguacguccgccaggggugcgaggcccggcgcagccacgagcaccucauccggcugcugcucgagaagggcaagugcccggagaacgggugggacgaguccacccuggagcuguuccuccacgagcuggccaucauggacagcaacaacuuccugggcaacugcggggugggcgagcgcgagggccggguggccuccgcccucgucgcgcgccggcacuaccgcuucauccacgggaucggccggagcggggacaucuccgccgugcagcccaaggccgccggcagcucccugcugaacaagaucaccaacagccucgugcuggacaucaucaagcuggcggggguccacacgguggccaacugcuucgugguccccauggccaccggcaugucccucacccugugcuuccugacccuccgccacaagcggcccaaggccaaguacaucaucuggccgcgcaucgaccagaaguccugcuucaagagcaugaucacggccggcuucgagcccguggugaucgagaacguccuggagggggacgagcugcggaccgaccucaaggcgguggaggccaaggugcaggagcugggccccgacugcauccugugcauccacagcaccaccuccugcuucgcgccccgcgucccggaccggcucgaggagcuggccgugaucugcgccaacuacgacaucccccacaucgugaacaacgccuacgggguccagagcuccaagugcaugcaccugauccagcagggcgcccgcgugggccggaucgacgccuucgugcagagccucgacaagaacuucaugguccccgucgggggcgccaucaucgccggguucaacgacuccuucauccaggagaucagcaagauguaccccggccgcgcgagcgccuccccgagccuggacgugcugaucacgcuccugucccuggggagcaacggcuacaagaagcuccugaaggagcggaaggagauguucuccuaccugagcaaccagaucaagaagcucuccgaggccuacaacgagcgccugcugcacacgccccacaaccccaucagccucgccaugacccugaagacccuggacgagcaccgcgacaaggccgugacccagcucggcuccaugcuguucacccgccaggugagcggggcgcgggucgugccccugggcuccaugcagaccgugagcggguacaccuuccggggcuucaugucccacacgaacaacuacccgugcgccuaccucaacgccgccagcgcgaucgggaugaagaugcaggacgucgaccuguucaucaagcgccuggaccggugccucaaggccgugcgcaaggagcgguccaaggagagcgacgacaacuacgacaagaccgaggacguggacaucgaggagauggcccugaagcuggacaacguccugcucgacaccuaccaggacgccuccagcuga

SEQ ID NO: 36217 - RNA, 1965 nt, Artificial Sequence
  derived and/or modified sequence opt1 from SERAC1__Homo_sapiens__NP_116250
augagccuggccgccuacugcgugaucugcugccgccggaucggcaccuccaccagcccgcccaaguccgggacgcacuggcgcgacauccggaacaucaucaaguucaccggcagccucauccucgggggcucccuguuccugaccuacgagguccuggcgcugaagaaggccgugacccucgacacccagguggucgagcgcgagaagaugaaguccuacaucuacgugcacacggugagccuggacaagggggagaaccacggcaucgccuggcaggcccggaaggagcugcacaaggccguccgcaaggugcucgcgaccagcgccaagauccugcggaaccccuucgccgaccccuucuccaccguggacaucgaggaccacgagugcgccgucuggcugcuccugcgcaagagcaaguccgacgacaagacgacccggcuggaggcggugcgcgagaugagcgagacccaccacuggcacgacuaccaguaccggaucaucgcccaggccugcgaccccaagacccucaucggccuggcccgcuccgaggagagcgaccugcgguucuuccuccugccgccgccccugcccucccucaaggaggacagcuccacggaggaggagcugcgccagcugcucgccagccugccccagaccgagcuggacgagugcauccaguacuucaccucccucgcgcugagcgagagcucccagagccuggccgcccagaagggcgggcucuggugcuucgggggcaacgggcugcccuacgccgaguccuucggcgaggugcccagcgccaccgucgagauguucugccuggaggcgaucgugaagcacuccgagaucagcacgcacugcgacaagaucgaggccaacggcgggcuccagcugcugcagcggcucuaccgccugcacaaggacugccccaaggugcagcggaacaucaugcgcgucaucggcaacauggcccugaacgagcaccuccacuccagcaucgugcgguccgggugggugagcaucauggccgaggccaugaaguccccgcacaucauggagagcucccacgcggcccgcauccuggccaaccuggaccgggagaccguccaggagaaguaccaggacggcguguacgugcuccacccccaguaccgcaccagccagcccaucaaggccgacguccuguucauccacggccugaugggggccgcguucaagaccuggcgccagcaggacuccgagcaggccgugaucgagaagcccauggaggacgaggaccgguacacgaccugcuggccgaagaccuggcucgccaaggacugccccgcccugcgcaucaucagcguggaguacgacaccucccugagcgacuggcgggcgcgcugccccauggagcggaaguccaucgccuuccgcagcaacgagcuccugcggaagcugcgcgccgccggcgucggggaccggcccguggucuggaucagccacuccaugggcgggcugcucgugaagaagaugcugcuggaggccagcacgaagccggagauguccaccgugaucaacaacacccgcggcaucaucuucuacagcgucccccaccacggcucccggcucgcggaguacagcgugaacauccgcuaccugcuguuccccucccucgaggugaaggagcugagcaaggacucccccgcccugaagacccuccaggacgacuuccuggaguucgccaaggacaagaacuuccagguccugaacuucguggagacgcucccgaccuacaucgggagcaugaucaagcugcacgugguccccguggaguccgccgaccugggcaucggggaccucauccccguggacgucaaccaccugaacaucugcaagcccaagaagaaggacgccuuccuguaccagcggacccuccaguucauccgcgaggcgcuggccaaggaccuggagaacuga

SEQ ID NO: 36218 - RNA, 333 nt, Artificial Sequence
  derived and/or modified sequence opt1 from SERF1A__Homo_sapiens__NP_068802
auggcccgcggcaaccagcgggagcuggcccgccagaagaacaugaagaagacccaggagaucagcaaggggaagcggaaggaggacucccucaccgcgagccagcgcaagcaguccagcggcgggcagaaguccgagagcaagauguccgccggcccccaccucccgcugaaggcgccccgggagaaccccugcuucccccugccggccgccgggggcagccgcuacuaccuggccuacggcuccaucacgcccaucagcgccuucguguucgucguguucuucuccguguucuuccccagcuucuacgaggacuucugcugcuggaucuga

SEQ ID NO: 36219 - RNA, 1377 nt, Artificial Sequence
  derived and/or modified sequence opt1 from SERGEF__Homo_sapiens__NP_036271
auggagcgcgagcccagcgccuccgaggccgcgccggccgccgccgcccuguucgcguggggcgccaacagcuacgggcagcucggccuggggcacaaggaggacgugcugcucccccagcagcugaacgacuucugcaagccccgguccguccgccggaucaccggcgggggcggccacagcgccguggugaccgacgggggcgaccuguucgucugcgggcucaacaaggacggccagcuggggcugggccacacggaggacauccccuacuucaccccgugcaagucccucuucggcugccccauccagcaggucgccugcgggugggacuucaccaucaugcugaccgagaacggccaggugcugagcugcggguccaacagcuucggccagcucggcgugccccacgggccccgccggugcguggugccgcaggcgaucgagcugcacaaggagaaggucgugugcaucgccgccggccugcgccacgccguggccgcgacggccuccgggaucgucuuccaguggggcaccgggcucgccagcugcggccggcgccugugccccggccagacccugccccucuucuucaccgccaaggagcccucccgggugacggggcuggagaacagcaaggccaugugcgugcuggcgggcuccgaccacagcgccucccucaccgacgccggggaggucuacguguggggcagcaacaagcacgggcagcuggccaacgaggccgcguuccugccggugccccagaagaucgaggcccacugcuuccagaacgagaaggucaccgccaucugguccggcuggacccaccucguggcccagacggagaccggcaagauguucaccugggggcgcgccgacuacggccagcuggggcggaagcuggagaccuacgagggcuggaagcucgagaagcaggacagcuuccugcccugcucccggcccccgaacagcaugcccagcagcccccacugccugacgggggcgaccgagguguccugcggcuccgagcacaaccucgccaucaucggcggggucugcuacagcuggggcuggaacgagcacgggaugugcggcgacggcaccgaggccaacgugugggcccccaagccggugcaggcgcugcuguccagcuccgggcuccuggucggcugcggggccggccacagccuggcccucugccagcugcccgcccaccccgcccuggugcaggaccccaaggucaccuaccucuccccggacgcgaucgaggacacggagagccagaaggccauggacaaggagcgcaacuggaaggagcgccaguccgagaccagcacccagucccagagcgacuggucccggaacgggggccuguga

SEQ ID NO: 36220 - RNA, 1362 nt, Artificial Sequence
  derived and/or modified sequence opt1 from SERINC1__Homo_sapiens__NP_065806
augggcagcgugcuggggcucugcuccauggccagcuggauccccugccugugcggcuccgccccgugccugcucugccgcugcugccccagcgggaacaacuccaccgucacccggcugaucuacgcccuguuccuccuggugggcgugugcgucgccugcgugaugcugauccccgggauggaggagcagcucaacaagauccccggcuucugcgagaacgagaagggcguggucccgugcaacauccuggugggguacaaggccguguaccgccugugcuucggccucgccauguucuaccugcugcucagccugcugaugaucaaggucaaguccagcuccgacccccgggccgcggugcacaacggguucugguucuucaaguucgccgccgccaucgcgaucaucaucggcgccuucuucauccccgaggggacguucaccaccgugugguucuacgucggcauggccggcgccuucugcuucauccucauccagcuggugcugcucaucgacuucgcccacagcuggaacgaguccuggguggagaagauggaggaggggaacagccgcugcugguacgcggcccugcuguccgccaccgcccucaacuaccugcugagccucgucgccaucgugcuguucuucguguacuacacgcaccccgcguccugcagcgagaacaaggccuucaucuccgucaacaugcugcucugcgugggcgccagcgugauguccauccugccgaagauccaggagagccagccccggagcgggcugcuccaguccagcgucaucaccguguacaccauguaccugaccugguccgccaugacgaacgagcccgagaccaacugcaaccccagccugcucuccaucaucggcuacaacaccaccagcacggugccgaaggagggccaguccguccagugguggcacgcccaggggaucaucggccugauccuguuccuccugugcguguucuacagcuccauccgcaccagcaacaacucccaggucaacaagcugacccucaccagcgacgaguccacgcugaucgaggacgggggcgcgcggagcgacgggucccuggaggacggcgacgacgugcaccgcgccguggacaacgagcgggacggcgucaccuacagcuacuccuucuuccacuucaugcuguuccucgccagccuguacaucaugaugacccucaccaacugguaccgcuacgagcccucccgggagaugaagucccaguggacggccgugugggugaagaucagcagcagcuggaucgggaucguccuguacguguggacccugguggcgccccugguccucaccaaccgcgacuucgacuga

SEQ ID NO: 36221 - RNA, 1422 nt, Artificial Sequence
  derived and/or modified sequence opt1 from SERINC3__Homo_sapiens__NP_006802
augggcgccgugcugggggucuucagccucgccuccugggugcccugccugugcagcggcgccuccugccugcucugcagcugcugcccgaacuccaagaacagcaccgugacccgccugaucuacgccuucauccugcuccuguccacggucgugagcuacaucaugcagcggaaggagauggagaccuaccugaagaagauccccggguucugcgagggcggguucaagauccacgaggccgacaucaacgccgacaaggacugcgacgugcucgucggcuacaaggccguguaccgcaucuccuucgcgauggccaucuucuucuucguguucagccugcugauguucaaggucaagaccuccaaggaccuccgggccgccgugcacaacggcuucugguucuucaagaucgcggcccugaucgggaucauggugggcagcuucuacauccccgggggcuacuucuccagcgucugguucgugguggggaugaucggcgccgcccuguucauccucauccagcugguccugcucguggacuucgcccacuccuggaacgagagcugggugaaccgcauggaggagggcaacccccggcugugguacgcggcccugcucuccuucaccagcgccuucuacauccuguccaucaucugcgucgggcugcucuacacguacuacaccaagccggacggcugcaccgagaacaaguucuucaucagcaucaaccugauccugugcgugguggccagcaucaucuccauccaccccaagauccaggagcaccagccccgcagcgggcuccugcaguccagccugaucacccucuacacgauguaccugaccugguccgccaugagcaacgagcccgaccgguccugcaacccgaaccugaugagcuucaucacccgcaucaccgcgcccacgcucgcccccggcaacuccaccgccgucgugcccaccccgaccccgcccagcaaguccggcagccugcuggacuccgacaacuucaucggccucuucguguucguccugugccugcucuacagcuccauccggacgagcaccaacucccagguggacaagcugacccugagcggguccgacagcgucauccucggggacaccacgaccagcggcgccuccgacgaggaggacgggcagccccgccgggccguggacaacgagaaggagggcgugcaguacagcuacucccuguuccaccugaugcucugccuggcgagccuguacaucaugaugacccucaccuccugguacagccccgacgccaaguuccaguccaugacgagcaaguggcccgccgucugggugaagaucuccagcuccugggugugccugcugcuguacgucuggacccucguggcgccccuggugcugaccagccgcgacuucuccuga

SEQ ID NO: 36222 - RNA, 1263 nt, Artificial Sequence
  derived and/or modified sequence opt1 from SERINC5__Homo_sapiens__NP_001167542
augagcgcccagugcugcgccggccagcuggcgugcugcugcggguccgccggcugcagccucugcugcgacugcugcccccgcauccggcagucccugagcacccgcuucauguacgcccuguacuucauccucguggucgugcugugcugcaucaugauguccaccacgguggcccacaagaugaaggagcacaucccguucuucgaggacaugugcaaggggaucaaggccggcgacacgugcgagaagcuggucggguacagcgcgguguaccgggugugcuucggcauggccugcuucuucuucaucuucugccuccugacccugaagaucaacaacuccaagagcugccgcgcccacauccacaacggcuucugguucuucaagcuccugcugcucggggccaugugcuccggcgcguucuucauccccgaccaggacaccuuccugaacgccuggcgguacgucggggccgugggcggguuccuguucaucggcauccagcuccugcugcucguggaguucgcccacaaguggaacaagaacuggaccgccggcaccgcgagcaacaagcugugguacgccucccuggcccucgucacccugaucauguacagcaucgccaccgggggccuggugcucauggccguguucuacacgcagaaggacuccugcauggagaacaagauccugcugggggucaacggcggccucugccugcugaucagccucguggcgaucucccccugggugcagaaccgccagccccacagcgggcugcugcaguccggcgucaucagcugcuacgugaccuaccucaccuucuccgcccugagcagcaagccggccgaggugguccuggacgagcacgggaagaacgugaccaucugcgugcccgacuucggccaggaccucuaccgggacgagaaccuggucacgauccuggggaccucccuccugaucggcugcauccuguacagcugccucaccuccaccacgcgcagcuccagcgacgcccugcagggccgguacgccgcgcccgagcuggagaucgcccgcugcugcuucugcuucucccccgggggcgaggacaccgaggagcagcagccggggaaggagggcccccgggugaucuacgacgagaagaaggggaccguguacaucuacagcuacuuccacuucgucuucuuccucgccucccuguacgugaugaugaccgucacgaacugguucaagagcgccuuccaccuccugcccuga

SEQ ID NO: 36223 - RNA, 201 nt, Artificial Sequence
  derived and/or modified sequence opt1 from SERP1__Homo_sapiens__NP_055260
augguggccaagcagcgcauccggauggccaacgagaagcacagcaagaacaucacccagcgcggcaacgucgcgaagaccucccggaacgcccccgaggagaaggccagcguggggccguggcugcucgcccuguucaucuucguggucugcggcuccgccaucuuccagaucauccagagcauccgcauggggauguga

SEQ ID NO: 36224 - RNA, 198 nt, Artificial Sequence
  derived and/or modified sequence opt1 from SERP2__Homo_sapiens__NP_001010897
augguggccaagcagcgcauccggauggccaacgagaagcacagcaagaacaucacccagcgcggcaacgucgcgaagacccugcggccccaggaggagaaguacccgguggggcccuggcuccuggcccuguucguguucgucgugugcggcuccgccaucuuccagaucauccagagcauccgcauggggauguga

SEQ ID NO: 36225 - RNA, 1335 nt, Artificial Sequence
  derived and/or modified sequence opt1 from SERPINA10__Homo_sapiens__NP_001094077
augaaggugguccccagccugcuccuguccgugcugcucgcccagguguggcuggucccgggccuggcccccagcccccagucccccgagaccccggcgccccagaaccagaccagccgcguggugcaggcccccaaggaggaggaggaggacgagcaggaggccuccgaggagaaggccagcgaggaggagaaggccuggcucauggcgucccggcagcagcuggccaaggagacgagcaacuucggguucucccugcuccgcaagaucagcaugcggcacgacggcaacauggucuucucccccuucgggaugagccuggccaugaccggccugaugcucggggccaccggcccgaccgagacgcagaucaagcgcggccugcaccuccaggcgcugaagcccaccaagcccgggcugcugcccucccucuucaagggccugcgggagacccugagccgcaaccucgagcuggggcugacccagggcuccuucgccuucauccacaaggacuucgacgugaaggagacguucuucaaccucagcaagcgguacuucgacaccgagugcgugccgaugaacuuccgcaacgccucccaggccaagcggcugaugaaccacuacaucaacaaggagacccgcgggaagauccccaagcuguucgacgagaucaaccccgagaccaagcucauccuggucgacuacauccuguucaagggcaaguggcucacgcccuucgacccgguguucaccgagguggacaccuuccaccuggacaaguacaagaccaucaagguccccaugauguacggcgccgggaaguucgcgagcacguucgacaagaacuuccggugccacgugcugaagcuccccuaccagggcaacgccaccaugcuggugguccugauggagaagaugggggaccaccucgcccuggaggacuaccugaccaccgaccucguggagacguggcugcgcaacaugaagacccggaacauggagguguucuuccccaaguucaagcuggaccagaaguacgagaugcacgagcuccugcgccagaugggcauccggcgcaucuucuccccguucgccgaccugagcgagcucagcgccaccggccggaaccugcaggucucccgcgugcugcagcggaccgugaucgaggucgacgagcgcgggacggaggcgguggccggcauccucagcgagaucaccgccuacuccaugccgcccgugaucaaggucgaccggcccuuccacuucaugaucuacgaggagaccagcgggaugcugcuguuccugggccgcguggucaaccccacccuccuguga

SEQ ID NO: 36226 - RNA, 1269 nt, Artificial Sequence
  derived and/or modified sequence opt1 from SERPINA11__Homo_sapiens__NP_001073920
augggccccgccuggcuguggcuccuggggaccggcauccuggccagcgugcacugccagccgcuccuggcgcacggggacaagucccugcagggcccccagccgccccgccaccagcucagcgagcccgcccccgccuaccaccggaucacccccacgaucaccaacuucgcccugcgccuguacaaggagcucgccgcggacgcccccgggaacaucuucuucuccccggucagcaucuccaccacccuggcccugcucagccugggcgcccaggcgaacacguccgcccugauccucgagggccugggguucaaccugaccgagacccccgaggccgacauccaccagggcuuccggagccuccugcacacccuggcccuccccucccccaagcuggagcugaagguggggaacagccucuuccuggacaagcgccugaagccgcggcagcacuaccucgacuccaucaaggagcuguacggcgccuucgcguucagcgccaacuucacggacuccgugaccaccgggcgccagaucaacgacuaccugcggcgccagaccuacggccaggucguggacugccuccccgaguucagccaggacacguucauggugcuggccaacuacaucuucuucaaggccaaguggaagcaccccuucucccgguaccagacccagaagcaggagagcuucuucgucgacgagcgcaccucccuccaggugcccaugaugcaccagaaggagaugcaccgguuccuguacgaccaggaccuggccugcaccgugcugcagaucgaguaccgcggcaacgcgcucgcccugcugguccucccggaccccgggaagaugaagcaggucgaggccgcccugcagccccagacgcugcggaaguggggccagcuccugcugcccagccuccuggaccugcaccucccgcgcuucuccaucagcgggaccuacaaccuggaggacauccugccccagaucggccugaccaacauccucaaccuggaggccgacuucagcggcgugaccgggcagcugaacaagacgaucuccaaggugagccacaaggcgaugguggacauguccgagaagggcaccgaggccggggccgccagcggccuccugucccagccgcccagccugaacaccauguccgacccccacgcccacuucaaccggcccuuccuccugcugcucugggaggugaccacgcagagccugcuguuccucgggaaggucgugaaccccguggcgggcuga

SEQ ID NO: 36227 - RNA, 1245 nt, Artificial Sequence
  derived and/or modified sequence opt1 from SERPINA12__Homo_sapiens__NP_001291390
augaaccccacccugggccucgccaucuuccuggccgugcugcucaccgucaaggggcugcugaagccgagcuucagcccccgcaacuacaaggcgcucuccgaggugcagggcuggaagcagcggauggccgccaaggagcuggcccgccagaacauggaccugggguucaagcuccugaagaagcuggccuucuacaaccccggccggaacaucuuccucagcccccuguccaucuccacggcguucagcaugcugugccucggggcccaggacuccacccuggacgagaucaagcagggcuucaacuuccgcaagaugccggagaaggaccugcacgagggcuuccacuacaucauccacgagcucacccagaagacccaggaccugaagcugagcaucgggaacacccucuucaucgaccagcggcugcagccccagcgcaaguuccuggaggacgccaagaacuucuacuccgccgagaccauccucaccaacuuccagaaccuggagauggcgcagaagcagaucaacgacuucaucagccagaagacccacggcaagaucaacaaccugaucgagaacaucgaccccgggacggugaugcuccuggccaacuacaucuucuuccgggcccgcuggaagcacgaguucgaccccaacgucaccaaggaggaggacuucuuccuggagaagaacuccagcgugaaggugccgaugauguuccgguccggcaucuaccaggucggguacgacgacaagcucagcugcaccauccuggagauccccuaccagaagaacaucaccgccaucuucauccugcccgacgagggcaagcucaagcaccuggagaagggccuccagguggacacguucucccgcuggaagacccugcugagccggcgcguggucgacguguccgugccccggcugcacaugaccgggaccuucgaccucaagaagacgcugagcuacaucggcgucuccaagaucuucgaggagcacggggaccugaccaagaucgccccgcaccgcagccucaaggugggcgaggcggugcacaaggccgagcugaagauggacgagcggggcaccgagggggccgccggcaccggggcccagacgcugcccauggagacgccccucgucgugaagaucgacaagcccuaccugcugcucaucuacagcgagaagaucccguccgugcuguuccugggcaagaucgucaaccccaucgggaaguga

SEQ ID NO: 36228 - RNA, 1257 nt, Artificial Sequence
  derived and/or modified sequence opt1 from SERPINA1__Homo_sapiens__NP_001121179
augcccuccuccgugagcuggggcauccugcuccuggccgggcugugcugccucgucccggugucccuggccgaggacccccagggcgacgcggcccagaagaccgacaccagccaccacgaccaggaccaccccacguucaacaagaucacccccaaccuggccgaguucgccuucucccucuaccgccagcuggcccaccagagcaacuccaccaacaucuucuucagcccgguguccaucgcgaccgccuucgccaugcugagccucgggacgaaggccgacacccacgacgagauccuggagggccugaacuucaaccucaccgagauccccgaggcgcagauccacgagggguuccaggagcugcugcggacccucaaccagcccgacucccagcugcagcugacgaccggcaacggccucuuccugagcgaggggcugaagcucgucgacaaguuccuggaggacgugaagaagcuguaccacuccgaggccuucaccgugaacuucggcgacaccgaggaggccaagaagcagaucaacgacuacgucgagaaggggacgcagggcaagaucguggaccucgugaaggagcuggaccgcgacaccgucuucgcccuggugaacuacaucuucuucaaggggaagugggagcggcccuucgaggugaaggacaccgaggaggaggacuuccacgucgaccaggugaccacggugaaggucccgaugaugaagcgccucggcauguucaacauccagcacugcaagaagcugagcuccugggugcugcucaugaaguaccugggcaacgccaccgcgaucuucuuccugcccgacgaggggaagcuccagcaccuggagaacgagcugacccacgacaucaucaccaaguuccucgagaacgaggaccggcgcagcgccucccugcaccuccccaagcugagcaucacgggcaccuacgaccugaaguccgugcuggggcagcucggcaucaccaaggucuucagcaacggcgccgaccugagcggggugaccgaggaggcgccccugaagcucuccaaggccgugcacaaggccguccugacgaucgacgagaagggcaccgaggccgccggggccauguuccuggaggccaucccgaugagcaucccgcccgaggugaaguucaacaagcccuucguguuccucaugaucgagcagaacaccaagagcccccuguucaugggcaaggucgugaaccccacccagaaguga

SEQ ID NO: 36229 - RNA, 1272 nt, Artificial Sequence
  derived and/or modified sequence opt1 from SERPINA3__Homo_sapiens__NP_001076
auggagcgcaugcugccccuccuggcccugggccuccuggccgcgggguucugcccggccgugcugugccaccccaacagcccccucgacgaggagaaccugacccaggagaaccaggaccggggcacccacgucgaccuggggcucgccuccgccaacguggacuucgccuucagccuguacaagcagcuggugcucaaggcgcccgacaagaacgucaucuucuccccgcugagcaucuccacggcccuggccuuccucagccugggcgcccacaacaccacccugaccgagauccucaaggggcugaaguucaaccugacggagaccuccgaggcggagauccaccagagcuuccagcaccuccugcgcacccugaaccaguccagcgacgagcuccagcuguccaugggcaacgccauguucgugaaggagcagcugagccuccuggaccgguucaccgaggacgccaagcgccuguacggcuccgaggccuucgccacggacuuccaggacagcgcggccgccaagaagcucaucaacgacuacgugaagaacgggacccggggcaagaucaccgaccugaucaaggaccuggacucccagaccaugaugguccucgugaacuacaucuucuucaaggccaagugggagaugcccuucgacccccaggacacgcaccagagccgcuucuaccuguccaagaagaagugggugaugguccccaugaugagccugcaccaccucaccaucccguacuuccgggacgaggagcuguccugcaccgugguggagcugaaguacaccgggaacgccagcgcccucuucauccugcccgaccaggacaagauggaggaggucgaggcgaugcugcuccccgagacgcugaagcgcuggcgggacagccuggaguuccgcgagaucggcgagcucuaccugcccaaguucuccaucagccgggacuacaaccugaacgacauccuccugcagcuggggaucgaggaggccuucaccuccaaggccgaccugagcggcaucaccggcgcccgcaaccucgcggugucccaggugguccacaaggccgugcuggacguguucgaggaggggaccgaggccagcgccgccacggcggucaagaucacccugcucuccgcccugguggagacccggaccaucgugcgcuucaaccggccguuccugaugaucaucguccccacggacacccagaacaucuucuucaugagcaaggugaccaaccccaagcaggccuga

SEQ ID NO: 36230 - RNA, 1395 nt, Artificial Sequence
  derived and/or modified sequence opt1 from SERPINA4__Homo_sapiens__NP_001275961
augcccggcgacccggagaagcccccgcccgggacccacagcugguaccgcgccgcccugaccgagggccaggggcuccuggcggccaaccccggccugcgggugcagcgcaugcaccucaucgacuaccugcugcuccugcuggucgggcuccuggcccugucccacggccagcuccacguggagcacgacggcgagagcugcuccaacagcucccaccagcagauccuggagacgggggagggcagccccucccugaagaucgcccccgccaacgcggacuucgccuuccgguucuacuaccucaucgccagcgagacccccgggaagaacaucuucuucuccccgcugagcaucuccgccgcguacgccaugcugagccucggcgccugcucccacagccgcucccagauccuggaggggcugggcuucaaccucaccgagcugagcgaguccgacgugcaccggggcuuccagcaccuccuccacacccugaaccugcccgggcacggccucgagacgcgcgucgggagcgcccuguuccugucccacaaccucaaguuccuggccaaguuccugaacgacaccauggcgguguacgaggccaagcuguuccacaccaacuucuacgacaccgugggcacgauccagcugaucaacgaccacgucaagaaggagacccggggcaagaucguggaccuggugagcgagcucaagaaggacguccugauggugcuggugaacuacaucuacuucaaggcccucugggagaagcccuucaucagcucccgcaccacccccaaggacuucuacgucgacgagaacacgaccgugcgggugccgaugaugcugcaggaccaggagcaccacugguaccugcacgaccgcuaccuccccugcagcguccugcggauggacuacaagggggacgccaccguguucuucauccugcccaaccagggcaagaugcgcgagaucgaggaggugcucacccccgagaugcugaugcgguggaacaaccugcuccgcaagcggaacuucuacaagaagcuggagcugcaccucccgaaguucuccaucagcggguccuacguccucgaccagauccugccccgccugggcuucacggaccucuucagcaagugggccgaccuguccgggaucaccaagcagcagaagcuggaggcgagcaaguccuuccacaaggccacccucgacguggacgaggccggcaccgaggccgccgcggccacgagcuucgccaucaaguucuucuccgcccagaccaaccggcacauccugcgcuucaaccggcccuuccugguggucaucuucagcaccuccacccagagcgugcuguuccugggcaagguggucgaccccacgaagccguga

SEQ ID NO: 36231 - RNA, 1221 nt, Artificial Sequence
  derived and/or modified sequence opt1 from SERPINA5__Homo_sapiens__NP_000615
augcagcuguuccuccugcugugccucgugcugcugagcccccagggcgccucccuccaccgccaccacccgcgggagaugaagaagcgcgucgaggaccugcacgugggggccaccguggcgcccagcucccggcgcgacuucaccuucgaccuguaccgggcccucgccagcgccgcccccucccagagcaucuucuucucccccgucagcaucuccaugagccuggcgaugcugucccucggcgccgggagcuccacgaagaugcagauccuggagggccuggggcucaaccugcagaaguccagcgagaaggagcugcaccgcggcuuccagcagcuccugcaggagcugaaccagccgcgggacggcuuccagcucagccuggggaacgcccuguucaccgaccucgugguggaccugcaggacaccuucgucuccgccaugaagacccuguaccucgcggacacguuccccaccaacuuccgcgacagcgccggcgccaugaagcagaucaacgacuacguggccaagcagaccaaggggaagaucguggaccugcugaagaaccucgacuccaacgccgucgugaucauggugaacuacaucuucuucaaggcgaagugggagaccagcuucaaccacaagggcacgcaggagcaggacuucuacgucaccagcgagaccguggugcggguccccaugaugucccgcgaggaccaguaccacuaccugcuggaccggaaccucagcugccgcgugguggggguccccuaccagggcaacgccaccgcccuguucauccugccguccgagggcaagaugcagcaggucgagaacgggcucagcgagaagacgcugcggaaguggcugaagauguucaagaagcgccagcucgagcuguaccugcccaaguucuccaucgagggcagcuaccagcucgagaaggugcugcccucccuggggaucagcaacguguucaccucccacgccgaccucagcggcaucuccaaccacagcaacauccagguguccgagauggugcacaaggccgucguggaggucgacgagagcggcacccgggcggccgccgccaccgggacgaucuucaccuuccgcuccgcccggcugaacagccagcgccugguguucaaccggcccuuccucauguucaucguggacaacaacauccuguuccugggcaaggucaaccgcccguga

SEQ ID NO: 36232 - RNA, 1218 nt, Artificial Sequence
  derived and/or modified sequence opt1 from SERPINA6__Homo_sapiens__NP_001747
augccccugcuccuguacacgugccugcucuggcugccgaccagcggccuguggaccgugcaggccauggaccccaacgccgcguacgucaacauguccaaccaccaccgcgggcucgccagcgccaacguggacuucgccuucucccuguacaagcaccugguggcccucagccccaagaagaacaucuucaucucccccgucagcaucuccauggcgcuggccaugcugagccucgggaccugcggccacacccgggcccagcugcugcagggccucggguucaaccugaccgagcgcuccgagacggagauccaccagggcuuccagcaccuccaccagcuguucgccaagagcgacaccucccuggagaugaccaugggcaacgcgcuguuccucgacgggagccuggagcugcucgaguccuucagcgccgacaucaagcacuacuacgaguccgaggugcuggccaugaacuuccaggacugggccaccgccagccggcagaucaacuccuacgugaagaacaagacgcagggcaagaucgucgaccuguucagcgggcucgacuccccggcgauccuggugcuggugaacuacaucuucuucaagggcaccuggacccagcccuucgaccucgccagcacccgcgaggagaacuucuacgucgacgagacgaccguggugaagguccccaugaugcugcagagcuccaccaucagcuaccugcacgacgccgagcuccccugccagcuggugcagaugaacuacguggggaacggcaccgucuucuucauccugccggacaagggcaagaugaacacggugaucgccgcccucucccgggacaccaucaaccgcuggagcgcggggcugaccuccagccagguggaccuguacauccccaaggucaccaucuccggcguguacgaccucggggacgugcuggaggagaugggcaucgccgaccuguucacgaaccaggccaacuucagccggaucacccaggacgcccagcucaaguccagcaaggucgugcacaaggccgugcugcagcugaacgaggagggcgucgacaccgcgggguccaccggcgugacgcucaaccugaccagcaagcccaucauccugcgcuucaaccagcccuucaucaucaugaucuucgaccacuucaccugguccagccucuuccuggcccgggucaugaacccgguguga

SEQ ID NO: 36233 - RNA, 1248 nt, Artificial Sequence
  derived and/or modified sequence opt1 from SERPINA7__Homo_sapiens__NP_000345
augagccccuuccuguaccucgugcugcugguccucggccugcacgccaccauccacugcgccuccccggaggggaaggugaccgcgugccacagcucccagcccaacgccacgcuguacaagaugagcuccaucaacgccgacuucgccuucaaccucuaccgccgguucaccguggagacccccgacaagaacaucuucuucagccccgucuccaucagcgccgcgcuggugaugcuguccuucggcgccugcugcagcacccagacggagaucguggagacccucggguucaaccugaccgacaccccgauggucgagauccagcacggcuuccagcaccugaucugcucccucaacuuccccaagaaggagcuggagcugcagaucgggaacgcccucuucaucggcaagcaccugaagccccuggccaaguuccucaacgacgugaagacgcuguacgagaccgagguguucagcaccgacuucuccaacaucagcgcggccaagcaggagaucaacucccacgucgagaugcagaccaagggcaaggugguggggcugauccaggaccucaagcccaacacgaucaugguccuggugaacuacauccacuucaaggcccagugggccaacccguucgaccccagcaagaccgaggacuccagcuccuuccugaucgacaagaccaccacggugcagguccccaugaugcaccagauggagcaguacuaccaccucguggacauggagcugaacugcaccgugcugcagauggacuacagcaagaacgcccucgcgcuguucguccugcccaaggagggccagauggagagcguggaggccgccauguccagcaagacccucaagaaguggaaccgccugcugcagaagggguggguggaccucuucgucccgaaguucuccaucagcgccaccuacgaccugggcgccacgcugcucaagauggggauccagcacgcguacuccgagaacgccgacuucagcggccugaccgaggacaacggccugaagcucuccaacgccgcccacaaggccgugcugcacaucggggagaagggcaccgaggcggccgccgugcccgaggucgagcugagcgaccagcccgagaacaccuuccuccaccccaucauccagaucgaccgguccuucaugcugcugauccucgagcgcagcacgcgguccauccuguuccuggggaagguggucaacccgaccgaggccuga

SEQ ID NO: 36234 - RNA, 1008 nt, Artificial Sequence
  derived and/or modified sequence opt1 from SERPINA9__Homo_sapiens__NP_001035983
augcagggccaggggcgccggcgcgggaccugcaaggacaucuucugcagcaagauggccuccuaccuguacggcgugcuguucgccgucggccugugcgcgcccaucuacugcgugagcccggccaacgcccccuccgccuacccccggcccagcuccaccaagagcacgccggccucccagguguacagccugaacaccgacuucgcguuccgccucuaccggcgccugguccuggagacccccucccagaacaucuucuucagccccgcccggaucaacucccacgugaagaagaagacccaggggaagguggucgacaucauccagggccucgaccugcugacggccauggugcucgugaaccacaucuucuucaaggccaagugggagaagcccuuccacccggaguacacccgcaagaacuuccccuuccuggucggcgagcaggucaccgugcacgugcccaugaugcaccagaaggagcaguucgcguucgggguggacaccgagcugaacugcuucgugcuccagauggacuacaagggcgacgccgucgccuucuucgugcugcccagcaaggggaagaugcggcagcuggagcaggcccucuccgcccgcacgcugcggaaguggagccacucccugcagaagcgcuggaucgagguguucaucccgcgguucagcaucuccgcgagcuacaaccucgagaccauccugcccaagaugggcauccagaacgucuucgacaagaacgccgacuucuccgggaucgccaagcgcgacagccuccaggugagcaaggccacccacaaggccgugcucgacgucuccgaggagggcaccgaggcgacggccgccaccaccaccaaguucaucgugcggagcaaggacggccccuccuacuucacggugagcuucaaccgcaccuuccugaugaugaucaccaacaaggccaccgacgggauccuguuccucggcaaggucgagaaccccacgaaguccuga

SEQ ID NO: 36235 - RNA, 1194 nt, Artificial Sequence
  derived and/or modified sequence opt1 from SERPINB10__Homo_sapiens__NP_005015
auggacagccuggccaccuccaucaaccaguucgcccucgagcugagcaagaagcuggcggaguccgcccagggcaagaacaucuucuucagcuccuggagcaucuccaccagccucacgaucguguaccugggggccaagggcaccaccgccgcccagauggcgcagguccugcaguucaaccgcgaccagggggugaagugcgaccccgaguccgagaagaagcggaagauggaguucaaccucagcaacuccgaggagauccacagcgacuuccagacccugaucuccgagauccugaagccgaacgacgacuaccuccugaagacggccaacgccaucuacggcgagaagaccuacgccuuccacaacaaguaccuggaggacaugaagaccuacuucggggcggagccccagcccgugaacuucgucgaggccagcgaccagauccgcaaggacaucaacuccuggguggagcggcagaccgagggcaagauccagaaccuccugcccgacgacagcguggacuccacgacccgcaugauccuggucaacgcccucuacuucaagggcaucugggagcaccaguuccuggugcagaacaccaccgagaagccguuccggaucaacgagacgaccagcaagcccgugcagaugauguucaugaagaagaagcugcacaucuuccacaucgagaagcccaaggccgucgggcuccagcuguacuacaagucccgcgaccugagccuccugauccugcuccccgaggacaucaacggccuggagcagcuggagaaggccaucaccuacgagaagcucaacgaguggaccagcgcggacaugauggagcuguacgaggugcagcugcaccucccgaaguucaagcuggaggacuccuacgaccucaagagcacgcuguccagcauggggauguccgacgccuucagccaguccaaggccgacuucagcggcauguccagcgcccggaaccuguuccuguccaacguguuccacaaggccuucgucgagaucaacgagcaggggaccgaggcggccgccggcagcggcuccgagaucgacauccgcauccgggugcccagcaucgaguucaacgccaaccaccccuuccucuucuucauccgccacaacaagaccaacaccauccuguucuacgggcggcugugcucccccuga

SEQ ID NO: 36236 - RNA, 1176 nt, Artificial Sequence
  derived and/or modified sequence opt1 from SERPINB13__Homo_sapiens__NP_036529
auggacagccugggcgccguguccacccgccucggguucgaccuguucaaggagcugaagaagaccaacgacggcaacaucuucuucagccccgucgggauccucacggccaucggcauggugcugcuggggacccggggcgcgaccgccucccagcucgaggagguguuccacagcgagaaggagaccaaguccagccgcaucaaggccgaggagaaggaggucaucgagaacacggaggccgugcaccagcaguuccagaaguuccugaccgagaucuccaagcugaccaacgacuacgagcucaacaucaccaaccggcuguucggcgagaagacguaccuguuccuccagaaguaccuggacuacguggagaaguacuaccacgccagccuggagccggucgacuucgugaacgcggccgacgagucccgcaagaagaucaacagcuggguggaguccaagaccaacgagaagaucaaggaccucuuccccgacgggagcaucuccagcuccaccaagcugguccuggugaacaugguguacuucaagggccagugggaccgggaguucaagaaggagaacaccaaggaggagaaguucuggaugaacaagagcacguccaagagcguccagaugaugacccagucccacagcuucagcuucaccuuccucgaggaccugcaggccaagauccuggggauccccuacaagaacaacgaccucuccauguucgugcugcugcccaacgacaucgacggccucgagaagaucaucgacaagaucagcccggagaagcugguggaguggaccucccccgggcacauggaggagcgcaaggucaaccugcaccucccccgguucgagguggaggacggcuacgaccuggaggccgugcuggcggccaugggcaugggggacgccuucagcgagcacaaggccgacuacuccggcaugagcuccgggagcggccucuacgcccagaaguuccugcacuccagcuucgucgcggugacggaggagggcaccgaggccgccgccgccaccgggaucggcuucaccgugacguccgcgcccgggcacgagaacguccacugcaaccacccguuccuguucuucauccgccacaacgagagcaacuccauccucuucuucggccgguucagcucccccuga

SEQ ID NO: 36237 - RNA, 1140 nt, Artificial Sequence
  derived and/or modified sequence opt1 from SERPINB1__Homo_sapiens__NP_109591
auggagcagcugagcuccgccaacacccgcuucgcccucgaccuguuccuggcgcucagcgagaacaaccccgccggcaacaucuucaucuccccguucagcaucuccagcgccauggccaugguguuccuggggacccggggcaacacggccgcgcagcuguccaagaccuuccacuucaacaccgucgaggaggugcacagccgcuuccagucccucaacgccgacaucaacaagcgcggggccagcuacauccugaagcuggccaaccggcucuacggcgagaagaccuacaacuuccugcccgaguuccugguguccacgcagaagaccuacggggcggaccucgccagcgucgacuuccagcacgccuccgaggacgcccggaagaccaucaaccagugggugaagggccagaccgagggcaagauccccgagcugcuggccagcgggaugguggacaacaugacgaagcucguccuggugaacgcgaucuacuucaagggcaacuggaaggacaaguucaugaaggaggccaccaccaacgcccccuuccgccugaacaagaaggaccggaagaccgugaagaugauguaccagaagaagaaguucgccuacggguacaucgaggaccucaagugccgcguccuggagcugccguaccagggcgaggagcucuccauggugauccugcugcccgacgacaucgaggacgagagcacggggcucaagaagaucgaggagcagcugacccuggagaagcuccacgaguggaccaagcccgagaaccuggacuucaucgaggugaacgucucccugccccgguucaagcucgaggagagcuacacccugaacuccgaccuggcccgccucggcgugcaggaccuguucaacagcagcaaggcggaccuguccggcaugagcggggcccgggacaucuucaucuccaagaucgugcacaagagcuucgucgaggugaacgaggagggcacggaggccgccgccgcgaccgccgggaucgccaccuucugcaugcucaugccggaggagaacuucaccgccgaccaccccuuccuguucuucauccgccacaacuccagcggcuccauccuguuccucggccgguucagcucccccuga

SEQ ID NO: 36238 - RNA, 1248 nt, Artificial Sequence
  derived and/or modified sequence opt1 from SERPINB2__Homo_sapiens__NP_001137290
auggaggaccugugcguggccaacacccucuucgcccugaaccuguucaagcaccucgcgaaggccagccccacccagaaccuguuccuguccccguggagcaucuccagcacgauggccauggucuacaugggcucccgcgggagcaccgaggaccagauggccaaggugcuccaguucaacgaggugggcgccaacgcggucacccccaugacccccgagaacuucacguccugcggguucaugcagcagauccagaagggcagcuaccccgacgccauccugcaggcccaggccgcggacaagauccacuccagcuuccggucccugagcuccgccaucaacgccagcaccgggaacuaccuccuggaguccgugaacaagcuguucggcgagaaguccgccagcuuccgcgaggaguacauccggcucugccagaaguacuacagcuccgagccgcaggccguggacuuccuggagugcgcggaggaggcccgcaagaagaucaacagcugggucaagacccagaccaagggcaagauccccaaccugcuccccgaggggagcguggacggcgacacgcggauggugcuggucaacgccguguacuucaaggggaaguggaagacccccuucgagaagaagcugaacggccucuacccguuccgcgugaacuccgcccagcggacccccguccagaugauguaccugcgcgagaagcugaacaucggguacaucgaggaccucaaggcccagauccuggagcugcccuacgcgggcgacgugagcauguuccuccugcugcccgacgagaucgccgacguguccaccggccucgagcugcuggagagcgagaucacguacgacaagcucaacaaguggaccuccaaggacaagauggccgaggacgaggucgagguguacaucccgcaguucaagcuggaggagcacuacgagcugcggagcauccuccgcuccauggggauggaggacgccuucaacaagggccgggccaacuucagcgggauguccgagcgcaacgaccuguuccugagcgagguguuccaccaggcgauggucgacgugaacgaggagggcaccgaggccgccgccggcaccgggggcgugaugacggggcggaccggccacgggggcccccaguucgucgccgaccaccccuuccucuuccugaucaugcacaagaucaccaacugcauccuguucuucggccgcuucuccagccccuga

SEQ ID NO: 36239 - RNA, 1173 nt, Artificial Sequence
  derived and/or modified sequence opt1 from SERPINB3__Homo_sapiens__NP_008850
augaacagccuguccgaggccaacaccaaguucauguucgaccucuuccagcaguuccgcaagagcaaggagaacaacaucuucuacucccccaucagcaucaccuccgcccugggcauggugcugcucggggcgaaggacaacacggcccagcagaucaagaagguccugcacuucgaccaggugaccgagaacaccaccggcaaggccgccacguaccacguggaccggagcgggaacguccaccaccaguuccagaagcugcucaccgaguucaacaaguccaccgacgccuacgagcugaagaucgcgaacaagcuguucggcgagaagaccuaccucuuccugcaggaguaccuggacgccaucaagaaguucuaccagacgagcguggaguccguggacuucgccaacgccccggaggagagccgcaagaagaucaacuccugggucgagagccagaccaacgagaagaucaagaaccucauccccgaggggaacaucggcuccaacaccacccuggugcuggugaacgcgaucuacuucaagggccagugggagaagaaguucaacaaggaggacacgaaggaggagaaguucuggcccaacaagaacaccuacaagagcauccagaugaugcggcaguacaccuccuuccacuucgccagccucgaggacguccaggccaaggugcuggagauccccuacaaggggaaggaccuguccaugaucgugcuccugccgaacgagaucgacggccugcagaagcucgaggagaagcugaccgccgagaagcugauggaguggacgagccuccagaacaugcgcgagacccgggucgaccugcaccucccccgcuucaagguggaggaguccuacgaccugaaggacacccugcggaccauggggaugguggacaucuucaacggcgacgccgaccugagcgggaugacgggcagccgcggccucguccuguccggggugcugcacaaggcguucguggaggucaccgaggagggcgccgaggccgccgccgcgaccgccguggugggguucggcagcucccccaccagcacgaacgaggaguuccacugcaaccaccccuuccucuucuucauccggcagaacaagaccaacuccauccuguucuacggccgcuucagcuccccguga

SEQ ID NO: 36240 - RNA, 1110 nt, Artificial Sequence
  derived and/or modified sequence opt1 from SERPINB4__Homo_sapiens__NP_778206
augaacagccuguccgaggccaacaccaaguucauguucgaccucuuccagcaguuccgcaagagcaaggagaacaacaucuucuacucccccaucagcaucaccuccgcccugggcauggugcugcucggggcgaaggacaacacggcccagcagaucagcaagguccugcacuucgaccaggugaccgagaacaccaccgagaaggccgccacguaccacguggaccgguccggcaacguccaccaccaguuccagaagcugcucaccgaguucaacaagagcaccgacgccuacgagcugaagaucgcgaacaagcuguucggggagaagaccuaccaguuccuccaggaguaccuggacgccaucaagaaguucuaccagacguccguggagagcaccgacuucgccaacgccccggaggagucccgcaagaagaucaacagcuggguggagucccagaccaacgagaagaucaagaaccuguuccccgacggcaccaucgggaacgacacgacccucguccuggugaacgcgaucuacuucaagggccagugggagaacaaguucaagaaggagaacaccaaggaggagaaguucuggcccaacaaggacgugcaggccaagguccuggagauccccuacaagggcaaggaccucagcaugaucgugcugcugccgaacgagaucgacgggcuccagaagcuggaggagaagcugaccgccgagaagcucauggaguggacgucccugcagaacaugcgggagaccugcguggaccugcaccucccccgcuucaagauggaggagagcuacgaccugaaggacacccugcggaccaugggcauggucaacaucuucaacggggacgccgaccucuccggcaugacguggagccacgggcuguccgugagcaaggugcugcacaaggccuucgucgaggugaccgaggagggcguggaggcggccgccgccaccgccgucgugguggucgagcucagcucccccagcaccaacgaggaguucugcugcaaccaccccuuccuguucuucauccgccagaacaagacgaacuccauccuguucuacggccgguucagcuccccguga

SEQ ID NO: 36241 - RNA, 1128 nt, Artificial Sequence
  derived and/or modified sequence opt1 from SERPINB5__Homo_sapiens__NP_002630
auggacgcccugcagcucgccaacagcgcguucgccguggaccuguucaagcagcugugcgagaaggagccccucggcaacguccuguucuccccgaucugccugagcaccucccucagccuggcccaggugggggccaagggcgacaccgccaacgagaucggccaggugcugcacuucgagaacgucaaggacgugcccuucggguuccagacggugaccuccgacgucaacaagcucagcuccuucuacagccugaagcugaucaagcgccucuacguggacaagucccugaaccugagcaccgaguucaucuccagcaccaagcggcccuacgcgaaggagcucgagacgguggacuucaaggacaagcuggaggagaccaaggggcagaucaacaacuccaucaaggaccugaccgacggccacuucgagaacauccucgccgacaacagcgucaacgaccagaccaagauccugguggugaacgccgccuacuucgucggcaaguggaugaagaaguucuccgagagcgagacgaaggagugccccuuccgcgugaacaagaccgacaccaagccggugcagaugaugaacauggaggcgaccuucugcauggggaacaucgacuccaucaacugcaagaucaucgagcugcccuuccagaacaagcaccucagcauguucauccugcugcccaaggacgucgaggacgaguccacgggccucgagaagaucgagaagcagcugaacagcgagagccugucccaguggaccaaccccagcaccauggccaacgccaaggugaagcucuccaucccgaaguucaagguggagaagaugaucgaccccaaggccugccuggagaaccuggggcucaagcacaucuucagcgaggacaccuccgacuucagcggcauguccgagacgaagggggucgcccugagcaacgugauccacaaggugugccuggagaucaccgaggacggcggcgacuccaucgagguccccggggcgcggauccuccagcacaaggacgagcugaacgccgaccaccccuucaucuacaucauccgccacaacaagacccggaacaucaucuucuucggcaaguucugcagcccguga

SEQ ID NO: 36242 - RNA, 1143 nt, Artificial Sequence
  derived and/or modified sequence opt1 from SERPINB6__Homo_sapiens__NP_001182220
augagcgccaucauggacgugcuggccgaggcgaacggcaccuucgcccucaaccugcugaagacccucgggaaggacaacuccaagaacgucuucuucagccccauguccaugagcugcgcccuggccaugguguacaugggcgccaaggggaacacggcggcccagauggcccagauccuguccuucaacaagagcggcgggggcggcgacauccaccagggguuccagucccuccugaccgaggugaacaagaccggcacccaguaccugcuccgcauggccaaccggcuguucggggagaaguccugcgacuuccugagcagcuuccgcgacuccugccagaaguucuaccaggcggagauggaggagcucgacuucaucagcgccgucgagaagucccggaagcacaucaacacguggguggccgagaagaccgagggcaagaucgccgagcugcugagcccgggguccguggacccccucacccgccugguccuggugaacgccguguacuuccggggcaacugggacgagcaguucgacaaggagaacaccgaggagcgccucuucaaggucagcaagaacgaggagaagcccgugcagaugauguucaagcaguccacguucaagaagaccuacaucggcgagaucuucacccagauccuggugcugcccuacgucgggaaggagcucaacaugaucaucaugcugccggacgagaccacggaccugcggaccguggagaaggagcucaccuacgagaaguucguggaguggacccgccuggacaugauggacgaggaggaggucgaggugagccugccccgguucaagcucgaggaguccuacgacauggagagcgugcugcgcaaccugggcaugacggacgcguucgagcucgggaaggccgacuucagcggcaugucccagaccgaccugagccuguccaaggucgugcacaagagcuucguggaggucaacgaggagggcaccgaggccgccgccgcgaccgccgccaucaugaugaugcggugcgcccgcuucgugccccgguucugcgccgaccaccccuuccucuucuucauccagcacuccaagacgaacgggauccuguucugcggccgcuucagcuccccguga

SEQ ID NO: 36243 - RNA, 1092 nt, Artificial Sequence
  derived and/or modified sequence opt1 from SERPINB7__Homo_sapiens__NP_001248760
auggccagccuggccgcggccaacgccgaguucugcuucaaccucuuccgcgagauggacgacaaccagggcaacgggaacguguucuucuccagccugucccuguucgccgcccucgcgcugguccggcugggcgcccaggacgacagccucucccagaucgacaagagcgggcugcagucccagcugaagcgcguguucagcgacaucaacgccucccacaaggacuacgaccucagcaucgugaacggccuguucgccgagaaggucuacggguuccacaaggacuacaucgagugcgcggagaagcuguacgacgccaagguggagcggguggacuucaccaaccaccucgaggacacccgccggaacaucaacaagugggucgagaacgagacgcacggcaagaucaagaacgugaucggcgagggcgggaucuccagcuccgccgugaugguccuggugaacgccguguacuucaaggggaaguggcagagcgccuucaccaaguccgagaccaucaacugccacuucaagagccccaagugcuccggcaaggcggucgccaugaugcaccaggagcgcaaguucaaccugagcgugaucgaggacccguccaugaagauccucgagcugcgguacaacgggggcaucaacauguacgugcugcuccccgagaacgaccugagcgagaucgagaacaagcugaccuuccagaaccucauggaguggacgaacccccgccggaugaccagcaaguacgucgagguguucuucccccaguucaagaucgagaagaacuacgagaugaagcaguaccugcgcgcccugggccucaaggacaucuucgacgaguccaaggccgaccugagcgggaucgccuccggcgggcggcuguacaucagccgcaugaugcacaaguccuacaucgaggugaccgaggagggcaccgaggcgacggccgccaccggcagcaacaucgucgagaagcagcucccgcaguccacccuguuccgggccgaccaccccuuccuguucgugauccgcaaggacgacaucauccucuucagcgggaagguguccugccccuga

SEQ ID NO: 36244 - RNA, 729 nt, Artificial Sequence
  derived and/or modified sequence opt1 from SERPINB8__Homo_sapiens__NP_001027018
auggacgaccugugcgaggccaacggcaccuucgccaucagccucuucaagauccugggggaggaggacaacucccgcaacguguucuucagccccauguccaucagcuccgcgcuggccauggucuucaugggcgccaaggggagcaccgccgcccagaugucccaggcgcucugccuguacaaggacggcgacauccaccggggguuccagagccugcucuccgaggugaaccgcacgggcacccaguaccugcugcggaccgccaaccgccucuucggcgagaagaccugcgacuuccugccggacuucaaggaguacugccagaaguucuaccaggccgagcuggaggagcucagcuucgccgaggacacggaggagugccggaagcacaucaacgacuggguggcggagaagaccgaggggaagaucuccgagguccuggacgccggcaccguggacccccugaccaagcucgugcuggucaacgccaucuacuucaaggggaaguggaacgagcaguucgaccgcaaguacacgcggggcaugcuguucaagaccaacgaggagaagaagaccgugcagaugauguucaaggaggccaaguucaagaugggguacgccgacgaggugcacacccagguccucgagcugcccuacguggaggaggagcugagcauggugauccuccugcccgacgacaacacggaccuggcggucaaggaguga

SEQ ID NO: 36245 - RNA, 1131 nt, Artificial Sequence
  derived and/or modified sequence opt1 from SERPINB9__Homo_sapiens__XP_005249241
auggagacccugagcaacgccuccggcaccuucgccauccgccuccugaagauccugugccaggacaaccccagccacaacguguucugcuccccggucagcaucuccagcgcgcucgccauggugcugcugggggccaagggcaacacggccacccagauggcccaggcgcucucccugaacaccgaggaggacauccaccgggccuuccagagccugcucaccgaggugaacaaggccgggacgcaguaccugcugcgcaccgccaaccgccucuucggcgagaagaccugccaguuccuguccaccuucaaggagagcugccugcaguucuaccacgcggagcucaaggagcuguccuucauccgggccgccgaggagagccggaagcacaucaacacgugggucuccaagaagaccgaggggaagaucgaggagcugcuccccggcagcuccaucgacgccgagacccgccuggugcuggugaacgccaucuacuucaagggcaaguggaacgagcccuucgacgagaccuacacgcgggagaugcccuucaagaucaaccaggaggagcagcgcccgguccagaugauguaccaggaggcgaccuucaagcucgcccacgugggggaggugcgggcccagcugcuggagcuccccuacgcccgcaaggagcugagccugcucguccugcugcccgacgacggcguggagcucuccaccguggagaagucccugaccuucgagaagcugacggccuggaccaagcccgacugcaugaaguccaccgaggucgaggugcuccugccgaaguucaagcugcaggaggacuacgacauggagagcgugcuccggcaccuggggaucgucgacgcguuccagcagggcaaggccgaccugagcgccaugagcgccgagcgcgaccucugccugagcaaguucgugcacaaguccuucguggaggucaacgaggaggggaccgaggccgcggccgccagcuccugcuucgugguggccgagugcugcauggagagcggcccccgguucugcgccgaccaccccuuccuguucuucauccgccacaaccgggcgaacuccauccucuucugcggccgcuucagcucccccuga

SEQ ID NO: 36246 - RNA, 1395 nt, Artificial Sequence
  derived and/or modified sequence opt1 from SERPINC1__Homo_sapiens__NP_000479
auguacagcaacgugaucggcaccgucaccuccgggaagcgcaagguguaccugcucagccugcugcucaucggcuucugggacugcgugacgugccacgggucccccgucgacaucugcaccgccaagccgcgggacauccccaugaaccccaugugcaucuaccgcagccccgagaagaaggccaccgaggacgagggcuccgagcagaagaucccggaggcgaccaaccggcgcgugugggagcugagcaaggccaacucccgguucgccacgaccuucuaccagcaccuggccgacagcaagaacgacaacgacaacaucuuccucagcccccugagcaucuccaccgccuucgcgaugaccaagcugggggccugcaacgacacgcuccagcagcugauggagguguucaaguucgacaccaucagcgagaagaccuccgaccagauccacuucuucuucgccaagcugaacugccgccucuaccggaaggccaacaagagcuccaagcuggucagcgcgaaccgccuguucggcgacaagucccucaccuucaacgagacguaccaggacaucagcgagcugguguacggcgccaagcugcagccccucgacuucaaggagaacgccgagcagucccgggccgccaucaacaagugggugagcaacaagaccgaggggcgcaucaccgacgucauccccagcgaggcgaucaacgagcugaccgugcuggugcucgucaacacgaucuacuucaagggccuguggaaguccaaguucagcccggagaacacccggaaggagcuguucuacaaggccgacggggaguccugcagcgccuccaugauguaccaggagggcaaguuccgcuaccggcgcguggccgaggggacccaggugcucgagcugcccuucaagggcgacgacaucaccaugguccugauccuccccaagcccgagaagucccuggccaagguggagaaggagcugacgccggaggugcuccaggaguggcuggacgagcuggaggagaugaugcucgucgugcacaugccccgguuccgcaucgaggacggcuucucccugaaggagcagcugcaggacauggggcucguggaccuguucagccccgagaaguccaagcugcccggcaucgucgcggaggggcgggacgaccucuacgugagcgacgccuuccacaaggccuuccuggaggugaacgaggagggcuccgaggccgccgcgagcaccgccgucgugaucgccggccgcucccugaacccgaaccgggucaccuucaaggccaaccgccccuuccucguguucauccgggaggugccccugaacaccaucaucuucauggggcgcgucgccaaccccugcgugaaguga

SEQ ID NO: 36247 - RNA, 1500 nt, Artificial Sequence
  derived and/or modified sequence opt1 from SERPIND1__Homo_sapiens__NP_000176
augaagcacagccugaacgcccuccugaucuuccugaucaucaccuccgccuggggcgggagcaagggcccccucgaccagcuggagaagggcggggagaccgcgcaguccgccgacccgcagugggagcagcugaacaacaagaaccucagcaugccccugcugcccgccgacuuccacaaggagaacacggugaccaacgacuggauccccgagggggaggaggacgacgacuaccucgaccuggagaagaucuucuccgaggacgacgacuacaucgacaucgucgacagccuguccgugagcccgaccgacuccgacgugagcgccggcaacauccuccagcuguuccacggcaagucccgcauccagcggcugaacauccucaacgccaaguucgcguucaaccuguaccgcguccugaaggaccaggugaacaccuucgacaacaucuucaucgcccccguggggaucagcacggccaugggcaugaucucccucgggcugaagggcgagacccacgagcagguccacagcauccugcacuucaaggacuucgugaacgccuccagcaaguacgagaucaccaccauccacaaccucuuccggaagcugacgcaccgccuguuccggcgcaacuucggguacacccuccgguccgugaacgaccuguacauccagaagcaguuccccauccugcucgacuucaagaccaagguccgcgaguacuacuucgcggaggcccagaucgccgacuucagcgaccccgccuucaucuccaagaccaacaaccacaucaugaagcugacgaagggccugaucaaggacgcccucgagaacaucgacccggcgacccagaugaugauccugaacugcaucuacuucaagggcagcugggugaacaaguuccccguggagaugacccacaaccacaacuuccggcugaacgagcgcgaggucgugaaggugagcaugaugcagaccaaggggaacuuccucgccgccaacgaccaggagcuggacugcgacauccugcagcucgaguacgucggcgggaucuccaugcugaucguggugccccacaagaugagcggcaugaagacgcuggaggcccagcucacgccccgggucguggagcgcuggcagaaguccaugaccaaccggacccgcgaggugcugcugccgaaguucaagcucgagaagaacuacaaccuggucgagagccugaagcucaugggcauccggaugcuguucgacaagaacgggaacauggccggcaucuccgaccagcgcaucgcgaucgaccuguucaagcaccaggggaccaucaccgugaacgaggagggcacccaggccaccacggugaccaccgucggguucaugccccucagcacccaggugcgguucacggucgaccgccccuuccuguuccugaucuacgagcaccggaccuccugccuccuguucaugggccgcguggccaaccccagccgguccuga

SEQ ID NO: 36248 - RNA, 1209 nt, Artificial Sequence
  derived and/or modified sequence opt1 from SERPINE1__Homo_sapiens__NP_000593
augcagaugagccccgcccugaccugccucgugcuggggcuggcccucgucuucggggagggcuccgcggugcaccacccgcccagcuacguggcccaccuggccuccgacuucgggguccgcguguuccagcaggucgcccaggccagcaaggaccggaacgugguguucucccccuacggcguggcgagcguccuggccaugcuccagcugaccaccgggggcgagacgcagcagcagauccaggccgccaugggcuucaagaucgacgacaaggggauggcgcccgcccugcgccaccucuacaaggagcugaugggcccguggaacaaggacgagaucuccaccaccgacgccaucuucgugcagcgggaccugaagcucgugcagggguucaugccccacuucuuccgccuguuccggagcacggucaagcaggucgacuucuccgagguggagcgcgcccgguucaucaucaacgacugggugaagacccacaccaagggcaugaucagcaaccugcucgggaagggcgccguggaccagcugacccgccuggugcucgucaacgcgcuguacuucaacggccaguggaagacgcccuuccccgacuccagcacccaccggcgccuguuccacaaguccgacgggagcaccguguccgugccgaugauggcccagaccaacaaguucaacuacacggaguucaccacccccgacggccacuacuacgacauccucgagcugcccuaccacggggacacccugagcauguucaucgccgcccccuacgagaaggaggucccgcucuccgcccugacgaacauccugagcgcgcagcucaucucccacuggaagggcaacaugacccggcugccccgccugcucgugcugcccaaguucagccuggagaccgagguggaccuccggaagccccuggagaaccugggcaugaccgacauguuccgccaguuccaggccgacuucacgagccucuccgaccaggagccgcugcacgucgcccaggcccugcagaaggugaagaucgaggucaacgagagcgggaccguggccuccagcuccaccgcggugaucgucagcgcccggauggcccccgaggagaucaucauggaccgccccuuccucuucguggugcggcacaaccccaccggcacgguccuguucaugggccaggugauggagccguga

SEQ ID NO: 36249 - RNA, 1194 nt, Artificial Sequence
  derived and/or modified sequence opt1 from SERPINE2__Homo_sapiens__NP_001130000
augaacuggcaccucccccuguuccugcuggccagcgugacccucccguccaucugcagccacuucaacccccugucccuggaggagcucggcagcaacaccgggauccaggucuucaaccagaucgugaagucccgcccccacgacaacaucgugaucagcccccacggcaucgccuccguccuggggaugcugcagcucggcgcggacgggcggacgaagaagcagcuggccauggugaugcgcuacggcgugaacggcgucgggaagauccugaagaagaucaacaaggccaucgugagcaagaagaacaaggacaucgugaccgucgccaacgccguguucgugaagaacgcguccgagaucgaggucccguucgugacccggaacaaggacguguuccagugcgagguccgcaacgugaacuucgaggaccccgccagcgccugcgacuccaucaacgccugggugaagaacgagacccgggacaugaucgacaaccuccugagccccgaccugaucgacggcguccucacgcgccuggugcuggugaacgcggucuacuucaaggggcucuggaagucccgguuccagcccgagaacaccaagaagcgcaccuucguggccgccgacggcaagagcuaccaggugccgaugcuggcccagcuguccgucuuccggugcgggagcaccuccgcccccaacgaccucugguacaacuucaucgagcugcccuaccacggcgagagcaucuccaugcugaucgcgcuccccacggagagcagcaccccgcuguccgccaucaucccccacaucagcaccaagaccaucgacuccuggaugagcaucauggugcccaagcgcguccaggugauccugcccaaguucacggccguggcccagaccgaccucaaggagccgcugaagguccugggcaucaccgacauguucgacuccagcaaggccaacuucgcgaagaucacccgguccgagaaccuccacgugagccacauccugcagaaggccaagaucgagguguccgaggacgggacgaaggccagcgccgccaccaccgcgauccugaucgcccgcuccagcccgcccugguucaucgucgaccggcccuuccucuucuucauccgccacaaccccaccggcgccgugcuguucauggggcagaucaacaagcccuga

SEQ ID NO: 36250 - RNA, 1275 nt, Artificial Sequence
  derived and/or modified sequence opt1 from SERPINE3__Homo_sapiens__NP_001094790
augcccccguuccugaucacccucuuccuguuccacagcugcugccugcgcgccaacggccaccuccgggaggggaugacccugcugaagacggaguucgcccuccaccuguaccaguccguggcggccugccgcaacgagaccaacuucgucaucagccccgccggcgugucccugccccucgagauccugcaguucggggccgagggcagcaccgggcagcagcuggccgacgcgcucggcuacaccgugcacgacaagcgggucaaggacuuccugcacgccguguacgccacgcugcccaccuccagccagggcaccgagauggagcucgccugcucccuguucgugcaggucgggaccccgcugagccccugcuucguggagcacguguccuggugggcgaacagcucccucgagcccgccgaccugagcgagcccaacuccacggccauccagaccagcgagggcgccucccgcgagaccgccgggggcgggccgagcgagggccccggcggguggcccugggagcaggucuccgcggccuucgcccagcuggugcucgugagcaccauguccuuccagggcacguggcggaagcgcuucagcagcaccgacacccagauccugcccuucacgugcgccuacgggcugguccuccaggugccgaugaugcaccagaccaccgaggugaacuacggccaguuccaggacaccgccggccaccaggucggggugcuggagcugcccuaccucggcuccgcggugagccuguuccugguccucccccgggacaaggacacgccccugucccacaucgagccgcaccugaccgccagcaccauccaccucuggaccaccucccugcgccgggcccgcauggacguguuccugccccgguuccgcauccagaaccaguucaaccucaagagcauccugaacuccuggggcgugacggaccuguucgacccccucaaggccaaccugaaggggaucagcgggcaggacggcuucuacgucuccgaggccauccacaaggcgaagaucgaggugcuggaggagggcaccaaggccagcggggccaccgcccuccugcugcucaagcggucccgcauccccaucuucaaggccgaccggccguucaucuacuuccugcgcgagcccaacaccggcaucacgguguucuucgaccggauccagaucaucuaccagugccugagcuccaacaaggggagcuucguccacuacccccucaagaacaagcacuccuucuga

SEQ ID NO: 36251 - RNA, 1257 nt, Artificial Sequence
  derived and/or modified sequence opt1 from SERPINF1__Homo_sapiens__NP_002606
augcaggcccuggugcuccugcugugcaucggcgcccuccuggggcacagcuccugccagaaccccgcgagcccgcccgaggagggcucccccgaccccgacagcaccggggcccuggucgaggaggaggacccguucuucaaggugcccgugaacaagcucgccgccgccgucuccaacuucggcuacgaccuguaccgcgugcggagcuccaccagccccacgaccaacgugcugcucagcccccugagcgucgcgaccgcccuguccgcccucagccugggggccgagcagcgcaccgaguccaucauccaccgggcgcuguacuacgaccucaucagcuccccggacauccacggcacguacaaggagcugcuggacaccgugaccgcgccccagaagaaccucaagagcgccucccgcaucguguucgagaagaagcugcggaucaagagcuccuucgucgcgccccuggagaaguccuacggcacccgcccccgggugcucacggggaacccgcgccuggaccugcaggagaucaacaacugggugcaggcccagaugaagggcaagcucgcccggagcaccaaggagauccccgacgagaucuccauccugcugcucggggucgcccacuucaagggccagugggugaccaaguucgacagccgcaagaccucccuggaggacuucuaccuggacgaggagcggacggugcgcguccccaugaugagcgaccccaaggccgugcuccgguacgggcuggacuccgaccugagcugcaagaucgcccagcucccgcugaccggcuccaugagcaucaucuucuuccugccccucaaggugacccagaaccugacccugaucgaggagucccucacgagcgaguucauccacgacaucgaccgcgagcugaagaccguccaggccgugcugaccgugcccaagcucaagcuguccuacgagggcgaggucaccaagagccugcaggagaugaagcuccagucccuguucgacagccccgacuucuccaagaucacggggaagccgaucaagcugacccagguggagcaccgggccggcuucgaguggaacgaggacggggccggcaccacccccagccccggccuccagcccgcccaccugacguucccgcuggacuaccaccugaaccagcccuucaucuucgugcuccgcgacaccgacaccggggcccugcuguucaucggcaagauccucgacccccgggggcccuga

SEQ ID NO: 36252 - RNA, 1476 nt, Artificial Sequence
  derived and/or modified sequence opt1 from SERPINF2__Homo_sapiens__NP_001159392
auggcccugcucuggggccugcuggugcucagcugguccugccugcaggggcccugcagcgucuucuccccggugagcgccauggagccccugggccggcagcucaccuccgggcccaaccaggagcaggucagcccccugacccugcucaagcugggcaaccaggagcccgggggccagacggcccugaaguccccgcccggcgugugcagccgggaccccaccccggagcagacccaccgccucgcccgggccaugauggccuucaccgccgaccuguucucccugguggcgcagacgagcacgugccccaaccucauccugagcccccuguccguggcccucgcccugucccaccuggcccucggggcgcagaaccacacccugcagcgccugcagcagguccuccacgccggcagcgggcccugccugccgcaccuccucucccggcugugccaggaccugggccccggggccuuccgccucgccgcccggauguaccugcagaagggcuuccccaucaaggaggacuuccuggagcagagcgagcagcuguucggcgcgaagcccgugucccugaccgggaagcaggaggacgaccuggccaacaucaaccagugggugaaggaggccaccgagggcaagauccaggaguuccucagcgggcugccggaggacaccguccugcuccugcugaacgccauccacuuccagggcuucuggcgcaacaaguucgaccccucccucacccagcgggacagcuuccaccuggacgagcaguucaccgugcccguggagaugaugcaggcccgcacguacccccugcggugguuccuccuggagcagccggagauccaggucgcgcacuuccccuucaagaacaacaugagcuucguggugcugguccccacccacuucgaguggaacgugucccaggugcucgccaaccugagcugggacacccugcacccgccccuggucugggagcgccccaccaaggugcggcuccccaagcuguaccugaagcaccagauggaccucguggccacgcugucccagcugggccuccaggagcuguuccaggcccccgaccugcgcgggaucagcgagcagucccucgucgugagcggcgugcagcaccaguccacccuggagcugagcgaggucgggguggaggccgcggccgccaccuccaucgccaugagccggaugucccucagcuccuucagcgucaaccgcccguuccuguucuucaucuucgaggacaccacgggccugccccucuucgugggguccgugcggaaccccaacccgagcgcgccccgcgagcugaaggagcagcaggacucccccggcaacaaggacuuccugcagagccucaagggcuucccccgcggggacaagcuguucggcccggaccugaagcucgucccgcccauggaggaggacuacccccaguucgggucccccaaguga

SEQ ID NO: 36253 - RNA, 1503 nt, Artificial Sequence
  derived and/or modified sequence opt1 from SERPING1__Homo_sapiens__NP_000053
auggccagccgccugacccuccugacccugcuccugcugcuccuggccggcgaccgggcguccagcaaccccaacgccacguccagcuccagccaggacccggagucccugcaggaccgcggggagggcaagguggccaccaccgucaucagcaagaugcuguucguggagcccauccuggagguguccagccugcccaccacgaacuccaccaccaacagcgccaccaagaucacggccaacaccaccgacgagcccaccacgcagccgaccaccgagcccaccacgcagcccaccauccagcccacccagccgaccacgcagcuccccaccgacucccccacccagcccaccacggggagcuucugcccgggccccgucacccugugcuccgaccuggagagccacuccaccgaggcggugcucggggacgcccugguggacuucagccugaagcucuaccacgccuucuccgccaugaagaaggucgagaccaacauggcguucagccccuucagcaucgccucccugcugacccaggugcuccugggcgccggcgagaacaccaagaccaaccuggagagcauccucuccuaccccaaggacuucacgugcgugcaccaggcccugaagggguucacgaccaagggcgucaccagcgugucccagaucuuccacagcccggaccuggccauccgggacaccuucgugaacgcgucccgcacgcucuacagcuccagcccccggguccuguccaacaacagcgacgccaaccuggagcucaucaacaccuggguggccaagaacaccaacaacaagaucucccgccugcuggacagccuccccuccgacacccggcuggugcugcucaacgccaucuaccugagcgccaaguggaagaccacguucgaccccaagaagacccgcauggagccguuccacuucaagaacuccgucaucaaggugcccaugaugaacagcaagaaguaccccguggcgcacuucaucgaccagacccugaaggccaaggucgggcagcuccagcugucccacaaccugagccucgugauccuggugccccagaaccugaagcaccggcucgaggacauggagcaggcccugagcccguccgucuucaaggccaucauggagaagcuggagaugagcaaguuccagcccacccuccugacgcugccccgcaucaaggugaccaccucccaggacaugcugagcaucauggagaagcucgaguucuucgacuucuccuacgaccugaaccugugcggccucaccgaggaccccgaccuccaggugagcgccaugcagcaccagacgguccuggagcucaccgagaccgggguggaggcggccgccgccuccgccaucagcgucgcgcggacccugcugguguucgaggugcagcagccguuccucuucguccugugggaccagcagcacaaguuccccguguucaugggccgcguguacgacccccgggccuga

SEQ ID NO: 36254 - RNA, 1257 nt, Artificial Sequence
  derived and/or modified sequence opt1 from SERPINH1__Homo_sapiens__XP_011543629
augcgcagccugcuccugcuguccgccuucugccuccuggaggccgcgcuggccgccgaggugaagaagcccgccgccgcggccgccccgggcaccgccgagaagcucagccccaaggcggccacccuggccgagcgguccgccgggcuggccuucagccucuaccaggcgauggccaaggaccaggccgucgagaacauccuggugucccccguggucguggccagcucccugggccucgugagccucgggggcaaggccacgaccgcgucccaggccaaggccguccugagcgccgagcagcugcgcgacgaggaggugcacgccgggcugggcgagcugcuccggucccugagcaacuccaccgcgcgcaacgugaccuggaagcugggcagccggcucuacgggcccuccagcgucuccuucgccgacgacuucgugcgcagcuccaagcagcacuacaacugcgagcacagcaagaucaacuuccgggacaagcgcagcgcccugcaguccaucaacgagugggccgcccagacgaccgacggcaagcugccggaggugaccaaggacgucgagcggaccgacggggcgcuccuggugaacgccauguucuucaagccccacugggacgagaaguuccaccacaagaugguggacaaccgcggcuucauggucacgcggagcuacaccgugggggugaugaugaugcaccgcaccggccuguacaacuacuacgacgacgagaaggagaagcuccagaucgucgagaugccccuggcccacaagcuguccagccucaucauccugaugccccaccacguggagccgcuggagcggcucgagaagcugcugaccaaggagcagcucaagaucuggaugggcaagaugcagaagaaggccguggcgaucucccugcccaagggggucguggaggugacgcacgaccugcagaagcaccucgccggccuggggcugaccgaggccaucgacaagaacaaggccgaccucagccgcauguccggcaagaaggaccuguaccuggccagcgucuuccacgcgaccgccuucgagcucgacaccgacggcaaccccuucgaccaggacaucuacgggcgggaggagcugcgcucccccaagcuguucuacgccgaccacccguucaucuuccucgugcgggacacgcagagcggcucccugcuguucaucgggcgccugguccggcccaagggcgacaagaugcgcgacgagcucuga

SEQ ID NO: 36255 - RNA, 1233 nt, Artificial Sequence
  derived and/or modified sequence opt1 from SERPINI1__Homo_sapiens__NP_005016
auggccuuccugggccucuucagccugcuggugcuccaguccauggccaccggggcgaccuuccccgaggaggccaucgccgaccugagcgucaacauguacaaccgccugcgggccacgggcgaggacgagaacauccucuucuccccgcugagcaucgcccuggcgauggggaugauggagcucggcgcccagggguccacccagaaggagauccgccacagcaugggcuacgacucccugaagaacggcgaggaguucagcuuccugaaggaguucuccaacauggugaccgccaaggagagccaguacgugaugaagaucgccaacucccucuucguccagaacggguuccacgugaacgaggaguuccugcagaugaugaagaaguacuucaacgcggccgugaaccacgucgacuucagccagaacguggccguggccaacuacaucaacaagugggucgagaacaacaccaacaaccuggugaaggaccucgugagcccccgggacuucgacgccgcgacguaccuggcccugaucaacgccgucuacuucaagggcaacuggaagucccaguuccgccccgagaacacccggaccuucuccuucaccaaggacgacgagagcgaggugcagauccccaugauguaccagcagggggaguucuacuacggcgaguucuccgacgggagcaacgaggccggcggcaucuaccaggugcucgagaucccguacgagggggacgagaucuccaugaugcugguccugagccgccaggaggugccccucgccacgcuggagccccuggugaaggcgcagcucgucgaggagugggccaacagcgugaagaagcagaagguggaggucuaccugccccgguucaccguggagcaggagaucgaccugaaggacgugcucaaggcccugggcaucaccgagaucuucaucaaggacgccaaccugaccgggcucuccgacaacaaggagaucuuccugagcaaggccauccacaaguccuuccuggaggucaacgaggagggcagcgaggcggccgccguguccggcaugaucgccaucagccgcauggccguccucuacccccaggugaucguggaccacccguucuucuuccugauccggaaccgccggacggggaccauccuguucaugggccgcgucaugcaccccgagaccaugaacaccuccgggcacgacuucgaggagcucuga

SEQ ID NO: 36256 - RNA, 1248 nt, Artificial Sequence
  derived and/or modified sequence opt1 from SERPINI2__Homo_sapiens__NP_001012303
augauccagaaccugaugcgcgaggugaagauggacaccaucuuccucuggagccugcugcuccuguucuucggcucccaggccagccggugcuccgcccagaagaacaccgaguucgcggucgaccuguaccaggaggugagccucucccacaaggacaacaucaucuucagcccccuggggaucacgcuggugcucgagaugguccagcugggcgccaaggggaaggcccagcagcagauccgccagacccugaagcagcaggagaccuccgccggcgaggaguucuucgugcucaagagcuucuucuccgccaucagcgagaagaagcaggaguucaccuucaaccuggcgaacgcccuguaccuccaggagggguucacggugaaggagcaguaccugcacggcaacaaggaguucuuccaguccgccaucaagcuggucgacuuccaggacgccaaggcgugcgccgagaugaucagcaccuggguggagcggaagaccgacggcaagaucaaggacauguucuccggggaggaguucggcccgcucacccgccuggugcuggucaacgccaucuacuucaagggggacuggaagcagaaguuccggaaggaggacacgcagcucaucaacuucaccaagaagaacggcagcaccgugaagauccccaugaugaaggcccugcugcgcaccaaguacggguacuucuccgagagcucccucaacuaccaggugcuggagcugagcuacaagggcgacgaguucucccucaucaucauccugcccgccgagggcauggacaucgaggaggucgagaagcugaucacggcgcagcagauccucaaguggcugagcgagaugcaggaggaggagguggagaucagccugccccgguucaagguggagcagaaggucgacuucaaggacgugcucuacucccugaacaucaccgagaucuucagcgggggcugcgaccuguccgggaucaccgacagcuccgagguguacgucagccaggugacccagaagguguucuucgagaucaacgaggacggcuccgaggccgccacgagcaccggcauccacaucccggucaucaugucccucgcccagagccaguucaucgccaaccaccccuuccuguucaucaugaagcacaaccccaccgaguccauccuguucauggggcgcgugaccaaccccgacacgcaggagaucaagggccgggaccucgacagccuguga

SEQ ID NO: 36257 - RNA, 711 nt, Artificial Sequence
  derived and/or modified sequence opt1 from SERTAD1__Homo_sapiens__NP_037508
augcugagcaagggccucaagcgcaagcgggaggaggaggaggagaaggagccccuggccguggacuccugguggcuggacccggggcacaccgccgucgcgcaggccccgcccgccguggccagcuccagccucuucgaccuguccgugcugaagcuccaccacagccugcagcaguccgagcccgaccugcgccaccucguccugguggugaacacccugcggcgcauccaggccagcauggcgcccgccgccgcccucccgcccguccccuccccgcccgcggcccccagcguggccgacaaccugcuggccuccagcgacgccgcgcucuccgccagcauggccucccugcuggaggaccucagccacaucgagggccugucccaggcgccccagccccuggccgacgaggggccgcccggccggagcaucgggggcgccgcccccucccucggcgcccuggaccugcucgggcccgccacgggcugccugcuggacgacgggcucgagggccuguucgaggacaucgacaccagcauguacgacaacgagcugugggcccccgcgagcgaggggcucaagcccggccccgaggacggcccggggaaggaggaggcccccgagcuggacgaggccgagcuggacuaccucauggacgugcuggucggcacccaggcccuggagcgcccgcccgggcccggccgguga

SEQ ID NO: 36258 - RNA, 966 nt, Artificial Sequence
  derived and/or modified sequence opt1 from SERTAD2__Homo_sapiens__XP_011531506
augcugcccgugauccaguacaugcucggcaagggcgggaagcgcaaguucgacgagcacgaggacgggcuggagggcaagaucgucagcccgugcgacgggcccuccaaggugagcuacacccugcagcggcagaccaucuucaacaucucccucaugaagcuguacaaccaccgcccccugacggagcccagccuccagaagaccgugcugaucaacaacaugcugcggcgcauccaggaggagcucaagcaggagggcucccugcggccgauguucacccccagcucccagcccaccacggagcccagcgacuccuaccgcgaggccccgcccgccuucagccaccuggcgucccccagcucccaccccugcgaccucggcagcaccaccccgcuggaggccugccugacccccgccucccuccuggaggacgacgacgacacguucugcaccagccaggccaugcagcccaccgcccccaccaagcuguccccgcccgcgcuccugcccgagaaggacagcuucuccagcgcccuggacgagaucgaggagcucugccccacgagcaccuccaccgaggccgccaccgcggccacggacagcgucaaggggaccuccagcgaggccggcacccagaagcuggacgggccgcaggagucccgggccgacgacagcaagcugauggacucccuccccggcaacuucgagaucaccacgagcaccggguuccugaccgaccugacccucgacgacauccuguucgccgacaucgacacguccauguacgacuucgaccccugcaccagcuccagcggcaccgcguccaagauggcccccgugagcgccgacgaccugcucaagacccuggccccguacuccagccagcccgugacgcccucccagcccuucaagauggaccugaccgagcucgaccacaucauggagguccuggugggcagcuga

SEQ ID NO: 36259 - RNA, 1479 nt, Artificial Sequence
  derived and/or modified sequence opt1 from SESN1__Homo_sapiens__NP_001186862
augcgccuggccgccgcggccaacgaggccuacaccgcgccccucgccgugagcggccugcuggggugcaagcagugcggcgggggccgggaccaggacgaggagcucgggauccgcaucccgcggccccugggccagggccccucccgcuucauccccgagaaggagauccugcaggucgggagcgaggacgcccagaugcacgcccucuucgccgacuccuucgccgcgcugggccggcuggacaacaucacccucgugaugguguuccacccgcaguaccuggagagcuuccugaagacgcagcacuaccuccugcagauggacgggccccugccccuccacuaccgccacuacaucggcaucauggccgccgcccggcaccagugcuccuaccuggucaaccugcacgugaacgacuuccuccacgucgggggcgaccccaaguggcugaacggccuggagaacgccccgcagaagcuccagaaccugggggagcugaacaaggugcucgcgcaccgccccuggcugaucaccaaggagcacaucgagggccugcucaaggccgaggagcacagcuggucccuggccgagcuggugcacgccgugguccuccugacccacuaccacagccuggccuccuucaccuucgggugcggcaucagccccgagauccacugcgacggcgggcacacguuccggcccccguccgugagcaacuacugcaucugcgacaucaccaacggcaaccacuccguggacgagaugcccgucaacagcgcggagaacguguccgugagcgacuccuucuucgaggucgaggcccucauggagaagaugcgccagcugcaggagugccgggacgaggaggaggccagccaggaggagauggccucccgcuucgagaucgagaagcgggagagcauguucguguucagcuccgacgacgaggaggugacccccgcccgcgcggucagccggcacuucgaggacaccuccuacggguacaaggacuucagccgccacggcaugcacgugcccacguuccgggugcaggacuacugcugggaggaccacggguacucccuggucaaccgccucuacccggacgugggccagcugaucgacgagaaguuccacaucgccuacaaccugaccuacaacaccauggccaugcacaaggacguggacaccagcaugcuccggcgcgccaucuggaacuacauccacugcauguucggcauccgguacgacgacuacgacuacggggagaucaaccagcugcuggaccgcuccuucaaggucuacaucaagacgguggucugcacccccgagaaggugaccaagcgcauguacgacagcuucuggcggcaguucaagcacuccgagaaggugcacgucaaccuccugcugaucgaggcccgcaugcaggcggagcuccuguacgcccugcgggccaucacccgcuacaugacguga

SEQ ID NO: 36260 - RNA, 1062 nt, Artificial Sequence
  derived and/or modified sequence opt1 from SESN3__Homo_sapiens__NP_001258523
augagccugcacacccaguaccucgaguccuuccugcgcagccaguucuacaugcugcggauggacggcccccucccgcugcccuaccgccacuacaucgccaucaugaagcuggugaagaccggggagaacaacuggucccuccccgagcugguccacgccguggugcugcucgcgcacuaccacgcccuggccagcuucgucuucggcuccgggaucaaccccgagcgggacccggagaucagcaacggcuuccgccugaucuccgugaacaacuucugcgugugcgaccucgccaacgacaacaacaucgagaacgccagccuguccgggagcaacuucggcaucgucgacucccugagcgagcucgaggcgcugauggagcggaugaagcgccugcaggaggagcgggaggacgaggaggccucccaggaggagaugagcacgcgcuucgagaaggagaagaaggagucccucuucguggugagcggcgacaccuuccacuccuucccccacagcgacuucgaggacgacaugaucaucaccuccgacgucagccgguacaucgaggaccccggguucggcuacgaggacuucgcccgccgcggggaggagcaccuccccaccuuccgggcccaggacuacacgugggagaaccacggcuucagccuggugaaccggcuguacuccgacaucgggcaccuccuggacgagaaguuccgcaugguguacaaccugaccuacaacaccauggcgacccacgaggacgucgacacgaccaugcugcggcgcgcccuguucaacuacgugcacugcauguucggcauccgguacgacgacuacgacuacggcgaggugaaccagcuccuggagcgcagccugaaggucuacaucaagaccgugaccugcuacccggagcggacgaccaagcgcauguacgacuccuacuggcggcaguucaagcacagcgagaaggugcacgucaaccuccugcugauggaggcccgcaugcaggccgagcuccuguacgcccugcgcgcgaucacccggcaccucaccuga

SEQ ID NO: 36261 - RNA, 729 nt, Artificial Sequence
  derived and/or modified sequence opt1 from SETBP1__Homo_sapiens__NP_001123582
auggagagccgcgagacccuguccagcucccggcagcgcggcggggagagcgacuuccuccccguguccagcgccaagccgcccgccgcgcccggcugcgccggggagccccugcuguccaccccgggccccgggaagggcauccccgucggcggggagcggauggagcccgaggaggaggacgagcucggcagcgggcgcgacguggacuccaacagcaacgccgacuccgagaaguggguggccggcgacgggcuggaggagcaggaguucagcaucaaggaggccaacuucacggagggcucccugaagcucaagauccagaccaccaagcgggcgaagaagccgcccaagaaccuggagaacuacaucugcccgcccgagaucaagaucaccaucaagcagagcggcgaccagaaggucucccgcgccgggaagaacagcaaggccacgaaggaggaggagcggucccacagcaagaagaagcugcucaccgccuccgaccuggcggccagcgaccugaagggcuuccagccccagaucaaggacagcuccaaggaggagguguggaagcgccgcgggggccagggcauccccuucaagaagcaguuccucagccaggagcgggccaugugcuucuccugcccccggaaccccuucccggccaagcccgggagccugacccugcccuuccacuccgagcccgccgugugggcgcaggaggucuga

SEQ ID NO: 36262 - RNA, 5124 nt, Artificial Sequence
  derived and/or modified sequence opt1 from SETD1A__Homo_sapiens__NP_055527
auggaccaggagggcgggggcgacgggcagaaggcccccagcuuccaguggcgcaacuacaagcugaucguggacccggcccucgaccccgcgcugcggcgccccucccagaaggucuaccgguacgacggcgugcacuucagcgugaacgacuccaaguacauccccgucgaggaccugcaggacccgcgcugccacgugcggagcaagaaccgcgacuucucccuccccgugcccaaguucaagcuggacgaguucuacaucgggcagaucccccugaaggaggucaccuucgcccggcucaacgacaacgugcgcgagaccuuccugaaggacaugugccggaaguacggcgagguggaggaggucgagauccugcuccacccgcgcacgcggaagcaccugggccuggcccgcgugcucuucaccagcacccggggggccaaggagaccgugaagaaccugcaccugacguccgucaugggcaacaucauccacgcccagcucgacaucaaggggcagcagcgcaugaaguacuacgagcugaucgugaacggcagcuacaccccccagaccgugcccaccgggggcaaggcgcuguccgagaaguuccagggcagcggggccgccacggagaccgccgagucccggcgccggagcuccagcgacaccgcggccuaccccgccggcaccacggccgucgggaccccgggcaacggcacccccugcucccaggacaccagcuucuccagcucccgccaggacacgcccagcagcuucgggcaguucaccccccaguccagccagggcaccccguacaccucccgggggagcacgcccuacucccaggacagcgccuacuccagcuccaccaccagcaccuccuucaagccccgccggagcgagaacuccuaccaggacgcguucagccgccgccacuucuccgccagcuccgccagcacgaccgccuccaccgccaucgcggccaccacggccgccaccgccagcagcuccgcgagcuccagcucccucagcuccagcuccagcuccagcuccagcuccagcuccagccaguuccggagcuccgacgccaacuaccccgccuacuacgagagcuggaaccgcuaccagcggcacaccuccuacccgccccgccgggccacccgcgaggagccccccggcgccccguucgcggagaacacggccgagcgguucccccccagcuacaccuccuaccugcccccggagcccagccgccccaccgaccaggacuaccggccgcccgccuccgaggccccccccccggagccccccgagcccgggggcggcgggggcgggggcgggccgagccccgagcgcgaggaggugcggaccuccccccgccccgcgagcccggcccgguccggcagccccgcccccgagacgaccaacgaguccgugcccuucgcccagcacagcucccuggacagccgcaucgagaugcuccugaaggagcagcgguccaaguucagcuuccuggccuccgacaccgaggaggaggaggagaacagcagcaugguccucggcgcgcgcgacaccggguccgaggugccgagcggcuccgggcacggccccugcaccccccccccggcccccgccaacuucgaggacguggcccccacggggagcggcgagcccggcgccacccgggaguccccgaaggcgaacgggcagaaccaggccagccccugcuccagcggcgacgacauggagaucuccgacgacgaccgcgggggcagccccccgcccgcccccacccccccgcagcagcccccccccccgcccccccccccgcccccccccccgcccuaccuggccucccugccccucggcuaccccccgcaccagcccgccuaccugcugcccccccggccggacgggcccccccccccggaguacccccccccgcccccccccccgccccacaucuacgacuucgucaacagccucgagcugauggaccgccugggcgcgcagugggggggcaugcccauguccuuccagaugcagacccagaugcucacgcgccugcaccagcugcggcaggggaagggccucaucgccgccagcgccggccccccggggggcgcguucggggaggccuuccugcccuucccccccccgcaggaggccgccuacggccugcccuacgcccucuacgcgcaggggcaggagggccgcggcgccuacucccgggaggccuaccaccugcccaugcccauggccgccgagccgcugcccagcuccagcguguccggggaggaggcgcgccuccccccccgggaggaggccgagcuggccgagggcaagacccugccgaccgccgggaccgugggccgcguccucgccaugcuggugcaggagaugaagagcaucaugcagcgggaccugaaccgcaagauggucgagaacguggcguucggggccuucgaccaguggugggagagcaaggaggagaaggccaagcccuuccagaacgccgcgaagcagcaggccaaggaggaggacaaggagaagacgaagcucaaggagcccggccugcugucccugguggacugggccaagagcggcgggaccaccggcaucgaggccuucgccuucggguccggccuccggggggcgcugcgccugcccagcuucaaggucaagcggaaggagccguccgagaucagcgaggccuccgaggagaagcgcccccggcccagcacccccgccgaggaggacgaggacgacccggagcaggagaaggaggccggcgagcccggccgccccgggacgaagccgcccaagcgggacgaggagcgcggcaagacccaggggaagcaccggaaguccuucgcccucgacagcgagggcgaggaggcgucccaggagagcuccagcgagaaggacgaggaggacgacgaggaggacgaggaggacgaggaccgcgaggaggccguggacaccaccaagaaggagacggagguguccgacggcgaggacgaggagagcgacuccagcuccaagugcagccuguacgccgacagcgacggggagaacgacuccaccagcgacuccgagagcuccagcuccagcuccagcuccagcuccagcuccagcuccagcuccagcagcuccagcuccagcuccagcgaguccagcuccgaggacgaggaggaggaggagcggcccgccgcccugcccagcgcguccccgcccccccgcgagguccccgugccgacccccgcccccguggagguccccgugccggagcggguggccggcagccccgucaccccccuccccgagcaggaggccuccccggcccgccccgcggggcccacggaggagagccccccguccgccccccugcgcccccccgagccgcccgccggccccccggcccccgcgccccggcccgacgagcgcccgagcucccccaucccccugcuccccccgcccaagaagcggcgcaagaccgugagcuucuccgccaucgaggugguccccgcccccgagccgccccccgccacccccccgcaggccaaguuccccgggcccgcgagccggaaggccccccgcggcguggagcggaccauccgcaaccugccgcuggaccacgccagccucgugaaguccuggcccgaggaggucagccggggcgggcgcucccgggccggcgggcgcggccggcugacggaggaggaggaggccgagcccgggaccgagguggaccuggcggugcucgccgaccuggcccugacccccgcccgccggggccucccggcccugcccgcggucgaggacagcgaggccaccgagacguccgacgaggccgagcgcccccggccccugcucagccacauccugcuggagcacaacuacgcccucgcggugaagccgaccccccccgccccggcccugcgcccccccgagcccgugccggcccccgccgcgcuguucuccagccccgccgacgagguccucgaggcccccgaggugguggucgccgaggccgaggagccgaagccccagcagcugcagcagcagcgggaggagggcgaggaggagggggaggaggagggcgaggaggaggaggaggaguccagcgacuccagcuccagcuccgacggggagggcgcgcugcgccgccggagccuccgcucccacgcccggcgccggcgcccccccccgcccccccccccgccccccccccgggccuacgagccgcgcagcgaguucgagcagaugaccauccuguacgacaucuggaacagcgggcuggacuccgaggacaugagcuaccuccggcugaccuacgagcgccugcuccagcagacguccggcgccgacuggcugaacgacacccacugggugcaccacaccaucaccaaccugacgacccccaagcggaagcgccggccccaggacggcccccgcgagcaccagaccgggagcgcccgguccgagggcuacuacccgaucagcaagaaggagaaggacaaguaccucgacgugugccccgucuccgcgcgccagcuggaggggguggacacccagggcaccaaccgggugcugagcgagcgccgguccgagcagcgccggcuccugagcgccaucggcacguccgccaucauggacagcgaccugcucaagcugaaccagcugaaguuccgcaagaagaagcuccgcuucgggcggucccgcauccacgaguggggccuguucgccauggagcccaucgcggccgacgagauggucaucgaguacguggggcagaacauccggcagaugguggccgacaugcgcgagaagcgguacguccaggagggcaucgggagcuccuaccuguuccgcguggaccacgacaccaucaucgacgccaccaagugcggcaaccucgcccgguucaucaaccacugcugcacccccaacugcuacgcgaaggugaucacgaucgagagccagaagaagaucgucaucuacuccaagcagccgaucggcguggacgaggagaucaccuacgacuacaaguucccccuggaggacaacaagauccccugccugugcgggaccgagagcugccgcggcucccucaacuga

SEQ ID NO: 36263 - RNA, 5772 nt, Artificial Sequence
  derived and/or modified sequence opt1 from SETD1B__Homo_sapiens__NP_055863
auggagaacagccaccccccgcaccaccaccaccagcagccccccccccagccgggccccuccggggagcgccggaaccaccacuggcgcagcuacaagcugaugaucgaccccgcccucaagaagggccaccacaagcuguaccgguacgacgggcagcacuucucccuggccaugagcuccaaccgccccguggagaucgucgaggacccgcggguggugggcaucuggaccaagaacaaggagcucgagcugagcguccccaaguucaagaucgacgaguucuacguggggcccgugcccccgaagcaggucaccuucgcgaagcugaacgacaacauccgcgagaacuuccuccgggacaugugcaagaaguacggcgagguggaggagguggagauccuguacaaccccaagacgaagaagcaccugggcaucgccaaggucguguucgccaccgugcgcggggccaaggacgccguccagcaccuccacuccaccagcgugaugggcaacaucauccacguggagcuggacaccaagggggagacgcggaugcgcuucuacgagcugcucgucaccggccgguacaccccccagacccugcccgugggggagcuggacgcgguguccccgaucgucaacgagacgcuccagcugagcgacgcccugaagcgccucaaggacggcggccuguccgccgggugcggcagcggguccagcuccgugacccccaacagcggcggcacccccuucucccaggacaccgccuacagcuccugccggcuggacacgcccaacagcuacgggcagggcaccccgcucaccccccgccuggggacccccuucagccaggacuccagcuacuccagccggcagcccacgccguccuaccuguucagccaggaccccgcggugaccuucaaggcccgccggcacgaguccaaguucaccgacgccuacaaccgccggcacgagcaccacuacguccacaacagccccgccgugaccgccguggcgggcgccacggccgccuuccgcggguccagcgaccuccccuucggcgccgucggcgggaccggcggguccagcggcccgcccuucaaggcgcagccccaggacuccgccaccuucgcccacaccccgccccccgcccaggccacgcccgcgccgggguucaagagcgccuucucccccuaccagacccccguggcccacuuccccccgccccccgaggagcccaccgccaccgccgcguucggcgcccgggacagcggcgaguuccgccgcgccccggccccccccccccugccgcccgcggagccccuggccaaggagaagcccgggacgccgcccggcccccccccgcccgacaccaacuccauggagcucgggggccggcccaccuucggguggagcccggagcccugcgacucccccggcacccccacgcuggagagcagcccggccggccccgagaagccccacgacucccuggacagccgcaucgagaugcuccugaaggagcagcggaccaagcugcucuuccugcgcgagcccgacuccgacaccgagcugcagauggaggggagcccgaucuccagcuccagcucccagcucagcccccuggcccccuucggcaccaacucccagcccggguuccggggcccgacgccccccagcucccgccccagcuccaccggccuggaggacaucagcccgaccccccuccccgacuccgacgaggacgaggagcuggaccuggggcucggcccccggccgccccccgagcccgggccgcccgaccccgccggccugcugagccagaccgcggaggucgcccucgaccuggugggggaccgcacccccacgagcgagaagauggacgagggccagcaguccagcggcgaggacauggagaucuccgacgacgagaugccgagcgcccccaucaccuccgccgacugccccaagccgaugguggucacccccggggccgcggccguggccgcccccagcgugcuggcccccacccucccgcugcccccccccccgggcuuccccccccugcccccgcccccccccccgccccccccccagccgggguuccccaugccccccccgcugcccccccccccgccccccccgccccccgcgcaccccgccgucacggugccgccccccccccucccggccccccccggcgugcccccgccccccauccugcccccgcugccccccuuccccccggggcucuuccccgucaugcagguggacaugucccacgugcugggcggccagugggggggcaugcccaugagcuuccagaugcagacccagguccugucccggcucaugaccgggcagggcgccugccccuacccgcccuucauggcggccgccgccgccgcggccagcgccgggcugcaguucgugaaccugcccccguaccgcggccccuucucccucagcaacuccggccccgggcggggccagcacuggcccccgcugcccaaguucgaccccagcgugcccccgcccggguacaugccccgccaggaggacccccacaaggccaccgucgacggcgugcugcucgugguccugaaggagcugaaggccaucaugaagcgggaccucaaccgcaagaugguggagguggucgcguuccgggccuucgacgaguggugggacaagaaggagcgcauggccaaggccucccugacgccggugaagagcggggagcacaaggacgaggaccggcccaagcccaaggaccgcaucgccuccugccugcucgagagcuggggcaagggcgaggggcugggcuacgaggggcugggccucggcaucgggcugcggggcgcgauccgccugcccuccuucaaggugaagcgcaaggagccgcccgacaccaccagcagcggggaccagaagcggcuccgccccuccaccagcgucgacgaggaggacgaggaguccgagcgggagcgcgaccgggacauggccgacacgcccugcgagcuggccaagcgcgacccgaagggcgugggggugcggcgccggcccgcccgcccccuggagcucgacagcggcggcgaggaggacgagaaggagucccugagcgaggagcaggaguccaccgaggaggaggaggaggcggaggaggaggaggaggaggaggacgacgacgacgacgacagcgacgaccgggacgaguccgagaacgacgacgaggacaccgcccugagcgaggccuccgagaaggacgagggggacagcgacgaggaggagaccgucuccaucgugacgagcaaggccgaggccaccuccagcuccgagagcuccgagagcagcgaguucgaguccagcuccgagagcucccccagcuccagcgaggacgaggaggagguggucgcgcgcgaggaggaggaggaggaggaggaggaggagaugguggccgaggaguccauggccagcgccggcccggaggacuucgagcaggacggggaggaggccgcgcucgcccccggcgcccccgccguggacucccuggggauggaggaggaggucgacaucgagaccgaggccguggcgcccgaggagcggccgagcaugcuggacgagcccccccucccggugggcgucgaggagcccgccgacucccgcgagccccccgaggagccgggccugagccaggagggggccaugcugcucucccccgagccccccgccaaggagguggaggcccggccgccccugagccccgagcgcgcgcccgagcacgaccuggagguggagccggagccccccaugaugcucccccugccgcugcagcccccccuccccccgccccggcccccccgcccgcccuccccccccccggagcccgagaccacggacgccagccaccccuccgucccgcccgagccccuggccgaggaccaccccccgcacacccccggccugugcgggagccucgccaagagccaguccaccgagaccgugcccgcgacgcccggcggggagccgccccugagcggcggcuccagcgggcugucccucagcuccccccaggugcccggcagcccguucuccuaccccgcccccagccccucccugagcuccgggggccugccgcggacccccggccgcgacuucagcuucacccccaccuucuccgagcccagcgggccgcuccugcugcccgucugcccccuccccacgggccggcgcgacgagcgcuccgggccgcuggccagccccgugcugcucgagaccggccugccccugccccucccgcugccccugccccucccgcuggcccugcccgccgugcuccgggcgcaggcccgcgcccccaccccccugccgccccugcuccccgccccccuggccuccugcccgccccccaugaagcggaagcccgggcgcccgcggcgcagcccccccagcaugcugucccucgacggcccccugguccggccgcccgcgggcgccgcccuggggcgcgagcuccugcugcuccccggccagccccagaccccgguguuccccagcacgcacgacccccggaccgugacccuggacuuccgcaacgccgggauccccgccccgccccccccgcugcccccccagcccccgcccccccccccgcccccccccgucgagccgaccaagcuccccuucaaggagcuggacaaccaguggcccuccgaggcgauccccccgggcccccgggggcgcgacgaggugacggaggaguacauggagcuggccaagagccggggccccuggcgccggcccccgaagaagcgccacgaggaccucgugccccccgccggcucccccgagcugagcccgccccagccccuguuccggccccgcuccgaguucgaggagaugaccauccucuacgacaucuggaacgggggcaucgacgaggaggacauccgguuccugugcgucaccuacgagcgccugcuccagcaggacaacgggauggacuggcugaacgacacccuguggguguaccacccgagcaccucccucagcuccgccaagaagaagaagcgcgacgacggcauccgggagcacgucacggggugcgcgcgcagcgagggcuucuacaccaucgacaagaaggacaagcugcgguaccugaacuccagccgcgccuccaccgacgagccccccgccgacacccagggcaugagcaucccggcccagccccacgccuccacgcgggcggggagcgagcgccgguccgagcagcgccggcugcucagcagcuucaccggcuccugcgacagcgaccugcugaaguucaaccagcucaaguuccgcaagaagaagcugaaguucugcaagucccacauccacgacugggggcuguucgccauggagcccaucgccgccgacgagauggugaucgaguacgugggccagaacauccggcaggucaucgccgacaugcgcgagaagcgguacgaggacgaggggaucggcagcuccuacauguuccgcguggaccacgacaccaucaucgacgcgaccaagugcggcaacuucgcccgguucaucaaccacagcugcaaccccaacugcuacgccaaggugaucacggucgagucccagaagaagaucgugaucuacagcaagcagcacaucaacgugaacgaggagaucaccuacgacuacaaguucccgaucgaggacgucaagauccccugccucugcggguccgagaacugccgcggcacccugaacuga

SEQ ID NO: 36264 - RNA, 7695 nt, Artificial Sequence
  derived and/or modified sequence opt1 from SETD2__Homo_sapiens__NP_054878
augaagcagcugcagccccagcccccgcccaagaugggcgacuucuacgaccccgagcacccgacccccgaggaggaggagaacgaggccaagaucgagaacgugcagaagaccggguucaucaagggccccauguucaagggggucgccagcagccgcuuccuccccaagggcaccaagaccaaggugaaccuggaggagcaggggcggcagaaggugagcuucagcuucagccugaccaagaagacccuccagaaccgcuuccugaccgcccugggcaacgagaagcaguccgacacccccaacccgcccgccgucccccuccagguggacagcacccccaagaugaagauggagaucggcgacacccuguccaccgccgaggagagcagcccgcccaagagccggguggagcuggggaagauccacuucaagaagcaccuccugcacgucaccucccgcccccugcucgccaccaccacggccguggccagcccgcccacccacgccgcgccccuccccgccgugaucgcggaguccaccaccgucgacagcccgcccuccagcccgcccccgccgccgccgcccgcccaggccacgacccuguccagccccgcccccgugaccgagcccguggcccucccccacacccccaucacgguccugauggcggcccccgugccccugcccguggacgucgccgugcggucccucaaggagccgcccaucaucaucgugcccgagagccuggaggccgacaccaagcaggacaccaucagcaacucccuggaggagcacgucacccagauccucaacgagcaggccgacaucagcuccaagaaggaggacagccacaucggcaaggacgaggagauccccgacuccagcaagaucucccugagcugcaagaagacgggguccaagaagaaguccagccagagcgagggcaucuuccugggguccgagagcgacgaggacuccgugcgcaccagcuccagccagcggucccacgaccucaaguucagcgcgagcaucgagaaggagcgcgacuucaagaaguccagcgcgccccugaaguccgaggaccugggcaagcccagccgguccaagaccgaccgcgacgacaaguacuucagcuacuccaagcucgagcgggacacccgcuacgugagcucccggugccgcagcgagcgggagcgccggcgcucccggagccacucccgcagcgagcggggcucccgcacgaaccugagcuacucccgcagcgagcggagccacuacuacgacuccgaccgccgguaccaccgcagcucccccuaccgggagcgcacccgguacagccgccccuacaccgacaaccgggcccgcgaguccagcgacuccgaggaggaguacaagaagaccuacagccggcgcacguccagccacuccagcuccuaccgggaccugcgcaccagcuccuacagcaaguccgaccgggacugcaagaccgagaccagcuaccucgagauggagcgccgggggaaguacuccagcaagcuggagcgcgagagcaagcggacguccgagaacgaggccaucaagcgcugcugcuccccgcccaacgagcugggcuuccgccggggguccagcuacuccaagcacgacagcuccgccagccgcuacaaguccacccucagcaagcccauccccaaguccgacaaguucaagaacagcuucugcugcaccgagcugaacgaggagaucaagcagucccacagcuucucccugcagacccccugcagcaagggcuccgagcuccggaugaucaacaagaaccccgagcgcgagaaggcgggcagccccgcccccuccaaccggcugaacgacagccccacccugaagaagcucgacgagcugcccaucuucaagagcgaguucaucacgcacgacucccacgacagcaucaaggagcuggacucccucagcaaggucaagaacgaccagcugcgcuccuucugccccaucgagcugaacaucaacgggagccccggcgccgaguccgaccucgccaccuucugcaccagcaagaccgacgccgugcugaugacguccgacgacagcgugaccggguccgagcugagcccccucgucaaggcgugcaugcuguccagcaacggcuuccagaacaucucccggugcaaggagaaggaccuggacgacacgugcaugcugcacaagaaguccgaguccccguuccgcgagaccgagccccucgugagcccccaccaggacaagcugauguccaugcccgucaugacgguggacuacagcaagaccguggucaaggagccgguggacacccgggugagcugcugcaagaccaaggacuccgacaucuacugcacgcugaacgacagcaaccccucccucugcaacagcgaggccgagaacaucgagcccuccgucaugaagaucagcuccaacagcuucaugaacgugcaccuggaguccaagcccgugaucugcgacagccgcaaccugaccgaccacuccaaguucgccugcgaggaguacaagcagagcaucggguccaccagcuccgccagcgucaaccacuucgacgaccucuaccagcccaucggcuccagcggcaucgcguccagccugcagagccugccgcccgggaucaagguggacucccucacccugcugaagugcggcgagaacacgagccccgugcucgacgccguccugaaguccaagaaguccuccgaguuccugaagcacgccgggaaggagaccaucguggaggugggcagcgaccucccggacuccgggaagggcuucgccagccgggagaaccgccggaacaacggccuguccgggaagugccugcaggaggcccaggaggagggcaacagcauccuccccgagcgccgggggcgccccgagaucucccuggacgagcggggcgagggcgggcacguccacaccagcgacgacuccgaggugguguucagcuccugcgaccugaaccucaccauggaggacagcgacggcgucacguacgcgcugaagugcgacuccagcgggcacgcccccgagaucguguccaccgugcacgaggacuacagcggcagcuccgagagcuccaacgacgagagcgacuccgaggacaccgacagcgacgacuccagcaucccgcgcaaccggcugcaguccgucguggugguccccaagaacagcacccuccccauggaggagacgucccccugcagcucccgcagcucccagagcuaccggcacuacuccgaccacugggaggacgagcgccuggagagccgccggcaccuguacgaggagaaguucgagagcaucgccuccaaggccugcccgcagaccgacaaguucuuccuccacaaggggaccgagaagaaccccgagaucagcuucacccaguccagccgcaagcagaucgacaaccggcugcccgagcugucccacccccagagcgacggcguggacuccacgagccacaccgacgugaaguccgacccgcucggccaccccaacagcgaggagaccgucaaggccaagauccccucccgccagcaggaggagcugcccaucuacagcuccgacuucgaggacgugccgaacaagagcuggcagcagaccacguuccagaaccggcccgacucccgccuggggaagaccgagcucagcuucuccagcuccugcgagaucccccacguggacggccugcacagcagcgaggagcugcggaaccucgggugggacuucucccaggagaagccgagcaccaccuaccagcagcccgacuccagcuacggcgcgugcgggggccacaaguaccagcagaacgccgagcaguacggcgggacgcgcgacuacuggcagggcaacggguacugggacccccgguccggccgcccgcccgggaccggcgucguguacgaccggacccagggccaggugcccgacagccugaccgacgaccgcgaggaggaggagaacugggaccagcaggacgggucccacuucagcgaccaguccgacaaguuccugcucagccugcagaaggacaagggcuccguccaggcccccgagaucagcuccaacagcaucaaggacacccuggccgugaacgagaagaaggacuucuccaagaaccucgagaagaacgacaucaaggaccgggggccccugaagaagcgccggcaggagaucgagagcgacuccgagagcgacggcgagcugcaggaccgcaagaaggugcgggucgagguggagcagggggagacguccgugccgcccggcagcgcccucgucggccccagcugcgugauggacgacuuccgcgacccccagcgguggaaggagugcgcgaagcaggggaagaugcccugcuacuucgaccugaucgaggagaacguguaccugaccgagcgcaagaagaacaagucccaccgcgacaucaagcggaugcagugcgagugcacgccccugagcaaggacgagcgcgcccagggcgagaucgccugcggggaggacugccugaaccggcugcucaugaucgagugcuccagccgcugccccaacggcgacuacugcuccaaccggcgcuuccagcggaagcagcacgccgacgucgaggugauccugaccgagaagaagggguggggccugcgcgcggccaaggaccuccccagcaacacguucgugcuggaguacugcggcgagguccuggaccacaaggaguucaaggcccgggugaaggaguacgcccgcaacaagaacauccacuacuacuucauggcccucaagaacgacgagaucaucgacgcgacccagaaggggaacugcucccgguucaugaaccacagcugcgagccgaacugcgagacccagaaguggaccgugaacggccagcugcgcgucggguucuucacgaccaagcuggugcccuccggcagcgagcucaccuucgacuaccaguuccagcgguacggcaaggaggcccagaagugcuucugcggguccgccaacugccgcggcuaccucgggggcgagaaccgggugagcauccgcgccgccgggggcaagaugaagaaggagcggucccgcaagaaggacagcgucgacggcgagcuggaggcgcucauggagaacggggagggccuguccgacaagaaccaggugcugagccucucccggcugaugguccgcaucgagacccuggagcagaagcucacgugccuggagcugauccagaacacccacagccaguccugccucaagagcuuccuggagcggcacgggcugagccuccuguggaucuggauggccgagcugggcgacgggcgcgaguccaaccagaagcuccaggaggagaucaucaagacccuggagcaccuccccauccccaccaagaacaugcucgaggagagcaaggugcugccgaucauccagcgcuggucccagacgaagaccgccgugccgccccugagcgagggcgacggcuacuccagcgagaacaccucccgggcccacacgccccugaacacgccggaccccagcaccaagcuguccaccgaggccgacaccgacacgcccaagaagcugauguuccgccggcucaagaucaucagcgagaacuccauggacagcgcgaucuccgacgccaccagcgagcuggaggggaaggacggcaaggaggaccuggaccagcucgagaacguccccguggaggaggaggaggagcugcagucccagcagcugcucccgcagcagcugcccgagugcaagguggacagcgagaccaacaucgaggccuccaagcugcccaccagcgagccggaggccgacgcggagaucgagcccaaggaguccaacgggacgaagcuggaggagcccaucaacgaggagacccccagccaggacgaggaggagggcgucagcgacguggaguccgagcgcagccaggagcagccggacaagaccguggacaucuccgaccucgccaccaagcugcuggacagcuggaaggaccucaaggaggucuaccggauccccaagaagucccagacggagaaggagaacaccaccaccgagcgcgggcgggacgccgugggcuuccgcgaccagacgcccgcccccaagaccccgaaccggagccgcgagcgggaccccgacaagcagacccagaacaaggagaagcgcaagcggcgcuccagccugagcccgcccagcuccgccuacgagcggggcaccaagcgcccggacgaccgguacgacacccccacgagcaagaagaaggugcgcaucaaggaccggaacaagcuguccaccgaggagcgccgcaagcuguucgagcaggaggucgcgcagcgggaggcccagaagcagcagcagcagaugcagaaccuggggaugaccagcccccugcccuacgacucccucggcuacaacgccccgcaccaccccuucgccggguacccgcccggcuacccgaugcaggccuacguggaccccagcaaccccaacgcgggcaaggugcugcugcccaccccguccauggaccccgucugcagccccgccccguacgaccacgcccagccccucguggggcacuccacggagccccugagcgccccgccgcccgugcccgucgugccccacguggccgcgcccgucgaggugagcuccagccaguacguggcccaguccgacggcgucgugcaccaggacagcuccguggccguccugcccgugcccgcccccgggcccgugcagggccagaacuacagcgucugggacuccaaccagcagagcguguccgugcagcagcaguacagccccgcccagucccaggcgaccaucuacuaccaggggcagaccugccccaccgucuacggcgugacgagccccuacucccagaccaccccgcccaucgugcagagcuacgcccagcccucccuccaguacauccagggccagcagaucuucaccgcccacccccagggggucguggugcagccggccgcggccgucacgaccaucguggcccccggccagccccagccccugcagccgagcgagaugguggucaccaacaaccugcucgaccugccgccgcccuccccgcccaagcccaagaccaucgugcugccgcccaacuggaagacggcccgcgaccccgaggggaagaucuacuacuaccacgugaucacccggcagacccagugggacccgcccaccugggagagccccggcgacgacgccagccucgagcacgaggcggagauggaccuggggacgcccaccuacgacgagaaccccaugaaggccuccaagaagcccaagaccgccgaggccgacaccagcuccgagcuggccaagaaguccaaggaggucuuccgcaaggagaugucccaguucaucgugcagugccucaaccccuaccggaagcccgacugcaaggugggccgcaucacgaccaccgaggacuucaagcaccuggcgcggaagcugacccacggcgucaugaacaaggagcucaaguacugcaagaaccccgaggaccuggagugcaacgagaacgugaagcacaagacgaaggaguacaucaagaaguacaugcagaaguucggggccguguacaagccgaaggaggacaccgagcuggaguga

SEQ ID NO: 36265 - RNA, 1950 nt, Artificial Sequence
  derived and/or modified sequence opt1 from SETD3__Homo_sapiens__XP_011535533
auggagugccgcggccccaccagcucccggugcgugcugcgccggcaccaggccaccgggggcgccgagcgcgucgggugccucagcacgaacggcaagaaggcggagcuguccaaggaggagcgggccgccgcccugcucccggcccgccccgcggugcggaagauggggaagaagucccgcgugaagacccagaaguccggcaccggcgccaccgccacggucagccccaaggagauccugaaccugaccagcgagcuccugcagaagugcagcucccccgccccggggcccggcaaggagugggaggaguacgugcagauccggacccugguggagaagauccgcaagaagcagaaggggcucagcgucaccuucgacggcaagcgggaggacuacuuccccgaccugaugaagugggcguccgagaacggggccagcguggagggcuucgagauggugaacuucaaggaggagggcuucgggcugcgcgccacgcgggacaucaaggccgaggagcuguuccugugggucccccgcaagcugcucaugaccguggaguccgccaagaacagcgugcugggcccgcuguacucccaggaccggauccuccaggcgauggggaacaucgcccuggccuuccaccuccucugcgagcgcgccagccccaacuccuucuggcagcccuacauccagacccugcccagcgaguacgacaccccgcuguacuucgaggaggacgagguccgguaccuccaguccacgcaggccauccacgacguguucagccaguacaagaacaccgcgcgccaguacgccuacuucuacaaggugauccagacccacccccacgccaacaagcugccccugaaggacagcuucaccuacgaggacuaccggugggccgucuccagcgugaugacgcgccagaaccagauccccaccgaggacggcucccgggugacccucgcccugaucccgcugugggacaugugcaaccacaccaacggccucaucacgaccggguacaaccuggaggacgaccgcugcgagugcgucgcgcugcaggacuuccgcgccggcgagcagaucuacaucuucuacgggacccggagcaacgccgaguucgugauccacuccggcuucuucuucgacaacaacagccacgaccgcgugaagaucaagcucggggucuccaagagcgaccggcuguacgccaugaaggccgaggugcuggcgcgcgccggcauccccaccuccagcguguucgcccuccacuucacggagccgcccaucuccgcccagcugcuggcguuccuccgggucuucugcaugaccgaggaggagcugaaggagcaccuccugggcgacagcgccaucgaccgcaucuucacccuggggaacuccgaguuccccgugagcugggacaacgaggucaagcuguggaccuuccucgaggaccgggccucccugcugcucaagacguacaagaccaccaucgaggaggacaagagcgugcugaagaaccacgaccuguccgugcgcgccaagauggccaucaagcugcggcucggcgagaaggagauccuggagaaggcggucaagagcgccgccgugaaccgcgaguacuaccggcagcagauggaggagaaggcgccccugcccaaguacgaggaguccaaccucgggcugcuggagagcagcgugggcgacucccgccucccccugguccugcggaaccucgaggaggaggccggggugcaggacgcccugaacauccgcgaggccaucagcaaggccaaggccaccgagaacggccuggugaacggcgagaacuccaucccgaacgggacgcggagcgagaacgagucccucaaccaggagagcaagcgcgccgucgaggacgcgaagggcuccagcuccgacagcaccgccggggugaaggaguga

SEQ ID NO: 36266 - RNA, 4329 nt, Artificial Sequence
  derived and/or modified sequence opt1 from SETD5__Homo_sapiens__NP_001073986
augagcaucgccaucccccugggcgugaccaccuccgacacgagcuacuccgacauggccgcggggagcgacccggaguccgucgaggccagccccgccgugaacgagaaguccguguacagcacccacaacuacggcaccacccagcgccacgggugccggggccuccccuacgccacgaucaucccccgcuccgaccugaacgggcugccgagccccgucgaggagcggugcggcgacucccccaacagcgagggcgagaccgugcccaccuggugcccgugcgggcucucccaggacggcuuccugcugaacugcgacaagugccgcgggaugagccggggcaaggugauccgccuccaccggcgcaagcaggacaacaucuccgggggcgacagcuccgccaccgagagcugggacgaggagcugucccccagcacgguccuguacaccgcgacccagcacacccccacgagcaucacccucaccgugcggcgcaccaagcccaagaagcggaagaaguccccggagaagggccgcgccgcccccaagacgaagaagaucaagaacagccccuccgaggcccagaaccuggacgagaacaccaccgaggggugggagaaccggauccgccuguggaccgaccaguacgaggaggcguucacgaaccaguacagcgccgacgugcagaacgcccucgagcagcaccugcacuccagcaaggaguucgucggcaagcccaccauccuggacaccaucaacaagaccgagcucgccugcaacaacacggugaucgggucccagaugcagcugcagcugggccgggugacccgcguccagaagcaccggaagauccuccgcgccgcgcgggaccuggcccuggacacccucaucaucgaguaccgcggcaaggugaugcugcggcagcaguucgaggugaacgggcacuucuucaagaagccguaccccuucguccuguucuacagcaaguucaacggcguggagaugugcguggacgcccgcaccuucgggaacgacgcccgcuucauccggcgcuccugcacgcccaacgccgagguccggcacaugaucgcggacggcaugauccaccucugcaucuacgccgugagcgccaucaccaaggacgccgaggugaccaucgccuucgacuacgaguacuccaacugcaacuacaaggucgacugcgcgugccacaaggggaaccgcaacugccccauccagaagcggaacccgaacgccaccgagcugccccugcucccccccccgcccagccugcccacgaucggcgccgagacccgccggcgcaaggcccggcgcaaggagcuggagauggagcagcagaacgaggccuccgaggagaacaacgaccagcagagccaggaggugcccgagaaggugaccgucuccagcgaccacgaggagguggacaacccggaggagaagcccgaggaggagaaggaggaggucaucgacgaccaggagaaccucgcgcacucccggcgcacccgggaggaccgcaagguggaggccaucaugcacgccuucgagaaccuggagaagcggaagaagcgccgggaccagccccuggagcagagcaacuccgacguggagaucacgaccaccaccagcgagaccccggucggcgaggagacgaagaccgaggcccccgagagcgagguguccaacagcguguccaacgucaccauccccagcaccccccaguccgugggggugaacacgcgccggagcucccaggcgggcgacaucgccgccgagaagcucgucccgaagcccccccccgccaagccgagccgcccccgccccaagucccggaucagccgcuaccggaccuccagcgcccagcgccugaagcggcagaagcaggcgaacgcccagcaggccgagcugucccaggccgcccucgaggaggggggcagcaacucccuggugacccccaccgaggcggggagccuggacuccagcggcgagaaccgcccgcucacgggcagcgaccccaccguggucuccaucaccgggagccacgugaaccgggccgccuccaaguaccccaagaccaagaaguaccuggugacggaguggcugaacgacaaggccgagaagcaggagugccccgucgagugcccgcuccgcaucaccaccgaccccaccgugcuggccacgacccugaacaugcuccccggccugauccacagcccccugaucugcaccaccccgaagcacuacauccgguucgggucccccuucauccccgagcgccggcgccggccccuccugccggacggcacguucagcuccugcaagaagcgcuggaucaagcaggcgcuggaggaggggaugacccagaccagcuccgugccccaggagacccggacgcagcaccuguaccagagcaacgagaacuccagcuccagcuccaucugcaaggacaacgccgaccuccugagcccccugaagaaguggaagucccgcuaccucauggagcagaacgucaccaagcugcugcggccgcucagccccgugaccccccccccgcccaacuccggcagcaagagcccccagcuggccacccccggcuccagccacccgggggaggaggagugccgcaacggcuacucccugauguucagccccgugacgucccucaccaccgccagccggugcaacaccccccugcaguucgagcugugccaccgcaaggaccucgaccuggcgaaggucggguaccuggacuccaacacgaacagcugcgccgaccggcccucccuccugaacagcggccacuccgaccuggccccgcaccccagccucggccccaccuccgagaccggguuccccagccgcuccggcgacgggcaccagacccuggugcgcaacagcgaccaggccuuccggacggaguucaaccugauguacgccuacuccccgcucaacgcgaugccccgcgccgacggccuguaccgggggagcccccuggugggcgaccgcaagccccuccaccuggacggcggguacugcuccccggccgagggcuucagcagccgguacgagcacgggcugaugaaggaccucucccgcggcagccugucccccgggggcgagcgggccugcgagggcguccccagcgccccccagaacccgccccagcgcaagaaggugucccugcucgaguaccggaagcgcaagcaggaggcgaaggagaacagcgccgggggcgggggcgacuccgcccagagcaaguccaagagcgccggggccggccagggcuccagcaacuccgugagcgacaccggggcgcacggcguccagggguccagcgcccggacccccuccagcccccacaagaaguucuccccgagccacagcuccaugagccaccuggaggccgugucccccagcgacucccgcggcaccagcuccagccacugccggccccaggagaacaucuccagccgcuggauggugccgaccuccgucgagcggcugcgcgaggggggcagcauccccaaggugcuccgguccagcgugcgcgucgcccagaagggcgagcccucccccacgugggagagcaacaucaccgagaaggacuccgacccggcggacggggagggccccgagacccugagcuccgcccugagcaagggggccaccguguacagccccucccgguacagcuaccagcuccugcagugcgacuccccccgcacggagagccagucccugcuccagcagagcuccagcccguuccgcggccaccccacccagucccccggcuacagcuaccggaccaccgcccugcgccccgggaacccgcccucccacggcagcuccgagagcucccugagcuccacgagcuacuccagccccgcccaccccgugagcaccgacucccucgcgccguucaccgggacccccggcuacuucagcucccagccccacagcgggaacuccacgggcagcaaccugccccggcgcuccugcccgagcuccgccgccagccccacccugcagggccccuccgacagccccaccuccgacagcgucucccagagcuccaccgggacgcucagcagcaccuccuucccgcagaacagccgguccagccugcccuccgaccugcgcaccaucagccuccccuccgccggccagagcgccguguaccaggcgucccgggugagcgccgucuccaacagccagcacuacccccaccgcggguccggcggggugcaccaguaccggcugcagccgcugcagggcagcggcgugaagacccagacggggcucuccuga

SEQ ID NO: 36267 - RNA, 1101 nt, Artificial Sequence
  derived and/or modified sequence opt1 from SETD7__Homo_sapiens__NP_085151
auggacagcgacgacgagaugguggaggaggccgucgagggccaccuggacgacgacgggcucccccacggcuucugcaccgugaccuacuccagcacggaccgcuucgaggggaacuucgugcacggcgagaagaacgggcggggcaaguucuucuucuucgacggcuccacccuggagggguacuacgucgacgacgcccugcagggccaggggguguacaccuacgaggacggcggggugcuccagggcaccuacgucgacggcgagcugaacgggccggcgcaggaguacgacacggacggccgccugaucuucaaggggcaguacaaggacaacauccggcacggcgugugcuggaucuacuaccccgacggcgggagccucgugggcgaggucaacgaggacggggagaugaccggcgagaagaucgccuacguguaccccgacgagcgcaccgcccuguacgggaaguucaucgacggcgagaugaucgagggcaagcuggccacccucauguccacggaggaggggcggccccacuucgagcugaugccgggcaacagcguguaccacuucgacaaguccaccagcuccugcaucagcaccaacgcccugcuccccgaccccuacgaguccgagcgcgucuacguggcggagagccugaucuccagcgccggggagggccuguucuccaagguggccgucgggcccaacaccgugaugagcuucuacaacggcgugcggaucacgcaccaggaggucgacucccgcgacugggcccucaacggcaacacccugagccuggacgaggagaccgugaucgacgugccggagcccuacaaccacgucuccaaguacugcgcgagccucgggcacaaggccaaccacagcuucacccccaacugcaucuacgacauguucgugcacccccgguucggcccgaucaagugcauccgcacgcugcgggccguggaggccgacgaggagcugaccgucgccuacggguacgaccacuccccgcccggcaagagcgggcccgaggcgcccgagugguaccagguggagcucaaggccuuccaggccacccagcagaaguga

SEQ ID NO: 36268 - RNA, 1059 nt, Artificial Sequence
  derived and/or modified sequence opt1 from SETD8__Homo_sapiens__NP_065115
auggcccgcggccggaagaugagcaagccccgcgccguggaggcggccgccgccgccgcggccgucgccgccaccgcgccggggcccgagaugguggagcggcgcggccccgggcggccccgcaccgacggcgagaacguguucacggggcaguccaagaucuacagcuacauguccccgaacaagugcagcggcaugcgguucccccugcaggaggagaacuccgucacccaccacgaggugaagugccagggcaagccccucgccgggaucuaccgcaagcgggaggagaagcgcaacgccggcaacgccgugcggagcgccaugaaguccgaggagcagaagaucaaggacgcgcgcaaggggccccuggucccguuccccaaccagaaguccgaggccgccgagccgcccaagaccccgcccagcagcugcgacuccaccaacgccgccaucgcgaagcaggcccugaagaagcccaucaagggcaagcaggcgccccggaagaaggcccaggggaagacgcagcagaaccgcaagcucaccgacuucuaccccgugcggcgcagcucccgcaagagcaaggccgagcugcaguccgaggagcggaagcggaucgacgagcugaucgagagcggcaaggaggagggcaugaagaucgaccucaucgacgggaagggccgcggggugaucgccaccaagcaguucucccggggcgacuucgucguggaguaccacggcgaccugaucgagaucaccgacgccaagaagcgcgaggcccuguacgcccaggaccccagcacggggugcuacauguacuacuuccaguaccucuccaagaccuacugcguggacgccacccgcgagaccaaccggcugggccgccugaucaaccacagcaagugcgggaacugccagacgaagcuccacgacaucgacggcgucccccaccugauccugaucgcgagccgggacaucgccgccggggaggagcuccuguacgacuacggcgaccgcuccaaggccagcaucgaggcgcaccccuggcugaagcacuga

SEQ ID NO: 36269 - RNA, 2124 nt, Artificial Sequence
  derived and/or modified sequence opt1 from SETDB2__Homo_sapiens__NP_001153780
augggcgagaagaacggggacgccaagaccuucuggauggagcuggaggacgacggcaagguggacuucaucuucgagcagguccagaacgugcuccagagccugaagcagaagaucaaggacggguccgccaccaacaaggaguacauccaggcgaugauccuggugaacgaggccacgaucaucaacagcuccaccagcaucaaggaccccaugccggucacccagaaggagcaggagaacaaguccaacgccuuccccagcaccuccugcgagaacagcuuccccgaggacugcacguuccucaccaccgagaacaaggagauccugucccuggaggacaaggugguggacuuccgcgagaaggacagcuccagcaaccucuccuaccagagccacgacugcuccggcgccugccugaugaagaugccccugaaccucaagggggagaacccgcugcagcugcccaucaagugccacuuccagcggcgccacgccaagaccaacagccacuccagcgcgcuccacgucuccuacaagacgcccugcggccggagccugcgcaacguggaggagguguuccgguaccugcucgagaccgagugcaacuuccuguucaccgacaacuucagcuucaacaccuacguccagcuggcccgcaacuaccccaagcagaaggaggugguguccgacgucgacaucagcaacggcguggaguccgugccgaucagcuucugcaacgagaucgacucccggaagcucccccaguucaaguaccgcaagacggucuggccccgggccuacaaccugaccaacuucagcuccauguucaccgacagcugcgacugcuccgaggggugcaucgacaucaccaagugcgccugccugcagcucacggcgcgcaacgccaagaccagcccccuguccagcgacaagaucaccaccggcuacaaguacaagcggcugcagcgccagaucccgacggggaucuacgagugcucccuccugugcaagugcaaccggcagcugugccagaaccgcguggugcagcacggcccccagguccggcuccagguguucaagaccgagcagaagggguggggcgugcgcugccuggacgacaucgaccggggcaccuucgucugcaucuacagcgggcgccugcucucccgggccaacaccgagaaguccuacggcaucgacgagaacgggcgcgacgagaacacgaugaagaacaucuucagcaagaagcggaagcuggagguggccugcagcgacugcgagguggagguccugccccucggccuggagacccacccccgcaccgccaagaccgagaagugcccgcccaaguucuccaacaaccccaaggagcugacgguggagaccaaguacgacaacaucagccgcauccaguaccacagcgucauccgggaccccgaguccaagaccgcgaucuuccagcacaacggcaagaagauggaguucgugagcuccgagagcgugaccccggaggacaacgacggguucaagccgccccgcgagcaccucaacuccaagacgaagggcgcccagaaggacagcuccagcaaccacgucgacgaguucgaggacaaccugcugaucgaguccgacgugaucgacaucaccaaguaccgggaggagaccccgccccgcagccggugcaaccaggccaccacgcucgacaaccagaacaucaagaaggccaucgaggugcagauccagaagccccaggaggggcgcuccaccgccugccagcggcagcaggucuucugcgacgaggagcugcugagcgagaccaagaacaccuccagcgacucccucaccaaguucaacaagggcaacguguuccugcuggacgcgacgaaggaggggaacgugggccgcuuccucaaccacagcugcugccccaaccugcugguccagaacguguucguggagacccacaaccggaacuucccccucgucgccuucuucaccaaccgcuacgugaaggcccggaccgagcugacgugggacuacggcuacgaggccgggaccgugcccgagaaggagaucuucugccagugcggcgucaacaagugccgcaagaagauccuguga

SEQ ID NO: 36270 - RNA, 807 nt, Artificial Sequence
  derived and/or modified sequence opt1 from SET__Homo_sapiens__NP_001234929
augggcugccgcgaccugcuccccagccugaagccgacccugcucgagaaggagcagcaggaggccaucgagcacaucgacgaggugcagaacgagaucgaccggcugaacgagcaggccuccgaggagauccugaaggucgagcagaaguacaacaagcuccgccagcccuucuuccagaagcggagcgagcugaucgcgaagauccccaacuucugggugaccacguucgugaaccacccccaggucuccgcccugcucggggaggaggacgaggaggcccugcacuaccugacccgcguggaggugaccgaguucgaggacaucaagagcggcuaccggaucgacuucuacuucgacgagaacccguacuucgagaacaagguccucuccaaggaguuccaccugaacgagagcggggaccccuccagcaaguccaccgagaucaaguggaaguccggcaaggaccugacgaagcgcagcagccagacccagaacaaggccucccggaagcgccagcacgaggagcccgagagcuucuucaccugguucaccgaccacuccgacgccggggcggacgagcucggcgaggugaucaaggacgacaucuggcccaacccgcugcaguacuaccuggugcccgacauggacgacgaggagggcgagggggaggaggacgacgacgacgacgaggaggaggagggccucgaggacaucgacgaggagggggacgaggacgagggcgaggaggacgaggacgacgacgagggggaggagggcgaggaggacgagggcgaggacgacuga

SEQ ID NO: 36271 - RNA, 1098 nt, Artificial Sequence
  derived and/or modified sequence opt1 from SETMAR__Homo_sapiens__NP_001263254
auguucgccgaggccgcgaagaccacccgccccugcggcauggccgaguucaaggagaagcccgaggcccccacggagcagcuggacguggccugcgggcaggagaaccuccccgucggcgccuggcccccgggggcggcccccgcccccuuccaguacacccccgaccacguggugggcccgggggccgacaucgaccccacccagaucaccuuccccggcugcaucugcgucaagacgcccugccugccggggaccugcagcugccugcggcacggcgagaacuacgacgacaacuccugccuccgcgacaucggcagcgggggcaaguacgcggagcccguguucgagugcaacgugcugugccggugcuccgaccacugccgcaaccgggucgugcagaaggggcugcaguuccacuuccagguguucaagacccacaagaagggcuggggccuccgcacccuggaguucauccccaaggggcgguucgucugcgaguacgccggcgaggugcugggguucagcgaggugcagcgccggauccaccuccagacgaaguccgacagcaacuacaucaucgccauccgcgagcacgucuacaacggccaggugauggagaccuucguggaccccaccuacaucggcaacaucgggcgguuccugaaccacuccugcgagccgaaccugcucaugauccccguccgcaucgacagcauggugcccaagcuggcccuguucgccgcgaaggacaucgugcccgaggaggagcucuccuacgacuacagcggccgguaccugaaccugaccgucuccgaggacaaggagcgccucgaccacgggaagcugcggaagccgugcuacugcggcgccaagagcugcacggccuuccugcccuucgacuccagccucuacugccccguggagaaguccaacaucagcugcgggaacgagaaggagcccuccaugugcggcagcgccccguccguguuccccagcugcaagcgccugacccuggaggucagccucuucuccgacaagcagcuggccccgcccuacagcggccggcaguggcuggcguccuucaccagcgccuga

SEQ ID NO: 36272 - RNA, 8034 nt, Artificial Sequence
  derived and/or modified sequence opt1 from SETX__Homo_sapiens__NP_055861
augagcacgugcugcuggugcacccccggcggggccagcaccaucgacuuccugaagcgguacgccagcaacacccccagcggcgaguuccagaccgcggacgaggaccucugcuacugccuggagugcguggccgaguaccacaaggcccgggacgagcugcccuuccuccacgagguccugugggagcuggagacccuccgccugaucaaccacuucgagaaguccaugaaggccgagaucggggacgacgacgagcuguacaucguggacaacaacggcgagaugccccucuucgacaucacggggcaggacuucgagaacaagcugcgggugccccugcucgagauccugaaguacccguaccugcuccugcacgagcgcgucaacgagcugugcguggaggcccucugccggauggagcaggccaacugcagcuuccagguguucgacaagcaccccggcaucuaccuguuccugguccaccccaacgagauggugcgccggugggccauccucaccgcccgcaaccugggcaagguggaccgggacgacuacuacgaccugcaggagguccuccugugccuguucaaggugaucgagcucgggcugcuggagagccccgacaucuacaccuccagcgugcucgagaagggcaagcugauccugcucccgucccacauguacgacaccacgaacuacaagagcuacuggcuggggaucugcaugcugcucaccauccuggaggagcaggccauggacucccugcuccugggcagcgacaagcagaacgacuucaugcaguccauccugcacaccauggagcgcgaggcggacgacgacagcgucgaccccuucuggcccgcccuccacugcuucauggugauccuggaccggcugggguccaagguguggggccagcucauggaccccaucgucgccuuccagaccaucaucaacaacgccagcuacaaccgcgagauccggcacauccgcaacuccagcgugcggacgaagcuggagccggaguccuaccuggacgacauggugaccugcagccagaucgucuacaacuacaaccccgagaagaccaagaaggacagcggcuggcgcaccgccaucugccccgacuacugccccaacauguacgaggagauggagacgcucgcguccgugcugcagagcgacaucgggcaggacaugcgggugcacaacuccaccuuccugugguucaucccguucguccagagccugauggaccucaaggaccugggcguggccuacaucgcccagguggucaaccaccuguacuccgaggugaaggagguccucaaccagaccgacgccgugugcgacaaggugaccgaguucuuccugcugauccucgucagcgugaucgagcugcaccgcaacaagaagugccugcaccuccuguggguguccagccagcagugggucgaggccguggugaagugcgcgaagcugcccacgaccgccuucacccgguccagcgagaaguccagcgggaacugcuccaagggcaccgccaugaucagcucccucagccugcacuccaugcccagcaacuccguccagcuggccuacgugcagcucauccgcagccugcugaaggagggcuaccagcucgggcagcagagccugugcaagcgguucugggacaagcugaaccucuuccugcgcggcaaccugucccucggguggcagcugacgagccaggagacccacgagcugcaguccugccucaagcagaucauccgcaacaucaaguucaaggcgccgcccugcaacaccuucguggaccugaccagcgcgugcaagaucucccccgccagcuacaacaaggaggaguccgagcagaugggcaagacgagccggaaggacaugcacugccuggaggccuccagccccaccuucuccaaggagcccaugaagguccaggacagcgugcucaucaaggccgacaacaccaucgagggggacaacaacgagcagaacuacaucaaggacgugaagcuggaggaccaccuccucgccggcuccugccugaagcagagcuccaagaacaucuucaccgagcgcgcggaggaccagaucaagaucagcacgcggaagcagaaguccgucaaggagaucagcagcuacacccccaaggacugcaccucccgcaacggccccgagcgggggugcgaccgcggcaucaucgugagcacccggcugcucacggacuccagcaccgacgcccuggagaagguguccaccagcaacgaggacuucucccugaaggacgacgcccucgccaagaccagcaagcgcaagaccaagguccagaaggacgagaucugcgcgaagcugucccacgugaucaagaagcagcaccggaaguccacgcugguggacaacaccaucaaccucgacgagaaccugaccgucuccaacaucgagagcuucuacucccgcaaggacaccggggugcagaagggcgacggguucauccacaaccugagccucgaccccuccggcgugcuggacgacaagaacggcgagcagaagucccagaacaacguccugcccaaggagaagcagcucaagaacgaggagcuggugaucuucuccuuccacgagaacaacugcaagauccaggaguuccacguggacgggaaggagcugaucccguucacggagaugaccaacgccagcgagaagaaguccagccccuucaaggaccucaugaccguccccgagagccgggacgaggagauguccaacagcaccuccgugaucuacagcaaccugacgcgcgagcaggccccggacaucucccccaagagcgacacccugaccgacucccagaucgaccgggaccuccacaagcugagccugcucgcccaggccuccgugaucaccuuccccagcgacagcccccagaacagcucccagcugcagcgcaaggucaaggaggacaagcggugcuucacggcgaaccagaacaacgugggcgacaccagccgcggccaggugaucaucaucuccgacagcgacgacgacgacgacgagcggauccugucccucgagaagcugaccaagcaggacaagaucugccuggagcgcgagcacccggagcagcacgucagcaccgugaacuccaaggaggagaagaaccccgugaaggaggagaagacggagacccucuuccaguucgaggagagcgacagccagugcuucgaguucgaguccagcuccgaggucuucagcguguggcaggaccaccccgacgacaacaacuccgugcaggacggcgagaagaagugccuggcccccaucgccaacaccaccaacgggcagggcugcacggacuacgucagcgagguggugaagaagggcgccgaggggaucgaggagcacacccggccgcgcuccaucagcgucgaggaguucugcgagaucgaggugaagaagcccaagcgcaagcgguccgagaagcccauggccgaggaccccgugcgcccgagcuccagcguccggaacgagggccaguccgacaccaacaagcgcgaccugguggggaacgacuucaagagcaucgaccggcgcaccuccacgcccaacagccggauccagcgcgcgaccaccgugucccagaagaaguccuccaagcucugcacgugcacggagcccauccggaagguccccgugagcaagaccccgaagaagacccacagcgacgccaagaagggccagaaccgcuccagcaacuaccuguccugccggaccacgcccgccaucgugccgcccaagaaguuccgccagugcccggagcccaccagcaccgccgagaagcugggccucaagaaggggccccggaaggccuacgagcugucccagcgcagccuggacuacgucgcgcagcuccgggaccacggcaagaccgugggggucguggacacgcgcaagaagaccaagcugaucagcccccagaaccugagcgugcggaacaacaagaagcuccugaccucccaggagcugcagaugcagcgccagauccggcccaagagccagaagaaccgccggcgccucuccgacugcgagagcaccgacgucaagcgcgccggcucccacaccgcccagaacagcgacaucuucgugcccgaguccgaccggagcgacuacaacugcaccggcgggaccgaggugcuggccaacuccaaccgcaagcagcugaucaagugcaugcccagcgagccggagaccaucaaggcgaagcacgggucccccgccaccgacgacgccugcccccucaaccagugcgacagcgucgugcugaacgggacggugcccaccaacgaggucaucgugagcaccuccgaggacccgcugggcgggggcgaccccaccgcccggcacaucgagauggccgcgcucaaggagggggagcccgacagcuccagcgacgccgaggaggacaaccuguuccugacgcagaacgaccccgaggacauggaccucugcucccagauggagaacgacaacuacaagcugaucgagcugauccacggcaaggacaccguggaggucgaggaggacagcgugucccgcccgcagcucgagagccuguccggcaccaagugcaaguacaaggacugccuggagaccacgaagaaccagggggaguacugccccaagcacagcgaggugaaggccgccgacgaggacgucuuccggaagcccggccugcccccgcccgccuccaagccccugcgccccaccaccaagaucuucagcuccaagagcaccucccggaucgcggggcugagcaagucccuggagacgagcuccgcccucagccccagccugaagaacaaguccaagggcauccagagcauccugaaggugccccagcccgugccccucaucgcccagaagccggucggggagaugaagaacuccugcaacgugcugcacccccagagccccaacaacuccaaccgccagggcugcaaggugcccuucggcgagagcaaguacuucccguccagcucccccgucaacauccugcucagcucccagagcguguccgacaccuucgugaaggagguccugaaguggaaguacgagauguuccugaacuucgggcagugcgggccgcccgccagccucugccaguccaucagccggccggugcccgugcgcuuccacaacuacggggacuacuucaacgucuucuucccccugauggugcugaacaccuucgagaccguggcccaggaguggcucaacuccccgaaccgggagaacuucuaccagcugcagguccgcaaguuccccgcggacuacaucaaguacugggaguucgccguguaccuggaggagugcgagcucgccaagcagcuguaccccaaggagaacgaccugguguuccucgcccccgagcggaucaacgaggagaagaaggacacggagcgcaacgacauccaggaccugcacgaguaccacagcggcuacguccacaaguuccggcgcaccagcgugaugcggaacgggaagaccgagugcuaccuguccauccagacccaggagaacuucccggcgaaccucaacgagcuggugaacugcaucgucaucagcucccuggugacgacccagcgcaagcucaaggccaugagccugcugggcucccggaaccagcucgcccgcgccgugcugaaccccaaccccauggacuucugcaccaaggaccugcucaccacgaccagcgagcgcaucaucgccuaccugcgggacuucaacgaggaccagaagaaggcgaucgagaccgccuacgccauggucaagcacucccccagcguggccaagaucugccugauccacggcccgcccgggaccggcaaguccaagacgaucguggggcuccuguaccgccugcucaccgagaaccagcggaagggccacagcgacgagaacuccaacgccaagaucaagcagaaccgcguccuggugugcgcgcccagcaacgccgccguggacgagcugaugaagaagaucauccucgaguucaaggagaagugcaaggacaagaagaacccccugggcaacugcggggacaucaaccugguccggcucggcccggagaaguccaucaacagcgaggugcugaaguucucccuggacagccaggugaaccaccgcaugaagaaggagcuccccucccacguccaggccaugcacaagcggaaggaguuccuggacuaccagcuggacgagcucagccgccagcgggcccugugccgcgggggccgggagauccagcgccaggagcuggacgagaacaucuccaaggugagcaaggagcggcaggagcucgcgagcaagaucaaggaggugcaggggcgcccccagaagacccaguccaucaucauccuggagagccacaucaucugcugcacccuguccacgagcggcggccuccugcuggaguccgccuuccgggggcagggcgggguccccuucagcugcgugaucgucgacgaggccggccaguccugcgagaucgagacccucaccccgcugauccaccgcugcaacaagcugauccucgugggggaccccaagcagcugccgcccaccgugaucagcaugaaggcccaggaguacggcuacgaccaguccaugauggcccgguucugccgccugcucgaggagaacgucgagcacaacaugaucagccggcugccgauccugcagcucaccgugcaguaccgcaugcaccccgacaucugccuguuccccuccaacuacguguacaaccggaaccugaagacgaaccgccagaccgaggcgauccgcugcagcuccgacuggcccuuccagccguaccucgucuucgacgugggcgacgggagcgagcggcgcgacaacgacuccuacaucaacgugcaggagaucaagcuggucauggagaucaucaagcugaucaaggacaagcggaaggacgugagcuuccgcaacaucggcaucaucacccacuacaaggcccagaagaccaugauccagaaggaccucgacaaggaguucgaccggaaggggcccgccgagguggacacggucgacgccuuccagggccgccagaaggacugcgugaucgugaccugcguccgggcgaacuccauccaggggagcaucggcuuccuggccucccugcagcgccucaacgugaccaucacccgggccaaguacagccuguucauccugggccaccuccgcacgcugauggagaaccagcacuggaaccagcugauccaggacgcccagaagcgcggggccaucaucaagaccugcgacaagaacuaccgccacgacgcggugaagauccucaagcugaagcccguccugcagcggagccucacccacccgcccaccaucgcccccgagggcucccgcccccagggcggccugccgagcuccaagcuggacagcggcuucgccaagacguccguggccgccagccucuaccacacccccuccgacagcaaggagaucacccugaccgugacguccaaggaccccgagcggcccccgguccacgaccagcugcaggacccccgccuccugaagcggauggggaucgaggugaagggcgggaucuuccugugggacccccagcccagcuccccgcagcaccccggcgcgaccccgcccaccggggagcccggcuuccccgugguccaccaggaccucagccacauccagcagcccgccgccgugguggccgcccuguccagccacaagcccccgguccgcggcgagccgcccgcggccucccccgaggccuccacgugccaguccaagugcgacgacccggaggaggagcugugccaccggcgcgaggcccgcgcguucagcgagggggagcaggagaagugcggcuccgagacccaccacacccggcgcaacagccggugggacaagcgcacccucgagcaggaggacagcuccagcaagaagcggaagcugcuguga

SEQ ID NO: 36273 - RNA, 2982 nt, Artificial Sequence
  derived and/or modified sequence opt1 from SEZ6__Homo_sapiens__NP_001092105
augcgccccguggcccugcuccugcugccgagccuccuggcccugcucgcgcacggccugucccuggaggcccccaccgucgggaagggccaggcccccgggaucgaggagaccgacggcgagcucacggccgcccccaccccggagcagcccgagcgcggggugcacuucgugaccaccgcgcccacgcugaagcugcucaaccaccacccccugcuggaggaguuccuccaggagggccuggagaagggcgacgaggagcugcggccggcccuccccuuccagcccgacccgcccgcccccuucacccccagcccccugccgcggcuggccaaccaggacucccgccccgucuucaccagccccacccccgcgauggccgccgugccgacgcagccccaguccaaggaggggcccuggagccccgaguccgagagcccgaugcuccggaucaccgcgccccugccgcccggccccuccauggccgugcccacccuggggcccggcgagaucgccagcaccacgccgcccucccgcgccuggacccccacccaggaggggcccggcgacaugggccggccgugggucgccgagguggugagccagggggccggcaucgggauccagggcaccaucacguccagcaccgccuccggcgacgacgaggagaccaccacgaccaccaccaucaucacgaccaccaucaccacgguccagacccccgggcccugcagcuggaacuucuccggccccgaggggagccucgacuccccgaccgaccugagcagccccaccgacgugggccuggacugcuucuucuacaucuccguguaccccggguacggcgucgagaucaaggugcagaacaucagccuccgcgagggcgagacggugaccgucgaggggcugggcgggcccgacccgcugccccucgcgaaccaguccuuccugcugcggggccaggugauccgcagccccacccaccaggccgcccuccgguuccagucccugcccccgcccgccgggcccggcaccuuccacuuccacuaccaggccuaccugcucagcugccacuucccccgccggccggcguacggcgacgugacggucaccucccugcaccccgggggcagcgcccgcuuccacugcgccaccggguaccagcugaagggcgcccggcaccugaccugccucaacgccacccagcccuucugggacuccaaggagcccgugugcaucgcggccugcgggggcgugauccgcaacgccacgaccggccggaucgucagcccgggguuccccggcaacuacuccaacaaccugaccugccacuggcuccuggaggcccccgaggggcagcgccugcaccuccacuucgagaaggugagccuggcggaggacgacgaccggcugaucauccgcaacggcgacaacguggaggccccgcccgucuacgacuccuacgagguggaguaccuccccaucgagggccugcugagcuccgggaagcacuucuucgucgagcugagcaccgacuccagcggcgccgccgccgggauggcgcuccgguacgaggccuuccagcagggccacugcuacgagcccuucgugaaguacgggaacuucuccagcagcacgccgaccuaccccgugggcaccaccgucgaguucuccugcgaccccggcuacacgcuggagcaggggagcaucaucaucgagugcguggacccccacgacccgcaguggaacgagaccgagcccgccugccgcgccgugugcuccggcgagaucaccgacagcgccggggucgugcugucccccaacuggcccgagccguacggccgcgggcaggacugcaucuggggcgugcacgucgaggaggacaagcggaucaugcucgacauccgcgugcugcggaucggccccggggacgugcugaccuucuacgacggcgacgaccucacggcgcgcguccuggggcaguacagcggcccccggucccacuucaagcuguucaccagcauggccgacgugaccauccaguuccaguccgaccccgggaccagcgugcucggcuaccagcagggcuucgucauccacuucuucgaggugccgcgcaacgacacgugccccgagcugcccgagauccccaacggguggaaguccccgagccagcccgagcuggugcacggcaccgucgugaccuaccagugcuaccccggguaccagguggucggcuccagcgugcucaugugccagugggaccugaccugguccgaggaccugcccagcugccagcgggugacguccugccacgacccgggggacgucgagcacagccgccggcucaucagcucccccaaguuccccgugggcgccaccgugcaguacaucugcgaccagggcuucguccugauggggagcuccauccugaccugccacgaccgccaggccggcagccccaagugguccgaccgggccccgaagugccuccuggagcagcugaagcccugccacgggcucagcgcgcccgagaacggcgcccgcuccccggagaagcagcugcaccccgccggcgccaccauccacuucagcugcgcgcccggguacgugcugaagggccaggccuccaucaagugcgugcccgggcacccgagccacugguccgacccgccgcccaucugccgggccgccagccucgacggcuucuacaacucccgcagccuggacgucgccaaggcgcccgccgccuccagcacgcuggacgccgcccacaucgcggccgccaucuuccucccccugguggccauggugcugcucgucgggggcguguacuucuacuucucccggcugcagggcaagagcucccugcagcucccccgcccccggccccgccccuacaaccggaucaccaucgagagcgccuucgacaaccccaccuacgagaccggggagacgcgcgaguacgaggugagcaucuga

SEQ ID NO: 36274 - RNA, 2430 nt, Artificial Sequence
  derived and/or modified sequence opt1 from SEZ6L2__Homo_sapiens__NP_001107572
augggcaccccccgcgcccagcacccgccccccccccagcugcucuuccugauccugcucagcugcccguggauccaggggcugccccugaaggaggaggagauccuccccgagcccggcuccgagaccccgacgguggccagcgaggcgcuggccgagcugcuccacggggcccugcugcggcgcggccccgagaugggguaccuccccggcuccgaccgggaccccacccuggccaccccgcccgccggccagacccuggcgguccccagccucccccgcgccacggagccggggaccggcccccugaccaccgccgugacgcccaacggggugcggggcgccgggcccaccgcgccggagcugcucacccccccccccggcaccacggccccgcccccccccuccccggccagccccggccccccgcuggggcccgagggcggggaggaggagaccaccaccacgaucaucaccaccaccacggucaccaccaccgugacgucccccgccuaccugcucagcugcggcuuccccccgcgccccgcccacggcgacguguccgucaccgaccugcaccccgggggcaccgcgaccuuccacugcgacagcggguaccagcugcagggcgaggagacgcucaucugccugaacgggacccggcccuccuggaacggcgagaccccgagcugcauggccuccugcggcgggaccauccacaacgccacgcugggccgcaucgugagccccgagcccgggggcgccguggggcccaaccucaccugccggugggucaucgaggccgcggagggccgccggcugcaccugcacuucgagcgcgugucccucgacgaggacaacgaccggcugauggugcgcagcggcggguccccgcugagccccgucaucuacgacuccgacauggacgacgugcccgagcggggccucaucagcgacgcccagagccuguacguggagcugcucuccgagacccccgccaacccgcugcugcucagccugcgcuucgaggccuucgaggaggaccggugcuucgcccccuuccuggcgcacgggaacgucaccacgaccgaccccgaguaccgccccggcgcccucgccaccuucuccugccugccgggguacgcccuggagccccccggccccccgaacgccaucgagugcguggaccccaccgagccccacuggaacgacaccgagccggcgugcaaggccaugugcggcggggagcucagcgagcccgccggcgugguccugucccccgacuggccccagagcuacuccccggggcaggacugcguguggggcgugcacguccaggaggagaagcggauccugcuccagguggagauccugaacgugcgcgagggcgacaugcugacgcuguucgacggggacggccccagcgcccggguccucgcgcagcugcgcgggccccagccccgccggcgccugcucuccagcggcccggaccugacccugcaguuccaggccccccccgggcccccgaaccccggccucggccagggguucgugcugcacuucaaggaggucccccggaacgacaccugccccgagcugccgccccccgaguggggcuggcgcaccgccucccacggggaccucauccggggcacggugcugaccuaccagugcgagcccggguacgagcugcucggcagcgacauccugaccugccagugggaccuguccuggagcgccgccccgcccgcgugccagaagaucaugaccugcgccgaccccggcgagaucgccaacgggcaccgcacggccuccgacgccggcuuccccguggggagccacguccaguaccggugccucccgggcuacucccuggagggggcggccaugcugaccugcuacagccgcgacaccggcacccccaagugguccgaccgggugcccaagugcgcccucaaguacgagcccugccugaacccgggcgugcccgagaacggguaccagacgcuguacaagcaccacuaccaggccggcgagagccuccgcuucuucugcuacgagggguucgagcugaucggcgaggucaccaucaccugcgugcccgggcacccgagccaguggaccucccagcccccccugugcaagguggccuacgaggagcuccuggacaaccggaagcuggaggucacgcagaccaccgaccccagccgccagcucgagggcggcaaccuggcgcuggccauccuccugccgcuggggcucgugaucgugcugggcuccggggucuacaucuacuacaccaagcugcagggcaagagccucuucggcuucuccgggagccacuccuacagccccaucacgguggaguccgacuucagcaacccccuguacgaggccggcgacacccgggaguacgagguguccaucuga

SEQ ID NO: 36275 - RNA, 3072 nt, Artificial Sequence
  derived and/or modified sequence opt1 from SEZ6L__Homo_sapiens__NP_001171702
augcccgccgcccgcccgcccgcggccggccugcgggggaucagccucuuccuggcccugcuccugggcucccccgccgccgcgcuggagcgcgacgcccuccccgagggggacgccagcccgcugggccccuaccugcuccccuccggggcccccgagcggggcagcccgggcaaggagcaccccgaggagcgcguggucaccgcgccgcccuccagcucccagagcgccgaggugcugggggagcuggugcucgacggcaccgcccccuccgcccaccacgacauccccgcccugagcccccugcuccccgaggaggcgcggccgaagcacgcccugccgcccaagaagaagcugcccucccucaagcaggucaacagcgcccgcaagcagcugcggcccaaggccacguccgccgcgaccgugcagcgcgccgggagccagcccgccucccagggccuggaccuccugagcuccagcaccgagaagcccgggcccccgggcgaccccgaccccaucguggccuccgaggaggccagcgaggucccccuguggcucgaccggaaggagagcgcggugccgaccacgcccgcgccccugcagaucuccccguucaccagccagcccuacguggcccacacccugccccagcgccccgagccgggcgagcccgggcccgacauggcccaggaggcgccccaggaggacaccuccccgauggcccucauggacaagggcgagaacgagcugacggggagcgccuccgaggagagccaggagaccaccaccuccacgaucaucaccaccaccgucaucacgaccgagcaggcccccgcccugugcagcguguccuucagcaaccccgagggcuacaucgacuccagcgacuacccccuccugccgcugaacaacuuccucgagugcaccuacaacgugaccgucuacacgggcuacgggguggagcuccaggugaaguccgucaaccugagcgacggcgagcuccuguccauccgcgggguggacggccccacccugaccgugcucgccaaccagacccugcuggucgagggccaggugauccggagccccacgaacaccaucuccguguacuuccggaccuuccaggacgacgggcucggcaccuuccagcugcacuaccaggccuucaugcugagcugcaacuucccccgccggccggacuccggggacgucacggugauggaccuccacagcggcgggguggcccacuuccacugccaccugggcuacgagcugcagggggccaagaugcugaccugcaucaacgccagcaagccccacugguccagccaggagcccaucugcuccgcgcccugcggcggcgccguccacaacgccaccaucgggcgcgugcugagcccguccuaccccgagaacaccaacggcagccaguucugcaucuggacgaucgaggcccccgaggggcagaagcugcaccuccacuucgagcggcuccugcugcacgacaaggaccgcaugaccguccacuccggccagaccaacaagagcgcccuccuguacgacucccugcagaccgagagcgugcccuucgaggggcuccuguccgagggcaacacgauccggaucgaguucaccagcgaccaggcgcgcgccgccuccaccuucaacauccgguucgaggccuucgagaagggccacugcuacgagccguacauccagaacgggaacuucaccaccagcgaccccacguacaacaucggcaccaucguggaguucacgugcgaccccgggcacucccuggagcagggcccggccaucaucgagugcaucaacguccgcgaccccuacuggaacgacaccgagccccucugccgcgcgaugugcggcggggagcugagcgccguggccggcgugguccugucccccaacuggccggagcccuacguggagggggaggacugcaucuggaagauccacgugggcgaggagaagcggaucuuccucgacauccaguuccugaaccugagcaacagcgacauccucaccaucuacgacggggacgaggucaugccccacauccugggccaguaccugggcaacuccgggccccagaagcucuacagcuccaccccggaccugaccauccaguuccacagcgaccccgccggccugaucuucgggaagggccagggguucaucaugaacuacaucgaggugucccgcaacgacagcugcuccgaccuccccgagauccagaacggcuggaagaccacgagccacaccgagcuggugcggggcgcgcgcaucaccuaccagugcgaccccggguacgacaucgucggcuccgacacccugacgugccagugggaccucagcugguccagcgacccgcccuucugcgagaagaucauguacugcaccgaccccggggagguggaccacuccacccggcugaucagcgaccccgugcugcucgucggcaccacgauccaguacacgugcaacccgggguucgugcuggagggcuccagccugcugaccugcuacucccgcgagaccggcacccccaucuggaccagccggcugccccacugcguguccgaggagagccuggccugcgacaaccccgggcucccggagaacggcuaccagauccuguacaagcgccuguaccuccccggggagagccugaccuucaugugcuacgagggcuucgagcugaugggggaggucaccauccggugcauccucggccagcccucccacuggaacggcccccugccggugugcaaggugaaccaggacagcuucgagcacgcccuggaggccgaggccgcggccgagacgucccucgagggcgggaacauggcccuggccaucuucauccccguccugaucaucagccuccugcucgggggcgccuacaucuacaucacccgcugccgguacuacuccaaccugcgccugccccugauguacagccaccccuacucccagaucaccguggagaccgaguucgacaacccgaucuacgagacgggcgagacccgggaguacgaggugagcaucuga

SEQ ID NO: 36276 - RNA, 2022 nt, Artificial Sequence
  derived and/or modified sequence opt1 from SF1__Homo_sapiens__NP_001171501
auggccaccggcgccaacgcgaccccccuggggaagcucggcccgcccgggcugcccccccugccgggccccaaggggggcuucgagcccggccccccgcccgcccccgggcccggcgccgggcuccuggccccgggccccccccccccgccccccguggggagcaugggcgcccugacggcggccuuccccuucgccgcccucccgcccccccccccgcccccccccccgccccccccgcagcagcccccccccccgcccccccccccgucccccggcgcgagcuacccccccccgcagcccccccccccgcccccccuguaccagcgcgucucccccccgcagcccccccccccgcagcccccccggaaggaccagcagccggggcccgccggcgggggcggcgacuuccccagcaagaagcgcaagcggucccgcuggaaccaggacaccauggagcagaagaccgugauccccgggaugccgaccgugaucccccccggccugacgcgggagcaggagcgcgccuacaucguccagcuccagaucgaggaccugacccggaagcugcgcaccggggaccucggcauccccccgaaccccgaggaccggagccccucccccgagccgaucuacaacagcgaggggaagcgccugaacacccgggaguuccgcacgcggaagaagcuggaggaggagcgccacaaccucaucaccgagaugguggcccugaaccccgacuucaagccccccgccgacuacaagccgcccgcgacccggguguccgacaaggucaugaucccccaggacgaguaccccgagaucaacuucgugggccugcucaucggcccgcgcgggaacacccugaagaacaucgagaaggagugcaacgccaagaucaugauccggggcaaggggagcgugaaggagggcaaggucgggcgcaaggacggccagaugcugcccggcgaggacgagccccuccacgcccuggugacggccaacaccauggagaacgugaagaaggccgucgagcagauccggaacauccugaagcaggggaucgagacccccgaggaccagaacgaccuccgcaagaugcagcugcgggagcuggcgcgccucaacggcacccugcgcgaggacgacaaccggauccugcgcccguggcaguccagcgagacgcgguccaucaccaacaccaccgugugcacgaagugcgggggcgccgggcacaucgccagcgacugcaaguuccagcgccccggcgacccccaguccgcccaggacaaggcccggauggacaaggaguaccucagccugauggcggagcugggcgaggcccccgugccggccuccgucgggagcaccuccggccccgccaccaccccccucgccagcgcgccgcgccccgccgcccccgccaacaaccccccgccccccagccugauguccacgacccagagccggcccccguggaugaacuccgggcccagcgagucccgccccuaccacggcaugcacggcgggggccccgggggcccggggggcggcccccacagcuucccccacccccugccgucccucaccgggggccacgggggccaccccaugcagcacaaccccaacgggcccccgccccccuggaugcagcccccgcccccccccaugaaccagggcccgcacccccccggccaccacgggccgccccccauggaccaguaccugggcagcacccccgugggguccggcguguaccggcugcaccaggggaagggcaugaugccgcccccccccaugggcaugaugccgcccccccccccgccccccagcgggcagcccccgcccccccccuccggcccgcucccccccuggcagcagcagcagcagcagcccccgccccccccgccccccagcuccagcauggcguccagcacgccccugccguggcagcagcgcucccugcccgccgccgccauggcccgggcgaugcgcguccggaccuuccgcgcccacugguga

SEQ ID NO: 36277 - RNA, 2382 nt, Artificial Sequence
  derived and/or modified sequence opt1 from SF3A1__Homo_sapiens__NP_005868
augcccgccggcccggugcaggccguccccccccccccgcccgugcccaccgagcccaagcagccgaccgaggaggaggcgagcuccaaggaggacagcgcccccuccaagcccguggucgggaucaucuaccccccgcccgaggugcgcaacaucguggacaagacggccagcuucgucgcccggaacggccccgaguucgaggcccgcauccggcagaacgagaucaacaaccccaaguucaacuuccugaacccgaacgaccccuaccacgcguacuaccgccacaagguguccgaguucaaggaggggaaggcccaggagcccagcgccgccauccccaaggugaugcagcagcagcagcagaccacccagcagcagcucccgcagaagguccaggcgcaggugauccaggagaccaucgugcccaaggagccccccccggaguucgaguucaucgccgacccccccuccaucagcgccuucgaccuggacgucgugaagcugacggcccaguucguggcccggaacggccgccaguuccucacccagcugaugcagaaggagcagcggaacuaccaguucgacuuccugcgcccccagcacucccucuucaacuacuucaccaagcuggucgagcaguacaccaagauccugaucccgcccaaggggcucuucagcaagcugaagaaggaggcggagaacccccgggaggugcuggaccaggugugcuaccgcgucgagugggccaaguuccaggagcgggagcgcaagaaggaggaggaggagaaggagaaggagcggguggccuacgcccagaucgacuggcacgacuucguggucguggagacgguggacuuccagccgaacgagcagggcaacuuccccccccccaccaccccggaggagcucggcgcccgcauccugauccaggagcgguacgagaaguucggggaguccgaggaggucgagauggagguggagagcgacgaggaggacgacaagcaggagaaggcggaggagccccccucccagcuggaccaggacacccagguccaggacauggacgagggcagcgacgacgaggaggaggggcagaaggugcccccgccccccgagacgcccaugccgcccccccuccccccgacccccgaccaggugaucguccgcaaggacuacgaccccaaggccuccaagccccugccgcccgcccccgcccccgacgaguaccuggugagcccgaucaccggcgagaagauccccgccuccaagaugcaggagcacaugcggaucgggcuccuggacccccgcuggcuggagcagcgggaccgcagcauccgggagaagcaguccgacgacgagguguacgcgccgggccucgacaucgagagcagccugaagcagcuggccgagcgccgcaccgacaucuucggcgucgaggagacggccaucgggaagaagaucggcgaggaggagauccagaagcccgaggagaaggugaccugggacgggcacuccggcagcauggcccggacccagcaggccgcgcaggccaacaucacccuccaggagcagaucgaggccauccacaaggccaagggccuggugcccgaggacgacacgaaggagaagaucgggcccuccaagccgaacgagaucccccagcagccccccccgcccagcuccgcgaccaacauccccagcuccgcccccccgaucaccagcgucccccgcccccccaccaugccgccccccgugcggacgaccguggucuccgccgugcccgugaugccgcgcccccccauggccagcgucgugcggcugcccccgggcuccgugaucgcccccaugccccccaucauccacgcgccgcgcaucaacgucgugcccaugcccccgagcgccccccccaucauggccccccggccgccccccaugaucgugcccaccgccuucgucccggccccccccguggcgcccgugccggcccccgcccccaugcccccgguccaccccccccccccgauggaggacgagcccaccuccaagaagcucaagacggaggacagccugaugcccgaggaggaguuccugcgccggaacaaggggcccguguccaucaaggugcaggucccgaacaugcaggacaagaccgaguggaagcucaacggccaggugcugguguucacccugccccucaccgaccaggucagcgugaucaaggugaagauccacgaggccacggggaugcccgccggcaagcagaagcugcaguacgagggcaucuucaucaaggacuccaacagccuggcguacuacaacauggccaacggggccgucauccaccucgcccugaaggagcgcggcgggcggaagaaguga

SEQ ID NO: 36278 - RNA, 435 nt, Artificial Sequence
  derived and/or modified sequence opt1 from SF3B1__Homo_sapiens__NP_001005526
auggccaagaucgccaagacccacgaggacaucgaggcgcagauccgcgagauccagggcaagaaggccgcccuggacgaggcccagggggugggccucgacagcaccggguacuacgaccaggagaucuacggcggguccgacagccgguucgccggcuacgucacguccaucgcggccaccgagcuggaggacgacgacgacgacuacagcuccagcaccucccugcucggccagaagaagcccggguaccacgccccgguggcccugcugaacgacaucccccagagcaccgagcaguacgaccccuucgcggagcaccggcccccgaagaucgccgaccgcgaggacgaguacaagaagcaccgccggacgaugaucaucucccccgagcgccucgaccccuucgccgacggcuucuacagcgccgccuga

SEQ ID NO: 36279 - RNA, 2688 nt, Artificial Sequence
  derived and/or modified sequence opt1 from SF3B2__Homo_sapiens__NP_006833
auggccaccgagcaccccgagccgcccaaggccgagcugcagcugccgcccccgcccccgcccggccacuacggggcgugggccgcccaggagcugcaggccaagcuggccgagaucggcgcgccgauccaggggaaccgcgaggagcucguggagcggcugcagagcuacacccgccagacgggcaucguccugaaccggcccgugcuccgcggggaggacggcgacaaggccgcgccgccgcccaugagcgcccagcugcccggcauccccaugcccccgccgccccucgggcucccgccccugcagcccccgcccccgcccccgcccccgccgcccggccuggggcucggcuuccccauggcccacccgcccaaccuggggcccccgccgccccugcgggugggcgagcccgucgcccucagcgaggaggagcggcugaagcuggcccagcagcaggccgcccuccugaugcagcaggaggagcgggcgaagcagcagggcgaccacucccugaaggagcacgagcuccuggagcagcagaagcgcgccgccgugcugcucgagcaggagcggcagcaggagaucgccaagauggggacccccgugccccggccgccccaggacaugggccagaucgggguccggacgccccugggcccccgcguggccgcgcccgugggccccgucgggcccacccccaccgugcugcccaugggcgcccccgugccccggccccgcgggcccccgcccccgcccggcgacgagaaccgggagauggacgaccccagcgucgggcccaagaucccccaggcccucgagaagauccugcagcugaaggagucccgccaggaggagaugaacagccagcaggaggaggaggagauggagaccgacgcccgguccagccucggccaguccgccagcgagaccgaggaggacaccguguccgugagcaagaaggagaagaaccgcaagcggcgcaaccggaagaagaagaagaagccccagcgcguccgcggcguguccagcgaguccagcggggaccgggagaaggacuccacgcgcagccggggcuccgacagccccgcggccgacguggagaucgaguacgucaccgaggagcccgagaucuacgagcccaacuucaucuucuucaagcgcaucuucgaggccuucaagcugaccgacgacgugaagaaggagaaggagaaggagcccgagaagcuggacaagcucgagaacagcgccgcccccaagaagaagggguucgaggaggagcacaaggacuccgacgacgacagcuccgacgacgagcaggagaagaagcccgaggcgcccaagcugagcaagaagaagcugcggcgcaugaaccgguucaccguggccgagcucaagcagcuggucgcccgccccgacgugguggagaugcacgacgucacggcccaggaccccaagcugcucgugcaccugaaggcgacccggaacuccguccccgugccccgccacuggugcuucaagcggaaguaccugcagggcaagcgcgggaucgagaagccgcccuucgagcuccccgacuucaucaagcggaccggcauccaggagaugcgcgaggcccugcaggagaaggaggagcagaagaccaugaaguccaagaugcgggagaaggugcgccccaagaugggcaagaucgacaucgacuaccagaagcugcacgacgccuucuucaaguggcagacgaagcccaagcucaccauccacggggaccuguacuacgagggcaaggaguucgagacccggcugaaggagaagaagcccggggaccucuccgacgagcugcgcaucagccugggcaugcccgucgggcccaacgcccacaaggugcccccgcccuggcugaucgccaugcagcgguacgggcccccgcccuccuaccccaaccucaagauccccggccugaacagccccauccccgaguccugcagcuucggguaccacgcgggcggguggggcaagccgcccguggacgagaccggcaagccccuguacggggacgucuucggcacgaacgccgccgaguuccagaccaagaccgaggaggaggagaucgaccgcacccccuggggcgagcucgagcccuccgacgaggagagcuccgaggaggaggaggaggaggagagcgacgaggacaagcccgacgagacgggcuucaucaccccggccgacuccgggcugaucacccccggcggcuucagcuccgugcccgccgggauggagacccccgagcugaucgagcuccgcaagaagaagaucgaggaggcgauggacggcagcgagacgccgcagcuguucaccgugcugcccgagaagcggaccgccaccgucgggggcgccaugauggggagcacgcacaucuacgacauguccaccgugaugagccgcaagggccccgcccccgagcuccagggcguggaggucgcccuggcgccggaggagcuggagcucgaccccauggccaugacccagaaguacgaggagcacgugcgggagcagcaggcccagguggagaaggaggacuucuccgacauggucgccgagcacgcggccaagcagaagcagaagaagcgcaaggcccagccccaggacagccgcgggggcuccaagaaguacaaggaguucaaguucuga

SEQ ID NO: 36280 - RNA, 378 nt, Artificial Sequence
  derived and/or modified sequence opt1 from SF3B6__Homo_sapiens__NP_057131
auggccaugcaggccgcgaagcgcgccaacauccggcugcccccggaggugaaccgcauccucuacauccggaaccugcccuacaagaucaccgccgaggagauguacgacaucuucggcaaguacgggcccauccgccagauccgggucggcaacacccccgagacgcgcgggaccgccuacgugguguacgaggacaucuucgacgccaagaacgcgugcgaccaccugagcggcuucaacgucugcaaccgguaccucguggugcuguacuacaacgccaaccgcgccuuccagaagauggacaccaagaagaaggaggagcagcugaagcuccugaaggagaaguacgggaucaacaccgacccgcccaaguga

SEQ ID NO: 36281 - RNA, 3729 nt, Artificial Sequence
  derived and/or modified sequence opt1 from SFI1__Homo_sapiens__NP_001007468
augaagaaccugcucaccgagaagugcaucagcucccacaacuuccaccagaaggugaucaagcagcgcauggagaagaagguggacagccgguacuucaaggacggcgccgugaagaagcccuacuccgccaagacccugagcaacaagaaguccagcgcguccuucgggauccgccgggagcugccgagcacgucccaccucgugcaguaccgcggcacccacacgugcacccggcaggggcgccugcgggagcugcgcauccggugcgucgcccgcaaguuccucuaccuguggauccggaugaccuucggccgcguguuccccagcaaggcccgguucuacuacgagcagcgccugcuccggaagguguucgaggaguggaaggaggaguggugggucuuccagcacgaguggaagcugugcgugcgcgccgacugccacuaccgguacuaccuguacaaccucauguuccagaccuggaagaccuacgugcgccagcagcaggagaugcggaacaaguacauccgcgccgagguccacgacgcgaagcagaagaugcggcaggccuggaaguccuggcugaucuacguggugguccgccgcaccaagcugcagaugcagacgaccgcccucgaguuccggcagcgcaucauccugcgggugugguggagcaccuggcgccagcggcugggccaggugcgcgucucccgggcccuccacgcgagcgcccugaagcaccgcgcccugucccuccaggugcaggccuggagccaguggcgggagcagcugcuguacgugcagaaggagaagcagaaggucguguccgccgugaagcaccaccagcacuggcagaagcgccgguuccucaaggcguggcuggaguaccugcagguccgccgggugaagcgccagcagaacgagauggccgagcgguuccaccacgugaccguccuccagaucuacuucugcgacuggcagcaggccugggagcgccgggagagccuguacgcccaccacgcccagguggagaagcuggcgcgcaagauggcccuccggcgcgccuucacgcacuggaagcacuacaugcugcugugcgccgaggaggccgcgcaguucgagauggccgaggagcaccaccgccacucccagcucuacuucugcuuccgggcccugaaggacaacgucacccacgcccaccuccagcagauccgccggaaccuggcccaccagcagcacggggugacccugcugcaccgcuucuggaaccucuggcggagccagaucgagcagaagaaggagcgcgagcugcugccccuccugcacgcggccugggaccacuaccggaucgcccugcucugcaagugcaucgagcuguggcugcaguacacccagaagcgccgguacaagcagcuccugcaggcccgcgcggacggccacuuccagcagcgggcccugcccgccgccuuccacacguggaaccgccuguggcgguggcgccaccaggagaacgugcucagcgcccgggcgacccgcuuccaccgggagacccuggagaagcaggucuucucccuguggcgccagaagauguuccagcaccgggagaaccgccucgccgagcggauggccauccugcacgccgagcgccagcugcucuaccgcagcugguucauguggcaccagcaggccgcggcccggcaccaggagcaggaguggcagaccguggccugcgcccaccaccgccacgggcggcugaagaaggccuucugccuguggcgcgaguccgcgcagggccuccggacggagcgcaccgggcgggugcgcgccgccgaguuccacauggcccagcugcugcggugggcguggagccaguggcgcgagugccucgcccugcggggcgccgagcgccagaagcugaugcgggccgaccuccaccaccagcacuccguccugcaccgcgcccugcaggcgugggugaccuaccaggggcgggugcgcagcauccuccgggaggucgccgcccgcgagucccagcacaaccggcagcugcugcgcggcgcccuccgccgguggaaggagaacaccauggcccgcguggacgaggcgaagaagacguuccaggccagcacccacuaccggcgcaccaucugcuccaaggugcugguccaguggcgggaggccgugagcgugcagauguacuaccgccagcaggaggacugcgccaucugggaggcccagaagguccuggaccggggcugccuccgcaccugguuccagcgguggugggacugcucccgccggagcgcgcagcagcgccugcagcuggagcgggccgugcagcaccaccaccgccagcuccugcuggaggggcucgcccgguggaagacgcaccaccuccagugcgugcgcaagcggcugcugcaccgccaguccacccagcugcuggcccagcggcucagccggaccugcuuccgccaguggcgccagcagcuggcggcccgccggcaggagcagcgcgccaccguccgggcccugugguucugggccuucucccuccaggcgaaggugugggccacguggcuggccuucgugcuggagcgccggcgcaagaaggcccggcuccagugggcccugcaggcguaccagggccagcugcuccaggagggggccacccgccugcugcgguucgccgccagcaugaaggccucccgccagcagcuccaggcgcagcagcagguccaggccgcccacagccugcaccgggccgugcgccggugcgccacccuguggaagcagaaggugcucggccgcggcgggaagccgcagccccuggcggccaucgcccccucccggaaggucaccuucgagggcccccugcucaaccgcaucgccgcgggggccggcgacgggacgcuggagaccaagcggccgcaggccagccgcccccugggcgcccucggccggcuggccgcggaggagccccacgcccuggagcucaacaccgcccacagcgcccgcaagcagccccgccggccgcacuuccugcuggagcccgcccagucccagcgcccccagaagccccaggagcacgggcucggcauggcgcagccggccgcccccagccugacccggcccuuccuggccgaggcccccaccgcgcucgugccgcacagcccccugcccggggcccuguccuccgcccccggcccgaagcagccgcccacggccagcaccgggcccgagcuccugcugcucccccuguccagcuucaugcccugcggcgcggccgcccccgcccgcguguccgcccagcgggcgaccccgcgcgacaagccgcccguccccagcucccuggccagcgugcccgacccccaccuccugcugcccggcgacuucuccgccacccgggccgggcccggccucagcacggccgggucccuggaccuggaggcggagcucgaggagauccagcagcagcugcugcacuaccagaccaccaagcagaaccucuggagcugccgccggcaggccuccagccugcgccgguggcuggagcucaaccgcgaggagccgggccccgaggaccaggagguggagcagcagguccagaaggagcuggagcaggucgagaugcagauccagcugcucgccgaggagcugcaggcccagcggcagcccaucggggccugcguggcgcgcauccaggcccugcggcaggcccucugcuga

SEQ ID NO: 36282 - RNA, 2601 nt, Artificial Sequence
  derived and/or modified sequence opt1 from SFMBT1__Homo_sapiens__NP_057413
augaacggcgagcagcagcuggacgccgacgccgggagcggcauggaggagguggagcucuccugggaggacuaccuggaggagaccgggagcaccgcgguccccuacggcuccuucaagcacguggacacgcgccugcagaacggguucgccccgggcaugaagcucgagguggccguccggaccgaccccgagaccuacuggguggccaccgugaucacgaccugcgagcagcugcugcuccugcgcuacgacggcuacggggaggaccggcgcgccgacuucuggugcgacauccggaaggcggaccuguaccccaucggcuggugcgagcagaacaagaagacccucgaggcccccgaggggauccgcgacaaggucagcgacugggacgaguuccugcggcagacccugaucggcgccugcuccccgcccgugccccuccuggaggggcugcgcaacggccggaacccccucgaccugaucgccccgggcagccgccuggagugccaggcguuccaggacucccucagcacguggaucgugaccgucguggagaacaucgggggccggcugaagcugcgcuacgaggggcucgaguccagcgacaacuacgagcacuggcuguacuaccuggaccccuuccuccaccacgugggcugggccgcccagcagggcuacgagcugcagccgcccuccgccauccggcaccugaagaacgaggccgaguggcaggagauccucgcgaaggucaaggaggaggaggaggagccccugcccagcuaccuguucaaggacaagcaggucaucgggauccacaccuucuccgugaacaugaagcucgaggccguggaccccuggagccccuucggcaucuccccggccaccguggugaaggucuucgacgagaaguacuuccugguggagauggacgaccugcgccccgagaaccacgcccggcgcagcuucgugugccacgccgacucccccgggaucuuccccguccaguggagccucaagaacggccugcacaucuccccgccgcccggguaccccagccaggacuucgacugggcggacuaccugaagcagugcggcgccgaggccgcgccccagcggugcuucccgccccucaucagcgagcacgaguucaaggagaacaugaagcuggaggccgugaaccccauccugcccgaggaggugugcgucgccacgaucaccgccgugcgcggcuccuaccucuggcugcagcuggaggggagcaagaagcccauccccgagugcaucgucuccguggagagcauggacaucuucccgcucggcuggugcgagaccaacgggcacccccuguccacgccccggcgcgcccggguguacaagcagcgcaagaucgccgucgugcagcccgagaagcaggucccgagcucccgcaccgugcacgagggccugcggaaccaggagcucaacagcaccgaguccgugaugaucaacgggaaguacugcugccccaagaucuacuucaaccaccgcugcuucagcggccccuaccugaacaagggccggaucgccgagcugccccagugcguggggccgggcaacugcguccucgugcugcgcgaggugcugacccugcucaucaacgcggccuacaagcccucccggguccugcgcgagcugcagcucgacaaggacagcguguggcacgggugcggcgaggugcugaaggccaaguacaaggggaaguccuaccgggccaccgucgagaucgugaagacggcggaccgcgugaccgaguucugccggcagaccugcaucaagcuggagugcugccccaaccucuucggcccccgcaugguccuggacaagugcagcgagaacugcuccgugcugaccaagacgaaguacacccacuacuacggcaagaagaagaacaagcggaucgggcgcccgcccggcgggcacagcaaccucgccugcgcccugaagaaggccuccaagcggcgcaagcggcgcaagaacguguucguccacaagaagaagcggagcuccgccagcguggacaacacccccgcgggcagcccccagggcuccgggggcgaggacgaggacgacccggacgagggggacgacgacagccuguccgagggcagcaccuccgagcagcaggacgagcuccaggaggagagcgagauguccgagaagaaguccugcagcagcucccccacgcagagcgagaucuccaccagccugccgcccgaccgccagcggcgcaagcgcgagcugcggaccuucuccuucagcgacgacgagaacaagccgcccucccccaaggagauccgcaucgagguggccgagcggcuccaccuggacagcaacccccugaaguggagcgucgccgacguggugcgcuucauccgguccaccgacugcgcgccccucgcccgcaucuuccuggaccaggagaucgacgggcaggcccugcuccugcugacgcuccccaccguccaggagugcauggaccugaagcugggccccgccaucaagcucugccaccacaucgagcggaucaaguucgccuucuacgagcaguucgccaacuga

SEQ ID NO: 36283 - RNA, 2685 nt, Artificial Sequence
  derived and/or modified sequence opt1 from SFMBT2__Homo_sapiens__NP_001018049
auggagagcacccuguccgccagcaacaugcaggaccccuccagcuccccgcucgagaagugccugggcagcgccaacgggaacggcgaccuggacuccgaggaggggagcucccucgaggagaccggcuucaacuggggcgaguaccuggaggagacgggggcgagcgccgcgccccacaccuccuucaagcacguggagaucagcauccaguccaacuuccagcccggcaugaagcuggaggucgccaacaagaacaaccccgacaccuacuggguggccaccaucaucacgaccugcgggcagcuccugcugcuccgcuacugcggcuacggggaggaccggcgcgccgacuucuggugcgacguggucaucgccgaccugcacccggugggcuggugcacccagaacaacaaggugcugaugccgcccgacgccaucaaggagaaguacaccgacuggacggaguuccucauccgggaccugaccgggagccgcaccgcccccgcgaaccugcucgagggcccccugcggggcaaggggcccaucgaccugaucaccgucggcucccucaucgagcugcaggacagccagaaccccuuccaguacuggaucguguccgugaucgagaacgucgggggccgccugcggcuccgcuacgugggccuggaggacacggagagcuacgaccaguggcuguucuaccucgacuaccggcugcgccccgugggguggugccaggagaacaaguaccggauggacccgcccuccgagaucuacccccugaagauggccagcgaguggaagugcacccucgagaagucccugaucgacgccgccaaguucccccugccgauggaggucuucaaggaccacgccgaccuccgcagccacuucuucaccgugggcaugaagcuggagaccgugaacaugugcgagcccuucuacaucagccccgcguccgucacgaagguguucaacaaccacuucuuccaggugaccaucgacgaccugcggcccgagccgagcaagcucuccaugcugugccacgccgacagccuggggauccuccccguccaguggugccugaagaacggcgugucccugaccccgcccaagggguacagcggccaggacuucgacugggccgacuaccacaagcagcacggcgcccaggaggccccgcccuucugcuuccgcaacaccuccuucagccggggguucacgaagaacaugaagcucgaggcggugaacccccgcaaccccggcgagcugugcgucgccuccguggugagcgucaaggggcggcugauguggcuccaccuggagggccugcagacccccgugcccgaggucaucguggacguggaguccauggacaucuuccccgucggguggugcgaggccaacagcuacccgcucaccgcgccccacaagaccgugucccagaagaagcgcaagaucgccgugguccagcccgagaagcagcugcccccgacggugcccgugaagaagaucccccacgaccugugccucuucccccaccuggacaccaccggcaccgucaacggcaaguacugcugcccgcagcuguucaucaaccaccggugcuucagcgggcccuaccugaacaagggccgcaucgccgagcucccccaguccguggggcccggcaagugcgugcugguccugaaggaggugcucagcaugaucaucaacgccgccuacaagccggggcgggugcugcgcgagcugcagcucgucgaggacccccacuggaacuuccaggaggagacgcugaaggccaaguaccgcggcaagaccuaccgggccguggugaagaucguccgcaccuccgaccagguggcgaacuucugccggcgcgugugcgccaagcuggagugcugccccaaccucuucagccccguccugaucagcgagaacugcccggagaacugcuccauccacaccaagacgaaguacaccuacuacuacggcaagcggaagaagaucagcaagccgcccaucggggaguccaaccccgacagcggccaccccaagcccgcccgccggcgcaagcggcgcaaguccaucuucgugcagaagaagcggcgcagcuccgccguggacuucaccgcggggagcggcgaggaguccgaggaggaggacgccgacgccauggacgacgacaccgccagcgaggagacgggcuccgagcugcgggacgaccagaccgacaccagcuccgccgagguccccagcgcgcgcccccggcgcgccgugacccuccgguccgggagcgagccggugcgccggccgccgcccgagcgcacccgccggggccgcggggcccccgccgccuccagcgcggaggagggcgagaagugcccgcccacgaagcccgaggggaccgaggacaccaagcaggaggaggaggagcggcugguccuggagagcaacccccucgaguggaccgugacggacgugguccgcuucaucaagcugaccgacugcgcgccccuggccaagaucuuccaggagcaggacaucgacggccaggcccuccugcugcucacccugcccaccgugcaggagugcauggagcugaagcucggccccgccaucaagcugugccaccagaucgagcgggugaaggucgccuucuacgcccaguacgccaacuga

SEQ ID NO: 36284 - RNA, 738 nt, Artificial Sequence
  derived and/or modified sequence opt1 from SFR1__Homo_sapiens__NP_001002759
auggccgagggcgagaagaaccaggacuucaccuucaagauggagagccccuccgacagcgccgugguccugccguccacgccccaggcgagcgccaaccccuccagccccuacaccaacuccagccgcaagcagccgauguccgccacccuccgggagcgccugcggaagacccgcuucagcuucaacuccagcuacaacguggugaagcggcugaaggucgaguccgaggagaacgaccagaccuucagcgagaagcccgccuccagcacggaggagaacugccucgaguuccaggaguccuucaagcacaucgacagcgaguucgaggagaacaccaaccugaagaacacccugaagaaccucaacgugugcgagucccagagccuggacagcggguccugcagcgcccugcagaacgaguucguguccgagaagcuccccaagcagcgccugaacgcggagaaggccaagcuggucaagcagguccaggagaaggaggaccuccugcggcgccugaagcucgugaagauguaccggagcaagaacgaccugucccagcugcagcuccugaucaagaaguggcgcagcugcucccagcugcuccuguacgagcugcagagcgccguguccgaggagaacaagaagcucagccugacccagcugaucgaccacuacggccucgacgacaagcugcugcacuacaaccgguccgaggaggaguucaucgacguguga

SEQ ID NO: 36285 - RNA, 945 nt, Artificial Sequence
  derived and/or modified sequence opt1 from SFRP1__Homo_sapiens__NP_003003
augggcaucgggcgcagcgagggcgggcggcgcggcgccgcccugggggugcuccuggcgcugggcgccgcccuccuggccgugggcuccgccagcgaguacgacuacguguccuuccagagcgacaucgggcccuaccaguccggccgguucuacaccaagccgccccagugcguggacauccccgcggaccugcgccucugccacaacgucggguacaagaagauggugcugcccaaccugcucgagcacgagaccauggccgaggugaagcagcaggccagcuccugggucccgcugcugaacaagaacugccacgccggcacccagguguuccucugcagccuguucgcgcccgugugccuggaccggcccaucuaccccugccgcuggcucugcgaggccguccgggacuccugcgagccggugaugcaguucuucggguucuacuggcccgagaugcugaagugcgacaaguuccccgagggcgacgugugcaucgccaugacgcccccgaacgccaccgaggccagcaagccccagggcaccacggucugcccgcccugcgacaacgagcugaaguccgaggcgaucaucgagcaccucugcgccagcgaguucgcccugcgcaugaagaucaaggaggugaagaaggagaacggggacaagaagaucgugcccaagaagaagaagccccugaagcucggccccaucaagaagaaggaccugaagaagcugguccucuaccugaagaacggggccgacugccccugccaccagcuggacaaccucucccaccacuuccugaucaugggccggaaggucaagagccaguaccugcucaccgccauccacaagugggacaagaagaacaaggaguucaagaacuucaugaagaagaugaagaaccacgagugcccgaccuuccaguccguguucaaguga

SEQ ID NO: 36286 - RNA, 888 nt, Artificial Sequence
  derived and/or modified sequence opt1 from SFRP2__Homo_sapiens__NP_003004
augcugcagggccccgggagccuccugcugcuguuccuggccucccacugcugccugggcagcgcccgcggccucuuccuguucgggcagccggacuucuccuacaagcggagcaacugcaagcccauccccgcgaaccugcagcucugccacgggaucgaguaccagaacaugcgccugcccaaccugcucggccacgagaccaugaaggaggugcuggagcaggccggcgccuggaucccgcuggucaugaagcagugccaccccgacaccaagaaguuccucugcucccuguucgcccccgugugccuggacgaccucgacgagacgauccagcccugccacagccugugcgugcaggucaaggaccggugcgccccggugauguccgcguucggguuccccuggcccgacaugcuggagugcgaccgcuucccccaggacaacgaccucugcaucccgcuggccagcuccgaccaccuccuccccgccaccgaggaggcccccaaggugugcgaggcgugcaagaacaagaacgacgacgacaacgacaucauggagacccugugcaagaacgacuucgcccugaagaucaaggucaaggagaucaccuacaucaaccgggacacgaagaucauccucgagaccaagagcaagaccaucuacaagcugaacggcguguccgagcgcgaccugaagaaguccgugcucuggcugaaggacagccugcagugcacgugcgaggagaugaacgacaucaacgcccccuaccucgucauggggcagaagcagggcggggagcuggugaucaccagcgugaagcgguggcagaagggccagcgcgaguucaagcggaucucccgcagcauccggaagcugcagugcuga

SEQ ID NO: 36287 - RNA, 1041 nt, Artificial Sequence
  derived and/or modified sequence opt1 from SFRP4__Homo_sapiens__NP_003005
auguuccugagcauccucguggcccugugccuguggcuccaccuggcccugggcguccgcggggcgcccugcgaggccgugcggaucccgaugugccgccacaugcccuggaacaucacccggaugcccaaccaccuccaccacuccacccaggagaacgccauccuggccaucgagcaguacgaggagcugguggacgucaacugcagcgccgugcuccgcuucuuccugugcgcgauguacgcccccaucugcacgcuggaguuccuccacgacccgaucaagcccugcaaguccgugugccagcgggcccgcgacgacugcgagccccugaugaagauguacaaccacagcuggcccgagucccuggccugcgacgagcucccggucuacgaccggggcgugugcaucagccccgaggcgaucgugaccgaccugcccgaggacgucaaguggaucgacaucacccccgacaugauggugcaggagcgcccgcuggacguggacugcaagcggcucucccccgaccgcugcaagugcaagaaggucaagcccacccuggccacguaccugagcaagaacuacuccuacgugauccacgccaagaucaaggccgugcagcggagcgggugcaacgaggucaccaccgugguggacgucaaggagaucuucaaguccagcucccccaucccgcgcacccaggugccccucaucacgaacagcuccugccagugcccccacauccugccccaccaggacgugcugaucaugugcuacgaguggcggagccgcaugaugcuccuggagaacugccuggucgagaaguggcgggaccagcucuccaagcgcagcauccagugggaggagcggcugcaggagcagcgccggaccgugcaggacaagaagaagaccgccggccgcaccucccggagcaacccgcccaagcccaaggggaagcccccggcgcccaagcccgccagccccaagaagaacaucaagacgcgcuccgcccagaagcgcaccaacccgaagcggguguga

SEQ ID NO: 36288 - RNA, 954 nt, Artificial Sequence
  derived and/or modified sequence opt1 from SFRP5__Homo_sapiens__NP_003006
augcgcgccgccgcggccggcgggggcgugcggaccgccgcccuggcccuccugcugggggcgcuccacugggcccccgcccgcugcgaggaguacgacuacuacggcuggcaggccgagccgcugcacgggcggagcuacuccaagccgccccagugccuggacauccccgcggaccucccccugugccacaccgucggcuacaagcgcaugcggcugcccaaccuccuggagcacgagagccuggccgaggugaagcagcaggccuccagcuggcucccccugcuggccaagcgcugccacuccgacacccagguguuccucugcagccuguucgcccccgucugccuggaccggccgaucuaccccugccgcucccucugcgaggcggugcgggccggcugcgcgccccugauggaggccuacggguuccccuggccggagaugcugcacugccacaaguucccccucgacaacgaccugugcaucgccgugcaguucggccaccuccccgccacggcgcccccggucaccaagaucugcgcccagugcgagauggagcacagcgccgacgggcugauggagcagaugugcuccagcgacuucguggugaagaugcgcaucaaggagaucaagaucgagaacggcgaccggaagcugaucggggcccagaagaagaagaagcugcucaagcccggcccccugaagcgcaaggacaccaagcggcugguccuccacaugaagaacggcgccgggugccccugcccgcagcuggacucccuggccggcagcuuccucgugauggggcgcaagguggacggccagcugcugcucauggccgucuaccggugggacaagaagaacaaggagaugaaguucgccgugaaguucauguucuccuaccccugcagccuguacuaccccuucuucuacggcgccgcggagccccacuga

SEQ ID NO: 36289 - RNA, 3012 nt, Artificial Sequence
  derived and/or modified sequence opt1 from SFSWAP__Homo_sapiens__NP_001248340
auguacggcgccagcgggggccgcgccaagcccgagcggaaguccggggcgaaggaggaggccggccccgggggcgccggcgggggcgggagccgcguggagcugcucgucuucggcuacgccugcaagcuguuccgggacgacgagcgcgcccuggcgcaggagcaggggcagcaccucauccccuggaugggcgaccacaagauccugaucgaccgguacgacggccgcgggcaccuccacgaccucuccgaguacgacgccgaguacagcaccuggaaccgggacuaccagcuguccgaggaggaggcccgcaucgaggcccugugcgacgaggagcgguaccucgcgcugcacaccgaccugcucgaggaggaggcccgccaggaggaggaguacaagcggcugagcgaggcccuggccgaggacggcuccuacaacgccgugggguucacguacggcagcgacuacuacgaccccuccgagcccaccgaggaggaggagccgagcaagcagcgcgagaagaacgaggcggagaaccucgaggagaacgaggagcccuucguggcgccccugggccuguccguccccagcgacguggagcucccgcccaccgccaagaugcacgccaucaucgagcggaccgccuccuucgugugccgccagggggcccaguucgagaucaugcugaaggccaagcaggcccggaacagccaguucgacuuccugcgcuucgaccacuaccucaaccccuacuacaaguucauccagaaggccaugaaggagggccgguacacgguccuggccgagaacaaguccgacgagaagaagaaguccgggguguccagcgacaacgaggacgacgacgacgaggaggacggcaacuaccugcaccccucccucuucgcgagcaagaagugcaaccgccuggaggagcugaugaagccgcucaagguggucgaccccgaccacccccuggccgcccuggugcggaaggcccaggccgacagcagcacccccaccccgcacaacgcggacggggcccccgugcagcccagccaggucgaguacaccgccgacuccacgguggccgcgauguacuacagcuacuacaugcugcccgacggcaccuacugccuggccccgcccccgcccggcaucgacgugaccaccuacuacuccacgcugccggccggggucaccgugagcaacucccccggcgugaccaccacggcgcccccgccgcccgggaccacgccccugcccccgcccaccacggccgagaccagcuccggcgccaccagcaccacgaccaccaccuccgcccucgcccccgucgccgccaucaucccgcccccgcccgacgugcagcccgugaucgacaagcuggcggaguacgucgcccgcaacgggcucaaguucgagacgagcgugcgggccaagaacgaccagcgcuucgaguuccugcagcccuggcaccaguacaacgccuacuacgaguucaagaagcaguucuuccugcagaaggagggcggcgacuccaugcaggccgugagcgcgcccgaggaggcccccaccgacuccgcccccgagaagcccagcgacgccggggaggacggcgcgcccgaggacgccgccgaggucggggcccgcgccggcuccgggggcaagaaggaggcgagcuccagcaagaccgugcccgacggcaagcucgucaaggccagcuucgccccgaucuccuucgccaucaaggccaaggagaacgaccugcugccccucgagaagaaccgggugaagcuggacgacgacagcgacgacgacgaggaguccaaggaggggcaggagagcuccagcuccgcggccaacaccaaccccgccguggcgcccccgugcgucgugguggaggagaagaagccccagcugacgcaggaggagcucgaggccaagcaggccaagcagaagcuggaggaccgccuggccgccgccgcgcgggagaagcucgcccaggccagcaaggaguccaaggagaagcagcugcaggccgagcgcaagcggaaggccgcgcuguuccugcagacccucaagaacccccugcccgaggccgaggccggcaagaucgaggagagcccguucuccgucgaggagagcuccaccacccccugcccccugcucaccgggggccgcccgcugcccacccuggaggugaagccgcccgaccggcccagcuccaagagcaaggacccgccccgcgaggaggagaaggagaagaagaagaagaagcacaagaagcggucccgcacccggagccgcagccccaaguaccacuccagcuccaagagccggucccgcagccacuccaaggccaagcacagccuccccuccgccuaccggaccgugcgccggagccgcgucaccgcgucccccggcacgcugcgggccgagcccugccagagcuccgccagcgugaccgccgccgcggagcccggguccuaccaggccgccagcaccaccacgcgcuucgacuccgccagcuccuucgagggcaagccggggaagaccagccgcagccggucccgcagcccccggcgccgggcccacucccccgagcgccggcgcgaggagcggagcgugcccaccgcguaccgcgucucccggagcccgggcgccucccgcaagcggacccgcagccggagcccccacgagaagaagaagaagcgccggucccgcucccggaccaagagcaaggcccgcucccagagcgugucccccagcaagcaggccgcgccccggccggccgcccccgccgcccacuccgcgcacagcgccuccgugagccccgucgagagccgcggguccagccaggagcgcucccggggcgugagccaggagaaggaggcccagaucuccagcgccaucguguccagcguccaguccaagaucacgcaggaccugauggccaaggugcgcgcgaugcucgccgccagcaagaaccugcagaccuccgccagcuga

SEQ ID NO: 36290 - RNA, 483 nt, Artificial Sequence
  derived and/or modified sequence opt1 from SFT2D2__Homo_sapiens__NP_955376
auggacaagcugaagaaggugcucagcggccaggacaccgaggaccgcuccgggcugagcgaggucguggaggccuccagccuguccuggagcacccggaucaagggcuucaucgccugcuucgcgaucgggauccucugcucccugcugggcacggugcuccugugggucccccgcaaggggcugcaccucuucgccguguucuacaccuucggcaacaucgccagcaucggcuccaccaucuuccugauggggccggugaagcagcugaagcggauguucgagcccacccgccucaucgccacgaucaugguccugcugugcuucgcccucacccugugcagcgcguucugguggcacaacaagggccuggcccucaucuucugcauccugcagucccuggcccucaccugguacagccuguccuucauccccuucgcccgggacgcggugaagaagugcuucgccgugugccuggccuga

SEQ ID NO: 36291 - RNA, 648 nt, Artificial Sequence
  derived and/or modified sequence opt1 from SFT2D3__Homo_sapiens__NP_116129
auggccgaccugcaccgccagcuccaggaguaccuggcccagggcaaggccgggggccccgcggccgccgagccgcugcucgccgcggagaaggccgaggagcccggggaccggcccgccgaggaguggcugggccgcgccgggcugcgguggaccugggcgcgcagccccgccgaguccgccgccgccggccugaccugccucccgagcgugacgcggggccagcgccuggcggccgggggcgggugccuccugcuggccgcccucugcuucggccuggccgcgcuguacgcccccguccuccugcugcgggcccgcaaguucgcccuccuguggucccuggggagcgcccucgcgcuggccggcuccgcccugcuccggggcggggccgccugcggccgccugcugcggugcgaggaggcgcccagccgccccgcccuccuguacauggccgcccugggggcgacccucuucgccgcccugggccugcgguccacccuccugaccgugcugggcgccggggcccagguggcggcccuccuggccgcccuggucggccuccugccguggggcggcgggacggcccugcgccucgcgcuggggcggcugggccgcggggccggccucgccaaggugcugcccguguga

SEQ ID NO: 36292 - RNA, 237 nt, Artificial Sequence
  derived and/or modified sequence opt1 from SFTA2__Homo_sapiens__NP_995326
augggcagcgggcugccccucgugcugcugcucacccugcugggcuccagccacgggaccggcccggggaugacgcuccagcugaagcugaaggaguccuuccucaccaacagcuccuacgagagcuccuuccuggagcugcucgagaagcugugccugcuccugcaccuccccagcggcaccuccgucacccugcaccacgcccgcagccagcaccacguggugugcaacacguga

SEQ ID NO: 36293 - RNA, 285 nt, Artificial Sequence
  derived and/or modified sequence opt1 from SFTA3__Homo_sapiens__NP_001094811
augcgcgccggcuucagcgacuuccagcugauccgggaccagguccucuuccugcaggaccaggcccagcgccugaccgaguggcuccagcuguccggguucgagaaccccgugagcgaguccaccacgcugugccuccgggagcgcgagaagcggaucccgaccugcguggcggugugcguccccagccccggcaccgugcacaccgcccugcugcaccccacgacccucucccagagccgcuccagcuccgaggccaagaugcugaucauccacaccgccuga

SEQ ID NO: 36294 - RNA, 645 nt, Artificial Sequence
  derived and/or modified sequence opt1 from SFTPA1__Homo_sapiens__NP_001158117
augcgccccugccaggugccgggcgccgccaccgggccccgggcgauguggcugugcccccucgcccugaaccugauccucauggccgccagcggcgccgucugcgaggugaaggacgugugcgucgggacccccggcaucccgggggagugcggcgagaagggcgagcccggggagcgcggcccgcccgggcugcccgcgcaccuggacgaggagcuccaggccacgcugcacgacuuccggcaccagauccugcagacccgcggcgcccucucccugcaggggagcaucaugaccgugggcgagaagguguucuccagcaacggccaguccaucaccuucgacgccauccaggaggcgugcgcccgggccgggggccgcaucgccgucccccggaaccccgaggagaacgaggccaucgcgagcuucgugaagaaguacaacacguacgccuacguggggcugaccgagggccccuccccgggcgacuuccgcuacagcgacgggacccccgucaacuacaccaacugguaccggggcgagcccgccgggcgcggcaaggagcagugcguggagauguacacggacgggcaguggaacgaccggaacugccucuacucccgccugaccaucugcgaguucuga

SEQ ID NO: 36295 - RNA, 798 nt, Artificial Sequence
  derived and/or modified sequence opt1 from SFTPA2__Homo_sapiens__XP_005270185
augcgcgaccgguggagcgaguccgugcgcgccgccaccggcccccgggcgauguggcugugcccgcucgcccugacccugauccucauggccgccagcggggccgcgugcgaggucaaggacgugugcgugggcucccccgggauccccggcacgcccgggagccacggccugccgggccgcgacgggcgggacggcgucaagggggaccccggcccgcccgggcccaugggcccgcccggcgagacccccugcccgcccgggaacaacggccugcccggggcccccggcgugcccggcgagcgcggggagaagggcgaggccggggagcggggcccgcccgggcuccccgcccaccuggacgaggagcugcaggcgacccuccacgacuuccgccaccagauccugcagacccggggcgcccugucccuccagggcagcaucaugacggugggggagaaggucuucuccagcaacggccaguccaucaccuucgacgccauccaggaggccugcgcccgcgccgggggccggaucgcggugccccgcaaccccgaggagaacgaggccaucgccagcuucgugaagaaguacaacaccuacgccuacgucgggcugaccgagggccccucccccggcgacuuccgguacagcgacgggacgccggugaacuacaccaacugguaccgcggcgagcccgcggggcggggcaaggagcagugcguggagauguacaccgacgggcaguggaacgaccgcaacugccuguacucccggcucaccaucugcgaguucuga

SEQ ID NO: 36296 - RNA, 1182 nt, Artificial Sequence
  derived and/or modified sequence opt1 from SFTPB__Homo_sapiens__XP_005264544
augcaccaggccggcuaccccgggugccgcggcgccauggcggagagccaccuccugcaguggcugcugcuccugcugccgacccucugcgggcccggcaccgccgccuggacgaccuccagccuggccugcgcccaggggcccgaguucuggugccagucccuggagcaggcgcuccagugccgggcccugggccacugccugcaggagguguggggccacgucggggccgacgaccucugccaggagugcgaggacaucgugcacauccugaacaagauggccaaggaggcgaucuuccaggacaccaugcgcaaguuccuggagcaggagugcaacgugcucccccugaagcugcucaugccgcagugcaaccagguccuggacgacuacuucccccuggugaucgacuacuuccagaaccagaccgacagcaacggcaucugcaugcaccucgggcugugcaagucccggcagcccgagcccgagcaggagccgggcaugagcgacccccugcccaagccccuccgcgacccgcugcccgacccccugcucgacaagcuggugcugcccguccucccgggggcccugcaggcccggcccggcccccacacgcaggaccuguccgagcagcaguuccccaucccgcuccccuacugcuggcugugccgcgcccugaucaagcggauccaggccaugauccccaagggcgcgcucgccguggccguggcccaggucugccgcguggugccccuggucgccgggggcaucugccagugccuggcggagcgguacagcgugauccuccuggacacccugcucgggcgcaugcugccgcagcuggugugccggcucguccugcgcugcuccauggacgacagcgccggcccccggucccccaccggcgaguggcugccccgcgacagcgagugccaccucugcauguccgugaccacgcaggccgggaacagcuccgagcaggccaucccgcaggccaugcugcaggcgugcgugggcagcuggcuggaccgggagaagugcaagcaguucgucgagcagcacaccccgcagcugcucacccuggugccccgcgggugggacgcccacaccacgugccaggcccugggcgugugcgggaccauguccagcccccuccagugcauccacucccccgaccuguga

SEQ ID NO: 36297 - RNA, 576 nt, Artificial Sequence
  derived and/or modified sequence opt1 from SFTPC__Homo_sapiens__NP_001165828
auggacgugggcagcaaggagguccugauggaguccccgcccgacuacagcgccgcgccccgcgggcgguucggcauccccugcugccccgugcaccucaagcgccugcugaucguggucgugguggucgugcucaucguggucgugaucgugggggcccugcugaugggccuccacaugucccagaagcacaccgagaugguccuggagaugagcaucggggccccggaggcccagcagcggcuggcccucuccgagcaccuggugaccacggccaccuucagcaucggcuccaccggccugguggucuacgacuaccagcagcuccugaucgcguacaagcccgcccccgggaccugcugcuacaucaugaagaucgcccccgagagcaucccgucccuggaggcccucacgcgcaaggugcacaacuuccaggcgaagcccgccgugcccaccagcaagcugggccaggccgaggggcgggacgccggcuccgcccccagcgggggcgacccggcguuccugggcauggccgucuccacccucugcggggaggugccccuguacuacaucuga

SEQ ID NO: 36298 - RNA, 1128 nt, Artificial Sequence
  derived and/or modified sequence opt1 from SFTPD__Homo_sapiens__NP_003010
augcuccucuuccugcugagcgcccucgugcugcugacccagccccucggcuaccuggaggccgagaugaagaccuacucccaccgcacgaugccgagcgcgugcacccuggucaugugcuccagcguggaguccgggcuccccggccgggacgggcgcgacggccgggaggggccccgcggcgagaagggcgaccccgggcugccgggcgccgccgggcaggccggcaugcccgggcaggccggccccgugggccccaagggggacaacggcagcgucggggagccgggccccaagggcgacaccgggcccuccgggcccccggggccgcccggcgugcccgggcccgcgggccgggagggcccccuggggaagcagggcaacaucgggccccagggcaagcccgggccgaagggcgaggccggccccaagggggaggugggcgcccccgggaugcagggcagcgccggggcgcgcggccucgccggccccaagggggagcggggcgucccgggggagcgcggcgugcccggcaacaccggggccgccggcuccgccggggcgaugggcccccaggggagccccggcgcccggggcccgcccgggcugaagggcgacaaggggauccccggcgacaagggggccaagggcgaguccggccugccggacguggccagccuccgccagcaggucgaggcccugcagggccaggugcagcaccuccaggcggccuucucccaguacaagaagguggagcuguuccccaacggccagagcgucggggagaagaucuucaagacggccggcuucgugaagcccuucaccgaggcccagcugcugugcacccaggccgggggccagcuggcgagcccccgguccgccgccgagaacgccgcccugcagcagcugguggucgcgaagaacgaggccgccuuccucuccaugaccgacagcaagacggagggcaaguucaccuacccgaccggggagucccugguguacagcaacugggcccccggcgagcccaacgacgacgggggcagcgaggacugcguggagaucuucaccaacgggaaguggaacgaccgcgcgugcggcgagaagcggcuggucgugugcgaguucuga

SEQ ID NO: 36299 - RNA, 969 nt, Artificial Sequence
  derived and/or modified sequence opt1 from SFXN1__Homo_sapiens__NP_073591
augagcggcgagcugcccccgaacaucaacaucaaggagccccgcugggaccaguccaccuucaucgggcgggccaaccacuucuucaccgugacggacccccgcaacauccuccugaccaacgagcagcuggagagcgcccggaagaucguccacgacuaccgccagggcaucgugcccccggggcucaccgagaacgagcuguggcgggcgaaguacaucuacgacuccgccuuccaccccgacaccggcgagaagaugauccugaucgggcgcaugagcgcccaggugcccaugaacaugacgaucaccggcugcaugaugaccuucuaccggaccacgcccgccguccucuucuggcaguggaucaaccaguccuucaacgccguggugaacuacaccaaccgcagcggcgacgcgccgcugaccgucaacgagcuggggaccgccuacguguccgccacgaccggcgccguggcgaccgcccucgggcugaacgcccugaccaagcacgucagcccccucaucggccgguucgugcccuucgccgccguggcggccgccaacugcaucaacaucccccugaugcgccagcgggagcugaaggucgggaucccggugacggacgagaacggcaaccgccucggcgaguccgccaacgccgcgaagcaggccaucacccagguggucgugagccggauccugauggccgcccccgggauggccaucccgcccuucaucaugaacacccuggagaagaaggcguuccucaagcgcuuccccuggauguccgcccccauccaggugggccuggucggguucugccugguguucgccacgccccucugcugcgcccuguucccccagaaguccagcaugagcgugaccucccuggaggccgagcuccaggcgaagauccaggagagccacccggagcugcggcgcgucuacuucaacaagggccuguga

SEQ ID NO: 36300 - RNA, 969 nt, Artificial Sequence
  derived and/or modified sequence opt1 from SFXN2__Homo_sapiens__NP_849189
auggaggccgaccugagcggcuucaacaucgacgcgccccgcugggaccagcggaccuuccucgggcgcgugaagcacuuccugaacaucaccgacccgcggacggucuucguguccgagcgcgagcuggacugggccaaggugauggucgagaagucccggaugggcguggugccgcccgggacccaggucgagcagcuccuguacgccaagaagcuguacgacagcgccuuccaccccgacaccggcgagaagaugaacgugaucgggcgcaugagcuuccagcuccccggcggcaugaucaucaccggguucaugcugcaguucuaccggacgaugcccgccgugaucuucuggcagugggucaaccaguccuucaacgcccuggugaacuacaccaaccgcaacgcggccagccccaccuccgugcggcagauggcccucagcuacuucaccgccacgaccaccgcggucgccaccgccgugggcaugaacaugcugacgaagaaggcgcccccgcugguggggcgcuggguccccuucgccgccguggccgccgccaacugcgugaacauccccaugaugcggcagcaggagcucaucaagggcaucugcgucaaggaccgcaacgagaacgagaucgggcacucccggcgcgccgcggccaucggcaucacccagguggugaucagccggaucaccauguccgcccccggcaugauccugcugccggucaucauggagcgccucgagaagcugcacuucaugcagaaggugaaggugcugcacgcgccccuccaggucaugcugagcgggugcuuccugaucuucauggugcccgucgccugcggccucuucccccagaagugcgagcugccgguguccuaccuggagcccaagcuccaggacaccaucaaggccaaguacggggagcuggagcccuacguguacuucaacaagggccuguga

SEQ ID NO: 36301 - RNA, 1014 nt, Artificial Sequence
  derived and/or modified sequence opt1 from SFXN4__Homo_sapiens__NP_998814
augagccuggagcaggaggaggagacccagcccggccgccuccuggggcggcgcgacgccgugccggccuucaucgagcccaacguccgguucuggaucaccgagcgccaguccuucauccggcgcuuccugcaguggacggagcuccuggaccccaccaacguguucaucagcguggaguccaucgagaacagccggcagcugcucugcaccaacgaggacgucuccagccccgcguccgccgaccagcgcauccaggaggccuggaagcggagccuggccaccgugcacccggacuccagcaaccugauccccaagcuguuccgccccgccgcguuccuccccuucauggccccgacgguguuccuguccaugacgccccucaagggcaucaagagcgucauccugccccagguguuccugugcgccuacauggccgcguucaacuccaucaacgggaaccggagcuacacgugcaagccccucgagcgcucccugcugauggccggcgccguggccagcuccaccuuccucggggucaucccgcaguucgugcagaugaaguacggccugaccggccccuggaucaagcggcugcuccccgugaucuuccugguccaggccagcgggaugaacguguacaugucccgcagccuggagagcaucaagggcaucgcggugauggacaaggaggggaacguccucggccacucccggaucgccgggaccaaggccgugcgcgagacccuggccagccggaucgugcuguucggcaccuccgcccucauccccgaggucuucaccuacuucuucaagcgcacccaguacuuccggaagaacccgggcagccuguggauccugaagcucuccugcaccgugcuggcgauggggcugauggugcccuucagcuucuccaucuucccccagaucggccagauccaguacugcagccucgaggagaagauccagucccccaccgaggagacggagaucuucuaccaccgcggggucuga

SEQ ID NO: 36302 - RNA, 1164 nt, Artificial Sequence
  derived and/or modified sequence opt1 from SGCA__Homo_sapiens__NP_000014
auggccgagacccuguucuggacgccccuccuggugguccugcucgccggccugggggacaccgaggcgcagcagaccacccugcacccgcucgugggccgcguguucguccacacccuggaccacgagacguuccugagccuccccgagcacguggccgugccgcccgccguccacaucaccuaccacgcccaccuccaggggcaccccgaccugccccgguggcuccgcuacacccagcggagcccccaccaccccggcuuccuguacggguccgccaccccggaggaccgcggccuccaggugaucgaggugacggcguacaaccgggacuccuucgacaccacccgccagcggcugguccuggagaucggcgaccccgaggggccccugcuccccuaccaggccgaguuccuggugcgcagccacgacgccgaggaggugcugccguccacccccgccagccgguuccucuccgcgcugggcgggcugugggagcccggcgagcuccagcugcugaacgucacgagcgcccucgaccgcgggggccgggugccccugccgaucgagggccgcaaggaggggguguacaucaaggucggcuccgccagccccuucuccacgugccugaagaugguggccagccccgacucccacgcccggugcgcgcaggggcagcccccgcuccugagcugcuacgacacccuggcgccccacuuccgcguggacuggugcaacgucacccucguggacaaguccgugcccgagcccgccgacgaggucccgacccccggcgacggcauccuggagcacgaccccuucuucugcccgcccaccgaggcccccgaccgggacuuccugguggacgcccucgugacccugcuggucccccuccugguggcgcugcuccugacccugcuccuggccuacgucaugugcugccgccgggaggggcgccugaagcgggaccucgccacgagcgacauccagauggugcaccacugcaccauccacggcaacaccgaggagcugcgccagauggccgccucccgggaggugccgcgcccccugagcacccugcccauguucaacguccacacgggggagcgccugcccccgcggguggacuccgcccaggugccccugauccuggaccagcacuga

SEQ ID NO: 36303 - RNA, 957 nt, Artificial Sequence
  derived and/or modified sequence opt1 from SGCB__Homo_sapiens__NP_000223
auggccgccgcggccgccgccgccgcggagcagcagagcuccaacggccccgugaagaaguccaugcgcgagaaggccgucgagcggcgcagcgugaacaaggagcacaacagcaacuucaaggccggguacaucccgaucgacgaggaccggcugcacaagaccggccuccgcgggcggaagggcaaccuggccaucugcgugaucauccugcuguucauccuggcggucaucaaccugaucaucacccucgugaucugggccgugauccgcaucgggcccaacggcugcgacuccauggaguuccacgagagcggccugcugcgguucaagcaggucuccgacaugggggugauccacccccucuacaagagcacggugggcgggcgccggaacgagaaccuggucaucaccggcaacaaccagcccaucguguuccagcaggggaccaccaagcuguccguggagaacaacaagacgagcaucaccuccgacaucggcaugcaguucuucgacccgcgcacccagaacauccucuucagcaccgacuacgagacgcacgaguuccaccuccccuccggcgucaagagccugaacgugcagaaggccuccaccgagcggaucaccagcaacgccaccuccgaccucaacaucaagguggacgggcgcgccaucguccggggcaacgaggggguguucaucaugggcaagacgaucgaguuccacaugggcgggaacauggagcugaaggcggagaacagcaucauccugaacggcuccgugauggucagcaccacccgccuccccagcuccagcuccggggaccagcugggcagcggggacugggugcgguacaagcugugcaugugcgccgacggcacccucuucaaggugcaggucacgucccagaacaugggcugccagaucagcgacaaccccugcgggaacacccacuga

SEQ ID NO: 36304 - RNA, 771 nt, Artificial Sequence
  derived and/or modified sequence opt1 from SGCD__Homo_sapiens__NP_758447
augaugccccaggagcaguacacccaccaccgcagcaccaugccgggcuccguggggccccaggucuacaaggugggcaucuacggguggcggaagcgcugccuguacuucuucgugcuccugcugaugauccucauccuggucaaccuggccaugacgaucuggauccucaaggugaugaacuucaccaucgacggcauggggaaccugcggaucaccgagaagggccugaagcucgagggcgacagcgaguuccugcagccccuguacgccaaggagauccagucccgccccgggaacgcccucuacuucaagagcgcccggaacgugaccgucaacauccugaacgaccagacgaaggugcugacccagcucaucaccggcccgaaggccguggaggccuacgggaagaaguucgaggucaagaccguguccggcaagcugcuguucagcgccgacaacaacgagguggucgugggggcggagcgccuccgggugcugggcgccgagggcacggucuuccccaaguccaucgagacccccaacgugcgcgccgaccccuucaaggagcugcggcucgagagcccgacccgcucccuggugauggaggcccccaagggggucgagaucaacgcggaggccggcaacauggaggcgaccugccggacggagcugcgccucgagagcaaggacggggaggugcgggacgagaaggaccgcuccagcaaguccuacagcuucaaccggcccacccugcccaucaccggcuga

SEQ ID NO: 36305 - RNA, 1356 nt, Artificial Sequence
  derived and/or modified sequence opt1 from SGCE__Homo_sapiens__NP_001092870
augcagcugccccgcuggugggagcucggcgacccgugcgccuggaccgggcagggccgggggacccgccggaugagccccgccacgaccggcaccuuccugcugaccguguacuccaucuucagcaagguccacuccgaccgcaacguguaccccagcgcggggguccucuucgugcacgugcuggagcgggaguacuucaagggcgaguucccgcccuaccccaagcccggcgagaucuccaacgaccccaucacguucaacaccaaccugaugggguacccggaccgccccggcuggcuccgguacauccagcgcacccccuacagcgacggggugcuguacggcucccccaccgccgagaacgucgggaagccgacgaucaucgagaucaccgccuacaaccggcgcaccuucgagaccgcccggcacaaccugaucaucaacaucaugagcgccgaggacuucccccuccccuaccaggcggaguucuucaucaagaacaugaacguggaggagaugcuggccuccgaggugcugggcgacuuccucggcgccgucaagaacguguggcagcccgagcgccugaacgccaucaacaucacgagcgcgcuggaccgcgggggccgggugccgcuccccaucaacgaccugaaggagggggucuacgugauggugggcgccgacguccccuucuccagcugccugcgggagguggagaacccccagaaccagcuccgcugcucccaggagauggagccggugaucacgugcgacaagaaguuccggacccaguucuacaucgacuggugcaagaucagccuggucgacaagaccaagcaggucuccaccuaccaggaggugauccgcggcgaggggauccugcccgacggcggggaguacaagccgcccagcgacucccucaagagccgggacuacuacaccgacuuccugaucacccuggccgugcccuccgccguggcccucgugcuguuccugauccucgcguacaucaugugcugccgccgggagggcgucauccagcuggugcaccacagcgccauccagaaguccaccaaggagcugcgcgacaugagcaagaaccgcgagaucgccuggccccucagcacgcugcccgucuuccaccccgugaccggggagaucaucccgccccugcacaccgacaacuacgacuccaccaacaugccccucaugcagacgcagcagaaccugccgcaccagacccagaucccccagcagcagaccaccggcgacuuccggcugacgaccuuccagcgcuucgaggugaacggcauccccgaggagcggaagcucaccgaggccaugaaccuguga

SEQ ID NO: 36306 - RNA, 876 nt, Artificial Sequence
  derived and/or modified sequence opt1 from SGCG__Homo_sapiens__XP_005266562
auggugcgcgagcaguacaccaccgccaccgagggcaucugcaucgagcggcccgagaaccaguacgucuacaagaucgggaucuacggcuggcgcaagcggugccuguaccucuucgugcugcugcuccugaucauccugguggucaaccucgcccugaccaucuggauccugaaggugaugugguucagcccggcggggaugggccaccucugcgugaccaaggacgggcugcgccuggagggcgaguccgaguuccucuucccccuguacgccaaggagauccacagccgggucgacuccagccugcuccugcaguccacccagaacgugacggugaacgcccgcaacagcgagggcgaggucaccgggcggcugaaggugggccccaagaugguggagguccagaaccagcaguuccagaucaacuccaacgacgggaagccccucuucaccguggacgagaaggagguggucgugggcaccgacaagcugcgcgugacggggccggagggcgcccuguucgagcacagcgucgagacgccccucgugcgggccgaccccuuccaggaccugcgccuggagucccccacccggagccucuccauggacgcgccgcgcggcgugcacauccaggcccacgccgggaagaucgaggcccugagccagauggacauccuguuccacuccagcgacggcaugcucguccuggacgcggagaccgugugccugcccaagcucgugcaggggaccuggggccccuccggcagcucccagagccuguacgagaucugcgucugccccgacgggaagcuguaccucuccguggccggcgucagcacgaccugccaggagcacaaccacaucugccuguga

SEQ ID NO: 36307 - RNA, 939 nt, Artificial Sequence
  derived and/or modified sequence opt1 from SGCZ__Homo_sapiens__NP_631906
auggaccgcagcaccaaccuggacaucgaggagcucaagaugacccgggagcaguacauccuggccacccagcagaacaaccugccccgcaccgagaacgcccagcucuacccggugggcaucuacggguggcggaagcgcugccuguacuucuucguccugcuccugcuggugaccaugaucgugaaccucgcgaugaccaucuggauccugaaggucaugaacuucacgguggacggcauggggaaccugcgggugaccaagaagggcauccgccucgaggggaucuccgaguuccugcugccccucuacgucaaggagauccacagccggaaggacagcccccuggugcugcaguccgaccgcaacgugaccgucaacgcccggaaccacaugggccagcucaccggccagcugacgaucggggccgacgccguggaggcccagugcaagcgcuucgaggugcgggcguccgaggacggccgcguccuguucagcgccgacgaggacgagaucaccaucggggccgagaagcucaaggugaccggcaccgagggggccguguucggccacuccgucgagacgccccacauccgggcggagccgagccaggaccugcgccuggagucccccacccggagccucaucauggaggccccgcgcggcguccagguguccgccgccgccggggacuucaaggcgaccugccggaaggagcugcaccuccagagcaccgagggcgagaucuuccugaacgccgagacgaucaagcuggggaaccugcccaccggcuccuucagcuccagcucccccagcuccagcagcucccgccagaccguguacgagcucugcgugugccccaacggcaagcuguaccugagccccgccggggugggcuccacgugccagagcuccagcaacaucugccucugguccuga

SEQ ID NO: 36308 - RNA, 1830 nt, Artificial Sequence
  derived and/or modified sequence opt1 from SGIP1__Homo_sapiens__XP_011540595
augauggagggccugaagaagcgcacccggaaggccuucgggauccgcaagaaggagaaggacaccgacagcacgggcucccccgaccgggacgggaucaagaaguccaacggcgccccgaacggguucuacgcggagaucgacugggagcgcuacaacucccccgagcucgacgaggagggcuacagcauccggcccgaggagcccggcuccaccaaggggaagcacuucuacagcuccagcgaguccgaggaggaggaggagagccacaagaaguucaacaucaagaucaagccgcugcaguccaaggacauccugaagaacgccgccaccguggacgagcucaaggccagcaucggcaacaucgcccugucccccagccccgucggggcgaucaagcgcaaccuguccagcgaggagguggcccggccccgccgguccaccccgacgcccgagcucaucagcaagaagccgcccgacgacaccaccgcccuggcgccccuguucggcccgccccucgaguccgccuucgacgagcagaagaccgaggugcugcuggaccagcccgagaucugggggagcggccagcccaucaaccccagcauggagucccccaagcucacgcgccccuucccgaccggcacgcccccgccccugccgcccaagaacguccccgccacgccgccccggaccgggagcccccugaccaucggccccggggccagcagccccgcccgccccgccacgccccucgugcccugccgguccaccaccccgcccccgccgccgccccggccgcccagccgccccaagcugccgcccggcaagcccggcgugggggacgucucccgccccuucagcccgcccauccacuccagcagcccgccgcccaucgcgccccuggcccgggccgaguccaccuccagcaucuccagcaccaacucccucagcgccgccaccacccccaccgugggcuccagccgcgggcccagcccccugaccaugggcgcgcaggacacccugcccguggccgccgccuucacggagaccgucaacgccuacuucaagggggcggaccccuccaagugcaucgugaagaucaccggcgagauggugcucagcuuccccgccggcaucacccggcacuucgccaacaaccccucccccgccgcccugacguuccgcgucaucaacuucagccggcuggagcacgugcuccccaacccccagcugcugugcugcgacaacacccagaacgacgcgaacaccaaggaguucugggugaacaugcccaaccucaugacccaccugaagaaggucuccgagcagaagccccaggccacguacuacaacguggacaugcugaaguaccaggugagcgcccaggggauccaguccacgccccucaaccuggccgucaacuggcgcugcgagcccagcuccaccgaccugcgcaucgacuacaaguacaacaccgacgcgaugaccaccgccguggcccucaacaacgugcaguuccugguccccaucgacggcggggugaccaagcugcaggccgugcugcccccggccgucuggaacgcggagcagcagcggauccucuggaagauccccgacaucagccagaaguccgagaacggcggggugggcagccugcucgcccgcuuccagcuguccgagggccccagcaagcccuccccgcuggucgugcaguucaccagcgagggguccacccucagcggcugcgacaucgagcuggugggggccggcuaccgguucagccugaucaagaagcgcuucgccgccgggaaguaccucgcggacaacuga

SEQ ID NO: 36309 - RNA, 1581 nt, Artificial Sequence
  derived and/or modified sequence opt1 from SGK1__Homo_sapiens__NP_001137148
auggugaacaaggacaugaacggcuuccccgucaagaagugcagcgccuuccaguucuucaagaagcgcgugcggcgcuggaucaaguccccgauggugagcgucgacaagcaccagucccccagccugaaguacaccggguccagcauggugcacaucccgcccggcgagcccgacuucgaguccagccucugccagaccugccugggggagcacgccuuccagcggggcgugcugccccaggagaacgaguccugcagcugggagacgcaguccgggugcgagguccgcgagcccugcaaccacgcgaacauccucaccaagcccgacccgcggaccuucuggaccaacgacgaccccgccuucaugaagcagcgccggaugggccugaacgacuucauccagaagaucgccaacaacagcuacgccugcaagcaccccgaggugcaguccauccugaagaucagccagccccaggagccggagcucaugaacgccaaccccuccccgccgcccagccccucccagcagaucaaccugggccccagcuccaacccccacgcgaagcccagcgacuuccacuuccugaaggugaucgggaagggcagcuucgggaagguccuccuggcccgccacaaggccgaggagguguucuacgccgugaagguccugcagaagaaggcgauccucaagaagaaggaggagaagcacaucauguccgagcggaacgugcugcugaagaacgugaagcaccccuuccucgucggccugcacuucagcuuccagacggccgacaagcuguacuucgugcucgacuacaucaacgggggcgagcuguucuaccaccuccagcgcgagcggugcuuccuggagccccgcgcccgguucuacgccgccgagaucgcguccgcccugggcuaccugcacagccucaacaucguguaccgcgaccugaagcccgagaacauccugcucgacucccaggggcacaucguccugaccgacuucggccugugcaaggagaacaucgagcacaacagcaccaccuccacguucugcgggaccccggaguaccucgcccccgaggugcugcacaagcagcccuacgaccggaccguggacugguggugccugggcgccguccucuacgagaugcuguacggccugcccccguucuacagccgcaacaccgccgagauguacgacaacauccucaacaagccccugcagcugaagcccaacaucacgaacuccgcgcggcaccuccuggaggggcugcuccagaaggaccgcaccaagcggcugggcgccaaggacgacuucauggagaucaagagccacguguucuucucccugaucaacugggacgaccucaucaacaagaagaucaccccgcccuucaaccccaacgugagcgggcccaacgaccugcgccacuucgacccggaguucaccgaggagcccguccccaacuccaucggcaagagccccgacuccgugcuggucacggccagcgugaaggaggccgccgaggcguuccucggguucuccuacgccccgcccaccgacagcuuccuguga

SEQ ID NO: 36310 - RNA, 4221 nt, Artificial Sequence
  derived and/or modified sequence opt1 from SGK223__Homo_sapiens__XP_005272427
augcaccagacccugugccucaaccccgagagccugaagauguccgccugcagcgacuucguggagcacaucuggaagccgggcuccugcaagaacugcuucugccugcgcagcgaccaccagcucgucgccgggcccccccagccccgggcgggcucccugccgccccccccccgccugccgccccggcccgagaacugccgccucgaggacgagggggugaacagcucccccuacagcaagccgaccaucgccgugaagcccacgaugauguccagcgaggccuccgacgucuggaccgaggccaaccugagcgccgaggugucccaggugaucuggcggcgcgcgcccggcaagcugccccucccgaagcaggaggacgcccccgucguguaccuggggagcuuccggggcgugcagaagcccgccggccccuccaccagcccggacgggaacucccgcugcccccccgccuacaccauggucggccugcacaaccucgagccccggggggagcgcaacaucgcguuccacccggugagcuuccccgaggagaaggccgugcacaaggagaagcccuccuuccccuaccaggaccggccgagcacgcaggagagcuuccgccagaagcuggccgccuucgccggcaccaccuccgggugccaccagggccccggcccccugcgggagagccucccguccgaggacgacagcgaccagcgcugcucccccagcggggacuccgagggcggggaguacugcagcauccuggacugcugccccggcucccccgucgcgaaggccgccagccagaccgccggcucccgggggcgccacggcgggcgggacugcagcccgacgugcugggagcagggcaagugcuccgggcccgccgagcaggagaagcgcggccccagcuuccccaaggagugcugcucccagggcccgaccgcgcaccccagcugccuggggcccaagaagcucucccugaccagcgaggccgccaucuccagcgacggccugagcugcggguccggcagcggguccggcagcggcgccuccagccccuucgugccgcaccucgaguccgacuacugcagccugaugaaggagcccgcccccgagaagcagcaggaccccgggugcccgggcgugacccccucccggugccuggggcucacgggcgagccccagcccccggcgcacccccgcgaggccacccagcccgagcccaucuacgccgagagcaccaagcggaagaaggccgccccgguccccuccaagagccaggcgaagaucgagcacgccgccgccgcgcaggggcagggccaggugugcaccggcaacgccugggcccagaaggccgccuccggguggggccgcgacagccccgacccgacgccccagguguccgcgaccaucaccgucauggccgcccaccccgaggaggaccaccgcaccaucuaccugagcucccccgacagcgccgugggggugcaguggccgcggggccccgucagccagaacuccgaggugggcgaggaggagacgagcgccgggcagggccuguccagccgcgagucccacgcgcacagcgccuccgagagcaagcccaaggagcggcccgccaucccgcccaagcucuccaagagcucccccguggggagccccgucuccccgagcgccggcgggccccccguguccccccuggccgaccugagcgacggcuccagcggcggguccagcaucggcccgcagccccccagccaggggcccgcggacccggcccccuccugccgcaccaacggcgucgccaucagcgaccccucccggugcccccagccggccgcgagcuccgccagcgagcagcgccggccccgcuuccaggccgggaccuggucccggcagugccgcaucgaggaggaggaggagguggagcaggagcuccugagccacuccuggggccgggagaccaagaacggccccacggaccacagcaacuccaccaccuggcaccgccugcaccccaccgacgggagcuccggccagaacagcaagguggggacgggcauguccaagagcgccuccuucgccuucgaguucccgaaggaccggagcgggaucgagaccuucuccccccccccgcccccccccaagagccgccaccuccugaagaugaacaagagcuccagcgaccuggagaaggucucccagggcagcgcggagucccucagcccguccuuccggggcgugcacgugagcuucaccaccggguccacggacagccuggccuccgacagccgcaccugcuccgacggcgggcccagcuccgagcuggcccacagccccaccaacuccggcaagaagcucuucgcccccgucccguuccccagcggguccaccgaggacgugagccccagcggcccccagcagccgcccccccugccccagaagaagaucgugucccgggccgcgagcuccccggacggcuucuucuggacgcaggggagccccaagcccggcaccgccucccccaagcugaaccucagccacuccgagaccaacguccacgacgagagccacuucuccuacagccuguccccggggaaccgccaccaccccguguucagcuccagcgacccccuggagaaggccuucaagggcuccggccacuggcuccccgccgccgggcuggcgggcaaccgggggggcugcgggagcccgggccugcagugcaagggcgcccccuccgccagcuccagccagcucagcguguccagccaggccuccaccgggagcacccagcugcagcugcacggccugcucuccaacaucagcuccaaggaggggacguacgcgaagcugggcgggcuguacacccagagccucgcccgccuggucgccaagugcgaggaccuguucaugggcggccagaagaaggagcuccacuucaacgagaacaacuggucccuguucaagcugaccugcaacaagcccugcugcgacagcggggacgccaucuacuacugcgccaccugcuccgaggaccccggcagcacguacgcggugaagaucugcaaggccccggagcccaagaccguguccuacugcagccccuccgucccggugcacuucaacauccagcaggacugcgggcacuucguggccagcguccccuccagcaugcucuccagccccgacgcccccaaggacccggugcccgcccugcccacccaccccccggcgcaggagcaggacugcguggucgugaucacccgcgaggugccccaccagacggccagcgacuucguccgggacuccgccgccagccaccaggccgagcccgaggcguacgagcgccgggugugcuuccugcuccugcagcugugcaacggccucgagcaccugaaggagcacgggaucauccaccgcgaccugugccucgagaaccugcugcucgugcacugcacccugcaggccggccccggcccggcccccgcccccgcccccgcgccggcccccgccgccgcggccccccccugcuccagcgccgccccgcccgccgggggcacccugucccccgcggccgggcccgccagcccggagggcccccgggagaagcagcucccccgccugaucaucuccaacuuccugaaggccaagcagaagccgggcgggacccccaaccuccagcagaagaagagccaggcccggcuggcgcccgagaucgucuccgccagccaguaccgcaaguucgacgaguuccagacgggcauccugaucuacgagcuccugcaccagcccaacccguucgaggugcgggcccagcugcgcgagcgggacuaccgccaggaggaccuccccccccugcccgcccugucccucuacagcccggggcugcagcagcuggcccaccuccugcuggaggcggaccccaucaagcggauccgcaucggcgaggccaagcgggugcuccagugccugcugugggggccccgccgggagcucguccagcagcccggcaccuccgaggaggcccugugcggcacccugcacaacuggaucgacaugaagcgcgcccucaugaugaugaaguucgcggagaaggccguggaccggcgccgggggguggagcuggaggacuggcugugcugccaguaccucgccagcgccgagccgggcgcccugcugcagucccucaagcugcugcagcuccuguga

SEQ ID NO: 36311 - RNA, 1104 nt, Artificial Sequence
  derived and/or modified sequence opt1 from SGK2__Homo_sapiens__NP_001186193
augaacagcucccccgccggcaccccgagcccccagcccucccgcgccaacgggaacaucaaccugggccccagcgcgaacccgaacgcccagcccaccgacuucgacuuccucaaggugaucgggaagggcaacuacgggaagguccugcuggccaagcggaaguccgacggcgccuucuacgccgugaaggugcuccagaagaaguccauccugaagaagaaggagcagagccacaucauggcggagcgcagcguccugcucaagaacgugcggcaccccuuccuggugggccugcgcuacuccuuccagacgcccgagaagcucuacuucguccuggacuacgugaacgggggcgagcuguucuuccaccuccagcgggagcgccgguuccuggagccgcgcgcccgguucuacgccgccgagguggcgagcgccaucggguaccugcacucccucaacaucaucuaccgcgaccugaagcccgagaacauccugcucgacugccagggccacgucgugcugaccgacuucgggcugugcaaggagggcguggagcccgaggacaccaccagcacguucugcggcacccccgaguaccucgccccggagguccugcggaaggagcccuacgaccgcgccguggacugguggugccugggggccgugcucuacgagaugcugcacggccugccgcccuucuacucccaggacgucagccagauguacgagaacauccuccaccagccccugcagauccccgggggccggaccguggcggccugcgaccugcuccagucccugcugcacaaggaccagcgccagcggcucggcagcaaggccgacuuccuggagaucaagaaccacguguucuucucccccaucaacugggacgaccuguaccacaagcgccucacgcccccguucaaccccaacgucaccgggcccgccgaccugaagcacuucgaccccgaguucacccaggaggccgugagcaaguccaucggcugcaccccggacaccguggcgagcagcuccggggccagcuccgccuuccugggcuucagcuacgcccccgaggacgacgacauccucgacugcuga

SEQ ID NO: 36312 - RNA, 1491 nt, Artificial Sequence
  derived and/or modified sequence opt1 from SGK3__Homo_sapiens__NP_001028750
augcagcgcgaccacaccauggacuacaaggagagcugccccuccgugagcauccccuccagcgacgagcaccgggagaagaagaagcgcuucaccgucuacaaggugcugguguccgucggccggagcgagugguucguguuccgccgguacgccgaguucgacaagcucuacaacacgcugaagaagcaguuccccgccauggcgcugaagauccccgccaagcgcaucuucggggacaacuucgaccccgacuucaucaagcagcggcgcgccggccucaacgaguucauccagaaccuggugcgguacccggagcuguacaaccaccccgacguccgcgccuuccuccagauggacucccccaagcaccagagcgaccccuccgaggacgaggacgagcggagcucccagaagcugcacagcaccucccagaacaucaaccuggggccgagcggcaacccccacgccaagcccaccgacuucgacuuccucaaggugaucgggaagggcuccuucggcaaggugcugcuggcgaagcgcaagcucgacgggaaguucuacgccgucaaggugcugcagaagaagaucgugcugaaccggaaggagcagaagcacaucauggccgagcgcaacguccuccugaagaacgugaagcaccccuuccuggugggccuccacuacagcuuccagaccacggagaagcuguacuucguccuggacuucgugaacgggggcgagcuguucuuccaccuccagcgggagcgcuccuucccggagcaccgggcccgcuucuacgcggccgagaucgccagcgcccugggguaccuccacuccaucaagaucguguaccgggaccugaagcccgagaacauccugcucgacagcgucggccacguggugcugaccgacuucggccugugcaaggaggggaucgccaucagcgacaccaccacgaccuucugcggcacccccgaguaccucgcgcccgaggucauccgcaagcagccguacgacaacaccguggacugguggugccugggggccgugcuguacgagaugcucuacggccugccgcccuucuacugccgggacgucgccgagauguacgacaacauccugcacaagccccucucccugcgccccggcgugagccugacggccugguccauccucgaggagcugcuggagaaggaccgccagaaccggcucggggccaaggaggacuuccuggagauccagaaccaccccuucuucgagagccuguccugggcggaccucguccagaagaagaucccgccgcccuucaaccccaacguggccggccccgacgacauccgcaacuucgacaccgccuucaccgaggagaccgugcccuacagcgucugcguguccagcgacuacuccaucgugaacgccagcguccuggaggccgacgacgcguucgugggguucuccuacgccccgcccagcgaggaccuguuccucuga

SEQ ID NO: 36313 - RNA, 1242 nt, Artificial Sequence
  derived and/or modified sequence opt1 from SGMS1__Homo_sapiens__XP_011537885
augaaggagguggucuacuggagccccaagaagguggccgacuggcugcucgagaacgccaugccggaguacugcgagccccuggagcacuucaccggccaggaccugaucaaccucacccaggaggacuucaagaagccgccccugugccgcguguccagcgacaacgggcagcggcugcucgacaugaucgagacgcugaagauggagcaccaccuggaggcgcacaagaacggccacgccaacgggcaccucaacaucggcgucgacauccccacccccgacggguccuucagcaucaagaucaagcccaacggcaugcccaacggcuaccgcaaggagaugaucaagaucccgaugcccgagcuggagcggucccaguaccccauggagugggggaagaccuuccuggccuuccucuacgcccugagcugcuucgugcugaccacggugaugaucuccgucgugcacgagcgcgugcccccgaaggagguccagccgccccuccccgacaccuucuucgaccacuucaaccgggugcagugggccuucagcaucugcgagaucaacggcaugauccugguggggcuguggcucauccaguggcugcugcucaaguacaaguccaucaucagccgccgguucuucugcaucgucggcacccuguaccuguaccgcugcaucaccauguacgugacgacccuccccgugcccgggaugcacuucaacugcucccccaagcuguucggcgacugggaggcgcagcugcggcgcaucaugaagcucaucgccggcgggggccugagcaucaccgggucccacaacaugugcggcgacuaccuguacagcggccacaccgucaugcucacgcugaccuaccuguucaucaaggaguacagcccccggcgccucuggugguaccacuggaucugcuggcugcuguccgugguggggaucuucugcauccuccuggcccacgaccacuacaccgucgacgugguggucgccuacuacaucaccacgcggcuguucuggugguaccacaccauggcgaaccagcagguccucaaggaggccucccagaugaaccugcuggcccgcguguggugguaccggccguuccaguacuucgagaagaacgugcagggcaucgugccccgcagcuaccacuggcccuuccccuggccggucgugcaccucucccgccaggugaaguacagccggcuggucaacgacaccuga

SEQ ID NO: 36314 - RNA, 1098 nt, Artificial Sequence
  derived and/or modified sequence opt1 from SGMS2__Homo_sapiens__NP_001129730
auggacaucaucgagaccgccaagcuggaggagcaccucgagaaccagcccagcgacccgaccaacacguacgcccgccccgcggagcccguggaggaggagaacaagaacggcaacgggaagcccaagucccugagcuccggccugcggaaggggaccaagaaguacccggacuacauccagaucgccaugcccaccgagagccgcaacaaguucccccucgagugguggaagaccggcaucgccuucaucuacgccgucuucaaccuggugcugacgaccgugaugaucaccgucgugcacgagcgggugcccccgaaggagcucuccccgccccugcccgacaaguucuucgacuacaucgaccgcgucaagugggccuucagcguguccgagaucaacgggaucauccuggugggccucuggaucacccaguggcuguuccugcgguacaagagcaucgucggccgccgguucugcuucaucaucgggacgcucuaccuguaccgcugcaucaccauguacgugaccacccugcccgugcccggcaugcacuuccagugcgcgcccaagcucaacggggacucccaggccaagguccagcggauccugcgccugaucagcggcgggggccucuccaucacgggcagccacauccugugcggggacuuccuguucuccggccacaccgugacccucacccugacguaccuguucaucaaggaguacagcccccggcacuucuggugguaccaccucaucugcuggcugcuguccgccgccgggaucaucugcauccucguggcgcacgagcacuacaccaucgacgucaucaucgccuacuacaucaccacccgccuguucuggugguaccacagcauggccaacgagaagaaccugaagguguccagccagacgaacuuccucucccgggccuggugguucccgaucuucuacuucuucgagaagaacgugcagggcagcauccccugcugcuucagcuggccccuguccuggcccccgggcugcuucaagagcuccugcaagaaguacagccgcguccagaagaucggggaggacaacgagaaguccaccuga

SEQ ID NO: 36315 - RNA, 1584 nt, Artificial Sequence
  derived and/or modified sequence opt1 from SGOL1__Homo_sapiens__NP_001012409
auggccaaggagcgcugccugaagaaguccuuccaggacucccucgaggacaucaagaagcggaugaaggagaagcgcaacaagaaccuggccgagaucggcaagcggcgcagcuucaucgcggcccccugccagaucaucaccaacaccuccacgcugcucaagaacuaccaggacaacaacaagaugcuggugcuggcccucgagaacgagaaguccaaggucaaggaggcccaggacaucauccugcagcugcggaaggagugcuacuaccugaccugccagcucuacgcccugaaggggaagcucaccagccagcagaccguggagccggcgcagaaccaggagaucugcagcuccggcauggaccccaacagcgacgacuccagccgcaaccuguucgugaaggaccugccccagaucccccucgaggagacggagcugccggggcagggcgaguccuuccagaucgaggaccagauccccaccaucccccaggacacccugggggucgacuucgacagcggcgaggccaaguccaccgacaacgugcucccccggacggugagcguccgcuccagccugaagaagcacugcaacuccaucugccaguucgacagccuggacgacuucgagaccucccaccucgccggcaagagcuucgaguucgagcgggugggguuccuggacccgcuggugaacaugcacauccccgagaacguccagcacaacgccugccaguggagcaaggaccaggugaaccucucccccaagcugauccagcccggcaccuucaccaagacgaaggaggacauccuggagagcaaguccgagcagaccaagagcaagcagcgcgacacccaggagcggaagcgcgaggagaagcggaaggcgaaccgccggaaguccaagcgcaugagcaaguacaaggagaacaaguccgagaacaagaagaccgugccgcagaagaagaugcacaagagcgucuccagcaacgacgccuacaacuucaaccucgaggagggggugcaccugacgcccuuccggcagaagguguccaacgacagcaaccgcgaggagaacaacgaguccgaggucagccugugcgaguccagcggcuccggggacgacagcgacgaccucuaccugccgaccugcaaguacauccagaaccccaccuccaacagcgaccggcccgugacccgcccccuggccaagcgggcccucaaguacacggacgagaaggagaccgagggcagcaagcccaccaagacccccacgaccaccccgcccgagacccagcagagcccccaccugagccugaaggacaucacgaacgugucccucuaccccgucgugaagauccgccgccugagccuguccccgaagaagaacaaggccagccccgcgguggcccuccccaagcggcgcugcaccgccuccgucaacuacaaggagcccacccuggccagcaagcugcggcgcggcgacccguucaccgaccucugcuuccugaacucccccaucuucaagcagaagaaggaccugcggcgcagcaagaaguccaugaagcagauccaguga

SEQ ID NO: 36316 - RNA, 1707 nt, Artificial Sequence
  derived and/or modified sequence opt1 from SGPL1__Homo_sapiens__XP_011538619
augcccagcaccgaccugcucaugcugaaggccuucgagccguaccuggagauccucgagguguacuccaccaaggccaagaacuacgucaacggccacugcacgaaguacgagcccuggcagcugaucgcguggagcgugguguggacccugcucaucgucuggggguacgaguucguguuccagcccgagucccuguggagccgcuucaagaagaagugcuucaagcugacccggaagaugcccaucaucggccgcaagauccaggacaagcucaacaagaccaaggacgacaucuccaagaacaugagcuuccugaagguggacaaggaguacgucaaggcccugccgucccaggggcucagcuccagcgccgugcuggagaagcugaaggaguacuccagcauggacgccuucuggcaggagggccgggccuccgggacgguguacagcggcgaggagaagcucaccgagcugcuggucaaggcguacggcgacuucgccugguccaacccccuccaccccgacaucuuccccgggcugcgcaagaucgaggccgagaucgugcggaucgccugcagccuguucaacggcgggccggacuccugcggcugcgugaccagcgggggcaccgaguccauccucauggcgugcaaggccuaccgcgaccuggccuucgagaagggcaucaagacgcccgagaucgucgcgccccagagcgcccacgccgccuucaacaaggccgccagcuacuucgggaugaagaucgugcgggugccccugaccaagaugauggaggucgacgugcgcgccaugcggcgcgcgaucucccggaacaccgccaugcucgugugcagcaccccgcaguucccccacggcgucaucgaccccgugcccgagguggccaagcuggccgucaaguacaagaucccgcugcacguggacgccugccucgggggcuuccugaucguguucauggagaaggcgggcuacccccuggagcaccccuucgacuuccgcgucaagggggugacguccaucagcgccgacacccacaaguacggcuacgcccccaagggguccagccucguccuguacuccgacaagaaguaccggaacuaccaguucuucguggacaccgacuggcagggcgggaucuacgccagcccgaccaucgccggcucccgccccggcgggaucagcgcggccugcugggccgcccugaugcacuucggcgagaacggguacguggaggcgacgaagcagaucaucaagaccgcccgguuccucaaguccgagcuggagaacaucaagggcaucuucgucuucgggaacccccagcugagcgugaucgcccucggcucccgcgacuucgacaucuaccggcugagcaaccugaugaccgccaagggcuggaaccucaaccagcugcaguucccgcccuccauccacuucugcaucacccugcuccacgcccgcaagcggguggcgauccaguuccugaaggacauccgcgagagcgucacgcagaucaugaagaaccccaaggccaagaccaccgggaugggcgccaucuacgggauggcccagaccacgguggaccggaacaugguggccgagcuguccagcgucuuccucgacucccuguacagcaccgacaccgugacccagggcagccagaugaacgggucccccaagccccacuga

SEQ ID NO: 36317 - RNA, 1326 nt, Artificial Sequence
  derived and/or modified sequence opt1 from SGPP1__Homo_sapiens__NP_110418
augagccugcgccagcggcucgcccagcuggugggccgccugcaggacccccagaaggucgcccgguuccagcgccucugcgggguggaggcgccgccccggcgcuccgccgaccggcgcgaggacgagaaggccgaggcgccccuggccggcgacccccggcugcgcgggcggcagccgggcgcccccgggggcccccagcccccgggcagcgaccgcaaccagugccccgccaagcccgacgggggcggggcccccaacggcgugcggaacgggcucgccgcggagcugggcccggccagcccccgccgggccggcgcccugcgccggaacucccucaccggggaggagggccagcuggcccgcgucuccaacuggccccuguacugccucuucugcuucgggaccgagcugggcaacgagcuguucuacauccucuucuuccccuucuggaucuggaaccuggacccgcuggugggccggcgccucguggucaucugggugcuggugauguaccuggggcagugcacgaaggacaucauccgguggccccgccccgcgagcccgcccgucgugaagcucgagguguucuacaacuccgaguacagcaugcccuccacccacgccaugagcggcaccgccauccccaucuccaugguccugcugaccuacgggcgcuggcaguacccccucaucuacggccugauccugaucccgugcuggugcagccucgugugccugucccggaucuacauggggaugcacagcauccuggacaucaucgccggcuuccucuacacgauccugauccuggccguguucuaccccuucgucgaccucaucgacaacuucaaccagacccacaaguacgcgcccuucaucaucaucggccugcaccuggcccucgggaucuucuccuucacccuggacaccuggagcacgucccgcggcgacaccgccgagauccuggggagcggcgccgggaucgccugcggcucccacgugaccuacaacaugggccucgugcuggaccccagccuggacacccucccgcuggcggggccgcccaucacggucacccuguucggcaaggccauccuccggauccugaucgggaugguguucgugcugaucauccgcgacgucaugaagaagaucaccaucccccucgccugcaagaucuucaacauccccugcgacgacauccggaaggcccgccagcacauggagguggagcugcccuaccgguacaucaccuacggcauggugggguucagcaucacguucuucguccccuacaucuucuucuucaucggcaucuccuga

SEQ ID NO: 36318 - RNA, 1200 nt, Artificial Sequence
  derived and/or modified sequence opt1 from SGPP2__Homo_sapiens__NP_689599
auggccgagcugcuccgcagccugcaggacucccagcugguggcccgguuccagcgccggugcggccucuuccccgcgccggacgaggggccccgcgagaacggcgccgaccccaccgagcgggccgcccgcguccccgggguggagcaccucccggccgcgaacggcaagggcggggaggcccccgccaacggccugcggcgcgccgcggcccccgaggccuacgugcagaaguacgucgugaagaacuacuucuacuacuaccuguuccaguucagcgccgcccuggggcaggagguguucuacaucaccuuccugcccuucacgcacuggaacaucgacccguaccucucccggcgccugaucaucaucuggguccuggugauguacaucggccagguggcgaaggacguccucaaguggccccggcccagcuccccgcccguggugaagcuggagaagcgccugaucgccgaguacgggaugcccagcacccacgccauggccgccaccgcgaucgccuucacccuccugaucuccacgauggaccgguaccaguaccccuucguccugggccucgugauggccguggucuucagcacccuggugugccugucccgccucuacaccgggaugcacaccgugcuggacguccugggcggcgugcucaucacggcccugcugaucgugcucaccuaccccgccuggaccuucaucgacugccuggacagcgcguccccgcuguuccccgucugcgugaucgugguccccuucuuccucugcuacaacuaccccgugagcgacuacuacuccccgacccgggccgacacgaccaccauccuggccgccggggccggcgucaccaucggguucuggaucaaccacuucuuccagcuggugagcaagcccgcggagucccuccccgugauccagaacaucccgccccugacgaccuacaugcugguccucggccugaccaaguucgccgugggcaucgugcugauccuccugguccgccagcuggugcagaaccucagccuccaggugcuguacuccugguucaaggucgugacccggaacaaggaggcccgccggcgccuggagaucgaggugcccuacaaguucgucacguacaccagcguggggaucugcgccaccaccuucgugcccaugcugcaccgguuccugggccuccccuga

SEQ ID NO: 36319 - RNA, 1509 nt, Artificial Sequence
  derived and/or modified sequence opt1 from SGSH__Homo_sapiens__NP_000190
auguccugccccgugccggccugcugcgcccugcuccugguccugggccucugccgcgcgcggccccgcaacgcccugcugcuccuggccgacgacgggggcuucgaguccggggccuacaacaacagcgccaucgcgacgccccaccuggacgcccucgcccggcgcucccugcuguuccggaacgccuucaccagcguguccagcugcucccccagccgcgcgucccuccugaccggccugccgcagcaccagaacgggauguacggccuccaccaggacgugcaccacuucaacagcuucgacaagguccggucccugccccugcuccugagccaggccggcgugcgcaccgggaucaucggcaagaagcacguggggcccgagaccgucuaccccuucgacuucgccuacaccgaggagaacggcuccgugcuccagguggggcggaacaucacgcgcaucaagcugcugguccggaaguuccugcagacccaggacgaccgcccguucuuccucuacguggccuuccacgacccccaccggugcggccacagccagccccaguacggcaccuucugcgagaaguucgggaacggcgaguccgggaugggccgcauccccgacuggaccccgcaggccuacgacccccuggacgugcugguccccuacuucgugcccaacacgccggcggcccgggccgaccucgccgcccaguacaccaccgugggccgcauggaccagggggucggccuggugcugcaggagcuccgggacgcgggggugcugaacgacacccuggucaucuucacgagcgacaacggcauccccuuccccuccgggcgcaccaaccucuacuggcccggcaccgccgagccgcugcuggugagcucccccgagcaccccaagcgguggggccaggugagcgaggccuacgucagccuccuggaccugacccccacgauccucgacugguucuccaucccguaccccagcuacgccaucuucggguccaagaccauccaccugaccggccgcagccugcuccccgcccuggaggcggagccccugugggccaccguguucgggucccagagccaccacgaggugacgauguccuacccgaugcggagcguccagcaccgccacuuccgccucgugcacaaccugaacuucaagaugcccuuccccaucgaccaggacuucuacgucuccccgaccuuccaggaccugcucaaccggaccaccgccggccagcccacggggugguacaaggaccugcgccacuacuacuaccgggcccgcugggagcuguacgaccggagccgcgacccccacgagacccagaaccuggccaccgacccccgguucgcgcagcuccuggagaugcugcgcgaccagcucgccaaguggcagugggagacccacgacccgugggugugcgcccccgacggcgugcuggaggagaagcugagcccccagugccagccccuccacaacgagcuguga

SEQ ID NO: 36320 - RNA, 3021 nt, Artificial Sequence
  derived and/or modified sequence opt1 from SGSM2__Homo_sapiens__NP_001091979
augggcagcgccgaggacgccgugaaggagaagcugcucuggaacgucaagaaggaggugaagcagaucauggaggaggcggugacccgcaaguucguccacgaggacuccagccacaucaucgcccugugcggggccguggaggccugccugcuccaccagcugcggcgccgggccgcgggcuuccugcgcuccgacaagauggccgcccucuucaccaagguggggaagacgugccccgucgccggcgagaucugccacaaggugcaggagcugcagcagcaggcggaggggcggaagccgagcggcgugucccaggaggcccugcgccggcagggcagcgccuccgggaaggcccccgcccucagcccccaggcgcugaagcacgucugggugcgcaccgcccugaucgagaaggugcucgacaaggucgugcaguaccuggccgagaacugcuccaaguacuacgagaaggaggcccugcucgccgaccccguguucggcccgauccuggcgagccugcucgucgggcccugcgcccuggaguacaccaagcugaagaccgccgaccacuacuggacggaccccuccgccgacgagcucgugcagcggcaccgcauccgggggcccccgacccgccaggacagccccgccaagcggcccgcgcugggcauccgcaagcggcacuccagcggcuccgccagcgaggaccgccuggccgccugcgcccgggagugcguggagucccuccaccagaacagccgcacccggcugcuguacggcaagaaccacguccucgugcagcccaaggaggacauggaggcggugccgggguaccugucccugcaccagagcgccgagagccucacccugaaguggacgcccaaccagcugaugaacggcacccucggggacuccgagcuggagaaguccgucuacugggacuacgcccugguggugcccuucagccaggucgugugcauccacugccaccagcagaaguccggcggcacccucguccuggugagccaggacgggauccagcggcccccgcugcacuucccccagggcgggcaccuccugagcuuccuguccugccucgagaacggccugcugccccgcgggcagcucgagcccccgcuguggacccagcagggcaagggcaagguguuccccaagcugcgcaagcgcagcuccauccggagcgucgacauggaggagauggggacgggccgcgccaccgacuacguguuccggaucaucuaccccgggcaccgccacgagcacaacgcgggcgacaugaucgagaugcagggguucggccccucccucccggccuggcaccuggagccccugugcagccagggcuccagcugccuguccugcagcuccagcuccagcccccacgccacccccagccacugcuccugcaucccggaccggcucccccugcgccugcucugcgagagcaugaagcggcagaucgugucccgcgccuucuacggguggcuggcccacugccggcaccugagcaccguccgcacgcaccucuccgcgcuggugcaccacagcgugaucccgcccgaccggccgcccggcgccuccgccgggcugaccaaggacgucuggagcaaguaccagaaggacaagaagaacuacaaggagcucgagcugcugcgccagguguacuacggcgggaucgagcacgagauccggaaggacguguggcccuuccuccugggccacuacaaguucggcauguccaagaaggagauggagcaggucgacgccgugguggccgcgcgcuaccagcagguccuggccgaguggaaggccugcgagguggugguccggcagcgcgagcgggaggcccaccccgccacccgcaccaaguucagcuccgggagcuccaucgacagccacgugcagcggcucauccaccgcgacuccacgaucagcaacgacguguucaucuccgucgacgaccuggagccgcccgagccccaggaccccgaggacagccgccccaagcccgagcaggaggcgggccccgggaccccgggcaccgccgugguggagcagcagcacagcgucgaguucgacucccccgacagcggccugcccuccagccggaacuacuccguggccagcgggauccaguccagccucgacgagggccaguccgugggguucgaggaggaggacggcgggggcgaggagggcagcuccgggcccggcccggccgcgcacacccugcgcgagccccaggaccccagccaggagaagccccaggccggggagcuggaggccggcgaggagcucgccgccgucugcgcggccgccuacacgaucgagcugcuggacaccguggcccucaaccugcaccggaucgacaaggacgugcagcgcugcgaccggaacuacugguacuucaccccgcccaaccuggagcgccuccgggacgucaugugcuccuacgugugggagcaccuggacgugggguacguccagggcaugugcgaccugcucgcgccccugcuggugacccucgacaacgaccagcuggccuacagcugcuucucccaccugaugaagcgcaugagccagaacuuccccaacggcggggccauggacacgcacuucgccaacaugcggucccucauccagauccuggacagcgagcuguucgagcucaugcaccagaacggcgacuacacccacuucuacuucugcuaccgcugguuccugcuggacuucaagcgggagcuccuguacgaggacguguucgccgucugggaggugaucugggccgcgcgccacaucuccagcgagcacuucgugcuguucaucgcccucgcccuggucgaggccuaccgggagaucauccgcgacaacaacauggacuucaccgacaucaucaaguucuucaacgagcgggcggagcaccacgacgcccaggagauccugcgcaucgcccgggaccucgugcacaaggugcagaugcugaucgagaacaaguga

SEQ ID NO: 36321 - RNA, 2250 nt, Artificial Sequence
  derived and/or modified sequence opt1 from SGSM3__Homo_sapiens__NP_056520
augagcggcucccacacccccgccugcgggccguucagcgcccugacccccuccaucuggccccaggagauccucgcgaaguacacgcagaaggaggagagcgccgagcagcccgaguucuacuacgacgaguucggcuuccgcguguacaaggaggagggggacgagccgggcuccagccugcuggccaacagcccccucauggaggacgcgccccagcggcugcgcuggcaggcccaccuggaguucacccacaaccacgacgucggggaccucaccugggacaagaucgccgugucccugccccgguccgagaagcugcgcagccucgugcuggccggcaucccgcacggcaugcggccccagcuguggaugcgccucuccggggcccugcagaagaagcggaacagcgagcuguccuaccgcgagaucgucaagaacagcuccaacgacgagaccaucgccgcgaagcagaucgagaaggaccuccugcggacgaugcccagcaacgccugcuucgccuccaugggcagcaucggggugccccgccugcggcgcgugcuccgggcccuggccuggcuguacccggagaucggcuacugccaggggaccggcauggucgcggccugccuccugcuguuccucgaggaggaggacgccuucuggaugauguccgccaucaucgaggaccugcugcccgccagcuacuucagcaccacccuccugggcgugcagacggaccagcgcgugcugcggcaccucaucguccaguaccugccccgccuggacaagcuccugcaggagcacgacaucgagcugucccucaucacccugcacugguuccugaccgcguucgccagcgugguggacaucaagcuccugcugcggaucugggaccucuucuucuacgaggggucccgcguccuguuccagcugacccucggcaugcugcaccugaaggaggaggagcucauccagagcgagaacuccgccagcaucuucaacacgcuguccgacauccccagccagauggaggacgccgagcugcugcucgggguggccaugcggcuggcgggcucccugaccgacguggccgucgagacccagcgccggaagcaccucgccuaccugaucgccgaccagggccagcugcucggggccggcacccugacgaaccugagccagguggugcgccgccggacccagcgccggaaguccaccaucaccgcgcuccuguucggggaggacgaccuggaggcccucaaggccaagaacaucaagcagacggagcuggucgccgaccugcgcgaggcgauccuccggguggcccgccacuuccagugcaccgacccgaagaacugcagcguggagcugacccccgacuacuccauggagagccaccagcgggaccacgagaacuacgucgccugcucccgcagccaccggcgccgggccaaggcccugcucgacuucgagcgccacgacgacgacgagcugggcuuccggaagaacgacaucaucaccaucgugucccagaaggacgagcacugcugggugggggagcugaacggccuccgcggcugguuccccgcgaaguucgucgaggugcuggacgagcggagcaaggaguacuccaucgccggggacgacagcgucacggagggcgugaccgaccuggugcgcgggacccucugccccgcccugaaggcccuguucgagcacggccucaagaagccgagccugcucgggggcgccugccaccccuggcuguucaucgaggaggcggccggccgggaggucgagcgcgacuucgccuccguguacagccggcuggugcugugcaagaccuuccgccucgacgaggacgggaagguccugacgcccgaggagcugcucuaccgcgccgugcaguccgugaacgucacccacgacgccgugcacgcgcagauggacgugaagcugcggagccugaucugcgucggccucaacgagcagguccugcaccuguggcucgaggugcugugcuccagccugcccaccguggagaagugguaccagccgugguccuuccuccgcagccccgggugggugcagaucaagugcgagcugcgggugcugugcugcuucgccuucucccucagccaggacugggagcugcccgccaagcgcgaggcccagcagccccugaaggagggcguccgggacaugcucgugaagcaccaccuguucuccugggacguggacggguga

SEQ ID NO: 36322 - RNA, 942 nt, Artificial Sequence
  derived and/or modified sequence opt1 from SGTA__Homo_sapiens__XP_011526480
auggacaacaagaagcgccuggccuacgccaucauccaguuccuccacgaccagcugcggcacggcgggcugagcuccgacgcgcaggagagccucgagguggccauccagugccuggagaccgccuucggcgucaccguggaggacuccgaccuggcccucccccagacgcugccggagaucuucgaggccgcggccaccgggaaggagaugccccaggaccugcgcagccccgcccggacgcccccguccgaggaggacagcgccgaggcggagcgccucaagaccgagggcaacgagcagaugaagguggagaacuucgaggccgccguccacuucuacgggaaggccaucgagcugaaccccgccaacgcgguguacuucugcaaccgggccgccgccuacuccaagcugggcaacuacgccggcgcggugcaggacugcgagcgcgccaucugcaucgaccccgccuacagcaaggccuacgggcggaugggccucgcccuguccagccugaacaagcacgucgaggcgguggccuacuacaagaaggcccucgagcuggaccccgacaacgagaccuacaaguccaaccugaagaucgccgagcucaagcugcgcgaggccccgagccccaccgggggcgugggguccuucgacaucgcgggccugcucaacaaccccggcuucaugagcauggccuccaaccugaugaacaacccccagauccagcagcugaugagcgggaugaucuccggcgggaacaacccgcucggcacccccggcaccagccccucccagaacgaccuggccagccugauccaggccgggcagcaguucgcgcagcagaugcagcagcagaaccccgagcucaucgagcagcugcggagccagauccgcucccggacgccgagcgccuccaacgacgaccagcaggaguga

SEQ ID NO: 36323 - RNA, 2271 nt, Artificial Sequence
  derived and/or modified sequence opt1 from SH2B1__Homo_sapiens__NP_001139267
augaacggcgcccccagcccggaggacggggccucccccagcucccccccccugccgcccccccccccgcccagcuggcgcgaguucugcgagucccacgcgcgggccgccgcccucgacuucgcccgccgguuccgccuguaccuggcgagccacccccaguacgccggccccggggccgaggccgcguucucccggcgcuucgccgagcucuuccugcagcacuucgaggccgagguggcccgggccagcggcucccugagcccgcccauccucgcgccccugucccccggggccgagaucagcccgcacgaccugucccucgagagcugccgcgucggcggcccccuggccgugcuggggcccucccggagcuccgaggaccucgccggcccccugccgagcuccgugagcagcuccagcaccaccuccagcaagcccaagcugaagaagcgcuucucccuccggagcgucgggcgcuccgugcggggcagcgugcgcgggauccugcaguggcggggcacggucgacccccccuccagcgccggcccgcuggagaccuccagcgggccccccgugcucggcgggaacuccaacagcaacuccagcggcggcgcggggaccgugggccgcgggcuggucuccgacggcaccagccccggggagcgguggacgcaccgcuucgagcggcugcgccucucccggggcggcggggcccugaaggacggcgccgggauggugcagcgcgaggagcugcucagcuucaugggcgccgaggaggccgcgccggaccccgccggggugggccgcggcgggggcgucgccgggcccccgagcggcgggggcggccagccccaguggcagaagugccggcugcugcuccgcuccgagggggagggcgggggcggcagccggcuggaguucuucgugccccccaaggccucccgcccgcggcugagcauccccugcuccagcaucaccgacgugcgcaccaccacggcccucgagaugcccgaccgggagaacaccuucgucgugaagguggaggggcccuccgaguacaucauggagaccgucgacgcgcagcacgugaaggccugggugagcgacauccaggagugccuguccccgggccccugccccgccaccagcccccgcccgaugacgcugccccucgcccccgggaccuccuuccugacccgggagaacaccgacagccuggagcucuccugccugaaccacagcgagucccugcccagccaggaccuccugcugggcccguccgagagcaacgaccgccucagccagggggcguacggcggccuguccgaccggcccagcgccuccaucagccccuccagcgccuccaucgccgccagccacuucgacuccauggagcugcuccccccggagcugcccccccgcauccccaucgaggaggggccgcccacgggcaccguccacccccugagcgcgccguaccccccccucgacacccccgagaccgccacgggguccuuccuguuccagggcgagccggaggggggcgagggcgaccagccccugagcggguaccccugguuccacggcaugcugucccggcucaaggccgcccagcuggugcugaccgggggcaccgggagccacggcguguuccucguccgccaguccgagacccggcgcggcgaguacgugcugacguucaacuuccaggggaaggccaagcaccugcggcucagccugaacgaggagggccagugccgcguccagcaccugugguuccaguccaucuucgacaugcucgagcacuuccgggugcaccccaucccgcuggagagcgggggcuccagcgacgugguccuggugagcuacgugcccuccagccagcgccagcaggagcccaccaccucccacgaccccccgcagccccccgagcccccgagcuggaccgaccccccccagcccggggcggaggaggccucccgcgccccggaggucgccgccgcggccgccgccgcggccaaggagcggcaggagaaggagaaggccggcggcgggggcgugcccgaggagcucgugcccgucguggagcuggugcccgucguggagcuggaggaggccaucgccccggggagcgaggcgcagggcgccggcuccgggggcgacgccggggugccccccaugguccagcuccagcagagcccccugggcggggacggcgaggagggcgggcacccgcgcgccaucaacaaccaguacuccuucguguga

SEQ ID NO: 36324 - RNA, 2028 nt, Artificial Sequence
  derived and/or modified sequence opt1 from SH2B2__Homo_sapiens__NP_066189
auggaccccagcuacugccccgcccacggcuuccccucccaggacccccuguggccccucagcucccagcaguggagcuccgcccacuacagcgagccggcggccgggggcugcgacgggaccgaggccaugaacggcgccgggcccggccccgccgcggccgcccccgugccgguccccgugcccgugcccgacuggcgccaguucugcgagcugcacgcccaggcggccgccgucgacuucgcccacaaguucugccgguuccugcgcgacaacccggccuacgacacccccgacgcgggcgccuccuucagccggcacuucgccgccaacuuccucgacguguucggggaggaggugcgccggguccugguggccggccccacgacccgcggggcggccguguccgccgaggccauggagcccgagcuggccgacaccagcgcgcucaaggccgccccguacggccacucccggagcuccgaggacgucagcacccacgccgccacgaaggcgcgcgugcggaagggguucucccugcgcaacaugagccugugcguggucgacggcgugcgggacauguggcaccgccgggccucccccgagcccgacgccgccgcggcgccccgcaccgccgagccgcgggacaaguggacccgccggcuccgccugagccggacccuggccgccaagguggagcucgucgacauccagcgcgagggcgcccugcgguucaugguggccgacgacgccgccgccggguccggcgggagcgcgcaguggcagaagugccgccugcuccugcgccgggccguggccgaggagcgcuuccggcuggaguucuucgucccgcccaaggccagccgccccaagguguccaucccccucagcgccaucaucgaggugcggacgaccaugccccuggagaugcccgagaaggacaacaccuucguccugaagguggagaacggcgcggaguacauccucgagaccaucgacucccugcagaagcacagcuggguggccgacauccagggcugcgucgaccccggggacuccgaggaggacacggagcugagcugcacccgcggcgggugccucgccucccggguggccagcugcuccugcgagcugcugaccgacgcggucgaccucccgcgcccgcccgagaccacggccgugggcgccguggucaccgcgccccacagccgggggcgcgacgccgugcgggagucccugauccacgugccccuggagaccuuccuccagacccuggagagccccggcggcuccgggagcgacuccaacaacacgggcgagcagggggccgagaccgaccccgaggccgagccggagcuggagcucagcgacuaccccugguuccacggcacccugucccgcgucaaggccgcccagcuggugcucgccgggggcccccggaaccacggccuguucgugauccgccagagcgagacccggcccggggaguacguccugacguucaacuuccagggcaaggcgaagcaccuccgccugucccugaacgggcacggccagugccacgugcagcaccucugguuccagagcgugcuggacaugcugcggcacuuccacacccacccgaucccccucgagagcgggggcuccgccgacaucacccugcgcagcuacguccgggcccaggacccgccgcccgagcccggccccacgccgcccgccgcccccgcgucccccgccugcuggagcgacucccccgggcagcacuacuucagcucccuggccgccgcggccugcccgcccgccagccccuccgacgccgccggcgcgagcuccagcuccgccagcuccagcuccgccgccagcgggcccgccccgccccgccccguggagggccagcucagcgcgcgcucccggagcaacuccgccgagcgccugcuggaggccguggccgccaccgcggccgaggagccgcccgaggccgcccccggccgggcccgcgcggucgagaaccaguacagcuucuacuga

SEQ ID NO: 36325 - RNA, 1122 nt, Artificial Sequence
  derived and/or modified sequence opt1 from SH2B3__Homo_sapiens__NP_001278353
augggcuuccccgugcugugccgcggguggcggcgcaccuggccgggcugcgccagcuggcucggggccccgccgccccagaagccccugcugagcccccuccugcugaaccaccgguccuccaagagcucccgccccaagcuccaggcggccugcagcuccauccaggagguccgguggugcacccgccuggagaugcccgacaaccuguacaccuucgugcucaaggugaaggaccggaccgacaucaucuucgaggucggcgacgagcagcagcugaacagcuggauggccgagcuguccgagugcaccgggcgcggccucgagagcaccgaggccgagaugcacauccccuccgcccuggagcccagcacguccagcagcccccggggcuccaccgacucccugaaccagggggcgagccccggcgggcuccuggacccggccugccagaagaccgaccacuuccuguccugcuaccccugguuccacggccccaucagccgcgugaaggccgcccagcucgugcagcugcaggggcccgacgcgcacggcgucuuccuggugcggcagagcgagacccgccggggcgaguacgugcucacguucaacuuccaggggaucgccaagcaccuccgccugucccugaccgagcggggccagugccgcguccagcaccuccacuucccgagcgugguggacaugcugcaccacuuccagcggucccccaucccccuggagugcggggccgccugcgacguccgccugagcuccuacgugguggucgugagccagcccccgggcuccugcaacaccgugcuguuccccuucagccucccccacugggacuccgagagccugccccacuggggcuccgagcuggggcucccgcaccugagcuccagcggcugcccccgggggcugucccccgagggccuccccgggcgcagcuccccgcccgagcagaucuuccaccugguccccagcccggaggagcuggccaacucccuccagcaccuggagcacgagcccgugaaccgggcgcgcgacagcgacuacgagauggacagcuccagccgcucccaccuccgggccaucgacaaccaguacacgccccuguga

SEQ ID NO: 36326 - RNA, 378 nt, Artificial Sequence
  derived and/or modified sequence opt1 from SH2D1A__Homo_sapiens__NP_001108409
auggacgccguggccgucuaccacggcaagaucagccgcgagaccggggagaagcugcuccuggcgaccggccuggacggguccuaccuccugcgggacagcgaguccgugcccggcguguacugccugugcguccucuaccacggguacaucuacacguaccgcgugagccagaccgagaccggcuccuggagcgccgagaccgccccgggcgugcacaagcgguacuuccgcaagaucaagaaccugaucuccgccuuccagaagcccgaccaggggaucgucaucccccugcaguaccccguggagaagaaguccagcgcccggagcacgcagggcauccgcgaggacccggacgugugccucaaggcgcccuga

SEQ ID NO: 36327 - RNA, 1200 nt, Artificial Sequence
  derived and/or modified sequence opt1 from SH2D2A__Homo_sapiens__NP_001154913
auggaguucccccuggcccagaucugcccccagggcagccacgaggcccccauccccaccuucuccaccuuccagaucacggacaugacccgccggagcugccagaaccucggguacaccgcggccagcccccaggccccggaggccgccuccaacaccggcaacgcggagcgcgccgaggaggugcccggggagggcucccuguuccugcaggccgagacgcgggccugguuccagaagacccaggcgcacuggcuccugcagcacggggccgcccccgccugguuccacggcuucaucacccgccggguccggcccccgcugagcgugacccaccgcgaggccgagcgccuccuggagcccaagccccagggcugcuaccuggugcgguucuccgagagcgcggucacguucgugcucaccuaccgcucccggaccugcugccgccacuuccugcuggcccagcuccgggacgggcgccacgugguccugggcgaggacagcgcccacgcccggcugcaggaccuccugcugcacuacaccgcccacccccucuccccguacggggagacgcugaccgagccccuggcgcgccagacccccgagcccgccggccucagccugcggaccgaggaguccaacuucgggagcaagucccaggacccgaacccccaguacagccccaucaucaagcagggccaggcccccgugccgaugcagaaggagggcgccggggagaaggagcccucccagcugcuccgccccaagcccccgauccccgccaagccccagcugcccccggagguguacacgauccccgucccccggcaccgcccggcgccccggcccaagcccagcaacccgaucuacaacgagcccgacgagcccaucgccuucuacgccaugggccgcgggucccccggcgaggccccgagcaacaucuacguggagguggaggacgagggccugcccgccacccucgggcaccccguccugcgcaagagcuggucccggcccgugccgggcgggcagaacaccggcgggagccagcugcacuccgagaacagcgugaucggccagggcccgccccucccccaccagcccccgcccgcguggcgccacacccugccccacaaccugucccggcagguccuccaggaccgcgggcaggccuggcugccccugggcccgccccaguga

SEQ ID NO: 36328 - RNA, 1731 nt, Artificial Sequence
  derived and/or modified sequence opt1 from SH2D3A__Homo_sapiens__NP_005481
augcaggucccccaggacggcgaggaccuggccgggcagccgugguaccacggccuccugagccgccagaaggccgaggcgcugcuccagcagaacggggacuuccuggugcgggccuccggcagccgcgggggcaaccccgugaucuccugccgguggcgcggcagcgcccugcacuucgagguguuccgggucgcccuccgcccccggcccgggcgcccgaccgcccuguuccagcuggaggacgagcaguuccccuccauccccgcgcucgugcacagcuacaugaccggccggcgcccccugucccaggccacgggggccguggucagccggccggugaccuggcagggcccccugcgccgguccuucagcgaggacacccucauggacgggcccgcccgcaucgagccccugcgggcgcgcaagugguccaacagccagccggccgaccuggcccacaugggccggucccgcgaggaccccgccggcauggaggccagcaccaugcccaucuccgcgcucccccggacgagcuccgacccggugcugcugaaggcccccgccccgcucgggaccgucgccgacagccugcgcgccuccgacggccagcugcaggcgaaggcccccaccaagccgccccggacccccagcuucgagcuccccgacgccagcgagcgcccgcccacguacugcgagcuggugccccgcgugcccuccguccaggggaccagcccgucccagagcugccccgagcccgaggccccguggugggaggccgaggaggacgaggaggaggagaaccggugcuucacccgcccccaggcggagaucuccuucugcccccacgacgcccccagcugccugcucggcccgcagaaccggccccuggagccccaggugcugcacacccuccgcggccuguuccuggagcaccaccccggguccacggcccuccaccuccugcugguggacugccaggccaccggccugcugggggucacccgggaccagcgcggcaacaugggggugagcuccggccucgagcugcugacccucccgcacggccaccaccuccggcuggagcugcuggagcgccaccagacgcuggcccucgcgggggcccuggccgugcugggcugcagcgggccccucgaggagcgggccgcggcccugcgcggccuggucgagcuggcccucgcccugcggcccggggccgcgggcgaccugcccggccucgccgccgugaugggggcccugcugaugccccaggugucccgccucgagcacaccuggcggcagcugcgccggagccacaccgaggccgcgcuggccuucgagcaggagcucaagccccugaugcgcgcccuggacgagggcgccgggcccugcgaccccggcgaggucgcccucccgcacguggcgcccauggugcggcugcuggagggggaggaggucgccggcccccucgacgaguccugcgagcgccugcugcggacccuccacggcgcccgccacauggugcgcgacgcccccaaguuccggaaggucgcggcccagcgccugcggggguuccgcccgaaccccgagcugcgggaggcccucacgaccggcuucgugcgccggcugcugugggggagccgcggcgccggcgcgccccgggccgagcgcuucgagaaguuccagcgggugcucgggguccugucccagcgccuggagcccgaccgguga

SEQ ID NO: 36329 - RNA, 2109 nt, Artificial Sequence
  derived and/or modified sequence opt1 from SH2D3C__Homo_sapiens__NP_001136005
augaccgagcgcugcagccugugguccgcccucagcgccgcggccugcugcuucuaccggggcuccuucgugcagguccaguucagcaaggagaaguacauccuggacuccagccccgagaagcugcacaaggagcucgaggaggagcugaagcuguccagcaccgaccuccgcucccacgccugguaccacgggcggaucccgcgcgaggugagcgagacgcuggugcagcggaacggcgacuuccugauccgcgacucccucaccagccugggggacuacguccugaccugccgguggcgcaaccaggcccuccacuucaagaucaacaaggugguggucaaggccggcgaguccuacacccacauccaguaccuguucgagcaggagagcuucgaccacgugcccgcgcuggugcgguaccacgucgggucccgcaaggccgugagcgagcaguccggcgccaucaucuacugccccgugaaccggacguucccccuccgcuaccuggaggccagcuacggccuggggcagggcuccagcaagccggcgagccccgucucccccagcgggcccaagggcucccacaugaagcggcgcagcgugaccaugaccgacgggcucaccgccgacaaggugacgcgguccgacggcugcccgaccagcaccucccugccccgcccccgggacagcauccgcuccugcgcccugagcauggaccagauccccgaccuccacuccccgaugagccccaucuccgagagccccuccagccccgccuacuccaccgucacgcgggugcacgccgcgccggccgcccccagcgccaccgcccugcccgcgucccccguggcccgccggagcagcgagccgcagcugugccccggcuccgcccccaagacccacggggagagcgacaagggcccccacaccuccccgagccacacgcucgggaaggccucccccagccccucccugagcuccuacagcgaccccgacuccggccacuacugccagcugcagccgcccguccgcggcagccgcgagugggccgcgaccgagaccuccagccagcaggcccgguccuacggggagcgccucaaggagcugagcgagaacggcgcccccgagggggacuggggcaagaccuucacggugccgaucguggaggucaccuccagcuucaaccccgccaccuuccagagccugcucaucccccgggacaaccgcccccuggagguggggcugcuccggaaggugaaggagcugcuggccgaggucgacgcgcgcacccucgcccggcacgugacgaaggucgacugccugguggcccgcauccugggcgugaccaaggagaugcagacccucaugggcguccggugggggauggagcugcugacccucccgcacggccgccagcugcggcuggaccuccuggagcgcuuccacacgauguccaucaugcuggccguggacauccucgggugcaccggcagcgcggaggagcgggccgcccugcugcacaagaccauccagcuggccgccgagcuccgcgggaccaugggcaacauguucuccuucgcggccgugaugggcgcccuggacauggcccagaucagccggcuggagcagacgugggucacccuccgccagcggcacaccgagggggccauccuguacgagaagaagcugaagcccuuccucaagucccugaacgagggcaaggaggggccgccccugagcaacaccacguucccccacgugcucccccugaucacccugcucgagugcgacuccgcgccgcccgagggccccgagcccugggggagcaccgagcacggcguggaggucgugcuggcccaccuggaggccgcccgcaccguggcccaccacggcgggcucuaccacaccaacgcggaggucaagcugcagggcuuccaggcccggcccgagcugcucgagguguucuccacggaguuccagaugcgccugcugugggggagccagggcgccuccagcucccaggcccgccgguacgagaaguucgacaaggugcucaccgcgcugagccacaagcuggagcccgccguccgcuccagcgagcucuga

SEQ ID NO: 36330 - RNA, 1365 nt, Artificial Sequence
  derived and/or modified sequence opt1 from SH2D4A__Homo_sapiens__NP_001167630
augcugaagcagauccucagcgagauguacaucgaccccgaccugcuggccgagcucuccgaggagcagaagcagauccuguucuucaagaugcgcgaggagcagauccggcgcuggaaggagcgggaggccgcgauggagcgcaaggagagccugccggugaagccccggcccaagaaggagaacggcaaguccguccacuggaagcucggggccgacaaggaggugugggugugggucaugggcgagcaccaccuggacaagcccuacgacgugcugugcaacgagaucaucgccgagcgcgcccggcucaaggccgagcaggaggcggaggagccgcgcaagacccacagcgaggaguucaccaacucccugaagaccaagagccaguaccacgaccugcaggcccccgacaaccagcagacgaaggacaucuggaagaagguggccgagaaggaggagcucgagcaggggucccggcccgcccccacccuggaggaggagaagauccgcagccuguccagcuccagccggaacauccagcagaugcucgcggacuccaucaaccgcaugaaggccuacgccuuccaccagaagaaggagagcaugaagaagaagcaggacgaggagaucaaccagaucgaggaggagcggaccaagcagaucugcaaguccuggaaggaggacagcgaguggcaggccucccugcgcaagagcaaggccgcggacgagaagcggcgcucccuggccaagcaggcccgggaggacuacaagcgccucagccugggcgcccagaaggggcggggcggcgagcgccugcagagcccgcuccgggucccccagaagcccgagcggcccccgcugccgcccaagccccaguuccugaacuccggggccuacccccagaagccccuccgcaaccagggcguggugcgcacgcugagcuccagcgcgcaggaggacaucauccgcugguucaaggaggagcagcugccccuccgggccggguaccagaagaccuccgacaccaucgcccccugguuccacggcauccugacccugaagaaggccaacgagcuccugcugagcacggggaugccgggcuccuuccucauccgcgucagcgagcggaucaagggcuacgcccuguccuaccugagcgaggacgggugcaagcacuuccucaucgacgcguccgccgacgccuacagcuuccugggcguggaccagcugcagcacgccacccucgccgaccugguggaguaccacaaggaggagcccaucaccucccuggggaaggagcuccugcuguaccccugcggccagcaggaccagcuccccgacuaccuggagcuguucgaguga

SEQ ID NO: 36331 - RNA, 930 nt, Artificial Sequence
  derived and/or modified sequence opt1 from SH2D4B__Homo_sapiens__NP_001139191
augcugcccgaggacagcggcggguccccggacgccgccgcgagcgacaagcacauccaguggcuccugggcgccgacggggaggugugggucuggaucaugggcgaggggcccggcgacaagcccuacgaggagaucuccgaggagcugaucgccgagcgcgcccggcuccaggcccagcgcgaggcggaggagcuguggcggcagaaggaggccgagaucaccaagaaguuccgcgacgcccuggccaacgagaaggcgcggauccucgccgagaaguggaagguggagauggaggaccgcaaggccgccaaggugcuggaggagcggauccacgaggaguucaagcgcaaggaggaggaggagcggaagcgcggcgaggagcagauccggcugcaggaggagcagcgcgccaaggagcucuacuggacccugaagcaggcgcagcugcacugccaggccagcgagaaggaggagcgggagugggaggagcagcuccgccgguccaaggccgccgacgaggagcgcagccggcgcgcccagcgggcgcgcgacgaguaccggcaccacucccugcgcgccauccagaaggggacggucgccggccugagcuccauguuccgcgagcucgggcagagccacgagcaggaggcccggcuguaccaccaccuccccgacccgggccugccccagccccuggcccugcccgugucccgcaccugggagcggccgcuccgccccgugagccgggacgucaucgugcgcugguucaaggaggagcagcugccccggcgcgcgggguucgagcggaacaccaaguucaucgcccccugguuccacggcggcaacuaccacugcuuccgccggcgcgugaccuccgggacgcugcggaccgagggccagccgacccgccuccccagcgucguguga

SEQ ID NO: 36332 - RNA, 387 nt, Artificial Sequence
  derived and/or modified sequence opt1 from SH3BGR__Homo_sapiens__NP_001001713
augcgcgagaacgugcccggcgagaagaagccgcagaacgggaucccccugccgccccagaucuucaacgaggagcaguacugcggcgacuucgacagcuucuucuccgccaaggaggagaacaucaucuacagcuuccucgggcuggcgcccccgcccgacuccaagggcagcgagaaggccgaggagggcggggagaccgaggcccagaaggagggcuccgaggacgucgggaaccugcccgaggcccaggagaagaacgaggaggagggcgagaccgccacggaggagaccgaggagaucgccauggagggggcggagggcgaggccgaggaggaggaggagaccgccgagggggaggagcccggcgaggacgaggacagcuga

SEQ ID NO: 36333 - RNA, 324 nt, Artificial Sequence
  derived and/or modified sequence opt1 from SH3BGRL2__Homo_sapiens__NP_113657
auggugauccgcgucuucaucgccagcuccagcggcuucguggccaucaagaagaagcagcaggacgugguccgguuccuggaggcgaacaagaucgaguucgaggagguggacaucaccauguccgaggagcagcgccaguggauguacaagaacgugcccccggagaagaagcccacccaggggaacccccugcccccgcagaucuucaacggcgaccgguacugcggggacuacgacagcuucuucgaguccaaggagagcaacacggucuucuccuuccucggccugaagccccgccucgccagcaaggccgagcccuga

SEQ ID NO: 36334 - RNA, 345 nt, Artificial Sequence
  derived and/or modified sequence opt1 from SH3BGRL__Homo_sapiens__NP_003013
auggugauccgcgucuacaucgccagcuccagcggcuccaccgccaucaagaagaagcagcaggacgugcugggguuccucgaggcgaacaagaucggcuucgaggagaaggacaucgccgccaacgaggagaaccggaaguggaugcgcgagaacgugcccgagaacagccggcccgccaccggguacccccugccgccccagaucuucaacgagucccaguaccgcggcgacuacgacgccuucuucgaggcgcgggagaacaacgccgucuacgccuuccuggggcucacggccccgcccggcagcaaggaggcggaggugcaggccaagcagcaggccuga

SEQ ID NO: 36335 - RNA, 2106 nt, Artificial Sequence
  derived and/or modified sequence opt1 from SH3BP1__Homo_sapiens__NP_061830
augaugaagcgccagcugcaccggaugcgccagcucgcccagaccggcagccuggggcggacccccgagacggccgaguuccugggcgaggaccuccugcagguggagcagcgccuggagccggcgaagcgggccgcccacaacauccacaagcgccuccaggccugccugcaggggcaguccggcgccgacauggacaagcgggucaagaagcugccccucauggcgcugagcaccaccauggccgaguccuucaaggagcuggaccccgacagcuccauggggaaggcccucgagaugagcugcgccauccagaaccagcuggcgcgcauccuggccgaguucgagaugacccucgagcgggacgugcugcagccccugucccgccucagcgaggaggagcugccggccauccugaagcacaagaagucccuccagaagcuggugagcgacuggaacacgcugaagucccggcucagccaggccaccaagaacuccggcagcucccagggccuggggggcagccccgggucccacagccacaccaccauggccaacaaggucgagacgcugaaggaggaggaggaggagcucaagcgcaagguggagcagugccgggacgaguaccuggcggaccuguaccacuucgugaccaaggaggacuccuacgccaacuacuucauccgccuccuggagauccaggccgacuaccaccggcgcagccugagcucccucgacaccgcccuggccgagcugcgggagaaccacggccaggcggaccacagccccuccaugaccgccacgcacuucccccgcgucuacggggugagccucgccacccaccugcaggagcugggccgggagaucgcccucccgaucgaggccugcgugaugaugcugcuguccgagggcaugaaggaggaggggcucuuccgccuggcggccggcgccagcguccugaagcggcucaagcagaccauggccuccgacccccacagccuggaggaguucugcuccgacccccacgccguggcgggggcccugaagagcuaccuccgcgagcugcccgagccgcugaugaccuucgaccuguacgacgacuggaugcgcgccgccucccucaaggagcccggcgcgcggcugcaggcccugcaggaggugugcagccgccucccccccgagaaccuguccaaccugcgguaccucaugaaguuccuggcccgccuggccgaggagcaggaggucaacaagaugacgccgagcaacaucgccaucgugcucggccccaaccugcuguggccccccgagaaggagggggaccaggcgcagcucgacgccgccuccgugagcuccauccaggucgugggcguggucgaggcccugauccagagcgccgacacccuguucccgggggacaucaacuucaacguguccggccucuucagcgcggugacccugcaggacaccgucagcgaccggcuggccuccgaggagcuccccagcacggccgugcccacccccgccaccaccccggcccccgcgcccgcccccgccccggcccccgcgcccgcccuggccuccgccgccacgaaggagcgcaccgagagcgaggugccgccccggcccgcgucccccaaggucacccgcagcccgcccgagaccgccgcccccguggaggacauggcccggcgcacgaagcggcccgccccggcgcgccccaccaugccccccccgcaggucuccgggagccgguccagcccccccgcccccccgcugccccccggcuccggcagccccgggaccccgcaggcccucccccgccggcuggugggcuccagccugcgcgcccccaccgugcccccgccccuccccccgacgcccccccagcccgcccggcgccagucccggcgcagcccggcgucccccagccccgccagccccgggccggccucccccagccccgucucccugagcaaccccgcccagguggaccugggcgcggccaccgccgaggggggcgccccggaggccaucuccggcgugcccaccccccccgcgaucccgccccagccccgcccccggagccucgccuccgagaccaacuga

SEQ ID NO: 36336 - RNA, 1770 nt, Artificial Sequence
  derived and/or modified sequence opt1 from SH3BP2__Homo_sapiens__NP_001139327
auggccagccugggcccccgcaccccggcccccucccggagccgcgggcggcgcgcgaugugcuggguguccaccaucagcuucauggccgccgaggagaugcacuggcccguccccaugaaggccaucggcgcccagaaccuccugacgaugccggggggcguggcgaaggccggguaccugcacaagaagggcggcacccagcuccagcugcugaaguggccccuccgguucgugaucauccacaagcgcugcgucuacuacuucaaguccagcaccuccgccagcccccagggggccuucucccugagcggcuacaaccgggugaugcgcgcggccgaggagaccacguccaacaacguguuccccuucaagaucauccacaucagcaagaagcaccggaccugguucuucuccgccagcuccgaggaggagcgcaagagcuggauggcccugcuccggcgcgagaucgggcacuuccacgagaagaaggaccugccgcuggacaccuccgacagcuccagcgacaccgacagcuucuacggcgccgucgagcggcccguggacaucucccucagccccuaccccacggacaacgaggacuacgagcacgacgacgaggacgacuccuaccuggagccggacagccccgagcccgggcgccuggaggacgcgcucaugcaccccccggccuaccccccccccccggugcccaccccccggaagcccgccuucuccgacaugccgcgcgcccacagcuucaccuccaagggccccggcccccugcugcccccgccccccccgaagcacgggcuccccgacgucggccuggccgcggaggacagcaagcgggacccccugugcccccgccgggccgagccgugcccccgcgugcccgccaccccccggcgcauguccgacccgccccucagcacgaugcccaccgcccccgggcugcgcaagccgcccugcuuccgggaguccgccagccccucccccgagccguggacccccggccacggcgcgugcagcaccuccagcgccgccaucauggccacggccaccucccgcaacugcgacaagcugaagagcuuccaccucuccccccgggggcccccgaccagcgagcccccccccgugccggcgaacaagcccaaguuccugaagaucgccgaggaggaccccccgcgcgaggccgccaugcccggccuguucgucccccccguggcgccgcggccccccgcccucaagcugcccgugccggaggccauggcccgccccgccguccugccccggcccgagaagccgcagcucccccaccugcagcgcagcccccccgacgggcaguccuuccggagcuucuccuucgagaagccgcgccagcccagccaggcggacaccggcggggacgacuccgacgaggacuacgagaaggugccccugcccaacagcguguucgucaacacgaccgaguccugcgagguggagcggcucuucaaggccaccagcccgcgcggcgagccccaggacggccuguacugcauccggaacuccagcaccaaguccgggaaggugcuggucgugugggacgagacgagcaacaaggugcgcaacuaccggaucuucgagaaggacuccaaguucuaccucgagggcgagguccuguucgugagcgucggguccaugguggagcacuaccacacccacgugcugcccagccaccagucccuccugcugcgccaccccuacggcuacaccgggccgcgguga

SEQ ID NO: 36337 - RNA, 2892 nt, Artificial Sequence
  derived and/or modified sequence opt1 from SH3BP4__Homo_sapiens__XP_011509196
auggccgcccagcgcauccgggcggccaacagcaacggccugccccgcugcaaguccgaggggacccucaucgaccugagcgagggcuucuccgagaccagcuucaacgacaucaaggugccgucccccagcgcccugcucgucgacaaccccacgcccuucgggaacgccaaggaggugaucgccaucaaggacuacugcccgaccaacuucaccacccugaaguucuccaagggcgaccaccuguacgugcucgacacgagcgggggcgaguggugguacgcgcacaacaccaccgagaugggcuacauccccuccagcuacguccagccccugaacuaccggaacuccacccugagcgacuccgggaugaucgacaaccuccccgacagcccggacgagguggccaaggagcuggagcugcucggcggguggacggacgacaagaaggugcccggccgcauguacuccaacaaccccuucuggaacgggguccagaccaaccccuuccugaacggcaacgugccggugaugcccagccuggacgagcucaaccccaaguccaccgucgaccugcuccuguucgacgccggcaccagcuccuucacggagagcagcuccgccaccaccaacagcaccgggaacaucuucgacgagcugcccgugacgaacggccugcacgcggagccgcccgugcggcgcgacaaccccuucuuccgguccaagcgcagcuacucccucagcgagcuguccguccugcaggccaagagcgacgcccccaccuccagcuccuucuucaccgggcucaagagcccggcccccgagcaguuccagucccgggaggacuuccgcaccgccuggcugaaccaccggaagcuggcgcgcagcugccacgaccucgaccugcugggccagucccccggcugggggcagacgcaggccguggagaccaacaucgugugcaagcucgacagcuccggcggggccguccagcugcccgacaccagcaucuccauccacgugccggagggccacguggcccccggggagacccagcagaucagcaugaaggcccugcucgacccgccccuggagcugaacagcgaccgguccugcagcaucucccccguccucgaggugaagcugagcaaccuggaggugaagacguccaucauccucgagaugaaggucagcgcggagaucaagaacgaccuguucuccaagagcaccgugggccugcagugccuccgcuccgacagcaaggagggccccuacguguccgucccccugaacugcagcugcggggacaccgugcaggcccagcugcacaaccucgagccgugcauguacgucgccgugguggcccacggccccuccauccuguaccccagcaccgucugggacuucaucaacaagaaggugacgguggggcuguacggccccaagcacauccacccguccuucaagaccgucgugaccaucuucgggcacgacugcgcccccaagacccuccuggugagcgaggucacgcggcaggcgcccaaccccgccccgguggcccugcagcuguggggcaagcaccaguucgugcucucccgcccccaggaccugaaggucugcauguucagcaacaugaccaacuacgaggugaaggccagcgagcaggccaaggugguccggggcuuccagcugaagcucgggaaggugucccgccugaucuuccccaucaccagccagaaccccaacgagcuguccgacuucacccuccgggugcaggucaaggacgaccaggaggcgauccugacgcaguucugcgugcagaccccgcagcccccgcccaagagcgccaucaagcccuccggccagcgccgguuccugaagaagaacgagguggggaagaucauccucagccccuucgccaccaccaccaaguaccccacguuccaggaccgccccgucuccagccugaaguucggcaagcugcucaagaccguggugcgccagaacaagaaccacuaccugcuggaguacaagaagggggacggcaucgcccuccuguccgaggagcggguccgccugcggggccagcucuggaccaaggagugguacaucggguacuaccagggccgcguggggcuggugcacaccaagaacguccugguggugggccgggcgcgcccgagccucugcuccggccccgagcugagcacguccguccugcucgagcagauccugcggcccugcaaguuccugaccuacaucuacgccagcgugcgcacccuccugauggagaacaucuccagcuggcgguccuucgccgacgcccugggguacgugaaccucccccugaccuucuucugccgcgccgagcuggacagcgagccggagcgggucgcguccgugcucgagaagcugaaggaggacugcaacaacacggagaacaaggagcgcaagagcuuccagaaggagcuggugauggcccuccugaagauggacugccagggccuggucgugcggcucauccaggacuucgugcugcugaccaccgccgucgagguggcccagcgcuggcgggagcucgccgagaagcuggcgaaggugagcaagcagcagauggacgccuacgagagcccccaccgcgaccggaacggggucguggacuccgaggccauguggaagcccgccuacgacuuccugcucaccuggucccaccagaucggcgacagcuaccgcgacgugauccaggagcugcaccuggggcucgacaagaugaagaacccgaucacgaagcgguggaagcaccugaccggcacccugauccucgucaacucccuggacgugcugcgcgccgcggccuucagccccgccgaccaggacgacuucgugaucuga

SEQ ID NO: 36338 - RNA, 897 nt, Artificial Sequence
  derived and/or modified sequence opt1 from SH3BP5__Homo_sapiens__NP_001018009
augcugaaccacgccacccagcgcgugauggaggccgagcagaccaagacgcggagcgagcucguccacaaggagaccgcggcccgcuacaacgccgccaugggccggaugcgccagcuggagaagaagcugaagcgggccaucaacaaguccaagcccuacuucgagcucaaggcgaaguacuacgugcagcuggagcagcugaagaagaccguggacgaccuccaggccaagcugacccuggccaagggggaguacaagauggcccucaagaaccuggagaugaucagcgacgagauccacgagcgccggcgcuccagcgcgaugggcccgcgggggugcggcgucggggccgagggcuccagcacguccguggaggaccugcccggcagcaagcccgagcccgacgccaucuccguggccagcgaggccuucgaggacgacuccugcagcaacuucgucuccgaggacgacagcgagacccaguccgugagcuccuucagcuccgggccgaccagccccagcgagaugcccgaccaguuccccgcggugguccgcccgggcucccucgaccugcccagccccgugucccugagcgaguucgggaugauguuccccgugcucggcccgcgguccgagugcagcggggccuccagccccgagugcgaggucgagcgcggcgaccgggccgagggcgccgagaacaagaccuccgacaaggccaacaacaaccgcgggcugagcuccagcuccggcagcgggggcuccagcaagucccagagcuccacgagccccgagggccaggcgcuggagaaccggaugaagcagcucagccugcagugcuccaaggggcgcgacggcaucaucgccgacaucaagauggugcagaucggguga

SEQ ID NO: 36339 - RNA, 2373 nt, Artificial Sequence
  derived and/or modified sequence opt1 from SH3D19__Homo_sapiens__NP_001009555
augaacaucaugaacaccgagcagagccagaacuccaucgugagccgcaucaaggucuucgagggccagaccaacaucgagacguccgggcugcccaagaagccggagaucaccccccggagccucccccccaagccgaccguguccagcggcaagcccuccguggcccccaagcccgccgcgaaccgcgccagcggggagugggacuccggcaccgagaaccggcugaaggucacgagcaaggaggggcugaccccguaccccccccuccaggaggccggcuccauccccgugaccaagccggagcugcccaagaagcccaaccccggccugauccgcagcgugaacccggagauccccgggcggggcccccucgccgaguccagcgacuccgggaagaagguccccaccccggccccccgcccccugcugcucaagaagagcguguccagcgagaaccccacguacccguccgcgccccugaagcccgugaccguccccccgcggcuggccggcgccagccaggccaaggcguacaagagccucggggagggcccccccgccaacccgcccgugcccgugcugcaguccaagccccuggucgacaucgaccucaucagcuucgacgacgacgugcugccgacccccuccggcaaccuggccgaggagagcgugggguccgagaugguccucgaccccuuccagcugcccgccaagaccgagccgaucaaggagcgcgccgugcagcccgcgcccacgcggaagcccaccgugauccgcaucccggccaagcccggcaagugccugcacgaggacccccagagccccccgccccuccccgccgagaagcccaucgggaacaccuucuccaccgucagcggcaagcuguccaacguggagcggacgcgcaaccuggagagcaaccacccgggccagaccgggggcuucgugcggguccccccccgccuccccccgcggcccgugaacgggaagaccauccccacccagcagccgcccacgaaggugccccccgagcgcccgcccccccccaagcuguccgccacccggcgcagcaacaagaagcugccguucaaccgguccagcuccgacauggaccuccagaagaagcagagcaaccuggccaccggccuguccaaggcgaagagccaggucuucaagaaccaggaccccgugcuccccccccgcccgaagcccgggcacccccuguacuccaaguacaugcugagcgucccccacggcaucgccaacgaggacaucgugagccagaacccgggcgagcucuccugcaagcggggggacgugcuggucaugcugaagcagaccgagaacaacuaccucgagugccagaagggcgaggacacggggcgcgugcaccugagccagaugaagaucaucaccccccuggacgagcaccuccgcucccggcccaacgaccccagccacgcccagaagccgguggacuccggcgccccccacgccgucgugcugcacgacuuccccgcggagcagguggacgaccugaaccucaccagcggggagaucgucuaccugcuggagaagaucgacaccgacugguaccgcggcaacugccggaaccagaucggcaucuuccccgccaacuacgugaaggugaucaucgacaucccggaggggggcaacgggaagcgcgagugcgucuccagccacugcgugaagggcucccggugcguggcccgcuucgaguacaucggggagcagaaggacgagcucagcuucuccgagggcgagaucaucauccugaaggaguacgucaacgaggagugggcccggggcgaggugcgcgggcggacgggcaucuucccccugaacuucguggagcccgucgaggacuaccccaccagcggggccaacgugcucuccaccaaggugccgcugaagaccaagaaggaggacagcggcuccaacagccaggucaacucccugcccgcggaguggugcgaggcccugcacagcuucacggccgagaccagcgacgaccucuccuucaagcgcggcgaccggauccagauccuggagcgccuggacagcgacuggugccgggggcgccuccaggaccgggagggcaucuuccccgccguguucgugcgcccgugccccgcggaggccaaguccaugcuggccaucguccccaaggggcggaaggccaaggcccuguacgacuuccgcggcgagaacgaggacgagcucagcuucaaggcgggggacaucaucaccgagcuggaguccguggacgacgacuggaugagcggcgagcugaugggcaaguccgggaucuuccccaagaacuacauccaguuccuccagaucagcuga

SEQ ID NO: 36340 - RNA, 963 nt, Artificial Sequence
  derived and/or modified sequence opt1 from SH3GL1__Homo_sapiens__NP_001186872
augagcguggccggccugaagaagcaguucuacaaggccucccagcucgucagcgagaaggucgggggcgcggaggggaccaagcuggacgacgacuucaaggagauggagaagaagguggacgugaccuccaaggccgugacggaggugcuggcccgcaccaucgaguaccuccagcccaacccgggcgacgcccugcuggacgccggggagagcaugaagcggcucgcggaggucaaggacucccuggacaucgaggugaagcagaacuucaucgacccccugcagaaccucugcgagaaggaccugaaggagauccagcaccaccugaagaagcucgagggccgccggcuggacuucgacuacaagaagaagcgccagggcaagauccccgacgaggagcugcggcaggcccucgagaaguucgaggagagcaaggagguggccgagaccuccaugcacaaccugcuggagaccgacaucgagcaggucagccagcucuccgcccugguggacgcgcagcuggacuaccaccgccaggccgugcagauccucgacgagcuggccgagaagcugaagcggcgcaugcgggaggccagcucccgccccaagcgggaguacaagccgaagccccgcgagcccuucgaccucggggagcccgagcagagcaacggcggguucccgugcacgaccgcccccaagaucgcggccuccagcuccuuccggagcuccgacaagcccauccgcacccccagccgguccaugccgccccuggaccagcccagcugcaaggcccuguacgacuucgagcccgagaacgacggcgagcucggguuccacgagggcgacgucaucacccugacgaaccagaucgacgagaacugguacgagggcaugcuggacgggcagagcggcuucuucccgcucuccuacguggaggugcuggucccccugccccaguga

SEQ ID NO: 36341 - RNA, 1059 nt, Artificial Sequence
  derived and/or modified sequence opt1 from SH3GL2__Homo_sapiens__NP_003017
augagcguggccggccugaagaagcaguuccacaaggccacccagaaggucuccgagaaggucgggggcgcggaggggaccaagcucgacgacgacuucaaggagauggagcgcaagguggacgugacgagccgggccgugauggagaucaugaccaagaccaucgaguaccugcagcccaacccggccucccgcgccaagcugagcaugaucaacaccauguccaagauccggggccaggagaaggggcccggcuacccccaggccgaggcgcuccuggccgaggccaugcugaaguucggccgcgagcucggggacgacugcaacuucggccccgcccugggggaggugggcgaggcgaugcgggagcugagcgaggucaaggacucccucgacaucgaggugaagcagaacuucaucgacccgcugcagaaccugcacgacaaggaccuccgcgagauccagcaccaccugaagaagcuggaggggcggcgccucgacuucgacuacaagaagaagcggcagggcaagauccccgacgaggagcugcgccaggcccuggagaaguucgacgagagcaaggagaucgccgaguccagcauguucaaccuccuggagauggacaucgagcaggucucccagcugagcgcccucgugcaggcccagcuggaguaccacaagcaggcggugcagauccugcagcaggucacggugcggcucgaggagcgcauccggcaggccuccagccagccccgccgggaguaccagcccaagccgcgcaugucccuggaguuccccaccggcgacagcacccagcccaacgggggccugucccacaccgggacgcccaagccgagcggcgugcagauggaccagcccugcugccgggcccucuacgacuucgagcccgagaacgagggcgagcugggguucaaggagggcgacaucaucacccugaccaaccagaucgacgagaacugguacgaggggaugcuccacggccacuccggguucuuccccaucaacuacguggagauccuggucgcccugccgcacuga

SEQ ID NO: 36342 - RNA, 1068 nt, Artificial Sequence
  derived and/or modified sequence opt1 from SH3GL3__Homo_sapiens__NP_001288038
auggacggcaucuucgccgggaucaucugcaaccaggccaaccgcugccugaccuggaccagccagcagcuguucuccgagaagaucagcggcgcggaggggacgaagcucgacgacgaguuccuggacauggagcggaagaucgacgugaccaacaaggucguggccgagauccucuccaagaccaccgaguaccugcagcccaacccggccuaccgcgccaagcugggcaugcucaacacggugagcaagauccgggggcaggucaagaccaccggcuacccccagaccgagggccugcugggggacugcaugcucaaguacggcaaggagcugggggaggacuccacguucggcaacgcccugaucgaggugggggagagcaugaagcucauggcggaggugaaggacucccuggacaucaacgucaagcagaccuucaucgacccccugcagcuccugcaggacaaggaccugaaggagaucggccaccaccucaagaagcuggagggccgccggcuggacuacgacuacaagaagaagcgcguggggaagauccccgacgaggaggugcggcaggccgucgagaaguucgaggagagcaaggagcucgccgagcgcuccauguucaacuuccuggagaacgacguggagcaggucagccagcuggccguguucaucgaggcggcccucgacuaccaccggcaguccaccgagauccugcaggagcugcagagcaagcuccagaugcgcaucuccgccgccagcuccgugccgcggcgcgaguacaagccccggcccgugaagcgcagcuccagcgagcugaacggcgucuccaccacgagcguggugaagaccaccgggagcaacauccccauggaccagccgugcugccggggccuguacgacuucgagcccgagaaccagggcgagcucggguucaaggagggcgacaucaucacccugacgaaccagaucgacgagaacugguacgaggggaugauccacggcgaguccggguucuuccccaucaacuacgucgaggugaucgugccccugccgcaguga

SEQ ID NO: 36343 - RNA, 1887 nt, Artificial Sequence
  derived and/or modified sequence opt1 from SH3KBP1__Homo_sapiens__NP_001019837
auggaggugagcgccgccaaggcgcccuccgccgccgaccugagcgagaucgagaucaagaaggagaugaagaaggacccgcucaccaacaaggcccccgagaagccccugcacgagguccccuccggcaacagccugcucuccagcgagaccauccugcgcacgaacaagcgcggggagcggcggcgccggcgcugccagguggccuucuccuaccugccgcagaacgacgacgagcucgagcugaaggugggcgacaucaucgaggucgugggggagguggaggagggcuggugggaggggguccugaacggcaagaccggcauguuccccagcaacuucaucaaggagcucuccggggagagcgacgagcugggcaucucccaggacgagcagcugagcaaguccagccuccgggagaccaccggguccgagagcgacggcggggacuccagcuccaccaagagcgagggcgcgaacggcacgguggccaccgccgccauccagcccaagaaggugaagggggucggcuucggggacaucuucaaggacaagcccaucaagcugcgcccgcggagcaucgagguggagaacgacuuccugcccguggagaagaccaucggcaagaagcuccccgcgacgaccgccacccccgacuccagcaagaccgagauggacucccgcaccaagagcaaggacuacugcaaggucaucuucccguacgaggcccagaacgacgacgagcugacgaucaaggagggcgacaucgugacccugaucaacaaggacugcaucgacgugggguggugggagggcgagcucaacgggcggcgcggcgucuuccccgacaacuucgugaagcugcugccgcccgacuucgagaaggaggggaaccggcccaagaagcccccgccgcccuccgcccccgugaucaagcagggcgccggcaccacggagcgcaagcacgagaucaagaagaucccgcccgagcggcccgagaugcuccccaaccgcaccgaggagaaggagcggcccgagcgcgagcccaagcuggaccugcagaagcccagcguccccgcgaucccgcccaagaagccccggccgcccaagaccaacucccucagccgccccggggcccugccgccccggcgccccgagcgccccgugggcccccugacccacacgcgcggggacucccccaagaucgaccucgccggcagcucccugagcgggauccuggacaaggaccucuccgaccggagcaacgacaucgaccuggagggcuucgacuccguggucagcuccaccgagaagcugagccaccccaccaccucccggccgaaggccacgggccgccggccgcccagccagagccucaccuccagcucccugagcucccccgacaucuucgacagccccucccccgaggaggacaaggaggagcacaucagccuggcccaccgcgggguggacgcguccaagaagaccagcaagaccgugacgaucucccaggucagcgacaacaaggccucccucccgcccaagcccggcaccauggccgccgggggcgggggccccgcgccccugagcuccgccgcccccagcccgcuguccagcagccucggcaccgccgggcaccgggccaacucccccagccuguucggcaccgaggggaagcccaagauggagccggccgcguccagccaggccgccguggaggagcugcgcacgcagguccgggagcuccgcuccaucaucgagaccaugaaggaccagcagaagcgggagaucaagcagcugcugagcgagcucgacgaggagaagaagauccgccugcggcugcagauggaggugaacgacaucaagaaggcccuccaguccaaguga

SEQ ID NO: 36344 - RNA, 3318 nt, Artificial Sequence
  derived and/or modified sequence opt1 from SH3PXD2A__Homo_sapiens__NP_055446
augcuggccuacugcgugcaggacgccaccgucguggacguggagaagcgccggaaccccagcaagcacuacgucuacaucaucaacgugaccugguccgacagcacgucccagaccaucuaccgccgguacagcaaguucuucgaccuccagaugcagcugcuggacaaguucccgaucgagggcgggcagaaggaccccaagcagcgcaucauccccuuccuccccggcaagauccuguuccggcgcucccacauccgggacguggcggucaagcgccugaagccgaucgacgaguacugccgggcccucgugcgccugccgccccacaucagccagugcgacgagguguuccgguucuucgaggcccgccccgaggacgucaacccgcccaaggaggacuacggguccagcaagcggaaguccguguggcugagcuccugggccgagagccccaagaaggacgugaccggcgccgacgcgaccgccgagcccaugauccucgagcaguacgucgugguguccaacuacaagaagcaggagaacagcgagcugucccugcaggccggggaggucguggacgugaucgagaagaacgagagcggcuggugguucgucuccacgagcgaggagcagggcugggugcccgccaccuaccucgaggcgcagaacgggacccgcgacgacuccgacaucaacaccagcaagacgggcgaggaggagaaguacgugaccguccagcccuacaccagccaguccaaggacgagaucggguucgagaagggcgugaccguggaggucauccggaagaaccuggagggguggugguacauccgcuaccugggcaaggagggcugggcccccgccagcuaccucaagaaggccaaggacgaccugcccacgcggaagaagaaccuggccgggccgguggagaucaucggcaacaucauggagaucuccaaccuccugaacaagaaggcgagcggggacaaggagaccccgcccgccgagggcgagggccacgaggcccccaucgccaagaaggagaucucccugcccauccucugcaacgccagcaacggguccgcggucggcgugcccgaccgcaccgugagccggcuggcccaggggucccccgccgucgcccgcaucgcgccccagcgggcccagaucagcuccccgaaccugcgcacccgcccgccgccccggcgcgagagcucccucggcuuccagcugcccaagccgcccgagccgcccagcguggagguggaguacuacacgaucgccgaguuccaguccugcaucagcgacgggaucuccuuccggggcggccagaaggccgaggucaucgacaagaacagcgggggcuggugguacgugcagaucggggagaaggagggcugggcccccgccuccuacaucgacaagcgcaagaagcccaaccugagccggcgcaccagcacccucacccggcccaaggugcccccgcccgcgccgcccuccaagcccaaggaggccgaggaggggcccacgggcgccagcgagucccaggacagcccccgcaagcugaaguacgaggagcccgaguacgacauccccgccuucggcuucgacuccgagcccgagcugagcgaggagcccgucgaggaccgggcguccggggagcgccggcccgcccagccccaccgccccagcccggccuccagccuccagcgggcccgcuucaaggugggcgaguccagcgaggacguggcccuggaggaggagaccaucuacgagaacgagggguuccggcccuacgcggaggacacccuguccgcccgcggcagcuccggggacagcgacucccccggcagcagcucccucagccugacccggaagaacucccccaagagcggcucccccaagagcuccagccugcucaagcugaaggccgagaagaacgcccaggccgagauggggaagaaccacuccagcgcguccuucagcuccagcaucacgaucaacacgaccugcugcuccagcuccagcuccagcagcuccagccuguccaagaccagcggcgaccucaagccgcgcuccgccagcgacgccgggauccggggcacccccaagguccgcgccaagaaggacgccgacgcgaacgccggccugaccuccugcccgcgcgccaagcccagcgugcggcccaagcccuuccugaaccgcgccgagucccagagccaggagaagauggacaucuccacccuccggcgccagcugcggccgaccgggcagcugcgcggcgggcucaagggcagcaaguccgaggacagcgagcugccgccccagacggcguccgaggcccccagcgaggggucccggcgcagcuccagcgaccugaucacccuccccgccaccaccccgcccugccccacgaagaaggagugggagggccccgccaccagcuacaugaccugcuccgccuaccagaaggugcaggacagcgagaucuccuuccccgcgggcgucgagguccaggugcuggagaagcaggagagcggguggugguacgugcgguucggcgagcuggaggggugggcccccucccacuaccuggugcucgacgagaacgagcagcccgacccgagcggcaaggagcuggacaccgugcccgccaaggggcgccagaacgagggcaaguccgacagccuggagaagaucgagcggcgcguccaggcccucaacaccgugaaccaguccaagaaggccacgccgcccauccccagcaagccgcccggcggguucggcaagaccuccgggacccccgcggugaagaugcggaacggcguccgccagguggccgugcggccccagagcgucuucgugagcccgccgcccaaggacaacaaccuguccugcgcccugcgccggaacgagucccucaccgccacggacgggcugcgcggcgugcggcgcaacagcuccuucagcaccgcccgguccgcggccgccgaggccaagggccgccuggcggagcgcgccgccagccaggggagcgacagcccccuccugcccgcccagcggaacuccauccccgucucccccgugcgccccaagcccaucgagaagucccaguucauccacaacaaccugaaggacguguacgucagcaucgccgacuacgagggcgacgaggagaccgcgggguuccaggagggcgugagcauggaggugcucgagcggaaccccaacggguggugguacugccagauccuggacggcgucaagccguucaagggcugggugcccuccaacuaccuggagaagaagaacuga

SEQ ID NO: 36345 - RNA, 2736 nt, Artificial Sequence
  derived and/or modified sequence opt1 from SH3PXD2B__Homo_sapiens__NP_001017995
augcccccgcgccggagcaucguggaggucaaggugcuggacgugcagaagcgccggguccccaacaagcacuacguguacaucauccgcgugaccugguccagcggcuccaccgaggccaucuaccggcgcuacagcaaguucuucgaccuccagaugcagaugcuggacaaguuccccauggaggggggccagaaggaccccaagcagcggaucaucccguuccugcccgggaagauccucuuccgccggucccacauccgcgacgucgccgugaagcggcugauccccaucgacgaguacugcaaggcgcugauccagcuccccccguacaucagccagugcgacgaggugcugcaguucuucgagacgcgccccgaggaccugaacccccccaaggaggagcacaucggcaagaagaaguccgggggcgaccagaccagcgucgacccgauggugcucgagcaguacguggucguggccaacuaccagaagcaggaguccagcgagaucucccugagcgugggccaggucguggacaucaucgagaagaacgaguccggguggugguucgugagcaccgccgaggagcagggcuggguccccgccaccugccuggaggggcaggacggcgugcaggacgaguucucccuccagcccgaggaggaggagaaguacacggugaucuaccccuacaccgcccgggaccaggacgagaugaaccuggagcgcggggcggucguggaggugauccagaagaaccuggagggcugguggaagauccgguaccagggcaaggaggggugggccccggccagcuaccucaagaagaacuccggcgagccccugccccccaagccggggcccggcagccccucccaccccggcgcccuggaccucgacggggucagccgccagcagaacgcggugggccgggagaaggagcugcugagcucccagcgcgacgggcgguucgagggccgcccgguccccgacggggacgccaagcagcggagccccaagaugcgccagcgccccccgccccggcgcgacaugaccaucccccggggccucaaccugccgaagccccccauccccccgcagguggaggaggaguacuacaccaucgccgaguuccagacgaccauccccgacggcaucuccuuccaggccgggcugaagguggaggucaucgagaagaaccucagcggcuggugguacauccagaucgaggacaaggaggggugggcccccgcgaccuucaucgacaaguacaagaagaccuccaacgccagccgccccaacuuccuggccccgcugccccacgaggugacgcagcuccggcugggcgaggccgccgcgcuggagaacaacaccggguccgaggccaccggccccagccgcccccucccggacgccccccacggcgugauggacuccgggcugcccuggagcaaggacuggaagggcuccaaggacguccugcggaaggccagcuccgacaugagcgccuccgcgggguacgaggagaucagcgaccccgacauggaggagaagccgucccuccccccccgcaaggagagcaucaucaaguccgagggcgagcugcuggagcgggagcgcgagcggcagcgcaccgagcagcuccgggggcccacgccgaagccccccggcgugauccugcccaugaugccggccaagcacaucccccccgcccgcgacagccggcgcccggagcccaagcccgacaagagccggcuguuccagcucaagaacgacaugggccuggagugcgggcacaaggugcuggccaaggaggucaagaagcccaaccuccgcccgaucuccaagagcaagaccgaccugcccgaggagaagcccgacgccaccccccagaacccguuccugaagucccggccccaggugcgccccaagcccgcgccgagccccaagaccgagcccccccagggcgaggaccagguggacaucugcaaccuccgcuccaagcugcggccggccaagagccaggacaagucccugcucgacggggagggcccccaggccgucggcgggcaggacguggccuucagccgcuccuuccugcccggcgaggggcccggccgggcgcaggaccgcacggggaagcaggacggccugagcccgaaggagaucuccugccgggcccccccccgccccgccaagaccaccgacccggugagcaaguccguccccgugccccugcaggaggccccccagcagcggccggugguccccccccgccggccgcccccccccaagaagaccagcuccagcucccgcccgcuccccgaggugcggggcccccagugcgaggggcacgagagccgcgccgcgcccacgccgggccgggcccugcuggugccccccaaggccaagcccuuccucagcaacucccuggggggccaggacgacacccgcgggaagggcagccugggcccgugggggaccggcaagaucggggagaaccgggagaaggccgccgcggccuccguccccaacgccgacggccucaaggacagccuguacguggccguggccgacuucgagggggacaaggacaccuccagcuuccaggagggcacggucuucgaggugcgcgagaagaacuccagcggcuggugguucugccaggugcuguccggggcgcccagcugggagggcuggauccccuccaacuaccuccggaagaagccguga

SEQ ID NO: 36346 - RNA, 2667 nt, Artificial Sequence
  derived and/or modified sequence opt1 from SH3RF1__Homo_sapiens__NP_065921
auggacgagagcgcccugcucgaccugcuggagugccccgugugccucgagcgccuggacgccuccgcgaagguccugccgugccagcacaccuucugcaagcggugccuccugggcaucguggggagccgcaacgagcugcggugccccgagugccgcacccucgugggcuccggggucgaggagcugcccagcaacauccugcucgugcggcugcuggacggcaucaagcagcgccccuggaagccggggcccggcggcggguccggcacgaacugcaccaacgcccuccggagccaguccagcaccguggccaacugcuccagcaaggaccugcaguccagccaggggggccagcagccccgcguccaguccuggagccccccggugcgggggaucccccagcugcccugcgccaaggcccucuacaacuacgagggcaaggagcccggcgaccugaaguucuccaagggggacaucaucauccugcgccggcagguggacgagaacugguaccacggcgaggucaacgggauccacggcuucuucccgaccaacuucgugcagaucaucaagccccucccccagcccccgccccagugcaaggcgcuguacgacuucgaggugaaggacaaggaggccgacaaggacugccugcccuucgccaaggacgacguccucacggugauccgccggguggacgagaacugggccgagggcaugcuggcggacaagaucgggaucuuccccaucagcuacgucgaguucaacuccgccgccaagcagcugaucgagugggacaagccgcccgugcccggcguggacgccggggagugcagcuccgccgcggcccagagcagcaccgcccccaagcacuccgacaccaagaagaacaccaagaagcgccacagcuucacgucccucaccauggccaacaagagcucccaggccagccagaaccggcacuccauggagaucagcccgcccguccugaucuccagcuccaaccccaccgcggccgcccgcaucagcgagcuguccggccucagcugcuccgcccccagccaggugcacaucuccaccacggggcugaucgugaccccgccccccagcuccccggucaccaccggccccagcuucacguuccccagcgacgugcccuaccaggccgcgcugggcacccucaacccgccccugccccccccgccccugcucgccgccaccgugcuggccuccaccccccccggggccacggcggccgccgccgcggccggcauggggccgcggcccauggccggcagcaccgaccagaucgcccaccugcgcccccagacccggcccuccgucuacguggccaucuacccguacaccccccgcaaggaggacgagcucgagcugcggaagggggagauguuccuggucuucgagcgcugccaggacggcugguucaagggcacgagcaugcacaccuccaagaucgggguguuccccggcaacuacguggcgcccgucacccgcgccgugaccaacgccagccaggccaaggugccgauguccacggccgggcagaccagccggggcgucaccauggugucccccagcaccgcggggggccccgcccagaagcuccagggcaacgggguggccggcucccccagcgucgugccggccgccguggucuccgcggcccacauccagacgagcccccaggccaaggugcugcugcacaugaccgggcagaugaccgugaaccaggcccgcaacgcgguccggaccguggccgcccacaaccaggagcgccccacggccgccgugaccccgauccagguccagaacgcggccggccucucccccgccagcgugggccugucccaccacagccuggccagcccccagcccgccccgcucaugcccggguccgcgacccacaccgccgccaucagcaucucccgggccagcgccccccuggcgugcgccgccgccgcgccccugaccuccccgagcaucacguccgccagccuggaggccgagcccuccggccgcaucgugaccguccuccccgggcugcccaccagcccggacuccgccagcuccgccugcggcaacagcuccgcgaccaagcccgacaaggacagcaagaaggagaagaaggggcugcucaagcugcuguccggcgccagcacgaagcggaagccccgcgugucccccccggccagccccacccucgagguggagcugggcagcgccgagcugccccuccagggggccgucggccccgagcugccgcccgggggcgggcacggccgggcgggcuccugccccguggacggggacggccccgugaccaccgccgucgccggggccgcccuggcgcaggacgccuuccaccgcaaggccagcucccucgacagcgccgugccgaucgccccccccccccggcaggcgugcuccagccugggcccggugcugaacgagucccgccccgucgugugcgagcggcaccgcguggucgugagcuaccccccgcaguccgaggccgagcucgagcugaaggagggggacaucguguucguccacaagaagcgggaggacggcugguucaagggcacgcugcagcgcaacgggaagaccggccucuuccccgggagcuucguggagaacaucuga

SEQ ID NO: 36347 - RNA, 2649 nt, Artificial Sequence
  derived and/or modified sequence opt1 from SH3RF3__Homo_sapiens__NP_001092759
augcugcucggcgccagcuggcugugcgccuccaaggcggccgccgccgccgcgcagagcgagggggacgaggaccgccccggcgagcggcgccggcgccgggccgccgccaccgcggccggggccggcgaggacauggacgaguccagccugcucgaccugcuggagugcuccgugugccucgagcgccuggacaccacggccaagguccugccgugccagcacaccuucugccggcgcugccucgagagcaucgugugcucccggcacgagcugcgcugccccgagugccggauccugguggggugcggcgucgacgagcuccccgccaacauccugcuggugcgccuccuggacggcauccggcagcgcccccgggcggggaccagcccgggcggguccccgcccgcccgccccauccccggccagagcgccgcccccacccuggccgggggcggcgggggcgcggccggguccacgcccggcagccccguguuccucuccgccgccgccggcagcaccgcggggucccugcgggagcuggccaccagccgcaccgccccggccgccaagaaccccugccuccugcccuacggcaaggcgcuguacuccuacgaggggaaggagcccggcgaccucaaguucaacaagggggacaucaucguccugcggcgcaagguggacgagcagugguaccacggcgagcugcacggcacgcagggguuccucccggccagcuacauccagugcauccagccccugccccacgcgcccccgcagggcaaggcccuguacgacuucgagaugaaggacaaggaccaggacaaggacugccucaccuucaccaaggacgagauccugaccgugcugcggcgcgucgacgagaacugggcggaggggaugcucggcgacaagaucgggaucuucccccugcuguacguggagcucaacgacuccgccaagcagcugaucgagauggacaagcccugccccgccgccgccagcagcugcaacgcgucccugccgagcgacuccggcgccguggccagcgucgcccccucccccacgcucagcuccagcggcgccguguccgcguuccagcgccggguggacgggaagaagaacaccaagaagcgccacagcuucaccgcccuguccgucacccaccggagcucccaggccgccagccaccgccacuccauggagaucagcgcccccgugcugaucuccagcuccgacccgcgggcggccgcccgcaucggcgaccucgcccaccugagcugcgcggcccccacgcaggacgugagcuccagcgccggguccacccccaccgccgucccgcgggccgcgagcguguccggcgagcaggggaccccgcccaaggugcagcugccccucaacgucuaccuggcccuguacgccuacaagccccagaaguccgacgagcucgagcugcacaagggcgagauguaccgcgugcuggagaagugccaggacggcugguucaagggggccagccugcggacgggcgugagcggggucuuccccggcaacuacgugacccccgucucccgcgugcccgccggcggggcgggcccgccccggaacaacguggucgggggcagcccccucgccaaggggaucaccaccacgaugcaccccggcuccggcagccuguccagccuggccaccgccacccgcccggcccuccccaucaccacgccccaggcgcacgcccagcaccccaccgccuccccgcccaccgggagcugccugcggcacuccgcccagcccaccgcgagccaggcccgcagcacgaucuccaccgccgcccacagcgccgcgcaggcccaggaccggcccaccgccaccguguccccgcugcgcacgcagaacagccccucccggcuccccgccaccagccugcgcccccacuccguggucagcccgcagcacucccaccagccgcccgugcagaugugcccccggcccgccaucccccugaccagcgcggccuccgccaucacgcccccgaacgugagcgccgccaaccucaacggcgaggccgggggcgggcccaucggcguccuguccaccagcucccccaccaacaccggcugcaagcuggacgagaagaaguccgagaagaaggagaagaaguccgggcuccugaagcugcucgccggcgccagcaccaagaagaagucccgcagcccgcccagcgugagccccacccacgacccccagguggccgucgacgcccugcugcagggggcggugggccccgaggugagcucccucagcauccacgggcgcgccggcuccugcccgaucgagagcgagaugcagggcgccauggggauggagccccugcaccggaaggccggcucccuggaccucaacuucacgagccccucccgccaggcgccccugagcauggccgccauccggccggagcccaagcugcucccccgcgagcgguaccgcgucgugguguccuacccgccccagagcgaggccgagaucgagcugaaggagggggacaucgucuucgugcacaagaagcgggaggacggcugguacaaggggacccugcagcgcaacggccggaccggccucuuccccggguccuucguggagagcuucuga

SEQ ID NO: 36348 - RNA, 3867 nt, Artificial Sequence
  derived and/or modified sequence opt1 from SH3TC2__Homo_sapiens__NP_078853
augggcgggugcuucugcaucccccgcgagcggagccugacccgcggcccggggaaggagacccccuccaaggaccccacggugagcuccgagugcaucgccagcuccgaguacaaggagaagugcuuccucccccagaacaucaacccggaccugacccugagcuucugcgucaagucccggagccgccggugcgugaacggcccccuccaggaggccgcgcgccggcgccugugggcccuggagaacgaggaccaggaggugcggaugcuguucaaggaccuguccgcccgccuggucagcauccagucccagcgggcccaguuccucaucaccuucaagaccauggaggagaucuggaaguucagcacguaccugaaccugggguacguguccaugugccucgagcaccuccuguucgaccacaaguacuggcucaacugcauccugguggaggacaccgagauccaggucagcguggacgacaagcaccuggagaccaucuaccucggccugcugauccaggagggccacuucuucugccgcgcccucugcuccgugaccccgcccgcggagaaggagggggagugccugacgcugugcaagaacgagcucaucagcgucaagauggccgaggccggcuccgagcuggagggggugagccuggugaccggccagcgggggcucguccugguguccgcccuggagccccucccccugcccuuccaccagugguuccugaagaacuaccccggcagcugcggccucagccgcaagcgggacuggaccggguccuaccagaucggccgcgggcggugcaaggcgcugaccggcuacgagccgggcgagaaggacgagcugaacuucuaccagggggagagcaucgagaucaucggcuucgugauccccgggcuccagugguucaucggcaaguccacgagcuccgggcaggucggcuucgugcccacccgcaacaucgaccccgacagcuacuccccgaugagccggaacuccgccuuccugagcgacgaggagcgcugcucccugcucgcccugggcagcgacaagcagaccgagugcuccagcuuccugcacacccucgcccggacggacaucaccuccguguaccgccugagcggguucgaguccauccagaacccgcccaacgaccugagcgccucccagcccgagggcuucaaggagguccgccccgggcgggcgugggaggagcaccaggccgugggcagccgccagagcuccagcuccgaggacagcucccucgaggaggagcugcugagcgccaccuccgacagcuaccggcuccccgagcccgacgaccuggacgaccccgagcugcugauggaccucuccaccgggcaggaggaggaggccgagaacuucgccccgauccuggcguuccuggaccacgagggcuacgccgaccacuucaagagccucuacgacuucuccuucagcuuccugacguccagcuucuacuccuucagcgaggaggacgaguucguggccuaccuggaggccucccgcaagugggccaagaagucccacaugaccugggcgcacgcccggcucugcuuccugcugggccgccucagcauccggaaggucaagcugucccaggcccgcguguacuucgaggaggccauccacauccugaacggggccuucgaggaccucagccugguggcgacccuguacaucaaccucgccgccaucuaccugaagcagcggcugcgccacaagggcuccgcccuccuggagaaggcgggggcccugcucgccugccugcccgaccgggagagcuccgccaagcacgagcuggacgucguggccuacguccuccgccagggcaucgugguggggagcagcccccuggaggcgcgggccugcuuccuggccauccgccuccugcugagccucggccggcacgaggagguccugcccuucgccgagcgccugcagcuccuguccggccacccgcccgccagcgaggcgguggccuccgugcugagcuuccucuacgacaagaaguaccugccccaccuggccgucgccuccgugcagcagcacgggauccagagcgcccagggcaugucccucccgaucuggcagguccaccuggugcugcagaacaccacgaagcuccugggguuccccagccccggcuggggcgagguguccgcgcuggccugccccaugcuccggcaggcccuggccgcgugcgaggagcuggccgaccgcagcacccagcgggcccucugccugauccuguccaagguguaccucgagcaccgcagcccggacggggccauccacuaccugagccaggcccugguccucggccagcugcugggggagcaggaguccuucgagagcucccucugccuggcgugggccuaccugcucgccagccaggccaagaaggcccuggacgugcuggagccccuccugugcucccugaaggagaccgagagccucacccagcgcggcgugaucuacaaccugcuggggcucgcgcugcagggcgagggccgggucaaccgcgccgccaaguccuaccugcgggcccucaaccgcgcccaggaggugggggacgugcacaaccaggcggucgccauggccaaccugggccaccugagccucaaguccugggcccagcaccccgcgcggaacuaccugcugcaggccgugcgccucuacugcgagcugcaggccagcaaggagacggacauggagcuggugcaggucuuccucuggcuggcccaggugcugguguccgggcaccagcucacccacggccugcugugcuacgagauggcccuccuguucgggcugcggcaccgccaccucaagagccagcugcaggcgaccaagucccugugccacuucuacagcuccgucagccccaacccggaggccugcaucaccuaccacgagcacuggcucgcccuggcccagcagcugcgggaccgcgagauggagggccggcugcucgagucccugggccagcuguaccgcaaccucaacacggcccggagccugcgccggucccugaccugcaucaaggagagccuccgcaucuucaucgaccugggggagaccgacaaggcggccgaggccuggcugggcgccgggcggcuccacuaccugaugcaggaggacgagcugguggagcucugccugcaggccgcgauccagaccgcccugaaguccgaggagccccuccuggcccugaagcucuacgaggaggccggcgacguguucuucaacgggacgcgccaccggcaccacgccgucgaguacuaccgcgcgggcgccgugccccuggcccggcgccugaaggccgugcgcaccgagcuccggaucuucaacaagcugaccgagcugcagaucucccucgagggcuacgagaaggcgcuggaguucgccacccuggccgcccgccucagcaccgucacgggggaccagcggcaggagcugguggccuuccaccgccuggcgaccguguacuacucccuccacauguacgagauggccgaggacugcuaccugaagacccugagccucugcccgcccuggcugcagucccccaaggaggcccuguacuacgccaaggucuacuaccggcucggccgccugaccuucugccagcugaaggacgcccacgacgcgacggaguacuuccuccuggcccuggccgccgccgugcuccugggggacgaggagcugcaggacaccauccggagccgccucgacaacaucugccagagcccccuguggcacagccggcccuccggcugcagcuccgagcgcgcgcgguggcugagcgggggcggccucgcccuguga

SEQ ID NO: 36349 - RNA, 972 nt, Artificial Sequence
  derived and/or modified sequence opt1 from SH3YL1__Homo_sapiens__NP_001153069
augaacaaccccaucccgagcaaccugaaguccgaggccaagaaggccgcgaagauccuccgcgaguucaccgagaucaccagccggaacggccccgacaagaucauccccgcccacgugaucgccaaggccaaggggcuggccauccuguccgucaucaaggcgggcuuccucgugacggcccgcgggggcagcgggaucguggucgcccggcugcccgacggcaagugguccgccccgagcgcgaucggcaucgccgggcugggcgggggcuucgagaucgggaucgagguguccgaccucgugaucauccugaacuacgaccgcgccgucgaggccuucgccaagggcggcaaccugacccucgggggcaaccugaccguggcgguggggccccugggccggaaccucgagggcaacgucgcccugcgcagcuccgccgccguguucaccuacugcaagagccgggggcuguucgccggcgugucccucgaggggagcugccugaucgagcgcaaggagacgaaccggaaguucuacugccaggacauccgcgcguacgacauccuguucggcgacacgccccggcccgcccaggccgaggaccucuacgagauccuggacuccuucaccgagaaguacgagaacgaggggcagcgcaucaacgcccggaaggccgcgcgcgagcagcgcaagagcuccgccaaggagcugccgcccaagccccucagccggccccagcaguccagcgccccgguccagcugaacuccggcagccagagcaaccugaaccagcccaucgaggugaccgcccucuacuccuucgagggccagcagcccggggaccugaacuuccaggccggcgaccggaucaccgugaucagcaagaccgacucccacuucgacuggugggaggggaagcugcgcggccagaccgggaucuuccccgcgaacuacgucaccaugaacuga

SEQ ID NO: 36350 - RNA, 6486 nt, Artificial Sequence
  derived and/or modified sequence opt1 from SHANK1__Homo_sapiens__XP_006723296
augacccacagccccgccaccuccgaggacgaggagcgccacagcgccuccgagugcccggagggcgggagcgaguccgacagcucccccgacggccccgggcggggcccccgcgggacgcggggccagggcagcggggcgccgggcucccuggccagcgugcgcgggcuccagggccgguccaugagcguccccgacgacgcccacuucuccaugaugguguuccgcaucgggauccccgaccugcaccagaccaagugccugcgguucaaccccgacgccaccaucuggaccgccaagcagcaggugcucugcgcgcugagcgagucccugcaggacguccucaacuacggccuguuccagccggccacgagcggccgcgacgccaacuuccuggaggaggagcggcuccugcgcgaguacccccaguccuucgagaagggggugcccuaccuggaguuccgguacaagacccgcguguacaagcagaccaaccucgacgagaagcagcuggccaagcugcacaccaagacgggccucaagaaguuccuggaguacguccagcuggggaccagcgacaagguggcgcggcuccuggacaagggccuggaccccaacuaccacgacuccgacagcggcgagaccccgcucacccuggccgcccagacggaggggagcguggaggucauccgcacccugugccucggcggggcccacaucgacuuccgggcccgcgacggcaugaccgcgcugcacaaggccgccugcgcccggcacugccuggcccucaccgcgcugcuggaccucgggggcucccccaacuacaaggaccgccggggccugacgccccuguuccacaccgccaugguggggggcgacccccgcugcugcgagcuccugcuguucaaccgggcccagcucgggaucgccgacgagaacggcuggcaggagauccaccaggccugccagcgcgggcacagccagcaccuggagcaccugcucuucuacggcgcggagccgggcgcccagaacgccuccgggaacaccgcccugcacaucugcgcccuguacaacaaggagaccugcgcgcgcauccuccuguaccggggcgccgacaaggacgugaagaacaacaacgggcagacgcccuuccaggucgccgugaucgccggcaacuucgagcugggggagcucauccgcaaccaccgggagcaggacgugguccccuuccaggagagccccaaguacgcggcccgccggcgcggcccgcccggcaccgggcugaccgugccccccgcccugcuccgggccaacuccgacaccagcauggcccugccggacuggaugguguucuccgcgcccggcgccgccagcuccggggcccccggccccacgagcggcucccaggggcagagccagccguccgcccccaccaccaagcugagcuccggcacccugcgcagcgcguccagcccccggggggcccgcgcccgguccccgagccgcggccggcaccccgaggacgccaagcgccagccccgggggcgccccagcuccagcggcacgccgcgggagggccccgccgggggcaccgggggcuccgggggccccggcgggagccucggcucccgcgggcggcgccgcaagcuguacagcgcgguccccggccgguccuucauggccgugaagagcuaccaggcccaggccgagggggagaucucccugagcaagggcgagaagaucaaggugcucuccaucggcgaggggggcuucugggaggggcaggucaagggccgcguggggugguucccgagcgacugccuggaggagguggcgaaccggucccaggagagcaagcaggagucccgcagcgacaaggccaagcggcuguuccgccacuacaccgucggcuccuacgacagcuucgacgcccccagccucauggacggcaucgggcccggcuccgacuacaucaucaaggagaagaccgugcugcugcagaagaaggacagcgagggguucggcuucguccuccggggcgccaaggcccagacgcccaucgaggaguucaccccgacccccgcguuccccgcccugcaguaccuggaguccguggacgaggggggcguggccuggcgcgccgggcuccggaugggcgacuuccugaucgaggucaacgggcagaacguggugaaggucggccaccgccagguggugaacaugauccggcagggcgggaacacccugauggucaagguggugauggucacgcgccaccccgacauggacgaggccgugcacaagaaggcgccgcagcaggccaagcggcuccccccccccaccaucagccugcgcuccaagagcaugaccuccgagcuggaggagauggaguacgagcagcagccggcccccgugcccagcauggagaagaagcggaccgucuaccagauggcccucaacaagcuggacgagauccuggccgcggcccagcagaccaucuccgccagcgagucccccggcccggggggccucgccagccuggggaagcaccgccccaagggcuucuucgcgacggaguccagcuucgacccccaccaccgggcccagccguccuacgagcgccccagcuuccugccccccggcccggggcucaugcugcggcagaaguccaucggcgccgccgaggacgaccgccccuaccuggccccccccgcgaugaaguucagccggucccucagcgugccggggagcgaggacauccccccccccccgaccaccuccccccccgagcccccguacagcaccccccccgugcccuccagcuccggccgccugacgccgagcccccgcgggggccccuucaaccccggcuccgggggcccgcugcccgccagcucccccgccagcuucgacgggcccuccccgcccgacacccgggucggcagccgcgagaagucccucuaccacagcggcccccugccgcccgcccaccaccaccccccccaccaccaccaccaccacgccccgcccccccagccccaccaccaccacgcgcacccgccccacccccccgagauggagaccgggggcuccccggacgacccccccccccggcuggcccucgggccgcagcccagccugcgcggcuggcgggggggcggccccucccccaccccgggggcccccagccccucccaccacggcagcgccgggggcgggggcggcagcucccaggggcccgcccugcgcuacuuccagcucccgccccgggcggccagcgccgccauguacgugcccgcccgcuccggccgggggcgcaagggcccccuggugaagcagacgaaggucgagggggagccgcagaagggcggcgggcugccccccgcgccgagccccaccucccccgccagcccccagccgccccccgccguggccgcgcccuccgagaagaacagcaucccgauccccaccaucaucaucaaggcccccuccaccagcuccagcggccgguccagccagggguccagcacggaggccgagcccccgacccagcccgagcccaccggcgggggcggcgggggcggguccagccccuccccggcccccgccaugagccccgugcccccgagccccucccccguccccaccccggcgagccccuccggccccgccacgcucgacuucaccagccaguucggcgccgcccuggugggggccgcgcgccgggagggcggguggcagaacgaggcccgccggcgcuccacccuguuccucagcaccgacgccggcgacgaggacgggggcgacggcgggcugggcacgggggccgccccgggcccccggcugcgccacuccaagagcaucgacgaggggauguucuccgcggagcccuaccuccggcuggagagcgccggcuccggcgccggguacggcggguacggcgccgggagccgcgcguacggcggcgggggcggguccagcgccuucaccuccuuccugcccccgcgcccccucgugcacccccugaccggcaaggcccuggaccccgccagcccgcucgggcuggcccuggcggcccgggagcgcgcccucaaggaguccagcgagggcggcggggccccccagccccccccgcggccccccuccccccgcuacgaggccccgccccccaccccccaccaccacagcccgcacgcgcaccacgagcccguccugcggcuguggggcgccagcccccccgacccggcccgccgggagcucggguaccgcgccggccugggcucccaggagaagagccugcccgccuccccccccgcggcccggcgcagccuccugcaccggcugccgcccacggcccccggggugggcccgcuccugcugcagcucgggaccgagccccccgccccccacccgggcguguccaagcccuggcgcagcgcggcccccgaggagcccgagcggcugccgcugcacguccgcuuccucgagaacugccagccccgggcccccgugaccuccgggcgcggccccccgagcgaggacggccccggggugccccccccguccccccggcgcagcgucccccccuccccgaccagcccccgggccuccgaggagaacggccugccccugcucgugcugcccccgcccgcccccagcguggacgucgaggacggggaguuccuguucguggagccccucccgcccccccuggaguucuccaacagcuucgagaagccggaguccccccugacgcccggccccccgcacccccuccccgacacccccgcgccggccaccccccugccccccgugccgccccccgccgucgccgccgcgcccccgacccuggacagcacggccuccagccucaccagcuacgacuccgagguggccacccugacccagggggccagcgccgcgcccggcgacccccaccccccgggcccccccgcccccgccgccccggcccccgcggccccccagcccgggccggacccccccccgggcacggacuccgggaucgaggagguggacagccgcuccagcuccgaccacccccuggagaccaucagcuccgccagcacccucuccagccuguccgccgagggcgggggcagcgcgggcgggggcgggggcgccggcgccggggucgccuccggccccgagcugcucgacaccuacguggccuaccuggacgggcaggcguucggcgggagcuccacccccggcccgcccuaccccccccagcugaugacgccgagcaagcuccggggccgcgcccugggggccagcggcgggcugcgccccggccccuccgggggccuccgggaccccgugaccccgaccagccccaccgucuccgugacgggcgccgggaccgacggccugcuggcccugcgcgcgugcagcgggccccccaccgccggcguggccgggggcccggucgccguggagcccgaggugccccccgucccgcuccccaccgccuccagccugccccggaagcugcuccccugggaggagggcccggggccccccccgcccccccugcccggcccgcuggcgcagccccaggccuccgcccucgccacggugaaggcgagcaucaucuccgagcugagcuccaagcugcagcaguucgggggcagcuccgccgccgggggcgcccuccccugggcccgcggcgggagcggcgggggcggcgacucccaccacgggggcgcgagcuacguccccgagcggaccuccagccugcagcgccagcggcuguccgacgacagccagagcucccuccugagcaagccgguguccagccuguuccagaacuggcccaagcccccccucccgccccugcccaccgggaccggcgugucccccacggccgccgccgccccgggggcgaccagccccuccgccagcuccagcuccaccagcacccgccaccugcagggcgucgaguucgagaugcggcccccccuccugcgccgggccccgucccccagccugcuccccgccuccgagcacaaggugagccccgccccgcgccccuccagccugcccauccugcccuccggcccgcucuaccccgggcuguucgacauccggggcagccccacggggggcgcggggggcagcgccgacccguucgcccccguguucguccccccccacccgggcaucuccgggggccuggggggcgcccucagcggggcgucccgcagccugucccccacccggcugcucagccugccccccgacaagccguucggcgccaagccccugggcuucuggaccaaguucgacguggccgacuggcucgaguggcuggggcuggccgagcaccgcgcccaguuccucgaccacgagaucgacggcucccaccugcccgcgcugaccaaggaggacuacguggaccucggggucacgcgggugggccaccgcaugaacaucgaccgggcccugaaguucuuccuggagcgcuga

SEQ ID NO: 36351 - RNA, 5550 nt, Artificial Sequence
  derived and/or modified sequence opt1 from SHANK2__Homo_sapiens__NP_036441
augccccgcagccccaccagcagcgaggacgagauggcccaguccuucagcgacuacuccguggggagcgaguccgacagcuccaaggaggagaccaucuacgacaccauccgggccaccgccgagaagcccgggggcgcccgcaccgaggagagccaggggaacacccuggucauccggguggugauccacgaccuccagcagacgaagugcauccgcuucaaccccgacgccaccgucuggguggccaagcagcggauccugugcacccugacccagucccucaaggacgugcugaacuacggccuguuccagcccgccagcaacgggcgcgacggcaaguuccucgacgaggagcggcugcugcgcgaguacccccagcccgucggcgagggggugcccucccucgaguuccgguacaagaagcgcguguacaagcaggccagccuggacgagaagcagcuggccaagcuccacacgaagaccaaccugaagaagugcauggaccacauccagcaccggcuggucgagaagaucaccaagaugcucgaccgcggccuggaccccaacuuccacgaccccgagaccggggagacgccccugacccucgccgcccagcuggacgacuccguggaggugaucaaggcgcugaagaacggcggggcccaccucgacuuccgggccaaggacggcaugaccgcccugcacaaggccgcgcgcgcccggaaccaggucgcccugaagacccuccuggagcugggcgccagccccgacuacaaggacuccuacgggcucacgccccuguaccacaccgccaucgugggcggggaccccuacugcugcgagcugcuccugcacgagcacgcgaccgugugcugcaaggacgagaacggcuggcacgagauccaccaggccugccgcuacggccacguccagcaccuggagcaccuccuguucuacggggccgacaugagcgcccagaacgccuccggcaacaccgcgcugcacaucugcgcccucuacaaccaggacagcugcgcccgggugcugcuguuccgcgggggcaacaaggagcucaagaacuacaacagccagacgcccuuccagguggccaucaucgccgggaacuucgagcuggcggaguacaucaagaaccacaaggagaccgacaucguccccuuccgggaggcccccgccuacuccaaccgccggcgccgcccgcccaacacccuggccgcgccccgggugcuccugcgcagcaacuccgacaacaaccugaacgccagcgcccccgacugggccgugugcuccaccgccacgagccaccggucccucagcccccagcugcugcagcagaugcccuccaagcccgagggcgcggccaagaccaucggcagcuacguccccgggccccgcucccggagccccucccucaaccgccugggcggggccggcgaggacgggaagcggccccagccccuguggcacgugggcagccccuucgcccugggcgccaacaaggacucccucagcgcguucgaguaccccgggcccaagcgcaagcuguacuccgccgugcccggccggcuguucgucgccgugaagcccuaccagccccaggucgacggggagaucccccuccaccgcggcgaccgggugaaggugcugagcaucggggagggcggcuucugggagggguccgcccgcggccacaucgggugguuccccgccgagugcgucgaggaggugcagugcaagccccgggacagccaggcggagacccgcgccgaccggagcaagaagcuguuccgccacuacaccgugggcuccuacgacagcuucgacacguccagcgacugcaucaucgaggagaagaccgucgugcuccagaagaaggacaacgagggcuucggguucgugcugcggggcgccaaggccgacacccccaucgaggaguucacccccacgccggcguuccccgcccugcaguaccucgaguccgucgacgagggcgggguggccuggcaggccgggcugcgcaccggcgacuuccugaucgaggugaacaacgagaacgucgugaaggugggccaccggcaggucgugaacaugauccgccagggcgggaaccaccucgugcugaaggucgugaccgugacccgcaaccuggaccccgacgacacggcccggaagaaggcgcccccgccgcccaagcgcgcccccaccaccgcccucacccugcggagcaaguccaugaccagcgagcuggaggagcucgucgacaaggccuccgugcgcaagaagaaggacaagccggaggagaucgugcccgccagcaagcccucccgggcggccgagaacauggccgucgagccccgcguggccacgaucaagcagcggccgagcucccgcugcuuccccgccgggagcgacaugaacuccguguacgagcggcagggcaucgcggucaugacccccaccgugcccgggagcccgaaggcccccuuccugggcaucccccgcggcaccaugcggcgccagaaguccaucgacagccggaucuuccugagcgggaucacggaggaggagcgccaguuccucgccccgcccaugcugaaguucacccggucccugagcaugcccgacaccuccgaggacaucccgccgccgccccagagcgugccgcccagcccgccgccgcccagccccaccacguacaacugccccaagucccccacgccccgcgucuacggcaccaucaagcccgccuucaaccagaacagcgcggccaaggugucccccgccacccggagcgacaccguggccaccaugaugcgcgagaaggggauguacuuccggcgcgagcucgaccgguacucccuggacagcgaggaccuguacucccgcaacgccggcccccaggcgaacuuccgcaacaagcgggggcagaugcccgagaaccccuacagcgaggucggcaagaucgccuccaaggccguguacgugcccgccaagcccgcccgccggaagggcaugcucgucaagcagagcaacguggaggacucccccgagaagaccugcagcauccccauccccaccaucaucgugaaggagcccuccacgagcagcuccgggaaguccucccagggcagcuccauggagaucgacccgcaggcgcccgagcccccgagccagcugcgccccgacgagucccugaccgucagcucccccuucgccgccgccaucgccggggcggugcgggaccgcgagaagcggcucgaggcccgccggaacagccccgccuuccuguccaccgaccugggcgacgaggacguggggcucggcccgcccgcgccccgcacccggcccagcauguucccggaggagggcgacuucgccgacgaggacuccgcggagcagcugagcucccccaugcccagcgccacgccccgcgagccggagaaccacuucgucgggggcgccgaggccuccgcgcccggggaggccggccggccccugaacagcaccuccaaggcccagggccccgagagcagcccggccgugcccuccgccagcuccgggaccgcgggccccgggaacuacgugcacccccucaccggccgccugcuggacccgagcagcccccuggcccuggcccugagcgcccgggaccgcgccaugaaggagucccagcaggggcccaagggcgaggcgcccaaggccgaccucaacaagccgcuguacaucgacacgaagaugcggcccagccuggacgccggcuuccccaccgucacccgccagaacacccgggggccccuccgccgccaggagacggagaacaaguacgagaccgaccugggccgggaccgcaagggggacgacaagaagaacaugcugaucgacaucauggacaccucccagcagaaguccgccggccuccugauggugcacaccguggacgccacgaagcuggacaacgcgcuccaggaggaggacgagaaggccgaggucgagaugaagccggacuccagccccuccgaggugcccgagggggugagcgagaccgagggcgcccugcagaucuccgccgcgccggagcccaccaccguccccggccggacgaucguggccgucgggagcauggaggaggccgugauccugcccuuccgcaucccgccgccgccccucgccuccguggaccuggacgaggacuucaucuucaccgagccgcugccgccgccccucgaguucgccaacagcuucgacaucccggacgaccgggcggccuccguccccgcccugagcgaccuggugaagcagaagaaguccgacacgccccagucccccagccucaacuccagccagccgaccaacuccgccgacagcaagaagcccgccucccugagcaacugccugcccgcguccuuccugcccccgcccgagagcuucgacgccguggccgacuccggcaucgaggaggucgacagccgcuccagcuccgaccaccaccucgagaccacgagcaccaucuccaccgugagcuccaucagcacccugagcuccgagggcggggagaacguggacacgugcaccgucuacgccgacgggcaggccuucaugguggacaagccgcccgugccgcccaagcccaagaugaagcccaucauccacaagagcaacgcgcucuaccaggacgcccuggucgaggaggacguggacuccuucgugaucccgccgcccgccccgccgccgccgcccggcagcgcccagcccggcauggcgaagguccugcagccccggaccuccaagcucuggggcgacgugaccgagaucaagagccccauccuguccggccccaaggccaacgugaucagcgagcugaacuccauccuccagcagaugaaccgcgagaagcuggccaagcccggggagggccuggacagccccaugggcgccaaguccgccagccucgcgccccgguccccggagaucaugagcacgaucuccgggacccgcagcaccaccgucacguucaccgugcggcccggcaccucccagcccaucacccugcagagccgcccgcccgacuacgagucccggacgagcgggacccgccgggcccccagccccguggucucccccaccgagaugaacaaggagacccugcccgcgccccucagcgccgccacggcgucccccagccccgcccuguccgacguguucagccugccgucccagccgcccagcggcgaccucuucgggcugaacccggccggccgcucccggagccccucccccagcauccugcagcagcccaucuccaacaagccguucaccaccaagcccgugcaccucuggaccaagcccgacgucgccgacuggcuggagagccugaaccucggcgagcacaaggaggccuucauggacaacgagaucgacgggucccaccuccccaaccugcagaaggaggaccucaucgaccugggcgugacgcgcguggggcaccggaugaacaucgagcgcgcgcugaagcagcuccuggaccgguga

SEQ ID NO: 36352 - RNA, 5196 nt, Artificial Sequence
  derived and/or modified sequence opt1 from SHANK3__Homo_sapiens__NP_277052
auggacggccccggggccuccgccgugguggugcgcgugggcauccccgaccugcagcagaccaagugccuccggcuggaccccgccgcccccgucugggccgccaagcagcgcgugcugugcgcccucaaccacucccugcaggacgcccugaacuacgggcuguuccagccgcccucccggggccgcgccgggaaguuccuggacgaggagcggcugcuccaggaguacccgcccaaccuggacacgccccuccccuaccucgaguuccgcuacaagcggcgcguguacgcccagaaccugaucgacgacaagcaguucgccaagcugcacaccaaggccaaccucaagaaguucauggacuacguccagcugcacuccaccgacaagguggcccggcugcucgacaagggccuggaccccaacuuccacgaccccgacagcggcgagugcccccugucccucgccgcccagcuggacaacgccaccgaccugcucaaggugcugaagaacgggggcgcgcaccuggacuuccgcacccgggacgggcucaccgccguccacugcgccacccgccagcggaacgccgccgcgcugaccacccugcucgaccugggcgccagccccgacuacaaggacucccgcgggcugacgccccucuaccacagcgcccugggcggcggggacgcccugugcugcgagcuccugcugcacgaccacgcccagcucggcaucaccgacgagaacggguggcaggagauccaccaggcgugccgguucggccacgugcagcaccuggagcaccuccuguucuacggcgccgacaugggggcccagaacgccuccggcaacaccgcccugcacaucugcgcgcuguacaaccaggagagcugcgcccgcgugcuccuguuccgcggggccaaccgcgacguccggaacuacaacucccagaccgccuuccagguggcgaucaucgccggcaacuucgagcuggccgaggugaucaagacccacaaggacagcgacgucgugcccuuccgcgagacccccuccuacgccaagcggcgccgccucgccgggcccagcggccuggcgagcccccggccccugcagcgcagcgccuccgacaucaaccugaagggcgaggcccagcccgccgccagccccgggcccucccuccggagccugccccaccagcugcuccugcagcgccugcaggaggagaaggaccgggaccgcgacgcggaccaggagagcaacaucuccggcccccucgccgggcgggccggccagagcaagaucucccccagcgggcccggcggccccgggcccgcccccggccccgggcccgccccgcccgcgccgcccgcgcccccgccccggggccccaagcggaagcuguacuccgccgugcccgggcgcaaguucaucgccgucaaggcccacagcccccagggcgagggcgagaucccccugcaccgcggggaggccgugaaggugcucuccaucggcgagggcggguucugggagggcaccgucaaggggcgcaccggcugguuccccgccgacugcguggaggaggugcagaugcggcagcacgacacgcgcccggagacccgggaggaccgcaccaagcggcuguuccgccacuacaccgucgggagcuacgacucccugacgagccacuccgacuacgugaucgacgacaaggucgccgugcuccagaagcgggaccacgagggcuucggguucgugcugcgcggcgccaaggcggagacccccaucgaggaguucacccccacccccgccuucccggcccugcaguaccucgagagcgucgacguggagggcguggccuggcgcgccgggcugcggacgggcgacuuccugaucgaggucaacggggugaacguggucaaggugggccacaagcaggucgucgcgcucauccgccagggcgggaaccggcuggugaugaagguggucuccgugacccgcaagcccgaggaggacggcgcccggcgccgggcgccgcccccgcccaagcgcgcccccagcaccacccugacgcuccgguccaagagcaugaccgccgagcuggaggagcuggcguccauccgccggcgcaagggggagaagcucgacgagaugcuggccgccgccgcggagcccacccugcggcccgacaucgccgacgccgacagccgcgccgccaccgugaagcagcggcccacgucccgccggaucacccccgcggagaucagcagccucuucgagcgccagggccugccggggcccgagaagcugcccggcucccuccggaaggggaucccccgcaccaagagcgucggcgaggacgagaagcuggccucccugcucgagggccgguucccgcgcagcaccuccaugcaggaccccgugcgcgaggggcggggcaucccgcccccgccccagacggcgcccccgccgccgcccgcccccuacuacuucgacagcgggcccccgcccgccuucagcccgcccccgccgcccggccgcgcguacgacaccgugcggagcuccuucaagcccgggcuggaggcccgccugggcgccggcgccgccgggcucuacgagcccggcgcggcccuggggccccugcccuaccccgagcggcagaagcgcgcccggagcaugaucauccuccaggacuccgcccccgagagcggcgacgcgccccggcccccgcccgcggccacgccgcccgagcgccccaagcgccggccccggccgcccggccccgacucccccuacgccaaccugggggccuucagcgcgucccuguucgcccccagcaagccccagcggcgcaagagcccccuggucaagcagcuccagguggaggacgcccaggagcgggccgcccuggcggugggcagccccgggcccggcgggggcagcuucgcccgcgagcccucccccacccaccggggcccccgccccgggggccucgacuacggggccggcgacgggccgggccuggccuucggcgggcccggccccgccaaggaccggcgccuggaggagcgccggcgcagcaccgucuuccucuccgugggggcgaucgagggcagcgcccccggggccgaccugccgucccugcagcccagccgguccaucgacgagcgccuccugggcaccggccccaccgccgggcgggaccugcuccugcccagcccgguguccgcccugaagccccucgucagcggccccucccuggggccgagcggcuccaccuucauccacccccugaccggcaagccccucgaccccagcuccccgcuggcgcuggcccucgccgcccgcgagcgggcgcuggccagccaggcccccucccgcagccccacgcccgugcacuccccggacgccgaccggcccgggccccuguucguggacguccaggcccgcgaccccgagcggggcagccucgcgagcccggccuucagcccccggagccccgccuggauccccgugccggcccggcgcgaggccgagaaggugccccgggaggagcgcaagucccccgaggacaagaaguccaugauccuguccguccuggacaccagccuccagcggcccgcggggcugaucguggugcacgccaccuccaacggccaggagccgagccgccucgggggcgccgaggaggagcggcccggcacccccgagcucgcccccgccccgaugcaguccgcggccgucgccgagccccugcccagcccgcgcgcccagccgcccgggggcacgcccgcggacgccgggccgggccagggguccagcgaggaggagcccgagcugguguucgccgugaaccugccgcccgcccagcuguccagcuccgacgaggagacccgggaggagcuggcccgcaucggccucgucccgccgcccgaggaguucgcgaacggcgugcugcuggccacgccccuggccgggccgggccccagccccaccacggugcccuccccggccagcgggaagcccuccagcgagccgccgcccgcccccgagagcgcggccgacuccggcgucgaggaggccgacacccgcagcuccagcgacccccaccuggagaccaccuccacgaucagcaccguguccagcauguccacccugagcuccgagagcggggagcucaccgacacgcacaccuccuucgccgacggccacaccuuccugcuggagaagccgcccgugccgcccaagcccaagcucaagagcccccugggcaaggggcccgucaccuuccgggacccccugcucaagcaguccagcgacuccgagcugauggcccagcagcaccacgcggccagcgccggccuggccuccgccgcggggccggcccgcccccgguaccucuuccagcgccggagcaagcuguggggcgaccccguggagagccgcgggcugcccggcccggaggacgacaagcccacggugaucuccgagcugagcucccggcuccagcagcugaacaaggacacccgcagccugggcgaggagcccgucgggggccucgggucccugcuggaccccgccaagaaguccccgaucgccgcggcccgccucuucuccagccugggcgagcuguccagcaucuccgcccagcgcagccccggcgggcccggcgggggcgccuccuacagcgugcggcccuccgggcgcuacccgguggcccggcgcgcgcccagccccgucaagcccgccucccucgagcggguggagggccugggcgccggggccggcggggccggccgcccguucgggcugacgccgcccaccauccucaagagcuccagccugagcaucccccacgagccgaaggagguccgguucguggugcgcuccgucagcgcgcggucccgcagccccucccccagcccccugccgucccccgccagcggccccggccccggggccccgggcccccgccggcccuuccagcagaagccgcuccagcugugguccaaguucgacgugggggacuggcuggagagcauccaccucggcgagcaccgcgaccgguucgaggaccacgagaucgagggggcccaccuccccgcccugacgaaggacgacuucguggagcucggcgucacccgcgugggccaccggaugaacaucgagcgcgcgcugcggcagcuggacggguccuga

SEQ ID NO: 36353 - RNA, 1164 nt, Artificial Sequence
  derived and/or modified sequence opt1 from SHARPIN__Homo_sapiens__NP_112236
auggcgcccccggccggcggggccgccgccgccgccagcgaccugggcuccgcggccgugcuccuggccguccacgccgcggugcgcccccugggggccggccccgacgccgaggcccagcuccggcgccugcagcugagcgccgaccccgagcggccggggcgcuuccggcucgagcugcugggcgcgggccccggggccgugaaccucgaguggccccuggaguccgucagcuacaccauccgcggccccacccagcacgagcugcagccgccgcccgggggccccgggacgcucucccugcacuuccugaacccccaggaggcccagcggugggccgugcucgugcgcggcgccaccgucgagggccagaacgggagcaaguccaacagcccgcccgcgcugggccccgaggccugccccgugucccugcccagcccgcccgaggccuccacccucaaggggcccccgcccgaggccgaccugccccggagccccggcaaccugaccgagcgcgaggagcucgccggcucccuggcgcgggccaucgccgggggcgacgagaagggggccgcccagguggcggccguccuggcccagcaccgcguggcccucagcgugcagcugcaggaggcgugcuucccgcccggccccauccggcugcaggucacgcucgaggacgccgccuccgccgccagcgcggccuccagcgcccacguggcccuccaggugcacccccacugcaccgucgccgcgcugcaggagcaggucuucuccgagcugggguucccgcccgccgugcagcgcugggugaucggccggugccugugcgugcccgagcgcagccuggccagcuacggcgugcggcaggacggggaccccgccuuccucuaccugcuguccgcgccccgcgaggcccccgccaccggcccgagcccccagcacccccagaagauggacggggagcucggccggcuguucccgcccucccuggggcucccgcccggcccccagcccgccgccagcucccugcccagcccccugcagcccuccuggagcugcccguccugcaccuucaucaacgcgcccgaccgccccggcugcgagaugugcagcacgcagcggcccugcaccugggacccgcucgccgccgccuccaccuga

SEQ ID NO: 36354 - RNA, 1155 nt, Artificial Sequence
  derived and/or modified sequence opt1 from SHBG__Homo_sapiens__NP_001139751
auggagagccgcggcccccuggccaccucccggcuccugcugcuccugcugcuccugcugcuccgccacacccggcaggggugggcccugcgcccggugcugcccacgcagagcgcgcacgacccgcccgccguccaccucuccaacggccccgggcaggagcccaucgccgugaugaccuucgaccugaccaagaucaccaagacgagcuccagcuucgaggugcggaccugggaccccgagggcgucaucuucuacggggacaccaaccccaaggacgacugguucaugcugggccuccgcgacggccggccggagauccagcugcacaaccacugggcccagcugaccgugggggccggcccccgccucgacgacgggcgguggcaccagguggaggucaagauggagggcgacuccgugcugcuggagguggacggggaggagguccuccgccugcgccaggugagcggcccccugacguccaagcggcaccccaucaugcggaucgcgcucggcgggcugcuguucccggccagcaaccuccgccugcccgccgagaucuccgccagcgcgcccaccucccugcggagcugcgacguggaguccaaccccggcaucuuccucccgcccgggacccaggccgaguucaaccugcgcgacaucccccagccccacgccgagccgugggccuucagccuggaccucggccugaagcaggccgcgggcuccgggcaccuccuggcccugggcacccccgagaaccccagcuggcugucccuccaccuccaggaccagaaggucgugcugagcagcggguccggccccgggcuggaccugccgcuggugcucggccugccccugcagcucaagcugagcaugucccgggucgugcugagccagggcuccaagaugaaggcccuggcccucccgccccuggggcuggcgccccuccugaaccugugggccaagccccagggccgccucuuccugggggcccugcccggcgaggacagcuccacgagcuucugccucaacgggcugugggcccagggccagcggcuggacguggaccaggcccucaaccgcucccacgagaucuggacccacagcugcccgcagucccccggcaacgggaccgacgccagccacuga

SEQ ID NO: 36355 - RNA, 1530 nt, Artificial Sequence
  derived and/or modified sequence opt1 from SHB__Homo_sapiens__NP_003019
auggccaaguggcugaacaaguacuucagccucggcaacuccaagaccaagagcccgccgcagccgccccgccccgacuaccgggagcagcgccggcgcggggagcggcccucccagccgccccaggccgugccccaggcgagcuccgccgccagcgccuccugcggccccgccaccgcgagcugcuucuccgccagcuccgggagccugcccgacgacuccggcagcacguccgaccugauccgcgccuaccgggcccagaaggagcgcgacuucgaggaccccuacaacgggcccggcagcucccuccggaagcugcgcgcgaugugccggcuggacuacugcggcgggagcggcgagcccgggggcguccagcgcgccuucuccgccagcagcgccuccggggccgcgggcugcugcugcgccagcuccggcgccggggccgccgcgagcuccagcuccagcuccggcagcccccaccucuaccgguccagcuccgagcgccggcccgccacccccgccgaggugcgcuacaucagcccgaagcaccggcugaucaagguggaguccgccgccgggggcggcgcgggggacccccugggcggggccugcgccggcgggcgcaccuggagccccaccgccugcggcggcaagaagcuccugaacaagugcgccgcguccgccgccgaggagagcggggccggcaagaaggacaaggucacgaucgcggacgacuacuccgaccccuucgacgccaagaacgaccugaaguccaaggccgggaagggcgagagcgccggguacauggagccguacgaggcccagcggaucaugaccgaguuccagcgccaggaguccgugcggagccagcacaagggcauccagcucuacgacacccccuacgagcccgagggccaguccguggacagcgacuccgagagcaccgucagcccccgccugcgcgagagcaagcugccgcaggacgacgaccggcccgcggacgaguacgaccagcccugggaguggaaccgcgugacgauccccgcccucgccgcccaguucaacgggaacgagaagcggcaguccagcccgucccccagccgcgaccggcgccggcagcugcgcgcccccggcgggggcuucaagccgaucaagcacgggucccccgaguucugcggcauccugggcgagcggguggaccccgcggucccccucgagaagcagaucugguaccacggggccaucagccgcggcgacgccgagaaccugcugcggcucugcaaggagugcuccuaccuggugcgcaacagccagaccuccaagcacgacuacagccugagccuccgguccaaccagggguucaugcacaugaagcuggccaagaccaaggagaaguacgugcugggccagaacagcccgcccuucgacuccguccccgaggugauccacuacuacaccacgcgcaagcuccccaucaagggcgccgagcaccugagccugcucuacccgguggcgguccggacccuguga

SEQ ID NO: 36356 - RNA, 1755 nt, Artificial Sequence
  derived and/or modified sequence opt1 from SHC1__Homo_sapiens__NP_001123512
auggaccugcuccccccgaagcccaaguacaacccccugcgcaacgagagccuguccagccucgaggagggcgccuccgggagcacccccccggaggagcugcccucccccagcgccuccagccugggccccauccucccgccccugcccggggacgacucccccaccacgcugugcagcuucuucccgcggauguccaaccuccgccuggcgaaccccgccggcgggcggcccggcagcaagggcgagcccgggcgcgccgccgacgacggcgaggggaucgugggcgccgcgaugccggacuccgggccccugccccuccugcaggacaugaacaagcugagcggcggcgggggccggcgcacccgggucgaggggggccagcucggcggggaggaguggacccgccacggcuccuucgugaacaagcccacccggggguggcugcacccgaacgacaaggugaugggccccggggucagcuaccuggugcgcuacaugggcugcguggagguccuccaguccaugcgggcccuggacuucaacacgcgcacccaggugacccgggaggccaucagccuggugugcgaggccguccccggcgcgaagggggccacccgccggcgcaagcccugcucccggccgcucagcagcauccugggccgcuccaaccugaaguucgccgggaugcccaucacgcucaccgugagcaccuccagccugaaccugauggccgccgacugcaagcagaucaucgcgaaccaccacaugcaguccaucagcuucgccuccggcggggaccccgacaccgccgaguacguggccuacgucgccaaggaccccgugaaccagcgggcgugccacauccucgagugcccggagggccuggcccaggacgugaucagcacgaucggccaggccuucgagcugcgcuucaagcaguaccuccggaacccccccaagcuggucaccccgcacgaccgcauggccggguucgacggcuccgccugggacgaggaggaggaggagccccccgaccaccaguacuacaacgacuuccccgggaaggagccgccccugggcggggugguggacaugcgccuccgggagggcgcggcccccggcgccgcccgccccaccgccccgaacgcgcagacccccagccaccugggggccacgcugcccgucggccagcccguggggggcgacccggaggugcggaagcagaugcccccccccccgcccugccccgccggccgcgagcucuucgacgaccccuccuacgucaacgugcagaaccuggacaaggcccggcaggcgguggggggcgccgggccgcccaaccccgccaucaacggcagcgccccccgcgaccuguucgacaugaagccguucgaggacgcccuccgggucccccccccgccccaguccgugagcauggcggagcagcugcgcggggagcccugguuccacggcaagcugucccggcgcgaggccgaggcccuccugcagcugaacggcgacuuccucguccgggagagcaccaccacccccgggcaguacgugcugacgggccugcaguccgggcagccgaagcaccuccugcugguggaccccgagggcgucgugcgcaccaaggaccaccgguucgagagcgugucccaccugaucagcuaccacauggacaaccaccuccccaucaucagcgccggguccgagcugugccugcagcagcccgucgagcgcaagcucuga

SEQ ID NO: 36357 - RNA, 1749 nt, Artificial Sequence
  derived and/or modified sequence opt1 from SHC2__Homo_sapiens__NP_036567
augacccagggccccgggggccgcgccccgcccgccccgcccgcgccgcccgagcccgaggcccccaccacguucugcgcccugcugccccggaugccccaguggaaguucgccgcccccgggggcuuccuggggcgcggccccgcggccgcccgggccgcgggcgccagcgggggcgccgacccgcagcccgagcccgccgggcccggcggggugccggcccuggcggccgccguccucggcgccugcgagccccgcugcgccgcgcccugcccccugccggcccugucccggugccgcggcgccgggagccggggcucccgcgggggccggggcgccgccgggagcggcgacgcggccgccgccgccgaguggauccgcaagggguccuucauccacaagcccgcgcacggcuggcuccaccccgacgcccgggugcuggggcccggcgugagcuacgucgugcgcuacaugggcugcaucgaggugcugcgguccaugcgcagccucgacuucaacacccggacccaggucacccgcgaggccaucaaccggcugcacgaggccgugccgggggugcgcggcuccuggaagaagaaggcgcccaacaaggcccuggccagcguccucgggaaguccaaccugcgguucgccggcaugagcaucuccauccacaucagcacggacgggcugucccucagcgugcccgccacccgccaggugaucgcgaaccaccacaugcccuccaucagcuucgccuccggcggcgacaccgacaugaccgacuacgucgccuacguggccaaggacccgaucaaccagcgggccugccacauccuggagugcugcgaggggcuggcgcagagcaucaucagcacggugggccaggccuucgagcuccgcuucaagcaguaccugcacuccccgcccaaggucgcccugccgcccgagcgccucgccgggcccgaggagagcgccuggggcgacgaggaggacucccuggagcacaacuacuacaacagcauccccgggaaggagccgccccugggcggccucguggacucccggcuggcgcugacccagcccugcgcccucaccgcccuggaccaggggcccagccccucccugcgcgacgccugcagccuccccugggacgugggcuccaccgggacggcgccgcccggcgacggcuacguccaggccgacgcccgggggccgcccgaccacgaggagcaccuguacgugaacacccagggccuggacgcccccgagcccgaggacagccccaagaaggaccucuucgacaugcgccccuucgaggacgcccugaagcugcacgagugcuccguggcggccggggucaccgccgcgccccucccccuggaggaccaguggccgagcccgcccacccggcgcgcccccguggcccccacggaggagcagcugcggcaggagcccugguaccacggccgcaugucccggcgcgccgccgagcggaugcuccgcgccgacggggacuuccuggugcgggacagcgucaccaaccccggccaguacgugcugaccggcaugcacgccgggcagccgaagcaccuccugcuggucgaccccgagggcguggugcgcaccaaggacguccucuucgaguccaucagccaccugaucgaccaccaccuccagaacgggcagcccaucguggcggccgaguccgagcugcaccuccggggcguggucagccgcgagcccuga

SEQ ID NO: 36358 - RNA, 1785 nt, Artificial Sequence
  derived and/or modified sequence opt1 from SHC3__Homo_sapiens__NP_058544
augcugccccgcaccaaguacaaccgguuccgcaacgacagcgugaccuccgucgacgaccuccugcacagccuguccgugagcggcgggggcgggaagguguccgccgcccgggcgacgccggccgccgcccccuaccucgucagcggcgaggcccugcgcaaggcgcccgacgacgggcccggcucccugggccaccuccugcacaaggugagccaccugaagcucuccagcuccgggcugcggggccugagcuccgccgcccgcgagcgggccggggcgcgccucagcggcuccugcagcgccccgucccuggccgcccccgacgggagcgcccccuccgcgccccgggccccggccaugagcgccgcccgcaagggccggcccggcgacgagccccugccccgcccgccccgcggggcgccccacgccagcgaccaggugcucggccccggggucaccuacguggugaaguaccugggcugcaucgagguccugcgguccaugcggagccucgacuucuccacccgcacccagaucacgcgggaggccaucagccgcgugugcgaggccgugccgggcgccaagggggcguucaagaagcggaagccgcccuccaagaugcugagcuccauccugggcaagagcaaccuccaguucgccgggauguccaucagccugaccaucuccaccgccagccugaaccuccgcacccccgacuccaagcagaucaucgccaaccaccacaugcggagcaucuccuucgccagcggcggggaccccgacacgaccgacuacgucgcguacguggccaaggaccccgugaaccgccgcgccugccacauccuggagugcugcgacggccuggcccaggacgucaucggcuccaucgggcaggcguucgagcuccgguucaagcaguaccugcagugccccaccaagauccccgcccugcacgaccgcaugcagagccucgacgagccguggaccgaggaggagggcgacggguccgaccaccccuacuacaacagcauccccagcaagaugcccccgcccggcggguuccuggacacgcggcugaagccccgcccgcacgcccccgacaccgcccaguucgccggcaaggagcagaccuacuaccagggccggcaccucggggacaccuucggcgaggacuggcagcagacgccccugcgccagggguccagcgacaucuacuccacccccgagggcaagcugcacguggcgccgaccggggaggcccccaccuacgugaacacgcagcagaucccgccccaggccuggcccgccgccgucagcuccgcggagagcagcccccggaaggaccucuucgacaugaagcccuucgaggacgcccugaagaaccagccccugggcccggugcucuccaaggccgccuccguggagugcaucagccccgucagcccccgcgcccccgacgcgaagaugcuggaggagcugcaggccgagaccugguaccagggcgagaugucccggaaggaggccgaggggcuccuggagaaggacggcgacuuccuggugcgcaaguccaccaccaacccggggagcuucgugcucacgggcaugcacaacggccaggccaagcaccuccugcuggucgaccccgaggggaccauccggaccaaggaccgcguguucgacuccaucagccaccugaucaaccaccaccuggaguccagccugcccaucgucagcgcgggcuccgagcucugccugcagcagcccguggagcggaagcaguga

SEQ ID NO: 36359 - RNA, 1893 nt, Artificial Sequence
  derived and/or modified sequence opt1 from SHC4__Homo_sapiens__NP_976224
augcgcgagcggggccaggacagccuggccgggcucgugcuguacgucggccuguucgggcaccccggcaugcuccaccgcgccaaguacucccgguuccgcaacgagagcaucaccucccuggacgaggggagcuccggcggcagcguggggaacaagggcuccccgcagccgccccaccccgcgcuggcgccccaccuccccaccgaggacgccacgcugcccagccaggagucccccaccccgcugugcacccucaucccccggauggccagcaugaagcuggccaaccccgccacccugcucucccugaagaacuucugccuggggacgaaggaggugccccgccucaagcugcaggagagccgggacccgggcuccagcgggcccuccagccccgagaccucccugagccgcuccggcaccgcgcccccgccccagcaggaccucgucggccaccgggccaccgcccugacgcccgacagcugcccccugccggggcccggcgagcccacccuccgcagccggcaggaccgccacuuccugcagcaccuccuggggaugggcaugaacuacugcgugcgguacaugggcugcguggagguccugcaguccaugcgcagccuggacuucgggaugcggacccaggugacccgcgaggccaucucccggcucugcgaggccgugcccggcgccaacggggccaucaagaagcgcaagccgcccgucaaguuccugagcacggugcugggcaaguccaaccuccaguucagcgggaugaacaucaagcugaccaucuccacgugcagccugacccucaugaaccuggacaaccagcagaucaucgccaaccaccacaugcaguccaucagcuucgcguccggcggcgaccccgacaccaccgacuacguggccuacgucgccaaggaccccgugaaccagcgggccugccacauccuggagugccacaacgggauggcccaggacgugaucagcaccaucggccaggcguucgagcuccgcuucaagcaguaccugaagaacccgucccugaacaccagcugcgaguccgaggagguccacaucgacagccacgccgaggagcgggaggaccacgaguacuacaacgagauccccgggaagcagcccccggugggcgggguguccgacaugcgcaucaagguccaggccacggagcagauggccuacugccccauccagugcgagaagcucugcuaccugcccggcaacagcaagugcuccagcguguacgagaacugccuggagcagagccgcgccaucggcaacgugcacccccgcgggguccagucccagcgggacaccagccuccugaagcacacgugccggguggaccuguucgacgacccgugcuacaucaacacccaggcgcuccaguccacccccggcagcgccgggaaccagcgcuccgcccagccccugggcagccccuggcacugcgggaaggccccggagaccgugcagcccggcgccaccgcgcagcccgccuccagccacucccugccccacaucaagcagcagcucuggagcgaggagugcuaccacggcaagcugucccggaaggccgccgagagccugcuggucaaggacggggacuuccucgugcgcgaguccgcgaccagcccgggccaguacguccuguccgggcugcagggcggccaggccaagcaccuccugcugguggaccccgaggggaaggugcggacgaaggaccacgucuucgacaacgugggccaccucauccgcuaccacauggacaacagccugcccaucaucuccagcgggagcgaggugucccugaagcagcccguccggaaggacaacaacccggcccuccugcacagcaacaaguga

SEQ ID NO: 36360 - RNA, 2019 nt, Artificial Sequence
  derived and/or modified sequence opt1 from SHCBP1__Homo_sapiens__NP_079021
auggccgacggcagccugaccgggggcgggcucgaggccgcggccauggcccccgagcgcaccggcugggccguggagcaggagcuggccucccuggagaaggggcuguuccaggacgaggacagcugcuccgacugcagcuaccgggacaagccgggcuccagccugcaguccuucaugcccgagggcaagacguucuuccccgagaucuuccagaccaaccagcuccucuucuacgagcgcuuccgggcguaccaggacuacauccuggccgacugcaaggccagcgagguccaggaguucaccgccgaguuccuggagaaggugcucgagcccuccggguggcgcgcgguguggcacaccaacgucuucaaggugcugguggagaucacggacgucgacuucgccgcccugaaggccguggugcggcucgccgagccguaccugugcgacagccaggucuccaccuucaccauggagugcaugaaggagcugcucgaccugaaggagcaccgccugccccuccaggagcugugggugguguucgacgacagcggcgucuucgaccagaccgcgcuggccaucgagcacgugcgguucuucuaccagaacaucuggcgcuccugggacgaggaggaggaggacgaguacgacuacuucgugcggugcgucgagccccgccuccggcugcacuacgacauccuggaggaccgcgugcccagcgggcucaucguggacuaccacaaccugcugucccagugcgaggagagcuaccggaaguuccucaaccugcgcuccagccuguccaacugcaacagcgacagcgagcaggagaacaucuccauggucgagggccucaagcuguacagcgagauggagcagcugaagcagaagcucaagcugaucgagaacccgcugcuccgguacguguucggguaccagaagaacuccaacauccaggccaagggcgugcgcagcuccggccagaagaucacgcacgucgugagcuccaccaugauggccgggcugcugcggagccuccugaccgaccgccugugccaggagcccggcgaggaggagcgggagauccaguuccacuccgacccccucagcgccaucaacgcgugcuucgagggggacaccgugaucgucugccccggccacuacgugguccacggcacguucuccaucgccgacagcaucgagcuggagggguacggccugccggacgacaucgugaucgagaagcgcgggaagggcgacaccuucguggacugcaccggggccgacaucaagaucuccggcaucaaguucguccagcacgacgccguggagggcauccucaucgugcaccgggggaagaccacgcuggagaacugcguccugcagugcgagaccaccggcgugaccgugcgcacgagcgccgaguuccucaugaagaacuccgaccuguacggggcgaagggcgccgggaucgagaucuaccccggcagccagugcacccuguccgacaacggcauccaccacugcaaggaggggauccugaucaaggacuuccucgacgagcacuacgacauccccaagaucagcauggucaacaacaucauccacaacaacgagggcuacgggguggugcuggucaagcccaccaucuucuccgaccugcaggagaacgccgaggacggcaccgaggagaacaaggcccucaagauccagacgagcggggagccggacguggccgagcgcguggaccuggaggagcugaucgagugcgcgaccggcaagauggagcucugcgcccggaccgaccccagcgagcaggucgagggcaacugcgagaucgugaacgagcugaucgccgccuccacccagaaggggcagaucaagaagaagcgccugagcgagcucggcaucacgcaggcggacgacaaccugaugucccaggagauguucguggggaucgucggcaaccaguucaaguggaacggcaaggggagcuucggcaccuuccuguucuga

SEQ ID NO: 36361 - RNA, 1326 nt, Artificial Sequence
  derived and/or modified sequence opt1 from SHF__Homo_sapiens__NP_001288097
augcugcucagcggcgcgcccccggccgggucccgccccggcccccggacccaggggagcgccggcgggggccccggcgggucccgccggggcgccgggggcgccggggccggcccgggcgggggcgggagcggcggcguggccaaguggcugcgcgagcaccugggguuccggggcgggggcgggggcggcgggggcuccaagcccgcgccgcccgagcccgacuaccgcccgcccgcccccagccccgccgccccgcccgcgcccccgcccgacauccucgccgccuaccggcugcagcgcgagcgggacuucgaggaccccuacuccgggggcagcuccgggagcgccgcccuggcgacccccgucgcccccggccccacgcccccgccccgccacggcuccccgccccaccggcucauccgcguggagacccccgggccgcccgcgccgcccgccgacgagcggaucagcggcccgcccgccuccagcgaccgccuggccauccuggaggacuacgccgaccccuucgacgugcaggagaccggggagggcuccgccggggccagcggcgcccccgagaagguccccgagaacgacggcuacauggagcccuacgaggcgcagaagaugauggccgagauccggggguccaaggagaccgccacgcagccccucccccuguacgacacccccuacgagcccgaggaggacggcgccacccccgagggggagggcgccccguggccccgcgagagccggcugcccgaggacgacgagcggcccccggaggaguacgaccagcccugggaguggaagaaggagcgcaucuccaaggcguucgccgcccaguucgagggccccgagaaguccugccucagccccgggcgcgaggagaagggccggcugccgccccgccugagcgccgggaaccccaagagcgcgaagccccucuccauggagccgagcagcccccugggcgaguggaccgaccccgcccugccgcucgagaaccaggugugguaccacggggccaucucccgcacggacgccgagaaccugcugcggcucugcaaggaggccuccuaccuggugcgcaacagcgagaccuccaagaacgacuucagccugucccucaagagcucccagggcuucaugcacaugaagcugagccggaccaaggagcacaaguacguccugggccagaacuccccgcccuucagcuccgugcccgagaucgugcaccacuacgcgagccgcaagcuccccaucaagggggccgagcacaugucccugcuguaccccgucgccauccggacccucuga

SEQ ID NO: 36362 - RNA, 213 nt, Artificial Sequence
  derived and/or modified sequence opt1 from SHFM1__Homo_sapiens__NP_006295
augagcgagaagaagcagcccguggaccugggccuccuggaggaggacgacgaguucgaggaguucccggccgaggacugggccgggcuggacgaggacgaggacgcgcacgucugggaggacaacugggacgacgacaacguggaggacgacuucuccaaccagcuccgcgccgagcuggagaagcacggcuacaagauggagaccagcuga

SEQ ID NO: 36363 - RNA, 1389 nt, Artificial Sequence
  derived and/or modified sequence opt1 from SHH__Homo_sapiens__NP_000184
augcugcuccuggcccgcugccugcuccuggugcuggucagcucccuccuggugugcagcggccuggccugcgggcccggccggggguucggcaagcgccggcacccgaagaagcucacgccccuggcguacaagcaguucauccccaacguggccgagaagacccugggggccuccggccgcuacgagggcaagaucagccggaacuccgagcgcuucaaggagcucacccccaacuacaacccggacaucaucuucaaggacgaggagaacaccggggccgaccggcugaugacccagcgcugcaaggacaagcugaacgcccucgcgaucagcgucaugaaccaguggcccggcgugaagcugcgggugaccgaggggugggacgaggacggccaccacuccgaggagagccugcacuacgaggggcgcgccgucgacaucacgaccuccgaccgggaccgcagcaaguacggcaugcucgcccggcuggccguggaggcgggcuucgacuggguguacuacgaguccaaggcccacauccacugcagcgucaaggccgagaacuccguggccgccaagagcgggggcugcuuccccggguccgcgaccgugcaccuggagcagggcggcaccaagcucgucaaggaccugagccccggggaccgcgugcuggccgccgacgaccagggccggcuccuguacuccgacuuccugacguuccucgaccgcgacgacggggccaagaagguguucuacgucaucgagacccgggagccgcgcgagcggcugcugcucaccgccgcgcaccuccuguucguggcgccccacaacgacagcgccaccggcgagcccgaggccuccagcgggagcgggcccccguccggcggggcccugggcccccgcgcccuguucgccagccgggugcgccccgggcagcgcgucuacgugguggccgagcgggacggcgaccgccggcugcuccccgccgccguccacuccgugacgcugagcgaggaggcggccggggccuacgccccgcugaccgcgcagggcaccauccucaucaaccgcgugcuggccuccugcuacgccgucaucgaggagcacagcugggcccaccgggccuucgcgcccuuccgccuggcccacgcccuccuggccgcccuggcgcccgcccggaccgaccgcggcggggacuccggcgggggcgaccggggcggcggcgggggccgcguggcccucacggcccccggggccgcggacgccccgggcgccggcgccaccgcggggauccacugguacagccagcugcuguaccagaucggcaccuggcuccuggacuccgaggcccugcacccccuggggauggccgucaagagcuccuga

SEQ ID NO: 36364 - RNA, 888 nt, Artificial Sequence
  derived and/or modified sequence opt1 from SHISA2__Homo_sapiens__NP_001007539
auguggggcgcccgccggagcuccgugagcuccagcuggaacgccgcgucccugcuccagcugcugcucgccgcccugcuggccgccggggcgcgcgccagcggcgaguacugccacggguggcucgacgcccagggcgucuggcggaucggguuccagugccccgagcgcuucgacggcggcgacgccaccaucugcugcggguccugcgcgcugcgguacugcugcagcuccgccgaggcccgccuggaccagggcgggugcgacaacgaccggcagcagggcgccggggagccgggccgcgccgacaaggacggccccgacgggagcgcggugcccaucuacgugcccuuccucaucgucggcuccguguucguggccuucaucauccuggggagccuggucgccgccugcugcugccggugccuccgcccgaagcaggacccccagcagucccgggcccccggcggcaaccgccugauggagaccauccccaugaucccgagcgcguccacgagccggggguccagcucccgccagagcagcaccgccgccuccagcuccagcuccgccaacagcggcgcccgggcgccgcccacccgcucccagaccaacugcugccugcccgaggggacgaugaacaacguguacgugaacaugcccaccaacuucagcguccucaacugccagcaggccacccagaucgugccccaccagggccaguaccugcacccgcccuacgugggguacaccguccagcacgacuccgugcccaugacggccgugccgcccuucauggacggccugcagcccggcuaccggcagauccagagccccuucccccacaccaacuccgagcagaagauguaccccgccgucaccguguga

SEQ ID NO: 36365 - RNA, 717 nt, Artificial Sequence
  derived and/or modified sequence opt1 from SHISA3__Homo_sapiens__NP_001073974
augcgcgcccugcucgcccugugccugcuccugggcuggcugcggugggggcccgcgggcgcccagcagagcggggaguacugccacggcuggguggacguccaggggaacuaccacgagggcuuccagugcccggaggacuucgacacccucgacgccaccaucugcugcggcuccugcgcccugcgcuacugcugcgccgcggccgacgcccggcuggagcagggcgggugcacgaacgaccgccgggagcucgagcaccccgggaucaccgcccagcccguguacgugcccuuccugaucgucggcagcaucuucaucgcguucaucauccugggguccgugguggccaucuacugcugcacgugccuccgcccgaaggagcccagccagcagcccauccgguucucccugcgcagcuaccagaccgagacccugcccaugauccucaccuccaccagcccgcgggcccccucccgccagagcuccaccgccacgagcuccagcuccaccggcggcagcauccggcgcuucuccuucgcccgggcggagcccgggugccugguccccagcccgcccccgcccuacaccaccucccacagcauccaccuggcccagcccagcggcuuccucgugagcccccaguacuucgccuacccccugcagcaggagcccccgcugcccgggaaguccugccccgacuucuccagcuccuga

SEQ ID NO: 36366 - RNA, 1503 nt, Artificial Sequence
  derived and/or modified sequence opt1 from SHISA6__Homo_sapiens__NP_001166932
auggcccugcgccggcuccugcugcuccugcugcucagccuggagucccuggaccuccugcccagcgugcacggcgcccgcgggcgggcggccaaccgcacccuguccgccggcggggccgccgucggcgggcggcgcgcgggcggcgcccucgcccgcgggggccgggagcugaacgggaccgcccgggcgccgggcauccccgaggccgggagccgccggggccagcccgccgccgccguggcggccgccgccuccgccgcggugacguacgagaccugcuggggcuacuacgacgucagcgggcaguacgacaaggaguucgagugcaacaacuccgagagcggcuaccuguacugcugcgggaccugcuacuaccgcuucugcugcaagaagcggcacgagaagcucgaccagcgccagugcaccaacuaccagucccccgugugggugcagacgccgagcaccaaggucgugucccccggccccgagaacaaguacgaccccgagaaggacaagaccaacuucaccguguacaucacgugcggcgucaucgccuucgugaucguggccggggucuucgccaaggugagcuacgacaaggcccaccggccgccccgcgagaugaacauccaccgggcgcuggccgacauccugcgccagcagggccccauccccaucgcccacugcgagcgggagaccaucuccgccaucgacaccagcccgaaggagaacacccccgugcgcuccagcuccaagaaccacuacacgcccguccggaccgccaagcagacccccgagaagccgcgcaugaacaacauccucaccagcgcgacggagcccuacgaccuguccuucagccgcagcuuccagaaccuggcccaccucccgcccuccuacgagagcgccgugaagaccaaccccuccaaguacagcucccugaagcggcugaccgacaaggaggccgacgaguacuacaugcgccggcgccaccuccccgaccuggcggcccgggggacccugccccucaacgugauccagaugagccagcagaagccccugccgcgcgagcggccccgccggcccauccgcgccaugucccaggaccggguccugagccccgaccgcggccucccggacgaguucuccaugcccuacgaccggauccugagcgacgagcagcugcucuccacggagcgccugcacagccaggacccccugcucuccccggagcggaccgccuuccccgagcagagccugucccgcgccaucagccacaccgacguguucguguccacccccguccuggaccgguaccgcaugagcaagaugcacucccaccccagcgcgagcaacaacuccuacgccacgcucgggcagagccagaccgccgccaagcggcacgccuucgcgucccgccgccacaacaccguggagcagcugcacuacaucccgggccaccacacgugcuacaccgccagcaagaccgaggugaccgucuga

SEQ ID NO: 36367 - RNA, 1275 nt, Artificial Sequence
  derived and/or modified sequence opt1 from SHISA9__Homo_sapiens__NP_001138676
augcgccgggugcugcgccuccugcugggcugcuuccucaccgagcugugcgcccgggucugccgcgcccaggagcgggcggggcacggccagcuggcccagcucgggggcgugcugcugcucgccgggggcaaccgcagcggcgccgccuccggggaggcgagcgagggcgccgaggccuccgacgccccgcccacccgggcgcccacgcccgacuucugccgcggguacuucgacgugaugggccagugggacccgcccuucaacugcagcuccggggacuucaucuucugcugcgggaccugcggcuuccgguucugcugcaccuucaagaagcgccggcugaaccagagcacgugcaccaacuacgacacgccccuguggcucaacaccggcaagccgcccgcccgcaaggacgacccccugcacgaccccaccaaggacaagaccaaccugaucgucuacaucaucugcggcgugguggccgucauggugcucguggggaucuucaccaagcugggccuggagaaggcccaccggccccagcgcgagcacaugucccgggcccucgcggacgucaugcgcccccagggccacugcaacaccgaccacauggagcgggaccugaacaucguggugcacguccagcacuacgagaacauggacacccgcacgcccaucaacaaccugcacgccacccagaugaacaacgccgugcccaccagcccccuccugcagcagauggggcacccccacuccuacccgaaccugggccagaucagcaaccccuacgagcagcagccgcccgggaaggagcucaacaaguacgccucccugaaggccgugggcagcuccgacggggacugggcggucagcacccugaagucccccaaggccgacaaggugaacgacgacuucuacacgaagcggcgccaccucgccgagcuggccgccaagggcaaccugccccuccaccccgugcgggucgaggacgagccccgcgcguucagcccggagcacggccccgccaagcagaacgggcagaagucccgcaccaacaagaugccgccccacccccuggccuacaccagcaccacgaacuucaagggcugggaccccaacgagcagucccugcggcgccaggccuacagcaacaaggggaagcucggcaccgccgagaccgggagcuccgacccccugggcacccggccgcagcacuacccgccgccccagcccuacuucaucacgaacagcaagaccgaggugaccguguga

SEQ ID NO: 36368 - RNA, 1038 nt, Artificial Sequence
  derived and/or modified sequence opt1 from SHMT1__Homo_sapiens__NP_001268715
augggccuggaccuccccgacgggggccaccugacccacggguucaugaccgacaagaagaagaucagcgccacguccaucuucuucgagagcaugccguacaaggugaaccccgacaccggcuacaucaacuacgaccagcuggaggagaacgcccgccucuuccaccccaagcugaucaucgcggggaccuccugcuacagccggaaccuggaguacgcccgccuccggaagaucgccgacgagaacggcgccuaccugauggccgacauggcgcacaucuccggccuggucgccgccgggguggugcccagcccguucgagcacugccacgucgugaccacgaccacccacaagacccuccgcggcugccgggccgggaugaucuucuaccgcaagggcgugaaguccgucgaccccaagacggggaaggagauccuguacaaccuggagagccucaucaacuccgcgguguuccccggccugcagggcgggccccacaaccacgccaucgccggcguggccgucgcccugaagcaggcgaugacccucgaguucaagguguaccagcaccagguggucgccaacugccgggcccugagcgaggcccugaccgagcucggguacaagaucgugaccggcggcuccgacaaccaccugauccugguggaccuccgcagcaaggggacggacggcgggcgggccgagaagguccuggaggcgugcuccaucgccugcaacaagaacacgugcccgggcgaccgcagcgcccugcggcccuccgggcuccgccugggcacccccgcccugaccagccggggccuccuggagaaggacuuccagaagguggcccacuucauccaccgcgggaucgagcugacccuccagauccaguccgacaccggcgugcgggcgacccugaaggaguucaaggagcgccuggccggggacaaguaccaggccgccguccaggcccuccgggaggagguggagagcuucgcgucccuguucccccugccgggccuccccgacuucuga

SEQ ID NO: 36369 - RNA, 1485 nt, Artificial Sequence
  derived and/or modified sequence opt1 from SHMT2__Homo_sapiens__NP_001159828
augcuguacuucagccucuucugggccgcccgcccccugcagcggugcggccagcuggugcgcauggcgauccgggcccagcacuccaacgccgcccagacccagaccggggaggccaaccgcggcuggacggggcaggagagccucuccgacagcgacccggagaugugggagcugcugcagcgggagaaggaccgccagugccggggccucgagcugaucgcguccgagaacuucugcagccgcgccgcccuggaggcccucggguccugccugaacaacaaguacagcgagggcuaccccggcaagcgguacuacgggggcgcggaggucguggacgagaucgagcugcucugccagcgccgggcccuggaggccuucgaccuggaccccgcccaguggggcgugaacguccagcccuacuccgggagcccggccaaccucgcgguguacaccgcccugcugcagccccacgaccgcaucauggggcucgaccugcccgacggcggccaccugacccacggguacauguccgacgugaagcggaucagcgccaccuccaucuucuucgagagcaugcccuacaagcucaaccuggcccugacggcccgccucuuccggccgcgccugaucaucgcgggcaccuccgccuacgcccggcugaucgacuacgcccgcaugcgggaggucugcgacgaggugaaggcccaccuccuggcggacauggcccacaucagcgggcugguggccgccaaggucauccccucccccuucaagcacgccgacaucgugaccaccacgacccacaagacccuccgcggcgcgcggagcggccugaucuucuaccgcaagggggugaaggccgucgaccccaagaccggccgcgagaucccguacacguucgaggaccggaucaacuucgccguguuccccucccugcagggcgggccccacaaccacgccaucgcggccguggccgucgcccucaagcaggccugcacccccauguuccgcgaguacagccuccaggugcugaagaacgcgcgggccauggccgacgcccugcuggagcgcggguacagccugguguccggcggcaccgacaaccaccucguccugguggaccugcggccgaaggggcucgacggcgcccgcgcggagcgggugcuggagcuggucagcaucaccgccaacaagaacacgugccccggggaccgcuccgccaucacccccggcgggcuccggcugggcgcccccgcccugaccagccgccaguuccgggaggacgacuuccgccgggugguggacuucaucgacgagggcgucaacaucgggcucgaggugaaguccaagaccgcgaagcugcaggacuucaagagcuuccugcugaaggacuccgagacgagccagcgccucgccaaccugcggcagcgcgucgagcaguucgcccgggccuucccgaugcccggcuucgacgagcacuga

SEQ ID NO: 36370 - RNA, 1611 nt, Artificial Sequence
  derived and/or modified sequence opt1 from SHOC2__Homo_sapiens__NP_001255968
augagcuccagccugggcaaggagaaggacuccaaggagaaggaccccaaggugccgagcgccaaggagcgcgagaaggaggccaaggcguccgggggcuucgggaaggagagcaaggagaaggagcccaagaccaagggcaaggacgccaaggacgggaagaaggacuccagcgccgcccagcccggcgucgccuucuccguggacaacaccaucaagcggcccaacccggcgcccggcacgcgcaagaaguccagcaacgccgaggugaucaaggagcucaacaagugccgggaggagaacagcaugcgccuggaccuguccaagcggagcauccacauccuccccuccagcaucaaggagcugacccagcugaccgagcucuaccuguacuccaacaagcugcagagccuccccgccgaggucgggugccuggugaaccugaugacccucgcccuguccgagaacagccugacgagccucccggacucccuggacaaccugaagaagcuccgcaugcuggaccugcggcacaacaagcuccgcgagauccccagcguggucuaccggcuggacucccugaccacccucuaccugcgcuucaaccggaucaccacgguggagaaggacaucaagaaccugagcaagcucuccaugcugagcauccgcgagaacaagaucaagcagcugcccgcggagaucggcaaccucuccagccugucccggcuggggcuccgcuacaaccggcugagcgccaucccccgcucccuggccaagugcagcgcccucgaggagcugaaccuggagaacaacaacaucuccacccucccggagagccugcuguccagccucgugaagcugaacucccugacccucgcccggaacugcuuccagcuguaccccgucggcgggcccagccaguucuccaccaucuacagccugaacauggagcacaaccgcaucaacaagauccccuucggcaucuucagccgggcgaaggugcucuccaagcugaacaugaaggacaaccagcugacgagccugccgcucgacuucggcaccuggaccuccaugguggagcugaaccuggccaccaaccagcucacgaagauccccgaggacgucagcgggcuggugucccuggaggugcucauccugagcaacaaccugcucaagaagcugccccacggccuggggaaccuccgcaagcugcgggagcuggaccucgaggagaacaagcuggagucccugcccaacgagaucgccuaccucaaggaccugcagaagcugguccucaccaacaaccagcugaccacccugccgcgcggcaucggccaccucacgaaccugacccaccuggggcucggcgagaaccugcugacccaccuccccgaggagaucgggacccuggagaaccuggaggagcucuaccugaacgacaaccccaaccugcacagccuccccuucgagcuggcccugugcuccaagcucagcaucauguccaucgagaacugcccgcugagccaccucccgccccagaucguggccggcgggcccuccuucaucauccaguuccugaagaugcagggccccuaccgcgcgaugguguga

SEQ ID NO: 36371 - RNA, 960 nt, Artificial Sequence
  derived and/or modified sequence opt1 from SHOX2__Homo_sapiens__NP_001157150
auggaggagcugaccgccuucgugagcaaguccuucgaccagaaggucaaggagaagaaggaggccaucaccuaccgcgaggugcucgagagcggcccccugcgcggggcgaaggagccgacgggcugcaccgaggccgggcgggacgaccgguccagccccgccgugcgcgccgccggcgggggcggcgggggcgggggcgggggcggcgggggcgggggcggcgggggcgucgggggcgggggcgcgggcgggggcgccgggggcgggcggucccccgugcgcgagcuggacaugggcgccgccgagcggagccgcgagcccggcuccccgcggcucaccgaggugagccccgagcugaaggaccgcaaggaggacgcgaaggggauggaggacgagggccagaccaagaucaagcagcggcgcucccggacgaacuucacccuggagcagcucaacgagcuggagcgccuguucgacgagacccacuaccccgacgccuucaugcgggaggagcucagccagcgccuggggcuguccgaggcccggguccaggugugguuccagaaccgccgggccaagugccgcaagcaggagaaccagcuccacaagggcgugcugaucggggccgcgagccaguucgaggccugccgggucgcccccuacgugaacgugggcgcccugcgcaugccguuccagcagguccaggcccagcuccagcuggacuccgcgguggcccacgcccaccaccaccuccacccccaccuggccgcccacgcgcccuacaugauguuccccgccccgcccuucggccugccccuggccacccucgccgccgacagcgcguccgccgccagcguggucgccgcggccgccgccgccaagacgaccuccaagaacagcuccaucgcggaccugcgccugaaggccaagaagcacgccgccgcccucgggcuguga

SEQ ID NO: 36372 - RNA, 879 nt, Artificial Sequence
  derived and/or modified sequence opt1 from SHOX__Homo_sapiens__NP_000442
auggaggagcugaccgccuucgugagcaaguccuucgaccagaaguccaaggacggcaacgggggcgggggcgggggcggcgggaagaaggacagcaucaccuaccgcgagguccucgagagcggccuggcccggucccgcgagcuggggacgagcgacuccagccuccaggacaucaccgagggcgggggccacugccccgugcaccuguucaaggaccacguggacaacgacaaggagaagcugaaggaguucggcaccgcgcgggucgccgaggggaucuacgagugcaaggagaagcgcgaggacgugaaguccgaggacgaggacggccagaccaagcucaagcagcggcgcagccggacgaacuucacccuggagcagcugaacgagcucgagcgccuguucgacgagacccacuaccccgacgccuucaugcgggaggagcugucccagcgccucgggcugagcgaggcccgggugcaggucugguuccagaaccgccgggccaagugccgcaagcaggagaaccagaugcacaagggcgugauccugggcaccgcgaaccaccucgacgccugccggguggcccccuacgucaacaugggggcccugcgcaugcccuuccagcagguccaggcgcagcugcagcucgagggcguggcccacgcccacccccaccuccacccccaccuggccgcccacgcgcccuaccugauguucccgccgccgcccuucgggcugcccaucgccucccuggccgagagcgccuccgccgcggccgugguggccgccgccgccaagagcaacuccaagaacagcuccaucgcggaccuccggcugaaggcccgcaagcacgccgaggcccugggccucuga

SEQ ID NO: 36373 - RNA, 1437 nt, Artificial Sequence
  derived and/or modified sequence opt1 from SHPK__Homo_sapiens__NP_037408
auggccgcccgccccaucacccugggcaucgaccucgggaccacgagcgugaaggcggcccugcugcgggccgccccggacgaccccuccggcuucgccguccucgcgagcugcgcccgcgccgcccgggcggaggccgccguggaguccgccguggccgggccccagggccgcgagcaggacgucagccggauccugcaggcgcugcacgagugccucgccgcccugccccgcccgcagcugcgguccgugguggggaucggcgucagcggccagaugcacggggugguguucuggaagaccggccaggggugcgaguggaccgagggcgggaucacccccgucuucgagccccgcgccgugucccaccucgugacguggcaggacggccggugcagcuccgaguuccuggccagccugccccagccgaagucccaccucagcgucgcgaccggcuucgggugcgccaccaucuucuggcugcugaaguaccgccccgaguuccucaaguccuacgacgccgccggcaccauccacgacuacgugguggccaugcugugcgggcugccccggccccucaugagcgaccagaacgcggccuccuggggcuacuucaacacgcagagccaguccuggaacgucgagacccugcgcagcuccggcuucccggugcaccuccugcccgacaucgccgagcccgggagcguggccggccggaccagccacaugugguucgagauccccaaggggacccaggucggcguggcccugggggaccugcaggcguccguguacagcugcauggcccagcgcacggacgccguccucaacaucuccaccagcgugcagcuggccgcguccaugccgagcggcuuccagcccgcccagacccccgaccccaccgccccgguggccuacuuccccuacuucaaccggacguaccugggcgucgccgcgucccucaacgggggcaacgugcuggccaccuucguccacaugcuggugcaguggauggccgaccucgggcuggagguggaggagagcaccgucuacucccgcaugauccaggccgccgugcagcagcgggacacccaccugacgaucacccccaccgugcucggcgagcgccaccuccccgaccagcuggcgagcgucacccggaucuccagcuccgaccugagccuggggcacgugacgcgcgcccugugccggggcaucgugcagaaccuccacuccaugcugccgauccagcagcugcaggaguggggcgucgagcgcgugauggggagcggcuccgcccucagccgcaacgacgugcugaagcaggagguccagcgggccuucccccugcccauguccuucgggcaggacguggacgccgcggugggcgccgcccucgucaugcugcgccggcaccugaaccagaaggagagcuga

SEQ ID NO: 36374 - RNA, 5052 nt, Artificial Sequence
  derived and/or modified sequence opt1 from SHPRH__Homo_sapiens__NP_001036148
augagcucccgccggaagcgcgcgccgcccgugcgggucgacgaggagaagcgccagcagcugcacuggaacaugcacgaggaccggcgcaacgagcccaucaucaucagcgacgacgacgagcagcccugccccggcuccgacaccagcuccgcccacuacaucauccugagcgacucccugaaggaggagguggcgcaccgggacaagaagcgcugcagcaagguggucuccuucagcaagcccaucgagaaggaggagaccgugggcaucuucagcccccugagcgugaagcucaacaucgucaucucccccuaccacuucgacaacagcuggaaggccuuccugggcgagcugacgcuccagcugcugcccgcccagucccucaucgagaacuucagcgagcgguccaucacccugaugagcuccgagagcagcaaccaguuccugaucuacgugcacuccaagggggaggacguggagaagcagaagaaggagcccaugagcaucugcgacaagggcauccucgucgaguccagcuucuccggggagaugcuggaggaccugggcuggcuccagaagaagcgccggaucaagcuguaccagaagcccgagggcaaccacaucaucaagguggggaucuaccugcucgaggccggccuggccaagcuggacuuccucagcgacgccaacucccgcaugaagaaguucaaccagcugaugaagaaggugauggagaagcugcacaacagcaucauccccgacguccucgaggaggacgaggacgaccccgaguccgagcccgaggggcaggacaucgacgagcuguaccacuucgugaagcagacccaccagcaggagacccagagcauccagguggacguccagcaccccgcccugauccccgugcuccggcccuaccagcgcgaggccgugaacuggaugcugcagcaggagugcuuccgguccagccccgccacggaguccgcgcugcacuuccucuggcgcgagaucgucaccagcgagggccugaagcuguacuacaaccccuacaccgggugcaucauccgggaguaccccaacuccggcccccagcuccugggcgggauccuggccgacgagaugggccucgggaagaccguggaggugcuggcccugauccucacgcacacccgccaggacgucaagcaggacgcccugacccugcccgagggcaagguggugaacuacuucauccccagccacuacuucggcgggaagcucaagaagaccgagauccagaacaucgaguucgagcccaaggagaagguccagugcccgcccacgcgggugaugauccugaccgccgucaaggagaugaacggcaagaaggggguguccauccugagcaucuacaaguacguguccagcaucuaccgcuacgacguccagcggaaccgcagccuccugaagcgcaugcugaagugccucaucuucgagggccuggugaagcagaucaaggggcacggcuucuccggcaccuucacccuggggaagaacuacaaggaggaggacaucugcgacaagacgaagaagcaggcggugggcagcccccggaagauccagaaggagacccgcaaguccgggaacaaggacaccgacagcgaguaccugcccuccgacaccagcgacgacgacgacgaccccuacuacuacuacuacaagucccggcgcaaccggagcaagcuccgcaagaagcuggucccguccacgaagaagggcaagagccagcccuucaucaaccccgacucccaggggcacugcccggccaccagcgacuccggcaucaccgacguggccaugagcaagagcacgugcaucagcgaguucaaccaggagcacgagaccgaggacugcgccgagucccugaaccacgccgacagcgacgugccgcccagcaacaccaugucccccuucaacaccagcgacuaccgguucgagugcaucugcggcgagcucgaccagaucgaccgcaagccgcggguccagugccugaagugccaccuguggcagcacgcgaagugcgugaacuacgacgagaagaaccucaagaucaagcccuucuacugcccccacugccugguggccauggagcccgucuccacccgcgccacgcugaucaucagcccguccagcaucugccaccaguggguggacgagaucaaccggcacgugcgcuccagcucccuccggguccugguguaccagggggugaagaaggacggcuuccugcagccccacuuccucgccgagcaggacaucgucaucaucaccuacgacgugcugcgcagcgagcugaacuacguggacaucccccacuccaacagcgaggacgggcggcgccuccggaaccagaagcgcuacauggccauccccuccccgcuggucgcgguggagugguggcggaucugccuggacgaggcccagaugguggagugccccaccgucaaggccgccgagauggcccagcgccucagcggcaucaaccgcuggugcaucuccgggacccccgugcagcggggccuggaggaccuguucggccucguggucuuccuggggaucgagcccuacugcgugaagcacuggugggugcgccugcucuaccggccguacugcaagaagaacccccagcaccuguacagcuucaucgcgaagauccuguggcgcuccgccaagaaggacgucaucgaccagauccagaucccgccccagacggaggagauccacuggcuccacuucagcccgguggagcggcacuucuaccaccgccagcacgaggugugcugccaggacgucguggugaagcugcggaagaucuccgacugggcccugaagcucagcagccuggaccgccggaccgucaccuccauccuguacccccuccugcgccugcggcaggccugcugccacccccaggcggugcgcggcgaguuccucccccugcagaaguccaccaugacgauggaggagcugcucaccucccugcagaagaagugcgggaccgagugcgaggaggcccaccggcagcuggugugcgcccucaacggccuggccggcauccacaucaucaagggggaguacgcccuggcggccgagcucuaccgcgagguccugcggagcuccgaggagcacaagggcaagcugaagaccgacagccuccagcgccugcacgccacccacaaccugauggagcuccugaucgcccggcacccggggaucccgcccacgcugcgcgacggccggcucgaggaggaggccaagcagcugcgcgagcacuacauguccaagugcaacaccgagguggcggaggcccagcaggcccuguacccggugcagcagaccauccacgagcuccagcggaagauccacagcaacucccccugguggcugaacgucauccaccgcgccaucgaguucaccaucgacgaggagcuggugcagcgcgugcggaacgagaucacgagcaacuacaagcagcagaccgggaagcucuccaugagcgagaaguuccgcgacugccggggccugcaguuccugcucaccacccagauggaggagcugaacaagugccagaagcugguccgcgaggccgugaagaaccucgaggggccgcccucccggaacgugaucgagagcgcgacggucugccaccuccgcccggcccggcugccccucaacugcugcguguucugcaaggccgacgagcuguucaccgaguacgaguccaagcuguucagcaacaccgugaaggggcagaccgccaucuucgaggagaugaucgaggacgaggagggccucgucgacgaccgcgcgcccacgaccacccgggggcugugggccaucuccgagaccgagcgcagcaugaaggccauccuguccuucgccaagagccaccgguucgacguggaguucgucgacgagggcagcacguccauggaccucuucgaggccuggaagaaggaguacaagcugcugcacgaguacuggauggcgcuccgcaaccgggugagcgccguggacgagcuggccauggccaccgagcgccugcggguccgcgacccccgggagccgaagcccaacccgcccgugcuccacaucaucgagccgcacgagguggagcagaaccgcaucaagcugcugaacgacaaggccgucgcgaccucccagcuccagaagaagcuggggcagcugcucuaccugaccaaccuggagaagucccaggacaagacguccggcggcgugaaccccgagcccugccccaucugcgcccggcagcucgggaagcagugggccgugcugaccugcggccacugcuucugcaacgagugcaucagcaucaucaucgagcaguacuccgucgggagccaccgcuccagcaucaagugcgccaucugccgccagaccaccucccacaaggagaucagcuacguguucacguccgagaaggccaaccaggaggaggacaucccggugaagggcagccacuccaccaaggucgaggcgguggugcggacccugaugaagauccagcuccgcgaccccggggccaaggcccuggucuucagcaccuggcaggacgugcuggacaucaucuccaaggcccugacggacaacaacauggaguucgcgcagaucagccgggugaagaccuuccaggagaaccucuccgccuucaagcgcgacccccagaucaacauccugcugcucccccugcacaccggcagcaacggccugaccaucaucgaggccacgcacguccuccugguggagccgauccugaaccccgcccacgagcuccaggccaucgggcgggugcaccgcaucggccagaccaagcccaccaucguccaccgguuccugaucaaggcgaccaucgaggagcgcaugcaggccaugcugaagacggccgagcggagccacaccaacuccagcgccaagcacuccgaggccagcgugcucaccguggcggaccuggccgaccuguucaccaaggagaccgaggagcucgaguga

SEQ ID NO: 36375 - RNA, 1734 nt, Artificial Sequence
  derived and/or modified sequence opt1 from SHQ1__Homo_sapiens__NP_060600
augcugacccccgccuucgaccucagccaggacccggacuuccugaccaucgccauccgcgugcccuacgcgcgggucuccgaguucgacguguacuucgagggcagcgacuucaaguucuacgccaagcccuacuuccugcgccucacgcugcccgggcggaucguggagaacggcuccgagcaggggagcuacgacgccgacaagggcaucuucaccauccgccugccgaaggagacccccgggcagcacuucgagggccucaacaugcugaccgcccugcucgcgccccggaagucccgcacggccaagccccuggucgaggagaucggcgccagcgagaucccggaggaggugguggacgacgaggaguucgacugggagaucgagcagacccccugcgaggaggucuccgagagcgcccugaacccccagugccacuacggguucggcaaccuccgguccggggugcugcagcgccugcaggacgagcucagcgacgugaucgacaucaaggaccccgacuucaccccggccgcggagcggcgccagaagcggcuggccgccgagcuggccaaguucgaccccgaccacuaccucgccgacuucuucgaggacgaggcgaucgagcagauccugaaguacaaccccugguggaccgacaaguacuccaagaugauggccuuccuggagaagucccaggagcaggagaaccacgccacgcucgucagcuucagcgaggaggagaaguaccagcugcgcaaguucgugaacaaguccuaccugcucgacaagcgggccugccgccaggugugcuacagccugaucgacauccugcucgccuacugcuacgagacccgggucaccgagggcgagaagaacguggaguccgcguggaacauccgcaagcugagccccacccugugcugguucgagacguggaccaacgugcacgacaucauggucuccuucgggcggcgcgugcucugcuacccgcuguaccggcacuucaagcuggugaugaaggccuaccgcgacaccaucaagauccuccagcugggcaagagcgccguccugaagugccuccuggacauccacaagaucuuccaggagaacgaccccgccuacauccugaacgaccucuacaucagcgacuacugcguguggauccagaaggugaaguccaagaagcuggccgcgcuggccgaggcccucaaggaggucagccugaccaaggcccagcugggccucgagcuggaggagcuggaggccgcggcccuccuggugcaggaggaggagacggcccugaaggccgcgcacuccgugagcgggcagcagacccugugcuccagcuccgaggccagcgacuccgaggacagcgacuccagcgucuccagcggcaacgaggacuccgggagcgacuccgagcaggacgagcucaaggacagccccuccgagaccgugagcagccugcagggccccuuccuggaggaguccagcgccuuccucaucgucgacggcggggugcggcgcaacaccgccauccaggaguccgacgccagccagggcaagccgcuggcguccagcuggccccuggggguguccggcccccucaucgaggagcugggggagcagcugaagacgaccguccaggugagcgagcccaagggcaccaccgccgugaaccgcuccaacauccaggagcgggacggcugccagacgccgaacaacuga

SEQ ID NO: 36376 - RNA, 4851 nt, Artificial Sequence
  derived and/or modified sequence opt1 from SHROOM2__Homo_sapiens__NP_001640
auggagggcgccgagccccgcgcccgccccgagcgccuggccgaggccgagacccgggccgccgacgggggccgccugguggagguccagcuguccgggggcgcccccuggggguucacccugaagggcggccgggagcacggggagccccuggugaucaccaagaucgaggagggcuccaaggccgccgccguggacaagcugcuggccggggacgagaucgucggcaucaacgacaucgggcucagcggcuuccgccaggaggcgaucugccuggugaagggcucccacaagacccugaagcucguggucaagcggcgcagcgagcugggguggcggccccacuccuggcacgccaccaaguucagcgacucccaccccgagcuggccgccagccccuucaccuccacgagcggcugccccuccuggagcgggcgccaccacgccuccagcuccagccacgaccucuccagcuccugggagcagaccaaccugcagcggacccuggaccacuucagcagccucggcuccguggacagccuggaccaccccuccagccgccuguccguggccaaguccaacuccagcaucgaccaccucggcucccacagcaagcgggacuccgccuacgggagcuucuccaccagcuccagcacgcccgaccacacccuguccaaggccgacaccagcuccgccgagaacauccuguacaccgucggccucugggaggcgccccgccagggcgggcggcaggcgcaggccgccggggacccccagggcagcgaggagaagcugagcugcuucccgccccgcgugcccggcgacuccgggaagggcccccggcccgaguacaacgccgagcccaagcuggccgcgcccgggcgcagcaacuucggccccgugugguacguccccgacaagaagaaggcccccuccuccccgccgcccccgcccccgccccugcgguccgacagcuucgccgccacgaagucccacgagaaggcccaggggcccguguucagcgaggcggccgccgcccagcacuucaccgcgcuggcccaggcccagccccgcggcgaccggcgccccgagcugaccgaccgccccuggcgguccgcccaccccggcagccucgggaagggcuccgggggccccgggugcccccaggaggcccacgcggacggcagcuggccgcccuccaaggacggcgccagcucccgccugcaggccagccuguccagcagcgacgugcgguucccccagagcccccacagcgggcgccacccgccccucuacuccgaccacagcccccugugcgccgacucccugggccaggagcccggggccgcgagcuuccagaacgacuccccgccccagguccggggccucagcuccugcgaccagaagcugggcagcggguggcagggcccccgccccugcgugcagggggaccugcaggccgcccagcucugggccggcugcuggcccuccgacaccgcccugggggcgcuggagagccugcccccgcccacggugggccagagcccccggcaccaccucccccagcccgagggcccgcccgacgcccgcgagaccgggcggugcuacccccuggacaagggcgccgaggggugcuccgccggcgcgcaggagccgccccgcgccucccgggccgagaaggccagccagcgccucgccgcguccaucaccugggccgacggggagagcucccggaucugcccccaggagacgccccuccugcacagccucacgcaggagggcaagcgccggcccgagagcucccccgaggacagcgccacccggcccccgcccuucgacgcccacgucggcaagcccacccggcgcuccgaccgguucgccaccacgcugcgcaacgagauccagaugcaccgcgcgaagcugcagaagucccggagcaccguggcccucaccgccgccggggaggccgaggacggcaccgggcgcuggcgggcgggccucgggggcggcacgcaggaggggccccuggccggcaccuacaaggaccaccugaaggaggcccaggcccgcgugcuccgggcgaccagcuucaagcgccgggaccuggaccccaaccccggggaccuguacccggagucccucgagcaccgcaugggcgaccccgacaccgucccccacuucugggaggccgggcuggcccagcccccgagcuccacgagcggcggcccccacccgccccggaucgggggccgccggcgcuucaccgccgagcagaagcugaaguccuacagcgagcccgagaagaugaacgagguggggcucacccggggcuacagcccccaccagcacccccgcaccagcgaggacacggugggcaccuucgccgaccgguggaaguucuucgaggagaccuccaagcccgucccgcagcgccccgcgcagaagcaggcccugcacgggaucccccgggacaagcccgagcgcccgcggaccgccggccggaccugcgaggggacggagcccuggagccggaccaccucccugggcgacagccucaacgcccacuccgccgcggagaaggccgggaccagcgaccugccccgccgccugggcacguucgccgaguaccaggccagcuggaaggagcagcggaagccgcucgaggcccgcuccagcggccggugccacuccgcggacgacauccuggacgugagccuggacccccaggagcgcccccagcacguccacgggcggucccgcagcucccccagcaccgaccacuacaagcaggaggccuccguggagcuccggcgccaggccggcgacccgggggagccccgggaggagcugcccagcgccgugcgcgccgaggagggccaguccacgccccgccaggcggacgcccagugccgcgaggggagcccgggcucccagcagcacccgcccagccagaaggcccccaacccgcccaccuucuccgagcugagccacugccggggcgcccccgagcucccccgcgaggggcggggccgcgcggggacccugccgcgggacuaccgcuacuccgaggagagcacccccgccgaccugggcccccgggcccagucccccgggagcccgcuccacgcccgcggccaggacagcuggcccgucuccagcgcccugcuguccaagcgccccgcgccccagcggccgccgccgcccaagcgcgagccgcggcgcuaccgggccaccgacggcgcccccgccgacgcccccgugggggugcucggccgcccguuccccacccccagccccgcgucccuggacgucuacguggcccggcugagccucucccacagcccguccguguucagcuccgcccagccccaggacacgcccaaggccaccgucugcgagcgcgggagccagcacguguccggcgacgccagccggccccugccggaggcgcugcugccgcccaagcagcagcaccuccgccugcagaccgccaccauggagacgucccggagccccuccccgcaguucgcgccccagaagcucaccgacaagccgccccugcugauccaggacgaggacagcacccgcaucgagcgggugauggacaacaacaccacggucaagauggugccgaucaagaucgugcacuccgagagccagcccgagaaggagagccgccagucccucgccugccccgcggagcccccggcccugccccacggccuggagaaggaccagaucaagacccucagcaccuccgagcaguucuacagccgguucugccuguacacccgccagggggccgagcccgaggcgccccaccgggcccagccggcggagccccagccccugggcacgcaggucccgcccgagaaggaccgcugcaccagcccgcccgggcucagcuacaugaaggccaaggagaagaccguggaggaccugaaguccgaggagcuggcccgggagaucgugggcaaggacaagagccucgccgacauccuggacccguccgucaagaucaagaccacgauggaccugauggaggggaucuuccccaaggacgagcaccuccuggaggaggcccagcagcgccggaagcugcuccccaagauccccagcccgcgcuccaccgaggagcgcaaggaggagcccagcgugcccgcggccgugucccuggccaccaacagcaccuacuacuccacgagcgcccccaaggccgagcugcucaucaagaugaaggaccugcaggagcagcaggagcacgaggaggacuccggcagcgaccuggaccacgaccucuccgucaagaagcaggagcugaucgagagcaucagccggaagcuccaggugcuccgcgaggcgcgggagucccugcuggaggacgugcaggccaacaccguccucggcgccgagguggaggccaucgugaagggggucugcaagccgagcgaguucgacaaguuccgcauguucaucggcgaccuggacaagguggugaaccugcuccugucccugagcgggcggcucgcgcgcgucgagaacgcccugaacaaccuggacgacggcgccucccccggggaccggcagagccuccuggagaagcagcgcgugcugauccagcagcacgaggacgccaaggagcucaaggagaaccuggaccggcgcgagcggaucguguucgacauccuggccaacuaccucuccgaggagagccuggcggacuacgagcacuucgucaagaugaaguccgcccugaucaucgagcagcgcgagcucgaggacaagauccaccugggcgaggagcagcugaagugccuccuggacagccugcagcccgagcggggcaaguga

SEQ ID NO: 36377 - RNA, 5991 nt, Artificial Sequence
  derived and/or modified sequence opt1 from SHROOM3__Homo_sapiens__NP_065910
augaugcgcaccaccgaggacuuccacaagcccuccgccacccugaacuccaacaccgccaccaaggggcgguacaucuaccucgaggccuuccuggagggcggggcccccuggggguucacccugaagggcgggcucgagcacggcgagccccugaucaucagcaagguggaggagggcgggaaggccgacacccuguccagcaagcuccaggccggcgacgaggucgugcacaucaacgaggugacccuguccagcucccgcaaggaggccgucagccuggugaagggguccuacaagacccuccggcuggugguccgccgggacgugugcaccgaccccggccacgccgacaccggggccagcaacuucgugucccccgagcaccugaccagcggcccgcagcaccgcaaggccgccugguccggcggggucaagcuccggcugaagcaccgccggagcgagcccgcgggccgcccccacuccuggcacaccaccaagagcggggagaagcagcccgacgccuccaugaugcagaucagccagggcaugaucggcccgcccuggcaccaguccuaccacagcagcuccagcaccuccgaccugagcaacuacgaccacgccuaccuccggcgcucccccgaccagugcagcucccaggggagcauggagucccuggagcccagcggcgccuacccgcccugccaccugucccccgccaagagcaccggguccaucgaccagcucagccacuuccacaacaagcgggacuccgcguacagcuccuucagcaccuccagcagcauccuggaguacccccacccgggcaucuccgggcgcgagcggagcggcuccauggacaacaccagcgcccgcggcgggcugcucgagggcaugcggcaggccgacauccgcuacgugaagaccguguacgacacccggcgcggggucuccgccgaguacgaggugaacagcuccgcccugcugcuccagggccgggaggcgcgcgccagcgccaacgggcagggcuacgacaagugguccaacaucccccgcggcaagggggugccgccgcccagcuggucccagcagugccccagcucccuggagaccgccaccgacaaccugccgcccaaggucggcgccccgcugccgcccgcgcggagcgacuccuacgccgccuuccgccaccgggagcgccccagcuccuggagcagccuggaccagaagcggcugugccgcccgcaggccaacucccucgggagccugaagucccccuucaucgaggagcagcugcacaccgugcucgagaagucccccgagaacuccccgcccgugaagcccaagcacaacuacacccagaaggcccagcccggccagccgcugcugcccaccagcaucuaccccguccccucccucgagccgcacuucgcccaggugccccagcccagcguguccagcaacgggaugcuguaccccgcccuggccaaggaguccggcuacaucgccccgcagggcgcgugcaacaagauggccaccaucgacgagaacgggaaccagaacggcagcgggcggcccggcuucgccuucugccagccccucgagcacgaccugcugucccccgucgagaagaagccggaggccacggccaaguacgugcccagcaaggugcacuucugcuccguccccgagaacgaggaggacgcgagccucaagcgccaccugacgccgccccagggcaacagcccccacagcaacgagcggaaguccacccacagcaacaagcccagcucccacccccacagccugaagugcccccaggcccaggccuggcaggccggggaggacaagcgcuccagccggcucuccgagcccugggagggcgacuuccaggaggaccacaacgccaaccuguggcgccggcuggagcgcgaggggcucggccagagccuguccgggaacuucggcaagaccaagagcgcguucuccagccugcagaacauccccgagucccugcggcgccacagcucccucgagcugggccgggggacgcaggagggcuaccccggcgggcgcccgaccugcgccgugaacaccaaggccgaggaccccgggcggaaggccgcccccgaccuggggagccaccucgaccgccaggucuccuacccgcgccccgagggccggaccggggcgagcgccuccuucaacagcacggaccccucccccgaggagccgcccgcccccagccacccccacaccagcucccugggccgccgggggccgggccccgggagcgccuccgcgcugcagggcuuccaguacggcaagccccacugcagcgugcucgagaagguguccaaguucgagcagcgcgagcaggggagccagcggcccuccgucggcgggagcggcuucgggcacaacuaccgcccgcaccggaccguguccaccagcuccacgagcggcaacgacuucgaggagaccaaggcccacauccgcuucuccgagagcgccgagccccugggcaacggggagcagcacuucaagaacggcgagcugaagcucgaggaggccucccggcagcccugcgggcagcagcugagcggcggcgccuccgacagcgggcgcggcccccagcggccggacgcgcgccugcuccggucccagagcaccuuccagcugagcuccgagcccgagcgcgagcccgaguggcgggaccgccccgggagcccggagagcccccuccucgacgcccccuucucccgggccuaccgcaacuccaucaaggacgcccagagccgggugcugggcgccaccuccuuccgccggcgcgaccuggagcucggggcgcccgucgccagccgcuccuggcggccgcgccccagcuccgcccacgugggccugcggagccccgaggccuccgccagcgcguccccgcacacgccccgcgagcggcacagcgugacgcccgccgagggcgaccuggcccgccccgucccgcccgccgcgcggcgcggggcccggcgccggcucacccccgagcagaagaagcgcuccuacagcgagcccgagaagaugaacgaggugggcaucguggaggaggccgagccggcgccccucgggccccagcggaacggcaugcgcuuccccgaguccagcgucgccgaccggcgccggcuguucgagcgcgacgggaaggcgugcagcacccucucccugagcggcccggagcugaagcaguuccagcaguccgcccucgccgacuacauccagcggaagaccggcaagcgccccacgagcgccgccgggugcucccugcaggagcccggcccccugcgcgagcgggcgcagagcgccuaccuccagccggggcccgccgcccuggagggcuccgggcuggccagcgcguccagccucuccagccugcgcgagcccucccugcagccccggcgcgaggccacccuccugccggccaccguggccgagacccagcaggcgccccgcgaccgcagcuccagcuucgcgggcggccggcgccugggggagcggcgccggggcgaccuccuguccggggccaacggcggcacgcgcgggacccagcggggcgacgagacgccccgcgagcccagcuccuggggcgcccgggccggcaagagcaugagcgcggaggaccugcucgagcgcuccgacgugcuggccgggccgguccacgugcggagccgcuccagccccgccaccgccgacaagcggcaggacgugcugcucggccaggacuccggcuucgggcuggucaaggaccccugcuaccuggccggccccgggagccgcucccucagcugcuccgagcggggccaggaggagaugcugccgcuguuccaccaccucacgccccgcuggggcgggagcggcugcaaggcgaucggggacuccagcgugcccuccgagugcccgggcacccuggaccaccagcgccaggccagccggacccccugcccccggccgccccuggccgggacccagggccucgugacggacacccgggccgcgccccugacccccaucgggacgccccugcccuccgcgauccccagcggcuacugcucccaggacggccagacggggcgccagccccugccgcccuacacccccgccaugaugcaccggagcaacggccacacccugacccagccgcccgggccccgcggcugcgagggggacggccccgagcacggcgucgaggaggggacgcggaagcgcgugagccugccccaguggcccccgcccucccgggccaagugggcccacgccgcgcgcgaggacagccuccccgaggaguccagcgcccccgacuucgccaaccugaagcacuaccagaagcagcagucccugccgagccucugcuccaccagcgaccccgacacgccccugggcgccccguccacccccgggcggaucagccugcgcaucuccgagagcgugcuccgggacagcccgccgccccacgaggacuacgaggacgaggucuucgugcgcgacccccaccccaaggcgacgagcucccccaccuucgagccccugccgccgcccccgcccccgccgcccagccaggagacccccguguacuccauggacgacuucccgcccccgccgccccacaccgucugcgaggcccagcuggacagcgaggaccccgagggcccccggcccuccuucaacaagcucagcaaggugacgaucgcccgcgagcggcacaugcccggcgccgcccacguggucgggagccagacccuggcgucccgccugcagaccagcaucaagggcuccgaggccgagagcacgccgcccuccuucaugagcgugcacgcccagcucgccgggucccugggcgggcagcccgcccccauccagacgcagagccugucccacgaccccgugagcggcacccagggccucgagaagaaggucucccccgacccccagaaguccagcgaggacauccggaccgaggcgcuggccaaggagaucgugcaccaggacaagagccuggccgacauccucgaccccgacucccgccugaagaccaccauggaccugauggagggccucuucccccgcgacgugaaccugcugaaggagaacagcgucaagcggaaggccauccagcgcacgguguccagcuccggcugcgaggggaagcggaacgaggacaaggaggccgugagcaugcucgucaacugccccgcguacuacagcguguccgcccccaaggccgagcugcugaacaagaucaaggagaugcccgccgaggugaacgaggaggaggagcaggcggacgucaacgagaagaaggccgagcucaucggcagccugacccacaagcuggagacccuccaggaggccaaggggucccugcugaccgacaucaagcucaacaacgcccugggcgaggagguggaggcccugaucagcgagcugugcaagcccaacgaguucgacaaguaccgcauguucaucggcgaccucgacaagguggucaaccugcugcucucccugagcgggcggcuggcgcgcguggagaacgugcucuccggccugggggaggacgccagcaacgaggagcgguccagccuguacgagaagcgcaagauccucgccggccagcacgaggacgcccgggagcugaaggagaaccuggaccgccgggagcgcgucgugcucgggauccuggccaacuaccuguccgaggagcagcuccaggacuaccagcacuucgugaagaugaaguccacgcugcugaucgagcagcggaagcucgacgacaagaucaagcugggccaggagcaggucaagugccugcucgagucccugcccagcgacuucauccccaaggcgggcgcccuggcccucccgcccaaccugaccuccgagcccauccccgccgggggcugcaccuucagcgggaucuuccccacccugacgagcccccucuga

SEQ ID NO: 36378 - RNA, 4482 nt, Artificial Sequence
  derived and/or modified sequence opt1 from SHROOM4__Homo_sapiens__NP_065768
auggagaaccgccccggcagcuuccaguacgugccgguccagcugcaggggggcgcccccuggggguucacccucaagggcgggcuggagcacugcgagccccugaccguguccaagaucgaggacggcggcaaggccgcgcucagccagaagaugcggacgggggacgagcuggugaacaucaacggcaccccccuguacgggucccgccaggaggcccucauccugaucaagggcagcuuccggauccugaagcucaucguccgccggcgcaacgccccggugucccggccccacagcuggcacguggccaagcugcuggaggggugccccgaggccgcgaccaccaugcacuuccccuccgaggccuucagccucuccuggcacagcggcugcaacacguccgacgucugcgugcaguggugcccgcugagccgccacugcuccaccgagaagagcuccagcaucggcuccauggagagccuggagcagcccgggcaggccaccuacgagucccaccuccugcccaucgaccagaacauguaccccaaccagcgggacagcgccuacagcuccuucagcgcguccagcaacgccuccgacugcgcccugagccuccgcccggaggagcccgccuccaccgacugcaucaugcagggccccgggcccacgaaggccccgagcggccggcccaacguggcggagaccuccggcgggagccgccggaccaacggcgggcaccugacccccuccagccagauguccagccgcccccaggagggcuaccaguccgggccggccaaggccguccggggccccccccagcccccggugcgccgggacagccugcaggccucccgcgcccagcuccugaacggcgagcagcggcgcgcgagcgagcccguggucccccugccccagaaggagaagcucucccuggagccggugcugcccgcccggaaccccaaccgcuucugcugccucagcgggcacgaccaggugacgagcgagggccaccagaacugcgaguucucccagccgcccgagagcucccagcaggggagcgagcaccugcugaugcaggccuccaccaaggccgucggcagccccaaggccugcgaccgcgcguccagcguggacuccaacccccucaacgaggccagcgccgagcuggccaaggccuccuucgggcggccgccccaccugaucggccccaccggccaccgccacagcgcgcccgagcagcuccuggccucccaccugcagcacgugcaccucgacacccgggggagcaagggcauggagcugccgcccguccaggacgggcaccaguggacgcuguccccccuccacagcucccacaagggcaagaagagccccugcccgcccaccgggggcacccacgaccagagcuccaaggagcgcaagacccggcagguggacgaccgcagccuggugcugggccaccagucccagagcucccccccccacggggaggccgacggccacccgagcgagaagggguuccucgaccccaaccggacgucccgcgccgcgagcgagcuggccaaccagcagcccuccgccagcggcucccugguccagcaggccaccgacugcagcuccaccaccaaggccgcgagcggcacggaggccggggaggagggcgacuccgagcccaaggagugcagccggauggggggccgccgguccgggggcacccgcggccggagcauccagaaccgccggaaguccgagcgcuucgccaccaaccuccggaacgagauccagcgccggaaggcccagcugcagaagagcaaggggccgcugagccagcucugcgacaccaaggagcccguggaggagacgcaggagccccccgaguccccgccccugaccgccagcaacaccucccugcugagcuccugcaagaagcccccgagcccccgcgacaagcucuucaacaaguccaugaugcugcgcgcgcggagcuccgagugccugagccaggcccccgagucccacgagagccgcaccggccucgaggggcggaucucccccggccagcgcccggggcagagcucccugggccugaacacgugguggaaggcccccgaccccagcuccagcgaccccgagaaggcccacgcccacugcggcgugcgggggggccacuggcgcugguccccggagcacaacagccagccccucgucgcggccgccauggaggggcccagcaaccccggcgacaacaaggagcugaaggccuccaccgcgcaggccggggaggacgccauccugcucccguucgccgaccggcgcaaguucuucgaggagagcuccaagagccuguccaccagccaccugcccggccucaccacgcacuccaacaagaccuucacccagcggcccaagcccaucgaccagaacuuccagccgaugagcuccagcugccgcgagcugcggcgccaccccauggaccaguccuaccacagcgccgaccagcccuaccacgcgaccgaccaguccuaccacagcauguccccccugcagagcgagaccccgacguacuccgagugcuucgccagcaagggccucgagaacuccaugugcugcaagccccugcacugcggggacuucgacuaccaccggaccugcagcuacagcugcuccgugcagggcgcccugguccacgaccccugcaucuacugcagcggggagaucugccccgcccuccugaagcgcaacaugaugccgaacugcuacaacugccggugccaccaccaccagugcauccgcugcuccgugugcuaccacaacccccagcacagcgcccuggaggacuccagccucgcgcccggcaacaccuggaagccccggaagcugaccgugcaggaguucccgggggacaaguggaaccccaucacgggcaaccgcaagaccucccagagcggccgggagauggcccacuccaagaccagcuucuccugggccacccccuuccacccgugccuggagaaccccgcccucgaccugagcuccuaccgcgccaucagcucccuggaccuccugggggacuucaagcacgcgcugaagaagagcgaggagacguccgucuacgaggagggcagcucccucgccagcaugccccacccccugcggagccgcgccuucuccgagagccacaucucccuggccccgcagagcacccgcgcgugggggcagcaccggcgcgagcucuucuccaagggcgacgagacccagagcgaccugcugggcgcccggaagaaggccuucccccccccccgcccgcccccccccaacugggagaaguaccggcucuuccgcgccgcccagcagcagaagcagcagcagcagcagcagaagcagcaggaggaggaggaggaggaggaggaggaggaggaggaggaggaggaggaggaggaggaggaggcggaggaggaggaggaggagcugccgccccaguacuucuccagcgagaccuccgggagcugcgcccugaaccccgaggaggugcucgagcagccccagccgcuguccuucggccaccuggaggggagccggcagggcucccagagcgugcccgccgagcaggaguccuucgcccuccacagcuccgacuuccugccccccauccgcgggcaccugggcagccagccggagcaggcccagccccccugcuacuacggcaucgggggccucuggcggacguccgggcaggaggcgaccgagagcgccaagcaggaguuccagcacuucagccccccguccggcgcccccgggauccccaccagcuacuccgccuacuacaacaucagcgucgccaaggcggagcugcugaacaagcucaaggaccagcccgagauggccgagaucggccugggcgaggaggagguggaccacgagcuggcccagaagaagauccagcucaucgaguccaucagccgcaagcuguccgugcugcgggaggcccagcgcgggcuccuggaggacaucaacgccaacagcgcgcugggcgaggaggucgaggccaaccucaaggccgugugcaaguccaacgaguucgagaaguaccaccuguucgugggggaccuggacaaggucgugaaccuccugcugagccucuccggccggcuggcccgcguggagaacgcgcugaacagcaucgacuccgaggccaaccaggagaagcucguccugaucgagaagaagcagcagcugaccgggcagcucgccgacgccaaggagcugaaggagcacguggaccggcgcgagaagcugguguucggcauggucagccgguaccucccgcaggaccagcugcaggacuaccagcacuucgugaagaugaaguccgcccugaucaucgagcagcgcgagcucgaggagaagaucaagcugggcgaggagcagcugaagugccuccgggagagccugcugcucgggcccuccaacuucuga

SEQ ID NO: 36379 - RNA, 1467 nt, Artificial Sequence
  derived and/or modified sequence opt1 from SIAE__Homo_sapiens__NP_001186851
auggugcugcagaaggagcccgccggcgccgucaucuggggguucggcaccccgggggcgaccgugacggugacccuccgccagggccaggagaccaucaugaagaaggucaccagcgugaaggcccacuccgacacguggauggugguccuggaccccaugaagcccgggggccccuucgaggugauggcccagcagacccuggagaagaucaacuucacccuccgggugcacgacguccuguucggcgacguguggcugugcagcgggcaguccaacaugcagaugaccgugcuccagaucuucaacgccacgcgcgagcugagcaacaccgccgcguaccaguccguccggauccugagcguguccccgauccaggccgagcaggagcucgaggaccugguggccgucgaccugcaguggagcaagcccaccuccgagaaccucggccacggguacuucaaguacaugagcgccgugugcuggcuguucggccgccaccuguacgacacccuccaguaccccaucgggcugaucgcguccagcuggggcggcacgcccaucgaggccugguccagcgggcggucccugaaggccugcggcgugccgaagcaggggagcauccccuacgacuccgucaccggccccagcaagcacuccgugcucuggaacgccaugauccacccccugugcaacaugacccugaagggcguggucugguaccagggggagagcaacaucaacuacaacaccgaccucuacaacugcacguucccggcccugaucgaggacuggcgcgagaccuuccaccggggcagccaggggcagaccgagcgcuucuuccccuucggccuggugcagcucuccagcgaccuguccaagaaguccagcgacgacggguucccccagauccgguggcaccagaccgcggacuucggcuacgugcccaacccgaagaugcccaacacguucauggccgucgccauggaccugugcgaccgcgacagccccuucggcuccauccacccccgggacaagcagaccguggccuaccgccuccaccugggggcccgggcgcuggccuacggcgagaagaaccucaccuucgaggggccgcugcccgagaagaucgagcugcucgcccacaagggccugcugaaccucaccuacuaccagcagauccagguccagaagaaggacaacaagaucuucgagaucagcugcugcuccgaccaccgcugcaaguggcugcccgccagcaugaacacgguguccacccagagccugacccucgccaucgacuccugccacgggaccguggucgcgcugcgguacgccuggacgaccuggcccugcgaguacaagcagugcccgcuguaccaccccagcuccgcccuccccgcgcccccguucaucgccuucaucaccgaccagggccccggccaccagagcaacguggccaaguga

SEQ ID NO: 36380 - RNA, 942 nt, Artificial Sequence
  derived and/or modified sequence opt1 from SIAH1__Homo_sapiens__NP_001006611
augaccggcaaggccaccccgcccagccuguacuccuggcgcgggguccucuucacgugccugcccgccgcgcggacccgcaagcggaaggagaugagccgccagaccgccaccgcccugcccacgggcaccuccaagugcccgcccagccagcgggugcccgcccucaccgggaccacggccuccaacaacgaccuggcgagccuguucgagugccccgugugcuucgacuacgugcugcccccgauccuccagugccaguccggccaccuggucugcagcaacugccgccccaagcugaccugcugcccgaccugccgggggccccucggcuccauccgcaaccuggccauggagaagguggccaacagcguccucuuccccugcaaguacgccuccagcggcugcgagaucacccugccccacacggagaaggcggaccacgaggagcugugcgaguuccggcccuacuccugccccugcccgggggccagcugcaaguggcagggcucccucgacgccgugaugccccaccugaugcaccagcacaagagcaucaccacccugcagggggaggacaucguguuccucgccaccgacaucaaccugcccggcgccguggacugggucaugaugcaguccugcuucggguuccacuucaugcuggugcucgagaagcaggagaaguacgacggccaccagcaguucuucgcgaucgugcagcugaucggcacgcgcaagcaggccgagaacuucgccuaccggcuggagcucaacgggcaccgccggcgccugaccugggaggccacgccccggagcauccacgagggcaucgccaccgcgaucaugaacuccgacugccuggucuucgacaccagcaucgcccagcuguucgccgagaacgggaaccucggcaucaacgugaccaucagcaugugcuga

SEQ ID NO: 36381 - RNA, 975 nt, Artificial Sequence
  derived and/or modified sequence opt1 from SIAH2__Homo_sapiens__NP_005058
augagccgccccuccagcaccggccccuccgccaacaagcccugcagcaagcagcccccgccccagccccagcacacccccucccccgccgcgccgcccgccgccgccacgaucagcgccgcggggcccggcuccagcgccgugcccgccgccgcggccgucaucuccgggccgggcgggggcggcggggccggccccgugagcccccagcaccacgagcugaccucccucuucgagugccccgugugcuucgacuacguccugccgcccauccugcagugccaggccgggcaccucgugugcaaccagugccggcagaagcugagcugcugcccgaccugccgcggcgcccugacccccuccauccggaaccucgcgauggagaagguggccagcgccguccuguuccccugcaaguacgccacgaccgggugcucccugacccuccaccacaccgagaagcccgagcacgaggacaucugcgaguaccgccccuacagcugccccugcccgggcgccuccugcaaguggcagggcagccuggaggcggugaugucccaccugaugcacgcccacaagagcaucacgacccuccagggggaggacaucguguuccuggccaccgacaucaaccugcccggcgccgucgacugggugaugaugcagagcugcuucgggcaccacuucaugcucgugcuggagaagcaggagaaguacgagggccaccagcaguucuucgccaucguccugcucaucggcacccggaagcaggcggagaacuucgccuaccgccuggagcugaacgggaaccggcgccggcucacgugggaggccaccccgcgcuccauccacgacggcguggccgccgcgaucaugaacagcgacugccugguguucgacaccgccaucgcccaccuguucgccgacaacgggaaccucggcaucaacgucaccaucuccacgugcugccccuga

SEQ ID NO: 36382 - RNA, 2484 nt, Artificial Sequence
  derived and/or modified sequence opt1 from SIDT1__Homo_sapiens__NP_060169
augcgcggcugccugcggcucgcccugcugugcgcccuccccuggcugcugcucgcggccagcccggggcaccccgccaagagcccccgccagcccccggcgccccggcgcgaccccuucgacgccgcccggggcgccgacuucgaccacguguacuccggggucgugaaccuguccaccgagaacaucuacagcuucaacuacaccucccagcccgaccaggugacggccguccgcguguacgugaacagcuccagcgagaaccugaacuacccgguccucguggugguccggcagcagaaggaggugcuguccuggcaggucccccuccuguuccagggccuguaccagcgcagcuacaacuaccaggaggugucccggacccugugccccagcgaggccaccaacgagaccgggccccuccagcagcugaucuucguggacguggcguccauggccccgcugggcgcccaguacaagcuccuggucacgaagcugaagcacuuccagcuccgcaccaacguggccuuccacuucaccgccagccccucccagccccaguacuuccuguacaaguuccccaaggacguggacagcgucaucaucaaggugguguccgagauggcguacccgugcagcgucguguccgugcagaacaucaugugccccgucuacgaccuggaccacaacguggaguucaacggcgucuaccagagcaugaccaagaaggccgccaucacgcuccagaagaaggacuuccccggggagcaguucuucgugguguucgucaucaagcccgaggacuacgccugcggcgggagcuucuucauccaggagaaggagaaccagaccuggaaccugcagcggaagaagaaccuggaggugaccaucgugccguccaucaaggagagcgucuacgugaaguccagccucuucuccguguucaucuuccugagcuucuaccugggcugccuccuggucggguucgugcacuaccugcgcuuccagcggaaguccaucgacggcagcuucggcuccaacgacgggagcggcaacaugguggccucccaccccaucgcggccagcacccccgagggguccaacuacggcacgaucgacgagagcuccagcucccccggccgccagaugagcuccagcgacgggggcccgcccgggcagagcgacaccgacuccagcgucgaggaguccgacuucgacaccaugcccgacaucgagagcgacaagaacaucauccggaccaagauguuccucuaccuguccgaccugagccgcaaggaccggcgcaucguguccaagaaguacaagaucuacuucuggaacaucaucacgaucgccguguucuacgcccuccccgucauccagcuggugaucaccuaccagaccguggucaacgugaccggcaaccaggacaucugcuacuacaacuuccugugcgcccacccgcucggggugcugagcgcguucaacaacauccuguccaaccucggccacguccugcugggcuuccucuuccugcugaucgugcuccggcgcgacauccugcaccggcgcgcccuggaggccaaggacaucuucgccguggaguacgggauccccaagcacuucggccuguucuacgccauggggaucgcgcucaugauggagggcguccugagcgccugcuaccacgugugccccaacuacuccaacuuccaguucgacacgagcuucauguacaugaucgccgggcugugcaugcucaagcuguaccagacccgccacccggacaucaacgccuccgcguacagcgccuacgccuccuucgccguggucaucauggugaccgugcugggcgucguguucggcaagaacgacgugugguucugggucaucuucagcgccauccacgugcucgcgucccuggcccugagcacccagaucuacuacauggggcgguucaagaucgaccucggcaucuuccgccgggccgccaugguguucuacacggacugcauccagcagugcagccgcccccuguacauggaccggaugguccugcucgugguggggaaccuggucaacugguccuucgcccuguucggccucaucuaccgcccccgggacuucgcgagcuacaugcuggggaucuucaucugcaaccugcuccuguaccuggccuucuacaucaucaugaagcuccgcuccagcgagaaggugcugcccgugccgcuguucugcaucgucgccaccgccgugaugugggccgcggcccucuacuucuucuuccagaaccuguccagcugggagggcacccccgccgagucccgggagaagaaccgcgagugcauccugcucgacuucuucgacgaccacgacaucuggcacuuccugagcgccaccgcgcuguucuucuccuuccucgugcugcugacgcucgacgacgaccuggacgucgugcggcgcgaccagauccccguguucuga

SEQ ID NO: 36383 - RNA, 1233 nt, Artificial Sequence
  derived and/or modified sequence opt1 from SIGIRR__Homo_sapiens__NP_001128526
augcccggcgugugcgaccgcgcccccgacuuccugagccccuccgaggaccagguccuccggcccgcccuggggagcuccguggcgcugaacugcaccgccuggguggucagcggcccccacugcucccucccgagcgugcaguggcugaaggacgggcugccccucggcaucgggggccacuacucccugcacgaguacagcugggugaaggccaaccuguccgagguccucgugagcuccgugcugggcgucaacgugaccagcacggagguguacggggccuucacgugcuccauccagaacaucagcuucuccagcuucacccugcagcgcgccggccccaccucccacgucgcggccgugcucgccagccugcuggugcuccuggcccugcuccuggcggcccugcucuacgucaagugccggcugaacgugcugcucugguaccaggacgccuacggggagguggagaucaacgacggcaagcuguacgacgccuacgucuccuacagcgacugccccgaggaccgcaaguucgugaacuucauccugaagccgcagcucgagcggcgccggggguacaagcuguuccuggacgaccgcgaccuccugccccgggccgagcccagcgcggaccugcucgugaaccugucccgcugccggcgccugaucgucgugcucagcgacgccuuccugucccgggccuggugcagccacuccuuccgcgagggccugugccggcuccuggagcugacccgccggcccaucuucaucaccuucgagggccagcgccgggacccggcccaccccgcccuccgccugcugcggcagcaccgccaccucgugacccugcugcucuggcgccccgggagcgucacccccuccagcgacuucuggaaggaggugcagcuggcgcugccgcggaagguccaguaccgccccguggagggcgacccccagacgcagcugcaggacgacaaggaccccaugcucauccugcgggggcgcgugccggagggccgggcccuggacuccgaggucgaccccgaccccgagggcgaccucggggugcgcggccccguguucggggagccgagcgccccgccccacaccuccggcgucagccugggggagucccggagcuccgagguggacgugagcgaccugggcucccgcaacuacagcgcccggaccgacuucuacugccucgucuccaaggacgacauguga

SEQ ID NO: 36384 - RNA, 1809 nt, Artificial Sequence
  derived and/or modified sequence opt1 from SIGLEC11__Homo_sapiens__NP_001128635
auggugcccggccaggcccagccgcagagccccgagaugcugcuccugccccugcuccugcccguccugggggccggcucccucaacaaggacccgagcuacucccuccaggugcagcgccaggugcccguccccgaggggcugugcgugaucgugagcugcaaccucuccuacccccgggacggcugggacgagagcaccgcggccuacggguacugguucaagggccgcaccuccccgaagacgggcgcccccgucgccaccaacaaccagagccgggagguggagauguccacccgcgaccgguuccagcugaccggggaccccggcaaggggagcugcucccuggugauccgcgacgcccagcgggaggacgaggcgugguacuucuuccgcgucgagcggggcagccgcgugcggcacuccuuccucagcaacgccuucuuccugaaggugacggcccugaccaagaagcccgacgucuacaucccggagacccucgagcccgggcagcccgugaccgugaucugcgucuucaacugggccuucaagaagugccccgcgccguccuucagcuggacgggcgccgcccugagcccccgccggacccgccccuccaccucccacuucagcgugcugagcuucacccccuccccgcaggaccacgacacggaccugaccugccacguggacuucagccggaagggcgucuccgcccagcgcaccgugcggcugcgcguggccuacgcgcccaaggaccugaucaucagcaucucccacgacaacaccagcgcccucgagcugcaggggaacgucaucuaccuggaggugcagaagggccaguuccuccggcugcugugcgccgccgacucccagccgcccgccacgcucagcugggugcugcaggaccgcguccuguccagcucccaccccugggggccccggacccucggccuggagcugcgcggcgugcgcgcgggggacagcggccgguacacgugccgcgccgagaaccggcucgggucccagcagcaggcccuggaccugagcguccaguacccgcccgagaaccuccgcgugauggugucccaggccaaccggaccguccuggagaaccugggcaacgggaccagccuccccgugcuggagggccagucccugcgccucgugugcgucacccacagcuccccgcccgcccggcugagcuggacccgcuggggccagaccguggggcccagccagcccuccgaccccggcgugcuggagcugcccccgauccagauggagcacgagggggaguucacgugccacgcgcagcacccccucggcagccagcacgucucccugagccucuccgugcacuggaagcuggagcacgggggcggccuggggcugggcgccgcccucggggccggcguggccgcgcugcuggccuucugcagcugccucgucguguuccgggugaagaucugccgcaaggaggcccggaagcgcgccgcggccgagcaggacguccccuccacccuggggcccaucagccagggccaccagcacgagugcuccgccggcagcucccaggaccacccgccgcccggggccgccaccuacacccccggcaagggggaggagcaggagcugcacuacgcgagccucuccuuccagggccugcggcugugggagcccgccgaccaggaggcccccagcacgaccgaguacuccgagaucaagauccacaccggccagccccuccgcgggcccggcuucgggcugcagcuggagcgggagaugagcggcauggugccgaaguga

SEQ ID NO: 36385 - RNA, 1191 nt, Artificial Sequence
  derived and/or modified sequence opt1 from SIGLEC14__Homo_sapiens__NP_001092082
augcugccccuccugcugcucccgcugcuguggggcgggagccuccaggagaagcccguguacgagcugcagguccagaaguccgugaccgugcaggagggccugugcguccucgugcccugcagcuucuccuaccccuggcgcagcugguacuccagcccgccccuguacguguacugguuccgggacggggagauccccuacuacgccgaggucguggccaccaacaaccccgaccgccgggugaagccggagacgcagggccgcuuccggcugcucggggacguccagaagaagaacugcucccugagcaucggcgacgcgcgcauggaggacaccggcuccuacuucuuccggguggagcgcgggcgggacgugaaguacagcuaccagcagaacaagcugaaccucgaggucaccgcccugaucgagaagcccgacauccacuuccuggagccccucgaguccggccgccccacccggcugagcugcucccugccggggagcugcgaggccggcccgccccucacguucuccuggaccgggaacgcccugagcccccuggaccccgagaccacccgcuccagcgagcucacgcugacgccccggcccgaggaccacggcaccaaccugaccugccaggugaagcgccagggcgcccaggugaccaccgagcggaccguccagcucaacguguccuacgcgccccagaaccuggccaucagcaucuucuuccgcaacgggaccggcacggcccugcggauccucagcaacgggauguccgugccgauccaggagggccagagccuguuccuggccugcaccgucgacuccaacccgcccgcgagccucuccugguuccgcgagggcaaggcccugaaccccagccagaccuccaugagcgggacccuggagcuccccaacaucggcgcccgggagggcggggaguucacgugccgcgugcagcacccccuggggucccagcaccugagcuucauccucuccgugcagcggagcuccagcuccugcaucugcgucaccgagaagcagcagggcagcuggccccuggugcugacccucauccgcggcgcccugaugggggccggcuuccugcucaccuacgggcugacguggaucuacuacacccgcugcggcgggccccagcagucccgggcggagcgcccgggcuga

SEQ ID NO: 36386 - RNA, 5130 nt, Artificial Sequence
  derived and/or modified sequence opt1 from SIGLEC1__Homo_sapiens__XP_011527630
augggcuuccugcccaagcugcugcugcuggccuccuucuuccccgccgggcaggcguccuggggcguguccagcccccaggacgugcagggggugaagggcuccugccugcugauccccugcaucuucuccuuccccgccgacguggaggugcccgacgggaucaccgccaucugguacuacgacuacuccggccagcgccagguggugucccacagcgccgaccccaagcucgucgaggcccgguuccggggccggaccgaguucauggggaaccccgagcaccgcgugugcaaccugcugcugaaggaccugcagcccgaggacuccggcagcuacaacuuccgguucgagaucuccgaggugaaccgcuggagcgacgugaaggggacccuggugaccgugaccgaggagccccgggugcccaccaucgcgucccccguggagcuccuggagggcacggagguggacuucaacugcagcacccccuacgucugccugcaggagcagguccgccuccaguggcaggggcaggacccggcccgguccgugaccuucaacagccagaaguucgagcccaccggcgucggccaccuggagacgcugcacauggccauguccuggcaggaccacgggcgcauccuccggugccagcugagcguggccaaccaccgcgcgcaguccgagauccaccuccaggugaaguacgcccccaagggcgucaagauccuccugagccccagcgggcggaacauccugcccggcgagcucgugacccugaccugccaggugaacuccagcuaccccgccgucuccagcaucaaguggcugaaggacggcgugcgccuccagaccaagacggggguccugcaccucccccaggccgccugguccgacgcgggcguguacacgugccaggccgagaacggggugggcagccucgucagcccgcccaucagccugcacaucuucauggccgagguccaggugucccccgccgggcccauccuggagaaccagaccgucacccucgugugcaacacgcccaacgaggcccccagcgaccugcgguacuccugguacaagaaccacgugcugcucgaggacgcgcacagccacacccugcgccugcaccucgccacccgggccgacaccggcuucuacuucugcgagguccagaacgugcacggcuccgagcgcagcgggcccguguccgucguggugaaccacccgccccugacgccgguccugaccgccuuccucgagacccaggccggccugguggggauccugcacugcagcguggucuccgagccccucgcgacccuggugcugagccacggcgggcacauccucgccuccacgagcggcgacagcgaccacagcccccgguucagcggcaccuccgggccgaacagccugcgccuggagauccgggaccuggaggagaccgacuccggcgaguacaagugcagcgccaccaacucccucgggaacgccacgagcacccuggacuuccacgccaacgcggcccgccugcucaucucccccgccgccgagguggucgagggccaggcggugacccugagcugccgcuccgggcugagccccacccccgacgcccgguucuccugguaccucaacggcgcccugcugcacgagggcccggggagcucccuccugcugcccgccgccagcuccacggacgcgggcagcuaccacugccgcgcccgggacgggcacagcgccuccggccccagcucccccgccgugcucaccguccuguacccgccccgccagcccaccuucaccacgcggcuggaccucgacgccgcgggcgccggggccggccgccgggggcugcugcucugccgcguggacagcgacccgcccgcccggcugcagcugcuccacaaggaccgcguggucgccaccucccugcccagcggcgggggcugcagcacgugcggcgggugcagcccccggaugaaggugaccaaggcgcccaaccugcuccgcguggagauccacaacccccugcuggaggaggagggccucuaccugugcgaggccuccaacgcccuggggaacgccagcaccuccgcgaccuucaacggccaggccaccguccucgccaucgcccccagccacacccugcaggaggggaccgaggccaaccugacgugcaacgugucccgggaggcggccggcagccccgccaacuucuccugguuccgcaacggcgugcucugggcccaggggccccuggagaccgucacccugcucccgguggcccggaccgacgcggcccuguacgccugccgcauccugacggaggccggcgcccagcucagcacccccgugcugcuguccguccucuacccgcccgaccggccgaagcugagcgcgcugcucgacauggggcagggccacauggcccuguucaucugcaccguggacucccgcccccuggcccuccuggcccuguuccacggggagcaccuccuggcgaccagccugggcccccaggugccgagccacggccgguuccaggccaaggccgaggccaacucccucaagcuggagguccgcgagcuggggcucggcgacagcggguccuaccgcugcgaggccacgaacgugcugggcagcuccaacaccagccuguucuuccaggugcgcggggccuggguccaggugucccccagccccgagcuccaggagggccaggccgugguccuguccugccaggugcacaccggcgugcccgaggggaccagcuaccgcugguaccgggacggccagccgcugcaggaguccacgagcgccacccuccgcuucgccgccaucacccugacccaggcgggggccuaccacugccaggcccaggcccccggcuccgccacgaccagccuggcggcccccaucucccuccacgucagcuacgcgccccggcacgugacccugaccacgcugauggacaccggcccggggcgccucggccugcugcucugccggguggacuccgacccgcccgcccagcugcgccugcuccacggggaccggcuggucgccagcacccugcagggcgucggcgggcccgagggguccagcccgcgccuccacgucgccguggcccccaacacccugcggcuggagauccacggggccaugcucgaggacgagggcguguacaucugcgaggccagcaacacgcuggggcaggcguccgccagcgccgacuucgacgcccaggccgucaacguccagguguggcccggcgcgaccguccgcgaggggcagcuggugaaccugaccugccugguguggaccacgcaccccgcccagcugaccuacaccugguaccaggacggccagcagcggcucgacgcccacuccaucccgcugcccaacgucaccgugcgcgacgccacgagcuaccggugcggcguggggccgcccggccgcgccccgcggcugucccgccccaucacccucgacguccuguacgcgccccggaaccugcgccucaccuaccugcuggagagccacgggggccagcuggcccucgugcugugcaccguggacucccggcccccggcccagcuggcccucagccacgccgggcgccugcuggcguccagcaccgccgccuccguccccaacacgcuccgccuggagcugcggggcccccagccccgcgacgagggcuucuacagcugcuccgcccggagcccgcucgggcaggcgaacaccucccuggagcugcgccucgagggcgugcgggugauccuggcccccgaggccgccguccccgagggggccccgaucaccgugaccugcgcggaccccgccgcccacgcccccacgcuguacaccugguaccacaacggccgcuggcuccaggagggccccgccgcgagccuguccuuccugguggccacccgggcccacgccggggccuacagcugccaggcgcaggacgcccagggcacccgcuccagccggccggccgcccuccagguccuguacgcgccccaggacgccgugcugagcuccuuccgcgacagccgggcccgcuccauggccgugauccagugcacggucgacagcgagccgcccgccgagcucgcgcugucccacgacgggaaggugcuggccaccagcuccggcgugcacagccucgccuccgggaccggccacguccagguggcccggaacgcccugcgccuccaggugcaggacgucccggcgggcgacgacaccuacgugugcacggcccagaaccuccuggggagcaucuccaccaucggccggcuccagguggagggggcccgcgucguggccgagcccggccucgacgugcccgagggggccgcgcugaaccugagcugccggcuccugggcggccccgggccggucggcaacuccaccuucgccugguucuggaacgaccgccggcugcacgccgagcccgugcccacccucgccuucacgcacguggcccgcgcgcaggccgggauguaccacugccuggccgagcugcccaccggcgccgcggccagcgccccggucaugcuccgcgugcuguacccgcccaagacccccaccaugaugguguucgucgagccggagggcggccugcggggcauccucgacugccgcguggacuccgagccccuggccagccugacgcuccaccuggggucccggcugguggccagcucccagccccagggcgcgcccgccgagccgcacauccacguccucgccagccccaacgcccugcgcguggacaucgaggcccugcggcccagcgaccagggggaguacaucugcuccgcgagcaacgugcucggcuccgccagcaccuccaccuacuucgggguccgcgcccugcaccggcugcaccaguuccagcagcuccugugggugcugggccuccuggugggccugcuccugcugcuccuggggcugggcgccugcuacaccuggcgccggcgccgggucugcaagcagagcaugggggagaacuccguggagauggccuuccagaaggagacgacccagcucaucgaccccgacgcggcgaccugcgagaccagcacgugcgccccgccccugggcuga

SEQ ID NO: 36387 - RNA, 1656 nt, Artificial Sequence
  derived and/or modified sequence opt1 from SIGLEC5__Homo_sapiens__NP_003821
augcugccccuccugcugcucccgcugcuguggggcgggagccuccaggagaagcccguguacgagcugcagguccagaaguccgugaccgugcaggagggccugugcguccucgugcccugcagcuucuccuaccccuggcgcagcugguacuccagcccgccccuguacguguacugguuccgggacggggagauccccuacuacgccgaggucguggccaccaacaaccccgaccgccgggugaagccggagacgcagggccgcuuccggcugcucggggacguccagaagaagaacugcucccugagcaucggcgacgcgcgcauggaggacaccggcuccuacuucuuccggguggagcgcgggcgggacgugaaguacagcuaccagcagaacaagcugaaccucgaggucaccgcccugaucgagaagcccgacauccacuuccuggagccccucgaguccggccgccccacccggcugagcugcucccugccggggagcugcgaggccggcccgccccucacguucuccuggaccgggaacgcccugagcccccuggaccccgagaccacccgcuccagcgagcucacgcugacgccccggcccgaggaccacggcaccaaccugaccugccagaugaagcgccagggcgcccaggugaccaccgagcggaccgugcagcucaacgucuccuacgcgccccagaccaucacgaucuuccgcaacgggaucgcccuggagauccugcagaacaccagcuaccucccggugcuggagggccaggcccugcggcuccugugcgacgcccccagcaacccgcccgcgcaccuguccugguuccaggggagccccgcccucaacgccacccccaucuccaacaccggcauccuggagcugcgccgggugcgcagcgccgaggagggcggguucacgugccgggcccagcacccccucggcuuccugcagaucuuccugaaccucuccgucuacagccugccccagcugcucgggccguccugcagcugggaggcggagggccugcacugccgcugcuccuuccgcgcccggcccgcccccagccugugcuggcgccucgaggagaagccgcuggaggggaacuccagccagggcuccuucaaggugaacagcuccagcgccggccccugggccaacuccagccugauccugcacgggggccucuccagcgaccugaaggugagcugcaaggcguggaacaucuacgggucccagagcggcuccguccugcuccugcaggggcggagcaaccugggcaccggcguggugcccgccgcccucgggggcgccggggucauggcccugcugugcaucugccucugccugaucuucuuccugaucgugaaggcgcgccggaagcaggccgccggccgccccgagaagauggacgacgaggacccgaucauggggaccaucaccuccggcagccggaagaagcccuggcccgacucccccggcgaccaggccagcccgcccggggacgccccgccccucgaggagcagaaggagcugcacuacgcgucccugagcuucuccgagaugaagucccgcgagcccaaggaccaggaggcccccagcacgaccgaguacagcgagaucaagaccuccaaguga

SEQ ID NO: 36388 - RNA, 438 nt, Artificial Sequence
  derived and/or modified sequence opt1 from SIGLEC7__Homo_sapiens__NP_001264130
augcugcuccugcugcuccugccccugcucuggggccgcgagcggguggaggggcagaaguccaaccgcaaggacuacagccugaccaugcagagcuccgucaccgugcaggagggcaugugcgugcacguccggugcagcuucuccuacccgguggacagccagacggacuccgaccccgugcacggguacugguuccgcgccggcaacgacaucagcuggaaggcccccgucgcgaccaacaaccccgccugggccgugcaggaggagacccgggaccgcuuccaccuccugggggacccgcagaccaagaacugcacgcuguccauccgggacgcccgcaugagcgacgccggccgguacuucuuccgcauggagaagggcaacaucaaguggaacuacaaguacgaccagcuguccgugaacgucaccggguga

SEQ ID NO: 36389 - RNA, 1500 nt, Artificial Sequence
  derived and/or modified sequence opt1 from SIGLEC8__Homo_sapiens__NP_055257
augcugcuccugcugcuccugcugccccuccuguggggcaccaaggggauggagggcgaccgccaguacggggacggcuaccugcuccaggugcaggagcuggucaccgugcaggaggggcugugcgugcacgucccgugcagcuucuccuacccccaggacggcuggacggacagcgaccccgugcacggcuacugguuccgggccggggaccgccccuaccaggacgccccgguggcgaccaacaaccccgaccgggagguccaggccgagacccagggccgcuuccagcuccugggggacaucugguccaacgacugcagccuguccauccgggacgcccgcaagcgggacaagggcagcuacuucuuccgccucgagcggggguccaugaaguggagcuacaagucccagcugaacuacaagaccaagcagcugagcguguucgugacggcccucacccaccgccccgacauccugauccugggcacccucgaguccggccacagccggaaccugaccugcuccguccccugggccugcaagcaggggacgccgcccaugaucagcuggaucggcgcguccgugagcucccccgggcccaccaccgcccgcagcuccgugcugacccucacgccgaagccccaggaccacggcaccagccugaccugccaggucacccugcccggcacgggggugaccaccaccagcacggugcggcucgacgucuccuacccgcccuggaaccugaccaugaccguguuccagggcgacgccaccgccagcacggcgcuggggaacggcuccagccucuccgugcuggaggggcagagccugcgccucgucugcgccgugaacuccaacccgcccgcccggcugagcuggacccgcggcucccugacccucugccccagccgguccagcaaccccggccugcuggagcucccccgcgugcacguccgggacgagggggaguucacgugccgcgcccagaacgcccagggcucccagcacaucagccugucccugagccuccagaacgaggggaccggcaccucccggcccgugagccaggugacccuggcggccgucgggggcgccggcgccaccgcccuggcguuccucuccuucugcaucaucuucaucaucgugcgcagcugccgcaagaaguccgcccggcccgccgccggggucggcgacacggggauggaggacgccaaggcgauccgcggcagcgccagccaggggccgcugaccgaguccuggaaggacggcaacccccugaagaagcccccgcccgccguggcccccagcuccggcgaggagggggagcuccacuacgccacccugagcuuccacaaggugaagccccaggacccgcagggccaggaggcgaccgacuccgaguacagcgagaucaagauccacaagcgggagacggccgagacccaggccugccugcgcaaccacaaccccuccagcaaggagguccggggguga

SEQ ID NO: 36390 - RNA, 1440 nt, Artificial Sequence
  derived and/or modified sequence opt1 from SIGLEC9__Homo_sapiens__NP_001185487
augcugcuccugcugcucccccugcuguggggccgcgagcgggccgaggggcagaccagcaagcuccugaccaugcaguccagcgugacgguccaggagggccugugcgugcacgugccgugcuccuucagcuaccccucccacggguggaucuaccccggccccgucgugcacggguacugguuccgcgagggcgccaacaccgaccaggacgcgccgguggccaccaacaaccccgcccgggccgucugggaggagacccgcgaccgguuccaccuccugggcgacccccacacgaagaacugcacccugagcauccgcgacgcccggcgcuccgacgcggggcgguacuucuuccgcauggagaagggcagcaucaaguggaacuacaagcaccaccggcucuccgugaacgugaccgcccugacccaccgccccaacauccugaucccggggacgcucgagagcggcugcccccagaaccugaccugcuccguccccugggccugcgagcaggggacgcccccgaugaucagcuggaucggcaccuccgugagcccccuggaccccuccaccacccggagcuccgugcucacccugaucccccagccgcaggaccacggcaccagccugacgugccaggucaccuuccccggggccuccgugaccaccaacaagacggugcaccucaacgucagcuacccgccccagaaccugaccaugaccguguuccagggcgacgggaccgugagcacgguccugggcaacggcuccagccucucccugcccgaggggcagagccugcgccucgugugcgcgguggacgccgucgacuccaacccgcccgcccggcugagccuguccuggcgcggccucacccugugccccagccagcccuccaaccccggggugcuggagcuccccugggugcaccuccgggacgccgccgaguucacgugccgcgcgcagaacccccugggcagccagcaggucuaccugaacgugucccugcagagcaaggccaccuccggggucacccagggcguggugggcggggccggcgccaccgcccuggucuuccucagcuucugcgugaucuucguggucgugcgguccugccgcaagaaguccgcgcggccggccgccggggugggcgacaccgggaucgaggacgccaacgccguccgcggcagcgcgagccagauccugaaccacuucaucggcuuccccaccuuccuggggcucggcuucgaguuccugcugaaccuccgcgaccugugcugccaccccgacuccgaguucuacguguaccacuucagccacuuccggcugaucaagaacaucgccggggagaucguguggagccucgagggcaagauccuguggcugcuggacgucuccgacuucuuccacugguucuuccucaucugcgugggguga

SEQ ID NO: 36391 - RNA, 612 nt, Artificial Sequence
  derived and/or modified sequence opt1 from SIGMAR1__Homo_sapiens__NP_001269136
augcagugggccgugggccgccggugggccugggcggcccugcuccuggccgucgccgccgugcugacccagguggucuggcucuggcuggggcuggaccacgagcucgcguucagccgccugaucguggagcugcggcgccuccaccccggccacgugcugccggacgaggagcugcagugggucuucgugaacgccgggggcuggaugggggccaugugccuccugcacgccucccugagcgaguacgugcuccuguucggcaccgcgcugggcucccgggggcacagcggccgcuacugggccgagaucuccgacacgaucaucagcgggaccuuccaccaguggcgggagggcaccaccaaguccgaggucuucuaccccggggagacgguggugcacggccccggcgaggccaccgccgucgagugggggcccaacaccuggaugguggaguacggccgcggggugaucccgagcacccucgccuucgcgcuggccgacacggucuucuccacccaggacuuccugacccucuucuacacccugcggagcuacgcccgcggccugcggcucgagcugacgaccuaccuguucggccaggaccccuga

SEQ ID NO: 36392 - RNA, 5484 nt, Artificial Sequence
  derived and/or modified sequence opt1 from SI__Homo_sapiens__NP_001032
auggcccgcaagaaguucagcggccuggagaucucccucaucgugcuguucgucaucgugaccaucaucgccaucgcgcugaucgugguccucgccaccaagacgcccgccguggacgagaucagcgacuccaccagcaccccggccaccacgcgggugaccaccaaccccuccgacagcgggaagugccccaacguccugaacgaccccgugaacgugcgcaucaacugcaucccggagcaguuccccaccgagggcaucugcgcccagcgggggugcugcuggcgccccuggaacgacucccugauccccuggugcuucuucgucgacaaccacggcuacaacgugcaggacaugacgaccaccagcaucgggguggaggcgaagcucaaccggaucccgucccccacccuguucggcaacgacaucaacagcguccuguucacgacccagaaccagacccccaaccgcuuccgguucaagaucaccgaccccaacaaccgccgguacgaggugccgcaccaguacgugaaggaguucacgggccccaccgucuccgacacccucuacgacgugaagguggcccagaaccccuucagcauccaggucauccgcaaguccaacgggaagacccuguucgacacgagcaucggcccccugguguacuccgaccaguaccuccagaucagcacccggcugccguccgacuacaucuacgggaucggcgagcaggugcacaagcgcuuccggcacgaccugagcuggaagaccuggcccaucuucacccgcgaccagcuccccggggacaacaacaacaaccuguacggccaccagacguucuucaugugcaucgaggacaccuccggcaagagcuucggggucuuccugaugaacagcaacgccauggagaucuucauccagcccaccccgaucgugaccuaccgggugacgggcgggauccucgacuucuacauccugcugggcgacacccccgagcaggucgugcagcaguaccagcagcucgucggccugcccgccaugcccgcguacuggaaccugggguuccagcucucccgcuggaacuacaagagccuggacguggugaaggaggucgugcggcgcaaccgggaggccggcaucccguucgacacccaggugaccgacaucgacuacauggaggacaagaaggacuucacguacgaccaggucgccuucaacgggcugccccaguucgugcaggaccuccacgaccacggccagaaguacgugaucauccuggaccccgccaucuccaucgggcgccgggccaacggcaccaccuacgcgaccuacgagcgcggcaacacgcagcacgucuggaucaacgagagcgacggguccacccccaucaucggcgagguguggccggggcugaccguguaccccgacuucaccaaccccaacugcaucgacuggugggccaacgagugcagcaucuuccaccaggagguccaguacgacggccucuggaucgacaugaacgagguguccagcuucauccagggguccaccaagggcugcaacgugaacaagcugaacuacccgcccuucacgcccgacauccuggacaagcucauguacagcaagaccaucugcauggacgccguccagaacuggggcaagcaguacgacgugcacucccuguacggguacagcauggccaucgccaccgagcaggcggugcagaaggucuuccccaacaagcgcuccuucauccugacccggagcacguucgccggcuccgggcgccacgccgcccacuggcucggcgacaacaccgccagcugggagcagauggagugguccaucaccgggaugcuggaguucagccuguucggcaucccgcucgugggcgcggacaucugcggguucguggccgagaccacggaggagcugugccggcgcuggaugcagcugggcgccuucuaccccuucucccggaaccacaacagcgacggguacgagcaccaggaccccgccuucuucggccagaacagccuccuggucaaguccagccgccaguaccugaccauccgguacacccuccugcccuuccuguacacccucuucuacaaggcccacguguucggcgagacgguggcgcgcccgguccugcacgaguucuacgaggacaccaacuccuggaucgaggacaccgaguuccugugggggcccgcccugcucaucacccccgugcugaagcagggcgccgacacggugagcgccuacauccccgacgcgaucugguacgacuacgaguccggggccaagcggccguggcgcaagcagcgggucgacauguaccugcccgccgacaagaucggccuccaccugcgcgggggcuacaucauccccauccaggagcccgacgugaccaccaccgccagccggaagaacccgcugggccucaucguggcccugggggagaacaacacggcgaagggcgacuucuucugggacgacggggagaccaaggacaccauccagaacggcaacuacauccuguacaccuucuccgucagcaacaacacgcucgacaucgugugcacccacuccagcuaccaggaggggaccacccuggccuuccagacggugaagauccugggccucaccgacuccgucaccgaggugcgcguggccgagaacaaccagcccaugaacgcccacagcaacuucaccuacgacgccuccaaccagguccugcugaucgcggaccucaagcugaaccugggccggaacuucagcgugcaguggaaccagaucuucuccgagaacgagcgcuucaacugcuaccccgacgccgaccucgccacggagcagaagugcacccagcgggggugcguguggcgcaccggcagcucccugagcaaggcccccgagugcuacuucccgcggcaggacaacagcuacuccgucaacagcgcccgcuacuccagcauggggaucaccgcggaccugcagcucaacacggccaacgcccgcaucaagcugcccuccgaccccaucagcacccugcggguggaggugaaguaccacaagaacgacaugcuccaguucaagaucuacgacccccagaagaagcgcuacgaggucccggugccccugaacauccccaccaccccgaucuccaccuacgaggaccggcuguacgacguggagaucaaggagaaccccuucggcauccagauccgccggcgcagcuccgggcgggucaucugggacagcuggcuccccggcuucgccuucaacgaccaguucauccagaucuccacgcgccugcccagcgaguacaucuacggcuucggggagguggagcacaccgcguucaagcgggaccugaacuggaacaccuggggcauguucacccgcgaccagccgcccggguacaagcucaacuccuacggcuuccaccccuacuacauggcccuggaggaggaggggaacgcccacggcguguuccugcucaacagcaacgccauggacgucacguuccagcccaccccggcccugaccuaccggaccgugggcgggauccuggacuucuacauguuccucggccccacgcccgagguggcgaccaagcaguaccacgaggucaucgggcaccccgugaugccggccuacugggcccugggcuuccagcugugccgcuacggcuacgccaacaccuccgagguccgggagcucuacgacgccaugguggcggccaacauccccuacgacgugcaguacaccgacaucgacuacauggagcgccagcuggacuucacgaucggggaggccuuccaggaccugccccaguucgucgacaagauccggggcgaggggaugcgcuacaucaucauccucgaccccgccaucagcggcaacgagaccaagaccuacccggccuucgagcgggggcagcagaacgacguguucgugaaguggcccaacaccaacgacaucugcugggcgaaggucuggcccgaccugcccaacaucacgaucgacaagacccugaccgaggacgaggccgugaacgccucccgcgcccacguggcguucccggacuucuuccggaccagcacggccgaguggugggcccgcgagaucgucgacuucuacaacgagaagaugaaguucgacggccucuggaucgacaugaacgagcccuccagcuucgugaacggcaccaccaccaaccagugccggaacgacgagcugaacuacccccccuacuucccggagcugacgaagcgcaccgacgggcuccacuuccgcaccaucugcauggaggccgagcagauccugagcgacggcaccuccgugcugcacuacgacguccacaaccucuacggguggagccagaugaagcccacgcacgacgcccugcagaagaccaccggcaagcgggggaucgugaucucccgcagcaccuaccccacguccggccgguggggcgggcacuggcugggcgacaacuacgcgcgcugggacaacauggacaagagcaucaucgggaugauggaguucucccucuucggcaugagcuacaccggggccgacaucugcggcuucuucaacaacuccgaguaccaccugugcacccgguggaugcagcugggcgccuucuaccccuacagccgcaaccacaacaucgccaacacccggcgccaggacccggccuccuggaacgagacguucgcggagaugagccggaacauccucaacauccgcuacacccugcugcccuacuucuacacccagaugcacgagauccacgccaacgggggcaccgugauccggccccuccugcacgaguucuucgacgagaagccgaccugggacaucuucaagcaguuccugugggggcccgccuucauggucacgcccgugcucgagcccuacgugcagaccgucaacgccuacgugccgaacgcccgcugguucgacuaccacaccggcaaggacaucggcgugcgggggcaguuccagaccuucaacgcguccuacgacacgaucaaccugcacguccgcggcgggcacauccugcccugccaggagcccgcccagaacaccuucuacagccggcagaagcacaugaagcucaucguggccgccgacgacaaccagauggcccagggcucccuguucugggacgacggggagagcaucgacaccuacgagcgcgaccuguaccucuccgugcaguucaaccugaaccagaccacgcugaccagcaccauccucaagcggggcuacaucaacaaguccgagacccgccugggcagccugcacgucugggggaagggcacgacccccgugaacgcggugacccucaccuacaacgggaacaagaacagccugccguucaacgaggacacgaccaacaugauccugcggaucgaccucaccacccacaacgucacgcuggaggagcccaucgagaucaacugguccuga

SEQ ID NO: 36393 - RNA, 2352 nt, Artificial Sequence
  derived and/or modified sequence opt1 from SIK1__Homo_sapiens__NP_775490
auggugaucaugagcgaguucuccgccgaccccgccggccaggggcagggccagcagaagccgcugcgcgucggguucuacgacaucgagcggacccucggcaaggggaacuucgcgguggugaagcuggcccgccaccgggucaccaagacccagguggccaucaagaucaucgacaagacgcgccuggacagcuccaaccucgagaagaucuaccgggaggugcagcugaugaagcugcucaaccacccccacaucaucaagcuguaccaggucauggagaccaaggacaugcuguacaucgugaccgaguucgccaagaacggcgagauguucgacuaccucacgagcaacggccaccuguccgagaacgaggcccgcaagaaguucuggcagauccugagcgcgguggaguacugccacgaccaccacaucguccaccgggaccucaagaccgagaaccugcugcucgacgggaacauggacaucaagcuggccgacuucggcuucgggaacuucuacaaguccggcgagccccugagcaccuggugcggguccccgcccuacgccgcccccgagguguucgagggcaaggaguacgagggcccccagcucgacaucuggagccugggggugguccuguacgugcucgugugcggcucccugcccuucgacgggccgaaccugcccacccuccgccagcggguccuggagggccgcuuccggauccccuucuucaugagccaggacugcgagucccugauccgccggaugcucgugguggaccccgcgcgccggaucacgaucgcccagauccgccagcaccgguggaugcgcgccgagccgugccugcccggccccgccugccccgccuucagcgcgcacuccuacaccagcaaccugggggacuacgacgagcaggcccucggcaucaugcagacccugggggucgaccggcagcgcaccguggagucccugcagaacagcuccuacaaccacuucgccgccaucuacuaccuccugcuggagcggcucaaggaguaccgcaacgcccagugcgcgcgcccgggccccgcccggcagccccgcccccggagcagcgaccuguccgggcuggaggugccgcaggagggccucagcacggaccccuuccgccccgcccugcugugcccccagccgcagacccucguccaguccgugcugcaggccgagauggacugcgagcugcagagcucccuccaguggccccuguucuuccccguggacgccagcugcuccggcgucuuccggccccgcccggugagccccuccagccugcucgacaccgcgaucuccgaggaggcccggcaggggcccggccuggaggaggagcaggacacccaggagagccugccguccagcacggggcgccggcacacccuggccgaggucuccacccgccucagcccccugaccgcccccugcaucguggugucccccagcacgaccgccuccccggcggagggcaccagcagcgacuccugccugaccuucagcgccuccaagagccccgccgggcucuccggcacgcccgccacccagggccugcugggggcgugcagccccguccggcucgccuccccguuccugggcagccaguccgccacccccgugcugcaggcccagggcgggcucgggggcgccgugcugcugcccgucagcuuccaggagggccgccgggcguccgacaccagccucacgcaggggcugaaggccuuccgccagcagcugcggaagaccacccgcaccaagggcuuccucgggcugaacaagaucaagggccuggcccgccaggugugccaggcccccgccucccgggcgagccggggcgggcucuccccguuccacgcccccgcccagagccccggccugcacgggggcgccgccgggucccgcgagggcuggagccugcucgaggaggugcuggagcagcagcgccugcuccagcugcagcaccaccccgcggccgccccgggcugcagccaggcgccccagcccgcccccgccccguucgucaucgcccccugcgacgggcccggcgccgcgccccugccguccacgcuccugaccagcgggcugccccuccugcccccgccccugcuccagaccggcgccucccccguggccagcgccgcccagcugcuggacacccaccuccacaucgggacgggccccaccgcccugccggcggugcccccgccccggcuggcccgccucgcccccggcugcgagccccuggggcugcuccagggcgacugcgagauggaggaccugaugcccugcucccuggggaccuucguccucgugcaguga

SEQ ID NO: 36394 - RNA, 2781 nt, Artificial Sequence
  derived and/or modified sequence opt1 from SIK2__Homo_sapiens__NP_056006
auggugauggccgacggcccccgccaccuccagcgggggccgguccgcgugggcuucuacgacaucgaggggacccucggcaaggggaacuucgccguggucaagcugggccggcaccgcaucaccaagacggagguggcgaucaagaucaucgacaagagccagcuggacgccgugaaccucgagaagaucuaccgggagguccagaucaugaagaugcuggaccacccccacaucaucaagcuguaccaggugauggagaccaaguccaugcucuaccuggugaccgaguacgccaagaacggcgagaucuucgacuaccuggccaaccacgggcgccucaacgagagcgaggcccggcgcaaguucuggcagauccuguccgcggucgacuacugccacggccggaagaucgugcaccgcgaccugaaggccgagaaccuccugcuggacaacaacaugaacaucaagaucgccgacuucggguucggcaacuucuucaagagcggggagcuccuggccaccuggugcggcuccccgcccuacgcggcccccgagguguucgagggccagcaguacgaggggccccagcuggacaucuggagcaugggcgucgugcucuacgugcuggucugcggggcccugcccuucgacggccccacgcucccgauccugcggcagcgcgugcuggagggccgguuccgcauccccuacuucauguccgaggacugcgagcaccucauccggcgcaugcuggugcuggaccccagcaagcggcucaccaucgcccagaucaaggagcacaaguggaugcugaucgagguccccgugcagcgcccggugcuguacccccaggagcaggagaacgagcccuccaucggggaguucaacgagcagguccuccggcugaugcacagccugggcaucgaccagcagaagaccaucgagucccugcagaacaagagcuacaaccacuucgccgcgaucuacuuccugcugguggagcgccucaagucccaccggagcuccuuccccguggagcagcgccuggacgggcgccagcggcgcccgagcaccaucgccgagcagacggucgccaaggcccagaccgugggccugcccgucaccaugcacucccccaacaugcggcuccugcgcagcgcccugcucccccaggcguccaacguggaggccuucagcuucccggccagcgggugccaggccgaggccgcguucauggaggaggagugcguggacacccccaaggucaacggcugccugcuggaccccgugcccccggugcucguccggaagggcugccagucccugcccagcaacaugauggagacguccaucgacgaggggcuggagaccgagggcgaggccgaggaggaccccgcccacgccuucgaggccuuccagagcacccgcuccgggcagcggcgccacacccucagcgaggugacgaaccagcugguggucaugcccggcgcggggaagaucuucuccaugaacgacagcccgucccuggacagcguggacuccgaguacgacaugggcagcgugcagcgggaccugaacuuccucgaggacaaccccucccugaaggacaucaugcuggccaaccagcccagcccgcgcaugaccucccccuucaucagccuccggcccaccaaccccgccaugcaggcccuguccagccagaagcgcgagguccacaaccgguccccggugagcuuccgcgagggccggcgcgcgagcgacaccucccugacgcaggggaucguggccuuccggcagcaccuccagaaccuggcccgcaccaagggcauccuggagcucaacaagguccagcugcuguacgagcagaucgggcccgaggccgaccccaaccucgcccccgcggccccgcagcugcaggaccuggccagcuccugcccccaggaggaggugagccagcagcaggaguccgugagcacccuccccgccuccguccacccccagcugagcccgcggcagucccuggagacccaguaccuccagcaccgccugcagaagcccagccugcucuccaaggcccagaacacgugccagcuguacugcaaggagccgccccgcagccuggagcagcagcuccaggagcaccggcugcagcagaagcgccuguuccuccagaagcagucccagcugcaggcguacuucaaccagaugcagaucgccgagagcuccuacccccagcccagccagcagcugccccucccccggcaggagaccccgccgcccucccagcaggcgccgcccuucagccugacccagccccugagccccgugcucgagcccuccagcgagcagaugcaguacucccccuuccugagccaguaccaggagaugcagcugcagccccuccccuccaccagcggcccgcgcgccgccccgccccugcccacgcagcugcagcagcagcagcccccgccgccgcccccgcccccgccgccccggcagcccggggccgcccccgcgccccuccaguucuccuaccagaccugcgagcugcccagcgccgccucccccgcccccgacuaccccacccccugccaguaccccguggacggcgcccagcagagcgaccugaccggccccgacugcccccgcucccccgggcuccaggaggcccccagcuccuacgacccccuggcccugagcgagcuccccggccuguucgacugcgagaugcuggacgcggucgacccccagcacaacggguacgugcucgugaacuga

SEQ ID NO: 36395 - RNA, 3786 nt, Artificial Sequence
  derived and/or modified sequence opt1 from SIK3__Homo_sapiens__NP_001268678
auggccgccgcggccgccagcggcgccgggggcgccgcgggggccggcaccgggggcgccggccccgccgggcgccugcucccgccccccgcgcccggcuccccggccgcccccgccgccgugagccccgcggccgggcagccccggccgcccgcccccgccucccgcggccccaugccggcccggaucggguacuacgagaucgaccgcaccaucggcaagggcaacuucgcggucgugaagcgggccacgcaccuggugaccaaggccaaggucgccaucaagaucaucgacaagacccagcuggacgaggagaaccucaagaagaucuuccgcgaggugcagaucaugaagaugcugugccacccccacaucauccggcuguaccaggugauggagaccgagcgcaugaucuaccucgucacggaguacgccagcgggggcgagaucuucgaccaccugguggcgcacgggcggauggccgagaaggaggcccgccggaaguucaagcagaucgugaccgccgucuacuucugccacugccgcaacaucgugcaccgggaccugaaggccgagaaccuccugcuggacgcgaaccucaacaucaagaucgccgacuucggcuucuccaaccuguucacccccggccagcugcucaagaccuggugcgggagccccccguacgccgcccccgagcuguucgagggcaaggaguacgacgggcccaagguggacaucuggucccugggcgucgugcucuacgugcuggucugcggggcgcugcccuucgacggcagcacgcuccagaaccugcgcgcccgggugcuguccggcaaguuccgcaucccguucuucaugagcaccgagugcgagcaccucauccggcacaugcuggugcuggaccccaacaagcgccucuccauggagcagaucugcaagcacaaguggaugaagcugggggacgccgaccccaacuucgaccggcugaucgccgagugccagcagcucaaggaggagcgccaggucgacccccugaacgaggacgugcugcucgccauggaggacaugggccuggacaaggagcagacccugcaggcggagcaggccgggaccgccaugaacaucagcgugccgcagguccagcucaucaaccccgagaaccagaucguggagcccgacggcacgcugaaccuggacuccgacgagggggaggagcccagcccggaggcccucgugcgguaccuguccaugcgccgccacaccgucggcguggccgacccccggaccgaggucauggaggaccugcagaagcuccugcccggcuucccgggggugaacccccaggcgcccuuccugcagguggcccccaacgucaacuucaugcacaaccuccugccgaugcagaaccugcagcccaccggccagcucgaguacaaggagcagagccugcugcagccccccacgcugcagcuccugaacgggaugggcccgcuggggcgccgggccuccgacggcggcgccaacauccagcuccacgcccagcagcugcugaagcgcccccgggggcccagcccccucgugaccaugaccccggcggugcccgccgucacccccguggacgaggaguccagcgacggcgagcccgaccaggaggccgugcagcgcuaccuggccaaccggagcaagcgccacacgcuggcgaugaccaacccgaccgccgagaucccccccgaccuccagcggcagcuggggcagcagcccuuccgcucccgggucuggccgccccaccuggugcccgaccagcaccgcagcaccuacaaggacuccaacacgcuccaccugcccaccgagcgguucagcccggugcgccgguucuccgacggcgccgccagcauccaggccuucaaggcgcaccuggagaagaugggcaacaacuccagcaucaagcagcuccagcaggagugcgagcagcugcagaagauguacgggggccagaucgacgagcgcacccuggagaagacccagcagcagcacaugcucuaccagcaggagcagcaccaccagauccugcagcagcagauccaggacuccaucugccccccccagccgagccccccccugcaggccgccugcgagaaccagcccgcccuccugacgcaccagcugcagcggcuccgcauccagccguccagccccccccccaaccacccgaacaaccaccuguuccggcagcccuccaacagcccccccccgauguccagcgccaugauccagccccacggggcggccuccagcucccaguuccagggccugcccagccgcagcgccaucuuccagcagcagcccgagaacugcuccagcccgcccaacgucgcccucaccugccuggggaugcagcagcccgcccagucccagcaggugaccauccaggugcaggagcccgucgacaugcugagcaacaugccgggcaccgcggccggcuccagcgggcgcggcaucuccaucagccccuccgccgggcagaugcagaugcagcaccggacgaaccucauggccacccugagcuacggccaccgcccccuguccaagcagcucagcgcggacuccgccgaggcccacagcgcccaccagcagcccccgcacuacaccaccuccgcccugcagcaggcgcugcucagccccacgccccccgacuacacccggcaccagcaggugccgcacauccugcaggggcugcucuccccccgccacagccugaccggccacagcgacauccggcugcccccgaccgaguucgcccagcucaucaagcgccagcagcagcagcggcagcagcagcagcagcagcagcagcagcaggaguaccaggagcuguuccgccacaugaaccagggcgacgccgggucccuggcccccagccucggcgggcaguccaugaccgagcggcaggcccugagcuaccagaacgcggacuccuaccaccaccacacgagcccccagcaccugcuccagauccgcgcccaggagugcgugucccaggccagcucccccaccccgccccacggcuacgcccaccagcccgcccugaugcacagcgaguccauggaggaggacugcagcugcgagggggcgaaggacggcuuccaggacuccaagagcuccagcacccugaccaagggcugccacgacuccccccuccugcugagcacggggggcccgggggaccccgagucccuccugggcaccgucagccacgcccaggagcuggggauccaccccuacggccaccagcccaccgccgccuucagcaagaacaaggugccgucccgggagcccgugaucggcaacugcauggaccgcagcucccccgggcaggccgucgagcuccccgaccacaacggccugggguacccggcgcggcccagcgugcacgagcaccaccgcccccgggcccugcagcgccaccacaccauccagaacuccgacgacgccuacgugcagcucgacaaccugcccggcaugagccuggucgccggcaaggcgcucuccagcgcccggauguccgacgccgugcugagccaguccagccugauggggucccagcaguuccaggacggcgagaacgaggagugcggggccagccucggcgggcacgagcacccggaccuguccgacggcagccagcaccugaacuccagcugcuaccccuccacgugcaucaccgacauccuccugagcuacaagcaccccgaggugagcuucuccauggagcaggccggcgucuga

SEQ ID NO: 36396 - RNA, 1386 nt, Artificial Sequence
  derived and/or modified sequence opt1 from SIL1__Homo_sapiens__NP_071909
auggcgccccagagccugccguccagccgcauggcgccccucggcaugcugcuggggcuccugauggccgccugcuucaccuucugccugucccaccagaaccucaaggaguucgcccugaccaaccccgagaaguccagcacgaaggagaccgagcggaaggagaccaaggccgaggaggagcuggacgccgaggugcucgaggucuuccaccccacccacgaguggcaggcccugcagccgggccaggccgugcccgccgggagccacgugcgccugaaccuccagacgggcgagcgggaggccaagcugcaguacgaggacaaguuccgcaacaaccugaaggggaagcggcucgacaucaacaccaacaccuacaccucccaggaccucaagagcgcgcuggccaaguucaaggagggcgccgagauggaguccagcaaggaggacaaggcccgccaggccgaggucaagcggcuguuccgccccaucgaggagcugaagaaggacuucgacgagcugaacguggugaucgagacggacaugcagaucaugguccggcucaucaacaaguucaacuccagcuccagcucccuggaggagaagaucgcggcccuguucgaccucgaguacuacgugcaccagauggacaacgcccaggaccugcugagcuucggcgggcuccagguggucaucaacggccugaacuccaccgagccccuggugaaggaguacgccgccuucgugcucggggcggccuucagcuccaacccgaagguccagguggaggccaucgagggcggggcccugcagaagcugcucgugauccuggccaccgagcagccccugaccgcgaagaagaagguccucuucgcccugugcagccugcuccgccacuuccccuacgcccagcggcaguuccugaagcugggcggccuccaggugcugcgcacgcuggugcaggagaaggggaccgagguccucgccgugcggguggucacccugcuguacgaccucgugaccgagaagauguucgccgaggaggaggcggagcugacgcaggagaugagccccgagaagcugcagcaguaccgccaggugcaccuccugccgggccugugggagcagggguggugcgagaucaccgcccaccuccuggcccugcccgagcacgacgcccgggagaagguccugcagacccucggcgugcugcugaccacgugccgcgaccgguaccgccaggacccccagcucggccggacccuggcgucccugcaggccgaguaccagguccucgccagccuggagcugcaggacggggaggacgagggcuacuuccaggagcuccugggguccgugaacagccugcucaaggagcugcgcuga

SEQ ID NO: 36397 - RNA, 2301 nt, Artificial Sequence
  derived and/or modified sequence opt1 from SIM1__Homo_sapiens__XP_005267157
augaaggagaaguccaagaacgccgcccgcacccggcgcgagaaggagaacuccgaguucuacgagcuggcgaagcuccugccccugccgagcgccaucaccucccagcucgacaaggccagcaucauccggcugacgaccuccuaccugaagaugcgcguggucuuccccgagggccucggggaggccuggggccacagcucccggaccagcccccuggacaacguggggcgcgagcugggcucccaccuccugcagacccuggacggguucaucuucguggucgcccccgacggcaagaucauguacaucagcgagacggcguccgugcaccucggccugagccagguggagcugaccgggaacuccaucuacgaguacauccacccggccgaccacgacgagaugaccgccguccucaccgcccaccagcccuaccacagccacuucgugcaggaguacgagaucgagcgguccuucuuccugcgcaugaagugcgugcuggcgaagcggaacgccggccucacgugcgggggcuacaaggucauccacugcagcggguaccugaagauccgccaguacucccuggacaugagccccuucgacggcugcuaccagaacgugggccucguggccgucgggcacucccugcccccgagcgccgugaccgagaucaagcugcacagcaacauguucauguuccgggccucccucgacaugaagcugaucuuccuggacagccgcguggcggagcucaccggcuacgagccccaggaccugaucgagaagacccuguaccaccacguccacgggugcgacacguuccaccuccggugcgcccaccaccuccugcuggugaagggccaggugaccaccaaguacuaccgcuuccuggccaagcacggcgggugggucugggugcaguccuacgccaccaucgugcacaacagccgguccagccgcccccacugcaucgucuccgugaacuacgugcugacggacaccgaguacaagggccuccagcugagccuggaccagaucuccgccagcaagcccgcguucuccuacaccagcuccagcaccccgacgaugaccgacaaccggaagggggccaagucccgccucagcuccagcaaguccaagagccggaccagccccuacccccaguacuccggcuuccacaccgagcgcagcgaguccgaccacgacagccaguggggcgggagcccccugacggacaccgccagcccgcagcugcucgaccccgccgaccggcccggcucccagcacgacgccagcugcgcguaccgccaguucuccgaccgcagcucccugugcuacggguucgcccuggaccacagccggcucgucgaggagcgccacuuccacacccaggccugcgagggcgggcggugcgaggccggccgcuacuuccuggggacgccccaggccggccgggagccgugguggggcucccgcgcggcccugccccucaccaaggccagccccgagucccgggaggccuacgagaacagcaugccccacaucgcguccgugcaccgcauccacgggcggggccacugggacgaggacagcgucgugagcuccccggaccccgggagcgccuccgagagcggcgaccgcuaccggaccgagcaguaccaguccagcccccacgagcccuccaagaucgagacccugauccgcgccacccagcagaugaucaaggaggaggagaaccggcugcagcugcgcaaggccccgagcgaccagcucgccuccaucaacggggcgggcaagaagcacagccugugcuucgccaacuaccagcagcccccgcccacgggcgaggugugccacggguccgcccuggccaacaccagccccugcgaccacauccagcagcgggagggcaagaugcucagcccccacgagaacgacuacgacaacucccccaccgcccugucccgcaucagcuccccgaacagcgaccggaucuccaagagcagccugauccucgcgaaggacuaccugcacuccgacaucagcccccaccagaccgccggggaccaccccacggucucccccaacugcuucggcagccaccgccaguacuucgacaagcacgccuacacccugaccggcuacgcccucgagcaccuguacgacuccgagaccauccggaacuacagccuggggugcaacggcucccacuucgacgugaccagccaccuccgcaugcagccggaccccgcccaggggcacaagggcacguccgugaucaucaccaacgggagcuga

SEQ ID NO: 36398 - RNA, 2004 nt, Artificial Sequence
  derived and/or modified sequence opt1 from SIM2__Homo_sapiens__NP_005060
augaaggagaaguccaagaacgccgccaagacccgccgggagaaggagaacggcgaguucuacgagcuggccaagcuccugccccugccguccgccaucaccagccagcucgacaaggccuccaucauccgccugacgaccagcuaccugaagaugcgggccguguuccccgaggggcucggcgacgccugggggcagcccucccgcgcgggcccccuggacggggucgccaaggagcugggcagccaccuccugcagacccuggacggcuucguguucguggucgccuccgacgggaagaucauguacaucagcgagaccgccuccgugcaccucggccugagccagguggagcugacggggaacuccaucuacgaguacauccacccgagcgaccacgacgagaugaccgcgguccucaccgcccaccagccccugcaccaccaccuccuccaggaguacgagaucgagcgguccuucuuccugcgcaugaagugcgugcuggccaagcggaacgccggccucacgugcagcggguacaaggugauccacugcuccggcuaccugaagauccgccaguacaugcuggacaugagccucuacgacuccugcuaccagaucgucggccugguggccguggggcagagccugccgcccuccgcgaucacggagaucaagcuguacagcaacauguucauguuccgggccagccuggaccugaagcucaucuuccuggacagccgcgucaccgaggugaccggcuacgagccccaggaccugaucgagaagacccucuaccaccacgugcacgggugcgacgucuuccaccuccgcuacgcccaccaccuccugcuggugaagggccaggugaccaccaaguacuaccggcugcugagcaagcggggcgggugggucugggugcaguccuacgccaccgugguccacaacagccgcuccagccggccccacugcaucguguccgugaacuacguccugaccgagaucgaguacaaggagcugcagcucagccuggagcaggucuccacggccaagagccaggacuccuggcgcaccgcgcugagcaccucccaggagacccggaagcucgugaagcccaagaacacgaagaugaagaccaagcugcgcaccaaccccuacccgccccagcaguacagcuccuuccagauggacaagcuggagugcggccagcucgggaacuggcgggccagcccgcccgccuccgccgccgcgccgcccgagcugcagccccacagcgaguccagcgaccugcuguacacccccagcuacucccuccccuucagcuaccacuacggccacuucccccuggacucccacguguucagcuccaagaagcccaugcugcccgccaaguucgggcagccgcagggcagccccugcgagguggcccgcuucuuccucuccacgcugcccgccagcggcgagugccaguggcacuacgccaacccccuggucccguccagcuccagccccgcgaagaacccgcccgagccgcccgccaacaccgcccggcacucccucgugcccagcuacgaggcccccgcggccgccgugcgccgcuucggggaggacaccgccccgcccuccuuccccagcugcggccacuaccgggaggagcccgcccuggggcccgcgaaggccgcccgccaggccgcccgggacggcgcgcgccuggcccucgcccgggccgcccccgagugcugcgcgcccccgacccccgaggcccccggggcccccgcccagcugccguucguccugcucaacuaccaccgcgugcuggcgcggcgcggcccccugggcggggccgcccccgccgccuccggccucgcgugcgcccccgggggcccggaggccgccacgggggcccugcggcugcgccaccccagccccgcggccaccagcccgcccggcgcgccccucccccacuaccugggcgccuccgugaucaucaccaacgggcgguga

SEQ ID NO: 36399 - RNA, 3822 nt, Artificial Sequence
  derived and/or modified sequence opt1 from SIN3A__Homo_sapiens__XP_006720530
augaagcgccggcuggacgaccaggagagccccguguacgccgcccagcagcgccggaucccgggcuccaccgaggcguucccccaccagcaccgcguccucgcccccgcgcccccgguguacgaggccgugagcgagaccaugcaguccgccacggggauccaguacagcgucacccccuccuaccaggugagcgccaugccccaguccagcggcucccacgggcccgccaucgccgccgugcacagcucccaccaccacccgaccgcgguccagccccacggcgggcaggucgugcagagccacgcccaccccgcgcccccggucgcccccgugcagggccagcagcaguuccagcggcugaagguggaggacgcccuguccuaccucgaccaggucaagcugcaguucggcagccagccccagguguacaacgacuuccuggacaucaugaaggaguucaagucccagagcaucgacacccccggggugaucucccgcgucagccagcuguucaagggccacccggaccugaucaugggguucaacacguuccugccgcccggcuacaagaucgaggugcagaccaacgacauggugaacgucaccacccccggccaggugcaccagauccccacgcacggcauccagccccagccccagcccccgccccagcaccccucccagcccagcgcccagagcgccccggcccccgcccagcccgccccgcagcccccgcccgcgaagguguccaagcccagccagcuccaggcccacacccccgccucccagcagaccccgccccugccgcccuacgccagcccccggagcccgcccguccagccccacacccccgugacgaucucccugggcaccgcccccucccuccagaacaaccagcccguggaguucaaccacgcgaucaacuacgucaacaagaucaagaaccgcuuccaggggcagcccgacaucuacaaggccuuccuggagauccugcacaccuaccagaaggagcagcggaacgccaaggaggccggcgggaacuacacccccgcccucacggagcaggagguguacgcgcaggucgcccgccuguucaagaaccaggaggaccugcucagcgaguucggccaguuccugcccgacgccaacuccagcgugcugcucuccaagaccaccgccgagaagguggacagcguccggaacgaccacggcgggaccgugaagaagccgcagcugaacaacaagccccagcgccccucccagaacggcugccagauccggcgccaccccacggggaccaccccgcccgugaagaagaagcccaagcuccucaaccugaaggacagcuccauggcggacgccagcaagcacggcggcgggaccgagucccuguucuucgacaaggugcggaaggcccuccgcagcgccgaggccuacgagaacuuccugcggugccuggugaucuucaaccaggaggugaucucccgcgcggagcucguccagcuggugagcccguuccuggggaaguuccccgagcuguucaacugguucaagaacuuccucggguacaaggagagcgugcaccuggagacguaccccaaggagcgggccaccgagggcaucgccauggagaucgacuacgccuccugcaagcgccucgggagcuccuaccgggcccugcccaagagcuaccagcagccgaagugcaccggccgcacgccccugugcaaggagguccucaacgacaccuggguguccuuccccagcugguccgaggacagcaccuucguguccagcaagaagacccaguacgaggagcacaucuaccgcugcgaggacgagcgguucgagcuggacgucgugcuggagaccaaccucgcgacgauccgcgugcuggaggccauccagaagaagcugucccggcucagcgccgaggagcaggccaaguuccgccuggacaacacccucgggggcaccuccgaggucauccaccggaaggcccugcagcgcaucuacgcggacaaggccgccgacaucaucgacggccugcggaagaaccccagcaucgccgugccgaucgugcugaagcgccugaagaugaaggaggaggaguggcgggaggcgcagcgcggguucaacaaggucuggcgggagcagaacgagaaguacuaccucaagucccuggaccaccagggcaucaacuucaagcagaacgacaccaaggugcugcgcagcaagucccuccugaacgagaucgagagcaucuacgacgagcggcaggagcaggccacggaggagaacgccggggugcccgucggcccccaccugagccucgccuacgaggacaagcagauccuggaggacgccgcggcccugaucauccaccacgugaagcgccagaccgggauccagaaggaggacaaguacaagaucaagcagaucaugcaccacuucauccccgaccuccuguucgcccagcggggcgaccuguccgacguggaggaggaggaggaggaggagauggacgucgacgaggccaccggcgccgugaagaagcacaacggggugggcgggagcccgcccaaguccaagcuccuguucagcaacaccgcggcccagaagcugcgcggcauggacgaggucuacaaccucuucuacgugaacaacaacugguacaucuucaugcggcugcaccagauccugugccuccgccugcugcggaucugcucccaggccgagcgccagaucgaggaggagaaccgcgagcgggagugggagcgcgaggugcucggcaucaagcgggacaagagcgacucccccgccauccagcugcgccugaaggagcccauggacgucgacguggaggacuacuacccggccuuccucgacauggugcggagccugcuggacgggaacaucgacuccagccaguacgaggacucccuccgcgagauguucaccauccacgcguacaucgccuucacgauggacaagcugauccagagcaucguccggcagcugcagcacaucguguccgacgagaucugcgugcaggucaccgaccucuaccuggccgagaacaacaacggcgccaccgggggccagcugaacacccagaacagccgcucccuccuggagagcacguaccagcggaaggcggagcagcugauguccgacgagaacugcuucaagcucauguucauccagagccagggccaggugcagcugaccaucgagcugcucgacaccgaggaggagaacuccgacgaccccguggaggccgagcgcuggagcgacuacgucgagcgguacaugaacagcgacaccacgucccccgagcugcgcgagcaccuggcccagaagcccguguuccucccgcggaaccugcgccggauccgcaagugccagcgggggcgcgagcagcaggagaaggagggcaaggaggggaacagcaagaagaccauggagaacguggacucccuggacaagcucgagugccgguucaagcugaacagcuacaagauggucuacgugaucaaguccgaggacuacauguaccgccggaccgcccugcuccgcgcccaccagagccacgagcgcguguccaagcggcugcaccagcgcuuccaggcgugggucgacaaguggaccaaggagcacgugccccgggagauggccgccgagacgagcaaguggcugaugggcgaggggcucgagggccuggugcccugcaccacgaccugcgacaccgagacccugcacuucgucuccaucaacaaguaccgcgugaaguacgggaccgucuucaaggcccccuga

SEQ ID NO: 36400 - RNA, 3393 nt, Artificial Sequence
  derived and/or modified sequence opt1 from SIN3B__Homo_sapiens__NP_001284524
auggcccacgccggcgggggcagcgggggcuccggggcgggcggccccgccgggcgcggccugagcggggcccgguggggccgcuccgggagcgccggccacgagaagcucccggugcacgucgaggacgcccugaccuaccuggaccaggugaagauccgguucggcuccgaccccgcgaccuacaacggguuccucgagaucaugaaggaguucaagagccaguccaucgacacgcccggcgugauccgccgggucagccagcuguuccacgagcaccccgaccugaucgugggguucaacgccuuccucccgcugggcuaccgcaucgacauccccaagaacggcaagcugaacauccaguccccgcucaccagccaggagaacucccacaaccacggggacggcgccgaggacuucaagcagcagguccccuacaaggaggacaagccccaggugccccuggagagcgacuccguggaguucaacaacgccaucagcuacgugaacaagaucaagacccgguuccuggaccaccccgagaucuaccgcuccuuccucgagauccugcacaccuaccagaaggagcagcugaacacgcgggggcgccccuuccggggcaugagcgaggaggaggucuucaccgagguggcgaaccucuuccgcgggcaggaggaccugcuguccgaguucggccaguuccucccggaggccaagcggagccuguucaccggcaacgggcccugcgagaugcacuccgugcagaagaacgagcacgacaagacccccgagcacagccgcaagcggagccgccccucccugcuccggccggucagcgcccccgccaagaagaagaugaagcugcgcggcacgaaggaccuguccaucgccgcgguggggaaguacggcacccuccaggaguucagcuucuucgacaaggugcggcgcguccugaagucccaggagguguacgagaacuuccugcggugcaucgcccucuucaaccaggagcuggugagcggguccgagcugcuccagcuggucagccccuuccugggcaaguuccccgagcuguucgcccaguucaaguccuuccugggcgugaaggagcugagcuucgccccgcccauguccgaccgcagcggggacggcaucucccgcgagaucgacuacgccagcugcaagcggaucggguccagcuaccgcgcgcuccccaagaccuaccagcagcccaagugcuccggccggaccgccaucugcaaggaggugcugaacgacacgugggucagcuucccguccuggagcgaggacagcaccuucguguccagcaagaagacccccuacgaggagcagcugcaccgcugcgaggacgagcgguucgagcucgacgugguccuggagaccaaccuggccacgauccgcgugcucgaguccguccagaagaagcugagccggauggcccccgaggaccaggagaaguuccgccuggacgacucccucgggggcaccagcgaggugauccagcggcgcgccaucuaccggaucuacggcgacaaggcgcccgagaucaucgagucccugaagaagaacccggugaccgccguccccguggugcugaagcgccucaaggccaaggaggaggaguggcgggaggcccagcagggguucaacaagaucuggcgcgagcaguacgagaaggccuaccucaagagccuggaccaccaggcggucaacuucaagcagaacgacaccaaggcccugcgguccaagagccuccugaacgagaucgaguccguguacgacgagcaccaggagcagcacagcgagggccgcuccgcccccagcuccgagccgcaccugaucuucguguacgaggaccggcagauccucgaggacgccgcggcccugaucagcuacuacgucaagcgccagcccgccauccagaaggaggaccaggggacgauccaccagcugcuccaccaguucgugcccucccuguucuucagccagcagcuggaccucggcgccagcgaggaguccgccgacgaggaccgggacagcccccagggccagaccaccgacccguccgagcgcaagaagcccgcgcccgggccccacagcuccccgcccgaggagaagggcgccuucggggacgcccccgccaccgagcagcccccgcugcccccgcccgcgccccacaagccccuggacgacguguacagccucuucuucgccaacaacaacugguacuucuuccugcgccugcaccagacgcucugcucccggcugcugaagaucuaccgccaggcccagaagcagcuccuggaguaccggaccgagaaggagcgcgagaagcugcucugcgagggccggcgcgagaaggggagcgaccccgccauggagcugcggcugaagcagcccuccgaggucgagcucgaggaguacuacccggccuuccuggacauggugcgcagccugcucgagggcuccaucgaccccacccaguacgaggacacccugcgggagauguucacgauccacgccuacgugggcuucaccauggacaagcugguccagaacaucgcgcgccagcuccaccaccuggugagcgacgacgugugccugaaggucguggagcucuaccugaacgagaagaagcgcggggccgccggcgggaaccuguccagccggugcgugcgggccgcgcgcgagaccuccuaccaguggaaggccgagcggugcauggccgacgagaacugcuucaaggucauguuccuccagcgcaagggccaggugaucaugaccaucgagcugcuggacacggaggaggcccagaccgaggaccccguggagguccagcaccucgcccgguacguggagcaguacguggggaccgagggcgcgagcuccagccccaccgagggcuuccugcugaagccggucuuccuccagcgcaaccugaagaaguuccggcgccgguggcaguccgagcaggcccgcgcccugcgcggggaggcccggagcagcuggaagcgccucgugggcguggaguccgccugcgacgucgacugccgguucaagcugagcacgcacaagaugguguucaucgugaacuccgaggacuacauguaccgccgggggacccugugccgcgcgaagcagguccagccccucgugcugcugcggcaccaccagcacuucgaggaguggcacagccgcuggcucgaggacaacgugaccgucgaggccgccucccuggugcaggacuggcugaugggcgaggaggacgaggacauggugcccugcaagacccucugcgagaccguccacgugcacgggcugccggugacgcgguaccgcguccaguacagccggcgccccgccucccccuga

SEQ ID NO: 36401 - RNA, 3129 nt, Artificial Sequence
  derived and/or modified sequence opt1 from SIPA1__Homo_sapiens__NP_694985
augcccaugugggccggcggggugggcagcccgcgccgggggauggcccccgcguccaccgacgaccuguucgcccgcaagcuccggcagcccgcccgccccccgcugaccccccacacguucgagccccggcccguccgcggcccgcugcuccggagcggguccgacgccggcgaggcccgcccccccacccccgcgagcccgcgggcccgcgcccacucccacgaggaggccagccggcccgcggccaccuccacccgccuguucacggacccccuggcccuccugggccugcccgccgaggagccggagcccgccuucccccccgugcucgagccgcggugguucgcgcacuacgacgugcagagccugcuguucgacugggccccccgcucccaggggaugggcagccacuccgaggccagcuccgggacccucgccagcgccgaggaccaggcggccuccagcgaccugcugcacggcgcccccggguucgucugcgagcucggcggcgagggggagcugggccuggggggccccgccuccccgcccgugccccccgcccucccgaacgcggccgugagcauccuggaggagccccagaaccggaccuccgccuacagccuggagcacgccgaccucggcgccggguacuaccgcaaguacuucuacggcaaggagcaccagaacuucuucgggauggacgagagccugggccccgucgcggugucccugcggcgcgaggagaaggaggggagcggcggcgggacccuccacuccuaccgggugaucguccgcacgacccagcugcggacccugcgcggcaccaucagcgaggacgcccucccgcccgggcccccccgcggccuguccccgcggaagcugcucgagcacguggccccccagcugagccccuccugccugcgccucgggagcgccucccccaaggugccgcggacgcugcugacccucgacgagcagguccugagcuuccagcgcaaggugggcauccuguacugccgggcgggccagggguccgaggaggagauguacaacaaccaggaggccggccccgccuucaugcaguuccucacccugcugggggacgugguccgccucaagggcuucgagagcuaccgggcccagcuggacaccaagacggacuccaccgggacccacagccuguacaccacguaccaggaccacgagaucauguuccacguguccaccaugcuccccuacacccccaacaaccagcagcagcugcugcgcaagcggcacaucggcaacgacaucgugaccaucgucuuccaggagccgggcagcaagcccuucugccccacgaccauccgcucccacuuccagcacguguuccucgugguccgggcccacacccccugcaccccgcacacgaccuaccgcguggcggugagccggacccaggacacccccgccuucgggcccgcccugcccgccggcgggggcccguucgccgcgaacgccgacuuccgcgccuuccugcuggccaaggcccucaacggcgagcaggcggccgggcacgcccggcaguuccacgccauggcgacgcgcacccggcagcaguaccugcaggaccuggccaccaacgaggucaccacgaccucccucgacagcgccagccgcuucggccugcccucccuggggggccggcgccgcgccgccccccgggggcccggcgcggagcuccaggccgccggcagccuggugugggggguccgcgccgccccgggcgcgcggguggccgccggggcccaggccuccggccccgaggggaucgaggugcccugccugcucggcaucagcgcggaggcccugguccugguggccccgcgcgacggccggguggucuucaacugcgccugccgcgacgugcucgcguggaccuucuccgagcagcagcuggaccuguaccacgggcggggcgaggccaucacccuccgcuucgacgggagccccggccaggccgugggggaggucguggcccggcugcagcuggugucccgcggcugcgagacccgggagcucgcccugccccgcgacggccaggggcggcugggcuucgaggucgacgcggagggguucgugacgcacguggagcgcuucaccuucgccgagaccgccggccuccggcccggggcccgccugcugcgggucugcggccagacccucccgagccugcgccccgaggccgcggcccagcugcuccgguccgcccccaaggugugcgugacgguccugcccccggacgagagcggccgcccccggcgcuccuucagcgagcuguacacccucucccugcaggagcccagccgccggggggcccccgacccggugcaggacgaggugcagggcgucacccugcuccccaccacgaagcagcugcugcaccucugccugcaggacgggggcuccccccccggcccgggggaccuggccgaggagcgcaccgaguuccuccacagccagaacucccugagcccccggagcucccugagcgacgaggcgcccgugcuccccaacaccaccccggaccugcugcucgccacgaccgccaagcccuccgugcccagcgccgacuccgagaccccccugacccaggaccgcccgggcagccccuccgggagcgaggacaagggcaaccccgcccccgagcugcgggcguccuuccucccgcgcacgcugagccugcggaacuccaucagccgcaucauguccgaggccgggagcggcacccucgaggacgaguggcaggccaucuccgagaucgccagcaccugcaacaccauccuggagucccugagccgggagggccagcccauccccgaguccggggacccgaagggcacgcccaagagcgacgcggagcccgagcccgggaaccucagcgagaaggucucccaccuggagagcaugcugcgcaagcuccaggaggaccugcagaaggagaaggccgaccgggccgcccuggaggaggaggugcgcucccuccggcacaacaaccgccggcugcaggccgagagcgaguccgcggccacccgccugcuccuggccagcaagcagcugggcuccccgaccgccgaccucgccuga

SEQ ID NO: 36402 - RNA, 5169 nt, Artificial Sequence
  derived and/or modified sequence opt1 from SIPA1L2__Homo_sapiens__NP_065859
augagcgacccccgccagucccaggaggagaagcacaagcugggccgggccagcuccaaguucaaggacccgccccgcaucaugcagagcgacgacuacuucgcccggaaguucaaggcgaucaacgggaacaugggccccaccaccucccucaacgccagcaacuccaacgagacgggcggcgggggccccgccaacggcacccccgccgugcccaagaugggggugcgcgcccgggugagcgaguggccgcccaagaaggacugcuccaaggagcugaccugcaaggcgcugugggagagccgcucccagaccagcuacgaguccaucacgagcgugcuccagaacggccaguccgaccagagcgaggggcagcaggacgagcagcuggaccuggacuucgucgaggccaaguacaccaucggcgacaucuucgugcacagcccccagcgggggcuccaccccauccgccagcgguccaacuccgacgugaccaucagcgacaucgacgccgaggacguccuggaccagaacgccgugaaccccaacaccggcgcggcccugcaccgcgaguacggcagcacguccagcaucgaccggcaggggcucuccggcgagaacuucuucgccaugcugcgcggguaccggguggagaacuacgaccacaaggccaugguccccuucggcuuccccgaguucuuccgcugcgaccccgccaucagccccucccugcacgcggccgcccagaucagccggggcgaguucgugcgcaucuccgggcucgacuacguggacagcgcccugcugaugggccgggaccgcgacaagcccuucaagcggcgccucaaguccgagagcgucgagaccucccuguuccggaagcugcgcaccgugaaguccgagcacgagaccuucaaguucacguccgagcucgaggagagccgccuggagcgggggauccgcccguggaacugccagcggugcuucgcccacuacgacgugcaguccauccuguucaacaucaacgaggcgauggccacccgcgccaacgucggcaagcggaagaacaucaccaccggggccagcgccgcgucccagacgcagaugcccaccggccagaccggcaacugcgagagcccccucggguccaaggaggaccugaacagcaaggagaaccuggacgccgacgagggcgacgggaaguccaacgaccucgugcuguccugccccuacuuccgcaacgagaccggcggggagggcgaccggcgcaucgcccugagccgggccaacuccagcuccuucagcuccggcgagagcugcuccuucgagagcucccucagcucccacugcacgaacgccggggugagcguccuggaggugccgcgcgagaaccagcccauccaccgggagaaggugaagcgcuacaucaucgagcacaucgaccugggcgcguacuacuaccggaaguucuucuacgggaaggagcaccagaacuacuucggcaucgacgagaaccucgggcccgucgccguguccauccgccgggagaagguggaggacgccaaggagaaggagggcagccaguucaacuaccgcgucgccuuccggaccuccgagcugaccacccugcgcggcgcgauccucgaggacgccauccccagcacggcccggcacgggaccgcccgcggccugccgcugaaggaggugcucgaguacgucauccccgagcugagcauccagugccugcgccaggccuccaacagccccaagguguccgagcagcuccugaagcuggacgagcaggggcucagcuuccagcacaagaucggcauccuguacugcaaggcgggccaguccaccgaggaggagauguacaacaacgagaccgccgggcccgccuucgaggaguuccuggaccuccugggccagcgggugcgccugaagggguucagcaaguaccgggcccagcucgacaacaagacggacuccaccggcacccacagccuguacaccacguacaaggacuacgagcugauguuccacgucuccacccugcucccguacaugcccaacaaccgccagcagcugcugcggaagcgccacaucgggaacgacaucgugaccaucguguuccaggagcccggcgcccucccguucacccccaagagcauccggucccacuuccagcacgucuucgugaucgugaagguccacaaccccugcacggagaacgugugcuacagcgugggcgucucccgcagcaaggacgugcccccguucgggccgcccauccccaagggcgugaccuucccgaaguccgcggucuuccgggacuuccugcuggccaaggugaucaacgccgagaacgccgcccacaagagcgagaaguuccgcgcgauggccacccggacccgccaggaguaccucaaggaccuggccgagaacuucgugaccacggccaccgucgacaccuccgugaaguucagcuucaucacccugggggcgaagaagaaggagaaggugaagccccggaaggacgcccaccucuucuccaucggcgccaucauguggcacgucaucgcccgcgacuucgggcagagcgccgacaucgagugccugcugggcaucagcaacgaguucaucaugcucaucgagaaggacuccaagaacgugguguucaacugcagcugccgggacgucaucggcuggacguccgggcuggugagcaucaagguguucuacgagcgcggcgagugcguccugcucuccagcguggacaacugcgcggaggacauccgggagaucgugcagcgccuggucaucgugacccgggggugcgagaccguggagaugacccugcgccggaacggccucgggcagcugggcuuccacgucaacuucgagggcaucguggccgacguggagcccuucggguucgccuggaaggccggccugcgccaggggucccgccucgucgagaucugcaagguggccguggcgacgcugacccacgagcagaugaucgaccugcuccggaccagcgucaccgugaagguggucaucauccagccccacgacgacggcuccccgcgccgggggugcagcgagcugugccgcauccccaugguggaguacaagcuggacuccgagggcacgcccugcgaguacaagacccccuuccggcgcaacaccaccuggcaccgggugccgacgcccgcccuccagccccugagccgcgccucccccaucccgggcacccccgaccggcugcccugccagcagcuccugcagcaggcccaggccgcgaucccccgcagcaccuccuucgaccggaagcugccggacgggacccgcagcucccccagcaaccaguccagcagcuccgaccccggccccgggggcagcggccccuggcggccccaggucggguacgacggcugccagagcccccugcugcuggagcaccaggggagcggcccgcucgagugcgacggggcccgcgagcgggaggacacgauggaggccucccgccaccccgagaccaaguggcacgggccgcccagcaaggugcugggcuccuacaaggagcgggcccugcagaaggacgggagcugcaaggacuccccgaacaagcucagccacaucggcgacaaguccugcagcucccacagcuccagcaacacccuguccagcaacaccuccagcaacagcgacgacaagcacuucggguccggcgaccugauggaccccgagcuccuggggcugacguacaucaagggcgcgagcaccgacuccggcaucgacaccgcccccugcaugcccgccaccauccucgggccggugcaccuggccggcagccgcucccugauccacagccgggccgagcagugggcggacgccgccgacgucuccgggcccgacgacgagcccgccaagcucuacagcgugcacggcuacgccuccacgaucagcgcgggguccgccgccgagggcagcaugggcgaccuguccgagaucagcucccacagcuccgggagccaccacuccggcagccccagcgcccacugcuccaagagcuccgggagccuggacuccagcaagguguacaucgucucccacagcuccggccagcaggucccgggcagcauguccaagcccuaccaccgccagggggccgucaacaaguacgugaucggcuggaagaaguccgaggggagcccgccgcccgaggagcccgaggugaccgagugccccggcauguacagcgagauggacgucauguccaccgcgacccagcaccagacgguggugggggacgccgucgccgagacccagcacgugcucagcaaggaggacuuccugaagcugaugcuccccgacagcccccugguggaggagggccgccggaaguucuccuucuacggcaaccugagcccccgccggagccucuaccgcacccugagcgacgaguccaucugcagcaaccggcgcggguccagcuucggcuccagccgguccagcguccuggaccaggcccuccccaacgacauccuguucuccaccacgcccccguaccacagcacccugccgccccgcgcccacccggcgcccuccauggggagccuccggaacgaguucugguucuccgacggcagccuguccgacaagagcaagugcgccgaccccgggcugaugccccucccggacaccgccaccggccuggacuggacccaccugguggacgccgcgcgcgccuucgagggccucgacuccgacgaggagcuggggcugcucugccaccacacgagcuaccuggaccagcggguggccagcuucugcacccugaccgacaugcagcacggccaggaccucgagggggcccaggagcugccccugugcgucgaccccggcuccgggaaggaguucauggacaccacgggcgagcgcagccccuccccgcucaccggcaaggugaaccagcuggagcugauccuccggcagcugcagaccgaccugcgcaaggagaagcaggacaaggccgugcuccaggcggagguccagcaccuccggcaggacaacaugcgccugcaggaggagagccagaccgccacggcccagcuccggaaguucaccgagugguucuucaccaccaucgacaagaaguccuga

SEQ ID NO: 36403 - RNA, 5346 nt, Artificial Sequence
  derived and/or modified sequence opt1 from SIPA1L3__Homo_sapiens__NP_055888
augaccaccuaccgcgccauccccuccgacggcguggaccuggccgccuccugcggggcccgggugggcgacgugcuccccgggccccacaccggcgacuacgcgccccugggguucugggcccagaacggcuccaugucccagccccugggcgagagccccgccaccgccaccgccaccgccacggccaccacccgccccucccccaccacgcccgccaugcccaagaugggggugcgggcccgcgucgccgacuggccgcccaagcgggaggcccuccgcgagcacagcaaccccuccccgagccaggacaccgacggcaccaaggccaccaagauggcgcacuccaugcggagcauccagaacgggcagccgcccacguccacccccgccagcuccggcagcaaggccuuccaccgccugucccggcgccggagcaaggacguggaguuccaggacggguggccccgcucccccggccgggccuuccugccccuccgccaccggagcuccagcgagaucacccugagcgagugcgacgccgaggacgcgggcgagccccgcggggcccggcacaccggcgcccugccccucuuccgcgaguacggguccacgagcuccaucgacgugcagggcaugcccgagcagagcuucuucgacauccugaacgaguuccgguccgagcagcccgacgcccgcggcugccaggcccugaccgagcuccugcgggcggaccccgggccccaccugaugggcgggggcgggggcgccaagggcgacagccacaacgggcagcccgccaaggacucccuccugccccugcagcccaccaaggagaaggagaaggcccgcaagaagcccgcccgcggccucgggggcggggacaccgucgacagcuccaucuuccggaagcugcgcagcuccaagcccgagggcgaggcgggccggagccccggggaggccgacgagggccgcuccccgcccgaggccagccggcccugggugugccagaaguccuucgcccacuucgacgugcagagcaugcuguucgaccucaacgaggcggccgccaaccgcgucuccgugagccagcggcgcaacacgaccaccggggccuccgccgcgagcgccgccagcgccauggccucccugaccgcgagccgggcccacucccugggcgggcucgaccccgccuucacgagcaccgaggaccugaacugcaaggagaaccuggagcaggaccucggcgacgacaacuccaacgaccugcugcucagcugcccccacuuccgcaacgagaucggcggggagugcgagcggaacguguccuucagccgcgccuccgucggcagccccuccagcggggagggccaccuggccgagcccgcgcuguccgccuaccggaccaacgccagcaucuccgugcucgaggugcccaaggagcagcagcgcacccagagccggccccgccaguacuccaucgagcacgucgaccugggcgcccgguacuaccaggacuacuucguggggaaggagcacgcgaacuacuucggcguggacgagaagcuggggcccgucgccgugagcaucaagcgcgagaagcucgaggaccacaaggagcacggcccccaguaccaguaccggaucaucuuccgcacgcgcgagcugaucacccugcgggggagcauccucgaggacgccacccccaccgccacgaagcacggcaccggccgcgggcugccccugaaggacgcccucgaguacgugauccccgagcugaacauccacugccugcggcucgcgcugaacacccccaaggucaccgagcagcugcucaagcuggacgagcagggccugugccgcaagcacaagguggggauccuguacugcaaggccggccaguccagcgaggaggagauguacaacaacgaggaggccgggcccgccuucgaggaguuccucucccugaucggcgagaaggugugccugaagggcuucacgaaguacgccgcgcagcucgacgucaagaccgacagcaccgggacccacucccuguacaccauguaccaggacuacgagaucauguuccacgugagcacgcugcuccccuacacccccaacaaccggcagcagcugcugcgcaagcggcacaucggcaacgacaucgucaccaucaucuuccaggagcccggggcccuccccuucaccccgaagaacauccgcucccacuuccagcacguguucaucaucgugcggguccacaaccccugcacggacaacgugugcuacagcauggccgugacccgcuccaaggacgcgccgcccuucggcccgcccauccccagcgggaccaccuuccggaaguccgacgucuuccgcgacuuccugcuggccaaggugaucaacgcggagaacgccgcccacaagagcgacaaguuccacacgauggccacccggacccgccaggaguaccucaaggaccuggcggagaacugcguguccaacaccccgaucgacagcacgggcaaguucaaccugaucucccucaccagcaagaagaaggagaagaccaaggcccgggccggcgccgagcagcacuccgccggggcgaucgccuggcgcgucguggcccaggacuacgcccagggcguggagaucgacugcauccuggggaucagcaacgaguucgucgugcugcucgaccugcggaccaaggagguggucuucaacugcuacugcggcgacgugaucggguggacgcccgacuccagcacccugaagaucuucuacggccgcggcgaccacaucuuccuccaggccaccgaggggagcguggaggacauccgggagaucguccagcgccugaaggugaugaccuccggcugggagacgguggacaugacccugcggcgcaacgggcucggccagcugggcuuccacgucaaguacgacgggaccguggcggagguggaggacuacggcuucgccuggcaggccgggcugcgccagggcagccggcucgucgagaucugcaagguggccguggucacccugacgcacgaccagaugaucgaccugcuccgcaccuccgugaccgugaaggucgugaucaucccgcccuucgaggacgggaccccgcggcgcggcuggcccgagacguacgacaugaacaccagcgagcccaagaccgagcaggaguccaucacccccggcgggcggccgcccuaccgcagcaacgcccccuggcagugguccggccccgcgagccacaacucccugccggccagcaagugggccacgcccaccacccccgggcacgcccagucccugagccggccccucaagcagaccccgaucgugcccuuccgcgagucccagccccugcacagcaagcggcccgucuccuucccggagacgcccuacaccgugagccccgccggcgcggaccgcgugcccccguaccggcagcccuccgggagcuucuccacccccggcagcgccaccuacguccgcuacaagcccagcccggagcgguacaccgccgcgccccacccccugcucucccuggacccgcacuucagccacgacggcacguccagcggggacuccagcuccggcgggcugaccagccaggaguccaccauggagcgccagaagcccgagccccucuggcacgugcccgcgcaggcccggcugagcgccaucgccggcuccagcgggaacaagcacccgucccgccaggacgccgcgggcaaggacagccccaaccggcacuccaagggcgagccccaguacagcucccacagcuccagcaacacccugagcuccaacgccagcuccagccacuccgacgaccgcugguucgacccccucgacccgcuggagcccgagcaggacccccugagcaagggcggcuccagcgacuccgggaucgacacgacccucuacaccagcucccccagcugcaugucccuggccaaggccccgcggcccgccaagccccacaagcccccgggcagcaugggccugugcgggggcgggcgcgaggcggccggccgcucccaccacgccgaccggcgccgggaggugagccccgcccccgccgucgcggggcaguccaagggcuaccgccccaagcucuacagcuccggcagcagcaccccgacggggcuggccggcgggucccgggacccgccccgccagcccagcgacaugggcucccgggugggguacccggcccagguguacaagaccgccagcgcggagacgccccgccccucccagcuggcccagcccagcccguuccagcucuccgccagcguccccaaguccuucuucagcaagcagcccgugcggaacaagcacccgaccggcuggaagcgcacggaggagccgccgccccggccgcugcccuucuccgaccccaagaagcaggucgacaccaacaccaagaacgucuucggccagccccgccugcgggccagccuccgcgaccugcgguccccgcgcaagaacuacaagagcaccaucgaggacgaccugaagaagcucaucaucauggacaaccuggggcccgagcaggagcgggacacgggccagagcccccagaaggggcugcagcgcacccucagcgacgagucccugugcagcggccggcgcgagcccuccuucgccagcccggcggggcuggagcccggccuccccagcgacgugcuguucaccagcacgugcgccuuccccagcuccacccugccggcccggcgccagcaccagcacccccacccgcccgugggcccgggggccacccccgccgcgggcagcggguuccccgagaagaaguccaccaucagcgccuccgagcucagccuggccgacggccgcgaccggccccugcgccggcucgacccggggcugaugccccugcccgacaccgccgccggccucgagugguccagccuggucaacgcggccaaggccuacgaggugcagcgcgccgugucccuguucagccucaacgacccggcgcugucccccgacaucccgcccgcccacagcccgguccacucccaccugagccucgagcgggggccgcccacgccccgcaccaccccgaccauguccgaggagccgccccuggaccugacggggaagguguaccagcucgaggucaugcugaagcagcugcacaccgaccuccagaaggagaagcaggacaagguggugcugcagagcgaggucgccagccugcggcagaacaaccagcgccuccaggaggagucccaggccgccagcgagcagcugcggaaguucgcggagaucuucugccgcgagaagaaggagcuguga

SEQ ID NO: 36404 - RNA, 1515 nt, Artificial Sequence
  derived and/or modified sequence opt1 from SIRPA__Homo_sapiens__NP_542970
auggagcccgccggcccggcccccgggcgccugggcccccuccugugccugcuccuggcggccagcugcgccugguccgggguggccggcgaggaggagcugcaggucauccagcccgacaagagcgugcucguggccgcgggggagaccgccacccugcggugcacggccaccucccugaucccggucggccccauccagugguuccgcggcgccgggcccggccgggagcucaucuacaaccagaaggaggggcacuucccccgcgugaccaccgugagcgaccugacgaagcggaacaacauggacuucuccauccgcaucggcaacaucaccccggcggacgccgggaccuacuacugcgucaaguuccggaagggcagccccgacgacguggaguucaaguccggcgccgggaccgagcugagcgugcgcgccaagcccuccgcccccgucgugagcggcccggcggcccgggccacgccccagcacaccguguccuucacgugcgagagccacggguucagcccccgcgacaucacccucaagugguucaagaacggcaacgagcuguccgacuuccagaccaacgucgaccccgugggcgaguccgugagcuacuccauccacagcaccgccaaggucgugcugacccgggaggacgugcacucccaggucaucugcgagguggcccacgugacccuccagggggacccgcugcgcggcacggcgaaccugagcgagaccauccgggugccgcccacccucgaggugacccagcagcccgugcgcgccgagaaccaggucaacgugacgugccagguccggaaguucuacccccagcgccugcagcugaccuggcucgagaacgggaacgugagccggaccgagaccgccuccacggugaccgagaacaaggacggcaccuacaacuggaugagcuggcugcuggucaacguguccgcccaccgcgacgacgugaagcugaccugccaggucgagcacgacgggcagcccgccgugagcaagucccacgaccucaaggugagcgcgcaccccaaggagcagggcuccaacacggccgccgagaacaccggcagcaacgagcggaacaucuacaucgucguggggguggucugcacccugcucguggcccugcugauggccgcgcucuaccuggugcgcauccggcagaagaaggcccagggcuccaccagcuccacgcgccugcacgagcccgagaagaacgcccgcgagaucacccaggacaccaacgacaucaccuacgccgaccucaaccugccgaaggggaagaagcccgcgccccaggccgccgagcccaacaaccacacggaguacgccagcauccagaccuccccgcagcccgccagcgaggacacccugaccuacgcggaccucgacaugguccaccugaaccggacccccaagcagccggcccccaagcccgagcccuccuucagcgaguacgccuccguccaggugccgcgcaaguga

SEQ ID NO: 36405 - RNA, 546 nt, Artificial Sequence
  derived and/or modified sequence opt1 from SIRPB1__Homo_sapiens__NP_001077379
augcccgugccggccagcuggccccaccuccccucccccuuccugcugaugacccugcuccugggccgccugaccggggucgccggcgaggacgagcuccaggugauccagccggagaaguccgugagcgucgcggccggggagagcgccacgcugcggugcgccaugaccucccugauccccgugggccccaucaugugguuccgcggggccggcgcgggccgggagcucaucuacaaccagaaggaggggcacuucccccgcgugaccaccgucagcgagcugacgaagcggaacaaccuggacuucuccaucagcaucuccaacaucaccccggccgacgccggcaccuacuacugcgugaaguuccgcaaggggagccccgacgacguggaguucaaguccggcgccgggaccgagcucagcguccgggaggcggcccuggcccccacggcgccccugcucguggcccugcugcucggcccgaagcugcugcucguggucggcguguccgccaucuacaucugcuggaagcagaaggccuga

SEQ ID NO: 36406 - RNA, 831 nt, Artificial Sequence
  derived and/or modified sequence opt1 from SIRPG__Homo_sapiens__NP_001034597
augcccgugccggccagcuggccccacccgcccggccccuuccugcuccugacccugcuccuggggcugaccgaggucgccggcgaggaggagcuccagaugauccagcccgagaagcugcugcucgugacgguggggaagaccgcgacccugcacugcaccgucacgucccugcuccccgugggccccgugcugugguuccgcggggucggcccgggccgggagcugaucuacaaccagaaggaggggcacuucccccgcgugaccaccgugagcgaccucaccaagcggaacaacauggacuucuccauccgcaucagcuccaucacgcccgccgacgucggcaccuacuacugcgugaaguuccggaaggggagccccgagaacguggaguucaaguccggcccggggaccgagauggcccugggcgccaagcccagcgcccccgucgugcugggccccgcggcccgcaccacgccggagcacaccguguccuucacgugcgagagccacggguucagcccccgggacaucacccucaagugguucaagaacggcaacgagcuguccgacuuccagaccaacgucgaccccaccgggcaguccguggccuacagcauccgcuccaccgcccgggugguccuggaccccugggacgugcgcagccaggugaucugcgaggucgcgcacgugacccuccagggcgacccgcugcggggcacggccaaccuguccgaggccauccgcgggcccgccagcucccucaccgcccugcugcucaucgcggugcugcugggccccaucuacguccccuggaagcagaagaccuga

SEQ ID NO: 36407 - RNA, 1359 nt, Artificial Sequence
  derived and/or modified sequence opt1 from SIRT1__Homo_sapiens__NP_001135970
auguucgacaucgaguacuuccgcaaggacccccggccguucuucaaguucgccaaggagaucuaccccggccaguuccagcccagccugugccacaaguucaucgcccucuccgacaaggaggggaagcugcugcgcaacuacacccagaacaucgacacccucgagcaggucgcgggcauccagcggaucauccagugccacgggagcuucgccacggccuccugccugaucugcaaguacaagguggacugcgaggccgugcgcggcgacaucuucaaccagguggucccccggugcccgcgcugccccgccgacgagccccuggcgaucaugaagcccgagaucguguucuucggggagaaccucccggagcaguuccaccgggccaugaaguacgacaaggacgagguggaccugcugaucgucaucggcagcucccucaaggugcgccccguggcccugauccccagcuccaucccccacgaggucccgcagauccugaucaaccgggagccccucccccaccuccacuucgacguggagcugcucggcgacugcgacgugaucaucaacgagcugugccaccgccucgggggcgaguacgccaagcugugcugcaaccccgucaagcugagcgagaucaccgagaagccgccccggacccagaaggagcuggcguaccucuccgagcugccgcccacgccccugcacgugagcgaggacuccagcucccccgagcgcaccagcccgcccgacuccagcgugaucgucacccuccuggaccaggccgccaaguccaacgacgaccuggacgugagcgaguccaaggggugcauggaggagaagccccaggaggugcagaccagccggaacgucgagagcaucgccgagcagauggagaaccccgaccucaagaacgugggcuccagcaccggggagaagaacgagcgcacguccguggccggcaccguccggaagugcuggcccaaccgcguggcgaaggagcagaucagccggcgccuggacggcaaccaguaccuguuccugcccccgaaccgguacaucuuccacggggccgagguguacuccgacagcgaggacgacguccuguccagcuccagcugcggcuccaacagcgacuccgggaccugccagagccccucccuggaggagcccauggaggacgagagcgagaucgaggaguucuacaacggccucgaggacgagccggacgugcccgagcgcgccggcggggccggcuucgggaccgacggcgacgaccaggaggccaucaacgaggcgaucuccgucaagcaggaggugacggacaugaacuaccccagcaacaaguccuga

SEQ ID NO: 36408 - RNA, 705 nt, Artificial Sequence
  derived and/or modified sequence opt1 from SIRT2__Homo_sapiens__NP_001180215
auggacuuccugcgcaaccucuucagccagacccugucccugggcagccagaaggagcggcuccuggacgagcugacccucgaggggguggcccgcuacaugcaguccgagcggugccgccgggucaucugccuggugggcgccgggaucagcacguccgcgggcauccccgacuuccgcagcccguccaccgggcuguacgacaaccucgagaaguaccaccuccccuaccccgaggccaucuucgagaucagcuacuucaagaagcaccccgagccguucuucgcccuggccaaggagcuguaccccggccaguucaagcccaccaucugccacuacuucaugcggcugcugaaggacaagggccuccugcugcgcugcuacacccagaacaucgacacgcucgagcggaucgccgggcuggagcaggaggaccugguggaggcgcacggcaccuucuacaccucccacugcgucagcgccuccugccgccacgaguacccccucagcuggaugaaggagaagaucuucuccgaggugaccccgaagugcgaggacugccagagccuggugaagcccgacaucgucuucuucggggagucccugcccgcccgguucuucagcugcaugcaguccgacuuccucaagguggaccugcugcucgugaugggcacgagccugcaggggcgcggccuggccggcuga

SEQ ID NO: 36409 - RNA, 774 nt, Artificial Sequence
  derived and/or modified sequence opt1 from SIRT3__Homo_sapiens__NP_001017524
auggugggcgccgggaucagcacccccuccggcaucccggacuuccgcagccccggguccggccuguacagcaaccuccagcaguacgaccugcccuaccccgaggccaucuucgagcugccguucuucuuccacaaccccaagcccuucuucacccucgcgaaggagcuguaccccgggaacuacaagccgaacgucacgcacuacuuccugcggcuccugcacgacaagggccugcuccugcgccuguacacccagaacaucgacggccucgagcggguguccgggauccccgccagcaagcugguggaggcccacggcaccuucgccuccgcgaccugcacggucugccagcgccccuuccccggggaggacauccgggccgacgugauggccgaccgcgugccgcggugccccgucugcaccggcguggugaagcccgacaucgucuucuucggggagccccugccgcagcgcuuccuccugcacgugguggacuuccccauggccgaccugcuccugauccugggcaccagccucgaggucgagcccuucgccucccugaccgaggcggugcggagcuccgugccccgccugcucaucaaccgggaccuggucggcccgcuggccuggcacccccgcagccgggacguggcccagcucggggacgugguccacggcguggagucccugguggagcugcucggguggacggaggagaugcgcgaccugguccagcgggagaccggcaagcuggacggccccgacaaguga

SEQ ID NO: 36410 - RNA, 945 nt, Artificial Sequence
  derived and/or modified sequence opt1 from SIRT4__Homo_sapiens__NP_036372
augaagaugagcuucgcccugaccuuccgcuccgccaagggccgguggaucgcgaaccccagccagccgugcuccaaggccagcaucgggcuguucgugcccgccuccccgccccuggaccccgagaaggucaaggagcugcagcgcuucaucacccucagcaagcggcugcuggugaugacgggcgccgggaucuccaccgagagcggcauccccgacuaccgcuccgagaagguggggcucuacgcccggaccgaccgccggcccauccagcacggcgacuucguccgcagcgcgcccauccggcagcgcuacugggcccggaacuucgugggcuggccgcaguucuccagccaccagcccaaccccgcccacugggcccuguccaccugggagaagcuggggaagcucuacuggcuggugacgcagaacgucgacgcgcugcacaccaaggccggcagccgccggcucaccgagcugcacgggugcauggaccgcgugcugugccucgacugcggcgagcagacgccccgcggggugcugcaggagcgguuccagguccugaacccgaccugguccgccgaggcccacggccucgcccccgacggcgacguguuccugagcgaggagcagguccgguccuuccaggugccgaccugcgugcagugcgggggccaccugaagcccgacguggucuucuucggggacaccgugaaccccgacaagguggacuucguccacaagcgcgugaaggaggcggacagccuccugguggucggcuccagccuccagguguacagcggcuaccgguucauccucaccgccugggagaagaagcugcccaucgccauccugaacaucgggcccacgcgcuccgacgaccucgccugccugaagcugaacagccggugcggcgagcuccugccccugaucgacccgugcuga

SEQ ID NO: 36411 - RNA, 879 nt, Artificial Sequence
  derived and/or modified sequence opt1 from SIRT5__Homo_sapiens__NP_001180196
augcgcccccugcagaucgugccgagccggcucaucucccagcuguacugcggccugaagccgcccgccagcacccgcaaccagaucugccucaagauggcccggcccuccagcuccauggcggacuuccgcaaguucuucgccaaggccaagcacaucgucaucaucagcggggccggcguguccgccgagagcggggugcccaccuuccggggcgccgggggcuacuggcgcaaguggcaggcccaggaccuggccacgccccuggccuucgcgcacaaccccucccgggucugggaguucuaccacuaccgccgggaggugaugggcagcaaggagcccaacgccgggcaccgcgccaucgccgagugcgagacccggcucggcaagcaggggcgccggguggucgugaucacccagaacaucgacgagcugcaccgcaaggccggcaccaagaaccugcucgagauccacgggucccuguucaagacgcggugcaccagcugcggcguggucgcggagaacuacaaguccccgaucugccccgcccugagcggcaaggggugcgaggaggccggcugcgggggccuccugcgcccccacguggugugguucggcgagaaccuggaccccgccauccucgaggaggucgaccgggagcuggcccacugcgaccugugccucgugguggggaccuccagcgucguguacccggcggccauguucgcgccccagguggccgcccgcggcguccccguggcggaguucaacaccgagacgacccccgccaccaaccgguuccgcuuccacuuccaggggccgugcggcaccacgcugcccgaggcccuggccugccacgagaacgagaccguguccuga

SEQ ID NO: 36412 - RNA, 987 nt, Artificial Sequence
  derived and/or modified sequence opt1 from SIRT6__Homo_sapiens__NP_001180214
augagcgugaacuacgccgccggccugucccccuacgcggacaaggggaagugcggccucccggagaucuucgacccgcccgaggagcuggagcgcaaggucugggagcuggcccggcucguguggcagagcuccagcguggucuuccacaccggggccggcaucuccaccgccagcgggauccccgacuuccgcggcccccacggcguguggacgauggaggagcgggggcuggcccccaaguucgacaccaccuucgaguccgcgcgccccacccagacgcacauggcccuggugcagcucgagcgggucggccugcugcgcuuccucgugagccagaacguggacgggcugcacguccgguccggcuucccccgcgacaagcuggccgagcuccacgggaacauguucguggaggagugcgccaagugcaagacccaguacgugcgggacaccgucgugggcaccaugggccugaaggcgacggggcgccugugcaccguggccaaggcccggggccuccgcgccugccggaacgccgaccugagcaucacccuggggaccucccuccagauccgcccgagcggcaaccugccccuggcgacgaagcggcgcggcgggcggcucgucaucgugaaccugcagcccaccaagcacgaccgccacgccgaccugcggauccacggcuacguggacgaggucaugacccgccucaugaagcaccuggggcuggagauccccgccugggacggcccgcgggugcucgagcgcgcccugccgccccugccccgcccgcccacccccaagcucgagcccaaggaggagucccccacgcggaucaacgggagcauccccgccggccccaagcaggagcccugcgcgcagcacaacggcuccgagccggccagccccaagcgcgagcggcccaccucccccgccccgcaccgcccgcccaagcgggugaaggccaaggccguccccagcuga

SEQ ID NO: 36413 - RNA, 1203 nt, Artificial Sequence
  derived and/or modified sequence opt1 from SIRT7__Homo_sapiens__NP_057622
auggccgccggcgggcugagccgcuccgagcggaaggccgccgagcgcgugcggcgccuccgggaggagcagcagcgcgagcggcugcgccaggucagccggauccugcgcaaggccgccgccgagcgguccgcggaggagggccgccuccuggccgagagcgccgaccuggugaccgagcuccaggggcggucccgccggcgcgagggccugaagcggcgccaggaggaggugugcgacgaccccgaggagcugcgggggaagguccgcgagcucgccagcgcggugcggaacgccaaguaccugguggucuacaccggcgccggcaucuccacggccgccagcaucccggacuaccgcgggcccaacggcguguggacccugcuccagaaggggcgcuccgugagcgcggccgaccuguccgaggccgagcccacccugacccacaugagcaucacgcggcuccacgagcagaagcugguccagcacguggugucccagaacugcgacggccugcaccuccgcagcgggcugccccggaccgccaucuccgagcugcacggcaacauguacaucgaggucugcaccagcugcgugccgaaccgcgaguacgugcgggucuucgacgugaccgagcgcacggcccuccaccggcaccagaccggccggaccugccacaagugcgggacccagcugcgcgacacgaucgugcacuucggcgagcgcgggacccugggccagccccucaacugggaggcggccaccgaggccgccucccgggccgacaccauccugugccugggcagcucccucaagguccugaagaaguacccccgccuguggugcaugacgaagcccccgagccggcgccccaagcucuacaucgugaaccugcaguggacccccaaggacgacugggcggcccugaagcuccacgggaagugcgacgacgugaugcggcugcugauggccgagcucggccuggagauccccgccuacagccgcuggcaggacccgaucuucucccuggccacgccccuccgggcgggggaggagggcagccacucccgcaagagccugugccggucccgcgaggaggccccgcccggggaccgcggcgcgccccugagcuccgcccccauccucggcgggugguucggccgggggugcaccaagcgcaccaagcggaagaaggucaccuga

SEQ ID NO: 36414 - RNA, 591 nt, Artificial Sequence
  derived and/or modified sequence opt1 from SIT1__Homo_sapiens__NP_055265
augaaccaggccgacccccgccugcgggccgugugccucuggacccugaccagcgcggccaugucccgcggcgacaacugcacggaccugcucgcccuggggaucccgagcaucacccaggccuggggccuguggguccuccugggggccgugacccugcuguuccugaucucccuggcggcccaccucagccaguggacccggggccgcucccggagccaccccgggcagggccgcuccggcgagagcguggaggaggucccccuguacgggaaccugcacuaccuccagacgggccggcugucccaggaccccgagccggaccagcaggaccccacccucgggggccccgcccgcgccgcggaggaggugaugugcuacaccagccuccagcugcggcccccgcaggggcgcauccccggccccggcacccccgugaaguacuccgaggucgugcuggacagcgagccgaagucccaggccagcgggcccgagcccgagcucuacgccuccgugugcgcccagacgcggcgcgcccgggcgagcuuccccgaccaggccuacgccaacucccagccggccgccagcuga

SEQ ID NO: 36415 - RNA, 528 nt, Artificial Sequence
  derived and/or modified sequence opt1 from SIVA1__Homo_sapiens__NP_006418
augcccaagcgcagcugcccguucgccgacguggcgccccugcagcucaagguccgggugucccagcgcgagcugagccggggcgugugcgccgagcgcuacucccaggaggucuucgagaagaccaagcggcuccuguuccugggggcccaggccuaccuggaccacgugugggacgagggcugcgccgugguccaccuccccgagagccccaagccggggcccaccggcgcgccccgcgccgcccgggggcagaugcugaucggccccgacggccgccugauccggucccucgggcaggccagcgaggccgacccguccggcguggcgagcaucgccugcuccagcugcgugcgcgccgucgacgggaaggccgugugcggccagugcgagcgggcccugugcgggcagugcgugcgcacgugcuggggcugcggcuccgucgcgugcacccugugcgggcucguggacugcagcgacauguacgagaaggugcugugcaccuccugcgccauguucgagaccuga

SEQ ID NO: 36416 - RNA, 855 nt, Artificial Sequence
  derived and/or modified sequence opt1 from SIX1__Homo_sapiens__NP_005973
augagcaugcugcccuccuucggcuucacccaggagcaggucgccugcgugugcgaggugcuccagcagggcgggaaccuggagcgccuggggcgguuccucuggagccugccggccugcgaccaccuccacaagaacgaguccgugcugaaggcgaaggccgucguggccuuccaccgcggcaacuuccgggagcuguacaagauccuggagagccaccaguucagcccccacaaccaccccaagcuccagcagcuguggcugaaggcccacuacguggaggccgagaagcuccgcgggcggccccugggcgcggucggcaaguaccgcgugcggcgcaaguucccgcugccccggaccaucugggacggggaggagacguccuacugcuucaaggagaagucccgcggcgugcuccgggagugguacgcccacaaccccuaccccagcccgcgcgagaagcgggagcuggccgaggccaccgggcugaccaccacgcaggucuccaacugguucaagaaccgccggcagcgcgaccgggcggccgaggccaaggagcgcgagaacaccgagaacaacaacagcuccagcaacaagcagaaccagcucagcccccuggagggcgggaagccccugauguccuccagcgaggaggaguucuccccgccccagagccccgaccagaacuccgugcuccugcugcagggcaacaugggccacgcccggagcagcaacuacucccuccccgggcugaccgccagccagcccucccacggccugcagacccaccagcaccagcuccaggacagccugcuggggccgcucacguccagccugguggaccugggcuccuga

SEQ ID NO: 36417 - RNA, 876 nt, Artificial Sequence
  derived and/or modified sequence opt1 from SIX2__Homo_sapiens__NP_058628
augagcaugcugcccaccuucggcuucacccaggagcaggucgccugcgugugcgaggugcuccagcagggcgggaacaucgagcgccuggggcgguuccuguggucccucccggccugcgagcaccuccacaagaacgagagcgugcugaaggcgaaggccgucguggccuuccaccgcggcaacuuccgggagcuguacaagauccuggagucccaccaguucagcccccacaaccacgccaagcugcagcagcucuggcugaaggcccacuacaucgaggcggagaagcugcgcgggcggccccucggcgccgugggcaaguaccgcguccggcgcaaguucccccugccgcgguccaucugggacggggaggagacgagcuacugcuucaaggagaagucccgcagcgugcugcgggagugguacgcccacaaccccuaccccagcccccgcgagaagcgggagcucgccgaggcgaccggccugaccaccacccagguguccaacugguucaagaaccgccggcagcgcgaccgggccgccgaggccaaggagcgcgagaacaacgagaacuccaacagcaacucccacaacccgcugaacgggagcggcaaguccguccucgggagcuccgaggacgagaagacgcccagcggcacccccgaccacuccagcagcucccccgcccugcugcucagcccgcccccgcccggccugcccucccugcacagccucgggcacccgcccggccccuccgcggugcccgugcccguccccgggggcggcggggccgacccccugcagcaccaccacggccugcaggacagcauccucaacccgauguccgccaaccugguggaccuggggagcuga

SEQ ID NO: 36418 - RNA, 999 nt, Artificial Sequence
  derived and/or modified sequence opt1 from SIX3__Homo_sapiens__NP_005404
augguguuccgcagcccccuggaccucuacuccagccacuuccugcugccgaacuucgccgacucccaccaccggagcauccuccuggccuccagcggcgggggcaacggggcgggcgggggcggcggggccggcgggggcuccgggggcggcaacggggccggcgggggcggcgccgggggcgccgggggcgggggcggcgggggcagccgcgcgccgcccgaggagcuguccauguuccagcuccccacccugaacuucagccccgagcaggucgccuccgugugcgagacccuggaggagacgggggacaucgagcggcucggccgcuuccuguggagccugcccguggcccccggggccugcgaggcgaucaacaagcacgaguccauccuccgggcccgcgccgucguggccuuccacaccggcaacuuccgggaccuguaccacauccuggagaaccacaaguucaccaaggagagccacggcaagcuccaggccauguggcuggaggcgcacuaccaggaggccgagaagcugcgcgggcggccccucggcccgguggacaaguaccgcguccggaagaaguucccccugccccgcaccaucugggacggggagcagaagacgcacugcuucaaggagcggacccgcucccugcuccgggagugguaccugcaggaccccuacccgaaccccagcaagaagcgcgagcuggcccaggccaccggccucacccccacccagguggggaacugguucaagaaccggcgccagcgggaccgcgccgcggccgccaagaaccggcugcagcaccaggccaucggccccuccggcaugcgcagccuggccgagccggggugccccacgcacggcuccgcggagagccccagcaccgccgccucccccaccacgagcguguccagccucaccgagcgcgccgacaccgggaccuccauccugagcgucacguccagcgacuccgagugcgacguguga

SEQ ID NO: 36419 - RNA, 2346 nt, Artificial Sequence
  derived and/or modified sequence opt1 from SIX4__Homo_sapiens__NP_059116
augagcuccagcucccccaccggccagaucgccagcgccgcggacaucaagcaggagaacgggauggaguccgccagcgagggccaggaggcccaccgcgagguggccgggggcgccgcggucgggcuguccccgcccgcccccgcccccuucccgcucgagcccggcgacgccgcgaccgccgccgcccgggugagcggcgaggagggggccguggcggccgccgccgccggcgcggccgccgaccagguccagcugcacuccgagcugcucgggcgccaccaccacgccgccgcggccgccgcccagacgccccuggccuucagccccgaccacguggcgugcgugugcgaggcccugcagcagggcgggaaccucgaccggcuggcccgcuuccuguggucccucccgcagagcgaccugcugcggggcaacgagucccuccugaaggcccgcgcgcuggucgccuuccaccagggcaucuaccccgagcucuacagcauccuggagucccacagcuucgaguccgccaaccacccccugcuccagcagcugugguacaaggcccgguacaccgaggccgagcgcgcgcgggggcgcccccugggcgccguggacaaguaccggcuccgccggaaguucccgcugccccgcaccaucugggacggggaggagaccguguacugcuucaaggagaagucccggaacgcccugaaggagcucuacaagcagaaccgcuaccccagccccgccgagaagcggcaccuggccaagaucacgggccugagccucacccaggucagcaacugguucaagaaccgccggcagcgcgaccggaacccguccgagacccagagcaaguccgagagcgacggcaaccccuccaccgaggacgagagcuccaaggggcacgaggaccugagcccccacccccuguccagcuccagcgacggcaucacgaaccucucccugagcucccacauggagccgguguacaugcagcagaucgggaacgcgaagaucagccuguccagcuccggcgugcuccugaacgggagccugguccccgccagcaccucccccguguuccucaacggcaacagcuucauccagggccccuccggggugauccugaacggccugaacgucgggaacacccaggccguggcccucaacccgcccaagaugagcuccaacaucgugagcaacggcaucuccaugaccgacauccuggggagcacgucccaggacgucaaggaguucaaggugcugcagagcuccgccaacagcgcgaccaccaccuccuacagccccuccgugcccgucagcuucccgggccucauccccuccacggaggugaagcgcgagggcauccagaccguggccagccaggacgggggcagcgucgugaccuucaccacgcccguccagaucaaccaguacgggaucgugcagaucccgaacuccggcgccaacagccaguuccugaacggguccaucggcuucagcccccugcagcucccgcccguguccgucgccgcgagccagggcaacaucuccgugagcuccagcaccuccgacgggagcaccuucaccuccgagagcacgaccgugcagcagggcaaggucuuccuguccagccuggcccccuccgccgugguguacaccguccccaacaccgggcagacgaucggcagcgugaagcaggagggccucgagcgcucccugguguucagccagcugaugcccgucaaccagaacgcccaggugaacgccaaccugagcuccgagaacaucagcggguccggccuccacccccuggcgagcucccuggugaacgucagcccgacccacaacuucucccucagccccuccacccugcugaaccccaccgagcucaaccgggacaucgccgacagccagcccauguccgccccgguggccagcaaguccacggugaccagcgucuccaacaccaacuacgccacccugcagaacugcagccugaucacggggcaggaccuccuguccgugcccaugacccaggcggcccugggcgagaucgugcccaccgccgaggaccaggucgggcaccccagcccggccgugcaccaggacuucgugcaggagcaccgccucguccugcaguccguggccaacaugaaggagaacuuccugagcaacagcgaguccaaggcgaccagcucccucaugaugcuggacagcaaguccaaguacgugcuggacggcauggucgacaccgugugcgaggaccucgagacggacaagaaggagcuggccaagcugcagaccgugcagcucgacgaggacaugcaggaccuguga

SEQ ID NO: 36420 - RNA, 2220 nt, Artificial Sequence
  derived and/or modified sequence opt1 from SIX5__Homo_sapiens__NP_787071
auggccacccugcccgccgagccgagcgcgggccccgccgccgggggcgaggccguggccgcggccgccgccaccgaggaggaggaggaggaggcgcgccagcuccugcagacgcugcaggccgccgagggggaggccgccgcggccgccggcgccggggccggcgcggccgccgccggcgccgaggggcccggcucccccggggucccgggcagcccccccgaggcggccuccgagcccccgaccgggcuccgguucagccccgagcagguggccugcgugugcgaggcccugcugcaggccggccacgcgggccgccucucccgguuccugggggcccugccccccgccgagcgccuccggggcagcgacccgguccugcgcgcccgggcgcugguggccuuccagcgcggggaguacgccgagcucuaccggcugcuggagucccgccccuuccccgccgcccaccacgcguuccuccaggaccuguaccugcgggcccgcuaccacgaggccgagcgggcccgcggccgggcccucggcgcgguggacaaguaccgccugcggaagaaguucccccugccgaagaccaucugggacggggaggagaccgucuacugcuucaaggagcgcagccgggccgcccucaaggccugcuaccgcggcaaccgguaccccacgcccgacgagaagcgccgccuggccacccugaccgggcucucccugacccaggugagcaacugguucaagaaccggcgccagcgggaccgcacgggcgcggggggcggcgcccccugcaaguccgagagcgacgggaacccgaccaccgaggacgaguccagccggucccccgaggaccuggagcgcggcgccgcccccgugagcgcggaggccgccgcccagggguccaucuuccucgccggcaccgggcccccggcgcccugccccgccagcuccagcauccuggucaacggcagcuuccuggccgccuccggcagccccgccgugcuccugaacgggggcccggugaucaucaacgggcuggcgcucggcgaggccuccagccuggggccccugcuccugacgggcggcgggggcgcccccccgccccagcccuccccccagggggccagcgagaccaagaccucccugguccucgacccgcagaccggcgaggugcggcuggaggaggcccagagcgaggcgcccgagacgaagggcgcccagguggccgcccccgggcccgcgcugggcgaggagguccucgggccgcuggcccagguggugcccggcccccccaccgccgccaccuucccgcugccccccgggcccgucccggccguggcggccccccagguggucccccucucccccccgcccggcuaccccaccggccugagccccacguccccgcugcucaaccugccccagguggugcccaccagccaggucgugacccugccgcaggccgucgggccccugcagcuccuggccgccggccccgggucccccgugaagguggcggccgccgccggcccggccaacguccaccugaucaacagcggggugggcgugaccgcgcuccagcugcccuccgccacggcccccggcaacuuccugcucgccaaccccgucagcggguccccgaucgugaccggcguggccguccagcaggggaagaucauccugaccgcgaccuuccccacgagcaugcuggugucccaggugcucccccccgccccgggccuggcccugccccucaagcccgagaccgccaucagcguccccgaggggggccugccgguggcgcccagccccgcccugcccgaggcccacgcccucggcacccuguccgcccagcagccgccccccgcggccgccaccacgagcuccaccagccugcccuucuccccggacagccccgggcuccugcccaacuuccccgccccgccccccgagggccugaugcucuccccggccgcggugcccgucuggagcgccgggcuggagcuguccgccggcaccgaggggcuccuggaggccgagaagggccugggcacccaggccccccacacggugcuccgccugcccgacccggaccccgaggggcugcuccugggcgcgaccgccgggggcgagguggacgagggccuggaggccgaggccaagguccucacccagcugcagagcgugcccguggaggagccccuggagcucuga

SEQ ID NO: 36421 - RNA, 741 nt, Artificial Sequence
  derived and/or modified sequence opt1 from SIX6__Homo_sapiens__NP_031400
auguuccagcugcccauccucaacuucagcccgcagcaggucgccggcgugugcgagacccuggaggaguccggggacguggagcgccugggccgguuccucuggagccugcccguggcccccgcggccugcgaggcccugaacaagaacgaguccguccuccgcgcccgggccaucguggcguuccacgggggcaacuaccgcgagcuguaccacauccuggagaaccacaaguucaccaaggagagccacgccaagcuccaggcccuguggcuggaggcccacuaccaggaggcggagaagcuccgggggcgcccccugggcccgguggacaaguaccggguccgcaagaaguucccccugccccggacgaucugggacggcgagcagaagacccacugcuucaaggagcgcacccggcaccuccugcgcgagugguaccugcaggaccccuacccgaaccccuccaagaagcgggagcucgcccaggccaccgggcugacgcccacccaggugggcaacugguucaagaaccgccggcagcgcgaccgggccgccgcggccaagaaccgccugcagcagcagguccucagccagggguccggccgggcccugcgcgccgagggggacggcacccccgaggugcugggcguggccaccagcccggcggccucccucagcuccaaggccgccacgagcgccaucuccaucaccagcuccgacagcgagugcgacaucuga

SEQ ID NO: 36422 - RNA, 768 nt, Artificial Sequence
  derived and/or modified sequence opt1 from SKA1__Homo_sapiens__NP_001034624
auggccagcuccgaccuggagcagcucugcagccacgugaacgagaagaucggcaacaucaagaagacccugucccugcgcaacugcgggcaggagcccacccucaagacgguccugaacaagaucggcgacgagaucaucgugaucaacgagcugcucaacaagcuggagcuggagauccaguaccaggagcagaccaacaacagccucaaggagcugugcgagucccuggaggaggacuacaaggacaucgagcaccucaaggagaacgugccgagccaccucccccaggucaccgugacccaguccugcgugaaggggagcgaccuggaccccgaggagcccaucaaggucgaggagccggagcccgugaagaagccgcccaaggagcagcgguccaucaaggagaugcccuucaucacgugcgacgaguucaacggcgugcccagcuacaugaagucccgccugaccuacaaccagaucaacgacgucaucaaggagaucaacaaggccgugaucagcaaguacaagauccugcaccagcccaagaaguccaugaacagcgugacccggaaccuguaccaccgcuucaucgacgaggagaccaaggacacgaaggggcgguacuucaucgucgaggcggacaucaaggaguucaccacccucaaggccgacaagaaguuccacgugcugcugaacauccuccgccacugccggcgccuguccgaggugcggggcggcgggcugacccgcuacgucaucacguga

SEQ ID NO: 36423 - RNA, 228 nt, Artificial Sequence
  derived and/or modified sequence opt1 from SKA2__Homo_sapiens__NP_001094065
auggccagcgaggugggccacaaccuggagucccccgagacccccgggggcgggggcuggacccgcguggaguucccgccgcccgcccccaagggggcggccacgguguggugccucaaccggcugggcagccgcaagcugucccucaucuggaucaccuucaacaccggcuggaacaugaagucccggcugaucauccugauccagcaggucagcugccaccacuga

SEQ ID NO: 36424 - RNA, 1080 nt, Artificial Sequence
  derived and/or modified sequence opt1 from SKAP1__Homo_sapiens__NP_003717
augcaggccgccgcgcugcccgaggagauccgcuggcuccuggaggacgccgaggaguuccuggccgagggccuccggaacgagaaccugagcgccguggcccgcgaccaccgggaccacauccugcgcggguuccagcagaucaaggcgcgguacuacugggacuuccagccgcagggcggggacaucggccaggacuccagcgacgacaaccacuccgggacccucggccugagccugaccuccgacgcccccuuccucagcgacuaccaggacgagggcauggaggacaucgucaagggggcccaggagcuggacaacgugaucaagcagggcuaccuggagaagaaguccaaggaccacagcuucuucggguccgaguggcagaagcgcuggugcguggucagccggggccucuucuacuacuacgccaacgagaaguccaagcagcccaaggggacguuccugaucaagggcuacggcgugcgcauggcgccccaccuccggcgcgacagcaagaaggaguccugcuucgagcugaccagccaggaccggcgcuccuacgaguucaccgccaccagcccggccgaggcccgggacuggguggaccagaucuccuuccugcugaaggaccucagcucccugacgauccccuacgaggaggacgaggaggaggaggagaaggaggagaccuacgacgacaucgacggguucgacagccccagcugcggcucccagugccgccccaccauccugccggggagcgucggcaucaaggagcccaccgaggagaaggaggaggaggacaucuacgaggugcuccccgacgaggagcacgaccuggaggaggacgaguccggcacgcggcgcaaggggguggacuacgccagcuacuaccagggccugugggacugccacggggaccagcccgacgagcucuccuuccagcggggcgaccugauccgcauccugagcaaggaguacaacauguacggguggugggucggcgagcucaacucccuggugggcaucgugccgaaggaguaccugaccaccgcguucgaggucgaggagcgguga

SEQ ID NO: 36425 - RNA, 564 nt, Artificial Sequence
  derived and/or modified sequence opt1 from SKAP2__Homo_sapiens__NP_001290397
augaacaacacccugcgcaaggacggcaagaaggacugcugcuucgagaucagcgcccccgacaagcggaucuaccaguucaccgccgcguccccgaaggacgccgaggagugggugcagcagcucaaguucguccugcaggacauggagagcgacaucauccccgaggacuacgacgagcgcggggagcuguacgacgacguggaccacccccuccccaucuccaacccgcugacgagcucccagcccaucgacgacgagaucuacgaggagcugcccgaggaggaggaggacagcgcccccgugaaggucgaggagcagcggaagaugucccaggacagcgugcaccacaccuccggcgacaagagcaccgacuacgccaacuucuaccaggggcucugggacugcaccggcgccuucuccgacgagcugagcuucaagcgcggggacgugaucuacauccuguccaaggaguacaaccgguacggcuggugggucggcgagaugaagggggcgaucggccucgugccgaaggccuacaucauggagauguacgacaucuga

SEQ ID NO: 36426 - RNA, 1917 nt, Artificial Sequence
  derived and/or modified sequence opt1 from SKIL__Homo_sapiens__NP_001138569
auggagaaccugcagaccaacuucagccucgugcagggcuccaccaagaagcugaacgggaugggcgacgacgggagcccgcccgccaagaagaugaucacggacauccacgccaacggcaagaccaucaacaagguccccaccgugaagaaggagcaccuggacgacuacggggaggcgcccguggagaccgacggcgagcacgucaagcgcacgugcaccuccgugcccgagacccuccaccugaacccgagccugaagcacacccucgcccaguuccaccuguccagccaguccagccugggcgggcccgccgccuucuccgcccggcacagccaggaguccaugagccccacgguguuccucccccugccgagcccccagguccugcccggcccccuccugaucccgagcgacuccagcaccgagcugacccagaccgugcucgagggggaguccaucagcugcuuccaggugggcggggagaagcgccugugccugccccagguccucaacuccgugcugcgggaguucacgcugcagcagaucaacaccgugugcgacgagcucuacaucuacugcagccgcugcaccagcgaccagcugcacauccugaagguccucggcauccugcccuucaacgcgcccuccugcggccugaucacccucacggacgcccagcggcugugcaacgcccugcuccgcccgcggaccuucccccagaacgggagcgugcugcccgccaaguccagccuggcgcagcucaaggagaccggcuccgccuucgagguggagcacgagugccuggggaagugccagggccuguucgcgccccaguucuacguccagccggacgcccccugcauccagugccucgagugcugcggcauguucgcgccccagaccuucgugaugcacagccaccgcucccccgacaagcggacgugccacuggggguucgagagcgccaaguggcacugcuaccugcacgugaaccagaaguaccugggcaccccggaggagaagaagcucaagaucauccuggaggagaugaaggagaaguucuccaugcgcagcgggaagcggaaccaguccaagaccgacgcccccagcggcauggagcugcaguccugguaccccgucaucaagcaggagggggaccacgugagccagacccacuccuuccuccaccccagcuacuaccuguacaugugcgacaagguggucgccccgaacgugucccugacgagcgccgugucccagagcaaggagcucaccaagaccgaggccaacgccagcaucuccaacaacagcaccuccaagcgcaagagcgaguccgccacgugcaaccugguccgggacaucaacaaggugggcaucggccuggucgccgccgccagcagcccccuccuggugaaggacgugaucugcgaggacgacaaggggaagaucauggaggaggucaugcgcaccuaccugaagcagcaggagaagcugaaccucauccugcagaagaagcagcagcugcagauggaggugaagaugcucuccuccagcaaguccaugaaggagcugaccgaggagcagcagaaccugcagaaggagcucgagagccugcagaacgagcacgcgcagcggauggaggaguucuacguggagcagaaggaccuggagaagaagcucgagcagaucaugaagcagaagugcacgugcgacuccaaccuggagaaggacaaggaggccgaguacgccggccagcuggccgagcuccgccagcggcuggaccacgccgaggcggaccgccaggagcugcaggacgagcuccggcaggagcgcgaggcccggcagaagcuggagaugaugaucaaggagcugaagcuccagauccugaaguccuccaagaccgccaaggaguga

SEQ ID NO: 36427 - RNA, 3129 nt, Artificial Sequence
  derived and/or modified sequence opt1 from SKIV2L2__Homo_sapiens__NP_056175
auggccgacgccuucggcgacgagcuguucagcguguucgagggggacuccaccaccgcggccggcacgaagaaggacaaggagaaggacaaggggaaguggaaggggcccccggggagcgccgacaaggccggcaagcgcuucgacggcaagcuccaguccgagagcaccaacaacgggaagaacaagcgggacgucgacuucgagggcaccgacgagcccaucuucgggaagaagccccgcaucgaggaguccaucaccgaggaccugagccuggccgaccucaugccccgggugaaggugcaguccgucgagacgguggagggcugcacccacgagguggcgcugccggccgaggaggacuaccugccccucaagccccgcgucgggaaggccgccaaggaguaccccuucauccuggacgcguuccagcgggaggccauccagugcguggacaacaaccagagcgugcuggucuccgcccacaccagcgccggcaagaccgugugcgccgaguacgcgaucgcccucgcccugcgcgagaagcagcgggugaucuucacguccccgaucaaggcccugagcaaccagaaguaccgcgagauguacgaggaguuccaggacgucggccucaugaccggggacgugaccaucaaccccaccgccuccugccuggugaugacgaccgagauccugcggagcaugcucuaccgcggcuccgaggucaugcgggagguggcgugggugaucuucgacgagauccacuacaugcgcgacagcgagcggggcgucgugugggaggagaccaucauccugcugcccgacaacgugcacuacgucuuccucuccgccaccauccccaacgcccgccaguucgccgaguggaucugccaccuccacaagcagccgugccacgugaucuacacggacuaccggcccacgccccugcagcacuacaucuuccccgccggcggcgacgggcugcaccugguggucgacgagaacggcgacuuccgcgaggacaacuucaacaccgcgaugcagguccugcgggacgccggggaccucgccaagggcgaccagaaggggcgcaagggcggcaccaaggggccgagcaacguguucaagaucgugaagaugaucauggagcggaacuuccagcccgugaucaucuucuccuucagcaagaaggacugcgaggccuacgcccugcagaugaccaagcuggacuucaacaccgacgaggagaagaagauggucgaggagguguucagcaacgcgaucgacugccucuccgacgaggacaagaagcugccccagguggagcacguccugccccuccugaagcgcggcaucgggauccaccacggcgggcugcucccgauccugaaggagaccaucgagauccuguucagcgagggccucaucaaggcccuguucgccaccgagacguucgccaugggcaucaacaugcccgcgcggaccgugcuguucaccaacgcccgcaaguucgacgggaaggacuuccgcuggaucuccagcggcgaguacauccagauguccgggcgggccggccgccgggggauggacgaccgcggcaucgugauccucauggucgacgagaagaugagccccaccaucggcaagcagcugcugaagggguccgccgacccccucaacagcgccuuccaccugacguacaacauggugcugaaccuccugcggguggaggagaucaacccggaguacaugcuggagaaguccuucuaccaguuccagcacuaccgcgcgauccccggcgucguggagaaggugaagaacagcgaggagcaguacaacaagaucgucauccccaacgaggaguccguggugaucuacuacaagauccggcagcagcucgccaagcuggggaaggagaucgaggaguacauccacaagcccaaguacugccugccguuccugcagcccggccgccucgucaaggugaagaacgagggcgacgacuucggguggggcguggucgugaacuucagcaagaaguccaacgugaagcccaacagcggggagcuggacccgcuguacgucguggaggugcuccugcggugcuccaaggagagccugaagaacuccgccaccgaggccgccaagcccgcgaagcccgacgagaagggcgagaugcaggucgugcccgugcucguccaccuccugagcgccaucuccagcgugcgccuguacaucccgaaggaccugcggcccguggacaaccgccagagcguccugaaguccauccaggaggugcagaagcgguuccccgacgggaucccccuccuggacccgaucgacgacaugggcauccaggaccagggccugaagaaggugauccagaaggucgaggccuucgagcaccgcauguacagccacccccuccacaacgaccccaaccuggagaccguguacacccugugcgagaagaaggcccagaucgccaucgacaucaaguccgcgaagcgggagcucaagaaggcccgcacggugcugcagauggacgagcugaagugccggaagcgcguccuccggcgccugggguucgccaccagcuccgacgugaucgagaugaagggccgcguggccugcgagaucagcuccgcggacgagcugcuccugaccgagaugauguucaacgggcuguucaacgaccucagcgccgagcaggccaccgcccugcuguccugcuucgucuuccaggagaacagcuccgagaugcccaagcucacggagcagcuggccggcccgcugcggcagaugcaggagugcgcgaagcgcaucgccaaggugagcgccgaggccaagcucgagaucgacgaggagaccuaccuguccagcuucaagccccaccugauggacguggucuacaccugggccaccggggcgaccuucgcccacaucugcaagaugacggacguguucgagggcuccaucauccggugcaugcgccggcucgaggagcugcugcgccagaugugccaggccgccaaggccaucggcaacaccgagcucgagaacaaguucgcggaggggaucaccaagaucaagcgggacaucguguucgccgccagccuguaccuguga

SEQ ID NO: 36428 - RNA, 3741 nt, Artificial Sequence
  derived and/or modified sequence opt1 from SKIV2L__Homo_sapiens__NP_008860
augauggagaccgagcgccuggugcugcccccgcccgacccccuggaccugccccuccgggccgucgagcugggcugcaccgggcacugggagcugcucaaccugccgggcgcccccgagagcucccugccccacgggcugcccccgugcgcgcccgaccugcagcaggaggccgagcagcuguuccucagcucccccgccuggcugccccugcacggcguggagcacagcgcccgcaaguggcagcggaagacggacccguggucccuccuggccgugcugggggcgcccguccccagcgaccuccaggcccagcgccaccccaccaccggccagauccugggcuacaaggaggugcugcucgagaacaccaaccuguccgccacgaccagccugucccuccggcgcccgcccgggcccgccagccagucccuguggggcaaccccacccaguacccguucuggcccgggggcauggacgagcccaccaucacggaccugaacacccgggaggaggcggaggaggagaucgacuucgagaaggaccuccugaccaucccgcccggguucaagaagggcauggacuucgcccccaaggacugccccacccccgccccgggccugcucagccuguccugcaugcuggagccccucgaccucgggggcggggacgaggacgagaacgaggccgugggccagcccggcgggccgcgcggcgacacggucagcgccucccccugcagcgcgccccuggcccgggccuccagccucgaggaccuggugcugaaggaggccuccaccgccgugagcacccccgaggcgccggagccgcccagccaggagcagugggccauccccgucgacgccaccucccccgugggggacuucuaccgccucaucccccagcccgccuuccagugggccuucgagcccgacguguuccagaagcaggcgauccugcaccuggagcggcacgacagcgucuucguggccgcccacacguccgccggcaagaccguggucgccgaguacgcgaucgcccucgcccagaagcacaugacccgcaccaucuacacgagcccgaucaaggcccuguccaaccagaaguuccgggacuuccgcaacaccuucggggacgugggccugcucaccggcgacgugcagcugcaccccgaggcgagcugccugaucaugaccacggagauccuccgguccaugcuguacagcggguccgacgucauccgcgaccuggagugggugaucuucgacgaggugcacuacaucaacgacgucgagcggggcguggugugggaggagguccugaucaugcuccccgaccacgugagcaucauccugcuguccgccaccguccccaacgcccucgaguucgccgacuggaucgggcgccugaagcggcgccagaucuacgugaucagcaccgugacccggccggucccccuggagcacuaccucuucacgggcaacuccagcaagacccagggggagcuguuccugcuccuggacucccgcggcgccuuccacaccaagggcuacuacgcggccguggaggccaagaaggagcgcaugagcaagcacgcccagaccuucggggccaagcagcccacgcaccagggcgggcccgcgcaggaccggggcguguaccugucccuccuggccagccugcgcacccgggcccagcucccggucgugguguucaccuucucccgcgggcggugcgacgagcaggccagcggccugaccagccuggaccucacgaccuccagcgagaaguccgagauccaccuguuccugcagcgcugccucgcccggcugcgcggcagcgaccggcagcugccccagguccuccacauguccgagcugcugaaccgcgggcucggcgugcaccacagcgggauccugcccauccugaaggagaucguggagaugcuguucucccggggccuggucaaggugcuguucgcgaccgagaccuucgccaugggcgugaacaugcccgcccgcaccgucguguucgacagcaugcggaagcacgacggguccacguuccgcgaccuccugccgggcgaguacgugcagauggccgggcgggcgggccgccgggggcuggaccccaccggcaccgucauccuccugugcaagggccgcgugcccgagauggccgaccugcaccggaugaugauggggaagccgagccagcuccagucccaguuccgccugaccuacacgaugauccugaaccuccugcgcguggacgcccugcgggucgaggacaugaugaagcgcagcuucuccgaguuccccagccggaaggacuccaaggcccacgagcaggcccucgcggagcugaccaagcgccugggcgcccucgaggagcccgacaugaccgggcagcugguggaccugcccgaguacuacagcuggggcgaggagcucaccgagacgcagcacaugauccagcggcgcaucauggaguccgugaacgggcucaagagccugagcgccggccgggucgugguggucaagaaccaggagcaccacaacgcccucggcgugauccuccagguguccagcaacuccaccagccgcgucuucaccacccuggugcucugcgacaagccgcugucccaggacccccaggaccgggggcccgccacggcggaggugcccuacccggacgaccuggucggcuucaagcuguuccuccccgaggggcccugcgaccacaccguggugaagcugcagcccggcgacauggccgccaucaccaccaagguccuccgcgugaacggggagaagauccuggaggacuucagcaagcggcagcagccgaaguucaagaaggacccgccccuggccgccgugacgaccgcgguccaggagcuccugcgccuggcccaggcccaccccgccggcccgcccacccucgaccccgugaacgaccugcagcugaaggacauguccguggucgagggcgggcuccgggcgcgcaagcuggaggagcugauccagggcgcccagugcgugcacagcccccgguuccccgcccaguaccucaagcugcgcgagcggaugcagauccagaaggagauggagcgccugcgguuccuccuguccgaccagagccugcuccugcugcccgaguaccaccagcgcguggagguccuccggacccugggguacguggacgaggccggcacggugaagcuggccgggcgcgucgcgugcgccauguccagccacgagcuccugcugaccgagcucauguucgacaacgcccuguccacccugcgccccgaggagaucgccgcccuccugagcggccuggugugccagucccccggcgacgcgggggaccagcugccgaacacccucaagcagggcaucgagcgggugcgcgccgucgccaagcggaucggggaggugcaggucgccugcggccugaaccagacgguggaggaguucgugggcgagcugaacuucgggcucgucgaggugguguacgagugggcccgcggcaugcccuucagcgagcuggcggggcuguccggcacccccgaggggcucgucgugcggugcauccagcgccuggccgagaugugccggagccugcgcggcgccgcccggcucgugggcgagcccguccugggggccaagauggagaccgcggccacccugcuccgccgggacaucguguucgccgccucccuguacacgcaguga

SEQ ID NO: 36429 - RNA, 2607 nt, Artificial Sequence
  derived and/or modified sequence opt1 from SKOR1__Homo_sapiens__NP_001244953
augauccccaagagccuggugcaggccgccgagacccagcgcggccucugcgagcccgggggcaaggggcgggagggccgcuccgggggcaagggcgagacccggccccgcggggucggcacccaggaggggaagggcaccauccccgggagcccccgggagaagcgcggcgagcggggcgagggggacccggcgcugcugcccgccgaggaccucuggcgccugcccggcuccaaggaccggcugcgcagcucccuccugcccccgcccgggccgcccagcuccgacagcggcccgggcccgcccuccagccacuccgggaagaccgcccagggcccccggacccugaacugggcccgcaagcagagcgcccggacguccagcaaccucugcgcguggucccuggccauggccaccaagauggccgagauccccagcucccccuacgagcccgggcagcgcggcaugaaggacacccagcgcggggacgcgccccagcggggcagcccggagccccggauccugcagcucgcccgcgugggcaacguguaccugaaggaggaguccagccggagcgggcgccuggaggccaagaaguggauccccaccaaguuccucgagaaccuguccgucccccacguggaccugggcgggaaccagcucuggagcggcgggauggaggcccugacgacccagcugggcccgggccgggagggguccagcucccccaacagcaagcaggagcuccagcccuacuccggcagcuccgcccugaagcccaaccaggugggggagaccagccuguacggcgucccgaucgugucccucgugaucgacgggcaggagcgccugugccuggcgcagaucagcaacacccuccugaagaacuacuccuacaacgagauccacaaccgccgggucgcccugggcaucacgugcgugcagugcacccccgugcagcucgagauccugcgccgggccggcgccaugcccaucagcucccgccggugcgggaugaucaccaagcgcgaggccgagcggcugugcaagagcuuccucggcgagcacaagccgcccaagcugcccgagaacuucgcguucgacgucgugcacgagugcgccugggggucccgcggcagcuucauccccgcccgguacaacuccagccgcgccaagugcaucaagugcggcuacugcagcauguacuucuccccgaacaaguucaucuuccacagccaccggacccccgacgccaaguacacgcagcccgacgcggccaacuucaacuccuggcgccggcaccugaagcucagcgacaaguccgccaccgacgagcugagccacgccugggaggaccgcgggcugggccucgccaccggggcguccggccccgccgggccgggcggccccgggggcggggccggcgugcggagcuaccccgucauccccgugccguccaagggguucggccugcugcagaagcucccgccgccccuguucccccaccccuacggcuuccccaccgccuucgggcugugccccaagaaggacgaccccgugcucggcgcgggggagcccaagggcgggagcuacgucuccgccuuccgccccguggugaaggacacggagagcaucgccaagcuguacggcuccgcccgggaggccuacggcgcggggcccgcccgcggcccggggcccggcgccgggagcggcggcuacgucucccccgacuuccugagcgagggguccagcagcuacaacuccgccagcccggacguggacaccgccgacgagcccgagguggacgucgaguccaaccgguuccccgacgacgaggacgcgcaggaggagaccgagcccagcgccccguccgccggcgggggccccgacgccggccgccccgccuucggggaccucgcggccgaggaccuggugcgccggcccgagcgcagcccgcccuccggcgggggcggguacgagcugcgggagcccugcggcccccugggcgggccggcccccgccaaggucuucgcgcccgagcgcgacgagcacgucaagagcgccgccguggcccucggccccgccgcguccuacgugugcaccccggaggcccacgagcccgacaaggaggacaaccacagccccgccgacgaccuggagacgcggaaguccuaccccgaccagcgcagcaucucccagccgagccccgccaacaccgaccgcggggaggacggccugacccucgacgugaccgggacgcaccugguggagaaggacaucgagaaccuggcccgggaggagcuccagaagcugcugcucgagcagauggagcugcggaagaagcuggagcgcgaguuccagucccucaaggacaacuuccaggaccagaugaagcgggagcuggcguaccgcgaggagaugguccagcagcugcagaucgugcgggacacccucugcaacgagcuggaccaggagcgcaaggcccgguacgccauccagcagaagcugaaggaggcccacgacgcccuccaccacuucagcugcaagaugcugacgccccgccacugcaccggcaacugcuccuucaagcccccgcugcuccccuga

SEQ ID NO: 36430 - RNA, 891 nt, Artificial Sequence
  derived and/or modified sequence opt1 from SKOR2__Homo_sapiens__NP_001032891
auggccagcagcccccugccgggccccaacgacauccuccuggccucccccuccagcgcguuccagcccgacacccugucccagccgcgccccgggcacgccaaccucaagcccaaccaggugggccaggucauccuguacgggauccccaucgugagccuggugaucgacggccaggagcggcucugccuggcccagaucuccaacacccugcucaagaacuucagcuacaacgagauccacaaccgccgggucgcccuggggaucacgugcgugcagugcaccccggugcagcuggagauccuccgccgggccggcgcgaugcccaucuccagccgccggugcggcaugaucaccaagcgcgaggccgagcggcugugcaaguccuuccugggggagaaccgcccgcccaagcuccccgacaacuucgccuucgacgucagccacgagugcgccuggggcugccggggguccuucauccccgcgcgcuacaacagcucccgggccaagugcaucaagugcagcuacugcaacauguacuucucccccaacaaguucaucuuccacagccaccgcacccccgacgccaaguacacgcagccggacgccgccaacuucaacuccuggcggcgccaccugaagcugaccgacaagagcccccaggacgagcucguguucgcgugggaggacgugaaggccauguucaacggcgggagccggaagcgcgcccugccccagcccggcgcccacccggccugccacccccuguccagcauccggacccgcuccaucgcguucagcucccagacccucaugcugcuggaggagaucuucggcgagaaggaccaggaggacuacaugcggaucaacgaggacaacaucuggcucuga

SEQ ID NO: 36431 - RNA, 483 nt, Artificial Sequence
  derived and/or modified sequence opt1 from SKP1__Homo_sapiens__NP_008861
augcccagcaucaagcugcaguccagcgacggcgagaucuucgagguggacgucgagaucgccaagcaguccgugaccaucaagaccaugcucgaggaccuggggauggacgacgagggcgacgacgacccggugccccugcccaacgucaacgccgcgauccucaagaaggugauccaguggugcacgcaccacaaggacgacccgcccccgcccgaggacgacgagaacaaggagaagcgcaccgacgacauccccgugugggaccaggaguuccugaaggucgaccaggggacccuguucgagcucauccuggccgccaacuaccuggacaucaagggccuccuggacgugaccugcaagacgguggccaacaugaucaaggggaagacccccgaggagauccggaagaccuucaacaucaagaacgacuucaccgaggaggaggaggcccaggucggcagcacgcaguucugccuguga

SEQ ID NO: 36432 - RNA, 633 nt, Artificial Sequence
  derived and/or modified sequence opt1 from SKP2__Homo_sapiens__NP_001230049
auggaccagccccuggccgagcacuucagcacccucgccaagaacuccaaccuggugcgccugaaccucagcggcugcuccggguucagcgaguucgcgcugcagacccugcucuccagcugcucccggcuggacgagcugaaccucagcuggugcuucgacuucacggagaagcacguccagguggccguggcccacgucuccgagaccaucacccagcugaaccugagcggcuaccgcaagaaccuccagaaguccgaccugagcacccuggugcggcgcugcccgaaccucgugcaccuggaccuguccgacagcgucaugcucaagaacgacugcuuccaggaguucuuccagcugaacuaccugcagcaccucucccugagccggugcuacgacaucauccccgagacgcugcucgagcugggggagauccccacccugaagacccuccagguguucggcaucgugcccgacgggacccugcagcugcucaaggaggcccugccgcaccuccagaucaacugcucccacuucacgaccaucgcccgccccaccaucggcaacaagaagaaccaggagaucuggggcaucaagugccggcugacccugcagaagcccagcugccuguga

SEQ ID NO: 36433 - RNA, 786 nt, Artificial Sequence
  derived and/or modified sequence opt1 from SLA2__Homo_sapiens__NP_115590
augggcagccugcccucccgccgcaagagccucccgucccccagccuguccagcuccgugcaggggcagggccccgucaccauggaggccgagcggagcaaggccaccgcgguggcccugggguccuuccccgccggcgggccggccgagcucagccugcggcugggcgagccccucacgaucguguccgaggacggcgacugguggaccguccugagcgagguguccgggcgcgaguacaacauccccagcgugcacgucgccaaggugucccacggcuggcuguacgaggggcucagccgggagaaggcggaggagcugcugcuccugcccggcaaccccgggggcgccuuccugauccgcgagucccagacccggcgcggcagcuacucccucagcgugcggcugagccgccccgccuccugggaccggauccgccacuaccggauccacugccuggacaacggguggcucuacaucagcccccgccugaccuuccccucccugcaggcccucgucgaccacuacagcgagcuggcggacgacaucugcugccugcucaaggagccgugcgugcugcagcgggccggcccccugcccgggaaggacaucccccucccggugacgguccagcgcaccccgcugaacuggaaggagcuggacuccagccuccuguucuccgaggccgccaccggcgaggagagccugcucuccgagggccugcgggagagccuguccuucuacaucagccucaacgacgaggccgugucccuggacgacgcguga

SEQ ID NO: 36434 - RNA, 831 nt, Artificial Sequence
  derived and/or modified sequence opt1 from SLA__Homo_sapiens__NP_001039021
augggcaacagcaugaaguccacccccgcccccgccgagcgcccccugcccaaccccgaggggcucgacagcgacuuccuggcggugcuguccgacuacccgagccccgacaucuccccgcccaucuuccggcgcggcgagaagcuccgggucaucagcgacgagggcgggugguggaaggccaucucccugagcaccgggcgcgaguccuacauccccggcaucugcguggcccggguguaccacggcuggcuguucgaggggcucggccgcgacaaggccgaggagcugcugcagcuccccgacacgaaggucgggagcuucaugauccgggaguccgagaccaagaagggcuucuacagccuguccgugcgccaccgccaggugaagcacuaccggaucuuccggcugcccaacaacugguacuacaucagcccccgccucaccuuccagugccuggaggaccuggucaaccacuacuccgagguggccgacgggcucugcugcgugcugaccacgccgugccugacccagagcaccgcggcccccgccguccgggccuccagcucccccgugacccuccgccagaagacgguggacuggcggcgcgucagccggcugcaggaggaccccgagggcaccgagaacccgcugggcguggacgagagccucuucuccuacgggcugcgcgagagcaucgcguccuaccugagccucaccuccgaggacaacaccagcuucgaccggaagaagaaguccaucagccugauguacggcggguccaagcgcaagagcuccuucuucagcuccccgcccuacuucgaggacuga

SEQ ID NO: 36435 - RNA, 1746 nt, Artificial Sequence
  derived and/or modified sequence opt1 from SLAIN2__Homo_sapiens__NP_065897
auggaggacgugaacagcaacgucaacgccgaccaggaggugcgcaagcugcaggagcucgugaagaagcuggagaagcagaacgagcagcugcggucccgcagcggcgccguccagggggcgggcucccucgggcccggcagcccggugcgggccggggccuccauccccagcuccggcgccgccagcccccgcggcuucccccuggggcuguccgccaagagcggcgggggcccgggguccggcccccggcgcaccagcuccgaggagcuccgggacgcgaccagccugcuggccgccggcgagggcggccuccuggacgagguggagccccugcgccccgacgagcucgagcggcuguccgggugggaggaggaggaggagagcuggcuguacuccagcccgaagaagaagcucacgcccaugcagaaguccgucagcccccugguguggugccgccaggugcuggacuaccccagcccggacgucgagugcgcgaagaagucccucauccacaagcuggaccagaccaugagcgcccugaagcggcagaaccucuacaacaaccccuucaacuccaugagcuacaccucccccuacagccccaacgccuccagcccguacuccagcggcuucaacucccccagcuccacccccgugcggcccccgaucgugaagcagcugauccugcccggcaacagcgggaaccucaaguccagcgaccgcaacccgccccugagcccccaguccuccaucgacagcgagcugagcgccuccgagcucgacgaggacagcaucggcuccaacuacaagcugaacgacgucacggacgugcagauccuggcccgcaugcaggaggagagccuccggcaggaguacgcggccaccaccucccgccggagcuccgggagcuccugcaacagcacccgccggggcacguucuccgaccaggagcuggacgcccagagccuggacgacgaggacgacaacaugcaccacgccguguaccccgccgucaaccgcuucucccccagcccccggaacuccccgcgccccagccccaagcaguccccgcgcaacagcccccggagccgcucccccgcgcgggggaucgaguacagccgcgugagcccccagccgaugaucucccggcuccagcagccccgccugucccugcagggccaccccaccgaccuccagaccagcaacgugaagaacgaggagaagcugcggcgcucccugcccaaccucagccggaccuccaacacgcaggucgacagcgugaaguccagccgcuccgacagcaacuuccaggugccgaacggcgggaucccccggaugcagccccaggccuccgccauccccagcccgggcaaguuccgcucccccgccgcccccagcccccuggcgcugcggcagccggucaaggccuucuccaaccacgggagcggcagccccgggucccaggagaucacccagcucacccagaccacgagcucccccgggcccccgauggugcagagcaccguguccgccaacccgcccagcaacaucaacuccgccacccugacccgccccgccggcacgaccgcgaugcggagcgggcugccccgccccuccgcccccagcgccggcgggaucccggucccccgguccaagcucgcccagcccgugcgccggagccugcccgcgccgaagaccuacggcuccaugaaggacgacagcuggaaggacgggugcuacuga

SEQ ID NO: 36436 - RNA, 1008 nt, Artificial Sequence
  derived and/or modified sequence opt1 from SLAMF1__Homo_sapiens__NP_003028
auggaccccaagggccugcucagccugaccuucgugcuguuccucucccuggccuucggggccagcuacggcaccgggggccgcaugaugaacugcccgaagauccugcggcagcucggguccaagguccugcugccccucacguacgagcgcaucaacaagagcaugaacaaguccauccacaucguggugaccauggccaagagccuggagaacuccgucgagaacaagaucgugagccuggaccccuccgaggcggggcccccgcgguaccucggcgaccgcuacaaguucuaccuggagaaccugacccucggcauccgggagagccgcaaggaggacgagggcugguaccugaugacccuggagaagaacguguccguccagcgguucugccuccagcugcgccuguacgagcaggucagcacgcccgagaucaaggugcucaacaagacccaggagaacgggaccugcacccugauccugggcugcacgguggagaagggggaccacguggccuacuccuggagcgagaaggccggcacccacccccucaaccccgccaacuccagccaccuccugucccugacccugggcccgcagcacgcggacaacaucuacaucugcaccgugagcaaccccaucuccaacaacagccagacguucagccccuggcccgggugccggaccgacccguccgagaccaagcccugggccgucuacgccggccugcucgggggcgugaucaugauccugaucaugguggucauccugcagcuccgccggcgcggcaagaccaaccacuaccagacgaccguggagaagaagucccugaccaucuacgcccaggugcagaagcccgggccccugcagaagaagcucgacagcuucccggcgcaggaccccugcaccacgaucuacgucgccgccaccgagcccgugcccgagagcgugcaggagaccaacuccaucaccgucuacgccagcgugacgcugccggaguccuga

SEQ ID NO: 36437 - RNA, 999 nt, Artificial Sequence
  derived and/or modified sequence opt1 from SLAMF6__Homo_sapiens__NP_001171643
augcuguggcuguuccagagccuccuguucguguucugcuucggccccgggaacgucgugucccagagcucccucaccccgcugauggugaacggcauccugggggagagcgucacccucccccuggaguuccccgccggcgagaaggugaacuucaucacguggcuguucaacgagaccucccucgccuucaucgugccccacgagaccaagagcccggagauccacgucaccaaccccaagcaggggaagcgccugaacuucacgcaguccuacagccugcagcucuccaaccugaagauggaggacaccggcagcuaccgggcgcagaucuccaccaagaccagcgccaagcuguccagcuacacgcuccgcauccugcggcagcugcgcaacauccaggugaccaaccacucccagcuguuccagaacaugaccugcgagcuccaccugaccugcagcguggaggacgccgacgacaacgucuccuuccggugggaggcccucggcaacacgcugagcucccagcccaaccugaccgugagcugggacccccgcaucagcuccgagcaggacuacacgugcaucgccgagaacgcggugagcaaccucuccuucagcgucuccgcccagaagcugugcgaggacgugaagauccaguacaccgacaccaagaugauccuguucauggugagcgggaucugcaucgucuucggcuucaucauccuccugcugcucgugcugcggaagcgccgggacucccugagccucuccacccagcgcacccaggggccggccgagagcgcccggaaccuggaguacguguccgucagccccaccaacaacacgguguacgcguccgugacccacagcaaccgcgagaccgagaucuggacgccccgggagaacgacaccaucaccaucuacuccaccaucaaccacagcaaggaguccaagcccaccuucagccgcgccacggcccuggacaacgucguguga

SEQ ID NO: 36438 - RNA, 498 nt, Artificial Sequence
  derived and/or modified sequence opt1 from SLAMF7__Homo_sapiens__NP_001269517
auggccggcagcccgaccugccugacccucaucuacauccuguggcagcugacgggguccgccgcgagcggccccgugaaggagcucgucggguccgugggcggggccgugaccuucccccucaagagcaaggucaagcaggucgacuccaucguguggaccuucaacaccacgccccuggugaccauccagcccgagggcggcaccaucaucgugacccagaaccgcaaccgggagcgcguggacuuccccgacgggggcuacagccugaagcuguccaagcugaagaagaacgacagcgggaucuacuacgucggcaucuacuccagcucccuccagcagcccagcacgcaggaguacgugcugcacguguacgagaacaaccccaaggggcgguccagcaaguacggccugcuccacugcggcaacaccgagaaggacgggaaguccccgcugaccgcccacgacgcccgccacaccaaggccaucugccuguga

SEQ ID NO: 36439 - RNA, 858 nt, Artificial Sequence
  derived and/or modified sequence opt1 from SLAMF8__Homo_sapiens__NP_064510
auggugaugcgcccccuguggagccuccugcugugggaggcccuccugccgaucaccgucaccggcgcccaggugcuguccaaggucgggggcagcgugcuccugguggcggcccggccgcccggguuccaggugcgcgaggccaucuggcggucccuguggcccagcgaggagcuccuggccacguucuuccgcggcucccuggagacccucuaccacagccgguuccuggggcgcgcccagcugcacuccaaccucagccuggagcugggcccccucgaguccggcgacagcgggaacuucuccguccugaugguggacacccggggccagcccuggacccagacgcugcagcucaagguguacgacgcggucccccgccccguggugcaggucuucaucgccguggagcgggacgcccagccgagcaagaccugccagguguuccuguccugcugggcccccaacaucagcgagaucaccuacuccuggcgccgggagaccacgauggacuucgggauggagccccacagccuguucaccgacggccagguccucuccaucagccuggggcccggcgaccgcgacguggcguacuccugcaucgugagcaacccggucagcugggaccuggccaccgugacccccugggacuccugccaccacgaggccgcccccggcaaggccagcuacaaggacgugcuccuggucguggugcccgucucccugcuccugaugcuggugacccucuucagcgcguggcacuggugcccgugcuccgggaagaagaagaaggacguccacgccgaccgggugggccccgagacggagaacccccuggugcaggaccugcccuga

SEQ ID NO: 36440 - RNA, 813 nt, Artificial Sequence
  derived and/or modified sequence opt1 from SLBP__Homo_sapiens__NP_006518
auggccugccgcccccggagcccgccccgccaccagucccggugcgacggcgacgccagcccgcccucccccgcgcgcuggagccuggggcggaagcgccgggccgacggccgccgguggcgccccgaggacgccgaggaggccgagcaccgcggggccgagcggcggcccgaguccuucaccacccccgagggcccgaagccccgcagccggugcuccgacugggcgagcgccguggaggaggacgagaugcgcacgcgggucaacaaggagauggcccgcuacaagcggaagcuccugaucaacgacuucgggcgcgagcggaaguccagcuccggcagcuccgacagcaaggaguccaugagcaccgugcccgccgacuucgagaccgacgaguccgugcugaugcgccgccagaagcagaucaacuacggcaagaacaccaucgcguacgaccgguacaucaaggaggucccccgccaccuccggcagccggggauccaccccaagacgcccaacaaguucaagaaguacagccgccgguccugggaccagcagaucaagcuguggaagguggcccugcacuucugggacccgcccgccgaggagggcugcgaccuccaggagauccaccccguggaccuggagagcgccgagagcuccagcgagccccagaccuccagccaggacgacuucgacgucuacuccgggacccccaccaaggugcgccacauggacagccagguggaggacgaguucgaccuggaggccugccucacggagccgcugcgggacuucuccgcgaugagcuga

SEQ ID NO: 36441 - RNA, 1050 nt, Artificial Sequence
  derived and/or modified sequence opt1 from SLC10A1__Homo_sapiens__NP_003040
auggaggcccacaacgccagcgcgcccuucaacuucacccugccgcccaacuucggcaagcgccccaccgaccucgcccuguccgugauccuggucuucaugcuguucuucaucaugcucagccuggggugcacgauggaguucuccaagaucaaggcccaccucuggaagcccaagggccuggccaucgcccugguggcgcaguacgggaucaugccgcucaccgccuucgugcugggcaaggucuuccggcugaagaacaucgaggcccucgccauccuggugugcgggugcagccccggcggcaaccuguccaacguguucagccucgcgaugaagggggacaugaaccuguccaucgucaugacgaccugcagcaccuucugcgcccugggcaugaugccccuccugcuguacaucuacucccgcgggaucuacgacggcgaccucaaggacaaggugcccuacaaggggaucgugaucagccugguccuggugcucaucccgugcaccaucggcaucgugcugaaguccaagcggccccaguacaugcgcuacgucaucaagggcgggaugaucaucauccugcucugcagcguggccgugaccguccuguccgccaucaacgugggcaagagcaucauguucgccaugacgccccugcucaucgcgaccuccagccugaugcccuucaucggguuccugcucggcuacgugcuguccgcccuguucugccucaacggccggugccgccggaccgucagcauggagaccgggugccagaacgugcagcugugcuccaccauccugaacguggccuucccgcccgaggucaucggcccccucuucuucuucccccugcuguacaugaucuuccagcucggggagggccugcugcucaucgccaucuucuggugcuacgagaaguucaagacgccgaaggacaagaccaagaugaucuacaccgccgcgaccacggaggagaccauccccggggcccugggcaacggcaccuacaagggggaggacugcagccccugcaccgccuga

SEQ ID NO: 36442 - RNA, 1047 nt, Artificial Sequence
  derived and/or modified sequence opt1 from SLC10A2__Homo_sapiens__NP_000443
augaacgaccccaacagcugcguggacaacgccaccgucugcuccggcgccagcugcguggugccggaguccaacuucaacaacauccugagcgucgugcucuccaccgugcugacgauccugcucgcgcuggucauguucagcauggggugcaacguggagaucaagaaguuccugggccacaucaagcgccccugggggaucugcgugggcuuccucugccaguucgggaucaugccccugaccggcuucauccuguccgucgccuucgacauccucccccugcaggccguggugguccugaucaucggcugcugccccgggggcaccgccagcaacauccucgccuacuggguggacggggacauggaccuguccgugagcaugaccacgugcuccacccugcucgcgcugggcaugaugccgcugugccuccugaucuacaccaagaugugggucgacagcggguccaucgugauccccuacgacaacaucggcaccagccugguggcccucgucgugcccguguccaucggcauguucgucaaccacaaguggccgcagaaggccaagaucauccugaagaucgggagcaucgccggcgcgauccugaucgugcucaucgccguggucgggggcauccuguaccaguccgccuggaucaucgcccccaagcuguggaucaucggcacgaucuuccccguggccggguacagccucggcuuccugcuggcgcggaucgccgggcuccccugguaccgcugccggaccgucgccuucgagaccggcaugcagaacacccagcugugcuccacgaucgugcagcugagcuucaccccggaggagcucaacguggucuucaccuucccccugaucuacagcaucuuccagcuggccuucgccgcgaucuuccucggguucuacguggccuacaagaagugccacggcaagaacaaggccgagauccccgaguccaaggagaacggcaccgagcccgagagcuccuucuacaaggccaacgggggcuuccagccggacgagaaguga

SEQ ID NO: 36443 - RNA, 1134 nt, Artificial Sequence
  derived and/or modified sequence opt1 from SLC10A6__Homo_sapiens__NP_932069
augcgcgccaacugcagcuccagcuccgccugccccgcgaacagcuccgaggaggagcugccggugggccucgagguccacgggaaccuggagcugguguucaccguggucagcaccgugaugaugggccuccugauguucucccuggggugcagcguggagauccggaagcucuggucccacauccgccggcccuggggcaucgccgucgggcugcugugccaguucggccucaugcccuucacggccuaccugcuggccaucagcuucucccucaagcccgugcaggccaucgcggugcugaucaugggcugcugccccgggggcaccaucagcaacaucuucaccuucugggucgacggggacauggaccuguccaucagcaugaccacgugcuccaccguggccgcccucggcaugaugccgcugugcaucuaccuguacaccuggagcuggucccuccagcagaaccugaccauccccuaccagaacaucgggaucacgcuggugugccucaccauccccgucgccuucggcguguacgugaacuaccgcuggccgaagcagagcaagaucauccugaagaucggcgcggucgucgggggcgugcugcuccuggugguggccguggccggggucgugcuggccaagggcuccuggaacagcgacaucacccuccugaccaucagcuucaucuucccccugaucggccacgugacgggguuccuccuggcccuguucacccaccaguccuggcagcggugccgcaccaucagccucgagaccggcgcgcagaacauccagaugugcaucacgaugcugcagcuguccuucaccgccgagcaccucguccagaugcugagcuucccccuggccuacggccucuuccagcugaucgacggguuccugaucguggccgccuaccagaccuacaagcggcgccucaagaacaagcacgggaagaagaacuccggcugcaccgaggucugccacacgcgcaagagcaccuccagccgggagaccaacgcguuccuggaggugaacgaggagggcgccaucacccccgggccgcccggccccauggacugccaccgggcccuggagcccguggggcacaucacguccugcgaguga

SEQ ID NO: 36444 - RNA, 1023 nt, Artificial Sequence
  derived and/or modified sequence opt1 from SLC10A7__Homo_sapiens__NP_001025169
augcgccugcucgagcggaugcgcaaggacugguucauggugggcaucguccuggccaucgccggggcgaagcuggagcccagcaucggcgugaacgggggcccgcucaagcccgagaucaccguguccuacaucgccgucgccaccaucuucuucaacagcgggcugucccugaagacggaggagcucaccagcgcccuggugcaccugaagcuccaccuguucauccagaucuucacccuggccuucuuccccgcgaccaucuggcuguuccuccagcugcucuccaucacgcccaucaacgaguggcugcugaagggccuccagaccgugggcugcaugccgccgcccgucagcuccgccgugauccugaccaaggccgucgggggcaacgaggccgcggccaucuucaacagcgccuucggguccuuccugggcaucgugaucacgccccuccugcugcuccuguuccuggggagcuccagcuccgugcccuucaccagcaucuucucccagcuguucaugaccguggucgugccccucaucaucggccagaucgugcggcgcuacaucaaggacuggcuggagcggaagaagccgcccuucggcgccaucagcuccagcguccuccugaugaucaucuacaccaccuucugcgacacguucuccaaccccaacaucgaccuggacaaguucagccucgugcugauccuguucaucaucuucagcauccagcucuccuucaugcugcugaccuucaucuucagcacccgcaacaacuccggguucacccccgccgacacgguggcgaucaucuucugcagcacccacaagucccucacccugggcauccccaugcugaagaucgucuucgccgggcacgagcaccucagccugaucuccgugccccugcucaucuaccacccggcccagauccugcugggcagcgugcucguccccaccaucaaguccuggauggugagccggcagaagggcgugaagcugacgcgccccaccgucuga

SEQ ID NO: 36445 - RNA, 1653 nt, Artificial Sequence
  derived and/or modified sequence opt1 from SLC11A1__Homo_sapiens__NP_000569
augaccggcgacaaggggccccagcgccugagcggcuccagcuacggguccaucagcuccccgaccagccccacgucccccggcccccagcaggccccgccccgggagaccuaccucagcgagaagauccccauccccgacaccaagccggggaccuucucccugcgcaagcugugggccuucacgggccccggcuuccucaugagcaucgcguuccuggaccccgggaacaucgaguccgaccugcaggccggcgccguggccggguucaagcuccuguggguccugcucugggccaccgugcugggccugcucugccagcggcuggcggcccgccuggggguggucaccggcaaggaccucggcgaggugugccaccuguacuaccccaaggugccgcggaccguccuguggcucacgaucgagcuggccaucguggggagcgacaugcaggaggugaucggcaccgccaucgcguucaaccugcucuccgccgggcgcaucccccuguggggcggcguccugaucaccaucguggacaccuucuucuuccucuuccuggacaacuacgggcugcggaagcucgaggccuucuucggccugcugaucacgaucauggcccucaccuucggguacgaguacguggucgcccgccccgagcagggcgcgcugcugcggggccucuuccugcccagcugcccggggugcggccaccccgagcugcuccaggccguggggaucgugggcgccaucaucaugccccacaacaucuaccugcacuccgcccuggucaagagccgcgagaucgaccgggcccgccgggcggacauccgcgaggccaacauguacuuccucaucgaggccaccaucgcccuguccgugagcuucaucaucaaccuguucgugauggccgucuucgggcaggcguucuaccagaagaccaaccaggccgccuucaacaucugcgccaacuccagccuccacgacuacgccaagaucuuccccaugaacaacgcgacgguggccguggacaucuaccagggcggggucauccugggcugccuguucggcccggccgcccucuacaucugggcgaucgggcugcuggccgccggccagagcuccaccaugaccgggaccuacgccggccaguucgugauggagggguuccuccggcugcgcuggagccgguucgcccgcgugcugcugacgcgguccugcgcgauccuccccaccguccugguggccgucuuccgcgaccugcgggaccucagcggccugaacgaccugcucaacgugcugcagucccugcuccugcccuucgccgugcugcccauccucaccuucaccagcaugccgacgcugaugcaggaguucgccaacggccugcucaacaaggucgugaccuccagcaucauggugcuggucugcgccaucaaccuguacuucgugguguccuaccuccccagccugccccaccccgcguacuucgggcuggccgcccuccuggccgccgcguaccugggccucuccaccuaccuggucuggaccugcugccuggcccacggggccacguuccucgcccacagcucccaccaccacuuccuguacggccugcucgaggaggaccagaagggcgagaccagcggguga

SEQ ID NO: 36446 - RNA, 1686 nt, Artificial Sequence
  derived and/or modified sequence opt1 from SLC11A2__Homo_sapiens__NP_000608
auggugcugggccccgagcagaagaugagcgacgacuccgucagcggggaccacggcgaguccgccagccucgggaacaucaacccggccuacuccaaccccagccugucccagagccccggcgacuccgaggaguacuucgcgaccuacuucaacgagaagaucagcauccccgaggaggaguacuccugcuucagcuuccgcaagcugugggccuucaccgggccgggcuuccucauguccaucgccuaccuggaccccggcaacaucgagagcgaccugcaguccggggccguggccggcuucaagcuccuguggauccugcuccuggcgacgcugguggggcuccugcugcagcggcucgccgcccgccugggcgucgugaccgggcugcaccucgccgaggugugccaccggcaguaccccaaggucccccgcgugauccuguggcugaugguggagcucgcgaucaucggcagcgacaugcaggaggucaucggcuccgccaucgccaucaaccugcugagcguggggcggaucccgcucuggggcggggugcugaucaccaucgccgacaccuucgucuuccuguuccucgacaaguacggccugcgcaagcuggaggccuucuucggcuuccucaucacgaucauggcgcugaccuucggguacgaguacgugaccgugaagcccucccagagccagguccugaagggcauguucgugcccagcugcuccgggugccggacgccccagaucgagcaggccgugggcaucgucggggccgugaucaugccgcacaacauguaccuccacagcgcccuggugaagucccgccaggucaaccggaacaacaagcaggaggugcgcgaggccaacaaguacuucuucaucgagagcugcaucgcgcuguucguguccuucaucaucaacgucuucguggucagcguguucgccgaggccuucuucggcaagaccaacgagcaggucguggaggugugcaccaacaccuccagcccccacgccggccucuuccccaaggacaacuccacccuggccguggacaucuacaagggcggggucgugcuggggugcuacuucggccccgcggcccucuacaucugggccguggggauccuggccgccggccagagcuccacgaugaccggcaccuacagcgggcaguucgucauggagggcuuccugaaccucaaguggucccgguucgcgcgcguggugcugacccggagcaucgccaucaucccgacgcugcucgucgccguguuccaggacguggagcaccugaccgggaugaacgacuuccugaacguccuccagucccugcagcugcccuucgcccugauccccauccucaccuucaccagccugcgccccgugauguccgacuucgcgaacggccugggguggcggaucgccggcggcauccucgugcugaucaucugcagcaucaacauguacuucgucgugguguacguccgcgaccuggggcacguggcccucuacguggucgccgccgugguguccgucgcguaccugggcuucguguucuaccugggguggcagugccucaucgcccugggcaugagcuuccuggacugcggccacacggugagcaucuccaaggggcuccugaccgaggaggccacccggggcuacgucaaguga

SEQ ID NO: 36447 - RNA, 3300 nt, Artificial Sequence
  derived and/or modified sequence opt1 from SLC12A1__Homo_sapiens__NP_000329
augagccugaacaacuccagcaacguguuccucgacuccguccccagcaacaccaaccgcuuccagguguccgugaucaacgagaaccacgagagcuccgccgccgcggacgacaacaccgacccgccccacuacgaggagacgagcuucggcgacgaggcccagaagcggcugcgcaucuccuuccggcccgggaaccaggagugcuacgacaacuuccugcagagcggcgagaccgccaagaccgacgccuccuuccacgccuacgacagccacaccaacacguacuaccuccagaccuucgggcacaacaccauggacgcgguccccaagaucgaguacuaccgcaacaccggcuccaucagcgggccgaaggugaaccggcccucccugcuggagauccacgagcagcucgccaagaacguggccgucacgcccagcuccgccgaccgcguggcgaacggcgacggcauccccggggacgagcaggccgagaacaaggaggacgaccaggccggcguggucaaguucgggugggugaagggcgugcugguccggugcaugcugaacaucuggggcgugaugcuguucauccgccucagcuggaucgugggggaggccggcaucgggcugggcguccucaucauccugcuguccaccauggugaccagcaucaccgggcucagcacguccgccaucgcgaccaacggcuucgugcggggcgggggcgccuacuaccugaucagccgcucccuggggccggaguucggcgggagcaucggccucaucuucgccuucgccaacgccgucgcgguggccauguacguggucggcuucgccgagaccgugguggaccugcugaaggaguccgacagcaugauggucgaccccaccaacgacauccggaucaucggguccaucacgguggucauccuccugggcaucagcguggccgggauggagugggaggccaaggcccaggugauccugcucgucauccugcugaucgcgaucgccaacuucuucaucggcaccgugauccccuccaacaacgagaagaagucccgcggguucuucaacuaccaggccagcaucuucgccgagaacuucggcccccgguucaccaagggcgagggguucuucagcguguucgcgaucuucuucccggccgccaccggcauccucgccggggcgaacaucuccggcgaccuggaggacccccaggacgccaucccccgcgggacgaugcuggccaucuucaucaccaccgucgccuaccucggcguggccaucugcgugggcgcgugcgucgugcgggacgccaccgggaacaugaacgacacgaucaucagcggcaugaacugcaacggguccgccgccugcggccugggcuacgacuucagccgcugccggcacgagcccugccaguacgggcugaugaacaacuuccaggugauguccauggucagcggcuucgggccgcucaucaccgccggcaucuucuccgcgacccugagcagcgcccuggccucccucgugagcgcccccaagguguuccaggcccugugcaaggacaacaucuacaaggcgcugcaguucuucgccaagggguacggcaagaacaacgagccccuccgcggcuacauccugaccuuccugaucgccauggccuucauccucaucgcggagcugaacacgaucgcccccaucaucuccaacuucuuccuggccagcuacgcccucaucaacuucuccugcuuccacgccagcuacgcgaaguccccgggguggcggcccgccuacggcaucuacaacaugugggucagccuguucggggccgugcugugcugcgccgugauguucgucaucaacuggugggccgcggugaucaccuacgugaucgaguucuuccucuacgucuacgugaccugcaagaagcccgacgugaacuggggcuccagcacccaggcccuguccuacgucagcgcccuggacaacgcccuggagcucacgaccguggaggaccacgugaagaacuuccgcccccagugcaucguccugaccgggggcccgaugacccggcccgcccugcucgacaucacgcacgcguucaccaagaacuccggccugugcaucugcugcgagguguucguggggccccgcaagcugugcgucaaggagaugaacagcggcauggccaagaagcaggccuggcucaucaagaacaagaucaaggccuucuacgcggccguggccgccgacugcuuccgcgacggggugcggucccugcugcaggccagcggccucgggcgcaugaagcccaacacccuggucaucggcuacaagaagaacuggcggaaggcgccgcugaccgagaucgagaacuacgugggcaucauccacgacgccuucgacuucgagaucgggguggucaucgugcgcaucucccagggcuucgacaucagccaggugcuccagguccaggaggagcuggagcggcuggagcaggagcgccucgcccuggaggccaccaucaaggacaacgagugcgaggaggagagcgggggcauccgggggcuguucaagaaggccggcaagcucaacaucacgaagaccacccccaagaaggacggcuccaucaacaccagccaguccaugcacgugggggaguucaaccagaagcugguggaggcgagcacgcaguucaagaagaagcaggagaagggcaccaucgacgucugguggcuguucgacgacgggggccucacccugcugauccccuacauccucacccugcgcaagaaguggaaggacugcaagcugcggaucuacgugggcgggaagaucaaccgcaucgaggaggagaagaucgugauggccucccuccugagcaaguuccggaucaaguucgccgacauccacaucaucggcgacaucaacauccgcccgaacaaggaguccuggaaggucuucgaggagaugaucgagcccuaccggcugcacgagagcugcaaggaccucacgaccgccgagaagcugaagcgcgagacccccuggaagaucaccgacgccgagcuggaggcggugaaggagaaguccuaccgccaggugcggcucaacgagcugcugcaggagcacagccgggccgccaaccucaucguccugucccugcccguggcccgcaaggggagcaucuccgaccuccuguacauggccuggcuggagauccucacgaagaaccugccgcccgugcugcucguccggggcaaccacaagaacgugcugaccuucuacagcuga

SEQ ID NO: 36448 - RNA, 3591 nt, Artificial Sequence
  derived and/or modified sequence opt1 from SLC12A2__Homo_sapiens__NP_001243390
auggagccccgccccaccgcccccagcuccggcgcccccgggcuggcgggcgugggggagacccccagcgccgccgcccucgccgcggcccgggucgagcugccgggcacggccgugcccuccgugcccgaggacgccgcgcccgccagccgcgacgggggcggcguccgggacgaggggccggccgccgccggcgacgggcugggccgcccccucgggcccacccccucccagagccgguuccagguggaccugguguccgagaacgcgggccgcgccgccgccgccgcggccgccgccgccgcggccgccgccgccgcgggcgccggggccggcgccaagcagaccccggcggacggggaggccagcggcgaguccgagcccgccaagggcagcgaggaggccaaggggcgguuccgcgucaacuucguggaccccgccgcguccagcuccgccgaggacagccuguccgacgccgccggcgugggggucgacggccccaacgugagcuuccagaacgggggcgacaccgugcucuccgagggcagcucccugcacagcgggggcgggggcgggagcggccaccaccagcacuacuacuacgacacgcacaccaacaccuacuaccugcggaccuucggccacaacacgauggacgccgucccgcgcaucgaccacuaccggcacaccgcggcccagcucggggagaagcugcugcgccccucccucgccgagcugcacgacgagcuggagaaggagcccuucgaggacggcuucgccaacggggaggagagcacccccacccgggacgccguggugacguacaccgcggaguccaagggcgucgugaaguucggguggaucaagggcgugcucguccgcugcaugcugaacaucuggggcgugaugcuguucauccggcucagcuggaucguggggcaggccggcaucgggcuguccguccuggugaucaugauggccaccguggucaccacgaucaccggccucagcaccuccgccaucgcgaccaacggcuucgugcgcgggggcggggccuacuaccugaucagccggucccugggcccggaguucgggggcgccaucggccucaucuucgccuucgccaacgcggucgccguggccauguacguggucggguucgccgagacggugguggagcugcugaaggagcacagcauccucaugaucgacgagaucaacgacauccgcaucaucggcgccaucaccgucgugauccugcuggggaucuccguggcgggcauggagugggaggccaaggcccagaucguccuccuggugauccugcuccuggccaucggggacuucgugaucggcaccuucaucccccuggagagcaagaagcccaagggcuucuucggguacaaguccgagaucuucaacgagaacuucggccccgacuuccgggaggaggagaccuucuucagcgucuucgccaucuucuucccggcggccacggggauccucgccggcgccaacaucuccggggaccuggcggacccccagagcgccauccccaagggcacccugcucgccauccugaucaccacccugguguacgugggcaucgccgucuccguggggagcugcgugguccgcgacgccacgggcaacgugaacgacaccaucgugaccgagcucaccaacugcacguccgcggccugcaagcugaacuucgacuucagcagcugcgaguccagccccugcuccuacgggcugaugaacaacuuccaggucaugagcaugguguccggcuucaccccgcucaucagcgccgggaucuucuccgccacccugagcuccgcccuggcgagccucguguccgcccccaagaucuuccaggcccugugcaaggacaacaucuaccccgccuuccagauguucgccaagggcuacggcaagaacaacgagccgcugcggggguacauccugaccuuccucaucgcgcugggcuucauccugaucgccgagcucaacgucaucgcccccaucaucagcaacuucuuccuggccuccuacgcccugaucaacuucagcguguuccacgcgucccucgccaagagccccggguggcgccccgccuucaaguacuacaacauguggaucucccugcugggcgccauccucugcugcaucgugauguucgucaucaacuggugggcggcccugcugacguacgugaucgugcucggccuguacaucuacgucaccuacaagaagccggacgugaacugggggagcagcacccaggcccugaccuaccucaacgcccugcagcacuccauccgccugagcggcguggaggaccacgucaagaacuuccggccccagugccucgugaugaccggggcccccaacucccgccccgcgcugcugcaccucgugcacgacuucacgaagaacgucggccugaugaucugcgggcacgugcacaugggcccgcggcgccaggccaugaaggagaugagcaucgaccaggccaaguaccagcgguggcugaucaagaacaagaugaaggccuucuacgcccccgugcacgcggacgaccuccgcgagggcgcccaguaccugaugcaggccgccgggcugggccggaugaagcccaacacccucguccugggguucaagaaggacuggcugcaggccgacaugcgcgacguggacauguacaucaaccucuuccacgacgcguucgacauccaguacggcguggucgugauccggcugaaggaggggcuggacaucucccaccuccagggccaggaggagcugcugagcucccaggagaagucccccggcaccaaggacguggucgugagcguggaguacagcaagaaguccgaccucgacaccagcaagccgcuguccgagaagcccaucacgcacaaggagagcaaggggcccaucgucccccugaacguggccgaccagaagcuccuggaggccuccacccaguuccagaagaagcagggcaagaacaccaucgacgugugguggcuguucgacgacgggggccucacccugcugaucccguaccuccugacgaccaagaagaaguggaaggacugcaagauccgcgucuucaucgggggcaagaucaaccggaucgaccacgaccgccgggccauggcgacccugcucagcaaguuccgcaucgacuucuccgacaucauggugcugggcgacaucaacaccaagcccaagaaggagaacaucaucgccuucgaggagaucaucgagcccuaccggcugcacgaggacgacaaggagcaggacaucgccgacaagaugaaggaggacgagcccuggcgcaucacggacaacgagcucgagcuguacaagaccaagaccuaccggcagauccgccugaacgagcuccugaaggagcacagcuccaccgccaacaucaucgucaugagccugccgguggcccggaagggggcggugagcuccgcccucuacauggccuggcuggaggcccugagcaaggaccucccgcccauccugcugguccgcggcaaccaccaguccgugcucacguucuacagcuga

SEQ ID NO: 36449 - RNA, 3093 nt, Artificial Sequence
  derived and/or modified sequence opt1 from SLC12A3__Homo_sapiens__NP_000330
auggccgagcugcccaccaccgagacgccgggcgacgccacccucugcagcgggcgcuucaccaucuccacccugcugagcuccgacgagcccagcccgcccgcggccuacgacuccagccaccccucccaccucacgcacagcuccaccuucugcaugcggaccuucggcuacaacaccaucgacgugguccccacguacgagcacuacgccaacagcacccagcccggggagccccgcaaggugcggccgacccuggccgaccugcacuccuuccucaagcaggagggccgccaccuccacgcccuggcguucgacagccggcccucccacgagaugaccgacgggcucguggagggcgaggccggcacgagcuccgagaagaaccccgaggagcccguccgcuucgggugggugaagggcgugaugauccggugcaugcugaacaucuggggcgucauccuguaccuccgccugccguggaucaccgcccaggccgggaucgugcugaccuggaucaucauccuccugagcgugaccgucacguccaucaccgggcugagcaucuccgcgaucagcaccaacggcaaggucaagagcggcgggaccuacuuccucaucucccggagccugggccccgagcucgggggcuccaucggccucaucuucgccuucgccaacgccguggggguggccaugcacacggugggcuucgcggagaccgugcgcgaccugcugcaggaguacggggcccccaucgucgaccccaucaacgacauccggaucaucggcguggugagcgucaccgugcuccuggccaucucccuggccgggauggagugggagagcaaggcccaggugcuguucuuccuggucaucaugguguccuucgcgaacuaccuggugggcacccucaucccgcccagcgaggacaaggccuccaagggcuucuucagcuaccgcgccgacaucuucguccagaaccuggugcccgacuggcgggggcccgacggcacguucuucgggauguucuccaucuucuucccgagcgccaccggcauccuggccggggcgaacaucuccggcgaccucaaggaccccgccaucgccauccccaagggcacccugauggccaucuucuggaccacgaucagcuaccuggccaucuccgcgaccaucgggagcugcgucgugcgcgacgccuccggcgugcucaacgacaccgucacccccggguggggcgccugcgaggggcuggccugcagcuacggcuggaacuucacggagugcacccagcagcacuccugccacuacggccugaucaacuacuaccagaccaugagcauggugagcggguucgcgccgcucaucaccgccggcaucuucggggccacgcuguccagcgcccuggccugccucguguccgcggccaaggucuuccagugccugugcgaggaccagcuguacccccucaucggcuucuucggcaagggguacggcaagaacaaggagcccgugcggggguaccugcuggccuacgccaucgccguggcguucaucaucaucgccgagcucaacaccaucgcccccaucaucagcaacuucuuccugugcuccuacgcccugaucaacuucagcugcuuccacgccuccaucaccaacagcccgggcuggcgccccuccuuccaguacuacaacaagugggcggcccuguucggggccaucaucagcgucgugaucauguuccuccugaccuggugggccgcgcugaucgccaucggcgugguccucuuccugcugcucuacgugaucuacaagaagcccgaggugaacuggggcuccagcguccaggccggguccuacaaccuggcccugagcuacuccgugggccucaacgagguggaggaccacaucaagaacuaccggccgcagugccugguccugaccgggccgcccaacuuccgccccgcccucguggacuucgugggcacguucacccggaaccugagccugaugaucugcgggcacguccucaucggcccccacaagcagcgcaugcccgagcugcagcugaucgcgaacggccacaccaaguggcucaacaagcggaagaucaaggccuucuacuccgacgugaucgccgaggaccugcgccgcggggugcagauccugaugcaggccgccggccucgggcggaugaagcccaacauccuggucgugggcuucaagaagaacuggcagagcgcgcaccccgccaccguggaggacuacaucgggauccugcacgacgccuucgacuucaacuacggcgucugcgugaugcgcaugcgggagggccucaacgugagcaagaugaugcaggcccacaucaacccggucuucgaccccgccgaggacgggaaggaggcguccgcccgcggcgcccggcccagcguguccggggcccuggaccccaaggcgcuggugaaggaggagcaggccacgaccaucuuccagagcgagcagggcaagaagaccaucgacaucuacuggcuguucgacgacgggggccugacccugcucaucccguaccugcugggccgcaagcggcgcugguccaagugcaagauccgggucuucgucgggggccagaucaaccgcauggaccaggagcggaaggccaucaucagccuccuguccaaguuccgccugggguuccacgaggugcacauccuccccgacaucaaccagaacccccgggccgagcacacgaagcgcuucgaggacaugaucgcccccuuccggcugaacgacggcuucaaggacgaggcgaccgugaacgagaugcgccgggacugcccguggaagaucagcgacgaggagaucaccaagaaccgcgugaagucccugcgccaggugcgccucaacgagaucguccuggacuacagccgcgacgccgcccugaucgugaucacccuccccaucggccggaaggggaagugccccuccagccuguacauggccuggcuggagacgcucucccaggaccugcggcccccggugauccugauccggggcaaccaggagaacguccucaccuucuacugccaguga

SEQ ID NO: 36450 - RNA, 3240 nt, Artificial Sequence
  derived and/or modified sequence opt1 from SLC12A4__Homo_sapiens__NP_001139433
augccccacuucaccgugguccccguggacggcccccgccgcggggacuacgacaaccuggagggccucagcuggguggacuacggggagcgggccgagcuggacgacuccgacggccacgggaaccaccgggagagcucccccuuccugagcccccucgaggccucccgcggcaucgacuacuacgaccggaaccuggcgcuguucgaggaggagcucgacauccgcccgaaggucagcucccugcugggcaagcucgugagcuacaccaaccugacgcagggggccaaggagcacgaggaggccgaguccggcgaggggacccggcgccgggccgccgaggcgcccagcaugggcacccugauggggguguaccuccccugccugcagaacaucuucggcgucauccuguuccuccgccugaccuggauggugggcacggccggggugcugcaggcccuccugaucguccugaucugcugcugcugcacccuccugaccgccaucuccaugagcgcgaucgccaccaacggcguggugcccgccgggggcuccuacuucaugaucagccggucccugggcccggaguucgggggcgccgucgggcucugcuucuaccugggcacgaccuucgccgcggccauguacauccugggggccaucgagauccuccugaccuacaucgccccgcccgccgcgaucuucuaccccagcggcgcccacgacaccuccaacgccacgcugaacaacaugcgcguguacggcaccaucuuccucaccuucaugacccugguggucuucgugggggugaaguacgucaacaaguucgccagccuguuccucgccugcgugaucaucuccauccugagcaucuacgcgggcgggaucaagagcaucuucgacccgcccguguuccccgucugcaugcugggcaaccggacgcucucccgcgaccaguucgacaucugcgccaagaccgccgugguggacaacgagaccgucgccacccagcuguggagcuucuucugccacucccccaaccugacgaccgacagcugcgaccccuacuucaugcucaacaacgugaccgagauccccgggauccccggcgccgcggccggcguccugcaggagaaccugugguccgccuaccucgagaagggggacaucguggagaagcacggccugcccagcgccgacgcgccgucccugaaggagagccucccccuguacguggucgccgacaucgccaccuccuucacggugcugguggggaucuucuuccccagcgucaccggcaucauggccggguccaaccggagcggcgaccuccgcgacgcccagaaguccauccccgugggcaccauccuggcgaucaucaccacgagccugguguacuucuccagcgucgugcuguucggggccugcaucgagggcgugguccuccgggacaaguacggggacggcgugucccgcaaccugguggucggcacccuggccuggccgagccccugggugaucgugaucggguccuucuucagcacgugcggcgccgggcuccagagccugaccggcgcgccccggcugcuccaggccaucgccaaggacaacaucauccccuuccugcgcgucuucgggcacggcaaggugaacggcgagccgaccugggcccugcuccugaccgcccugaucgccgagcucgggauccugaucgcgucccuggacaugguggcccccauccucagcauguucuuccugaugugcuaccuguucgucaaccucgccugcgccgugcagacccugcugcggacccccaacuggcgcccgcgcuucaaguacuaccacugggcgcucuccuuccugggcaugagccugugccucgcccugauguucguguccagcugguacuacgcccuggucgccaugcucaucgccgggaugaucuacaaguacaucgaguaccagggcgcggagaaggaguggggcgacgggauccggggccugucccugagcgccgcccgcuacgcccuccugcggcuggaggaggggccgccccacacgaagaacuggcgcccccagcuccuggugcugcucaagcuggacgaggaccugcacgugaaguacccccggcuccugaccuucgccucccagcugaaggcgggcaaggggcucaccaucgucggcagcgugauccagggguccuuccuggagagcuacggcgaggcccaggccgccgagcagaccaucaagaacaugauggagaucgagaaggugaagggcuucugccaggucgugguggccuccaagguccgcgaggggcuggcgcaccucauccagagcugcggccucgggggcaugcggcacaacuccguggugcugggguggcccuacggcuggcgccagagcgaggacccccgggccuggaagaccuucaucgacacgguccgcugcaccaccgccgcccaccuggcgcugcuggugcccaagaacaucgccuucuacccguccaaccacgagcgguaccucgagggccacaucgacgugugguggaucguccacgacgggggcaugcugaugcugcuccccuuccugcugcgccagcacaagguguggcggaagugccgcaugcggaucuucaccguggcccagauggacgacaacagcauccagaugaagaaggaccucgccgucuuccuguaccaccuccgccuggaggccgagcacaacagcgacaucuccgcguacacguacgagcggacccugaugauggagcagcgcagccagaugcugcggcagaugcgccucaccaagaccgagcgcgagcgggaggcccagcuggugaaggaccgccacuccgcccugcggcucgagagccuguacuccgacgaggaggacgagagcgccgugggggccgacaagauccagaugacguggacccgcgacaaguacaugaccgagaccugggaccccucccacgcgcccgacaacuuccgggagcugguccacaucaagccggaccagagcaacgugcgccggaugcacacggccgugaagcucaacgaggucaucgugacccgcucccacgacgcccggcuggugcugcucaacaugcccggcccgccccgcaacagcgagggcgacgagaacuacauggaguuccuggagguccugaccgaggggcucgagcgggugcugcugguccgcggcgggggccgggaggugaucaccaucuacuccuga

SEQ ID NO: 36451 - RNA, 3420 nt, Artificial Sequence
  derived and/or modified sequence opt1 from SLC12A5__Homo_sapiens__NP_001128243
augagccgccgguucaccgugaccucccugcccccggccggccccgcccgcagccccgaccccgagucccggcgccacagcgucgcggacccgcggcaccuccccggggaggacgugaagggcgacgggaaccccaaggaguccagccccuucaucaacuccacggacaccgagaagggcaaggaguacgacgggaagaacauggcccuguucgaggaggagauggacaccagcccgaugguguccagccugcucuccggccuggccaacuacaccaaccugccccagggcagccgcgagcacgaggaggccgagaacaacgagggcgggaagaagaagcccguccaggcgccccggauggggacguucaugggcguguaccucccgugccugcagaacaucuucggggugauccuguuccuccgccugaccugggucgugggcaucgccggcaucauggaguccuucugcaugguguucaucugcugcagcugcaccaugcugaccgccaucuccaugagcgccaucgccacgaacggggucgugcccgcgggcggguccuacuacaugaucagccggucccucggccccgaguucggcggggccgugggccugugcuucuaccuggggaccaccuucgccggcgccauguacauccucgggaccaucgagauccugcuggccuaccucuuccccgcgauggccaucuucaaggccgaggacgccagcggcgaggccgcggccaugcugaacaacaugcgcgucuacggcacgugcgugcugaccugcauggccaccguggucuucgugggggugaaguacgucaacaaguucgcccucguguuccugggcugcgugauccugagcauccucgccaucuacgcgggggucaucaaguccgccuucgacccgcccaacuuccccaucugccugcugggcaaccggacccucagccgccacggguucgacgugugcgccaagcuggccugggagggcaacgagacggugaccacccggcuguggggccucuucugcuccagccgcuuccugaacgcgaccugcgacgaguacuucacgcggaacaacgucaccgagauccaggggauccccggcgccgccuccgggcugaucaaggagaaccucuggagcuccuaccugaccaagggcgugaucgucgagcgcagcgggaugaccuccgugggccuggccgacggcacgccgaucgacauggaccaccccuacguguucagcgacaugaccuccuacuucacccuccuggucgggaucuacuuccccagcgugaccggcaucauggccggguccaaccggagcggcgaccugcgcgacgcgcagaaguccauccccacgggcaccauccucgccaucgccaccaccagcgccguguacaucuccagcgucgugcuguucggggccugcaucgagggcgugguccugcgggacaaguucggggaggcggugaacggcaaccucguggucgggacgcuggccuggccgucccccugggugaucgugaucggcagcuucuucagcacgugcggcgccgggcugcagucccucaccggcgcgccccgccugcugcaggccaucagccgggacgggaucguccccuuccuccagguguucggccacgggaaggccaacggcgagccgaccugggcccugcugcugaccgccugcaucugcgagaucggcauccucaucgccucccuggacgagguggcccccauccugagcauguucuuccucaugugcuacauguucgucaaccuggcgugcgccgugcagacccugcuccgcacccccaacuggcgcccgcgguuccgcuacuaccacuggacccuguccuuccuggggaugagccucugccuggcccugauguucaucugcuccugguacuacgcccucguggcgaugcugaucgccggccugaucuacaaguacaucgaguaccgcggggccgagaaggaguggggcgacgggauccggggccucagccuguccgccgcccgguacgcgcugcuccgccuggaggagggcccgccccacaccaagaacuggcggccccagcugcucguccuggugcgcguggaccaggaccagaacgucgugcacccccagcugcucagccugacgucccagcugaaggccgggaagggccucaccaucguggggagcguccuggagggcaccuuccuggagaaccacccccaggcccagcgggccgaggaguccauccgccggcucauggaggccgagaaggugaagggguucugccagguggucaucagcuccaaccugcgcgacggcgugagccaccugauccaguccggcgggcucggcgggcugcagcacaacaccgugcuggucggcuggccccggaacuggcgccagaaggaggaccaccagacguggcggaacuucaucgagcucgugcgcgagaccaccgcgggccaccuggcccugcucgugaccaagaacgucagcauguuccccgggaacccggagcgguucagcgagggcuccaucgacgugugguggaucgugcacgacgggggcaugcugaugcugcuccccuuccugcugcgccaccacaaggucuggcggaagugcaagaugcgcaucuucacgguggcccagauggacgacaacagcauccagaugaagaaggaccucaccaccuuccuguaccaccuccgcaucaccgccgagguggaggucguggagaugcacgaguccgacaucagcgccuacacguacgagaagacccuggugauggagcagcggucccagauccugaagcagaugcaccugaccaagaacgagcgcgagcgggagauccagagcaucaccgacgagucccgcgggagcauccggcgcaagaaccccgcgaacacgcggcuccgccugaacguccccgaggagaccgccggcgacuccgaggagaagccggaggaggaggugcagcugauccacgaccagagcgcccccuccugccccagcuccagccccuccccgggcgaggagcccgagggggagggcgagaccgaccccgagaaggugcaccucaccuggacgaaggacaagagcgucgccgagaagaacaaggggcccuccccggugagcuccgagggcaucaaggacuucuucagcaugaagcccgagugggagaaccugaaccagagcaacgugcggcgcaugcacaccgcgguccggcugaacgaggugaucgucaagaagucccgcgacgccaagcucgugcugcugaacaugcccgggcccccgcggaaccgcaacggcgacgagaacuacauggaguuccucgaggugcugaccgagcaccuggaccgggucaugcucgugcgcggcgggggccgggaggugaucaccaucuacagcuga

SEQ ID NO: 36452 - RNA, 3276 nt, Artificial Sequence
  derived and/or modified sequence opt1 from SLC12A6__Homo_sapiens__NP_001035960
augagcgagauguccggcgccaccaccagccuggccacgguggcgcucgacccgcccuccgaccggaccagccacccccaggacgucaucgaggaccugucccagaacagcaucaccggggagcacucccagcugcucgacgacggccacaagaaggcccggaacgccuaccugaacaacagcaacuacgaggagggggacgaguacuucgacaagaaccuggcccucuucgaggaggagauggacacccgccccaagguguccagccugcugaaccggauggccaacuacacgaaccucacccagggcgcgaaggagcacgaggaggccgagaacaucaccgaggggaagaagaagcccaccaagacgccgcagaugggcaccuucaugggcguguaccugcccugccugcagaacaucuucggggucauccucuuccugcgccugaccuggguggugggcaccgccgggguccuccaggccuucgcgaucgugcugaucugcugcugcugcacgaugcugaccgccaucuccaugagcgccaucgccaccaacggcgugguccccgccgggggcuccuacuucaugaucagccgggcgcucggccccgaguucgggggcgccguggggcugugcuucuaccugggcaccacguucgccgccgccauguacauccucggcgcgaucgagaucuuccugguguacaucgucccgcgcgccgccaucuuccacuccgacgacgcccugaaggagagcgccgcgaugcucaacaacaugcggguguacgggaccgccuuccuggugcugaugguccucgugguguucaucggcguccgcuacgugaacaaguucgccucccuguuccuggccugcgugaucgucagcauccucgccaucuacgcgggggccaucaaguccagcuucgccccgccccacuuccccgugugcaugcugggcaaccggacccugagcucccgccacaucgacgugugcagcaagaccaaggagaucaacaacaugacgguccccuccaagcucuggggguucuucugcaacagcucccaguucuucaacgcgaccugcgacgaguacuucgugcacaacaacgucaccagcauccagggcauccccggccuggccuccgggaucaucaccgagaaccuguggagcaacuaccuccccaagggcgagaucaucgagaagcccuccgccaagagcuccgacgugcuggggagccugaaccacgaguacgugcucgucgacaucacgaccuccuucacccugcuggugggcaucuucuucccgagcgugaccgggaucauggccggcuccaaccggagcggcgaccucaaggacgcccagaaguccauccccaucgggacgauccuggccauccugaccaccagcuucgucuaccucuccaacguggugcuguucggcgcgugcaucgagggggucgugcugcgcgacaaguucggcgacgccgugaaggggaaccucgucgugggcacccugagcuggcccagccccugggugaucgucaucggcuccuucuucagcacgugcggggccggccugcagucccugaccggggccccgcggcuccugcaggccaucgcgaaggacaacaucauccccuuccugcgcguguucggccacagcaaggccaacggcgagcccaccugggcccuccugcugaccgccgccaucgcggagcucgggauccugaucgccucccuggaccucguggcccccauccugagcauguucuuccugaugugcuaccucuucgucaaccuggccugcgcgcugcagacgcuccugcggaccccgaacuggcgcccccgguuccgcuacuaccacugggcccuguccuucaugggcaugagcaucugccucgcccugauguucaucuccagcugguacuacgccaucguggccauggugaucgcggggaugaucuacaaguacaucgaguaccagggcgccgagaaggaguggggcgacgggauccggggccugucccucagcgccgcccgcuucgcccugcugcggcucgaggaggggccgccccacaccaagaacuggcgcccccagcugcugguccuccugaagcuggacgaggaccuccacgugaagcacccccgccugcugaccuucgcgucccagcucaaggccggcaaggggcugaccaucgugggcagcgucaucguggggaacuuccuggagaacuacggcgaggcccucgccgccgagcagacgaucaagcaccugauggaggcggagaaggugaagggcuucugccagcuggucguggccgccaagcuccgggaggggaucucccaccugauccagagcugcggccucgggggcaugaagcacaacaccguggucaugggguggcccaacggcuggcgccaguccgaggacgcccgggcguggaagaccuucaucggcaccgugcgcgugacgaccgccgcccaccuggcccugcuggucgccaagaacaucagcuucuucccgagcaacguggagcaguucuccgaggggaacaucgacgugugguggaucguccacgacggcgggaugcucaugcugcugcccuuccuccugaagcagcacaagguguggcggaagugcagcauccgcaucuucaccguggcgcagcuggaggacaacuccauccagaugaagaaggaccucgccaccuuccuguaccaccuccggaucgaggccgaggucgaggugguggagaugcacgacagcgacaucuccgccuacacguacgagcgcacccugaugauggagcagcggagccagaugcugcgccacaugcggcuguccaagaccgagcgcgaccgggaggcccagcucgucaaggaccgcaacagcaugcugcggcugaccuccaucggcagcgacgaggacgaggagacggagaccuaccaggagaaggugcacaugaccuggaccaaggacaaguacauggcgucccgcgggcagaaggccaagagcauggagggcuuccaggaccuccugaacaugcggcccgaccaguccaacgugcgccggaugcacacggccgucaagcugaacgaggugaucgugaacaagagccacgaggccaagcucguccugcugaacaugcccggcccgccccgcaaccccgagggggacgagaacuacauggaguuccucgaggugcugaccgagggccuggagcgcgugcuccugguccgcgggggcggcuccgaggugaucaccaucuacagcuga

SEQ ID NO: 36453 - RNA, 3252 nt, Artificial Sequence
  derived and/or modified sequence opt1 from SLC12A7__Homo_sapiens__NP_006589
augcccaccaacuucaccguggucccgguggaggcccacgccgacggcgggggcgacgagacggcggagcgcaccgaggcccccgggacccccgagggccccgagccggagcggcccagccccggggacggcaacccccgcgagaacuccccguuccugaacaacguggaggucgagcaggagagcuucuucgagggcaagaacauggcccucuucgaggaggagauggacuccaaccccauggugagcucccugcugaacaagcucgccaacuacaccaaccugagccaggggguggucgagcacgaggaggacgaggagucccggcgccgggaggccaaggcgccccgcaugggcacguucaucgggguguaccugcccugccuccagaacauccugggcgugauccuguuccuccggcugaccuggaucgucgggguggccggcgugcuggagagcuuccucaucgucgccaugugcugcacgugcaccaugcugaccgccaucuccaugagcgcgaucgccaccaacggcguggugccggccgggggcuccuacuacaugaucagccgcucccuggggcccgaguucggcggcgccgucgggcucugcuucuaccugggcaccaccuucgccggggcgauguacauccugggcacgaucgagaucuuccucaccuacaucagccccggggccgccaucuuccaggccgaggccgcgggcggcgaggccgccgccaugcugcacaacaugcggguguacgggaccugcacccuggugcucauggcccuggucguguucgugggcgucaaguacgugaacaagcuggcgcucguguuccuggccugcgucgugcuguccauccucgccaucuacgccggggucaucaagagcgccuucgacccgccggacauccccgugugccugcugggcaaccgcacgcucucccggcgcagcuucgacgcgugcgugaaggccuacgggauccacaacaacuccgccaccagcgcccuguggggccuguucugcaacggcagccagcccuccgcggccugcgacgaguacuucauccagaacaacgucaccgagauccaggggauccccggcgccgccagcgggguguuccucgagaaccugugguccaccuacgcccacgcgggcgccuucguggagaagaagggggucccgagcgugcccguggccgaggagucccgggccagcgcccugcccuacguccucacggacaucgcggccuccuucacccugcuggugggcaucuacuuccccagcgugaccggcaucauggccggguccaaccgcagcggcgaccucaaggacgcccagaaguccaucccgaccgggacgauccuggccaucgucaccaccagcuucaucuaccuguccugcaucgugcuguucggcgcgugcaucgagggcgugguccugcgggacaaguucggggaggcccugcagggcaaccucgugaucgggaugcuggccuggcccagccccugggugaucgucaucggcuccuucuucagcacgugcggggccggccugcagucccucaccggcgcgccccgccugcugcaggccaucgcccgggacgggaucgugccguuccuccagguguucggccacgggaaggccaacggcgagcccaccugggcccuccugcugaccguccucaucugcgagaccgggauccugaucgcgagccuggacuccguggcccccauccucagcauguucuuccugaugugcuaccuguucgugaaccucgccugcgccguccagacgcugcugcgcaccccgaacuggcggccccgcuucaaguucuaccacuggacccucagcuuccugggcaugucccugugccucgcccugauguucaucugcagcugguacuacgcgcuguccgccaugcucaucgccggcugcaucuacaaguacaucgaguaccgcggggccgagaaggaguggggcgacgggauccggggccugagccugaacgccgcgcgcuacgcccuccugcggguggagcacgggccgccccacaccaagaacuggcgcccccaggugcuggucaugcucaaccuggacgccgagcaggccgugaagcacccccggcugcucuccuucacgagccagcugaaggcgggcaagggccugaccaucgugggguccguccucgagggcaccuaccuggacaagcacauggaggcccagcgcgccgaggagaacauccggagccugauguccaccgagaagaccaagggguucugccagcucguggugagcuccagccugcgcgacggcaugucccaccugauccagagcgccgggcucggcggccugaagcacaacacgguccugauggccuggcccgcguccuggaagcaggaggacaaccccuucagcuggaagaacuucguggacaccgugcgggacaccaccgccgcccaccaggcccuccuggucgccaagaacguggacuccuucccccagaaccaggagcgcuucgggggcgggcacaucgacgugugguggaucguccacgacggcggcaugcugaugcuccugcccuuccugcuccggcagcacaagguguggcgcaagugccggaugcgcaucuucacgguggcgcaggucgacgacaacagcauccagaugaagaaggaccugcagauguuccuguaccaccuccggaucagcgccgagguggagguggucgagaugguggagaacgacaucuccgccuucaccuacgagcgcacccugaugauggagcagcggagccagaugcugaagcagaugcagcucuccaagaacgagcaggagcgcgaggcccagcugauccacgaccggaacaccgccagccacacggcggccgccgcccgcacccaggccccgcccacccccgacaaggugcagaugaccuggacgcgggagaagcugaucgcggagaaguaccgcucccgcgacaccagccucuccggguucaaggaccuguucagcaugaagcccgaccaguccaacguccggcgcaugcacaccgccgugaagcugaacggcgugguccucaacaagagccaggacgcccagcuggugcugcucaacaugcccgggcccccgaagaaccggcagggcgacgagaacuacauggaguuccuggagguccugaccgaggggcucaaccgcgugcugcuggugcggggcggcgggcgcgaggucaucacgaucuacuccuga

SEQ ID NO: 36454 - RNA, 2145 nt, Artificial Sequence
  derived and/or modified sequence opt1 from SLC12A8__Homo_sapiens__NP_001182412
augacccagaugagccaggugcaggagcuguuccacgaggccgcccagcaggacgcgcucgcccagccccagccgugguggaagacccagcuguucaugugggagcccguccuguucggcacgugggacgggguguucaccuccugcaugaucaacaucuucggcgugguccucuuccugcgcaccggguggcuggugggcaacaccggggugcuccugggcauguuccuggucagcuucgugauccucguggcccuggucacggugcuguccggcaucggggugggcgagcggagcuccaucgggagcggcggggucuacuccaugaucagcuccgugcucggcggccagaccgggggcaccaucgggcugcuguacguguucggccagugcgucgccggcgccauguacaucaccggguucgcggagagcaucuccgaccuccugggccuggggaacaucugggccgugcgcggcaucagcguggccguccuccuggcccugcucgggaucaaccuggcgggcgugaaguggaucauccggcugcagcuccugcugcuguuccugcuggccguguccacgcucgacuucgucgugggcagcuucacccaccuggaccccgagcacggguucaucggcuacucccccgagcugcuccagaacaacacccugccggacuacagccccggggaguccuucuucaccguguucggcgucuucuuccccgccgccacgggggugauggccggcuucaacaugggcggggaccugcgcgagcccgcggccagcaucccgcucggcucccuggccgccgucgggaucagcugguuccuguacaucguguucguguuccuccugggcgccaucugcacccgggaggcgcugcgcuacgacuuccucaucgccgagaaggucagccugaugggguuccuguuccuccugggccuguacaucuccagccucgccuccugcaugggcgggcuguacggcgcgccccggauccugcagugcaucgcccaggagaaggugauccccgcccuggccugccucgggcagggcaagggccccaacaagaccccgguggccgccaucugccugaccagccuggucacgauggccuucguguucguggggcaggucaacgugcucgcgcccaucgugaccaucaacuucaugcugaccuacgucgccguggacuacuccuacuucagccuguccaugugcagcugcucccucacccccgugcccgagccgguccugcgcgagggcgccgaggggcugcacugcagcgagcaccuccugcuggagaaggcccccuccuacggcagcgaggggcccgcgcagcgggugcucgagggcacgcugcuggaguucaccaaggacauggaccagcuccugcagcugacccgcaagcucgaguccagccagccccggcagggcgaggggaaccgcaccccggagucccagaagcgcaagagcaagaaggccacgaagcagacccugcaggacuccuuccugcucgaccucaagagcccgcccuccuuccccguggagaucagcgaccggcugcccgccgccagcugggagggccaggaguccugcuggaacaagcagaccagcaaguccgaggggacccagcccgagggcacguacggggagcagcucguccccgagcugugcaaccagagcgaguccagcggcgaggacuucuuccugaagucccggcuccaggagcaggacguguggcgccggagcaccuccuucuacacccacaugugcaaccccugggugagccugcugggcgccgucgggucccuccugaucauguucgugauccaguggguguacacccuggucaacaugggcguggcggccaucguguacuucuacaucgggcgcgccagcccgggccuccaccugggguccgccagcaacuucuccuucuuccgguggaugcgcagccugcuccugcccuccugccggagccugcgcagcccccaggagcagaucauccucgccccgucccuggcgaaggucgacauggagaugacgcagcugacccaggagaacgccgacuucgccacccgcgaccgguaccaccacagcucccucgugaaccgcgagcagcugaugccccacuacuga

SEQ ID NO: 36455 - RNA, 1896 nt, Artificial Sequence
  derived and/or modified sequence opt1 from SLC12A9__Homo_sapiens__NP_001254741
auggccagcgaguccagcccccugcucgccuaccgccugcugggcgaggaggggguggcgcucccggccaacggcgccgggggccccgggggcgccuccgcccggaagcugagcaccuuccugggcgucguggugcccaccguccucuccauguucagcaucgugguguuccugcgcaucggguucgucgugggccacgcggggcugcuccaggcccuggccaugcugcucguggccuacuucauccuggcgcugacgguccucuccgugugcgccaucgccaccaacggcgccgugcagggcgggggcgccuacuucaugaucagccggacccuggggcccgaggucggcggguccaucggccugauguucuaccucgcgaacgugugcggcugcgccgugagccugcuggggcucgucgaguccgugcuggacguguucggcgccgacgccaccgggccgagcggccugcgcguccucccccagggguacggcuggaaccugcuguacggcucccuccugcuggggcucgugggcggggugugcacgcugggcgccgggcuguacgcgcgggccagcuuccucaccuuccugcuggucuccggcagccucgccuccgugcugaucagcuucguggccgucggcccccgcgacauccggcugacgccccgcccggggcccaacggcuccagccucccgccccgguucgggcacuucaccggcuucaacagcuccacccugaaggacaaccugggggccggcuacgcggaggacuacaccaccggcgccgugaugaacuucgccagcgucuucgccguccucuucaacgggugcaccggcaucauggccggggcgaacauguccggcgagcugaaggaccccagccgcgccaucccccugggcacgaucguggccguggccuacaccuucuucguguacgugcuccuguucuuccuguccagcuucacgugcgaccggacccuccugcaggaggacuacggguucuuccgcgcgaucucccuguggccgccccugguccucaucggcaucuacgccaccgcccugagcgccuccaugagcucccugaucggggccagccggauccuccacgcgcuggcccgcgacgaccuguucggcgugauccucgcccccgccaagguggucucccgcgggggcaaccccugggccgcggugcuguacagcuggggccuggugcagcucguccugcuggccgggaagcucaacacccuggccgccguggugaccgucuucuaccugguggccuacgcggccguggaccucuccugccugagccuggagugggccuccgcccccaacuuccggcccaccuucagccucuucuccuggcacacgugccugcugggcgucgcgagcugccuccugaugauguuccugaucagcccgggggccgccggcgggucccuccugcugaugggccuccuggccgcccugcucaccgcgcggggcgggcccagcuccuggggcuacgugagccaggcccugcuguuccaccaggugcgcaaguaccuccugcggcuggacguccgcaaggaccacgugaaguucuggcggccccagcuccugcugcucguggggaacccccgcggcgcccugccgcugcuccgccuggccaaccagcugaagaagggcgggcucuacguccugggccacgugacccugggggaccucgacucccugcccagcgaccccgugcagccccaguacggcgccuggcugucccucgucgaccgggcccaggugaaggcguucguggaccugacccugagcccguccguccgccagggggcccagcaccuccugcggaucagcggccuggaguccgggacgcuccugcccuggggcuuccgcagcuga

SEQ ID NO: 36456 - RNA, 1788 nt, Artificial Sequence
  derived and/or modified sequence opt1 from SLC13A1__Homo_sapiens__NP_071889
augaaguucuucagcuacauccugguguaccgccgguuccucuucgucguguucaccgugcugguccugcucccccugccgaucgugcugcacaccaaggaggccgagugcgccuacacccucuucguggucgcgacguucuggcugaccgaggcccugccccucuccgugaccgcccugcugcccagccucaugcugcccauguucggcaucaugccguccaagaagguggccagcgccuacuucaaggacuuccaccuccuccugaucggggucaucugccuggcgacguccaucgagaaguggaaccuccacaagcgcaucgcccugaagauggugaugauggugggcgucaaccccgccuggcugacccucggguucaugagcuccaccgccuuccugagcauguggcuguccaacaccagcacggcggccauggugaugcccaucgccgaggccgugguccagcagaucaucaacgccgaggcggagguggaggccacccagaugaccuacuucaacggcuccaccaaccacgggcucgagaucgacgagagcgugaacggccacgagaucaacgagcggaaggagaagacgaagcccgucccgggcuacaacaacgacaccgggaagaucuccagcaagguggagcuggagaagaacuccggcaugcgcaccaaguaccggaccaagaaggggcacgugacgcgcaagcugaccugccucugcaucgccuacagcuccaccaucggcgggcugaccacgaucaccggcaccagcaccaaccugaucuucgccgaguacuucaacacgcgguaccccgacugccgcugccucaacuucggcuccugguucaccuucagcuuccccgccgcgcugaucauccugcuccugagcuggaucuggcugcaguggcuguuccugggguucaacuucaaggagauguucaagugcggcaagaccaagaccguccagcagaaggccugcgccgaggugaucaagcaggaguaccagaagcuggggcccauccgguaccaggagaucgugacgcucguccuguucaucaucauggcccugcucugguucucccgcgacccgggcuucgugcccggcuggagcgcccuguucuccgaguaccccggguucgcgaccgacagcaccgucgcccugcucaucggccugcuguucuuccucauccccgccaagacccugacgaagaccaccccgaccggggagaucguggccuucgacuacagcccccugaucacguggaaggaguuccaguccuucaugcccugggacaucgccauccuggugggcgggggcuucgcgcucgccgacggcugcgaggaguccgggcugagcaaguggaucggcaacaagcugagcccccucgggucccugccggccuggcugaucauccucaucuccagccugauggucaccucccugaccgagguggccagcaaccccgcgaccaucacccucuuccugcccauccugagcccccucgccgaggccauccacgugaacccgcuguacauccugauccccuccacgcucugcaccuccuucgccuuccugcugcccgucgccaacccgcccaacgcgaucguguucagcuacggccaccucaaggugaucgacauggucaaggccgggcugggcgugaacaucgugggcgucgccguggugaugcuggggaucugcaccuggaucguccccauguucgaccucuacaccuaccccuccugggccccggccaugagcaacgagacgaugcccuga

SEQ ID NO: 36457 - RNA, 1926 nt, Artificial Sequence
  derived and/or modified sequence opt1 from SLC13A2__Homo_sapiens__NP_001139447
auggcgaccugcuggcaggcccugugggccuaccgcagcuaccucaucguguucuucguccccauccugcugcucccgcugcccauccuggugcccuccaaggaggccuacugcgccuacgccaucauccucauggcccuguucuggugcaccgaggcgcugccccucgccgugacggcccuguucccgcugauccucuuccccaugaugggcaucgucgacgccagcgagaucauccagcggcccuuccccuccagcuucgaguccccgggggagugccagagcgugggcauguccgugaccgcgagccacaaccucgggggcaccgucggggacucccgcguguucccgccccugagccacguguccacgugccaggucgccguggaguaccugaaggacagcaaccugcuguucuucggcggccuccugguggccaucgccgucgagcacuggaaccugcacaagcggaucgcccuccgcgugcugcugaucguggggguccggcccgcgccccucauccugggcuucaugcuggugaccgccuuccucuccauguggaucagcaacaccgccaccuccgccaugauggugcccaucgcccacgcgguccuggaccagcugcacagcucccaggccagcuccaacguggaggaggggagcaacaaccccaccuucgagcuccaggagcccagcccgcagaaggaggugacgaagcuggacaacggccaggcccugcccgucaccuccgccagcuccgaggggcgcgcccaccucagccagaagcaccuccaccugacccagugcaugucccugugcgugugcuacagcgcguccaucggcggcaucgccacccugacggggaccgcccccaaccuggugcuccagggccagaucaacagccuguucccccagaacgggaacgucgugaacuucgccuccugguucagcuucgccuucccgaccauggucauccugcuccugcuggcguggcucuggcugcagauccuguuccucggcuucaacuuccggaagaacuucggcaucggggagaagaugcaggagcagcagcaggccgccuacugcgugauccagaccgagcaccgccugcugggccccaugacguucgccgagaaggcgaucuccauccuguucgugauccucguccugcugugguucacccgggagcccggguucuuccucggcugggggaaccuggccuuccccaacgccaagggcgagagcaugguguccgacggcaccguggccaucuucaucgggaucaucauguucaucaucccgagcaaguuccccggccugacccaggaccccgagaaccccgggaagcucaaggccccgcugggccugcucgacuggaagacggucaaccagaagaugcccuggaacaucgugcugcugcucgggggcggcuacgcgcuggccaagggguccgagcgcagcggccuguccgaguggcucgggaacaagcugacgccccugcagagcgugccggcccccgccaucgccaucauccucucccugcuggucgcgaccuucaccgagugcaccagcaacguggccaccaccaccaucuuccuccccauccuggccagcauggcccaggccaucugccugcacccccucuacgugaugcugccgugcacgcuggcgaccucccucgccuucaugcugcccgucgccaccccgcccaacgccaucguguucagcuucggcgaccugaaggugcucgacauggcgcgggccggguuccugcugaacaucaucggcguccucaucaucgcccuggccaucaacuccuggggcaucccccuguucagccuccacuccuuccccagcugggcccaguccaacaccacggcgcagugccugcccagccuggccaacaccaccacccccuccccguga

SEQ ID NO: 36458 - RNA, 1668 nt, Artificial Sequence
  derived and/or modified sequence opt1 from SLC13A3__Homo_sapiens__NP_001011554
auggccguguacuggugcaccgaggcccugccccucagcgucaccgcgcugcugccgaucgugcuguuccccuucaugggcauccugcccuccaacaaggugugcccccaguacuuccuggacacgaacuuccucuuccugagcgggcugaucauggccuccgccaucgaggaguggaaccuccaccgccggaucgcccugaagauccugaugcucgucggcgugcagccggcccgccugauccuggggaugauggugaccaccagcuuccucuccauguggcugagcaacaccgcguccacggccaugaugcugcccaucgccaacgccauccucaagagccuguucggccagaaggagguccggaaggaccccucccaggagagcgaggagaacaccgcggccgugcgccggaacgggcugcacaccgugcccaccgagaugcaguuccucgccuccacggaggccaaggaccacccgggcgagaccgaggucccccuggaccugcccgccgacagccgcaaggaggacgaguaccggcgcaacaucuggaagggcuuccucaucuccauccccuacagcgcguccaucgggggcaccgccacccugacggggaccgccccgaaccugauccuccugggccagcucaagagcuucuucccccagugcgacguggugaacuucggguccugguucaucuucgccuucccccucaugcugcuguuccuccuggccggcuggcuguggaucagcuuccucuacggcgggcuguccuuccggggcuggcgcaagaacaagagcgagauccggaccaacgcggaggaccgcgcccgggccgucauccgcgaggaguaccagaaccuggggcccaucaaguucgccgagcaggccguguucauccucuucugcauguucgcgauccugcuguucacccgggacccgaaguucauccccggcugggccagccucuucaaccccggcuuccuguccgacgccgugacgggggucgccaucgugaccauccuguucuucuuccccagccagcgcccgucccucaaguggugguucgacuucaaggcccccaacaccgagaccgagccccugcugacguggaagaaggcgcaggagaccgugcccuggaacaucauccuccugcugggcgggggcuucgccauggccaaggggugcgaggagagcggccuguccgucuggaucggcgggcagcuccacccgcuggagaacgugccgcccgcccuggcggugcuccugaucaccgucgugaucgccuucuucaccgaguucgccagcaacacggccaccaucaucaucuuccugcccgugcucgccgagcuggcgauccggcugcgcguccacccccucuaccugaugauccccggcaccguggggugcuccuucgccuucaugcugcccgucagcaccccgcccaacuccaucgccuucgccagcggccaccuccuggugaaggacauggugcggacggggcugcucaugaaccugaugggcguccugcuccugucccuggccaugaacaccugggcgcagaccaucuuccagcucggcaccuuccccgacugggccgacauguacagcgugaacgugacggcccugcccccgacccuggccaacgacaccuuccgcacccucuga

SEQ ID NO: 36459 - RNA, 1569 nt, Artificial Sequence
  derived and/or modified sequence opt1 from SLC13A5__Homo_sapiens__NP_001137310
auggccagcgcccuguccuacgugagcaaguucaaguccuucgucauccucuucgugacgccccugcugcuccugccgcuggugauccucaugcccgcgaaguucguccgcugcgccuacgugaucauccugauggccaucuacuggugcaccgaggugaucccccuggccgucaccagccucaugcccgugcugcuguucccccucuuccagauccuggacucccgccaggugugcguccaguacaugaaggacaccaacaugcuguuccucggcgggcugaucguggccguggcggucgagcgguggaaccugcacaagcggaucgcccuccgcacccugcugugggugggcgccaagcccgcccggcucaugcugggguucaugggcgugaccgcgcugcucagcauguggaucuccaacacggccaccaccgccaugaugguccccaucguggaggccauccugcagcagauggaggccaccagcgcggccacggaggccgggcuggagcucguggacaagggcaaggccaaggagcugcccggcucccaggucaucuucgaggggccgacccugggccagcaggaggaccaggagcgcaagcggcucugcaaggccaugacccugugcaucugcuacgcggccagcaucgggggcaccgccacgcugaccgggaccggccccaacguggugcuccugggccagaugaacgagcuguuccccgacuccaaggaccucgucaacuucgccagcugguucgccuucgcguuccccaacaugcuggugaugcuccuguucgccuggcuguggcugcaguucguguacaugcgcuucaacuucaagaaguccugggggugcggccucgagagcaagaagaacgagaaggccgcccugaagguccugcaggaggaguaccggaagcucgggccgcuguccuucgccgagaucaacgugcugaucugcuucuuccuccuggucauccugugguucagccgcgaccccggcuucaugcccggcuggcugaccguggcguggguggagggggagacgaaguacgucuccgacgccaccguggccaucuucguggccacccuccuguucaucguccccagccagaagccgaaguucaacuuccggucccagaccgaggaggagcgcaagacgcccuucuacccgcccccgcugcucgacuggaaggugacccaggagaaggugcccuggggcaucguccugcugcucgggggcggguucgcgcuggccaagggcagcgaggccagcggccuguccguguggauggggaagcagauggagccccuccacgccgugcccccggccgcgaucacccugauccugagccuccuggucgccguguucaccgagugcacguccaacguggccaccaccacccuguuccuccccaucuucgccagcauggucaagacgggcgugaucaugaacaucaucgggguguucugcgucuuccuggccgugaacaccuggggccgggcgaucuucgaccuggaccacuuccccgacugggccaacgugacccacaucgagaccuga

SEQ ID NO: 36460 - RNA, 1338 nt, Artificial Sequence
  derived and/or modified sequence opt1 from SLC14A1__Homo_sapiens__NP_001122060
augaacggccgcagccugaucgggggcgccggggacgcccggcacggccccguguggaaggacccguucgggaccaaggcgggcgacgccgcccgccggggcaucgcccgccucucccuggcccuggcggacgggagccaggagcaggagcccgaggaggagaucgccauggaggacucccccaccaugguccggguggacagccccacgauggugcgcggcgagaaccaggucuccccgugccaggggcggcgcugcuuccccaaggcccucggcuacgugaccggggacaugaaggagcuggccaaccagcugaaggacaagcccgugguccuccaguucaucgacuggauccugcggggcaucagccaggugguguucgucaacaaccccguguccggcauccugauccucguggggcugcugguccagaacccguggugggcgcucaccggcuggcuggggaccguggugagcacgcugauggcccuccugcugucccaggaccgcagccucaucgccuccggccuguacggcuacaacgccacccuggucggggugcucauggccguguucagcgacaagggcgacuacuucugguggcugcugcuccccgucugcgcgauguccaugaccugccccaucuucagcuccgcccugaacagcaugcuguccaagugggaccuccccguguucacccugccguucaacauggcccugagcauguaccucuccgccacggggcacuacaaccccuucuuccccgccaagcuggugauccccaucaccaccgcgccgaacaucagcuggagcgaccuguccgcccucgagcugcucaagagcauccccgucggcguggggcagaucuacggcugcgacaaccccuggaccggcgggaucuuccugggcgccauccugcuguccagcccccucaugugccugcacgccgccaucgggucccugcucggcaucgcggccgggcugagccuguccgccccguucgaggacaucuacuucggccucuggggcuucaacagcucccuggccugcaucgccaugggcgggauguucauggcgcugacguggcagacccaccuccuggcccuggggugcgcccuguucaccgccuaccucggcguggggauggcgaacuucauggccgaggucggccugcccgccugcaccuggcccuucugccuggccacgcuccuguuccugaucaugaccaccaagaacagcaacaucuacaagaugccccucuccaaggugaccuacccggaggagaaccggaucuucuaccugcaggccaagaagcgcauggucgagagcccccuguga

SEQ ID NO: 36461 - RNA, 2763 nt, Artificial Sequence
  derived and/or modified sequence opt1 from SLC14A2__Homo_sapiens__XP_011524518
augagcgacccccacuccagcccgcugcuccccgagccccuguccagccgcuacaagcuguacgaggccgaguucaccucccccagcuggccguccaccagccccgacacgcaccccgcccucccccugcuggagaugccggaggagaaggaccuccgguccagcaacgaggacucccacaucgugaagaucgagaagcugaacgagcgcagcaagcggaaggacgacggcgucgcgcaccgcgacuccgccgggcagcggugcaucugccugagcaaggccgugggcuaccucaccggggacaugaaggaguaccgcaucuggcugaaggacaagcaccuggcccuccaguucaucgacugggugcugcggggcaccgcccaggucauguucaucaacaacccccuguccgggcucaucaucuucaucggccugcugauccagaaccccugguggaccaucacgggcgggcucggcaccguggugagcacccugaccgcgcuggcccucgggcaggaccgcuccgccaucgccagcggccugcacggguacaacggcaugcuggucggccuccugauggcgguguucuccgagaagcuggacuacuacugguggcuccuguuccccgugacguucaccgccaugagcugcccgguccugagcuccgcccucaacagcaucuucuccaagugggaccugcccguguucacccugcccuucaacaucgccgugacccucuaccuggccgcgacggggcacuacaaccuguucuuccccaccacccucgucgagccggugagcuccgugcccaacaucaccuggacggagauggagaugccccugcugcuccaggccauccccgucggcgugggccagguguacgggugcgacaacccguggaccggcggggucuuccugguggcccuguucaucagcagcccccucaucugccugcacgccgccaucggcuccaucguggggcugcucgcggcccuguccgucgccacccccuucgagaccaucuacacgggccuguggagcuacaacugcgugcucuccugcaucgccaucgggggcauguucuacgcccugaccuggcagacccaccuccuggcgcugaucugcgcccuguucugcgccuacauggaggccgccaucagcaacaucauguccguggucggcgugcccccggggaccugggcguucugccuggccacgaucaucuuccuccugcugaccaccaacaaccccgccaucuuccggcucccccugagcaaggucaccuaccccgaggccaaccgcaucuacuaccugacggugaaguccggcgaggaggagaaggcgccgagcgggggcgggggcgagcacccgcccaccgccggccccaagguggaggagggguccgaggccguccucagcaagcaccgguccguguuccacaucgaguggagcagcauccgccggcgcuccaagguguucggcaagggggagcaccaggagcggcagaacaaggaccccuuccccuaccgcuaccggaagcccaccgucgagcugcuggaccucgacaccauggaggagagcuccgagaucaagguggagacgaacaucagcaagaccuccuggauccgcagcuccauggccgccagcggcaagcggguguccaaggcgcugagcuacaucaccggggagaugaaggagugcggcgagggccugaaggacaaguccccggucuuccaguucuucgacugggugcuccgcgggaccagccaggugauguucgucaacaacccccuguccggcauccugaucauccucgggcuguucauccagaaccccuggugggccaucagcggcugccugggcacgaucauguccacccucaccgcccugauccugagccaggacaaguccgccaucgccgcgggguuccacggcuacaacggggugcucgugggccugcugauggccgucuucagcgacaagggggacuacuacugguggcuccugcugcccgugaucaucaugagcauguccugcccgauccucagcuccgcccugggcaccaucuucagcaagugggaccugcccguguucacccuccccuucaacaucacggucacccuguaccuggccgccaccggccacuacaaccucuucuuccccaccacgcugcugcagccggcguccgccaugcccaacaucaccuggagcgagguccaggugccccuccugcugcgggccauccccguggggaucggccagguguacgggugcgacaacccguggaccggcgggaucuuccucaucgcccuguucaucuccagcccccugaucugccuccacgcggccaucggcuccaccaugggcaugcuggccgcccugacgaucgccacccccuucgacagcaucuacuucgggcucugcggcuucaacuccacccuggcgugcaucgccaucgggggcauguucuacgugaucaccuggcagacgcaccuccuggccaucgccugcgcccuguucgcggccuaccugggggccgcccucgccaacaugcugagcgucuucggccugcccccgugcaccuggcccuucugccucuccgcgcugaccuuccugcuccugaccacgaacaaccccgccaucuacaagcugccccucagcaaggugaccuacccggaggccaaccgcaucuacuaccugucccaggagcgcaaccggcgcgccagcaucaucaccaaguaccaggcguacgacguguccuga

SEQ ID NO: 36462 - RNA, 2127 nt, Artificial Sequence
  derived and/or modified sequence opt1 from SLC15A1__Homo_sapiens__NP_005064
augggcaugagcaagucccacagcuucuucggguacccccuguccaucuucuucaucguggucaacgaguucugcgagcgcuucagcuacuacggcaugcgggccauccucauccuguacuucaccaacuucaucuccugggacgacaaccugagcaccgccaucuaccacacguucguggcgcucugcuaccugaccccgauccugggggcccucaucgccgacuccuggcugggcaaguucaagaccaucgugagccuguccaucgucuacaccaucgggcaggccgugacgagcguguccagcaucaacgaccucaccgaccacaaccacgacggcacccccgacucccugcccguccacguggugcugagccucaucggccuggcccugaucgcgcucgggaccggcgggaucaagcccugcgucuccgccuucggcggggaccaguucgaggagggccaggagaagcagcgcaaccgguucuucagcaucuucuaccuggccaucaacgccggcucccugcucagcacgaucaucaccccgaugcugcgcgugcagcagugcgggauccacuccaagcaggcgugcuacccccuggccuucggcgugcccgccgcccucauggccgucgcgcugaucguguucgugcuggggagcggcauguacaagaaguucaagccccagggcaacaucauggggaaggucgccaagugcaucggcuucgccaucaagaaccgguuccgccaccggagcaaggccuucccgaagcgcgagcacuggcucgacugggccaaggagaaguacgacgagcggcugaucucccagaucaagauggugacccgcgugauguuccuguacaucccccuccccauguucugggcgcuguucgaccagcaggggagccgguggacccugcaggccacgaccauguccggcaagaucggggcccucgagauccagcccgaccagaugcagaccgucaacgccauccugaucgugaucauggugccgaucuucgacgccguccuguacccccucaucgcgaagugcggcuucaacuucaccagccugaagaagauggccgugggcauggugcuggccuccauggccuucgucguggccgcgaucguccagguggagaucgacaagacgcuccccguguuccccaaggggaacgagguccagaucaaggugcugaacaucggcaacaacaccaugaacaucagccugccgggggagauggugacccucggccccaugucccagaccaacgccuucaugacguucgacgucaacaagcugacccgcaucaacaucagcucccccgggagccccgugaccgccgugaccgacgacuucaagcagggccagcggcacacgcugcucgucugggccccgaaccacuaccagguggugaaggacggccugaaccagaagcccgagaagggggagaacggcauccgcuucgucaacaccuucaacgagcugaucaccaucaccauguccgggaagguguacgcgaacaucagcuccuacaacgccagcacguaccaguucuuccccuccggcaucaagggguucaccaucagcuccaccgagaucccgccccagugccagcccaacuucaacaccuucuaccucgaguucggcagcgccuacacguacaucgugcagcggaagaacgacuccugccccgaggucaagguguucgaggacaucagcgccaacaccgugaacauggcccugcagaucccccaguacuuccugcugaccugcggcgaggucguguucagcgugaccgggcucgaguucuccuacagccaggcgccguccaacaugaaguccguccugcaggccggcuggcugcucacgguggccguggggaacaucaucguccugaucguggccggcgccggccaguucagcaagcagugggcggaguacauccuguucgccgcccuccugcugguggucugcgugaucuucgccaucauggcccgcuucuacaccuacaucaaccccgcggagaucgaggcccaguucgacgaggacgagaagaagaaccggcucgagaaguccaaccccuacuucaugagcggggccaacagccagaagcagauguga

SEQ ID NO: 36463 - RNA, 2097 nt, Artificial Sequence
  derived and/or modified sequence opt1 from SLC15A2__Homo_sapiens__NP_001139470
augaaccccuuccagaagaacgagagcaaggagacccuguucuccccggugagcaucgaggaggucccgccccgcccgcccuccccgcccaagaagcccagccccaccaucugcggcuccaacuacccccucagcaucgccuucaucguggugaacgaguucugcgagcgguucuccuacuacgggaugaaggccguccugauccuguacuuccucuacuuccugcacuggaacgaggacacgagcaccuccaucuaccacgcguucagcucccugugcuacuucacccccauccucggcgccgccaucgccgacagcuggcuggggaaguucaaggugcugucccucaucggccugagccugaucgcccucgggaccggcggcaucaagcccugcguggcggccuucgggggcgaccaguucgaggagaagcacgccgaggagcgcacgcgguacuucuccgucuucuaccugagcaucaacgccgggucccugaucagcaccuucaucacccccaugcuccgcggcgacgugcagugcuucggggaggacugcuacgcgcuggccuucggcgugcccggccugcucauggucaucgcccuggugguguucgccaugggguccaagaucuacaacaagcccccgcccgagggcaacaucgucgcccagguguucaagugcaucugguucgcgaucagcaaccgguucaagaaccgcagcggggacauccccaagcggcagcacuggcuggacugggccgccgagaaguaccccaagcagcucaucauggacgugaaggcccugacccgcguccuguuccucuacaucccccugccgauguucugggcccugcucgaccagcagggcucccgguggacgcugcaggcgauccgcaugaaccggaaccugggcuucuucgugcuccagcccgaccagaugcagguccugaacccccugcucgugcugaucuucaucccccuguucgacuucgugaucuaccgccucgugagcaagugcgggaucaacuucuccagccugcggaagauggccgucggcaugauccuggccugccucgccuucgccguggcggccgccguggagaucaagaucaacgagauggccccggcccagcccgggccccaggaggucuuccuccaggugcugaaccuggcggacgacgaggucaaggugaccguggucggcaacgagaacaacucccugcugaucgagagcaucaaguccuuccagaagacgccccacuacagcaagcuccaccugaagaccaagucccaggacuuccacuuccaccugaaguaccacaaccucagccuguacaccgagcacuccgugcaggagaagaacugguacagccuggugauccgcgaggacgggaacuccaucagcuccaugauggucaaggacaccgagagccggaccaccaacggcaugacgaccgugcgcuucgugaacacccugcacaaggacgucaacaucucccucagcaccgacacgucccugaacgugggcgaggacuacggggugagcgccuaccggaccguccagcgcggcgaguacccggccgugcacugccggaccgaggacaagaacuucagccugaaccucgggcugcuggacuucggcgccgcguaccucuucgugaucaccaacaacacgaaccaggggcugcaggccuggaagaucgaggacauccccgccaacaagauguccaucgccuggcagcugccccaguacgcccucgucaccgcgggcgaggugauguucagcgugaccggccuggaguucuccuacagccaggccccguccagcaugaaguccguccugcaggccgccuggcuccugaccaucgccguggggaacaucaucgugcuggucguggcgcaguucagcggccucgugcagugggccgaguucauccuguucuccugccugcuccuggucaucugccugaucuucagcaucaugggguacuacuacgugcccgugaagacggaggacaugcgcggccccgccgacaagcacaucccccacauccaggggaacaugaucaagcucgagaccaagaagaccaagcuguga

SEQ ID NO: 36464 - RNA, 1734 nt, Artificial Sequence
  derived and/or modified sequence opt1 from SLC15A4__Homo_sapiens__NP_663623
auggagggcagcgggggcggggccggcgagcgcgcgccccugcucggggcccggcgcgccgccgccgccgcggccgccgccggcgcguucgccggccggcgcgccgccugcggggccgugcugcugaccgagcuccuggagcgggcggccuucuacggcaucaccuccaaccugguccucuuccugaacggggccccguucugcugggagggcgcccaggccagcgaggcgcugcuccuguucauggggcugacguaccucggcucccccuucggcggguggcuggccgacgcccgccugggccgggcccgcgccauccuccugagccuggcgcucuaccugcuggggaugcucgccuucccccugcuggccgcccccgccacccgggcggcccucugcggcuccgcccgccugcugaacugcaccgccccgggccccgacgcggccgcccggugcugcagccccgccaccuucgccgggcucgugcuggugggccugggggucgcgacggugaaggccaacaucacccccuucggcgccgaccaggugaaggaccgcgggccggaggccacccggcgcuucuucaacugguucuacugguccaucaaccucggcgccauccugagccugggcgggaucgcguacauccagcagaacgucuccuucgugaccggcuacgccauccccacggugugcgucgggcucgccuucgugguguuccugugcggccagagcgucuucaucaccaagccgcccgacggguccgccuucaccgacauguucaagauccugaccuacagcugcugcucccagaagcggagcggcgagcgccaguccaacggcgaggggaucggcguguuccagcagagcuccaagcagagccucuucgacuccugcaagaugagccacgggggccccuucacggaggagaagguggaggacgucaaggcccuggugaagaucgugcccgucuuccuggcgcucauccccuacuggaccguguacuuccagaugcagaccaccuacgugcugcagagccugcaccuccggauccccgagaucuccaacaucacgaccaccccgcacacccugcccgccgccuggcugacgauguucgacgccguccucauccugcugcucaucccccugaaggacaagcugguggaccccauccugcgccggcacgggcuccugccgagcucccugaagcgcaucgcggugggcauguucuucgucaugugcagcgccuucgccgccggcauccucgaguccaagcggcugaaccuggugaaggagaagaccaucaaccagaccaucgggaacgucguguaccacgccgcggaccucagccugugguggcaggucccccaguaccugcucaucggcaucuccgagaucuucgccagcaucgccgggcuggaguucgccuacuccgccgcgcccaagagcaugcaguccgccaucaugggccuguucuucuucuucagcggcgugggguccuucgugggcagcgggcuccuggcccugguguccaucaaggccaucggcuggaugagcucccacaccgacuucgggaacaucaacggcugcuaccucaacuacuacuucuuccugcuggccgcgauccagggcgccacgcuccugcuguuccucaucaucagcgucaaguacgaccaccaccgcgaccaccagcgcucccgggccaacggggugcccaccagccgccgggccuga

SEQ ID NO: 36465 - RNA, 1548 nt, Artificial Sequence
  derived and/or modified sequence opt1 from SLC16A10__Homo_sapiens__NP_061063
auggugcugagccaggaggagcccgacuccgcccgcggcaccagcgaggcccagccgcucgggcccgcgcccaccggcgccgcgcccccgcccgggcccggccccuccgacagcccggaggccgccgucgagaagguggagguggagcuggccgggcccgccacggccgagccccacgagcccccggagccgcccgagggcggcuggggguggcuggucaugcucgccgcgauguggugcaacggcuccguguucgggauccagaacgccugcggcgugcuguucgucagcaugcuggagaccuucggguccaaggacgacgacaagaugguguucaagaccgccugggugggcagccucuccaugggcaugaucuucuucugcugccccaucgucagcguguucaccgaccuguucgggugccggaagacggccguggucggcgccgcggugggguucgugggccugauguccagcuccuucgucagcuccaucgagccccucuaccugaccuacggcaucaucuucgccugcgggugcagcuucgccuaccagcccucccuggugauccucggccacuacuucaagaagcgccuggggcuggugaacggcaucgucaccgccgggagcuccguguucaccauccuccugccccugcuccugcgggugcugaucgacagcgucggccucuucuacacgcugcgcgugcugugcaucuucauguucgugcuguuccuggccggcuucaccuaccggccccuggcgaccagcaccaaggacaaggaguccgggggcagcggguccagccucuucucccgcaagaaguucagcccgcccaagaagaucuucaacuucgccaucuucaaggucacggccuacgccgugugggccgucggcaucccccuggcgcuguucggguacuucgugcccuacgugcaccucaugaagcacgucaacgagcgguuccaggacgagaagaacaaggagguggugcugaugugcaucggcgucaccuccggcguggggcgccuccucuucggccggaucgccgacuacgugccgggggucaagaagguguaccuccaggugcugagcuucuucuucaucggccugauguccaugaugaucccccugugcagcaucuucggggcccugaucgccgucugccucaucaugggccuguucgacggcugcuucaucuccaucauggcccccaucgcguucgagcuggugggggcccaggacgugagccaggccaucggcuuccuccugggguucauguccauccccaugaccgucggcccgcccaucgccggccugcuccgcgacaagcuggggagcuacgacguggcguucuaccuggccggcgugcccccgcucaucgggggcgccguccugugcuucauccccuggauccacuccaagaagcagcgggagaucagcaagaccacggggaaggagaagauggagaagaugcuggagaaccagaacucccugcucagcuccagcagcggcauguucaagaaggaguccgacagcaucaucuga

SEQ ID NO: 36466 - RNA, 1416 nt, Artificial Sequence
  derived and/or modified sequence opt1 from SLC16A11__Homo_sapiens__NP_699188
augcccgccccgcagcgcaagcaccggcgcggcggguucagccaccggugcuuccccaccccccagaccgccaugacgccccagccggcgggcccccccgacgggggcuggggguggguggucgccgccgccgccuucgcgaucaacggccuguccuacggccuccugcgcagccuggggcucgccuuccccgaccuggccgagcacuucgaccgguccgcccaggacaccgcguggaucagcgcccuggcccucgccgugcagcaggccgcguccccggugggcagcgcccuguccacccgcuggggggcccggcccgucgugauggugggcgggguccuggccagccucggcuucguguucuccgccuucgcgagcgaccugcugcaccucuaccugggccuggggcuccuggccggcuucgggugggcccugguguucgcccccgcccucggcacccugucccgcuacuucagccggcgccggguccuggcggugggccucgcccugacggggaacggcgccuccagccugcuccuggcccccgcccugcagcuccugcuggacaccuucggguggcgcggcgcgcuccugcugcucggggccaucacccugcaccugaccccgugcggcgcccuccugcugccccucgugcugcccggcgaccccccggcccccccccgguccccccuggcggcccucgggcugagccuguucacgcgccgggccuucuccaucuucgcccucggcaccgcccuggucgggggcggguacuucgugccguacgugcaccuggcgccccacgcccucgaccgcggccugggcggguacggcgccgcccuggucguggccguggcggccaugggggacgccggcgcccggcuggucugcggguggcucgccgaccagggcugggugccccugccccgccugcucgcgguguucggcgcccugaccgggcugggccucugggucguggggcuggugccggucgugggcggcgaggagagcugggggggcccccugcucgccgccgcggucgccuacgggcuguccgccggcagcuacgccccccugguguucggggugcuccccggccuggucggcguggggggcgugguccaggccaccgggcuggugaugaugcucaugagccugggcgggcugcucggcccgccccuguccggcuuccugcgggacgagacgggggacuucaccgcgagcuuccuccuguccggcagccugauccucuccgggagcuucaucuacaucggccugccccgcgcccugccguccugcgggcccgccagcccccccgccaccccgccccccgagaccggcgagcuccugcccgccccgcaggcggugcugcucucccccggcgggcccggcagcacgcuggacaccaccugcuga

SEQ ID NO: 36467 - RNA, 1551 nt, Artificial Sequence
  derived and/or modified sequence opt1 from SLC16A12__Homo_sapiens__NP_998771
augcccagcggcucccacuggaccgccaacagcuccaagaucaucaccuggcugcucgagcagccggggaaggaggagaagcgcaagacgauggccaaggugaaccgggcgcgcagcaccuccccgcccgacggcggguggggcuggaugaucgucgccgggugcuuccuggugaccaucugcacccgggccgugacgcgcugcaucagcaucuucuucgucgaguuccagaccuacuucacccaggacuacgcccagaccgccuggauccacuccaucguggacugcgugacgaugcugugcgcgccccucggcagcgucguguccaaccaccugagcugccaggugggcaucaugcucgggggccugcuggccuccaccgggcugauccucagcuccuucgccaccagccugaagcaccuguaccucacccugggcguccugacggggcucggcuucgcccugugcuacucccccgcgaucgccauggugggcaaguacuucagccggcgcaaggcccuggccuacgggaucgccauguccggcagcgggaucggcaccuucauccucgcgcccgugguccagcugcugaucgagcaguucuccuggcggggcgcccuccugauccucgggggcuucgugcugaaccugugcgugugcggggcccugaugcgccccaucacccucaaggaggaccacaccacgcccgagcagaaccacgucugccggacccagaaggaggacaucaagcgcgugagcccguacagcucccugaccaaggagugggcccagaccugccugugcugcugccuccagcaggaguacagcuuccugcugauguccgacuucgugguccucgccgugagcgugcuguucauggcguacggcugcagcccccuguucgucuaccucgugcccuacgcccuguccgugggggucucccaccagcaggccgccuuccugaugagcauccucggcgugaucgacaucaucggcaacaucacguucggguggcugaccgaccggcgcugccugaagaacuaccaguacgucugcuaccucuucgccgugggcauggacgggcugugcuaccugugccuccccaugcugcagucccugccgcuccuggugcccuucagcugcaccuucggcuacuucgacggggcguacgucacccugauccccguggugacgaccgagaucgucggcaccaccucccugagcuccgcccucggcgugguguacuuccugcacgccguccccuaccuggugagcccgcccaucgccgggcggcucguggacacgaccggcuccuacaccgccgcguuccugcugugcggguucagcaugaucuucuccagcguccuccugggcuucgcccgccugaucaagcggaugcgcaagacccagcuccaguucaucgccaaggaguccgaccccaagcugcagcuguggacgaacgggagcguggccuacagcguggcgcgggagcucgaccagaagcacggcgagcccgucgccaccgccgugccgggcuacucccugaccuga

SEQ ID NO: 36468 - RNA, 1281 nt, Artificial Sequence
  derived and/or modified sequence opt1 from SLC16A13__Homo_sapiens__NP_963860
auggcccgccggaccgagcccccggacggcggguggggcuggguggucgugcugagcgccuucuuccaguccgcgcucguguucgggguccugcgcagcuucggcguguucuucguggaguucgucgccgccuucgaggagcaggccgcccggguguccuggaucgcgagcaucgggaucgccgugcagcaguucggcucccccgucggcagcgcccuguccaccaaguucgggccccgccccguggugaugacgggcgggauccucgccgcgcugggcaugcugcucgccagcuucgccaccucccugacccaccuguaccucagcaucgggcugcuguccggcagcggcugggcccucaccuucgccccgacgcuggcgugccuguccugcuacuucagccggcgccggucccucgccaccgggcuggcccugaccggcgucgggcucagcuccuucaccuucgcccccuucuuccaguggcugcugagccacuacgccuggcgcggcucccuccugcuggugagcgcgcucagccugcaccugguggccugcggcgcccuccugcggccgcccucccuggccgaggaccccgccgucgggggcccccgcgcgcagcucacgagccugcugcaccacgggcccuuccuccgguacaccguggcccugacccugaucaacaccggcuacuucauccccuaccuccaccugguggcccaccuccaggaccuggacugggacccgcugcccgccgccuuccugcucuccgucguggcgaucagcgaccugguggggcgcgucguguccggcuggcugggcgacgccgugcccgggcccgucacgcggcuccugaugcuguggaccacccucaccggcgugagccuggcccuguucccggucgcccaggcgcccacggcccugguggcccucgccguggccuacggguucaccuccggcgcgcuggcgccccuggccuucagcguccuccccgagcugaucgggacccgccggaucuacugcggccugggccuccugcagaugaucgaguccaucgggggccugcucgggccgccccugagcggcuaccugcgcgacgugaccgggaacuacacggccuccuucguggucgccggcgccuuccuccugagcggcuccgggauccugcucacccugccccacuucuucugcuucagcaccaccacguccggcccccaggaccuggugaccgaggcccucgacaccaaggugccgcugcccaaggaggggcuggaggaggacuga

SEQ ID NO: 36469 - RNA, 1503 nt, Artificial Sequence
  derived and/or modified sequence opt1 from SLC16A1__Homo_sapiens__XP_011540329
augcccccggccgugggcgggcccgucggcuacaccccgcccgacgggggcugggggugggccguggugaucggcgcguucaucagcaucggcuucuccuacgccuuccccaagagcaucaccgucuucuucaaggagaucgaggggaucuuccacgccacgaccuccgaggugagcuggaucuccagcaucaugcuggccgugauguacggcgggggccccaucuccagcauccucgucaacaaguacgggucccgcaucgugaugaucgugggcggcugccugagcgggugcggccugaucgccgcguccuucugcaacaccguccagcagcucuacgugugcaucggggugaucggcggccuggggcuggccuucaaccucaaccccgcccugaccaugaucggcaaguacuucuacaagcggcgcccccuggccaacgggcucgcgauggccggcagcccggucuuccugugcacgcuggcgccccucaaccagguguucuucgggaucuucggcuggcggggcuccuuccugauccucgggggccugcugcugaacugcugcguggccggggcccucaugcgccccaucggccccaagccgaccaaggccgggaaggacaagagcaaggccucccuggagaaggccggcaagagcggcgucaagaaggaccugcacgacgccaacaccgaccucaucgggcggcaccccaagcaggagaagcgcuccguguuccagaccaucaaccaguuccuggaccugacccucuucacgcaccggggcuuccugcuguaccucagcgggaacgugaucauguucuucggccuguucgcgccccuggucuuccucuccagcuacggcaagagccagcacuacuccagcgagaaguccgccuuccugcugagcauccucgccuucguggacaugguggcccgccccuccauggggcuggucgccaacaccaagccgauccggccccgcauccaguacuucuucgccgcgagcgugguggccaacggcgucugccacaugcuggcgccccucuccaccacguacgugggguucugcgucuacgccggcuucuucggguucgccuucggcuggcugagcuccgugcuguucgagacccucauggaccuggugggcccccagcgguucagcuccgccgucgggcuggugaccaucguggagugcugcccgguccuccugggcccgccccugcucgggcgccugaacgacauguacggcgacuacaaguacaccuacugggccugcgggguggugcugaucaucagcggcaucuaccucuucaucggcauggggaucaacuaccggcugcuggccaaggagcagaaggccaacgagcagaagaaggaguccaaggaggaggagacgagcaucgacgucgcgggcaagcccaacgaggugaccaaggccgccgagucccccgaccagaaggacaccgacgggggccccaaggaggaggagagccccguguga

SEQ ID NO: 36470 - RNA, 1620 nt, Artificial Sequence
  derived and/or modified sequence opt1 from SLC16A2__Homo_sapiens__NP_006508
auggcccugcagagccaggccuccgaggaggcgaagggccccuggcaggaggccgaccaggagcagcaggagccgguggggagccccgagcccgaguccgagcccgagccggagcccgagcccgagcccgucccggugcccccgcccgagccccagcccgagccccagccccucccggaccccgcgccccugcccgagcuggaguucgagagcgagcgcgugcacgagccggagcccacccccaccgucgagacgcggggcaccgcccgcggguuccagcccccggagggcggguucggcugggugguggucuucgccgccaccuggugcaacggcuccaucuucgggauccacaacagcgugggcauccucuacuccaugcugcuggaggaggagaaggagaagaaccgccagguggaguuccaggccgccugggucggggcccucgcgaugggcaugaucuucuucugcagccccaucguguccaucuucaccgaccggcuggggugccggaucacggccaccgccggcgccgccguggcguucaucggccugcacaccagcuccuucaccagcucccucagccugcgcuacuucacguacgggauccuguucggcugcgggugcuccuucgccuuccagcccagccucgucauccugggccacuacuuccagcggcgccugggccucgccaacggggugguguccgccggcagcuccaucuucagcaugagcuuccccuuccugauccggaugcugggggacaagaucaagcucgcccagaccuuccagguccuguccaccuucauguucgugcugaugcuccugagccugaccuaccgcccgcuccugcccuccagccaggacacgcccuccaagcggggcgugcgcacccugcaccagcgguuccucgcgcagcugcgcaaguacuucaacaugcgggucuuccgccagcggaccuaccgcaucugggccuucgggaucgccgccgccgcgcugggcuacuucgugccguacgugcaccucaugaaguacgucgaggaggaguucagcgagaucaaggagaccugggugcugcuggugugcaucggcgccacguccgggcucggccggcuggucagcgggcacaucuccgacagcauccccggccugaagaagaucuaccuccaggugcuguccuuccugcuccuggggcugaugagcaugaugaucccccucugccgcgacuucggcggccugaucgucgugugccuguuccucgggcugugcgacggcuucuucaucaccaucauggcccccaucgccuucgagcugguggggccgaugcaggccucccaggcgaucggcuaccuccuggggaugauggcccugcccaugaucgccggcccgcccaucgccggccugcuccggaacugcuucggggacuaccacgucgcguucuacuucgccggcgugccgcccaucaucggggccgugauccuguucuucgucccccugaugcaccagcgcauguucaagaaggagcagcgcgacagcuccaaggacaagaugcucgcccccgaccccgaccccaacggcgagcugcugcccggcagccccaacccggaggagcccaucuga

SEQ ID NO: 36471 - RNA, 1398 nt, Artificial Sequence
  derived and/or modified sequence opt1 from SLC16A3__Homo_sapiens__XP_011521909
augggcggggccguggucgacgagggccccaccggggugaaggccccggacggcggguggggcugggcggugcuguucggcugcuucgucaucaccggguucagcuacgccuuccccaaggccguguccguguucuucaaggagcucauccaggaguucggcaucggguacagcgacacggccuggaucuccagcauccugcuggccaugcucuacggcaccgggccccugugcuccgucugcgugaaccgcuucggcugccggcccgugaugcuggucggcggccucuucgcgagccuggggaugguggccgccuccuucugccgcagcaucauccagguguaccugaccaccggggucaucacgggccucggccuggcccugaacuuccagccgucccucaucaugcugaaccgguacuucagcaagcgccggcccauggcgaacgggcuggccgccgccggcucccccguguuccucugcgcccugagcccccuggggcagcuccugcaggaccgcuacggcuggcgcgggggcuuccugauccucggcgggcugcugcucaacugcugcgugugcgcggcccugaugcggccgcuggucgugaccgcccagcccggcuccgggccgccccggcccagccgccggcuccuggaccuguccguguuccgcgaccggggcuucguccucuacgccguggccgcgagcgugaugguccuggggcuguucgugccgcccguguucgucguguccuacgccaaggaccucggcguccccgacaccaaggccgccuuccugcugaccauccucggcuucaucgacaucuucgcccgccccgcggccggguucguggccggccuggggaaggugcggcccuacagcgucuaccuguucuccuucagcauguucuucaacggccucgccgaccuggccgggagcacggcgggcgacuacggcgggcuggugguguucugcaucuucuucggcaucuccuacgggauggucggcgcccuccaguucgaggugcugauggccaucgugggcacccacaaguucagcuccgccaucgggcugguccuccugauggaggcgguggccgugcuggucggcccgcccagcgggggcaagcuccuggacgccacccacguguacauguacguguucauccuggccggggccgagguccugaccuccagccucauccugcugcucggcaacuucuucugcauccgcaagaagcccaaggagccccagcccgagguggcggccgccgaggaggagaagcugcacaagcccccggccgacuccggcguggaccugcgggaggucgagcacuuccucaaggccgagcccgagaagaacggggagguggugcacacgcccgagaccagcgucuga

SEQ ID NO: 36472 - RNA, 1572 nt, Artificial Sequence
  derived and/or modified sequence opt1 from SLC16A6__Homo_sapiens__NP_004685
augacccagaacaagcugaagcucugcagcaaggccaacguguacaccgagguccccgacggcggguggggcugggccguggcgguguccuucuucuucgucgagguguucacguacgggaucaucaagaccuucggcguguucuucaacgaccugauggacagcuucaacgaguccaacagccgcaucuccuggaucaucagcaucugcgucuucgugcugaccuucuccgccccgcucgccaccgugcugagcaaccgguucgggcaccgccuggucgugaugcucggcggccugcugguguccacggggauggucgccgccagcuucucccaggaggugagccacauguacguggcgaucggcaucaucuccgggcucggcuacugcuucagcuuccugcccaccgucaccauccugucccaguacuucgggaagcggcgcagcaucgugaccgccguggccuccacgggcgagugcuucgccgucuucgcguucgcccccgccaucauggcccucaaggagcggaucggcuggcgcuacagccugcuguucguggggcuccugcagcugaacaucgugaucuucggcgcccuccugcggcccaucuucauccgcgggccggcgucccccaagaucgucauccaggagaaccggaaggaggcccaguacaugcuggagaacgagaagacccgcaccagcaucgacagcaucgacuccggcguggagcucaccacgagccccaagaacgugcccacccacaccaaccuggagcuggagccgaaggccgacaugcagcagguccucgugaagaccagcccccggcccagcgagaagaaggcgccccugcuggacuucuccauccucaaggagaaguccuucaucugcuacgcccuguucggccuguucgccacgcucggguucuucgccccgucccuguacaucaucccccugggcaucagccucgggaucgaccaggaccgcgccgccuuccugcuguccaccauggccaucgcggaggucuucggccggaucggggccggcuucgugcucaaccgcgagcccauccggaagaucuacaucgagcugaucugcgugauccugcucaccgucagccuguucgccuucaccuucgccacggaguucuggggccugauguccugcagcaucuucuucggguucauggugggcaccaucgggggcacccacaucccccuccuggccgaggacgacguggucgggaucgagaagauguccagcgcggccggcguguacaucuucauccaguccaucgccggccuggccgggccgccccucgcgggccugcugguggaccagagcaagaucuacucccgcgccuucuacagcugcgccgccgggauggcccucgcggccgucugccuggcccuggugcggcccugcaagaugggccugugccagcaccaccacuccggggagaccaagguggucagccaccgcggcaagacgcuccaggacauccccgaggacuuccuggagauggaccuggccaagaacgagcaccgggugcacgugcagauggagccggucuga

SEQ ID NO: 36473 - RNA, 1437 nt, Artificial Sequence
  derived and/or modified sequence opt1 from SLC16A7__Homo_sapiens__XP_005269288
augcccccgaugcccagcgccccgcccgugcacccgccgcccgacggcggguggggcuggaucgucgugggggccgcguucaucuccaucggcuucagcuacgccuuccccaaggccgugaccgucuucuucaaggagauccagcagaucuuccacaccacguacuccgagaucgccuggaucagcuccaucaugcuggccgugauguacgccgggggccccgugagcuccguccucgugaacaaguacggcagccgccccguggucaucgccgggggccugcugugcugccucgggauggugcuggccuccuucagcuccagcgugguccagcuguaccucaccaugggcuucaucaccgggcugggccuggccuucaaccuccagcccgcgcugaccaucaucggcaaguacuucuaccggaagcgccccauggccaacgggcuggccauggccggcucccccguguuccucagcucccuggcccccuucaaccaguaccuguucaacacguucggguggaagggcagcuuccucauccugggcucccugcuccugaacgcgugcguggccgggagccugaugcggccccucggccccaaccagaccaccuccaagagcaagaacaagaccgggaagacggaggacgacagcuccccgaagaagaucaagaccaagaaguccaccugggagaaggucaacaaguaccuggacuucagccuguucaagcaccgcggcuuccucaucuaccugagcgggaacgugaucauguuccugggcuucuucgcccccaucaucuuccucgcccccuacgccaaggaccagggcaucgacgaguacuccgcggccuuccugcugagcgugauggccuucgucgacauguucgcccggcccuccguggggcucaucgccaacagcaaguacauccgcccgcggauccaguacuucuucuccuucgcgaucauguucaacggcgugugccaccuccugugcccccuggcccaggacuacaccagccugguccuguacgccguguucuucgggcucggcuucggguccgugagcuccguccuguucgagacgcugauggaccucgugggcgcgccccgcuucagcuccgccgucggccuggugaccaucguggagugcgggcccguccugcucggcccgccccuggcggggaagcugguggaccucaccggcgaguacaaguacauguacaugagcugcggggccaucguggucgccgccuccguguggcugcugaucggcaacgcgaucaacuaccggcuccuggccaaggagcgcaaggaggagaacgcccggcagaagacccgcgagagcgagccccuguccaagagcaagcacagcgaggacgugaacgucaagguguccaacgcccagagcgugacguccgagcgggagaccaacaucuga

SEQ ID NO: 36474 - RNA, 1515 nt, Artificial Sequence
  derived and/or modified sequence opt1 from SLC16A8__Homo_sapiens__NP_037488
augggcgccgggggcccccgccgcggggagggcccgcccgacgggggcuggggcugggugguccugggggccugcuucguggugaccggcuucgcguacggguuccccaaggccgucagcguguucuuccgcgcccucaugcgggacuucgacgccggcuacuccgacaccgccugggugagcuccaucaugcuggcgaugcuguacgggacgggccccgucagcuccauccucgugacccgcuucggcugccggccggugaugcuggccgggggccugcucgccagcgccgggaugauccuggcguccuucgccacccgccugcucgagcuguaccugaccgccggcguccucacgggccuggggcuggcccucaacuuccagcccagccugaucaugcugggccucuacuucgagcggcgccggccccuggccaacgggcuggcggccgccggcucccccguguuccucagcgcccuguccccgcuggggcagcagcuccuggagcgcuucggcuggcggggcggguuccugcuccugggcgggcugcuccugcacugcugcgccugcggcgcggugaugcggcccccgcccgggcccggcccccggccccgccgggacagcgccggcgaccgcgccggggacgcccccggcgaggccgaggcggacggggccggccugcagcuccgggaggccuccccgcgcguccggccccgccggcgccugcuggaccucgccgugugcaccgaccgcgccuucgcgguguacgccgucaccaaguuccugauggcccugggccucuucgugcccgccauccugcuggugaacuacgcgaaggacgccgggguccccgacaccgacgccgccuuccuccugagcaucgugggcuucguggacaucgucgcccggccggcgugcggggcccuggccggccucgcccgccugcggccccacgugcccuaccuguucucccucgcccugcuggcgaacgggcugacggaccucagcuccgcccgcgcccggagcuacggcgcccugguggccuucugcgucgcguucggccuguccuacgggauggugggcgcccuccaguucgagguccugauggccgccgugggggcgccccgcuucccgagcgcccugggccucgugcugcuggucgaggccgccgccgugcucaucgggccgcccagcgcgggccggcugguggacguccugaagaacuacgagaucaucuucuaccucgccggcuccgagguggcccuggccgggguguucauggccgucgcgaccaacugcugccugcgcugcgccaaggccgcccccagcggccccgggaccgagggcggggccuccgacaccgaggacgcggaggccgagggcgacagcgagccccuccccgugguggccgaggagccgggcaaccuggaggcccuggagguccucuccgcgcgcggggagcccacggagcccgagaucgaggcccggccccggcuggccgccgagagcguguga

SEQ ID NO: 36475 - RNA, 1530 nt, Artificial Sequence
  derived and/or modified sequence opt1 from SLC16A9__Homo_sapiens__NP_919274
auggagcugaagaagucccccgacggcggguggggcugggugaucgucuucgugagcuuccucacccaguuccugugcuacgggagcccgcuggccgugggcguccucuacaucgaguggcuggacgccuucggggagggcaagggcaagaccgcguggguggggucccuggccagcggcguggggcuccuggccucccccgucugcagccugugcguguccagcuucggcgcccgccccgugacgaucuucuccggguucauggucgccggcggccucaugcugagcuccuucgcgcccaacaucuacuuccuguucuucagcuacgggaucguggugggccucgggugcggccugcuguacaccgccaccgucaccaucacgugccaguacuucgacgaccggcgcggccucgcccuggggcugaucuccaccggcagcuccgugggccucuucaucuacgccgcgcugcagcggaugcugguggaguucuacgggcucgacgggugccugcugaucgucggcgcccucgcccugaacauccuggccugcggcagccucaugcgcccgcugcaguccagcgacugcccccugcccaagaagaucgcccccgaggaccucccggacaaguacuccaucuacaacgagaaggggaagaaccuggaggagaacaucaacauccuggacaagagcuacagcuccgaggagaagugccggaucacccucgcgaacggcgacuggaagcaggacagccugcugcacaagaaccccaccgugacgcacaccaaggagcccgagaccuacaagaagaagguggccgagcagaccuacuucugcaagcagcucgccaagcgcaaguggcagcuguacaagaacuacugcggggagacggucgcccuguucaagaacaagguguucuccgcccucuucaucgcgauccugcuguucgacaucggcggguucccgcccagccuccugauggaggacguggcccgguccagcaacgucaaggaggaggaguucaucaugccccugaucuccaucaucggcaucaugaccgccgugggcaagcuccugcuggggauccucgccgacuucaaguggaucaacacccuguaccuguacguggccacccugaucaucaugggccucgcgcugugcgccauccccuucgccaagagcuacgucacgcuggcccuccuguccgggauccugggcuuccucaccgggaacuggagcaucuuccccuacgugaccaccaagacggucggcaucgagaagcuggcccacgcguacggcauccugauguucuucgccgggcucggcaacucccuggggccgcccaucgugggcugguucuacgacuggacccagaccuacgacaucgccuucuacuucagcggcuucugcgugcugcucgggggcuucauccugcugcucgccgcgcugcccuccugggacacgugcaacaagcagcugcccaagccggcccccaccaccuuccucuacaaggucgccagcaacguguga

SEQ ID NO: 36476 - RNA, 1404 nt, Artificial Sequence
  derived and/or modified sequence opt1 from SLC17A1__Homo_sapiens__NP_005065
augcagauggacaaccgccugcccccgaagaaggugcccggcuucugcagcuuccgguacgggcucuccuuccugguccacugcugcaacgugaucaucaccgcccagcgcgccugccugaaccucaccaugguggucauggugaacagcacggacccccacggccugcccaacaccuccaccaagaagcugcucgacaacaucaagaacccgauguacaacuggagccccgacauccaggggaucauccuguccagcaccuccuacggcgugaucaucauccagguccccgugggguacuucagcggcaucuacuccacgaagaagaugaucggcuucgcgcugugccucagcuccgugcugagccugcucaucccgcccgccgccgggaucggcgucgccugggugguggucugccgggccgugcagggggcggcccagggcaucguggccaccgcccaguucgagaucuacgucaagugggcgccgccccuggagcgcgggcggcugaccuccaugagcaccuccggcuuccuccugggccccuucaucgugcugcucgugacgggggucaucugcgagagccugggcuggcccaugguguucuacaucuucggggccugcggcugcgccgugugccugcucugguucguccuguucuacgacgaccccaaggaccaccccugcaucuccaucagcgagaaggaguacaucaccuccagccuggugcagcaggucagcuccagccgccagucccuccccaucaaggccauccucaagagccugccggugugggccaucuccaccggcagcuucaccuucuucuggucccacaacaucaugacgcucuacacccccauguucaucaacagcaugcugcacgugaacaucaaggagaacggguuccuguccagccuccccuaccuguucgcguggaucugcggcaaccuggccgggcagcucuccgacuucuuccugacccggaacauccugagcgucaucgccgugcgcaagcuguucaccgccgccggcuuccugcugcccgcgaucuucggggugugccucccguaccuguccagcacguucuacuccaucgucaucuuccugauccucgccggcgccaccggcagcuucugccucgggggcguguucaucaacgggcuggacaucgcgccccgguacuucggcuucaucaaggccugcuccacccugaccgggaugaucggcggccugaucgccagcacgcugaccgggcucauccugaagcaggaccccgaguccgccugguucaagaccuucauccugauggccgccaucaacgugaccggccugaucuucuaccucaucgucgccacggcggagauccaggacugggccaaggagaagcagcacacccgccuguga

SEQ ID NO: 36477 - RNA, 1437 nt, Artificial Sequence
  derived and/or modified sequence opt1 from SLC17A2__Homo_sapiens__NP_001273052
auggacggcaagcccgccacccgcaaggggccggacuucugcagccugcgguacggccucgcccugaucaugcacuucuccaacuucaccaugaucacgcagcgcgugagccuguccaucgcgaucaucgccauggucaacaccacccagcagcaggggcucagcaacgccuccaccgagggccccguggccgacgccuucaacaacagcuccaucagcaucaaggaguucgacacgaaggcguccguguaccaguggagccccgagacccaggggaucaucuucuccagcaucaacuacggcaucauccugacccugauccccuccggcuaccucgccgggaucuucggcgccaagaagaugcugggggccggccugcucaucagcucccugcugacccucuucacgccgcuggcggccgacuucggggucauccuggugaucauggugcggaccguccagggcauggcccagggcauggccuggaccgggcaguucaccaucugggccaagugggcgccgccccucgagcgcagcaagcugacgaccaucgccggcuccgggagcgccuucggcuccuucaucauccugugcgugggcgggcucaucagccaggcccugagcuggcccuucaucuucuacaucuucggcuccaccgggugcgugugcugccugcucugguucaccgucaucuacgacgaccccaugcaccaccccugcaucagcgugcgggagaaggagcacauccuguccagccuggcccagcagcccuccagccccggccgcgcggugccgaucaaggccauggucacgugccucccccugugggccaucuuccugggguucuucucccacuucuggcucugcaccaucauccugaccuaccugcccaccuacaucagcacgcuccugcacgugaacauccgggacuccggcgugcugagcucccuccccuucaucgccgccgcgagcugcaccauccugggcgggcagcuggccgacuuccuccugucccgcaaccugcuccggcugaucaccguccgcaagcuguucagcucccucggccugcugcucccgagcaucugcgccguggcccugcccuucguggccuccagcuacgucaucaccaucauccugcucauccugauccccgggacguccaaccugugcgacagcggcuucaucaucaacacccuggacaucgcgccccgguacgccagcuuccucauggggaucucccgcggcuucggccugaucgccgggaucaucagcuccaccgccaccggcuuccugaucagccaggacuucgaguccggguggcggaacguguucuuccucagcgcggccgugaacauguucggccuggucuucuaccugacguucgggcaggccgagcuccaggacugggccaaggagcgcacccugacccggcuguga

SEQ ID NO: 36478 - RNA, 1497 nt, Artificial Sequence
  derived and/or modified sequence opt1 from SLC17A3__Homo_sapiens__NP_001091956
auggccaccaagaccgagcugagccccacggcccgcgaguccaagaacgcgcaggacaugcaggucgacgagacccucaucccgcggaaggugcccagccugugcuccgcccgcuacggcaucgcccuggugcuccacuucugcaacuucaccaccaucgcccagaacgugaucaugaacaucacgauggucgccauggugaacagcaccagcccccagucccagcugaacgacuccagcgaggugcugcccgucgacuccuucgggggccucagcaaggcgccgaagucccugcccgccaaggcccccguguacgacuggagcccccagauccaggggaucaucuucggcgccgugggguacggcggcauccugaccauggcgccguccggguaccucgccggccgggucgggaccaagcgcguggugggcaucagccuguucgccacguccuuccugacccucugcaucccccuggccaccgacuucgggaucguccugcucaucgugacccggaucgugcagggccugagccaguccagcauccugggcgggcaguucgccaucugggagaaguggggcccgccccaggagcgcucccggcucugcagcaucgcgcugagcgggaugcugcucggcugcuucacggccauccugaucggcggguucaucuccgagacccugggcuggcccuucgucuucuacaucuucgggggcguggggugcgugugcugccuccugugguucgucgugaucuacgacgaccccgugagcuaccccuggaucuccaccagcgagaaggaguacaucaucuccagccugaagcagcaggucggcuccagcaagcagccccucccgaucaaggccaugcugcgcucccugcccaucuggagcaucugccucggcugcuucucccaccaguggcuggugagcaccaugguggucuacauccccacguacaucuccagcguguaccacgucaacauccgggacaacgggcugcucuccgcccugcccuucaucguggccugggugaucggcauggucgggggcuaccuggcggacuuccuccugaccaagaaguuccgccugaucaccgugcggaagaucgccaccauccucgggagccugccguccagcgcccugaucgugucccuccccuaccugaacagcggcuacaucacggccaccgcccugcucacccugagcugcggccuguccacccucugccagagcgggaucuacaucaacguccuggacaucgcgccccgcuacuccagcuuccugaugggcgccucccggggguucagcuccaucgcccccgugaucgugccgacggucagcggcuuccugcucucccaggaccccgaguucggguggcgcaacguguucuuccugcuguucgccgugaaccuccugggccuccuguucuaccugaucuucggcgaggccgacguccaggagugggcgaaggagcggaagcugacccgccucuga

SEQ ID NO: 36479 - RNA, 1494 nt, Artificial Sequence
  derived and/or modified sequence opt1 from SLC17A4__Homo_sapiens__NP_005486
augagcaccggccccgacgugaaggccaccgucggggacaucuccagcgacggcaaccugaacguggcccaggaggagugcucccgcaagggguucugcagcgugcggcacggccucgcgcugauccugcagcucugcaacuucuccaucuacacgcagcagaugaaccugagcaucgccaucccggccauggucaacaacaccgccccgcccucccagcccaacgccagcaccgagcgccccuccaccgacagccagggguacuggaacgagacgcugaaggaguucaaggcgauggcccccgccuacgacuggucccccgagauccagggcaucauccucagcucccugaacuacggcagcuuccuggcccccaucccguccggguacguggcgggcaucuucggggccaaguacguggucggcgccgggcuguucaucagcuccuuccugacccuguucaucccccucgccgccaacgcgggcguggcccugcugaucgugcuccggaucguccagggcaucgcccaggugauggugcugaccgggcaguacagcaucugggucaagugggccccgccccuggagcgcucccagcucaccacgaucgccggcagcgggagcaugcugggcuccuucaucgugcugcucgcgggcgggcugcugugccagaccaucggcuggcccuacguguucuacaucuucgggggcaucgggugcgccugcugcccccucugguucccccugaucuacgacgaccccgucaaccacccguucaucagcgccggcgagaagcgguacaucgugugcucccuggcccagcaggacugcagccccggcuggucccuccccauccgcgccaugaucaagagccugccccugugggcgauccucguguccuacuucugcgaguacuggcuguucuacaccaucauggccuacaccccgacguacaucagcuccguccugcaggccaaccuccgggacagcgggauccuguccgcccugcccuucguggugggcugcaucugcaucauccucgggggccugcuggccgacuuccuccugagccgcaagauccugcggcucaucaccauccgcaagcuguucaccgcgaucgggguccuguuccccuccgugauccucgugagccugcccuggguccgguccagccacuccaugaccaugacguuccuggugcucagcuccgccaucagcagcuucugcgaguccggcgcccuggucaacuuccuggacaucgccccgcgcuacaccggcuuccugaaggggcuccuccagguguucgcgcacaucgccggcgccaucagccccaccgccgccggguucuucaucucccaggacagcgaguucggcuggcggaacguguuccugcucuccgcggccgucaacaucagcgggcugguguucuaccugaucuucggccgcgccgacgugcaggacugggccaaggagcagaccuucacgcaccucuga

SEQ ID NO: 36480 - RNA, 1488 nt, Artificial Sequence
  derived and/or modified sequence opt1 from SLC17A5__Homo_sapiens__NP_036566
augcgcagccccgugcgggaccuggcccgcaacgacggcgaggaguccaccgaccggaccccgcuccugcccggggcgccccgcgccgaggccgcccccgucugcugcagcgcccgguacaaccuggccauccucgcguucuucggcuucuucaucguguacgcccugcgcgugaaccuguccgucgcccucguggacaugguggacagcaacacgacccuggaggacaaccggaccuccaaggccugcccggagcacagcgcgcccaucaagguccaccacaaccagaccgggaagaaguaccagugggacgccgagacgcagggcuggauccugggguccuucuucuacggcuacaucaucacccagauccccggcggguacguggccagcaagaucggcgggaagaugcuccugggcuucgggauccugggcaccgccgugcucacccuguucacgcccaucgccgcggaccugggcgucgggccgcucaucgugcugcgcgcccuggagggccucggggagggcgugaccuuccccgccaugcacgccaugugguccagcugggccccgccccuggagcgguccaagcugcucagcaucuccuacgcgggcgcccagcuggggaccgucaucagccugccccucuccggcaucaucugcuacuacaugaacuggaccuacguguucuacuucuucgggacgaucggcaucuucugguuccugcuguggaucuggcucgugagcgacacgccccagaagcacaagcgcaucucccacuacgagaaggaguacauccugagcucccugcggaaccagcucagcagccagaaguccguccccugggugcccauccucaagagccugccgcugugggccaucguggucgcccacuucuccuacaacuggaccuucuacacccugcugacgcuccugcccaccuacaugaaggagauccugcgcuucaacgugcaggagaacggguuccucagcucccugcccuaccugggcagcuggcucugcaugauccuguccggccaggccgcggacaaccugcgggccaaguggaacuucagcacccucugcgugcgccggaucuucucccugaucgggaugaucggccccgccgucuuccugguggccgccggguucaucggcugcgacuacagccucgcgguggccuuccugaccaucuccacgacccucgggggcuucugcagcuccggcuucagcaucaaccaccuggacaucgccccguccuacgccgggauccugcugggcaucaccaacaccuucgcgacgauccccgggauggucggccccgugaucgccaagagccugacccccgacaacaccgucggggaguggcagaccguguucuacaucgccgccgccaucaacguguucggcgcgaucuucuucacccucuucgccaagggcgagguccagaacugggcccugaacgaccaccacgggcaccgccacuga

SEQ ID NO: 36481 - RNA, 1749 nt, Artificial Sequence
  derived and/or modified sequence opt1 from SLC17A6__Homo_sapiens__NP_065079
auggagagcgugaagcagcgcauccuggcccccggcaaggaggggcucaagaacuucgccggcaagucccuggggcagaucuaccggguccuggagaagaagcaggacaccggcgagaccaucgagcucacggaggacgggaagccgcuggaggugcccgagcgcaaggcgccccugugcgacugcacgugcuucggccucccccggcgcuacaucaucgccaucaugagcggccugggguucugcaucuccuucggcauccggugcaaccuggggguggccaucgucgacauggugaacaacagcaccauccaccgcggcgggaaggugaucaaggagaaggccaaguucaacugggacccggagaccgucggcaugauccacggcuccuucuucuggggguacaucaucacgcagauccccggcggguacaucgccagccggcucgcggccaaccgcguguucggcgccgccauccugcugaccuccacccucaacaugcugauccccagcgcggcccgggugcacuacggcugcgucaucuucgugcgcauccugcaggggcucguggagggcgucaccuaccccgccugccacgggaucugguccaagugggccccgccccuggagcggagccgccuggccacgaccuccuucugcggcagcuacgcgggggccgugaucgccaugccccucgccggcauccuggugcaguacaccggcugguccagcgucuucuacguguacggguccuucggcauggugugguacauguucuggcugcucgucagcuacgagucccccgccaagcacccgaccaucacggacgaggagcggcgcuacaucgaggagagcaucggggaguccgcgaaccugcugggcgccauggagaaguucaagacccccuggcggaaguucuucaccagcaugcccguguacgccaucaucguggccaacuucugccgcagcuggaccuucuaccuccugcugaucucccagcccgccuacuucgaggaggucuucggguucgagaucagcaaggugggcaugcucuccgcggugccgcaccuggucaugacgaucaucgugcccaucggcgggcagaucgccgacuuccugcggagcaagcagauccucuccaccaccaccguccgcaagaucaugaacugcggcggguucggcauggaggccacgcugcugcucguggugggguacagccacacccggggcgucgccaucuccuuccuggugcuggccgugggcuucagcggguucgcgaucuccggcuucaacgucaaccaccucgacaucgcgccccgcuacgccagcauccugauggggaucuccaacggcgugggcacccugagcgggauggugugccccaucaucgucggcgccaugaccaagaacaagucccgggaggaguggcaguacguguuccucaucgccgcccuggugcacuacgggggcgucaucuucuacgccaucuucgccagcggggagaagcagccgugggccgaccccgaggagacguccgaggagaagugcggcuucauccacgaggacgagcuggacgaggagaccggcgacaucacccagaacuacaucaacuacgggaccaccaagagcuacggcgcgaccacccaggccaacgggggcuggcccuccgggugggagaagaaggaggaguucgugcagggcgaggugcaggacagccacuccuacaaggaccgcgucgacuacagcuga

SEQ ID NO: 36482 - RNA, 1683 nt, Artificial Sequence
  derived and/or modified sequence opt1 from SLC17A7__Homo_sapiens__NP_064705
auggaguuccgccaggaggaguuccggaagcuggccggccgcgcccucgggaagcugcaccggcugcucgagaagcgccaggagggcgcggagacccuggagcugagcgccgacgggcggcccgugaccacgcagacccgcgacccgcccgucguggacugcacgugcuucggccucccccggcgcuacaucaucgccaucauguccgggcugggcuucugcaucagcuucggcauccggugcaaccuggggguggccaucgucuccauggugaacaacagcaccacccaccgcggcgggcacguggucgugcagaaggcccaguucuccugggaccccgagaccgugggccucauccacgggagcuucuucuggggcuacaucgucacccagauccccggcggguucaucugccagaaguucgcggccaaccggguguucggcuucgccaucguggccaccuccacgcugaacaugcugauccccagcgcggcccgcguccacuacgggugcgugaucuucgugcggauccuccagggccuggucgagggcgugaccuaccccgccugccacgggaucugguccaagugggccccgccccuggagcgcagccggcucgccaccaccgcguucugcggcuccuacgccggggccguggucgccaugccccuggccggcgugcuggugcaguacagcgggugguccagcgucuucuacguguacggcuccuucggcaucuucugguaccucuucuggcugcuggugagcuacgagucccccgcgcuccaccccagcaucuccgaggaggagcgcaaguacaucgaggacgccaucggggagagcgccaagcugaugaacccccugacgaaguucagcacccccuggcggcgcuucuucaccuccaugcccgucuacgccaucaucguggccaacuucugccggagcuggaccuucuaccuccugcugaucucccagcccgcguacuucgaggaggucuucggcuucgagaucagcaagguggggcucguguccgcccugccccaccuggucaugacgaucaucgugcccaucggcgggcagaucgccgacuuccuccgcagccggcgcaucauguccaccaccaacgugcgcaagcugaugaacugcggcggcuucgggauggaggccacccugcuccuggucgugggcuacagccacuccaaggggguggccaucagcuuccugguccucgcggugggcuucuccggguucgccaucagcggcuucaacgugaaccaccuggacaucgcgccccgguacgccuccauccugaugggcaucagcaacggggucggcacgcucuccgggauggugugccccaucaucgugggcgccaugaccaagcacaagacccgcgaggaguggcaguacgucuuccugaucgccagccuggugcacuacggcggggugaucuucuacggcgucuucgccuccggggagaagcagcccugggccgagcccgaggagaugagcgaggagaagugcggcuucguggggcacgaccagcucgccggcuccgacgacagcgagauggaggacgaggcggagccgcccggcgccccgcccgccccgccgcccagcuacggggccacccacuccacguuccagccgccccggcccccgccgcccgugcgcgacuacuga

SEQ ID NO: 36483 - RNA, 1620 nt, Artificial Sequence
  derived and/or modified sequence opt1 from SLC17A8__Homo_sapiens__NP_001138760
augcccuucaaggccuucgacaccuucaaggagaagauccugaagccgggcaaggagggggugaagaacgccgucggcgacagccucgggauccugcagcgcaagaucgacggcaccacggaggaggaggacaacaucgagcugaacgaggaggggcggcccgugcagaccucccgccccagcccgccgcucugcgacugccacugcugcggccugcccaagcgguacaucaucgcgaucauguccggccugggguucugcaucagcuucggcauccgcugcaaccucgggguggccaucgucgagauggugaacaacuccaccguguacgucgacggcaagcccgagauccagaccgcccaguucaacugggaccccgagacgguggggcugauccacggcagcuucuucuggggcuacaucaugacccagauccccgggggcuucaucuccaacaaguucgccgccaaccggguguucggggcggccaucuuccugaccagcacccucaacauguucauccccuccgccgcccgcguccacuacggcugcgugaugugcgugcggauccugcagggccuggucgagggggugacguaccccgcgugccacggcauguggagcaagugggcgcccccgcucgagcgcucccggcuggccaccaccagcuucugcggguccuacgccggcgccguggucgccaugccccuggccggggugcucgugcaguacaucggcuggagcuccgucuucuacaucuacggcauguucgggaucaucugguacauguucuggcugcugcaggccuacgagugccccgccgcccaccccaccaucagcaacgaggagaagacguacaucgagaccuccaucggcgagggggcgaacguggugagccucuccgucggccugcugagcgccgugccgcacauggugaugaccaucgucgugcccaucgggggccagcucgccgacuaccugcgcagccggcagauccugaccacgaccgccguccgcaagaucaugaacugcggcggguucggcauggaggccacccuccugcugguggugggguucucccacaccaagggcgucgcgaucagcuuccucgugcuggccgugggguucuccggcuucgccaucagcggcuucaacgucaaccaccuggacaucgcgccccgguacgccuccauccucauggggaucagcaacggcguggggacgcuguccggcauggugugcccccugaucgucggcgccaugacccgccacaagacccgggaggaguggcagaacguguuccucaucgccgcccuggugcacuacagcggggucaucuucuacggcguguucgccuccggggagaagcaggagugggcggacccggagaaccugagcgaggagaagugcggcaucaucgaccaggacgagcucgccgaggagaucgagcugaaccacgaguccuucgccagccccaagaagaagauguccuacggggccaccagccagaacugcgaggugcagaagaaggaguggaagggccagcgcggcgccacgcuggacgaggaggagcucaccuccuaccagaacgaggagcggaacuucagcaccaucuccuga

SEQ ID NO: 36484 - RNA, 1578 nt, Artificial Sequence
  derived and/or modified sequence opt1 from SLC18A1__Homo_sapiens__XP_011542926
augcugcgcaccauccucgacgcgccccagcggcugcugaaggagggccgcgccagccggcagcucgugcuggucgugguguucgucgcccugcuccuggacaacaugcuguucaccgugguggucccgaucgugcccacguuccucuacgacauggaguucaaggaggugaacuccagccugcaccuggggcacgccggcuccagcccccacgcccucgccucccccgccuucagcaccaucuucuccuucuucaacaacaacaccgucgcgguggaggagagcgugccguccgggaucgccuggaugaacgacaccgccagcacgaucccgccgcccgccaccgaggcgaucuccgcccacaagaacaacugccugcagggcaccggguuccuggaggaggagaucacccgcgucggcgugcuguucgccagcaaggccgugaugcagcugcuggucaaccccuucgugggcccccucacgaaccggaucggguaccacauccccauguucgccggcuucgugaucauguuccuguccaccgucauguucgcguucagcgggaccuacacccuccucuucguggcccgcacgcugcagggcaucggguccagcuucuccagcguggccggccugggcaugcucgccuccgucuacaccgacgaccacgagcgggggcgcgccaugggcaccgcgcucgggggccuggcccugggccugcuggugggggcccccuucggcagcgugauguacgaguucgucggcaagagcgcccccuuccucauccuggccuuccuggcgcuccuggacggggcccugcagcucugcauccugcagcccuccaaggugagccccgaguccgccaaggggacgccccuguucaugcuccugaaggacccguacauccuggucgccgccggcagcaucugcuucgcgaacaugggcguggccauccucgagcccacccugcccaucuggaugaugcagaccaugugcucccccaaguggcagcuggggcucgccuuccugccggccagcguguccuaccugaucggcaccaaccucuucgggguccuggcgaacaagaugggccgguggcugugcagccugaucgggaugcucguggugggcaccucccugcugugcgucccccucgcccacaacaucuucggccugaucgggcccaacgccggccuggggcucgccaucggcaugguggacagcuccaugaugcccaucauggggcaccugguggaccugcgccacacgagcgucuacggcuccguguacgccaucgcggacguggccuucugcaugggcuucgccaucgggccgagcaccggcggggccaucgucaaggccaucggcuuccccuggcucauggugaucaccggcgugaucaacaucgucuacgcgccccugugcuacuaccugcgguccccgcccgccaaggaggagaagcucgccauccugagccaggacugccccauggagacccgcauguacgccacgcagaagcccaccaaggaguucccgcugggggaggacuccgacgaggagcccgaccacgaggaguga

SEQ ID NO: 36485 - RNA, 1545 nt, Artificial Sequence
  derived and/or modified sequence opt1 from SLC18A2__Homo_sapiens__NP_003045
auggcccugagcgagcucgcccuggugcgcuggcugcaggagucccggcgcagccggaagcucauccuguucaucgucuuccuggcgcuccugcuggacaacaugcuccugaccguggugguccccaucaucccguccuaccuguacagcaucaagcacgagaagaacgccaccgagauccagacggcccgccccgugcacaccgccuccaucagcgacuccuuccagagcaucuucuccuacuacgacaacagcaccauggugaccggcaacgccacgcgggaccucacccugcaccagaccgcgacccagcacauggucacgaacgccuccgccgugcccagcgacugccccuccgaggacaaggaccugcucaacgagaacgugcaggucgggcugcuguucgccagcaaggcgaccgugcagcucaucaccaacccguucaucggccugcugaccaaccgcaucggguaccccauccccaucuucgccggcuucugcaucauguucguguccacgaucauguucgccuucagcuccagcuacgccuuccuccugaucgcccggucccugcaggggaucggcagcagcugcuccagcgucgcgggcauggggaugcucgccuccguguacaccgacgacgaggagcgcggcaacgugauggggaucgcccugggcgggcuggccaugggcguccucguggggcccccguucggcagcgugcuguacgaguucgucggcaagaccgcccccuuccuggugcucgcggcccuggugcugcucgacggggccauccagcuguucguccugcagcccucccgggugcagcccgagagccagaagggcaccccgcucacgacccugcugaaggaccccuacauccucaucgccgccggcuccaucugcuucgcgaacauggggaucgccaugcuggagcccgcccugcccaucuggaugauggagaccaugugcagccgcaaguggcagcucggcguggccuuccugccggccuccaucagcuaccugaucgggaccaacaucuucggcauccucgcgcacaagauggggcgguggcugugcgcccugcucggcaugaucaucgucggcguguccauccugugcauccccuucgccaagaacaucuacgggcugaucgcccccaacuucggcgucggguucgcgaucggcaugguggacagcuccaugaugcccaucaugggguaccugguggaccuccgccacgucagcguguacggcuccguguacgccaucgccgacgucgccuucugcaugggcuacgccaucgggccgagcgcgggcggggccaucgccaaggccaucggcuuccccuggcugaugacgaucaucgggaucaucgacauccuguucgcgccccucugcuucuuccugcgguccccgcccgccaaggaggagaagauggccauccugauggaccacaacugccccaucaagaccaagauguacacccagaacaacauccagagcuaccccaucggcgaggacgaggaguccgagagcgacuga

SEQ ID NO: 36486 - RNA, 1599 nt, Artificial Sequence
  derived and/or modified sequence opt1 from SLC18A3__Homo_sapiens__NP_003046
auggagagcgccgagcccgccggccaggcgcgcgccgccgccaccaagcuguccgaggccgugggggcggcccuccaggagccgcggcgccagcggcgccugguccuggugaucgugugcgucgcccuccugcuggacaacaugcucuacauggugaucgugcccaucguccccgacuacaucgcccacaugcggggcgggggcgaggggcccacccgcacgccggaggugugggagcccacccugccccugcccaccccggcgaacgccagcgccuacaccgccaacacguccgccagccccaccgcggccuggcccgccggcuccgcccuccggccccgcuacccgaccgagagcgaggacgugaagaucggcguccuguucgccuccaaggcgauccugcagcuccuggugaacccccugagcgggcccuucaucgaccggauguccuacgacgugccccuccugaucggccugggggucauguucgccagcaccgugcuguucgccuucgccgaggacuacgccacgcuguucgcggcccgcucccugcagggccucgggagcgccuucgccgacaccuccggcaucgccaugaucgcggacaaguacccggaggagcccgagcggagccgcgcccugggcguggcccuggccuucaucuccuucgggagccucgucgcgccgcccuucggcgggauccuguacgaguucgccggcaagcgggugcccuuccuggugcucgccgccgucucccuguucgacgcccugcuccugcuggcgguggccaagcccuucagcgccgccgcccgcgcgcgggccaaccuccccgugggcacccccauccaccgccugaugcuggacccguacaucgccgucguggccggggcccucaccacgugcaacaucccccuggcguuccuggagcccaccaucgccaccuggaugaagcacaccauggccgccuccgagugggagaugggcauggcguggcuccccgccuucgugccgcacguccuggggguguaccugacgguccggcucgccgcccgcuacccccaccuccaguggcuguacggcgcccucgggcuggcggugaucggcgccagcagcugcaucgugcccgccugccgguccuucgccccgcuggucgugagccucugcggccugugcuucgggaucgcccugguggacaccgcgcugcuccccacccuggccuuccuggucgacgugcgccacguguccgucuacggcagcguguacgccaucgccgacaucuccuacagcguggccuacgcgcucgggcccaucgucgccggccacaucgugcacucccugggguucgagcagcugagccucggcaugggccuggccaaccugcucuacgcccccgugcugcugcuccugcggaacgucgggcugcucacccgcucccgcagcgagcgggacgugcugcuggacgagccgccccagggccucuacgacgcggugcgccugcgggagcgccccgucuccgggcaggacggcgagccccggagcccgcccgggcccuucgacgccugcgaggacgacuacaacuacuacuacacgcgcuccuga

SEQ ID NO: 36487 - RNA, 1470 nt, Artificial Sequence
  derived and/or modified sequence opt1 from SLC19A1__Homo_sapiens__NP_001192135
auggugcccagcuccccggccgucgagaagcagguccccguggagcccggccccgacccggagcugcgcagcuggcggcaccucgugugcuaccugugcuucuacggguucauggcccagauccgccccggcgaguccuucaucacccccuaccugcucgggcccgacaagaacuucacccgggagcaggucacgaacgagaucaccccggugcugagcuacuccuaccuggcggugcucgugcccguguuccugcugaccgacuaccuccgcuacacccccguccugcugcuccagggccugagcuucguguccguguggcugcuccugcugcucgggcacagcgucgcccacaugcagcugauggagcuguucuacuccgugacgauggccgcccggaucgccuacagcuccuacaucuucagccucgugcgccccgcgcgguaccagcgcgucgccggcuacucccgggccgccgugcugcugggcguguucaccagcuccguccucgggcagcugcuggugaccgugggccgcgucagcuucuccacccucaacuacaucagccuggcguuccugacguucuccguggugcucgcccuguuccugaagcggccgaagcgcagccucuucuucaaccgggacgaccgcgggcggugcgagaccagcgccuccgagcuggagcgcaugaaccccggccccgggggcaagcugggccacgcccuccgggucgccugcggggacagcgugcuggcgcgcaugcugcgggagcucggcgacucccugcgccggccccagcugcgccucuggagccuguggugggucuucaacuccgccggguacuaccuggugguguacuacguccacauccucuggaacgagguggacccgaccaccaacagcgcccgcguguacaacggcgccgccgacgcggccuccacgcugcugggcgccaucaccagcuucgccgccggguucgucaagauccggugggcgcgcugguccaagcuccugaucgccggcgugaccgccacccaggccgggcugguguuccugcucgcccacacgcggcaccccagcuccaucuggcugugcuacgcggccuucguccuguuccgcggcagcuaccaguuccucgugcccaucgccaccuuccagaucgccuccagccuguccaaggagcugugcgcgcucguguucggggucaacaccuucuucgccaccaucgugaagacgaucaucaccuucaucgugagcgacguccggggccugggccugcccgugcgcaagcagaacgaggagcuccacguggccucccugagccuguggaagucccaccuccggcuggccgccgacacccugagcagcgagggguccagcggcuccgggccgcgcagcugguuccucucccccacccugcgggcggcccugcacggccccgucugccccagcgaggugugcccguccuga

SEQ ID NO: 36488 - RNA, 1494 nt, Artificial Sequence
  derived and/or modified sequence opt1 from SLC19A2__Homo_sapiens__NP_008927
auggacgugcccggcccggucagccgccgggccgccgcggccgccgccaccgugcugcuccgcaccgcccgggugcgccgggagugcugguuccugcccacggcgcugcucugcgccuacggguucuucgccucccugcgccccagcgagcccuuccugaccccguaccuccugggccccgacaagaaccugaccgagcgggaggucuucaacgagaucuaccccguguggaccuacuccuaccucgugcugcuguuccccgucuuccucgccacggacuaccugcgcuacaagccgguggugcugcuccaggggcugagccugaucgucaccugguucaugcuccuguacgcgcagggccugcucgccauccaguuccuggaguucuucuacgggaucgccaccgccaccgagaucgccuacuacuccuacaucuacagcgugguggaccugggcauguaccagaaggucacguccuacugccggagcgcgacccucgugggcuucaccgugggguccguccugggccagauccuggugagcguggccggguggucccucuucagccugaacgucaucucccugaccugcgugagcguggccuucgccgucgccugguuccuccccaugccccagaagucccuguucuuccaccacauccccagcacgugccagcgcgugaacggcaucaaggugcagaacgggggcaucgucaccgacaccccggcguccaaccaccuccccggcugggaggacaucgagagcaagaucccccugaacauggaggagcccccgguggaggagcccgagcccaagcccgaccggcugcugguccucaaggugcuguggaacgacuuccugaugugcuacuccagccgcccgcuccugugcuggagcguguggugggcccuguccacgugcggguacuuccaggucgugaacuacacccagggccucugggagaaggugaugcccagccgguacgccgccaucuacaacgggggcgucgaggccguguccacccugcugggcgcgguggccgucuucgccgugggguacaucaagaucagcugguccaccuggggcgagaugacccucagccuguucucccugcucaucgccgccgcgguguacaucauggacacggucgggaacaucugggugugcuacgccagcuacguggucuuccgcaucaucuacaugcugcugaucaccaucgccaccuuccagaucgccgcgaaccuguccauggagcgguacgcccucguguucggcgugaacaccuucaucgcccuggcccugcagacgcuccugacccugaucgucguggacgccagcgggcucggccuggagaucaccacccaguuccugaucuacgcguccuacuucgcccucaucgccguggucuuccuggccagcggcgccguguccgugaugaagaagugccgcaagcuggaggacccccagagcuccagccaggucacgaccuccuga

SEQ ID NO: 36489 - RNA, 1479 nt, Artificial Sequence
  derived and/or modified sequence opt1 from SLC19A3__Homo_sapiens__XP_005246931
augaacccccugggcagcgccucccgcgccaccguggaccagcucaccgaccugccgagcaaggagcagcuguccugcgucguguucgcgcucuggccgcccgccuucagcuccaaccugagcgaccccggggugaagaucacgaacgagaucuuccccgucuggaccuacuccuaccuggugcuccugcugcccguguucguccucaccgacuacgugcgguacaagcccgugaucauccugcagggcaucagcuucaucaucaccuggcugcuccugcuguucgggcagggcgucaagacgaugcaggucguggaguucuucuacgggauggugaccgccgccgagguggccuacuacgcguacaucuacuccguggucagccccgagcacuaccagcgcguguccggcuacugccggagcgugacccucgccgccuacaccgccggcuccguccuggcgcagcugcucgugagccuggccaacauguccuacuucuaccugaacgugaucagccucgccuccgucagcguggccuuccuguucucccuguuccucccgaugcccaagaaguccauguucuuccacgccaagcccagccgcgagaucaagaaguccagcagcgugaaccccguccuggaggagacgcacgagggggaggcgccgggcugcgaggagcagaagcccaccagcgagauccuguccaccagcgggaagcucaacaagggccagcugaacucccugaagcccagcaacgugaccgucgacguguucgugcagugguuccaggaccucaaggagugcuacuccagcaagcggcuguucuacuggucccuguggugggccuucgccacggccggguucaaccagguccucaacuacgugcagauccugugggacuacaaggcccccagccaggacuccagcaucuacaacggcgcgguggaggccaucgccaccuucggcggggccgucgccgcguucgccgugggcuacgugaaggucaacugggaccugcucggggagcuggcccuggugguguucuccgucgugaacgccggcagccucuuccugaugcacuacaccgccaacaucugggcgugcuacgccggcuaccugaucuucaaguccagcuacaugcuccugaucaccaucgccguguuccagaucgccgucaaccugaacguggagcgcuacgcgcucguguucgggaucaacacguucaucgcccuggucauccagaccaucaugaccgugaucguggucgaccagcggggccugaaccucccgguguccauccaguuccugguguacgggagcuacuucgccgucaucgccggcaucuuccugaugcgcagcauguacaucaccuacuccaccaagagccagaaggacgugcagucccccgcccccagcgagaaccccgacgugucccacccggaggaggagagcaacaucaucauguccacgaagcuguga

SEQ ID NO: 36490 - RNA, 1575 nt, Artificial Sequence
  derived and/or modified sequence opt1 from SLC1A1__Homo_sapiens__NP_004161
augggcaagcccgcccgcaaggggugcgaguggaagcgguuccugaagaacaacugggugcuccugagcaccgucgccgcgguggugcugggcaucaccacggggguccucgugcgcgagcacuccaaccugagcacccuggagaaguucuacuucgccuucccgggcgagauccucaugcggaugcugaagcugaucauccucccccugaucaucuccagcaugaucaccgggguggccgcccuggacuccaacgucagcggcaagaucggccuccgcgccgugguguacuacuucugcaccacgcugaucgcggucauccuggggaucgugcucguggucuccaucaagcccggcgugacccagaaggugggggagaucgcccggaccggcagcacccccgaggucuccacgguggacgccaugcuggaccugauccgcaacauguucccggagaaccucgugcaggccugcuuccagcaguacaagaccaagcgggaggaggucaagccgcccagcgaccccgagaugaacaugaccgaggaguccuucaccgcggugaugacgaccgccaucagcaagaacaagaccaaggaguacaagaucguggggauguacuccgacggcaucaacguccugggccugaucguguucugccucguguucgggcuggucaucggcaagaugggggagaagggccagauccugguggacuucuucaacgcccucagcgacgccaccaugaagaucguccagaucaucaugugcuacaugccccugggcauccuguuccucaucgccgggaagaucaucgagguggaggacugggagaucuuccgcaagcugggccuguacauggcgacggugcucaccgggcuggccauccacuccaucgucauccugccccucaucuacuucaucguggugcggaagaaccccuuccgcuucgccaugggcauggcccaggcccugcugaccgcgcucaugaucagcuccagcuccgccacccugcccgucacguuccggugcgccgaggagaacaaccagguggacaagcgcaucacccgguucgugcugccggucggggccaccaucaacauggacggcaccgcccucuacgaggcgguggccgccguguucaucgcccagcugaacgaccuggaccucggcaucgggcagaucaucacgaucagcaucaccgccaccagcgcguccaucggcgccgccggggucccccaggccggccuggugaccauggugaucguccugagcgcgguggggcuccccgccgaggacgugacgcugaucaucgccgucgacuggcugcucgaccgcuuccggaccauggugaacgugcugggcgacgccuucggcaccgggaucgucgagaagcuguccaagaaggagcuggagcagauggacgugagcuccgaggugaacaucgucaaccccuucgcccucgagagcaccauccuggacaacgaggacuccgacacgaagaaguccuacgugaacggcggguucgcgguggacaagagcgacaccaucagcuucacccagaccucccaguucuga

SEQ ID NO: 36491 - RNA, 1698 nt, Artificial Sequence
  derived and/or modified sequence opt1 from SLC1A2__Homo_sapiens__NP_001182657
augcccaagcaggucgaggugcgcaugcacgacagccaccugggcuccgaggagccgaagcaccggcaccucgggcugcgccugugcgacaagcucggcaagaaccugcugcucacccugaccguguucggggugauccugggcgccgucugcgggggccuccugcggcuggccagccccauccaccccgacguggugaugcucaucgcguuccccggcgacauccugaugcgcaugcugaagaugcucauccugccgcugaucaucuccagccucaucacggggcuguccggccuggacgccaaggccagcgggcggcucggcacccgcgccauggucuacuacauguccaccaccaucaucgccgcggugcugggggugauccugguccucgccauccaccccggcaaccccaagcugaagaagcagcugggccccgggaagaagaacgacgaggugagcucccucgacgccuuccuggaccugauccggaaccucuucccggagaaccuggugcaggccugcuuccagcagauccagacggucaccaagaaggugcugguggcgcccccgcccgacgaggaggccaacgccaccagcgccgucgugucccuccugaacgagaccgugacggagguccccgaggagaccaagauggugaucaagaagggccuggaguucaaggacgggaugaacgugcucggccugaucggcuucuucaucgccuucgggaucgcgaugggcaagaugggggaccaggccaagcugauggucgacuucuucaacauccucaacgagaucgugaugaagcuggugaucaugaucaugugguacagcccccugggcaucgccugccucaucugcgggaagaucaucgccaucaaggaccuggaggucguggcccgccagcugggcauguacauggucaccgugaucaucggccucaucauccacgggggcaucuuccugccccugaucuacuucguggucacccggaagaaccccuucuccuucuucgcggggaucuuccaggccuggaucacggcccucggcaccgccagcuccgccgggacccugccggugaccuuccgcugccuggaggagaaccugggcaucgacaagcgggugacgcgcuucguccuccccgugggcgcgaccaucaacauggacgggaccgcccuguacgaggccguggccgccaucuucaucgcgcagaugaacggcgucgugcuggacgggggccagaucgugaccgucagccucacggccacccuggccuccgugggggccgcgagcauccccuccgccggccuggugaccaugcuccugauccugaccgccgucggccuccccacggaggacaucagccugcugguggccguggacuggcuccuggaccggaugcgcaccagcgucaacguggugggggacuccuucggcgccgggaucgucuaccaccugagcaaguccgagcucgacaccaucgacagccagcaccgggugcacgaggacaucgagaugaccaagacgcaguccaucuacgacgacaugaagaaccaccgcgagagcaacuccaaccagugcguguacgcggcccacaacagcgucaucguggacgagugcaaggugacccuggccgccaacggcaaguccgccgacugcagcgucgaggaggagccguggaagcgggagaaguga

SEQ ID NO: 36492 - RNA, 1494 nt, Artificial Sequence
  derived and/or modified sequence opt1 from SLC1A3__Homo_sapiens__NP_001160167
augaccaagagcaacggcgaggagcccaagaugggcgggcgcauggagcgguuccagcagggggugcgcaagcggacccugcucgccaagaagaagguccagaacaucacgaaggaggacgugaaguccuaccuguuccgcaacgccuucgugcugcucaccgucaccgcggugaucgugggcaccauccugggguucacgcugcggccguaccgcaugagcuaccgggaggucaaguacuucuccuuccccggcgagcuccugaugcgcaugcugcagaugcucgugcugccccugaucaucagcucccucgugaccggcauggccgcccuggacagcaaggccuccgggaagaugggcaugcgggccgucguguacuacaugaccaccacgaucaucgcgguggucaucgggaucaucaucgugaucaucauccaccccggcaaggggaccaaggagaacaugcaccgcgagggcaagaucgugcgggucaccgccgccgacgccuuccuggaccucauccgcaacauguucccgcccaaccugguggaggcgugcuucaagcaguucaagaccaacuacgagaagcggagcuucaaggugcccauccaggccaacgagacgcuggucggcgccgugaucaacaacguguccgaggccauggagacccucacccgcaucaccgaggagcugguccccgugccggggagcgugaacggcgucaacgcccuggggcucguggucuucuccaugugcuucggcuucgugaucggcaacaugaaggagcaggggcaggcgcugcgggaguucuucgacagccugaacgaggccaucaugcgccucguggccgucaucaugugguacgcccccgugggcauccuguuccugaucgccgggaagaucguggagauggaggacaugggcgucaucgggggccagcucgcgauguacacggugaccgugaucgucggccugcugauccacgccgugaucgugcucccccugcuguacuuccucgucacccggaagaaccccuggguguucaucgggggccugcugcaggcccucaucaccgcccuggggacguccagcuccagcgccacccugccgaucaccuucaagugccucgaggagaacaacggcguggacaagcgcgucacccgguucgugcugcccgugggggcgacgaucaacauggacggcaccgcccuguacgaggcccucgccgccaucuucaucgcgcaggucaacaacuucgagcugaacuucggccagaucaucaccauccgcgaccggcugcgcaccacgaccaacgugcucggggacucccugggcgccgggaucguggagcaccugagccgccacgagcucaagaaccgggacgucgagaugggcaacuccgugaucgaggagaacgagaugaagaagcccuaccagcugaucgcccaggacaacgagaccgagaagcccaucgacagcgagaccaagauguga

SEQ ID NO: 36493 - RNA, 705 nt, Artificial Sequence
  derived and/or modified sequence opt1 from SLC1A4__Homo_sapiens__NP_001180422
augaacauccugggccucgugcuguucgcccugguccucgggguggcccugaagaagcugggcagcgagggggaggaccucauccgcuucuucaacucccugaacgaggcgaccauggugcuggucagcuggaucaugugcuccgccacccuccccagcaugaugaagugcaucgaggagaacaacggcguggacaagcggaucucccgcuucauccugccgaucggggccacggugaacauggacggcgccgccaucuuccagugcgucgcggccguguucaucgcccagcugaacaacguggagcucaacgccggccagaucuucaccauccuggucaccgcgaccgccagcuccgugggggccgccggcgugcccgccgggggcguccugacgaucgcgaucauccucgaggccaucgggcugcccacccacgaccugccccucauccuggccguggacuggaucguggaccggaccaccacggucgugaacguggagggcgacgcccugggcgccgggauccuccaccaccugaaccagaaggcgaccaagaagggcgagcaggagcuggccgaggucaagguggaggccaucccgaacugcaagagcgaggaggagaccagcccccucgugacccaccagaaccccgccgggcccgucgccuccgcgccggagcuggaguccaaggagagcgugcuguga

SEQ ID NO: 36494 - RNA, 942 nt, Artificial Sequence
  derived and/or modified sequence opt1 from SLC1A5__Homo_sapiens__NP_001138616
augaacauccugggccucguggucuucgccaucguguucgggguggcccugcgcaagcugggccccgagggggagcuccugauccgguucuucaacagcuucaacgaggcgaccaugguccugguguccuggaucaugugguacgccccggugggcaucauguuccucgucgccgggaagaucguggagauggaggacgugggccugcuguucgcccgccucggcaaguacauccugugcugccugcucgggcacgccauccacggccugcugguccucccccugaucuacuuccuguucacccggaagaaccccuaccgcuuccucugggggaucgugacgccccuggcgaccgccuucggcaccagcuccagcuccgccacccugccgcucaugaugaagugcguggaggagaacaacggggucgccaagcacaucagccgguucauccugcccaucggcgcgacggugaacauggacggcgccgcccuguuccagugcguggccgccgucuucaucgcgcagcucucccagcagagccuggacuucgugaagaucaucaccauccuggugaccgccaccgccuccagcgucggggccgccggcauccccgccgggggcgugcucacgcuggcgaucauccuggaggccgugaaccuccccgucgaccacaucucccugauccuggccguggacuggcucguggaccgcagcugcaccguccugaacguggagggcgacgcccugggggcgggccuccugcagaacuacgucgaccggaccgagucccgcagcaccgagccggagcugauccaggugaaguccgagcucccccuggacccccugcccgugccgacggaggaggggaacccccuccugaagcacuaccggggccccgccggggacgccaccgucgccagcgagaaggaguccgugauguga

SEQ ID NO: 36495 - RNA, 939 nt, Artificial Sequence
  derived and/or modified sequence opt1 from SLC1A6__Homo_sapiens__NP_001259017
augagcucccacggcaacagccuguuccuccgcgaguccgggcagcggcugggccgcgugggguggcugcagcggcuccaggagagccugcagcagcgcgcccugcggacccgccuccggcugcagaccaugacgcuggagcacguccuccgcuuccugcggcgcaacgccuucauccugcucaccguguccgcgguggucaucggcgugagccuggccuucgcccugcggcccuaccagcucaccuaccgccagaucaaguacuucuccuucccgggggagcugcugaugcggaugcuccagaugcuggugcugccccucaucgucagcucccuggugaccggcauggccagccuggacaacaaggccacgggccgcauggggaugcgggcggccguguacuacauggucaccaccaucaucgccguguucaucggcauccucauggugaccaucauccaccccgggaagggcuccaaggaggggcugcaccgcgagggccggaucgagacgauccccaccgccgacgcguucauggaccugauccgcaacauguucccgcccaaccucgucgaggccugcuucaagcaguucaagacccaguacagcacccggguggugacgcgcaccaugguccggaccgagaacggcuccgagcccggggccagcaugcccccgcccuucuccguggagaacggcaccagcuuccuggagaacgugacgcgcgcccuggggacccuccaggagaugcuguccuucgaggagaccguccccgugcccggcagcgccaacggcaucaacgcgcuggggcucguggucuucuccguggccuucggccuggugaucgggggcaugaagcacaaggggcgcguccugcgggacuucuucgacagccucaacgaggccaucaugcgccuggugggcaucaucaucugguga

SEQ ID NO: 36496 - RNA, 2040 nt, Artificial Sequence
  derived and/or modified sequence opt1 from SLC20A1__Homo_sapiens__NP_005406
auggccacccugaucaccagcacgaccgccgcgaccgccgccuccggcccccucguggacuaccuguggaugcugauccucggguucaucaucgccuucguccuggccuucagcgugggcgcgaacgacguggccaacuccuucgggaccgccgucggcagcgggguggugacgcugaagcaggccugcauccucgcguccaucuucgagaccgucggcagcgugcugcugggcgccaagguguccgagaccauccgcaaggggcucaucgacgucgagauguacaacagcacccagggccugcugauggccggguccgugagcgccauguucggcuccgccguguggcagcucgucgcgagcuuccugaagcugccgaucuccgggacgcacugcaucgugggcgccaccaucggcuucagccucguggccaaggggcaggagggcgucaagugguccgagcugaucaagaucgugaugagcugguucgugagcccccugcucuccgggaucauguccggcauccuguucuuccugguccgggccuucauccuccacaaggccgaccccgugcccaacggccugcgcgcgcugccgguguucuacgccugcaccgucgggaucaaccucuucagcaucauguacaccggcgcgccccugcugggguucgacaagcucccccuguggggcacgauccugaucagcguggggugcgccguguucugcgcccucaucgucugguucuucgugugcccccggaugaagcgcaagaucgagcgggagaucaagugcuccccgagcgagagcccccugauggagaagaagaacucccugaaggaggaccacgaggagaccaagcucuccgucggcgacaucgagaacaagcaccccgugagcgaggugggccccgccaccgucccgcugcaggccgugguggaggagcgcaccgucuccuucaagcugggggaccucgaggaggcccccgagcgggagcgccugcccagcguggaccugaaggaggagacguccaucgacagcaccgugaacggcgccguccagcuccccaacgggaaccuggugcaguucucccaggccgugagcaaccagaucaacuccagcggccacuaccaguaccacaccguccacaaggacuccgggcuguacaaggagcuccugcacaagcugcaccucgcgaaggugggcgacugcaugggcgacagcggggacaagccgcugcggcgcaacaacuccuacaccagcuacacgauggccaucugcggcaugccccuggacuccuuccgggccaaggagggggagcagaagggcgaggagauggagaagcucaccuggcccaacgccgacagcaagaagcgcauccggauggacagcuacaccuccuacugcaacgcggugagcgaccugcacuccgccagcgagaucgacauguccgucaaggccgagauggggcugggcgaccgcaagggcagcaacgggucccuggaggagugguacgaccaggacaagcccgaggugagccuccuguuccaguuccugcagauccucaccgccugcuucggcuccuucgcccacgggggcaacgacgugagcaacgcgaucggcccgcuggucgcccuguaccucguguacgacacgggggacguguccagcaaggucgccacccccaucuggcugcugcucuacggcggggugggcaucugcguggggcugugggucuggggccggcgcgugauccagaccaugggcaaggaccugacccccaucacgcccuccagcggguucuccaucgagcucgccagcgcccugaccguggucaucgcguccaacaucggccugccgaucagcaccacccacugcaagguggggagcguggucuccgugggcuggcuccggagcaagaaggccguggacuggcgccuguuccggaacaucuucauggccugguucgucacggugcccaucuccggggugaucagcgccgccaucauggcgaucuuccgcuacgucauccugcggauguga

SEQ ID NO: 36497 - RNA, 1959 nt, Artificial Sequence
  derived and/or modified sequence opt1 from SLC20A2__Homo_sapiens__XP_005273670
auggccauggacgaguaccuguggauggugauccucggcuucaucaucgccuucauccuggcguucagcgucggggccaacgacguggccaacuccuucggcaccgccguggggagcggcgucgugacccugcgccaggccugcauccucgcguccaucuucgagacgaccgggagcgugcugcugggcgccaaggucggcgagaccauccggaaggggaucaucgacgugaaccucuacaacgagaccguggagacgcugauggccggcgaggucuccgccaugguggggagcgcgguguggcagcugaucgccuccuuccuccgccugcccaucagcggcacccacugcaucgucggguccaccaucggcuucagccugguggccaucggcaccaagggggugcaguggauggagcucgucaagaucguggccuccugguucaucagcccgcugcuguccggcuucaugagcgggcuccuguucgugcugauccggaucuucauccucaagaaggaggaccccguccccaacggccugcgcgcccugcccguguucuacgcggccacgaucgccaucaacguguucuccaucauguacaccggcgccccgguccucgggcuggugcugcccaugugggccaucgcgcucaucagcuucggcguggcccugcuguucgccuucuucgucuggcuguucgugugccccuggaugcggcgcaagaucaccgggaagcuccagaaggagggcgcccugucccgggucagcgacgagucccucagcaaggugcaggaggccgagagccccguguucaaggagcugccgggggcgaaggccaacgacgacuccaccaucccccugacgggcgccgccggcgagacccucgggaccagcgagggcaccuccgccgggagccacccccgcgcggccuacggccgggcccuguccaugacgcacgggagcgucaagucccccaucagcaacggcaccuucggcuucgacgggcacacccgcuccgacggccacguguaccacaccgugcacaaggacagcgggcuguacaaggaccuccugcacaagauccacaucgaccggggcccggaggagaagcccgcccaggaguccaacuaccgccugcuccggcgcaacaacagcuacacgugcuacaccgcggccaucugcgggcugcccguccacgccaccuuccgggccgccgacuccagcgcgcccgaggacuccgagaagcuggugggcgacaccgugagcuacuccaagaagcgccuccgguacgacagcuacuccagcuacugcaacgccgucgccgaggccgagaucgaggccgaggagggcgggguggagaugaagcuggcgagcgagcuggccgacccggaccagccccgcgaggaccccgccgaggaggagaaggaggagaaggacgcccccgaggugcaccuccuguuccacuuccugcagguccucacggccugcuucggcuccuucgcgcacgggggcaacgacgugagcaacgccaucggcccgcugguggcccuguggcugaucuacaagcagggcggggucacccaggaggccgcgacccccguguggcuccuguucuacgggggcguggggaucugcaccggccugugggucuggggccggcgcgugauccagacgauggggaaggaccucacccccaucacccccuccagcggcuucaccaucgagcuggccuccgccuucacgguggucaucgccagcaacaucgggcugccgguguccaccacccacugcaaggugggcagcgucguggccgugggguggauccggucccgcaaggcggucgacuggcgccucuuccggaacaucuucguggccugguucgugaccguccccguggccggccuguucagcgccgccgugauggcgcugcucauguacggcauccugcccuacgucuga

SEQ ID NO: 36498 - RNA, 1653 nt, Artificial Sequence
  derived and/or modified sequence opt1 from SLC22A11__Homo_sapiens__NP_060954
auggccuucagcaagcugcucgagcaggccggcggggugggccuguuccagacccugcagguccucaccuucauccugcccugccugaugaucccgucccagaugcuccuggagaacuucagcgcggccauccccgggcaccgcugcuggacgcacaugcuggacaacggcuccgccgugagcaccaacaugacccccaaggcccuccugaccaucuccaucccgcccgggcccaaccagggcccccaccagugccggcgcuuccggcagccccaguggcagcugcucgacccgaacgccacggcgaccagcugguccgaggccgacaccgagcccugcguggacggcugggucuacgaccgcagcguguucaccuccacgaucguggccaagugggaccuggucugcagcucccaggggcugaagccccucagccaguccaucuucaugagcggcauccuggugggguccuucaucuggggccugcucagcuaccgguucgggcgcaagcccaugcuguccuggugcugccugcagcucgccguggcgggcaccagcaccaucuucgccccgaccuucgucaucuacugcggccugcgguucguggccgccuucgggauggccggcaucuuccuguccagccucacgcugaugguggaguggaccaccaccagccgccgggcggucacgaugaccgugguggggugcgccuucuccgccggccaggccgcccugggcgggcucgcguucgcccugcgcgacuggcggacccugcagcucgccgccagcguccccuucuucgccaucucccugaucagcugguggcugcccgaguccgcgcgcuggcucaucaucaagggcaagcccgaccaggcccugcaggagcugcggaagguggcccgcaucaacgggcacaaggaggccaagaaccucaccaucgaggugcugaugagcuccgucaaggaggagguggccagcgcgaaggagccgcgguccgugcuggaccucuucugcguccccgugcugcgcuggcggagcugcgccaugcugguggucaacuucucccuccugaucagcuacuacggccugguguucgaccuccagucccuggggcgcgacaucuuccugcuccaggcccuguucggcgccgucgacuuccugggccgggcgacgaccgcccugcuccugagcuuccuggggcgccggaccauccaggccggcucccaggccauggccgggcucgcgauccuggccaacaugcuggugccccaggaccuccagacccugcgcguggucuucgccgugcugggcaaggggugcuucggcaucagccucacgugccugaccaucuacaaggccgagcuguuccccaccccggugcgcaugaccgccgacggcauccuccacacggucgggcggcugggcgcgaugauggggccccugauccucaugucccgccaggcccugccccugcugcccccgcuccuguacggcgugaucagcaucgccuccagccucgugguccuguucuuccugcccgagacccaggggcucccccugcccgacaccauccaggaccuggagagccagaaguccaccgccgcccagggcaaccggcaggaggcggugacgguggagagcaccucccucuga

SEQ ID NO: 36499 - RNA, 1560 nt, Artificial Sequence
  derived and/or modified sequence opt1 from SLC22A12__Homo_sapiens__NP_001263255
auggccuucagcgagcugcucgaccuggugggcgggcugggccgcuuccagguccuccagaccauggcccugaugguguccaucauguggcugugcacccagagcaugcucgagaacuucuccgcggccgugcccagccaccggugcugggccccgcugcuggacaacuccacggcccaggccagcauccucgggucccugagccccgaggcgcugcucgccaucuccaucccgcccggccccaaccagcgcccccaccagugccggcgcuuccggcagccccaguggcagcugcuggaccccaacgccaccgccaccagcugguccgaggcggacaccgagccgugcgucgacggguggguguacgaccgcagcaucuucacguccaccaucguggccaaguggaaccucgucugcgacagccacgcccugaagcccauggcccaguccaucuaccuggccggcauccucgugggcgcggccgccugcgggcccgccagcgaccgguucggccgccggcuggugcugaccugguccuaccuccagauggccgucauggugauggaguggaccgcggcccgcgcccggccccuggugaugacgcugaacagccucggguucuccuucggccacgggcugaccgccgccgucgcguacggcgugcgcgacuggacccugcuccagcugguggucagcgugccguucuuccugugcuuccucuacagcugguggcuggccgaguccgcccgguggcugcucaccacgggccgccuggacugggggcugcaggagcucuggcggguggccgccaucaacggcaagggggcgguccaggacacccugacccccgaggugcugcucagcgccaugcgcgaggagcuguccaugggccagccgcccgccagccugggcacccuccugcggaugcccgggcugcgcuuccggacgugcaucuccacccucugcugguucgccuucggcuucaccuucuucgggcuggcgcuggaccuccaggcccugggcagcaacaucuuccugcugcagauguucaucgggguggucgacauccccgccaagaugggcgcccuccugcugcucucccaccugggccgccggcccacccuggccgcgagccuccugcuggccgggcucugcauccuggccaacacgcuggugccccacgagaugggcgcccuccgcuccgcccuggcggugcuggggcucggcggggucggcgccgccuucacgugcaucaccaucuacagcuccgagcuguucccgaccgugcugcgcaugaccgccgucggccucgggcagauggccgcgcggggcggggccauccugggcccccuggugcgccuccugggggugcacggccccuggcugccccuccuggucuacggcaccgugccggugcugagcgggcucgccgcccugcugcuccccgagacccagucccugccccugcccgacaccauccaggacguccagaaccaggcggugaagaaggccacgcacggcacccucgggaacagcgugcugaaguccacccaguucuga

SEQ ID NO: 36500 - RNA, 1656 nt, Artificial Sequence
  derived and/or modified sequence opt1 from SLC22A13__Homo_sapiens__NP_004247
auggcccaguucgugcagguccuggccgagaucggcgacuucgggcgcuuccagauccagcuccugauccugcucugcgugcugaacuuccugagccccuucuacuucuucgcgcacguguucaugguccucgacgagccgcaccacugcgccguggccugggugaagaaccacaccuucaaccuguccgccgccgagcagcugguccucagcgugccccuggacaccgcgggccaccccgagcccugccugauguuccggccgccgcccgccaacgccucccuccaggacauccugagccaccgcuucaacgagacgcagcccugcgacauggggugggaguaccccgagaaccggcugcccucccucaagaacgaguucaaccuggugugcgaccgcaagcaccugaaggacaccacccagagcgucuucauggccggccuccugguggggacccugauguucggcccccucugcgaccggaucggccgcaaggcgacgauccuggcccagcugcuccuguucacccugaucgggcucgccaccgccuucgugcccuccuucgagcuguacauggcccugcgguucgcggucgccaccgccguggccggccucagcuucuccaacgugacgcugcugaccgagugggucgggccgagcuggcgcacccaggccguggugcucgcgcagugcaacuucucccugggccagaugguccuggccgggcucgccuacggcuuccggaacuggcgccugcugcagaucaccggcacggcccccgggcuccugcuguucuucuacuucugggcccuccccgagagcgcgcgguggcugcugacccgcggccggauggacgaggccauccagcucauccagaaggccgccuccgugaaccgccggaagcugagccccgagcugaugaaccagcucgugccggagaagaccgggcccuccggcaacgcccuggaccuguuccgccacccccagcugcggaaggucacccucaucaucuucugcgugugguucguggacagccugggcuacuacgggcugucccuccaggucggcgacuucgggcuggacguguaccugacgcagcucaucuucggcgcggucgaggugcccgcccgcugcagcuccaucuucaugaugcagcgguucgggcgcaaguggagccagcugggcacccuggugcucggcgggcugaugugcaucaucaucaucuucaucccggccgaccugcccgucguggugaccaugcucgccgucgugggcaagauggcgaccgccgccgccuucacgaucagcuacguguacuccgccgagcuguuccccaccauccugcggcagaccgggaugggccucgucgggaucuucagccgcaucggcggcauccugacgccccuggugauccuccugggggaguaccacgcggcccugccgaugcucaucuacggcucccugcccaucguggccgggcugcucugcacccugcugcccgagacccacggccaggggcucaaggacacccugcaggaccuggagcucggcccccacccgcgcagccccaaguccguccccagcgagaaggagaccgaggccaagggccggacguccagcccggggguggccuucguguccagcaccuacuucuga

SEQ ID NO: 36501 - RNA, 1785 nt, Artificial Sequence
  derived and/or modified sequence opt1 from SLC22A14__Homo_sapiens__NP_004794
auggccggcgaggagaacuucaaggaggagcugcgcagccaggacgccucccggaaccucaaccagcacgagguggcggggcacccccacagcuggucccuggagaugcugcuccgccggcugcgcgccguccacaccaagcaggacgacaaguucgccaaccugcucgacgccgugggcgaguucgggaccuuccagcagcggcugguggcccugacguucaucccgagcaucauguccgcguucuucauguucgccgaccacuucgucuucaccgcccagaagcccuacugcaacaccagcuggauccucgccgugggcccccaccuguccaaggcggagcagcugaaccucaccaucccccaggccccgaacgggagcuuccugacgugcuucauguaccugcccgugcccuggaaccucgacuccaucauccaguucggccugaacgacaccgacacgugccaggacggcuggaucuaccccgacgccaagaagcgcagccugaucaacgaguucgaccucgucugcgggauggagaccaagaaggacaccgcccagaucauguucauggccggccugccgaucgggucccugaucuuccggcucaucaccgacaagaugggccgcuaccccgcgauccugcugagccuccuggggcugaucaucuucggcuucggcaccgccuucaugaacuccuuccaccucuaccuguucuuccgguucgggaucagccaguccguggugggcuacgccaucagcuccaucagccuggccaccgaguggcucgucggggagcaccgcgcccacgcgaucauccugggccacugcuucuucgccgugggcgccgugcugcucacggggaucgccuacucccugccccacuggcagcugcuguuccuggucggcgggauccuggugauccccuucaucagcuacaucuggauccucccggagagcccccgguggcugaugaugaagggcaaggugaaggaggccaagcagguccugugcuacgcggccuccgugaacaagaagaccauccccagcaaccuccuggacgagcugcagcucccccgcaagaaggugacccgggccuccguccuggacuucugcaagaaccgccagcugugcaaggugacccucgugaugagcugcgucugguucacgguguccuacaccuacuucacccugagccugcggaugcgcgagcuggggguguccguccacuuccggcacguggucccgagcaucauggaggugcccgcccgccucugcugcaucuuccugcugcagcagaucggccggaaguggucccucgccgugacccugcugcaggcgaucaucuggugccuccugcuccucuuccugcccgagggcgaggacgggcugcgccucaaguggccccggugcccggccacggagcucaagagcaugaccauccugguccugaugcugcgcgaguucucccuggccgccaccgugaccguguucuuccucuacacggcggagcugcugcccaccguccuccgcgccaccggccuggggcuggugagccucgccuccguggccggcgccauccugagccugaccaucaucucccagacgcccagccuccugcccaucuuccugugcugcguccucgcgaucguggccuucucccugagcucccugcucccggagacccgggaccagccccugagcgagagccugaaccacuccagccagauccgcaacaaggugaaggacaugaagaccaaggagaccuccagcgacgacgucuga

SEQ ID NO: 36502 - RNA, 1734 nt, Artificial Sequence
  derived and/or modified sequence opt1 from SLC22A16__Homo_sapiens__NP_149116
augggcagccgccacuucgaggggaucuacgaccacgugggccacuucgggcgguuccagcgcguccuguacuucaucugcgccuuccagaacaucuccugcggcauccacuaccucgccagcguguucaugggggugacgccccaccacgucugccggccgcccggcaacgugucccagguggucuuccacaaccacagcaacuggucccuggaggacaccggcgcgcugcucagcuccgggcagaaggacuacgugaccgugcagcugcagaacggcgagaucugggagcugagccgcugcucccggaacaagcgcgagaacaccagcucccucggguacgaguacaccggcagcaagaaggaguuccccugcgucgacggguacaucuacgaccagaacaccuggaaguccaccgccgugacccaguggaaccuggugugcgaccggaaguggcuggccaugcucauccagccccuguucauguucggcguccugcucggcagcgugaccuucggguacuucuccgaccgccugggccggcgcgugguccugugggccaccagcuccagcauguuccucuucgggaucgccgcggccuucgccguggacuacuacacguucauggccgcgcgguucuuccuggccaugguggccuccggcuaccuggucgugggcuucguguacgucauggaguucaucgggaugaagucccgcaccugggccagcgugcaccuccacagcuucuucgccgugggcacccugcuggucgcgcucaccggguaccuggugcggacgugguggcuguaccagaugauccucagcaccgucaccgugccguucauccugugcugcugggugcugcccgagacccccuucuggcuccuguccgagggccgcuacgaggaggcccagaagaucgucgacaucauggccaaguggaaccgggccagcuccugcaagcugagcgagcuccugucccuggaccuccaggggcccgugagcaacuccccgacggaggugcagaagcacaaccugagcuaccuguucuacaacugguccaucaccaagcgcacccucaccgucuggcugaucugguucacgggcagccugggcuucuacuccuucagccucaacuccgugaaccucgggggcaacgaguaccugaaccuguuccugcuggggguggucgagauccccgccuacaccuucgugugcaucgcgauggacaaggugggccggcgcaccguccucgccuacagccuguucugcuccgcccuggccugcgggguggugauggucaucccccagaagcacuacauccucggcguggugaccgccauggucggcaaguucgcgaucggggccgccuucggccugaucuaccuguacacggccgagcuguaccccaccaucgugcggagccucgccgugggguccggcagcauggucugccgccuggcgagcauccuggccccguucuccguggaccucagcuccaucuggaucuucaucccccagcuguucguggggaccauggcccugcucagcggcguccugacccugaagcuccccgagacgcugggcaagcggcuggccaccaccugggaggaggcggccaagcucgaguccgagaacgagagcaaguccagcaagcugcugcucaccacgaacaacuccgggcuggagaagaccgaggccaucacgccccgcgacagcggccugggggaguga

SEQ ID NO: 36503 - RNA, 1563 nt, Artificial Sequence
  derived and/or modified sequence opt1 from SLC22A17__Homo_sapiens__NP_057693
auggccagcgaccccaucuucacccuggccccgccccuccacugccacuacggcgcguucccgcccaacgccuccgggugggagcagccgcccaacgccagcggcguguccgucgccagcgccgcgcuggccgccuccgccgcgagccgcguggccaccuccacggaccccagcugcuccggguucgccccgcccgacuucaaccacugccugaaggacugggacuacaacggccuccccgugcugaccaccaacgccaucgggcagugggaccuggucugcgaccucggcuggcaggucauccuggagcagauccuguucauccucggcuucgccagcggguaccuguuccugggcuaccccgcggaccgguucgggcgccggggcaucgugcuccugacccuggggcucgugggccccugcggcgucgggggcgccgccgccggguccagcacgggcgugauggcccugcgcuuccugcucggcuuccugcuggcggggguggaccucggcguguaccugaugcggcuggagcucugcgaccccacccagcgccugcggguggcccuggccggggagcucgucggcgucgggggccacuuccuguuccugggccucgcccugguguccaaggacuggcgcuuccugcagcggaugaucaccgcccccugcauccucuuccuguucuacggguggcccggccuguuccucgagagcgcgcgcuggcugaucgugaagcggcagaucgaggaggcccaguccgugcugcgcauccucgccgagcggaaccgcccccacgggcagaugcugggcgaggaggcccaggaggcccugcaggaccucgagaacacgugcccgcugcccgcgaccagcuccuucagcuucgccucccugcucaacuaccggaacaucuggaagaaccugcugauccucggguucaccaacuucaucgcccacgccauccgccacugcuaccagcccgugggcggcgggggcagccccagcgacuucuaccugugcucccugcuggcgagcgggaccgccgcccucgccugcgucuuccugggcgugaccguggaccgguucgggcgccggggcauccugcuccuguccaugacgcugaccggcaucgccagccucguccugcuggggcucugggacuaccugaacgaggcggccaucaccaccuucuccgugcugggccucuucagcucccaggccgccgccauccugagcacgcugcucgcggccgaggugaucccgaccaccguccgcgggcggggccugggccugaucauggcccucggggcccugggcgggcuguccggccccgcccagcgccuccacauggggcacggcgcguuccugcagcacgugguccuggccgccugcgcccuccugugcauccugagcaucaugcuccugcccgagaccaagcgcaagcugcuccccgaggugcugcgggacggcgagcugugccgccggccgucccuccugcgccagcccccgcccacgcggugcgaccacgugccccugcucgcgacccccaaccccgcccuguga

SEQ ID NO: 36504 - RNA, 453 nt, Artificial Sequence
  derived and/or modified sequence opt1 from SLC22A18AS__Homo_sapiens__NP_001289791
augcgcugcgccgagggcgccuggugguucagccccgacgggcccgcgggcuccgccgccagcaucuggcccgccgagggggccgagggccugcccgggcagcucggccgggaccgccuggagguggucuacuccgugcccgacaacgugccgggccagaacgggagccggcgcccccuggucugcaagaucaccggcaagugccucuccgugugcagcgaggagaacgcgaaggccgggggcugcuccgccuucccccugcugcucagccagcugggggcccggaugaccggccgcgagcacgcgcacaagggccccgagcugacgaccccggacuccgggcucccccggccgcccaaccccgcccuggccggcuuccgcgcccuggcccagcacagcccgccccucgggaccuccacccccagcgcggugcugcuguccgccgccacguga

SEQ ID NO: 36505 - RNA, 1275 nt, Artificial Sequence
  derived and/or modified sequence opt1 from SLC22A18__Homo_sapiens__NP_899056
augcagggcgcccgcgcgccccgggaccaggggcgcagcccgggccggauguccgcccuggggcgcagcuccgugauccuccugaccuacguccuggccgccaccgagcucacgugccuguucaugcaguucagcaucgugcccuaccugucccggaagcucggccuggacagcaucgccuucggguaccugcagaccaccuucggcgugcuccagcugcugggcgggcccgucuucggccgcuucgccgaccagcgcggggcgcgggccgcccucacccuguccuuccuggccgcgcucgcccuguaccugcuccuggccgccgccagcucccccgcgcugccgggcguguaccuccuguucgccagccggcugcccggggcccucaugcacacgcugcccgccgcccagauggugaucaccgaccuguccgcgcccgaggagcgcccggccgcccucggccggcugggccugugcuucggggucggcgugauccucgggagccugcugggcggcacccucguguccgccuacgggauccagugccccgccauccuggcggcccuggccacccuccugggcgccguccugagcuucacgugcauccccgccuccaccaagggggcgaagaccgacgcccaggcgccccucccgggcgggccccgcgccagcguguucgaccugaaggccaucgccucccugcuccggcugcccgacgugccccgcaucuuccuggucaagguggccagcaacugcccgaccggccucuucauggugauguucuccaucaucagcauggacuucuuccagcuggaggccgcccaggcgggcuaccugaugagcuucuucgggcuccugcagauggucacgcagggccuggugaucgggcagcuguccagccacuucuccgaggaggugcuccugcgggccagcguccugguguucaucguggucggccucgccauggccuggauguccagcguguuccacuucugccugcuggugcccgggcucgucuucucccugugcacccugaacguggucaccgacagcaugcucaucaaggccguguccaccagcgacacgggcaccaugcugggccugugcgcguccgugcagccccuccugcgcacccuggggcccaccgucggcgggcuccuguaccggagcuucggcgugccgguguucgggcacguccagguggccaucaacacgcuggugcuccugguccuguggcgcaagcccaugccccagcggaaggacaaggugcgcuga

SEQ ID NO: 36506 - RNA, 1665 nt, Artificial Sequence
  derived and/or modified sequence opt1 from SLC22A1__Homo_sapiens__NP_003048
augcccaccguggacgacauccuggagcaggucggcgagagcgggugguuccagaagcaggccuuccucauccugugccugcucuccgccgcguucgccccgaucugcgugggcaucguguuccugggguucacccccgaccaccacugccagagccccggcgucgccgagcugucccagcgcugcggguggagccccgccgaggagcucaacuacacggugccgggccugggccccgccggggaggcguuccugggccagugccggcgcuacgagguggacuggaaccaguccgcccucagcugcgucgacccccuggccucccuggccaccaaccggagccaccucccccuggggccgugccaggacggcuggguguacgacacccccggguccagcaucgugaccgaguucaaccuggucugcgcggacuccuggaagcucgaccuguuccagagcugccugaacgccggcuuccucuucggcucccugggggugggcuacuucgccgaccgcuucgggcggaagcugugccuccugggcacggugcuggucaacgccgugagcggcgugcucauggccuucucccccaacuacaugagcaugcugcuguuccgccuccugcaggggcuggucuccaagggcaacuggauggcgggguacacccucaucaccgaguucgugggcagcgggucccggcgcaccguggccaucauguaccagauggccuucacggucggccugguggcccugaccggccucgccuacgcgcugccccacuggcgguggcugcagcucgccgugagccugccgaccuuccuguuccuccuguacuacuggugcguccccgagagcccccgcuggcugcucucccagaagcggaacaccgaggccaucaagaucauggaccacaucgcccagaagaacgggaagcugcccccggccgaccugaagaugcucagccuggaggaggacgugacggagaagcugucccccagcuucgcggaccucuuccgcacgccccggcugcgcaagcggaccuucauccugauguaccugugguucaccgacuccgugcucuaccagggccugauccugcacaugggggccaccagcggcaaccucuaccuggacuuccuguacuccgcccucgucgagauccccggggccuucaucgcccugaucaccaucgaccgcgugggccggaucuacccgauggcgaugagcaaccugcucgccggcgccgccugccuggucaugaucuucaucucccccgaccugcacuggcucaacaucaucaucaugugcguggggcgcaugggcaucaccaucgcgauccagaugaucugccuggugaacgccgagcuguaccccaccuucguccggaaccucggggugauggugugcagcucccugugcgacaucggcgggaucaucacgcccuucaucgucuuccgccugcgggagguguggcaggcccucccgcugauccuguucgccgugcucggccugcuggccgcgggcgucacccuccugcugcccgagaccaaggggguggcccuccccgagaccaugaaggacgccgagaaccugggccgcaaggccaagcccaaggagaacacgaucuaccugaaggugcagaccagcgagccguccgggaccuga

SEQ ID NO: 36507 - RNA, 1086 nt, Artificial Sequence
  derived and/or modified sequence opt1 from SLC22A23__Homo_sapiens__NP_001273385
auggccaucgaccgccggcgcgaggccgcgggcgggggccccgggcggcagccggcccccgccgaggagaacggcagccugccgcccggggacgccgccgcguccgcgccccucggcggccgcgccgggcccggcgggggcgccgagauccagccccugcccccgcugcaccccgggggcggcccccaccccagcugcugcuccgccgccgccgccccgagccuccugcugcucgacuacgacggguccgugcugcccuuccugggcgggcucggcggcggguaccagaagacccugguccugcucaccuggauccccgcccuguucaucggcuucagccaguucuccgacagcuuccugcucgaccagcccaacuucuggugccggggcgcggggaaggggacggagcuggccggcgugaccaccaccggccgcgggggcgacauggggaacuggacgucccugccgaccacccccuucgccaccgcccccugggaggccgcgggcaaccggagcaacuccagcggggccgacggcggcgacacgcccccgcuccccuccccgcccgacaagggggacaacgccagcaacugcgacugccgcgccugggacuacggcauccgggccgggcuggugcagaacgucguguccaagugggaccuggugugcgacaacgcguggaagguccacaucgccaaguucagccuccuggugggccugaucuucggguaccucaucaccggcugcaucgccgacugggugggccgccggcccguccugcuguucuccaucaucuucauccucaucuucgggcugaccguggcccugagcgugaacgucaccauguucuccacgcuccgcuucuucgagggcuucugccuggccgggaucauccugacccucuacgcgcugcggaucgagcugugcccgcccggcaagcgcuucaugaucaccaugguggccagcuucguggccauggccggccaguuccucaugcccgggcuggcggcccugugccgggacuggcagguccuccaggcccugaucaucugccccuuccugcucaugcugcuguacuggagcuga

SEQ ID NO: 36508 - RNA, 1659 nt, Artificial Sequence
  derived and/or modified sequence opt1 from SLC22A24__Homo_sapiens__NP_001129978
augggcuucgacgugcugcucgaccaggucgggggcauggggcgcuuccagaucugccugaucgccuucuucugcaucaccaacauccugcuguuccccaacaucgugcuggagaacuucaccgccuucaccccgagccaccggugcugggugccccugcucgacaacgacaccgucuccgacaacgacaccggcacccugagcaaggacgaccugcuccgcaucuccaucccccuggacagcaaccugcggccccagaagugccagcgcuucauccacccgcaguggcagcuccugcaccugaacgggacguuccccaacaccaacgagcccgacaccgagcccugcguggacggcuggguguacgaccgguccagcuuccucuccaccaucgucacggagugggaccuggugugcgagagccagucccucaagagcauggugcagucccucuucauggcgggcagccugcucgggggccugaucuacgggcaccuguccgaccgcgucggccggaagaucaucugcaagcugugcuuccuccagcuggccaucagcaacacgugcgccgccuucgccccgaccuuccugguguacugcauccuccgcuuccuggcgggguucuccaccaugaccauccugggcaacaccuucauccucagccuggaguggacccugccccggucccgcagcaugaccaucauggugcuccugugcuccuacagcgucggccagaugcugcucgggggccuggccuucgccauccaggacuggcacauccugcagcucacggugagcacccccaucaucgugcuguuccuguccagcuggaagauggucgaguccgcccgguggcucaucaucaacaaccagcuggacgaggggcugaaggagcuccgccggguggcgcacaucaacggcaagaagaacaccgaggagacccugacgaccgagcuggugcgcagcaccaugaagaaggagcucgacgccguccggaucaagaccuccaucuucagccuguuccgcgcccccaagcugcggaugcgcguguucggccugugcuucgugcgguucgccaucacggucccguucuacgggcucauccugaaccugcagcaccucggcuccaacgugagccuguuccagauccugugcggggccgugaccuucaccgcgcgcugcgucucccuccugacccugaaccacaugggccggcgcaucagccagauccucuucacguuccccguggggcuguucauccuggucaacaccuuccucccccaggagaugcagauccugcgcguggugcuggccacccucggcaucggcuccgucagcgccgccuccaacagcgccuccgugcaccacaacgagcuggugcccaccauccugcggagcacggucgcggggaucaacgccguguccggccgcaccggggccgcccucgccccgcugcugaugacccucauggcguacagcccccaccuccccuggaucuccuacggcguguuccccauccuggccgucccggugauccugcugcugcccgagacccgggaccucccccugcccaacacgauccaggacguggagaacgaccgcaaggacagccggaacaucaagcaggaggacacgugcaugaaggucacccaguucuga

SEQ ID NO: 36509 - RNA, 1668 nt, Artificial Sequence
  derived and/or modified sequence opt1 from SLC22A2__Homo_sapiens__NP_003049
augcccaccaccguggacgacguccuggagcacggcggggaguuccacuucuuccagaagcagauguucuuccuccuggcccugcucagcgccacguucgcgccgaucuacgugggcaucguguuccugggguucacccccgaccaccgcugccggucccccggcgucgccgagcugagccuccgcugcggguggucccccgccgaggagcugaacuacaccgugccgggccccggccccgccggggaggccagcccccggcagugccgccgguacgagguggacuggaaccaguccaccuucgacugcgucgacccgcuggcgagccucgacacgaaccgcucccggcugccccugggccccugccgcgacggguggguguacgagacccccggcagcuccaucgugaccgaguucaaccucgucugcgccaacagcuggaugcuggaccuguuccaguccagcgugaacgugggguucuucaucggcuccaugagcaucggcuacaucgccgaccgguucgggcgcaagcucugccugcugaccacgguccucaucaacgccgcggccggcgugcugauggccaucuccccgaccuacaccuggaugcugaucuuccggcucauccaggggcuggugagcaaggccggcuggcugaucggcuacauccucaucaccgaguucgucgggcgccgguaccgccggacggugggcaucuucuaccagguggccuacaccgucgggcugcuggugcucgcgggcguggccuacgcccugccccacuggcgcuggcugcaguucaccgucucccuccccaacuucuucuuccugcuguacuacuggugcauccccgagagcccgcgguggcucaucucccagaacaagaacgccgaggccaugcgcaucaucaagcacaucgcgaagaagaacggcaagagccugcccgccagccugcagcggcuccgccuggaggaggagaccgggaagaagcugaaccccuccuuccucgaccuggugcggacgccccagauccgcaagcacaccaugauccugauguacaacugguucaccagcuccgugcucuaccagggccugaucaugcacauggggcuggccggcgacaacaucuaccucgacuucuucuacagcgcccuggucgaguucccggccgcguucaugaucauccugaccaucgaccgcaucgggcggcgcuaccccugggccgccuccaacaugguggccggcgccgcgugccucgccagcgucuucauccccggggaccugcaguggcugaagaucaucaucuccugccugggccggaugggcaucacgauggccuacgagaucgugugccucgugaacgccgagcuguaccccaccuucauccgcaaccuggggguccacaucugcagcuccaugugcgacaucggcgggaucaucaccccguuccucguguaccggcugaccaacaucuggcuggagcucccccugaugguguucggcguccuggggcucguggcgggcggccuggugcugcuccugcccgagacgaaggggaaggcccugcccgagaccaucgaggaggccgagaacaugcagcgcccgcggaagaacaaggagaagaugaucuaccuccagguccagaagcuggacaucccccugaacuga

SEQ ID NO: 36510 - RNA, 1671 nt, Artificial Sequence
  derived and/or modified sequence opt1 from SLC22A3__Homo_sapiens__NP_068812
augcccagcuucgacgaggcccugcagcgcgugggcgaguucgggcgguuccagcgccgggucuuccuccugcugugccucaccggcgugaccuucgccuuccuguucgugggggucguguuccugggcacgcagccggaccacuacuggugccgcgggcccuccgcggccgcccucgccgagcggugcggcuggagccccgaggaggaguggaaccgcaccgcccccgcgucccggggcccggagccgcccgagcgccgggggcgcugccagcgguaccugcuggaggccgccaacgacagcgccuccgcgaccagcgcccucuccugcgccgacccccuggccgccuuccccaaccgcagcgcgccccuggugcccugccggggcggguggcgcuacgcccaggcccacuccaccaucgucagcgaguucgaccucgugugcgugaacgccuggaugcuggaccugacgcaggccauccucaaccugggcuuccugaccggggcguucacccucggcuacgccgccgaccgguacggccgcaucgucaucuaccugcuguccugccucggggugggcgugaccggggucgugguggccuucgcccccaacuucccggucuucgugaucuuccgguuccugcagggcguguucggcaaggggacguggaugaccugcuacgucaucgugaccgagaucgugggcagcaagcagcgccggaucgucgggaucgugauccagauguucuucacccugggcaucaucauccuccccgggaucgcguacuucauccccaacuggcagggcauccagcuggccaucacgcugcccuccuuccucuuccugcuguacuacuggguggucccggagagcccccgcuggcucaucacccggaagaagggcgacaaggcccugcagauccugcgccgcaucgccaagugcaacgggaaguaccucuccagcaacuacuccgagaucaccgugaccgacgaggaggucagcaaccccuccuuccuggaccuggugcggacgccccagaugcgcaagugcacccucauccugauguucgccugguucaccagcgcgguggucuaccagggccuggugaugcggcucgggaucaucggcgggaaccuguacaucgacuucuucaucagcggcguggucgagcugccgggcgcccuccugauccugcucaccaucgagcgccuggggcggcgccugcccuucgccgccuccaacaucguggcgggcguggccugccucgucacggccuuccugcccgaggggaucgccuggcugcggaccaccguggccacccugggccgccucgggaucacgauggcguucgagaucguguaccuggucaacagcgagcuguaccccaccacccuccggaacuucggcgugucccugugcagcggccugugcgacuucgggggcaucaucgccccguuccuccuguuccgccuggccgccguguggcucgagcugccccugaucaucuucgggauccucgccuccaucugcggcggccuggucaugcugcuccccgagaccaaggggaucgcgcugcccgagacgguggacgacguggagaagcugggcagcccgcacuccugcaagugcgggcggaacaagaagacccccgucagccgcucccaccucuga

SEQ ID NO: 36511 - RNA, 1656 nt, Artificial Sequence
  derived and/or modified sequence opt1 from SLC22A4__Homo_sapiens__NP_003050
augcgcgacuacgacgaggugaucgccuuccugggcgagugggggcccuuccagcggcucaucuucuuccugcugagcgccuccaucaucccgaacggcuucaacgggaugagcgucguguuccucgcgggcacccccgagcaccgcugccgggugcccgacgccgccaaccuguccagcgccuggcgcaacaacuccgucccccugcggcuccgcgacgggcgggaggugccgcacagcugcucccgcuaccggcuggccaccaucgcgaacuucagcgcccugggccucgagcccggccgcgacguggaccuggggcagcuggagcaggaguccugccucgacggcugggaguucagccaggacgucuaccuguccacgguggugaccgaguggaaccuggucugcgaggacaacuggaaggugccccucaccaccagccuguucuucguggggguccugcucggcuccuucgugagcgggcagcuguccgaccgguucggccgcaagaacgugcuguucgccacgauggccguccagaccggcuucagcuuccuccagaucuucuccaucagcugggagauguucaccgugcuguucgugaucgucgggaugggccagaucuccaacuacgugguggcguucauccuggggaccgagauccucggcaagagcguccggaucaucuucagcacgcugggcgugugcaccuucuucgccgugggguacaugcugcucccccuguucgccuacuucauccgcgacuggcggaugcugcuccuggcccugaccgucccgggcgugcucugcgucccccuguggugguucauccccgagagcccccgcuggcugaucucccagcggcgcuuccgggaggccgaggacaucauccagaaggcggccaagaugaacaacaucgccgugccggccgugaucuucgacuccgucgaggagcucaacccccugaagcagcagaaggccuucauccuggaccucuuccgcacccggaacaucgcgaucaugacgaucaugagccugcugcucuggaugcugaccuccgugggguacuucgcccugagccucgacgcccccaaccugcacggcgacgccuaccugaacugcuuccucuccgcccugaucgagauccccgcguacaucaccgccuggcugcugcuccgcacccugccgcgccgguacaucaucgccgccgugcuguucuggggcgggggcguccuccuguucauccagcuggugcccguggacuacuacuuccucagcaucgggcuggucaugcugggcaaguucgggaucacguccgccuucagcaugcucuacguguucaccgcggagcuguaccccacccuggugcgcaacauggccgucggcgugaccuccacggccagccgggugggguccaucaucgcccccuacuucgucuaccucggcgcguacaaccgcaugcugccguacaucgugaugggcagccugaccgugcucaucgggauccugacccuguucuuccccgagucccucggcaugacccugcccgagacgcuggagcagaugcagaaggucaagugguuccggagcgggaagaagacccgcgacuccauggagaccgaggagaaccccaaggugcucaucaccgccuucuga

SEQ ID NO: 36512 - RNA, 1674 nt, Artificial Sequence
  derived and/or modified sequence opt1 from SLC22A5__Homo_sapiens__NP_003051
augcgcgacuacgacgaggugaccgccuuccugggcgagugggggcccuuccagcggcucaucuucuuccugcugagcgccuccaucaucccgaacggcuucaccgggcucagcuccgucuuccugaucgcgacgcccgagcaccgcugccgggugcccgacgccgccaaccugagcuccgccuggcgcaaccacaccgugccccuccggcugcgcgacggccgggaggucccgcacagcugccgccgguaccgccuggccaccaucgcgaacuucuccgcccucgggcuggagcccggccgggacguggaccugggccagcucgagcaggagagcugccuggacgggugggaguucucccaggacguguaccugagcaccaucgucacggaguggaaccucgugugcgaggacgacuggaaggcgccccugaccaucucccuguucuucgugggcguccuccuggggagcuucaucuccggccagcugagcgaccgcuucgggcggaagaacguccucuucgugaccaugggcaugcagaccggcuucuccuuccugcagaucuucagcaagaacuucgagauguucguggugcuguucgugcucgucgggaugggccagaucuccaacuacguggccgccuucgugcuggggacggagauccugggcaagagcguccgcaucaucuucuccacccucggcgugugcaucuucuacgccuucggguacauggugcugccccuguucgccuacuucauccgggacuggcgcaugcuccuggucgcccugaccaugccgggcgugcucugcguggcccuguggugguucauccccgagagcccccgguggcugaucagccaggggcgcuucgaggaggcggaggucaucauccggaaggccgccaaggccaacggcaucgugguccccuccaccaucuucgacccgagcgagcuccaggaccuguccagcaagaagcagcagucccacaacauccuggaccuccugcgcacguggaacauccggauggugaccaucaugagcaucaugcuguggaugaccaucuccgugggguacuucggccucagccuggacacccccaaccugcacggcgacaucuucgucaacugcuuccucuccgccaugguggaggugcccgcguacguccuggccuggcugcuccugcaguaccugccccgccgcuacagcauggccacggcccuguuccucgggggcuccgugcugcuguucaugcagcucgugccgcccgaccuguacuaccuggccaccguccucgugaugguggggaaguucggcgucaccgcggccuucagcaugguguacguguacaccgccgagcuguaccccacggucgugcggaacaugggggugggcgucuccagcaccgccucccgccugggcagcauccucucccccuacuucguguaccugggggccuacgaccgguuccugccguacauccucaugggcagccugaccauccugaccgcgauccucacgcuguuccugcccgaguccuucgggacgccccuccccgacaccaucgaccagaugcugcgcgugaagggcaugaagcaccggaagaccccgagccacacccgcaugcugaaggacgggcaggagcggcccaccauccucaagagcaccgccuucuga

SEQ ID NO: 36513 - RNA, 1692 nt, Artificial Sequence
  derived and/or modified sequence opt1 from SLC22A6__Homo_sapiens__NP_004781
auggccuucaacgaccugcuccagcaggucggcggggugggccgcuuccagcagauccaggugacccuggugguccugccccuccugcugauggccagccacaacacccuccagaacuucacggcggccaucccgacccaccacugccggccgcccgccgacgccaaccuguccaagaacgggggccuggagguguggcucccccgcgaccggcaggggcagcccgagagcugccugcgcuucaccagcccccaguggggccugcccuuccucaacggcaccgaggccaacgggacgggcgcgaccgagcccugcaccgacggguggaucuacgacaacuccaccuucccguccacgaucgugaccgagugggaccuggucugcagccaccgggcccugcgccagcucgcccagucccuguacauggugggcgugcugcucggggccauggucuucggcuaccuggcggaccggcugggccgccggaaggugcucauccugaacuaccugcagaccgccgugagcgggaccugcgccgccuucgcccccaacuuccccaucuacugcgcguuccgccuccuguccggcauggcccuggccgggaucagccucaacugcaugacgcugaacgucgaguggaugcccauccacacccgggccugcgugggcacccugaucggcuacguguacucccucgggcaguuccugcuggccggcgucgcguacgccgugccgcacuggcgccaccuccagcugcuggugagcgcccccuucuucgccuucuucaucuacuccugguucuucaucgagagcgcccgguggcacuccagcuccgggcgccucgaccugacccugcgggcgcuccagcgcgucgcccggaucaacggcaagcgcgaggagggggccaagcugagcauggaggugcugcgggccucccuccagaaggagcugacgaugggcaagggccaggccagcgcgauggagcugcuccgcugccccacccugcggcaccuguuccucugccugagcaugcugugguucgccaccuccuucgccuacuacgggcuggugauggaccuccagggcuucggggucagcaucuaccugauccaggugaucuucggcgccguggaccugcccgcgaagcucgucggguuccuggugaucaacucccugggccgccgcccggcccagauggccgcccuccugcuggccggcaucugcauccuccugaacggggucaucccccaggaccagagcaucgugcggaccucccuggcggugcucggcaaggggugccuggccgccagcuucaacugcaucuuccuguacacgggcgagcucuaccccaccaugauccgccagaccgggaugggcaugggcuccaccauggcccgggucgggagcaucgugagcccccugguguccaugacggccgagcuguacccguccaugccccucuucaucuacggcgcgguccccguggccgccagcgccgugaccguccugcugcccgagacccucgggcagccgcugcccgacaccgugcaggaccuggagucccgcugggcccccacgcagaaggaggcgggcaucuacccccggaagggcaagcagacccgccagcagcaggagcaccagaaguacauggugccgcuccaggccagcgcccaggagaagaacgggcuguga

SEQ ID NO: 36514 - RNA, 1641 nt, Artificial Sequence
  derived and/or modified sequence opt1 from SLC22A7__Homo_sapiens__NP_006663
augggcuucgaggagcugcucgagcaggucgggggcuucgggcccuuccagcugcgcaacguggcccugcucgcccugccgcgggugcugcucccccugcacuuccugcuccccaucuuccuggcggccgugcccgcccaccgcugcgcccugccgggcgcccccgcgaacuucagccaccaggacgucuggcucgaggcccaccucccccgggagcccgacgggacccuguccagcugccugcgcuucgccuacccgcaggcccugcccaacaccacgcugggcgaggagcggcagucccgcggcgagcucgaggacgagcccgcgaccgugcccugcagccaggggugggaguacgaccacuccgaguucagcuccaccaucgccaccgagugggaccuggugugcgagcagaagggccugaaccgggccgccagcacguucuucuucgccgggguccucgugggcgcgguggccuucggguaccuguccgaccgcuucggccggcgccggcugcuccuggucgccuacgugagcacccuggugcucggccuggccuccgccgcgagcgucuccuacgugauguucgccaucacccgcacccugacggggagcgcccucgccggcuucaccaucaucgugaugccgcuggagcuggaguggcucgacgucgagcaccggaccguggccggggugcuguccagcaccuucuggacgggcggcgucaugcugcucgcgcuggugggguaccugauccgcgacuggcgguggcuccugcuggccgugacccuccccugcgcccccggcauccugucccugugguggguccccgagagcgcccgcuggcuccugacccaggggcacgugaaggaggcccaccgguaccugcuccacugcgcgcgccugaacggccggccggugugcgaggacuccuucagccaggaggccgucagcaagguggccgccggggagcgcgucgugcggcgccccuccuaccuggaccuguuccgcacgccccggcuccgccacaucagccugugcugcguggucgugugguucggcgugaacuucuccuacuacggccugagccucgacgucuccgggcugggccugaacguguaccagacccagcuccuguucggggcgguggagcugcccagcaagcuccuggucuaccuguccgugcgguacgccggccgccggcucacccaggccgggacccugcugggcaccgcccucgccuucggcacgcgccugcuggugagcuccgacaugaaguccuggagcaccguccucgcggugauggggaaggccuucagcgaggccgccuucaccaccgccuaccuguucacguccgagcuguacccgaccgugcuccggcagaccggcauggggcugaccgcgcuggucggccgccucgggggcagccuggcgccccuggccgcccuccuggacggcguguggcugucccuccccaagcugacguacgggggcaucgcccugcucgccgccgggaccgcccugcugcuccccgagacccggcaggcccagcugccggagaccauccaggacguggagcgcaagagcgcgcccacgucccugcaggaggaggagaugcccaugaagcagguccagaacuga

SEQ ID NO: 36515 - RNA, 1629 nt, Artificial Sequence
  derived and/or modified sequence opt1 from SLC22A8__Homo_sapiens__NP_001171661
augaccuucagcgagauccuggaccgcgugggcuccauggggcacuuccaguuccuccacgucgccauccugggccugcccauccucaacauggccaaccacaaccugcugcagaucuucaccgcggccacgccggugcaccacugccggccgccccacaacgccagcaccgggcccugggugcuccccaugggccccaacgggaagcccgagcgcugccugcgguucguccacccgcccaacgccucccugcccaacgacacccagcgcgccauggagcccugccucgacggcuggguguacaacagcaccaaggacuccaucgugacggagugggaccuggucugcaacagcaacaagcugaaggagauggcgcaguccaucuucauggccggcauccucaucgggggccuggugcugggggaccucagcgaccgguucggccgccggcccauccugaccugcuccuaccugcuccuggccgccagcggguccggcgcggccuucagcccgaccuuccccaucuacaugguguuccgcuuccugugcggcuucgggaucuccggcaucacccucagcacggucauccugaacguggagugggugcccacccggaugcgcgccaucauguccaccgcccugggguacugcuacaccuucggccaguucauccuccccggccuggccuacgcgaucccgcaguggcgguggcugcagcucacggucagcauccccuucuucguguucuuccuguccagcugguggacccccgaguccauccgcuggcuggugcucagcggcaagagcuccaaggcccugaagauccugcggcgcgucgccguguucaacgggaagaaggaggagggggagcggcucagccuggaggagcugaagcucaaccugcagaaggagaucucccuggccaaggccaaguacaccgcgagcgaccucuuccgcauccccaugcugcggcgcaugaccuucugccugucccucgccugguucgccacgggcuucgccuacuacagccuggccauggggguggaggaguucggcgucaaccuguacauccuccagaucaucuucggcgggguggacgugccggcgaaguucaucaccauccugucccugagcuaccucggccggcacaccacccaggccgccgcccugcugcuggccgggggcgcgauccucgcccugacguucgucccccuggaccuccagaccgugcgcaccgugcuggccgucuucgggaagggcugccuguccagcuccuucagcugccucuuccuguacaccuccgagcuguaccccacggugauccggcagaccggcaugggggucagcaaccucuggacccgcgugggcuccauggugagcccccuggucaagaucaccggggaggugcagccguucauccccaacaucaucuacggcaucacggcccugcucgggggcuccgcggcccuguuccugcccgagacccucaaccagccccugccggagaccaucgaggaccuggagaacuggagccuccgcgccaagaagcccaagcaggagcccgagguggagaaggccucccagcggaucccgcugcagccccacggccccgggcugggcagcagcuga

SEQ ID NO: 36516 - RNA, 1797 nt, Artificial Sequence
  derived and/or modified sequence opt1 from SLC23A1__Homo_sapiens__NP_005838
augcgcgcccaggaggaccuggagggccggacccagcacgagaccacgcgcgaccccagcaccccgcuccccaccgagcccaaguucgacaugcuguacaagaucgaggacgugcccccgugguaccugugcauccuccugggguuccagcacuaccugaccugcuucuccggcacgaucgccguccccuuccuccuggcggaggcccugugcguggggcacgaccagcacauggugagccagcucaucggcaccaucuucacgugcgucgggaucaccacccugauccagaccaccgugggcauccggcugccccucuuccaggccuccgccuucgccuuccuggugcccgcgaaggccauccuggcccucgagcgcuggaagugcccgcccgaggaggagaucuacggcaacuggagccugccccugaacaccucccacaucuggcacccccggauccgcgagguccagggggccaucauggugagcuccguggucgagguggugaucggccuccuggggcugccgggcgcgcuccugaacuacaucgggccccugacggucacccccaccgugagccucaucggccuguccguguuccaggccgccggcgaccgggccgggagccacuggggcaucuccgccugcagcauccugcucaucauccuguucucccaguaccugcgcaaccucaccuuccugcugcccgucuaccggugggggaagggccucacgcugcugcgcauccagaucuucaagauguucccgaucaugcucgcgaucaugaccguguggcugcugugcuacgugcucacccugaccgacguccugcccacggaccccaaggccuacggcuuccaggcccggaccgacgcccgcggggacaucauggccaucgcgcccuggauccggaucccguaccccugccaguggggccuccccaccgugaccgccgccgccgugcuggggauguucagcgccacgcuggcgggcaucaucgaguccaucggggacuacuacgccugcgcccgccucgccggcgcgcccccgccgcccguccacgccaucaaccggggcaucuucaccgaggggaucugcugcaucaucgccggccugcuggggaccggcaacgggagcaccuccagcucccccaacaucggcgugcucggcaucacgaagguggggagccgccgggucgugcaguacggcgccgccaucaugcugguccuggggaccaucggcaaguucaccgcgcuguucgccagccuccccgaccccauccucgggggcauguucugcacccuguucggcaugaucacggccguggggcuguccaaccugcaguucguggacaugaacagcucccgcaaccuguucguccucggcuucagcauguucuucgggcugacccugcccaacuaccucgaguccaacccgggcgccaucaacaccggcauccuggagguggaccagauccugaucgugcuccugaccacggagauguucgucgggggcugccuggccuucauccucgacaacaccgugcccgggagccccgaggagcggggccugauccaguggaaggcgggggcccacgccaacuccgacaugagcuccagccugaaguccuacgacuuccccaucggcaugggcaucgugaagcgcaucaccuuccucaaguacaucccgaucugccccgucuucaagggguucagcuccagcuccaaggaccagaucgccauccccgaggacacccccgagaacaccgagacggccagcgugugcaccaagguguga

SEQ ID NO: 36517 - RNA, 1953 nt, Artificial Sequence
  derived and/or modified sequence opt1 from SLC23A2__Homo_sapiens__NP_005107
augaugggcaucgggaagaacaccaccagcaaguccauggaggccggcagcuccacggaggggaaguacgaggacgaggccaagcaccccgcguucuucacccugccgguggucaucaacggcggggccaccagcuccggcgagcaggacaacgaggacaccgagcucauggccaucuacacgaccgagaacggcaucgccgagaaguccagccuggccgagacccuggacagcaccgggucccucgacccccagcgcagcgacaugaucuacacgaucgaggacgugccgcccugguaccugugcaucuuccugggccuccagcacuaccugaccugcuucuccgggaccaucgcggugcccuuccugcucgccgacgccaugugcgucggcuacgaccagugggccaccagccagcugaucgggacgaucuucuucugcgugggcaucaccacccugcuccagaccacguucggcugccggcugccccuguuccaggcguccgccuucgccuuccucgcccccgcccgcgcgauccugagccuggacaaguggaagugcaacaccaccgacguguccgucgccaacgggaccgccgagcuccugcacacggagcacaucugguacccccggauccgcgagauccagggcgccaucaucaugagcucccugaucgagguggugaucgggcuccugggccugccgggcgcccuccugaaguacaucgggccccugaccaucacccccaccgucgcgcucaucggccugagcggguuccaggccgccggcgagcgggccgggaagcacuggggcaucgccaugcugacgaucuuccucgugcugcuguucucccaguacgcgcgcaacgugaaguucccccucccgaucuacaagagcaagaagggcuggaccgccuacaagcugcagcuguucaagauguuccccaucauccucgccauccuggucagcuggcugcucugcuucaucuucaccgugaccgacguguucccgcccgacuccacgaaguacggguucuacgcccggaccgacgcccgccagggcguccugcugguggcgcccugguucaaggugcccuaccccuuccagugggggcuccccaccgucagcgccgccggcgugaucgggaugcuguccgccguggucgcgagcaucaucgaguccaucggcgacuacuacgccugcgcccggcugagcugcgccccgcccccgcccauccacgccaucaaccgcggcaucuucguggaggggcucuccugcgugcuggacggcaucuucgggaccggcaacgggagcacguccagcucccccaacaucggcguccugggcaucaccaagguggggagccggcgcgucauccagugcggcgcggcccucaugcuggcccuggggaugaucggcaaguucuccgcccuguucgccagccuccccgaccccgugcugggcgcgcuguucugcacccucuucgggaugaucaccgccgugggccuguccaaccugcaguucaucgaccucaacagcucccggaaccuguucguccugggguucagcaucuucuucggccucgugcugcccuccuaccugcgccagaacccgcucgugacggggaucaccggcaucgaccagguccugaacgugcugcucaccaccgccauguucgugggcgggugcgucgccuucauccuggacaacaccauccccggcacgcccgaggagcgggggauccgcaaguggaagaagggcguggggaagggcaacaagagccuggacggcauggagagcuacaaccucccguucgggaugaacaucaucaagaaguaccggugcuucuccuaccugcccaucagccccaccuucgugggcuacaccuggaaggggcugcgcaaguccgacaacagccgguccagcgacgaggacucccaggccaccggcuga

SEQ ID NO: 36518 - RNA, 3300 nt, Artificial Sequence
  derived and/or modified sequence opt1 from SLC24A1__Homo_sapiens__NP_004718
augggcaagcugauccgcauggggccccaggagcgguggcuccugcgcaccaagcggcugcacuggagccgccuccuguuccugcucggcaugcugaucaucggguccaccuaccagcaccuccggcgcccgcggggccucagcucccugugggccgccgugagcucccaccagcccaucaagcuggcgagccgcgaccucuccagcgaggagaugaugaugauguccagcucccccagcaagcccuccagcgagaugggcgggaagaugcuggucccgcaggccuccgugggcagcgacgaggccacgcuguccaugaccguggagaacauccccagcaugcccaagcggaccgccaagaugauccccaccacgaccaagaacaacuacuccccgaccgccgcggggaccgagcgccggaaggaggacacgcccaccagcagccgcacccucaccuacuacacguccaccagcucccggcagaucgucaagaaguacacccccacgccccgcggcgagaugaaguccuacagcccgacccaggugcgggagaaggugaaguacacccccagcccccgcgggcggcgcgucggcaccuacgugcccuccaccuucaugacgauggagaccagccacgccaucaccccgcggaccacggugaaggacuccgacaucaccgccaccuacaagauccuggagaccaacagccugaagcgcaucauggaggagacgacccccaccacccucaaggggauguucgacuccacgcccaccuuccugacccacgaggucgaggccaacgugcugaccagcccccgguccgugauggagaagaacaaccucuucccgccccgccgcgucgagagcaacuccagcgcgcaccccuggggccuggugggcaaguccaaccccaagacgccgcaggggaccgugcugcuccacacccccgccaccagcgagggccaggucaccaucuccacgaugaccgggagcagccccgccgagaccaaggccuucaccgccgcguggucccugcggaaccccagcccgcgcacguccgugagcgccaucaagaccgcccccgccaucguguggcggcuggccaagaagcccuccaccgcgccgagcaccuccacgacccccaccguccgcgccaagcucaccaugcagguccaccacugcgugguggugaagcccacgcccgccaugcugaccaccccgagccccucccugaccacggcccuccugcccgaggagcugagccccuccccgagcgugcucccgcccucccugcccgaccugcaccccaagggcgaguacccgcccgaccucuucagcgucgaggagcggcgccagggcugggugguccugcacguguucgggaugauguacguguucgucgcccuggcgaucgugugcgacgaguacuucgugcccgcccucggcgucaucaccgacaagcugcagaucuccgaggacguggccggggccaccuucauggccgcgggcgggagcgcccccgagcuguucaccucccucaucggcguguucaucagccacagcaacgucggcaucgggacgaucgugggcuccgccguguucaacauccuguucgucaucgggaccugcagccuguucucccgggagauccucaaccugaccugguggccccuguuccgcgacgugagcuucuacauccucgaccugaucaugcugauccuguucuuccucgacucccugaucgccuggugggagagccugcuccugcugcucgcguacgccuucuacguguucaccaugaaguggaacaagcacaucgaggucugggugaaggagcagcugucccggcgccccguggccaaggucauggcccuggaggaccucagcaagcccggcgacggggccaucgcgguggacgagcugcaggacaacaagaagcugaagcucccgucccugcugacgcggggcagcuccagcaccucccuccacaacagcaccauccgcuccaccaucuaccagcugaugcugcacagccucgacccccugcgggaggugcgccuggccaaggagaaggaggaggagucccucaaccagggcgcccgggcccagccccaggccaaggcggagagcaagcccgaggaggaggagccggccaagcugcccgccgucacggugacccccgccccggugcccgacaucaagggggaccagaaggagaaccccggcgggcaggaggacgucgccgaggcggaguccaccggcgagaugcccggggaggagggcgagaccgccggcgagggggagacggaggagaaguccggcggggagacccagccggagggcgagggcgagaccgagacccaggggaagggcgaggagugcgaggacgagaacgaggccgaggggaagggcgacaacgagggggaggacgagggcgagauccacgccgaggacggcgagaugaaggggaacgagggcgagacggagagccaggagcugagcgcggagaaccacggggaggccaagaacgacgagaagggcguggaggacgggggcggcagcgacgggggcgacuccgaggaggaggaggaggaggaggaggagcaggaggaggaggaggaggaggaggagcaggaggaggaggaggaggaggaggaggaggaggaggagaaggggaacgaggagccccucagccuggacuggcccgagacccgccagaagcaggccaucuaccuguuccuccugcccaucguguucccgcuguggcucaccguccccgacgugcggcgccaggagucccggaaguucuucguguucaccuuccugggcagcaucauguggaucgccauguucuccuaccugauggucuggugggcccaccaggugggggagaccaucggcaucagcgaggagaucaugggccucacgauccuggcggccgggaccuccauccccgaccugaucaccagcgugaucgucgcccgcaagggccucggggacauggccguguccagcuccgugggcagcaacaucuucgacaucaccgucgggcugcccgugccguggcugcuguucucccugaucaacggccugcagcccgugcccgucagcuccaacggccucuucugcgccaucgugcugcuguuccucaugcugcuguucgugaucagcuccaucgcgagcugcaaguggcgcaugaacaagauccucggguucacgauguuccugcuguacuucgucuuccucaucaucagcgugaugcuggaggaccggaucaucuccugccccgugagcgucuga

SEQ ID NO: 36519 - RNA, 1986 nt, Artificial Sequence
  derived and/or modified sequence opt1 from SLC24A2__Homo_sapiens__XP_005251482
auggaccuccagcagagcaccaccaucacgucccucgagaaguggugccuggacgagagccuguccggcugccgccggcacuacagcgugaagaagaagcucaagcugauccgcguccugggccucuucauggggcugguggccaucuccaccgugagcuucuccaucagcgccuucuccgagaccgacacccagagcacgggggaggcguccgucgugagcggcccccggguggcccagggguaccaccagcgcacccugcucgaccugaacgacaagauccuggacuacaccccgcagccgccccucuccaaggagggcgagagcgagaacuccaccgaccacgcccagggcgacuaccccaaggacaucuucagccuggaggagcggcgcaagggggccaucauccugcacgucaucggcaugaucuacauguucaucgcccucgcgaucgugugcgacgaguucuucgugcccucccugacggucaucaccgagaagcuggggaucagcgacgacguggccggcgccaccuucauggccgccgggggcuccgcgcccgagcuguucaccagccucaucggcguguucaucgcccacagcaacgucgggaucggcacgaucgugggguccgccguguucaacauccuguucgucaucggcaugugcgcccucuucagccgggagauccugaaccugaccugguggccccucuuccgcgacguguccuucuacaucguggaccugaucaugcugaucaucuucuuccucgacaacgucaucauguggugggagagccugcugcuccugaccgcguacuucugcuacgugguguucaugaaguucaacguccagguggagaagugggugaagcagaugaucaaccggaacaaggucgugaaggucaccgcccccgaggcccaggccaagccguccgccgcgcgcgacaaggacgagcccacgcugcccgccaagccccggcuccagcgcggcgggagcuccgccagccugcacaacucccugaugcggaacagcaucuuccagcucaugauccacacccuggacccgcuggccgaggagcucggcuccuacgggaagcugaaguacuacgacaccaugaccgaggagggccgcuuccgggagaaggccagcauccugcacaagaucgcgaagaagaagugccacguggacgagaacgagcgccagaacggggccgccaaccacguggagaagaucgagcuccccaacuccacgagcaccgacgucgagaugacccccuccagcgacgccuccgagcccgugcagaacggcaaccugagccacaacaucgagggcgccgaggcgcagaccgccgacgaggaggaggaccagccgcugucccucgccuggcccagcgagacgcggaagcaggucaccuuccugaucguguuccccaucguguucccccuguggaucacccucccggacgugcgcaagcccagcucccggaaguucuuccccaucaccuucuucgggagcaucacguggaucgccgucuucuccuaccugaugguguggugggcgcaccaggugggcgagaccaucgggaucagcgaggagaucaugggccugaccauccuggccgccgggaccuccauccccgaccucaucacgagcgucaucguggcccgcaagggccugggcgacauggccguguccagcuccgucgggagcaacaucuucgacaucaccgugggccugccgcuccccuggcugcuguacaccgugauccaccgguuccagcccgucgcgguguccagcaacggccucuucugcgccaucgugcugcuguucaucaugcuccuguucgucauccuguccaucgcccucugcaaguggcgcaugaacaagauccugggguucaucauguucgggcuguacuucguguuccucguggucagcgugcugcuggaggaccgcauccugaccugccccguguccaucuga

SEQ ID NO: 36520 - RNA, 1935 nt, Artificial Sequence
  derived and/or modified sequence opt1 from SLC24A3__Homo_sapiens__NP_065740
augcgccccagcggcgacgaggaccgggcccgccggcgccggcgccggcgccggcgccgggaccugcuccugucccagcugugcuuccucgccagcguggcgcugcugcucuggucccugagcucccugcgcgagcagaaggagcucgaccugauggaccuggucggggaggaccggaaguggaugauggcccgcaagcucaugcaggucaacgacacccugaccagcgaggacgccggccugcggaacuccaagaacugcacggagccggcccuccacgaguuccccaacgacaucuucaccaacgaggaccgccggcagggggccguggugcugcacgugcugugcgcgaucuacauguucuacgcccucgccaucgugugcgacgacuucuucguccccagccuggagaagaucugcgagcgccugcaccucuccgaggacguggccggcgcgaccuucauggccgccgggagcuccgcccccgagcuguucaccagcgugaucggcgucuucaucacgaagggcgacgugggggugggcaccaucgucggguccgccguguucaacauccugugcaucaucggcgugugcggccucuucgcggggcaggucguggcccugagcuccuggugccugcuccgggacagcaucuacuacacccuguccgugaucgcccugaucgucuucaucuacgacgagaaggugagcuggugggagucccucgugcugguccugauguaccucaucuacaucgugaucaugaaguacaacgccugcauccaccagugcuucgagcgccggaccaagggcgccgggaacauggugaacggccuggcgaacaacgccgagaucgacgacagcagcaacugcgacgccacggucgugcugcucaagaaggccaacuuccaccgcaaggccuccgucaucaugguggacgagcugcugagcgcguacccgcaccagcucuccuucagcgaggccgggcugcgcaucaugaucaccucccacuucccgcccaagacccggcugagcauggccucccgcaugcucaucaacgagcggcagcgccugaucaacagccgggccuacaccaacggcgaguccgagguggccaucaagauccccaucaagcacacggucgagaacggcaccgggcccagcuccgcgcccgaccgcggcgugaacgggacccggcgcgacgacguggucgccgaggccggcaacgagaccgagaacgagaacgaggacaacgagaacgacgaggaggaggaggaggacgaggacgacgacgaggggcccuacacgcccuucgacaccccgagcggcaagcuggagaccgugaagugggccuucaccuggccccucuccuucgugcuguacuucacgguccccaacugcaacaagccccggugggagaagugguucauggugaccuucgcgagcuccacccuguggaucgccgccuucagcuacaugaugguguggauggucaccaucaucggcuacacgcucgggaucccggacgugaucaugggcaucaccuuccuggccgccgggaccuccgugcccgacugcauggcgagccugaucgucgcccgccagggcaugggggacauggccguguccaacagcaucggcagcaacguguucgacauccugaucggccucgggcugcccugggcccugcagacccucgccgucgacuacggcuccuacauccggcugaacagccgcgggcugaucuacuccgugggccuccugcuggcgagcguguucgucacgguguucggggugcaccucaacaaguggcagcuggacaagaagcugggcugcggcugccuccugcuguacggggucuuccucugcuucuccaucaugaccgaguucaacguguucaccuucgugaaccugcccaugugcggcgaccacuga

SEQ ID NO: 36521 - RNA, 1869 nt, Artificial Sequence
  derived and/or modified sequence opt1 from SLC24A4__Homo_sapiens__NP_705932
auggcccugcgcggcacccuccggccccugaaggugcgccggcgccgggagaugcugccgcagcaggucggguucgugugcgccgugcucgcgcuggucugcugcgccagcggccuguucgggucccucggccacaagaccgccagcgccuccaagcgcgugcugcccgacacguggcggaaccgcaagcugauggcccccgugaacgggacccagaccgcgaagaacugcaccgaccccgccauccacgaguucccgacggaccucuucagcaacaaggagcggcagcacggcgccguccugcugcacauccucggcgcccuguacauguucuacgcgcuggccaucgugugcgacgacuucuucgugcccucccucgagaagaucugcgagcgccugcaccugagcgaggacgucgccggggccaccuucauggccgcgggcuccagcacccccgagcuguucgccuccgugaucgggguguucaucacccacggcgacgucggggugggcacgaucgugggcagcgccgucuucaacauccucugcaucaucggggugugcggccuguucgccggccaggugguccggcucaccuggugggccgugugccgcgacuccguguacuacaccaucagcgucaucgugcugaucguguucaucuacgacgagcagaucgucuggugggaggggcuggugcucaucauccuguacgucuucuacauccugaucaugaaguacaacgugaagaugcaggcguucuucaccgugaagcagaaguccaucgccaacggcaaccccgucaacagcgagcucgaggccgggaacgacuucuacgacggcuccuacgacgacccgagcgugccccugcugggccaggugaaggagaagccccaguacgggaagaaccccgucgugaugguggacgagaucauguccagcuccccgcccaaguucacguuccccgaggccgggcuccggaucaugaucaccaacaaguucggcccccgcacccggcugcgcauggccagccggaucaucaucaacgagcgccagcggcugaucaacagcgcgaacggcgucuccagcaagccgcuccagaacgggcgccacgagaacaucgagaacggcaacgugcccguggagaaccccgaggacccccagcagaaccaggagcagcagccgccgccccagccgccgccgcccgagcccgagcccgucgaggccgacuuccugucccccuucagcgugcccgaggcccgcggggacaaggugaagugggucuucaccuggccccugaucuuccuccugugcgugacgauccccaacugcuccaagccccggugggagaaguucuucauggugaccuucaucaccgccacccuguggaucgccgucuucagcuacaucaugguguggcucgugacgaucaucggcuacacccuggggauccccgacgucaucaugggcaucaccuuccuggcggccggcaccuccgugcccgacugcauggccagccucaucguggcccgccaggggcugggcgacauggcggucuccaacacgaucgggagcaacguguucgacauccuggugggccucgggguccccuggggccugcagaccaugguggugaacuacggcuccaccgucaagaucaacagccgggggcugguguacuccgugguccuccugcugggcagcguggcccugaccgugcucgggauccaccugaacaaguggcgccuggaccggaagcucggcgucuacgugcuggugcuguacgccaucuuccucugcuucuccaucaugaucgaguucaacgucuucacguucgugaaccugcccaugugccgcgaggacgacuga

SEQ ID NO: 36522 - RNA, 1503 nt, Artificial Sequence
  derived and/or modified sequence opt1 from SLC24A5__Homo_sapiens__NP_995322
augcagaccaagggcgggcagaccugggcccgccgggcccugcuccugggcauccugugggcgacggcccaccucccccugagcgggaccucccugccgcagcgccucccccgggccaccggcaacagcacccagugcgugaucucccccagcuccgaguuccccgagggguucuucacgcgccaggagcggcgcgacggcggcaucaucaucuacuuccugaucaucgucuacauguucauggccaucagcaucgugugcgacgaguacuuccugccgucccucgagaucaucagcgagucccuggggcugagccaggacguggccggcaccaccuucauggcggccggguccagcgcccccgagcucgucaccgccuuccugggcguguucaucacgaagggggacaucggcaucuccaccauccugggcagcgcgaucuacaaccuccuggggaucugcgccgccugcggccugcucuccaacaccgugagcacccuguccugcuggccccuguuccgggacugcgccgccuacacgaucagcgcggccgccguccucgggaucaucuacgacaaccagguguacugguacgagggcgcccugcugcuccugaucuacggccuguacgugcucguccugugcuucgacaucaagaucaaccaguacaucaucaagaagugcucccccugcugcgccugccuggcgaaggccauggagcgcagcgagcagcagccgcucauggggugggaggacgagggccagcccuucauccggcgccagagccggaccgacuccgggaucuucuacgaggacagcggcuacucccagcugagcaucucccugcacgggcucagccagguguccgaggacccgcccagcguguucaacaugcccgaggccgaccugaagcgcaucuucuggguccugucccuccccaucaucacccugcuguuccucaccacgcccgacugccggaagaaguucuggaagaacuacuucgugaucaccuucuucaugagcgccaucuggaucuccgccuucaccuacauccugguguggauggucaccaucacgggcgagacccuggagauccccgacaccgugaugggccucacccugcuggcggccgggacgagcaucccggacaccaucgccuccgugcucgucgcccgcaagggcaagggggacauggccaugagcaacaucgugggcuccaacguguucgacaugcugugccuggggauccccugguucaucaagaccgcguucaucaacggcagcgcccccgccgaggucaacucccggggccucaccuacaucacgaucagccugaacaucuccaucaucuuccuguuccuggccgugcacuucaacggguggaagcucgaccgcaagcugggcaucgugugccugcucagcuaccuggggcuggcgacccucagcguccuguacgagcugggcaucaucgggaacaacaagauccggggcugcggcggguga

SEQ ID NO: 36523 - RNA, 891 nt, Artificial Sequence
  derived and/or modified sequence opt1 from SLC25A10__Homo_sapiens__NP_001257817
auggccgccgaggcgcgcgugagccggugguacuucggcgggcuggccuccugcggcgccgccugcugcacccacccccucgaccugcugaagguccaccuccagacccagcaggaggugaagcugcgcaugacggggauggcccugcgggugguccgcaccgacggcauccucgcgcuguacagcgggcuguccgccagccucugccggcagaugaccuacucccugacccgcuucgccaucuacgagacggugcgggaccgcguggccaagggcagccagggcccgcugcccuuccacgagaagguccuccugggguccgugagcggccuggccgggggcuucguggggacccccgcggaccucgucaacgugcggaugcagaacgacgugaagcugccccagggccagcgccggaacuacgcccacgcccuggacggccucuaccgcgucgcccgggaggaggggcugcgccggcuguucuccggcgcgaccauggccagcucccgcggggcccucgugaccgugggccagcugagcugcuacgaccaggccaagcagcugguccucuccacgggcuaccugagcgacaacaucuucacccacuucguggccuccuucaucgcggccgccggggacgagccgccgccccagggcgggugcgccaccuuccugugccagccccucgacgugcugaagacccggcugaugaacagcaagggcgaguaccagggggucuuccacugcgccguggagacggcgaagcucggcccccuggccuucuacaagggccuggugcccgccgggauccgccucaucccccacaccguccugaccuucguguuccuggagcagcuccggaagaacuucggcaucaaggugcccuccuga

SEQ ID NO: 36524 - RNA, 2037 nt, Artificial Sequence
  derived and/or modified sequence opt1 from SLC25A12__Homo_sapiens__NP_003696
auggccgugaagguccagaccaccaagcgcggcgacccccacgagcugcggaacaucuuccuccaguacgccagcacggagguggacggggagcgcuacaugaccccggaggacuucgugcagcgguaccugggccuguacaacgaccccaacuccaaccccaagaucguccagcuccuggcggggguggccgaccagaccaaggacggccugaucagcuaccaggaguuccucgccuucgaguccgugcugugcgcccccgacagcauguucaucgucgccuuccagcuguucgacaaguccgggaacggcgaggugaccuucgagaacgugaaggagaucuucggccagacgaucauccaccaccacaucccguucaacugggacugcgaguucauccgccuccacuucgggcacaaccggaagaagcaccugaacuacaccgaguucacccaguuccugcaggagcuccagcuggagcacgcgcgccaggccuucgcccugaaggacaagagcaaguccggcaugaucagcgggcucgacuucuccgacaucauggucaccauccggagccacaugcugacgcccuucguggaggagaaccugguguccgccgcgggcgggagcaucucccaccaggucagcuucuccuacuucaacgccuucaacagccuccugaacaacauggagcuggugcgcaagaucuacuccacccucgccggcacccggaaggacguggaggucaccaaggaggaguucgcccagagcgccauccgcuacggccaggugacgccccuggagaucgacauccuguaccagcucgcggaccuguacaacgccuccgggcggcugacccucgccgacaucgagcgcaucgcgccccuggccgagggcgcccugccguacaaccucgccgagcugcagcggcagcagagccccgggcugggccgccccaucuggcuccagaucgccgagagcgccuaccgguucacccugggcuccguggccggggcggucggcgccaccgccguguaccccaucgaccuggugaagacgcgcaugcagaaccagcgggggagcggcuccgucgugggggagcucauguacaagaacagcuucgacugcuucaagaaggugcugcgcuacgagggcuucuucggccuguaccgggggcucaucccgcagcugaucggcgucgcccccgagaaggccaucaagcugaccgugaacgacuucguccgcgacaaguucacccggcgcgacggguccgugccccuccccgcggaggugcuggccggcgggugcgccggcggcagccaggucaucuucaccaacccgcuggagaucgugaagauccgccuccagguggccggggagaucacgaccggcccccgggucuccgcgcugaacgugcugcgcgaccucgggaucuucggccuguacaagggggccaaggccugcuuccugcgggacauccccuucagcgccaucuacuuccccguguacgcccacugcaagcugcuccuggcggacgagaacggccacgucggcgggcugaaccuccuggccgccggcgccauggccggggugccggcggccucccuggugacccccgccgacgucaucaagacccgccuccagguggccgcccgggcgggccagacgaccuacagcggcgugaucgacugcuuccgcaagauccugcgggaggaggggcccuccgccuucuggaagggcaccgccgcccgcgucuuccggagcagcccccaguucggggugacccuggugacguacgagcuccugcagcgcugguucuacaucgacuucggcgggcugaagccggcgggcuccgagcccacccccaagucccggaucgccgaccugcccccggccaaccccgaccacaucggcggguaccgccucgccaccgccaccuucgcgggcaucgagaacaaguucgggcuguaccuccccaaguucaagagcccguccgucgccguggugcagcccaaggccgccgucgccgcgacgcaguga

SEQ ID NO: 36525 - RNA, 2031 nt, Artificial Sequence
  derived and/or modified sequence opt1 from SLC25A13__Homo_sapiens__NP_001153682
auggccgccgcgaagguggcccugaccaagcgcgccgaccccgccgagcuccggaccaucuuccugaaguacgccagcaucgagaagaacggcgaguucuucauguccccgaacgacuucgucacgcgcuaccugaacaucuucggggagagccagcccaaccccaagaccguggagcuccuguccggcguggucgaccagaccaaggacgggcugaucagcuuccaggaguucguggcguucgaguccgugcucugcgcccccgacgcccuguucauggucgccuuccagcuguucgacaaggcgggcaagggggaggugaccuucgaggacgugaagcaggucuucggccagacgaccauccaccagcacaucccguucaacugggacagcgaguucgugcagcuccacuucggcaaggagcggaagcgccaccugaccuacgccgaguucacccaguuccugcucgagauccagcuggagcacgccaagcaggccuucgugcagcgggacaacgcccgcacggggcgggucaccgcgaucgacuuccgcgacaucauggugaccauccggccccacgugcugacccccuucgucgaggagugccucguggccgccgccggcgggacgaccucccaccaggugagcuucuccuacuucaacggcuucaacagccugcugaacaacauggagcucauccgcaagaucuacuccacccuggccgggacccggaaggacgucgaggugacgaaggaggaguucgugcuggcggcccagaaguucggccaggucacccccauggagguggacauccucuuccagcuggccgaccuguacgagccgcgcggccggaugacccucgccgacaucgagcgcaucgcgccccuggaggaggggacccugcccuucaaccucgccgaggcccagcggcagcagaaggccagcggcgacuccgcccgccccgugcugcugcaggucgccgagagcgcguaccgguucgggcucggcuccguggccggcgccgucggggccacggcgguguacccgaucgaccuggugaagacccgcaugcagaaccagcggagcaccggcuccuucgucggggagcugauguacaagaacagcuucgacugcuucaagaaggugcuccgcuacgagggcuucuucgggcuguaccggggccugcucccccagcugcugggcguggcccccgagaaggccaucaagcucaccgucaacgacuucgugcgcgacaaguucaugcacaaggacggguccgugccccuggccgccgagauccuggcgggcgggugcgccggcgggagccaggucaucuucacgaacccgcucgagaucgugaagauccgccuccagguggccggcgagaucaccaccggcccccgggucagcgcccuguccguggugcgcgaccugggguucuucggcaucuacaagggggccaaggcgugcuuccugcgggacauccccuucagcgccaucuacuuccccugcuacgcccacgucaaggccuccuucgccaacgaggacggccaggugagcccggggucccugcuccuggcgggcgccaucgccggcaugcccgccgcgagccuggugacccccgccgacgucaucaagacgcgccuccagguggccgcccgggccgggcagaccaccuacuccggcgugaucgacugcuuccgcaagauccugcgggaggaggggcccaaggcgcuguggaagggcgccggcgcccgcgucuuccggagcuccccgcaguucggggugacccugcucacguacgagcugcugcagcgcugguucuacaucgacuucggcggggugaagcccaugggcagcgagcccguccccaagucccggaucaaccucccggcccccaaccccgaccacgucgggggcuacaagcuggccguggcgaccuucgccggcaucgagaacaaguucgggcuguaccucccgcuguucaagcccagcguguccaccagcaaggccaucggcgggggccccuga

SEQ ID NO: 36526 - RNA, 978 nt, Artificial Sequence
  derived and/or modified sequence opt1 from SLC25A14__Homo_sapiens__NP_001269124
augggcaucuuccccgggaucauccugaucuuccuccgcgugaaguucgccaccgccgcggucaucgugagcggccaccagaaguccaccacggugagccacgagauguccgggcugaacuggaagccguucgucuacggcgggcuggccagcaucguggccgaguucggcaccuuccccguggaccucaccaagacccggcugcagguccagggccaguccaucgacgcccgcuucaaggagaucaaguaccgggggauguuccacgcccuguuccgcaucugcaaggaggagggcgugcucgcgcuguacagcgggaucgcccccgcccugcuccggcaggccuccuacggcacgaucaagaucgggaucuaccagagccugaagcgccuguucguggagcggcucgaggacgagacccugcugaucaacaugaucugcggcgucguguccggcgugaucagcuccaccaucgcgaaccccaccgacguccucaagauccgcaugcaggcccaggggagccuguuccagggcuccaugaucgggagcuucaucgacaucuaccagcaggagggcacgcggggccuguggcgcgggguggugccgaccgcccagcgggccgccaucgucgugggcguggagcuccccgucuacgacaucaccaagaagcaccugauccuguccgggaugaugggcgacaccauccucacgcacuucgugagcuccuucacgugcgggcuggcgggcgcccuggccagcaaccccguggacgucgugcgcacccggaugaugaaccagcgcgccaucgugggccacgucgaccucuacaaggggaccguggacggcauccugaagauguggaagcacgagggguucuucgcccuguacaagggcuucuggcccaacuggcuccggcuggggccguggaacaucaucuucuucaucaccuacgagcagcugaagcgccuccagaucuga

SEQ ID NO: 36527 - RNA, 906 nt, Artificial Sequence
  derived and/or modified sequence opt1 from SLC25A15__Homo_sapiens__NP_055067
augaaguccaaccccgccauccaggccgcgaucgaccugaccgccggcgccgccgggggcaccgccugcgugcucacggggcagccguucgacaccaugaaggucaagaugcagaccuuccccgaccuguaccgcggccugaccgacugcugccucaagacguacagccaggugggguuccggggcuucuacaagggcaccagccccgcgcugaucgccaacaucgccgagaacuccgugcuguucaugugcuacggguucugccagcaggucgugcgcaagguggccggccucgacaagcaggcgaagcugagcgaccugcagaacgccgccgccggguccuucgccagcgcguucgccgcccucguccugugccccaccgagcuggugaagugccggcuccagaccauguacgagauggagacguccggcaagaucgccaagagccagaacaccgugugguccgucaucaagagcauccugcgcaaggacgggccgcugggcuucuaccacggccucuccagcacccugcugcgggaggugcccggguacuucuucuucuucggcggguacgagcucucccgcagcuucuucgccuccggccggagcaaggacgagcugggccccgugccccugaugcucuccgggggcgucgggggcaucugccuguggcuggcgguguacccgguggacugcaucaagagccgcauccagguccucuccaugagcgggaagcaggccggcuucauccggaccuucaucaacguggugaagaacgagggcaucacggcccuguacagcgggcugaagcccaccaugauccgcgccuuccccgccaacggcgcccucuuccuggcguacgaguacucccggaagcugaugaugaaccagcucgaggccuacuga

SEQ ID NO: 36528 - RNA, 705 nt, Artificial Sequence
  derived and/or modified sequence opt1 from SLC25A16__Homo_sapiens__XP_006718050
augaugauccgcaucuuccccuacggcgccauccaguucauggccuucgagcacuacaagacccugaucaccacgaagcucgggaucagcggccacgugcaccggcugauggcgggguccauggccggcaugaccgccgucaucugcaccuacccgcuggacauggugcgcgugcggcucgccuuccaggucaagggggagcacagcuacaccggcaucauccacgccuucaagacgaucuacgcgaaggagggcggguucuucggcuucuaccgcgggcugaugcccaccauccugggcauggcccccuacgccgggguguccuucuucaccuucggcacccucaagagcgugggccugucccacgcccccacgcugcucgggcggccgagcuccgacaaccccaacguccuggugcugaagacccacgugaaccuccugugcggcggggucgcgggcgccaucgcccagaccaucagcuaccccuucgacgugacccgccggcgcaugcagcugggcacggugcuccccgaguucgagaagugccugaccaugcgggacaccaugaaguacgucuacgggcaccacggcauccgcaaggggcuguaccggggccucucccugaacuacauccgcugcaucccgagccaggccguggccuucaccacguacgagcugaugaagcaguucuuccaccucaacuga

SEQ ID NO: 36529 - RNA, 948 nt, Artificial Sequence
  derived and/or modified sequence opt1 from SLC25A18__Homo_sapiens__NP_001290413
augacccaccaggaccugagcaucaccgccaagcucaucaacggcgggguggccggccuggucggggugacgugcguguuccccaucgaccuggcgaagacccgccuccagaaccagcacggcaaggccauguacaaggggaugaucgacugccugaugaagaccgcccgggccgagggcuucuucggcauguaccgcggggccgcggucaaccugacccucgugacgccggagaaggccaucaagcuggccgccaacgacuucuuccggcgccugcucauggaggacggcaugcagcggaaccugaagauggagaugcuggcggggugcggcgccgggaugugccagguggucgugaccugccccauggagaugcucaagauccagcugcaggacgccggccgccuggccgugcaccaccagggcuccgccagcgcgcccuccaccagccgguccuacaccacggggagcgccuccacccaccgccggcccagcgccacccucaucgccugggagcugcugcgcacccagggccucgccgggcuguaccggggccugggcgcgacgcuccugcgcgacaucccguucuccaucaucuacuucccccuguucgccaaccucaacaaccugggguucaacgagcuggccggcaaggccagcuucgcccacuccuucgucagcgggugcguggcgggcuccaucgccgccguggccgucacgccccucgacgugcugaagacccggauccagacccugaagaaggggcucggcgaggacauguacagcggcaucaccgacugcgcccgcaagcuguggauccaggaggggcccuccgcguucaugaagggcgccgggugccgggcccuggugaucgccccgcuguucggcaucgcgcagggggucuacuucaucggcaucggcgagcgcauccucaagugcuucgacuga

SEQ ID NO: 36530 - RNA, 963 nt, Artificial Sequence
  derived and/or modified sequence opt1 from SLC25A19__Homo_sapiens__XP_006722070
auggugggcuacgaccccaagccggacgggcgcaacaacaccaaguuccaggucgccguggccggcagcguguccgggcuggucacccgggcgcucaucagccccuucgacgugaucaagauccgcuuccagcugcagcacgagcggcugucccgcagcgaccccuccgccaaguaccacggcauccuccaggccagccggcagauccugcaggaggaggggcccacggccuucuggaagggccacgugccggcccagauccuguccaucggcuacggggcgguccaguuccucagcuucgagaugcugaccgagcuggugcaccgcggcuccguguacgacgcccgggaguucagcguccacuucgugugcgggggccucgccgccugcauggcgacccugaccgugcaccccgucgacgugcugcgcacgcgguucgccgcccagggggagcccaagguguacaacacccuccgccacgccgucggcaccauguaccgguccgagggcccccagguguucuacaaggggcuggccccgacccugaucgcgaucuuccccuacgccggccuccaguucagcugcuacuccagccugaagcaccuguacaagugggccauccccgccgaggggaagaagaacgagaaccuccagaaccugcugugcggcuccggcgccggggugaucagcaagacgcucaccuacccccuggaccuguucaagaagcgccuccaggucggcggguucgagcacgcgcgggccgccuucggccaggugcgccgguacaaggggcugauggacugcgccaagcagguccugcagaaggagggcgcccucggcuucuucaaggggcuguccccgagccugcucaaggcggcccuguccaccggcuucauguucuucagcuacgaguucuucugcaacguguuccacugcaugaaccgcaccgccagccagcgguga

SEQ ID NO: 36531 - RNA, 957 nt, Artificial Sequence
  derived and/or modified sequence opt1 from SLC25A1__Homo_sapiens__NP_001243463
auguuccccgccgcccuggcgcgccggccgcgccggcccaagagcggcaccggggagggccccgagcgccagcggcccgggggcucccuccgcagcggguucccggugcccgccggcggccuggccgggggcaucgagaucugcaucaccuuccccacggaguacgucaagacccagcugcagcucgacgagcggucccacccgccccgcuaccgggggaucggcgacugcgugcgccagaccgugcggagccacgggguccugggccuguaccgcggccucuccagccugcuguacggguccauccccaaggccgccgugcgguucggcauguucgaguuccucagcaaccacaugcgcgacgcgcaggggcggcuggacuccacccgcggccugcucugcggccugggggccggcguggccgaggccgucgugguggucugccccauggagacgaucaaggugaaguucauccacgaccagaccagccccaacccgaaguaccggggguucuuccacggcgugcgcgagaucguccgggagcaggggcugaagggcaccuaccagggccucaccgcgacggugcugaagcagggguccaaccaggccauccgcuucuucgugaugaccagccugcggaacugguaccgcggcgacaaccccaacaagcccaugaacccccucaucaccggggucuucggcgccaucgccggggccgcguccguguucggcaacaccccgcuggacgugaucaagacgcgcaugcagggccuggaggcccacaaguaccggaacaccugggacugcgggcuccagauccugaagaaggagggccugaaggccuucuacaaggggaccgucccccgccucggccgggugugccuggacguggccaucgucuucgugaucuacgacgagguggucaagcugcucaacaagguguggaagaccgacuga

SEQ ID NO: 36532 - RNA, 906 nt, Artificial Sequence
  derived and/or modified sequence opt1 from SLC25A20__Homo_sapiens__NP_000378
auggccgaccagcccaagccgaucagcccccugaagaaccuccuggccggcggguucggcggggugugccuggucuucgugggccacccccucgacaccgugaagguccgccugcagacccagcccccgucccugcccgggcagccgcccauguacagcggcacguucgacugcuuccggaagacccucuuccgcgagggcaucaccgggcuguaccggggcauggcggcccccaucaucggggugacccccauguucgccgugugcuucuucggcuucgggcugggcaagaagcuccagcagaagcaccccgaggacguccuguccuacccccagcuguucgccgccggcaugcucagcgggguguucacgaccggcaucaugaccccgggggagcgcaucaagugccugcugcagauccaggcguccagcggcgaguccaaguacaccggcacgcucgacugcgccaagaagcuguaccaggaguucgggauccggggcaucuacaaggggaccgugcugacccucaugcgcgacguccccgccagcggcauguacuucaugaccuacgaguggcugaagaacaucuucacgcccgaggggaagcggguguccgagcugagcgcgccccgcauccucguggccggcggcaucgccgggaucuucaacugggccgucgccaucccgcccgacgugcugaagucccgguuccagaccgccccgcccggcaaguaccccaacggguuccgcgacgugcugcgggagcucauccgcgacgagggcgucaccagccuguacaagggguucaacgcggugaugauccgggccuuccccgccaacgccgccugcuuccugggcuucgagguggcgaugaaguuccucaacugggccacccccaaccuguga

SEQ ID NO: 36533 - RNA, 897 nt, Artificial Sequence
  derived and/or modified sequence opt1 from SLC25A21__Homo_sapiens__NP_001164641
augagcgccaagcccgaggugucccugguccgcgaggccagccggcagaucguggcgggcggguccgccggccucguggagaucugccugaugcacccgcuggacgucgugaagacccgcuuccagauccagcggugcgccaccgaccccaacagcuacaagucccucguggacagcuuccgcaugaucuuccagauggaggggcuguucggcuucuacaaggggauccugccgcccauccucgccgagacgcccaagcgggccgucaaguucuucaccuucgagcaguacaagaagcugcugggcuacgugucccucagccccgcgcugaccuucgccaucgccggccugggguccggccucaccgaggccaucguggucaaccccuucgagguggugaaggucgggcugcaggcgaaccgcaacacguucgccgagcagcccagcaccgugggcuacgcccggcagaucaucaagaaggagggguggggccugcagggccucaacaaggggcugaccgccacccugggccgccacgggguguucaacauggucuacuucggcuucuacuacaacgugaagaacaugaucccggugaacaaggaccccauccucgaguucuggcggaaguucggcaucgggcugcuguccggcacgaucgccagcgucaucaacauccccuucgacguggcgaagucccgcauccaggggccccagccggugcccggcgagaucaaguaccggaccugcuucaagaccauggccaccgucuaccaggaggaggggauccucgcccuguacaagggccugcuccccaagaucaugcgccugggccccgggggcgccgugaugcugcucguguacgaguacacguacagcuggcugcaggagaacuga

SEQ ID NO: 36534 - RNA, 972 nt, Artificial Sequence
  derived and/or modified sequence opt1 from SLC25A22__Homo_sapiens__XP_011518673
auggccgacaagcagaucagccugcccgccaagcucaucaacggcgggaucgccggccugaucggggugaccugcgucuucccgaucgaccuggccaagacccgccuccagaaccagcagaacggccagcggguguacacguccaugagcgacugccugaucaagaccgugcgcuccgagggguacuucggcauguaccggggcgccgccgucaaccugacccucgugacccccgagaaggccaucaagcuggcggccaacgacuucuuccgccaccagcugagcaaggacgggcagaagcucacgcugcugaaggagaugcucgccggcugcggggccgggaccugccaggugaucgucaccacccccauggagaugcugaagauccagcugcaggacgcgggccggaucgccgcccagcgcaagauccucgccgcccagggccagcuguccgcgcagggcggggcccagcccagcguggaggccccggccgccccgcggcccacggcgacccagcugacccgcgaccuccugcggucccgcggcaucgccgggcuguacaagggccucggcgccacccugcugcgggacgugcccuucagcgucguguacuucccccucuucgccaaccugaaccagcuggggcgccccgccuccgaggagaagucccccuucuacgugagcuuccucgcgggcugcgucgccgggagcgccgccgccguggcggugaaccccugcgacgucgugaagacgcggcugcagucccugcagcgcggcgugaacgaggacaccuacagcgggauccucgacugcgcccggaagauccugcgccacgagggcccguccgccuuccugaagggcgccuacugccgggcgcucgucaucgcgccccuguucgggaucgcccaggugguguacuuccugggcaucgccgagagccuccuggggcugcuccaggacccccaggccuga

SEQ ID NO: 36535 - RNA, 1407 nt, Artificial Sequence
  derived and/or modified sequence opt1 from SLC25A23__Homo_sapiens__NP_077008
augcgcggcagccccggggacgccgagcggcgccagcgguggggccgccuguucgaggagcucgacuccaacaaggacgggcggguggacguccacgagcugcgccagggccuggcccggcucgggggcggcaacccggaccccggggcgcagcagggcaucagcuccgagggggacgccgaccccgacggcgggcuggaccuggaggaguucagccgcuaccuccaggagcgggagcagcgccugcugcucauguuccacucccuggaccggaaccaggacggccacaucgacgugagcgagauccagcaguccuuccgcgcccugggcaucagcaucucccucgagcaggccgagaagauccugcacagcauggaccgggacgggaccaugaccaucgacuggcaggaguggcgcgaccacuuccugcuccacucccuggagaacguggaggacguccuguacuucuggaagcacagcacggugcucgacaucggcgagugccugaccgugcccgacgaguucuccaagcaggagaagcugaccgggaugugguggaagcagcucgucgccggcgcgguggccggcgccgugagccggaccgggacggccccgcuggaccgccugaaggucuucaugcagguccacgcguccaagaccaaccggcucaacauccugggcgggcugcgcagcauggugcucgagggcgggauccggucccuguggcgcggcaacggcaucaacgugcugaagaucgcccccgagagcgccaucaaguucauggccuacgagcagaucaagcgggccauccucgggcagcaggagacccugcacgugcaggagcgcuucguggcgggcucccuggccggggccaccgcccagacgaucaucuaccccauggagguccucaagacccgccugacccugcggcgcaccggccaguacaaggggcuccuggacugcgcccggcgcauccuggagcgggagggcccccgcgcguucuaccggggcuaccucccgaacgugcuggggaucauccccuacgccggcaucgaccuggccguguacgagacgcucaagaacugguggcugcagcaguacagccacgacagcgccgaccccgggauccugguccuccuggccugcggcaccaucuccagcacgugcgggcagaucgcguccuacccccuggcccucgugcgcacccggaugcaggcccaggccagcaucgagggcggcccgcagcuguccaugcuggggcugcuccgccacauccugagccaggagggcaugcgggggcuguaccgcggcaucgcccccaacuucaugaaggugauccccgcggucuccaucagcuacgugguguacgagaacaugaagcaggcccucggcgucaccucccgguga

SEQ ID NO: 36536 - RNA, 1512 nt, Artificial Sequence
  derived and/or modified sequence opt1 from SLC25A25__Homo_sapiens__NP_001006642
auggugagcuccguccugugccgcugcguggccagcccgccgcccgacgccgcggccaccgccgccuccagcuccgccagcucccccgcgagcgugggcgaccccugcgggggcgccaucugcgggggccccgaccaccggcuccgccuguggcggcuguuccagacccucgacgucaaccgcgacgggggccugugcgugaacgaccuggccgugggccuccggcgccuggggcugcaccggacggagggcgagcuccagaagaucguccaggccggggacaaggaccuggacggccagcuggacuucgaggaguucgugcacuaccuccaggaccacgagaagaagcugcgccugguguucaagucccucgacaagaagaacgacgggcggaucgacgcgcaggagaucaugcagagccugcgcgaccugggcgucaagaucuccgagcagcaggccgagaagauccucaagagcauggacaagaacggcaccaugaccaucgacuggaacgaguggcgggacuaccaccuccugcaccccguggagaacauccccgagaucauccuguacuggaagcacuccaccaucuucgacgugggggagaaccugacgguccccgacgaguucaccguggaggagcgccagaccggcaugugguggcggcaccugguggccgggggcggcgccggggccgucagccggaccugcacggcgccgcucgaccgccugaaggugcugaugcagguccacgccucccgcagcaacaacaugggcaucgucgggggcuucacccagaugauccgggagggcggggcccgcucccucuggcggggcaacgggaucaacgugcugaagaucgcccccgagagcgccaucaaguucauggcguacgagcagaucaagcgccuggugggcuccgaccaggagacccuccggauccacgagcgccugguggccgggagccuggccggcgccaucgcccagagcuccaucuaccccauggaggugcucaagacccgcauggcgcugcggaagacggggcaguacagcggcaugcuggacugcgcccgccggauccucgcccgcgagggcguggccgccuucuacaagggguacguccccaacaugcugggcaucaucccguacgcggggaucgaccuggccguguacgagacccucaagaacgccuggcugcagcacuacgccgucaacuccgcggaccccggcguguucgugcugcucgccugcgggaccaugagcuccacgugcggccagcuggccagcuacccccuggcccucguccggacccgcaugcaggcccaggcguccaucgagggcgcccccgaggugaccaugagcucccuguucaagcacauccugcggaccgagggggccuucggccucuaccgcgggcuggccccgaacuucaugaaggugauccccgccgucagcaucuccuacgugguguacgagaaccugaagaucacccugggcguccagagccgguga

SEQ ID NO: 36537 - RNA, 903 nt, Artificial Sequence
  derived and/or modified sequence opt1 from SLC25A27__Homo_sapiens__NP_001190980
augagcgugcccgaggaggaggagcgccugcucccgcugacccagcgguggccccgcgccuccaaguuccugcucagcggcugcgccgcgaccgucgccgagcuggccacguucccccuggaccucaccaagacccggcugcagaugcagggggaggccgcccuggcgcgccucggcgacggggcccgggaguccgcccccuaccgcggcauggugcggaccgcccuggggaucaucgaggaggagggcuuccugaagcucuggcagggcgugacgccggcgaucuaccgccacgucguguacagcgggggccggauggugaccuacgagcaccuccgcgaggucguguucgggaaguccgaggacgagcacuacccccuguggaaguccgugaucggcgggaugauggccggcgucaucggccaguuccuggccaaccccaccgaccuggugaaggugcagaugcagauggaggggaagcggaagcuggagggcaagccccuccgcuuccgcgggguccaccacgccuucgccaagauccuggcggagggcggcauccgggggcugugggccggcugggugccgaacauccagcgggccgcccucgugaacaugggggaccugaccacguacgacaccgucaagcacuaccuggugcucaacacgccccuggaggacaacaucaugacccacggccugagcagccucugcuccgggcugguggccagcauccugggcacccccgcggacgucaucaagucccgcaucaugaaccagccccgggacaagcagggccgcgggcuccuguacaagagcuccaccgacugccugauccaggccgugcagggcgagggguucaugagccucuacaagggcuuccugccguccuggcugcggauguga

SEQ ID NO: 36538 - RNA, 906 nt, Artificial Sequence
  derived and/or modified sequence opt1 from SLC25A2__Homo_sapiens__NP_114153
augaaguccggccccgggauccaggccgccaucgaccugaccgcgggcgccgccgggggcaccgccugcgugcucacggggcagccguucgacaccaucaaggucaagaugcagaccuuccccgaccuguacaagggccugaccgacugcuuccucaagacguacgcccaggugggccugcgcggguucuacaagggcaccgggcccgcgcugauggccuacguggccgagaacagcguccucuucaugugcuacggcuucugccagcaguucgugcggaagguggccgggauggacaagcaggcgaagcugagcgaccugcagaccgccgccgccggcuccuucgccagcgcguucgccgcccucgcccugugccccaccgagcuggucaagugccgccuccagacgauguacgagauggagauguccggcaagaucgccaagagccacaacaccaucugguccguggugaaggggauccugaagaaggacggcccgcugggguucuaccacggccucagcuccacccugcugcaggagguccccggcuacuucuucuucuucgggggcuacgagcucagccgguccuucuucgcgagcgggcgcuccaaggacgagcugggccccgugcaccugaugcucagcgggggcguggccggcaucugccuguggcuggucguguuccccguggacugcaucaagucccggauccagguccucagcauguacgggaagcaggccggcuucaucgggacccugcuguccguggugcgcaacgagggcaucgucgcccucuacagcgggcugaaggccacgaugauccgggcgaucccggccaacggcgcccuguucguggccuacgaguacucccgcaagaugaugaugaagcagcucgaggccuacuga

SEQ ID NO: 36539 - RNA, 936 nt, Artificial Sequence
  derived and/or modified sequence opt1 from SLC25A36__Homo_sapiens__NP_001098117
augagccagcgcgacacccuggugcaccucuucgccggcgggugcggcgggaccgucggcgccauccugacgugcccccuggagguggugaagacccggcuccaguccagcuccgucacccuguacaucagcgaggugcagcugaacaccauggcgggggccuccgugaaccgcgucgugagcccgggcccccuccacugccugaaggugauccuggagaaggagggcccccggucccucuuccgcgggcugggccccaaccuggucgggguggccccgagccgggccaucuacuucgccgcguacuccaacugcaaggagaagcucaacgacguguucgaccccgacagcacgcagguccacaugaucuccgccgccauggccggcuucaccgcgaucaccgccaccaaccccaucuggcugaucaagacgcgccugcagcucgacgcccggaaccgcggggagcggcgcaugggcgccuucgagugcgugcggaagguguaccagaccgacggccugaagggguucuaccgcggcaugagcgccuccuacgcggggaucagcgagaccgucauccacuucgugaucuacgaguccaucaagcagaagcugcucgaguacaagaccgccagcacgauggagaacgacgaggaguccgugaaggaggccagcgacuucgucggcaugaugcuggccgccgcgaccuccaagaccugcgccaccacgaucgccuacccccacgagguggugcggacccgccugcgggaggagggcaccaaguaccgcagcuucuuccagacccucagccugcugguccaggaggagggguacggcucccucuaccgggggcugacgacccaccuggugcgccagaucccgaacaccgccaucaugauggccaccuacgagcucguggucuaccugcugaacggcuga

SEQ ID NO: 36540 - RNA, 1017 nt, Artificial Sequence
  derived and/or modified sequence opt1 from SLC25A37__Homo_sapiens__NP_057696
auggagcugcgcagcggcuccguggggagccaggccgucgcccggcgcauggacggcgacucccgggacgggggcgggggcaaggacgcgaccggcagcgaggacuacgagaaccuccccaccuccgccagcguguccacgcacaugaccgccggggccauggccggcauccuggagcacagcgugauguacccggucgacuccgugaagacccgcaugcagagccugucccccgaccccaaggcgcaguacaccagcaucuacggggcccucaagaagaucaugcggacggagggcuucuggcgcccccugcgcggggugaacgucaugaucaugggcgccggcccggcccacgcgauguacuucgccugcuacgagaacaugaagcggacccugaacgacguguuccaccaccaggggaacucccaccucgccaacggcaucgccgggagcauggccacccugcugcacgacgcggugaugaaccccgccgaggucgugaagcagcggcuccagauguacaacucccagcaccgcagcgccaucuccugcauccggaccguguggcgcacggagggccugggcgccuucuaccggagcuacaccacccagcugaccaugaacauccccuuccaguccauccacuucaucacguacgaguuccuccaggagcaggucaacccccaccgcaccuacaacccgcagagccacaucaucagcgggggccuggccggggcgcuggccgccgccgccaccacgccccucgacgugugcaagacccugcugaacacccaggagaacguggcgcucucccuggccaacaucagcggccggcuguccgggauggccaacgccuuccgcaccgucuaccagcucaacggccuggccggcuacuucaaggggauccaggcgcgggugaucuaccagaugcccagcaccgccaucuccuggagcguguacgaguucuucaaguacuuccugacgaagcgccagcucgagaaccgggcccccuacuga

SEQ ID NO: 36541 - RNA, 915 nt, Artificial Sequence
  derived and/or modified sequence opt1 from SLC25A38__Homo_sapiens__NP_060345
augauccagaacagccgccccucccugcugcagccgcaggacgugggcgacaccgucgagacccugaugcugcaccccgugaucaaggccuuccucugcgggagcaucuccggcacgugcagcacccugcuguuccagccccucgaccugcugaagacccggcuccagacccugcagcccuccgaccacgggagccgccgggugggcaugcuggccguccuccugaagguggugcgcacggagucccugcucgggcuguggaagggcaugagcccguccaucguccggugcgugcccggcguggggaucuacuucggcacccuguacagccucaagcaguacuuccugcgcgggcacccgcccaccgcgcuggaguccgucaugcucggcguggggagccgguccguggccggcgucugcaugagccccaucaccgugaucaagacgcgcuacgaguccggcaaguacggguacgagagcaucuacgccgcccugcgguccaucuaccacagcgagggccaccgcgggcuguucuccggccucaccgccacccugcugcgggacgcgcccuucagcggcaucuaccucauguucuacaaccagaccaagaacaucgugccccacgaccaggucgacgccacgcugauccccaucaccaacuucagcugcgggaucuucgccggcauccuggccucccucgugacccagccggcggacgugaucaagacccacaugcagcuguacccccugaaguuccaguggaucgggcaggccgucacgcucaucuucaaggacuacggccugcgcggguucuuccagggcggcaucccccgggcccugcgccggacccucauggccgccauggcguggaccguguacgaggagaugauggccaagauggggcucaagagcuga

SEQ ID NO: 36542 - RNA, 1086 nt, Artificial Sequence
  derived and/or modified sequence opt1 from SLC25A3__Homo_sapiens__NP_002626
auguucagcuccguggcccaccuggcccgcgcgaaccccuucaacaccccgcaccuccagcugguccacgacggccugggggaccuccgcagcuccagccccggccccaccgggcagccccgccggccgcgcaaccuggccgccgccgccguggaggaguacuccugcgaguucggcagcgcgaaguacuacgcccugugcggguucggcggcgugcucuccugcgggcugacgcacaccgccgucgugccccuggaccucgugaagugccggaugcaggucgacccccagaaguacaagggcaucuucaacggguucagcgugacccugaaggaggacggcgugcgcgggcuggccaagggcugggcgcccaccuuccucggcuacuccaugcaggggcugugcaaguucggcuucuacgaggucuucaaggugcuguacagcaacaugcucggggaggagaacacguaccuguggcggaccucccuguaccucgccgccagcgccuccgccgaguucuucgcggacaucgcccuggcccccauggaggccgccaaggugcgcauccagacccagcccggcuacgcgaacacccugcgggacgccgcccccaagauguacaaggaggagggccucaaggccuucuacaagggggucgcgccccuguggaugcgccagaucccguacacgaugaugaaguucgccugcuucgagcggaccguggaggcccuguacaaguucgugguccccaagccccgcagcgagugcuccaagcccgagcagcucguggugaccuucgucgccggcuacaucgccgggguguucugcgccaucgugagccacccggcggacuccgucgugagcgugcugaacaaggagaagggcuccagcgccagccugguccucaagcggcugggguucaagggcguguggaagggccuguucgcccgcaucaucaugaucgggacccucacggcccugcagugguucaucuacgacuccgucaagguguacuuccggcugccccggcccccgccgcccgagaugcccgagagccucaagaagaagcugggccugacccaguga

SEQ ID NO: 36543 - RNA, 1017 nt, Artificial Sequence
  derived and/or modified sequence opt1 from SLC25A40__Homo_sapiens__NP_061331
auggaccccgagacccgcggccaggagaucaucaaggugaccccgcugcagcagaugcucgccagcugcacgggggccauccugaccuccgucaucgugacgccccuggacguggucaagauccggcuccaggcgcagaacaacccccugcccaagggcaagugcuucguguacagcaacgggcugauggaccaccucugcgugugcgaggagggcgggaacaagcugugguacaagaagccgggcaacuuccagggcacccuggacgccuucuucaagaucauccgcaacgaggggaucaagucccucuggagcggccugccgcccacccuggucauggccgugcccgccaccgugaucuacuucacgugcuacgaccagcucuccgcccugcugcggagcaagcucggggagaacgagaccugcauccccaucgucgcgggcaucguggcccgcuucggggccgugaccgucaucagcccccuggagcugauccggaccaagaugcagagcaagaaguucuccuacguggagcuccaccgcuucgugagcaagaaggucuccgaggacggcuggaucagccuguggcggggcugggcccccaccgugcugcgcgacgugcccuucuccgcgauguacugguacaacuacgagauccucaagaaguggcugugcgagaaguccgggcuguacgagccgaccuucaugaucaacuucacguccggcgcccucagcggguccuucgccgccgucgccacccugcccuucgacguggugaagacccagaagcagacccagcuguggacguacgagagccacaagaucuccaugccccuccacaugagcaccuggaucaucaugaagaacaucgucgcgaagaacggcuucagcggccuguucuccgggcugaucccccggcucaucaagaucgccccggccugcgccaucaugaucagcaccuacgaguucggcaaggccuucuuccagaagcagaacgugcgccggcagcaguacuga

SEQ ID NO: 36544 - RNA, 1113 nt, Artificial Sequence
  derived and/or modified sequence opt1 from SLC25A41__Homo_sapiens__NP_775908
augggcgcccagcccggggagccgcagaacaccugcagccgcauccagacccuguuccggcgcgugaagacgcuccugaucaaggcccccccccccccgcagcccccccccccgccccccuccuggaaccccggcugcacccacgucuacggguacgcguucggccacaugcacgacaacaaccuggagcaccucccgagccagcaggugcuggacaccggggagcagcugauggugcccgucgaggugcucgagguggacaacaaggaggcccuguggaaguuccugcucuccggcgccauggccggcgccgucagccggaccgggacggcgccccuggaccgcgccaagguguacaugcagguguacuccagcaagaccaacuucaccaaccugcucggcgggcugcaguccaugguccaggagggcggguuccggagccuguggcgcggcaacggcaucaacgugcucaagaucgcccccgaguacgccaucaaguucuccguguucgagcagugcaagaacuacuucugcgggauccagggcagcccgcccuuccaggagcggcugcuggcggggucccucgccgucgccaucagccagacccugaucaaccccauggaggugcugaagacgcgccucacccugcggcgcaccggccaguacaagggccugcucgacugcgcccggcagauccugcagcgcgaggggacccgggcccuguaccgcggcuaccuccccaacaugcuggggaucaucccguacgcgugcacggaccuggccguguacgagaugcuccagugcuucugggucaaguccggccgggacaugggggaccccagcggccuggugucccugagcuccgugacccucagcaccaccugcggccagauggccuccuacccccugacgcugguccgcacccggaugcaggcccaggacaccguggaggggagcaaccccaccaugcgcggcgugcuccagcggauccuggcccagcagggguggcugggccucuaccgcgggaugacgccgacccugcugaagguccuccccgcgggcggcaucagcuacgugguguacgaggccaugaagaagacccuggggaucuga

SEQ ID NO: 36545 - RNA, 957 nt, Artificial Sequence
  derived and/or modified sequence opt1 from SLC25A42__Homo_sapiens__NP_848621
augggcaacggggugaaggagggccccguccgccugcacgaggacgccgaggccgugcugagcuccagcguguccagcaagcgggaccaccgccagguccuguccagccugcucuccggggcgcuggccggcgcccuggccaagaccgccguggcgccgcucgaccggaccaagaucaucuuccaggugagcuccaagcgcuucagcgccaaggaggccuuccggguccuguacuacacguaccugaacgagggguuccucucccuguggcgcggcaacagcgccaccauggugcgggugguccccuacgcggccauccaguucuccgcccacgaggaguacaagcgcauccugggcagcuacuacggguuccggggcgaggcccucccgcccuggccccgccuguucgccggggcgcuggccggcaccaccgccgccucccucacguacccccuggaccuggugcgggcccgcauggcggugacccccaaggagauguacagcaacaucuuccacgucuucauccggaucucccgcgaggaggggcucaagacccuguaccacggcuucaugcccaccgugcugggcgugaucccguacgccgggcucagcuucuucacguacgagacccugaagucccugcaccgggaguacagcggccgccggcagcccuaccccuucgagcgcaugaucuucggggccugcgccggccucaucggccagagcgccuccuacccccuggacgucgugcggcgccggaugcagaccgcgggggugaccggcuacccgcgcgccagcaucgcccgcacgcugcggaccaucguccgcgaggagggggccgugcggggccucuacaaggggcuguccaugaacugggugaagggccccaucgccgucggcaucagcuucaccaccuucgaccugaugcagauccuccugcgccaccuccaguccuga

SEQ ID NO: 36546 - RNA, 1026 nt, Artificial Sequence
  derived and/or modified sequence opt1 from SLC25A43__Homo_sapiens__NP_660348
auggccaccuggcgccgggacggccgccugaccgggggccagcggcuccugugcgccgggcuggcgggcacgcucagccugucccugaccgcgccccucgagcuggccaccgugcuggcccaggucgggguggugcgcggccacgcccggggcccgugggccaccgggcaccgcgucuggcgggccgagggccuccgcgcccuguggaaggggaacgccguggcgugccugcgccucuuccccugcagcgccgugcagcuggccgccuaccggaaguucgucgugcuguucacggacgaccucggccacaucucccaguggagcuccaucauggccgggagccuggcgggcaugguguccaccaucgucaccuaccccaccgaccugaucaagacgcggcucaucaugcagaacauccuggagcccagcuaccgcggccugcuccacgccuucuccaccaucuaccagcaggagggguuccuggcccuguaccggggcgugagccucaccguggucggggcccugccguucuccgccggcagccugcucguguacaugaaccuggagaagaucuggaacggcccccgcgaccaguucucccugccccagaacuucgcgaacgugugccucgccgccgccgucacccagacgcugagcuuccccuucgagaccgugaagcggaagaugcaggcccaguccccguaccugccccacagcgggggcguggacguccacuucuccggggcgguggacugcuuccgccagaucgugaaggcccagggcguccucgggcuguggaacggccugaccgccaaccuccugaagaucgugcccuacuucggcaucauguucagcaccuucgaguucugcaagcggaucugccuguaccagaacggguacauccucagcccccuguccuacaagcugacgccgggcguggaccagagccuccagccccaggagcugcgcgagcugaagaaguucuucaagacccggaagcccaagcccaagaagccgacccucuga

SEQ ID NO: 36547 - RNA, 795 nt, Artificial Sequence
  derived and/or modified sequence opt1 from SLC25A45__Homo_sapiens__NP_001265179
augcccguggaggaguucgucgccggcuggaucagcggggcccugggccucgugcuggggcacccguucgacaccgugaagcugcucggcuucuucaaggggauguccuuccccaucgcgagcaucgccgucgugaacuccgugcuguucggcgucuacagcaacacccugcucgugcugacggccaccucccaccaggagcgccgggcccagccccccagcuacaugcacaucuuccuggccggcugcaccgggggcuuccuccaggcguacugccuggccccguucgaccugaucaaggugcgccuccagaaccagaccgagccccgggcccagcccgggucccccccgccccgcuaccagggccccguccacugcgccgcgagcaucuuccgggaggaggggccccgcggccuguuccggggcgccugggcccugacgcuccgcgacaccccgaccguggggaucuacuucaucaccuacgagggccugugccggcaguacacgcccgaggggcagaaccccuccagcgccaccgugcuggucgccggcggcuucgcggggaucgccuccuggguggccgccaccccccucgacgugaucaagagccgcaugcagauggacggccugcggcgccgggucuaccaggggaugcuggacugcaugguguccagcauccgccaggagggccucgggguguucuuccggggcgucaccaucaacuccgcccgcgcguucccggugaacgccgugacguuccugagcuacgaguaccugcuccggugguggggcuga

SEQ ID NO: 36548 - RNA, 1014 nt, Artificial Sequence
  derived and/or modified sequence opt1 from SLC25A46__Homo_sapiens__NP_001290178
augcacccccgccggccggacggcuucgacgggcugggcuaccgcgggggcgcccgggacgagcagggguucggcggcgccuuccccgcgcgcagcuucuccaccgggagcgaccucggccacugggugaccacgccgcccgacauccccgggucccggaaccugcacuggggcgagaaguccccgcccuacgggguccccaccaccagcacccccuacgagggccccacggaggagcccuucagcuccggcgggggcgggagcgugcagggccaguccagcgagcagcugaaccgcuucgccggcuucgggaucggccucgccucccuguucaccgagaacgugcuggcccaccccugcaucguccuccggcgccagugccaggugaacuaccacgcccagcacuaccaccugaccccguucaccgugaucaacaucauguacagcuucaacaagacgcaggggccccgggcgcuguggaagggcaugggguccaccuucaucguccagggcgugacccucggcgccgaggggaucaucagcgaguucacgccccugccccgcgaggugcugcacaagugguccccgaagcagaucggcgagcaccuccugcucaagagccugaccuacgucguggccaugcccuucuacuccgccagccugaucgagaccgugcaguccaugcuggacgcguacuuccccgagcucaucgccaacuucgccgccagccugugcagcgacgucauccuguacccccucgagaccgugcugcaccggcugcacauccaggggacccgcacgaucaucgacaacaccgaccucggcuacgaggugcugccgaucaacacccaguacgaggggaugcgggacugcaucaacaccauccgccaggaggagggcgucuucggcuucuacaagggguucggcgccgugaucauccaguacacgcugcacgcggccgugcuccagaucaccaagaucaucuacuccacccugcugcagaacaacaucuga

SEQ ID NO: 36549 - RNA, 927 nt, Artificial Sequence
  derived and/or modified sequence opt1 from SLC25A47__Homo_sapiens__NP_997000
auggacuucguggccggcgccaucgggggcgucugcgggguggcggugggcuacccccuggacaccgucaaggugcgcauccagaccgagccgaaguacacggggaucuggcacugcgugcgggacaccuaccaccgcgagcgggucuggggcuucuaccgcggccucagccugcccgugugcaccgugucccuggucagcuccgugagcuucgggaccuaccggcacugccucgcccacaucugccgccugcgguacggcaaccccgacgccaagcccacgaaggccgacaucacccuguccgggugcgccagcggccucgugcgcgucuuccugaccuccccgaccgagguggcgaaggugcggcugcagacgcagacccaggcccagaagcagcagcgccggcucagcgccuccgggccccuggccgucccgcccaugugccccgugccgcccgcgugccccgagcccaaguaccgcggcccccugcacugccucgccaccguggcccgggaggagggccugugcgggcuguacaagggcagcuccgcccucguccugcgcgacgggcacagcuucgccaccuacuuccuguccuacgcggugcucugcgaguggcugagccccgccggccacucccggcccgacgugccgggcguccugguggccgggggcugcgccggggugcucgccugggcggucgccacgcccauggacgugaucaagagccgccugcaggccgacggccaggggcagcggcgcuaccggggccugcuccacugcauggucaccuccgugcgcgaggagggcccccgggugcuguucaaggggcugguccucaacugcugccgcgccuuccccgugaacaugguggucuucguggccuacgaggcggugcugcgccuggcccggggccuccugaccuga

SEQ ID NO: 36550 - RNA, 897 nt, Artificial Sequence
  derived and/or modified sequence opt1 from SLC25A4__Homo_sapiens__NP_001142
augggcgaccacgccuggagcuuccugaaggacuuccucgccgggggcguggcggccgccgucuccaagaccgccguggcccccaucgagcgcgugaagcugcugcuccagguccagcacgcgagcaagcagaucuccgccgagaagcaguacaaggggaucaucgacugcguggugcggaucccgaaggagcagggcuuccugagcuucuggcgcgggaaccuggccaacgucauccgguacuuccccacccaggcccucaacuucgcguucaaggacaaguacaagcagcuguuccugggcggcguggaccgccacaagcaguucuggcgguacuucgccgggaaccucgccuccggcggggccgccggcgcgacgagccugugcuucguguacccccuggacuucgcccgcacccggcucgccgccgacgucgggaagggcgccgcgcagcgcgaguuccacggccugggggacugcaucaucaagaucuucaaguccgacggccugcgggggcucuaccagggcuucaacgugagcgugcagggcaucaucaucuaccgcgccgccuacuucggggucuacgacaccgccaagggcaugcugcccgacccgaagaacgugcacaucuucguguccuggaugaucgcccagagcgucaccgcgguggccgggcugguguccuaccccuucgacacgguccggcgccggaugaugaugcagagcggccgcaagggggccgacaucauguacaccggcaccguggacugcuggcggaagaucgccaaggacgagggcgccaaggcguucuucaagggggccugguccaacgugcuccgcggcaugggcggggccuucguccuggugcuguacgacgagaucaagaaguacguguga

SEQ ID NO: 36551 - RNA, 924 nt, Artificial Sequence
  derived and/or modified sequence opt1 from SLC25A52__Homo_sapiens__NP_001029344
augcccuucaugcgcaagauccugagcaacaugaucgacuccgaggcccacgagaagcggccgcccauccucaccagcuccaagcaggacaucagcccccacaucaccaacgugggcgagaugaagcacuaccugugcgggugcugcgccgcguucaacaacgucgccaucacguaccccauccagaaggugcuguuccgccagcagcucuacggcaucaagacccgggacgccgugcugcagcugcgccgggacggguuccgcaaccucuaccggggcauccugccgccccugaugcagaagaccaccacgcucgcccugauguucgggcuguacgaggaccucuccugccugcugcgcaagcacguccgggcccccgaguucgcgacccacggcguggccgccgugcucgccggcaccgcggaggccaucuucacgccccuggagcgcguccagacccugcuccagaaccacaagcaccacgacaaguucaccaacaccuaccaggccuucaaggcccugaagugccacgggaucggcgaguacuaccgggggcuggugccgauccucuuccgcaacggccugagcaacgugcuguucuucgggcuccggggccccaucaaggagcaccuccccaccgccacgacccacuccgcgcaccuggucaacgacuucaucggcgggggccugcugggggccaugcugggcuuccucugcuuccccaucaacguggugaagacccgccugcagagccagaucggcggggaguuccaguccuucccgaaggucuuccagaagaucuggcuggagcgggaccgcaagcucaucaaccuguuccggggcgcccaccugaacuaccaccgcagccucaucuccugggggaucaucaacgccaccuacgaguuccugcugaaguucaucuga

SEQ ID NO: 36552 - RNA, 897 nt, Artificial Sequence
  derived and/or modified sequence opt1 from SLC25A5__Homo_sapiens__NP_001143
augaccgacgccgccgugagcuucgcgaaggacuuccuggccggcggggucgccgccgccaucuccaagaccgcgguggcccccaucgagcgcgugaagcuccugcugcagguccagcacgccagcaagcagaucacggccgacaagcaguacaagggcaucaucgacugcguggugcggaucccgaaggagcaggggguccucuccuucuggcgcggcaaccuggcgaacgugauccgguacuuccccacccaggcccugaacuucgccuucaaggacaaguacaagcagaucuuccucgggggcguggacaagcgcacccaguucuggcuguacuucgccggcaaccuggccagcgggggcgcggccggggccaccucccucugcuucgucuacccccuggacuucgcccggacgcgccuggccgcggacgugggcaaggccggggccgagcgggaguuccgcggccucggcgacugccuggugaagaucuacaagagcgacgggaucaagggccuguaccagggguucaacgucuccgugcagggcaucaucaucuaccgggccgccuacuucggcaucuacgacaccgcgaaggggaugcuccccgacccgaagaacacccacaucgugaucagcuggaugaucgcccagaccgucacggccguggccggccugaccuccuaccccuucgacaccgugcgccggcgcaugaugaugcagagcgggcggaagggcaccgacaucauguacacggggacccuggacugcuggcgcaagaucgcccgggacgagggcggcaaggcguucuucaagggggccugguccaacguccuccgcggcaugggcggggccuucgugcuggugcuguacgacgagaucaagaaguacaccuga

SEQ ID NO: 36553 - RNA, 897 nt, Artificial Sequence
  derived and/or modified sequence opt1 from SLC25A6__Homo_sapiens__NP_001627
augaccgagcaggccaucagcuucgccaaggacuuccuggcgggcgggaucgccgccgccaucuccaagaccgccguggcgcccaucgagcgcgucaagcuccugcuccaggugcagcacgccagcaagcagaucgccgccgacaagcaguacaagggcaucguggacugcaucguccggaucccgaaggagcagggggugcuguccuucuggcgcggcaaccuggcgaacgugauccgguacuuccccacgcaggcccugaacuucgccuucaaggacaaguacaagcagaucuuccucgggggcgucgacaagcacacccaguucuggcgcuacuucgccggcaaccuggccagcgggggcgcggccggggccaccucccugugcuucguguacccccucgacuucgcccggacccgccuggccgcggacgugggcaagagcgggacggagcgggaguuccgcggccugggcgacugccucgucaagaucaccaaguccgacgggauccggggccuguaccagggguucagcguguccgugcagggcaucaucaucuaccgcgccgccuacuucggcgucuacgacaccgccaaggggaugcugcccgacccgaagaacacccacaucguggugagcuggaugaucgcccagacggucaccgcgguggccggcguggucuccuaccccuucgacaccgugcggcgccggaugaugaugcagagcgggcgcaagggcgccgacaucauguacaccgggacgguggacugcuggcggaagaucuuccgcgacgagggcggcaaggccuucuucaagggggccugguccaacguccuccggggcaugggcggggcguucgugcuggugcuguacgacgagcucaagaaggucaucuga

SEQ ID NO: 36554 - RNA, 2106 nt, Artificial Sequence
  derived and/or modified sequence opt1 from SLC26A1__Homo_sapiens__NP_071325
auggacgagagccccgagccgcugcagcagggccgcgggcccgugcccguccggcgccagcggcccgccccgcgcggccuccgggagaugcugaaggcccgccuguggugcuccugcagcugcuccgugcucugcgugcgggcgcugguccaggaccugcuccccgccacccgcuggcugcggcaguaccgcccccgggaguaccuggccggggacgugaugagcggccucgugaucgggaucauccuggucccccaggccaucgccuacucccugcucgcgggccugcagccgaucuacagccuguacaccuccuucuucgccaaccucaucuacuuccugaugggcacgagccgccacguguccguggggaucuucagccugcucugccugauggucggccaggugguggaccgggagcugcagcucgccggguucgaccccucccaggacggccugcagcccggggccaacagcuccacccugaacggcagcgcggccaugcucgacugcggccgcgacugcuacgccauccgggucgccaccgcccugacccugaugacggggcucuaccaggugcugaugggcgugcugcgccucggguucgucuccgcguaccugagccagccccugcucgacggcuucgccaugggcgccuccgugaccauccugaccagccagcugaagcaccuccugggggugcggaucccgcgccaccagggccccgggauggucgugcugaccuggcucucccugcugcggggcgccgggcaggccaacgugugcgacgucgugacgagcaccgugugccucgcgguccugcuggccgccaaggagcucagcgaccgcuaccggcaccgccugcgcgugccccugcccaccgagcuccuggucaucgugguggccacccuggucucccacuucggccagcugcacaagcgguucggcagcuccguggccggggacaucccgacgggcuucaugccgccccaggugcccgagccccgccucaugcagcgggucgcgcuggacgccguggcccuggcccucguggccgcggccuucagcaucucccuggccgagauguucgcccgcagccacggguacuccguccgggcgaaccaggagcugcucgccgugggcugcugcaacgugcugcccgccuuccugcacugcuucgccaccagcgccgcgcucgccaagucccuggucaagaccgccaccgggugccgcacgcagcugagcuccguggugagcgccaccgucgugcuccuggugcugcucgcccuggcgccccuguuccacgaccuccagcgguccguccuggccugcgugaucguggucagccugcgcggcgcccuccggaaggugugggaccugccccgccuguggcggauguccccggccgacgcccucgugugggcgggcaccgccgcgaccugcaugcuggucagcacggaggccgggcugcucgccggcgugauccugucccugcucagccuggccgggcgcacccagcggccccgcaccgcccugcucgcccggaucggcgacaccgccuucuacgaggacgcgacggaguucgaggggcuggugcccgagcccggcguccgcguguuccgguucggcgggccgcuguacuacgccaacaaggacuucuuccuccagucccuguacagccugaccggccucgacgccgggugcauggccgcccgccggaaggagggcggcagcgagaccggggugggcgagggcgggcccgcgcagggggaggaccugggccccgucuccacccgcgccgcccuggugccggccgccgcgggcuuccacacgguggucaucgacugcgcgccccuccuguuccuggacgccgccggggugagcacccuccaggaccugcgccgggacuacggcgcccuggggaucucccuccugcuggccugcugcagcccgcccgugcgcgacauccucucccggggcggguuccugggcgagggccccggggacaccgccgaggaggagcagcuguuccucagcguccacgacgccgugcagaccgcccgcgcgcggcaccgcgagcuggaggccacggacgcccaccuguga

SEQ ID NO: 36555 - RNA, 2220 nt, Artificial Sequence
  derived and/or modified sequence opt1 from SLC26A2__Homo_sapiens__NP_000103
augagcuccgagagcaaggagcagcacaacgugagcccccgcgacuccgccgagggcaacgacuccuacccgagcgggauccaccuggagcuccagcgggaguccagcaccgacuucaagcaguucgagaccaacgaccagugccgccccuaccaccggauccugaucgagcgccaggagaaguccgacacgaacuucaaggaguucgucaucaagaagcugcagaagaacugccagugcagccccgccaaggcgaagaacaugauccucggcuuccugcccgugcugcaguggcucccgaaguacgaccugaagaagaacauccugggggacgugauguccggccucaucgucgggauccugcuggugccccagagcaucgccuacucccuccuggccggccaggagcccguguacggccuguacaccagcuucuucgccuccaucaucuacuuccuccuggggaccagccggcacaucuccgucggcaucuucggggugcugugccucaugaucggcgagaccguggaccgcgagcugcagaaggccggguacgacaacgcgcacagcgcccccucccugggcauggucagcaacggcagcacgcuccugaaccacaccuccgaccggaucugcgacaagagcugcuacgccaucauggugggguccaccgugaccuucaucgccggcgucuaccagguggcgaugggguucuuccaggugggcuucgucagcguguaccuguccgacgcccuccugagcggcuucgugacgggggccuccuucaccauccugaccagccaggccaaguaccuccugggccugaaccucccgcgcaccaacggggucggcucccugaucacgaccuggauccacguguuccggaacauccacaagaccaaccugugcgaccucaucaccagccugcugugccuccuggugcugcuccccacgaaggagcugaacgagcacuucaaguccaagcugaaggcccccauccccaucgagcucgucgugguggucgcggccacccuggccagccacuucgggaagcugcacgagaacuacaacuccagcaucgccggccacaucccgaccggcuucaugccgcccaaggugcccgaguggaaccucaucccguccgucgccguggacgcgaucgccaucagcaucaucggguucgccaucaccgugucccugagcgagauguucgccaagaagcacggcuacacggucaaggccaaccaggagauguacgcgaucggguucugcaacaucauccccuccuucuuccacugcuucaccaccagcgccgcccuggccaagacccucgugaaggagagcacgggcugccacacccagcuguccgggguggucaccgcccuggugcugcuccuggugcugcucgucaucgcgccccuguucuacagccugcagaaguccgugcucggcgugaucaccaucgucaaccugcgcggcgcccugcggaaguuccgcgaccuccccaagauguggagcaucucccggauggacacggugaucugguucgugaccaugcugagcuccgcccugcucagcaccgagaucgggcugcuggucggcgugugcuucuccaucuucugcgugauccuccgcacccagaagcccaagagcucccugcuggggcucgucgaggagagcgagguguucgaguccgugagcgccuacaagaaccugcagaucaagcccggcaucaagaucuuccgguucgucgcgccccuguacuacaucaacaaggagugcuucaaguccgcccucuacaagcagacggugaaccccauccugaucaagguggccuggaagaaggccgccaagcgcaagaucaaggagaaggucgugacccucgggggcauccaggacgagaugagcgugcagcucucccacgacccgcuggagcugcacaccaucgucaucgacugcagcgcgauccaguuccucgacaccgccggcauccacacgcugaaggaggugcggcgcgacuacgaggccaucgggauccaggugcugcucgcccagugcaaccccaccguccgggacagccugaccaacggcgaguacugcaagaaggaggaggagaaccugcuguucuacuccguguacgaggccauggcguucgccgaggugagcaagaaccagaagggggucugcgugcccaacggccugucccugagcuccgacuga

SEQ ID NO: 36556 - RNA, 2295 nt, Artificial Sequence
  derived and/or modified sequence opt1 from SLC26A3__Homo_sapiens__XP_011514169
augaucgagcccuucggcaaccaguacaucguggcccgcccggucuacagcaccaacgccuucgaggagaaccacaagaagaccgggcggcaccacaagacguuccuggaccaccucaaggugugcugcuccugcagcccccagaaggcgaagcgcaucgugcugucccuguuccccaucgccagcuggcuccccgccuaccggcugaaggaguggcugcucuccgacaucgucagcggcaucuccaccgggaucguggccgugcugcagggccuggccuucgcgcuccuggucgacaucccgcccguguacgggcuguacgccagcuucuuccccgccaucaucuaccucuucuucggcaccucccgccacaucagcgugggccccuucccgauccuguccaugauggucgggcuggccgugagcggcgcgguguccaaggccguccccgaccggaacgccaccacgcucgggcugcccaacaacagcaacaacuccagccugcucgacgacgagcgcgugcggguggccgccgcggccuccgucaccgugcugagcggcaucauccagcuggccuucgggauccuccgcaucggcuucguggucaucuaccuguccgagagccugaucagcggcuucaccaccgccgccgcggugcacgugcucgucucccagcugaaguucaucuuccagcugacggugcccagccacaccgacccgguguccaucuucaagguccucuacagcguguucucccagaucgagaagaccaacaucgccgaccuggucaccgcccugaucgugcuccugguggucagcaucgugaaggagaucaaccagcgguucaaggacaagcugcccgugcccauccccaucgaguucaucaugacggucaucgccgccgggguguccuacggcugcgacuucaagaaccgcuucaagguggcggucgugggggacaugaacccgggcuuccagccgcccaucacccccgacguggagaccuuccagaacaccgucggcgacugcuucgggaucgccaugguggccuucgccguggccuucagcgucgcguccguguacagccucaaguacgacuacccccuggacggcaaccaggagcugaucgcccucgggcugggcaacaucgugugcggggucuuccggggcuucgccggcuccacggcccugagccgcuccgcggugcaggagagcaccgggggcaagacccagaucgccgggcucaucggcgccaucaucgugcugaucgucgugcuggccaucggguuccuccuggcgccccugcagaaguccgugcucgccgcccuggcccugggcaaccucaagggcaugcugaugcaguucgccgagaucgggcggcuguggcgcaaggacaaguacgacugccugaucuggaucaugaccuucaucuucacgaucguccucggccuggggcugggccucgccgcgagcguggccuuccagcugcugaccaucguguuccggacccaguuccccaagugcuccacccucgccaacaucgggcgcacgaacaucuacaagaacaagaaggacuacuacgacauguacgagcccgagggcgucaagaucuuccggugcccgagccccaucuacuucgccaacaucggcuucuuccgccggaagcugaucgacgccgugggguucagcccccugcgcauccuccggaagcgcaacaaggcgcugcgcaagauccggaagcugcagaagcagggccuccuccaggugacccccaagggguucaucugcaccgucgacaccaucaaggacagcgacgaggagcuggacaacaaccagaucgaggugcuggaccagccgaucaacacgaccgaccugcccuuccacaucgacuggaacgacgaccugccccucaacaucgaggugccgaagaucagccugcacucccugauccucgacuucagcgccgucuccuuccuggacgugagcuccgugcgcggccugaaguccauccuccaggaguucauccggaucaaggucgacguguacaucgugggcaccgacgacgacuucaucgagaagcugaaccgcuacgaguucuucgacggggaggucaaguccagcaucuucuuccugaccauccacgacgccgugcuccacauccugaugaagaaggacuacuccacgagcaaguucaaccccucccaggagaaggacggcaagaucgacuucaccaucaacaccaacgggggccugcggaaccgcguguacgagguccccguggagaccaaguucuga

SEQ ID NO: 36557 - RNA, 2343 nt, Artificial Sequence
  derived and/or modified sequence opt1 from SLC26A4__Homo_sapiens__NP_000432
auggccgcccccggcgggcgcagcgagccgccccagcugcccgaguacuccugcagcuacauggugucccggcccgucuacagcgagcucgcguuccagcagcagcacgagcgccggcugcaggagcgcaagacccugcgggagucccucgccaagugcugcagcugcucccgcaagcgggccuucggcgugcugaagacccuggugccgauccucgaguggcugcccaaguaccgcgucaaggaguggcugcucagcgacgugaucuccggggugagcacgggccuggucgccacccugcaggggauggccuacgcgcuccuggccgccgugcccgugggcuacggccuguacuccgccuucuuccccauccucaccuacuucaucuucgggaccagccggcacaucuccgucggcccguuccccguggugagccugauggucggguccguggugcugagcauggcgcccgacgagcacuuccucgucuccagcuccaacggcacggugcugaacaccaccaugaucgacaccgccgcccgcgacacggcccgggugcugaucgccagcgcgcucacccugcuggucgggaucauccagcucaucuucggcggccugcagaucggguucaucgugcgcuaccuggccgacccccucgugggcggguucaccaccgccgccgccuuccagguccuggugagccagcugaagaucgugcucaacgucuccacgaagaacuacaacggcgugcugagcaucaucuacacccuggucgagaucuuccagaacaucggcgacaccaaccucgcggacuucaccgccgggcugcugacgaucguggugugcauggccgucaaggagcucaacgaccgguuccgccacaagaucccggugcccauccccaucgaggugaucgucaccaucaucgccaccgccaucuccuacggcgcgaaccuggagaagaacuacaacgccgggaucgucaagagcaucccccggggcuuccugccgcccgagcucccgcccgugucccuguucagcgagaugcuggccgccuccuucagcaucgccgugguggcguacgccaucgccguguccgucgggaagguguacgccaccaaguacgacuacacgaucgacggcaaccaggaguucaucgcguucggcaucagcaacaucuucuccggguucuucagcugcuucguggccaccaccgcccucucccgcaccgccguccaggagagcacgggcgggaagacccagguggccggcaucaucuccgcggccaucgugaugaucgccauccuggcccuggggaagcuccuggagccccugcagaaguccguccucgccgcgguggugaucgccaaccugaagggcauguucaugcagcugugcgacaucccccggcuguggcgccagaacaagaucgacgccgucaucuggguguucacgugcaucgugagcaucauccucggccuggaccuggggcuccuggccggccugaucuucgggcuccugaccgucgugcugcgggugcaguuccccagcuggaacggccucggguccauccccagcaccgacaucuacaagagcaccaagaacuacaagaacaucgaggagccgcagggcgucaagauccugcgcuucuccagccccaucuucuacggcaacguggacggguucaagaagugcaucaaguccaccgugggcuucgacgccauccgggucuacaacaagcgccugaaggcgcuccgcaagauccagaagcugaucaagagcgggcagcugcgggccaccaagaacggcaucaucuccgacgccgugagcacgaacaacgccuucgagcccgacgaggacaucgaggaccucgaggagcuggacauccccaccaaggagaucgagauccagguggacuggaacuccgagcugccggucaaggugaacgugcccaagguccccauccacagccucgugcuggacugcggcgcgaucuccuuccuggacguggucggggugcgcagccuccgggugaucgucaaggaguuccagcgcaucgacgugaacguguacuucgccucccugcaggacuacgucaucgagaagcuggagcagugcggcuucuucgacgacaacauccggaaggacaccuucuuccucaccgugcacgacgccauccuguaccugcagaaccaggucaagagccaggaggggcagggcuccauccucgagacgaucacccugauccaggacugcaaggacacccuggagcucaucgagaccgagcugaccgaggaggagcuggacgugcaggacgaggccaugcgcacgcucgccagcuga

SEQ ID NO: 36558 - RNA, 2139 nt, Artificial Sequence
  derived and/or modified sequence opt1 from SLC26A5__Homo_sapiens__NP_001161434
auggaccacgccgaggagaacgagauccuggccgcgacccagcgcuacuacguggagcggcccaucuucagccacccgguccuccaggagcgccugcacaccaaggacaaggugcccgacuccaucgccgacaagcugaagcaggccuucacgugcacccccaagaagauccggaacaucaucuacauguuccuccccaucaccaaguggcugccggccuacaaguucaaggaguacgugcugggcgaccucgucagcgggaucuccaccggcgugcugcagcugccccaggggcucgccuucgcgaugcuggccgccgugccgcccaucuucggccuguacagcuccuucuaccccgucaucauguacugcuuccucgggacgagccgccacaucuccaucggccccuucgccgugaucagccugaugaucggcgggguggcgguccggcuggugcccgacgacaucgugauccccggcggggucaacgccaccaacggcaccgaggcccgcgacgcccuccgggugaagguggccauguccgucacccugcugagcgggaucauccaguucugccucggcgugugccgcuucggcuucguggcgaucuaccugacggagccgcugguccggggguucaccaccgccgccgccgugcacguguucaccuccaugcucaaguaccuguucggcgucaagacgaagcgcuacagcgggaucuucuccgugguguacagcaccgucgccgugcugcagaacgucaagaaccucaacgugugcucccugggcgugggccugauggucuucgggcuccugcugggcgggaaggaguucaacgagcgguucaaggagaagcuccccgcgcccaucccccuggaguucuucgccguggugaugggcaccgggaucagcgccggcuucaaccugaaggaguccuacaacgucgacguggugggcacccucccgcuggggcugcucccgcccgccaaccccgacacgagccuguuccaccuggucuacguggacgccaucgcgaucgccaucgugggcuucuccgucaccaucagcauggccaagacccucgccaacaagcacggguaccagguggacggcaaccaggagcugaucgcccuggggcucugcaacagcaucggcucccuguuccagaccuucagcaucuccugcagccugucccgcagccucgugcaggagggcaccgggggcaagacgcagcuggcggggugccuggccucccucaugauccugcuggucauccuggccaccggcuuccucuucgagagccugccccagaccaucuggcugacgaccuucguguccagccucuuccuggggcuggacuacggccucaucaccgccgugaucaucgcgcugcugaccgucaucuaccggacgcagucccccagcuacaaggugcucggcaagcugcccgagaccgacguguacaucgacaucgacgccuacgaggaggucaaggagauccccgggaucaagaucuuccagaucaacgccccgaucuacuacgccaacuccgaccuguacagcaacgcccucaagcgcaagaccggcgugaaccccgcggugaucaugggggcccggcgcaaggccaugcggaaguacgccaaggaggucggcaacgccaacauggcgaacgccaccguggugaaggccgacgccgaggucgacggcgaggacgccacgaagcccgaggaggaggacggggaggugaaguacccgcccaucgugaucaaguccaccuuccccgaggagaugcagcgcuucaugcccccgggcgacaacguccacaccgugauccuggacuucacccaggugaacuucaucgacagcgucggggugaagacgcuggcgggcaucgugaaggaguacggggacgucggcaucuacguguaccucgccggcugcuccgcccagguggucaacgaccugacccggaaccgcuucuucgagaaccccgcccugugggagcuccuguuccacagcauccacgacgcggugcuggggucccagcuccgggaggcccuggccgagcaggaggccagcgccccgcccagccaggaggaccuggagcccaacgcgacccccgccacccccgaggccuga

SEQ ID NO: 36559 - RNA, 2217 nt, Artificial Sequence
  derived and/or modified sequence opt1 from SLC26A6__Homo_sapiens__NP_001035544
auggaccugcgccggcgcgacuaccacauggagcggccccuccugaaccaggagcaccuggaggagcucggccgcugggggagcgccccgcggacccaccaguggcgcaccuggcugcagugcucccgggcccgcgcguacgcccugcuccugcagcaccuccccgugcuggucuggcugccccgguaccccgugcgcgacuggcugcucggcgaccugcugagcgggcucuccguggccaucaugcagcugccgcagggccuggccuacgcccuccuggcggggcugccgcccgucuucggccucuacagcuccuucuaccccguguucaucuacuuccuguucggcacgagccggcacaucuccguggggaccuucgccgucaugagcgugauggugggcuccgucaccgagagccuggcgccccaggcccucaacgacuccaugaucaacgagaccgcccgcgacgccgcccggguccagguggccagcacgcuguccgugcuggugggccucuuccagguggggcuggggcugauccacuucggcuucgucgugaccuaccucagcgagccccuggugcgcggcuacaccaccgccgcggccguccagguguucgugucccagcugaaguacgucuucgggcuccaccugagcucccacagcggcccccugucccucaucuacacggugcuggaggugugcuggaagcugccccagagcaaggucgggaccguggucaccgccgccguggccggcgugguccucgugguggucaagcugcugaacgacaagcuccagcagcagcugccgaugcccauccccggcgagcugcucacccugaucggggcgacgggcaucagcuacgggaugggccugaagcaccgguucgagguggacguggucgggaacauccccgccggccucgugccgcccguggcccccaacacccagcuguucuccaagcuggucggcagcgccuucaccaucgccguggugggguucgcgaucgccaucucccugggcaagaucuucgcccuccgccacggguaccgggucgacagcaaccaggagcugguggcccugggccucuccaaccugaucgggggcaucuuccagugcuuccccgugagcugcuccaugagccgcucccugguccaggagagcaccggcgggaacucccagguggccggcgcgaucagcucccucuucauccugcugaucaucgugaagcucggggagcuguuccacgaccugccgaaggccguccucgccgccaucaucaucgugaaccugaagggcaugcugcggcagcucagcgacaugcgcucccuguggaaggcgaaccgggccgaccugcucaucuggcuggugacguucaccgccaccauccugcucaaccuggaccuggggcucgucguggccgugaucuucagccugcugcucgucguggugcgcacccagaugccccacuacuccguccugggccaggugcccgacacggacaucuaccgcgacguggccgaguacagcgaggcgaaggagguccggggcgugaagguguuccgcuccagcgccaccgucuacuucgccaacgccgaguucuacagcgacgcccugaagcagcggugcgggguggacguggacuuccucaucucccagaagaagaagcugcugaagaagcaggagcagcucaagcugaagcagcugcagaaggaggagaagcuccgcaagcaggcggccagccccaagggcgccuccgucagcaucaacgugaacaccucccuggaggacaugcggagcaacaacguggaggacugcaagaugaugcaggucuccagcggggacaagauggaggacgccaccgccaacggccaggaggacuccaaggcgccggacggcagcacgcugaaggcccucgggcugccccagcccgacuuccacucccugauccucgaccugggcgcccugagcuucguggacaccgugugccucaagucccugaagaacaucuuccacgacuuccgcgagaucgaggucgagguguacauggccgcgugccacagccccguggucucccagcuggaggccgggcacuucuucgacgccagcaucaccaagaagcaccucuucgccuccgugcacgacgccgugaccuucgcgcugcagcacccgcggcccguccccgacagcccggugagcgucacgcgccuguga

SEQ ID NO: 36560 - RNA, 1971 nt, Artificial Sequence
  derived and/or modified sequence opt1 from SLC26A7__Homo_sapiens__NP_439897
augaccggcgccaagcgcaagaagaaguccaugcuguggagcaagaugcacacgccccagugcgaggacaucauccaguggugccggcgccggcucccgauccuggacugggcgccccacuacaaccugaaggagaaccuccugcccgacaccgugagcgggaucaugcuggccguccagcaggucacccagggccucgccuucgccgugcuguccagcgugcaccccguguucgggcuguacggcucccucuucccggccaucaucuacgccaucuucgggaugggccaccacguggcgaccggcaccuucgcccugacgagccugaucuccgccaacgccgucgagcgcaucgugccccagaacaugcagaaccucaccacccagagcaacaccuccgugcuggggcugagcgacuucgagaugcagcggauccacgucgcggccgccguguccuuccucggcggggugauccaggucgccauguucgugcugcagcugggcagcgccacguucguggucaccgagcccgugaucuccgcgaugaccaccggggccgccacgcacguggucaccagccaggugaaguaccuccugggcaugaagaugcccuacaucuccggcccgcugggguucuucuacaucuacgccuacguguucgagaacaucaagagcguccgccucgaggcccugcugcucucccugcugagcaucguggugcucguccuggugaaggagcugaacgagcaguucaagcggaagaucaaggucgugcuccccguggaccugguccugaucaucgcggccuccuucgccugcuacugcaccaacauggagaacaccuacggccucgaggugguggggcacaucccccagggcauccccagcccgcgcgccccgcccaugaacauccugagcgccgucaucacggaggcguucggcguggcccuggugggguacgucgccucccucgcccuggcccagggcagcgcgaagaaguucaaguacuccaucgacgacaaccaggaguuccuggcccacgggcucagcaacaucguguccagcuucuucuucugcauccccuccgccgccgcgaugggccggaccgccgggcuguacagcaccggcgccaagacccagguggccugccugaucuccugcaucuucguccucaucgugaucuacgccaucggcccccugcuguacuggcuccccaugugcgugcuggcgagcaucaucgucguggggcugaagggcaugcucauccaguuccgcgaccugaagaaguacuggaacguggacaagaucgacugggggaucugggucuccacguacguguucaccaucugcuucgccgccaacgugggccugcuguucggggucgugugcaccaucgccaucgugaucggccgguucccccgcgccaugaccgucagcaucaagaacaugaaggagauggaguucaaggugaagacggagauggacuccgagacccuccagcaggucaagaucaucagcaucaacaacccccugguguuccugaacgcgaagaaguucuacaccgaccucaugaacaugauccagaaggagaacgccugcaaccagccgcuggacgacaucuccaagugcgagcagaacacccugcucaacagccuguccaacggcaacugcaacgaggaggccagccaguccugccccaacgagaagugcuaccugauccucgacugcagcggguucacguucuucgacuacagcggcguguccaugcugguggaggucuacauggacugcaaggggcggagcguggacgugcugcucgcccacugcaccgccucccugaucaaggcgaugaccuacuacggcaaccuggacagcgagaagcccaucuucuucgaguccgucagcgccgccaucucccacauccacagcaacaagaaccucuccaagcugagcgaccacuccgagguguga

SEQ ID NO: 36561 - RNA, 2913 nt, Artificial Sequence
  derived and/or modified sequence opt1 from SLC26A8__Homo_sapiens__NP_001180405
auggcccagcuggagcgcagcgccaucuccggcuucagcuccaagagccggcgcaacuccuucgcguacgacgugaagcgggaggucuacaacgaggagaccuuccagcaggagcacaagcgcaaggccagcuccagcgggaacaugaacaucaacaucaccacguuccggcaccacgugcagugccgcugcuccuggcaccgguuccuccgcugcgugcugaccaucuuccccuuccuggaguggaugugcauguaccggcucaaggacuggcugcugggcgaccuccuggccgggaucagcgucggccugguccaggugccgcaggggcucacccugucccugcucgcccgccagcugaucccgccccugaacaucgccuacgcggccuucugcagcuccgugaucuacgugaucuucggcagcugccaccagauguccaucggcagcuucuuccucguguccgcccugcugaucaacguccucaaggugagccccuucaacaacgggcagcuggugaugggcuccuucgucaagaacgaguucagcgcccccagcuaccugaugggguacaacaagucccucagcgugguggcgaccacgaccuuccugaccggcaucauccagcugaucauggggguccucggccugggcuucaucgccaccuaccugcccgaguccgccaugagcgccuaccucgccgcgguggcccugcacaucaugcugucccagcucacguucaucuucgggaucaugaucagcuuccacgccggccccaucuccuucuucuacgacaucaucaacuacugcguggcccugcccaaggccaacagcaccuccauccuggucuuccucaccgugguggucgcgcugcggaucaacaagugcauccgcaucagcuucaaccaguacccgaucgaguuccccauggagcuguuccucaucaucggguucaccgugaucgccaacaagaucuccauggccacggagaccagccagacccugaucgacaugauccccuacuccuuccugcuccccgugaccccggacuucagccugcugcccaagaucauccuccaggccuucucccugagccuggucuccagcuuccuccugaucuuccugggcaagaagaucgccucccuccacaacuacagcgugaacagcaaccaggaccugaucgcgaucggccugugcaacgucguguccagcuucuuccgguccugcguguucacgggggccaucgcccgcaccaucauccaggacaagagcggcgggcggcagcaguucgccucccuggucggcgccggggugaugcuccugcugauggugaagaugggccacuucuucuacacccuccccaacgcgguccuggccggcaucauccugagcaacgugauccccuaccucgagaccaucuccaaccugccgagccuguggcgccaggaccaguacgacugcgcccucuggaugaugacguucuccagcuccaucuuccuggggcuggacaucggccucaucaucagcguggucuccgccuucuucaucaccaccgugcggagccaccgcgcgaagauccugcugcucgggcagauccccaacaccaacaucuaccgguccaucaacgacuaccgcgagaucaucacgauccccggcgugaagaucuuccagugcugcagcuccaucaccuucgucaacguguacuaccugaagcacaagcugcucaaggagguggacauggucaaggugccccugaaggaggaggagaucuucagccuguucaacagcuccgacaccaaccuccagggcgggaagaucugccggugcuucugcaacugcgacgaccuggagccgcugccccgcauccucuacaccgagcgcuucgagaacaagcuggaccccgaggccagcuccaucaaccugauccacugcagccacuucgaguccaugaacacgagccagaccgccuccgaggaccaggugcccuacaccgucagcuccgugagccagaagaaccagggccagcaguacgaggagguggaggaggucuggcucccgaacaacuccagccggaacuccagccccgggcugcccgacguggccgagucccagggccgccggagccugauccccuacuccgacgccagccuccugccguccgugcacaccaucauccuggacuucagcaugguccacuacguggacagccgcgggcucgugguccugcggcagaucugcaacgcguuccagaacgccaacauccugauccucaucgccggcugccacuccagcaucgugcgcgccuucgagcggaacgacuucuucgacgccgggaucacgaagacccagcuguuccuguccgugcacgacgcgguccucuucgcccugagccgcaaggugaucggcuccagcgagcuguccaucgacgagagcgagaccgugauccgggagaccuacuccgagacggacaagaacgacaacagccgcuacaagauguccagcuccuuccucggcagccagaagaacgucucccccggguucaucaagauccagcagcccguggaggaggagagcgagcuggaccuggagcucgaguccgagcaggaggccggccuggggcuggaccucgaccuggaccgggagcuggagccggagauggagcccaaggccgagaccgagaccaagacccagaccgagauggagccccagcccgagacggagccggagauggagcccaaccccaagagccgcccccgggcccacaccuucccgcagcagcgcuacuggcccauguaccaccccuccauggcgagcacccagagccagacccagacgcggaccugguccguggagcgccggcgccaccccauggacagcuacuccccggagggcaacagcaacgaggacgucuga

SEQ ID NO: 36562 - RNA, 2664 nt, Artificial Sequence
  derived and/or modified sequence opt1 from SLC26A9__Homo_sapiens__NP_599152
augagccagccccgcccccgguacguggucgaccgcgccgccuacucccugacccucuucgacgacgaguucgagaagaaggaccggaccuaccccgugggcgagaagcugcgcaacgcguuccggugcagcuccgccaagaucaaggccguggucuucgggcugcuccccgugcugagcuggcugcccaaguacaagaucaaggacuacaucaucccggaccuccugggcgggcuguccggcgggagcauccaggugccccagggcauggccuucgcccuccuggcgaaccugcccgccgucaacggccucuacuccagcuucuucccccugcugacguacuucuuccucgggggcgugcaccagauggugccggggaccuucgccgucaucuccauccuggugggcaacaucugccugcagcucgcccccgagagcaaguuccagguguucaacaacgcgaccaacgaguccuacgucgacaccgccgccauggaggccgagcgccugcacgugagcgccacgcuggcgugccucaccgccaucauccagauggggcugggcuucaugcaguucggcuucguggccaucuaccuguccgagagcuucauccggggguucaugaccgccgccggccuccagauccugaucuccguccugaaguacaucuucgggcucaccauccccagcuacacgggccccggcuccaucguguucaccuucaucgacaucugcaagaaccugccgcacaccaacaucgcgagccugaucuucgcccucaucuccggggccuuccuggugcuggucaaggagcucaacgcccgcuacaugcacaagauccgguuccccauccccaccgagaugaucgugguggucguggccacggcgaucagcggcgggugcaagaugcccaagaaguaccacaugcagaucgugggcgagauccagcgcggguucccgacccccgucagccccguggucucccaguggaaggacaugaucggcaccgccuucagccuggccaucguguccuacgugaucaaccuggccaugggccggacccucgccaacaagcacggguacgacgucgacagcaaccaggagaugaucgcgcugggcugcuccaacuucuucgggagcuucuucaagauccacgugaucugcugcgcccuguccgugacgcucgccgucgacggcgccgggggcaagagccagguggcgucccugugcgugagccuggucgugaugaucaccaugcucgugcugggcaucuaccuguacccccucccgaaguccguccugggggcccugaucgccgugaaccucaagaacagccugaagcagcugaccgaccccuacuaccuguggcgcaaguccaagcucgacugcugcaucuggguggucagcuuccuguccagcuucuuccugucccuccccuacggcguggccgugggggucgccuucagcgugcugguggucguguuccagacccaguuccggaacggcuacgcgcuggcccaggugauggacacggacaucuacgucaaccccaagaccuacaaccgcgcccaggacauccaggggaucaagaucaucaccuacugcuccccgcucuacuucgccaacagcgagaucuuccggcagaaggugaucgccaagaccggcauggacccccagaaggugcugcuggcgaagcagaaguaccucaagaagcaggagaagcgccggaugcgccccacgcagcagcggcgcagccuguucaugaagaccaagaccgucucccugcaggagcuccagcaggacuucgagaacgcgcccccgaccgaccccaacaacaaccagacgcccgccaacggcaccagcguguccuacaucaccuucagcccggacuccagcucccccgcccagagcgagccgcccgccuccgccgaggcccccggggagcccagcgacaugcuggccuccgugccgcccuucgucaccuuccacacgcugauccucgacaugagcggcguguccuucguggaccugauggggaucaaggcccuggcgaagcucagcuccaccuacggcaagaucggcgucaagguguuccuggugaacauccacgcccaggucuacaacgacaucagccacgggggcguguucgaggacgggucccuggagugcaagcacguguuccccagcauccacgacgccguccucuucgcccaggccaacgcgcgggacgugacccccggccacaacuuccagggggcccccggcgacgccgagcugagccuguacgacuccgaggaggacauccgcagcuacugggaccucgagcaggagauguucggcuccauguuccacgccgagacccugacggcccuggagagccucuccgcggccgggggcugcuaccccuaccgcagcgagucccuggugagcccgcuguucacccggcaggcccucgccgccauggacaagccgcccgcgcacuccaccccgcccaccagcgcccugucccuggccgccgaggggcaccucgacuuccagcugcugcgcgucagccagaagcagaaggacaaguacaacugcgcgggccuccuguacaagcugcagaaggugucccagagcccccacggguccgugagcgacggcguccggcucucccgcaccuga

SEQ ID NO: 36563 - RNA, 1977 nt, Artificial Sequence
  derived and/or modified sequence opt1 from SLC27A1__Homo_sapiens__XP_011526304
augcgcgcccccggcgccggggcggccagcguggucucccuggcccuccuguggcugcucggccugccguggaccuggagcgccgccgcggcccuggggguguacgugggcuccgggggcuggcgguuccuccgcaucgucugcaagaccgcccggcgcgaccuguucggccugagcgugcucauccgggugcgccuggagcugcggcgccaccagcgggccgggcacacgaucccccgcaucuuccaggcggucgugcagcggcagcccgagcgccucgcccugguggacgccggcaccggggagugcuggaccuucgcccagcuggacgccuacuccaacgcggucgccaaccucuuccggcagcugggcuucgcccccggggacgugguggccaucuuccuggagggccgcccggaguucgucggccucuggcuggggcuggccaaggcgggcauggaggccgcccuccugaacgugaaccugcggcgcgagccccucgccuucugccuggggaccagcggcgccaaggcgcugaucuucggcggggagaugguggccgccgucgccgagguguccggccaccucggcaagagccugaucaaguucugcuccggggaccuggggcccgagggcauccuccccgacacgcaccuccuggacccgcuccugaaggaggccagcaccgcgccccuggcccagauccccuccaagggcauggacgaccggcuguucuacaucuacaccagcgggaccacgggccugcccaaggccgccaucgugguccacucccgcuacuaccggauggcggccuucgggcaccacgccuaccgcaugcaggccgccgacgugcuguacgacugccucccgcuguaccacagcgcgggcaacaucaucggggugggccagugccugaucuacggccucaccgucgugcugcggaagaaguucuccgccagccgcuucugggacgacugcaucaaguacaacugcaccaucaacggggugcgccacugccggcugcucugccuggucgugcaguacaucggcgagaucugccgcuaccugcucaagcagcccguccgggaggccgagcgccggcaccgcgugcggcuggccguggggaacggccugcgccccgccaucugggaggaguucaccgagcgguucgggguccgccagaucggcgaguucuacggcgcgacggagugcaacugcuccaucgccaacauggacgggaaggugggcagcugcggguucaacucccggauccugccccacguguacccgauccgccucgucaaggugaacgaggacaccauggagcugcugcgggacgcccagggccucugcauccccugccaggccggcgagcccgggcugcuggugggccagaucaaccagcaggacccccuccgccgguucgacggguacgucagcgagagcgccaccuccaagaagaucgcgcacagcguguucuccaagggcgacagcgccuaccuguccggggacgugcuggucauggacgagcucggcuacauguacuuccgcgaccggagcggcgacaccuuccgcuggcgcggggagaacguguccacgaccgagguggagggcguccugagccggcugcucgggcagaccgacguggccguguacggcgucgccgugccggggguggagggcaaggcgggcauggccgccgucgccgacccccacucccugcuggaccccaacgccaucuaccaggagcuccagaaggugcuggcgcccuacgcccgcccgaucuuccugcggcuccugccccagguggacaccacggggaccuucaagauccagaagacccgccugcagcgggagggcuucgacccccgccagaccagcgaccgccucuucuuccuggaccugaagcaggggcacuaccucccccugaacgaggccgucuacacgcggaucugcuccggcgccuucgcccuguga

SEQ ID NO: 36564 - RNA, 1704 nt, Artificial Sequence
  derived and/or modified sequence opt1 from SLC27A2__Homo_sapiens__NP_001153101
augcugagcgccaucuacaccgugcucgccggccugcuguuccucccccugcuggucaaccucugcugcccguacuucuuccaggacaucggguacuuccugaagguggcggccgugggccgccggguccgcuccuacgggaagcggcgccccgcccggaccauccugcgcgccuuccucgagaaggcccggcagacgccccacaagcccuuccugcuguuccgcgacgagacccucaccuacgcccagguggaccggcgcagcaaccagguggcgcgggcccugcacgaccaccugggccuccgccagggggacugcgucgcccugcugaugggcaacgagccggcguacguguggcucuggcugggccuggugaagcucgggugcgccauggccugccugaacuacaacauccgggccaagucccugcuccacugcuuccagugcugcggcgccaagguccugcuggugagccccgagcuccaggcggccguggaggagauccugcccucccugaagaaggacgacgucagcaucuacuacgugucccgcaccagcaacacggacgggaucgacuccuuccucgacaagguggacgaggucagcaccgagcccaucccggaguccuggcggagcgaggugaccuucuccacccccgcccuguacaucuacacgagcggcaccaccggggccacccuggcccuccgcacgaaguucuccgcgagccaguucugggacgacugccggaaguacaacgugaccgucauccaguacaucggcgagcugcugcgcuaccucugcaacagcccccagaagcccaacgaccgggaccacaaggugcgccuggcccugggcaacgggcuccggggcgacguguggcgccaguucgucaagcgcuucggggacaucugcaucuacgaguucuacgccgccaccgagggcaacaucggcuucaugaacuacgcccggaaggugggggcggugggccgcgucaacuaccugcagaagaagaucaucaccuacgaccugaucaaguacgacguggagaaggacgagccgguccgggacgagaacggguacugcgugcgcgugcccaagggcgaggucgggcuccuggugugcaagaucacgcagcugacccccuucaacggcuacgccggcgccaaggcccagaccgagaagaagaagcuccgggacguguucaagaagggggaccuguacuucaacuccggcgaccugcucauggucgaccacgagaacuucaucuacuuccacgaccgcgugggggacaccuuccgguggaagggcgagaacguggccacgaccgaggucgcggacaccguggggcugguggacuucguccaggaggugaacguguacggcguccacgugcccgaccacgagggccgcaucgggauggccuccaucaagaugaaggagaaccacgaguucgacggcaagaagcuguuccagcacaucgccgacuaccugccgagcuacgcccggccccgcuuccuccggauccaggacaccaucgagaucacggggaccuucaagcaccgcaagaugacccugguggaggagggcuucaaccccgcggucaucaaggacgcccuguacuuccucgacgacaccgccaagauguacgugcccaugacggaggacaucuacaacgccaucagcgccaagacccugaagcuguga

SEQ ID NO: 36565 - RNA, 2193 nt, Artificial Sequence
  derived and/or modified sequence opt1 from SLC27A3__Homo_sapiens__NP_077306
augggcgugugccagcgcacccgggcccccuggaaggagaagucccagcuggagcgcgccgcgcucggguuccggaagggcgggagcggcauguucgccagcggguggaaccagaccgucccgaucgaggaggccggcuccauggccgcccugcugcuccugccccugcuccugcugcucccccugcugcuccugaagcugcaccucuggccccagcugcgcuggcugccggcggaccucgccuucgccgugcgggcccugugcugcaagcgcgcgcugcgggcccgcgcccucgccgccgcggccgccgaccccgagggccccgagggcgggugcagccuggccuggcggcuggccgagcucgcgcagcagcgcgccgcccacacguuccugauccacgggucccggcgcuucagcuacuccgaggccgagcgggagagcaaccgcgccgcgcgggccuuccugcgcgcccucggcugggacugggggcccgacggcggcgacuccggggagggcagcgccggggagggcgagcgggccgcgccgggcgccggggacgccgccgcgggcuccggggccgaguucgccggcggggacggcgccgcccgcggcgggggcgcggccgcgccccugagccccggggccaccguggcccugcuccugcccgccggcccggaguuccuguggcucugguucgggcuggccaaggccggccugcggaccgccuucguccccaccgcccuccgccggggcccccugcugcacugccuccgcuccugcggggcgcgcgcccuggugcuggcccccgaguuccucgagagccuggagccggaccugcccgcccuccgggcgaugggccugcaccugugggccgccgggcccggcacgcaccccgccgggaucuccgaccuccuggccgaggugagcgcggaggucgacggcccggugcccggcuaccuguccagcccccaguccaucaccgacacgugccuguacaucuucaccagcgggaccaccggccuccccaaggccgcccgcaucagccaccugaagauccugcagugccagggguucuaccagcucugcggcgugcaccaggaggacgucaucuaccuggcccugccgcucuaccacauguccggcagccugcuggggaucgugggcugcauggggaucggcgccaccgugguccucaaguccaaguucagcgcggggcaguucugggaggacugccagcagcaccgggugaccguguuccaguacaucggcgagcugugccgcuaccuggucaaccagccgcccuccaaggccgagcggggccacaaggugcgccucgccguggggagcggccugcggcccgacacgugggagcgcuucguccggcgcuucgggccccuccaggugcuggagaccuacggccugaccgaggggaacguggccaccaucaacuacacgggccagcggggcgccgucgggcgcgcguccuggcuguacaagcacaucuuccccuucagccucauccgguacgacgugaccaccggcgagcccauccgcgacccgcaggggcacugcauggccaccucccccggcgagcccgggcugcugguggcccccgucagccagcaguccccguuccucggcuacgccggcgggcccgagcuggcgcagggcaagcugcucaaggacguguuccggcccggggacgucuucuucaacacgggcgaccugcuggugugcgacgaccagggguuccuccgcuuccacgaccggaccggcgacaccuuccgcuggaagggcgagaacguggccaccacggaggucgccgagguguucgaggcccuggacuuccugcaggaggugaacgucuacggggugaccgugcccggccacgaggggcgggccggcauggcggcccucguccugcgcccgccccacgcccuggaccucaugcagcuguacacccacgugagcgagaaccugccgcccuacgcccgcccccgguuccuccgccugcaggagucccuggccaccacggagaccuucaagcagcagaaggugcggauggcgaacgagggcuucgaccccagcacccucuccgacccccuguacguccuggaccaggccgugggggccuaccucccccugaccacggcccgcuacagcgcccugcucgcgggcaaccugcggaucuga

SEQ ID NO: 36566 - RNA, 1932 nt, Artificial Sequence
  derived and/or modified sequence opt1 from SLC27A4__Homo_sapiens__NP_005085
augcugcucggcgccagccugguggggguccuccucuucuccaagcuggugcugaagcuccccuggacccaggugggcuucagccugcuguuccucuaccugggguccggcggguggcgcuucauccgggucuucaucaagaccauccgccgggacaucuucggcggccuggugcuccugaaggugaaggccaagguccgccagugccugcaggagcggcgcacggugccgauccucuucgcgagcaccgugcggcgccaccccgacaagaccgcccugaucuucgaggggaccgacacgcacuggaccuuccggcagcuggacgaguacuccagcuccgucgccaacuuccuccaggcccgcggccuggccagcggggacguggcggccaucuucauggagaaccggaacgaguucgugggccuguggcucgggauggccaagcugggcgucgaggccgcgcugaucaacaccaaccuccgccgggacgcccugcugcacugccucaccacgucccgcgcccgggcccugguguucggcagcgagauggccuccgcgaucugcgaggugcacgccagccuggaccccucccucagccuguucugcuccgggagcugggagcccggcgccgucccgcccuccaccgagcaccuggacccccuccugaaggacgcccccaagcaccucccgagcugccccgacaagggguucaccgacaagcuguucuacaucuacaccuccggcacgaccggccugcccaaggccgcgaucguggugcacagccgcuacuaccggauggccgcccuggucuacuacggguuccgcaugcggcccaacgacaucguguacgacugccugccgcuguaccacagcgccggcaacaucguggggaucggccagugccugcuccacgggaugaccgucgugauccgcaagaaguucuccgccagccgguucugggacgacugcaucaaguacaacugcaccaucgugcaguacaucggcgagcugugccgcuaccugcucaaccagccgccccgcgaggcggagaaccagcaccagguccggauggcccugggcaacgggcugcgccaguccaucuggacgaacuucagcucccgguuccacaucccccagguggccgaguucuacggcgccaccgagugcaacugcagccucgggaacuucgacucccaggucggcgccugcggguucaacagccgcauccuguccuucguguaccccauccggcuggugcgcgucaacgaggacaccauggagcugauccggggccccgacggcgugugcauccccugccagcccggggagccgggccagcucguggggcgcaucauccagaaggacccccugcggcgcuucgacggcuaccugaaccagggggcgaacaacaagaagaucgccaaggacgucuucaagaagggcgaccaggccuaccucaccggcgacgugcuggugauggacgagcugggguaccucuacuuccgggaccgcacgggcgacaccuuccgguggaagggggagaacgucagcaccaccgagguggagggcacgcugucccgccugcucgacauggccgacguggcggucuacggcguggaggugcccgggaccgagggccgggccgggauggccgccgucgccagccccaccggcaacugcgaccuggagcgcuucgcccaggugcuggagaaggagcucccgcuguacgcgcggcccaucuuccugcgccuccugcccgagcugcacaagaccgggacguacaaguuccagaagaccgagcuccggaaggagggcuucgaccccgccaucgugaaggacccgcuguucuaccuggacgcccagaagggccgcuacgucccccucgaccaggaggccuacucccgcauccaggcgggggaggagaagcuguga

SEQ ID NO: 36567 - RNA, 2073 nt, Artificial Sequence
  derived and/or modified sequence opt1 from SLC27A5__Homo_sapiens__NP_036386
augggcgugcgccagcagcuggcccuccugcugcuccugcugcuccugcugugggggcucggccagcccgucuggccgguggccguggcgcugacccugcgguggcuccugggggacccgaccugcugcguccugcucggccuggccaugcuggcccgccccuggcucgggcccugggugccccacggccugagccuggccgccgcggcccucgcccugacgcugcuccccgcccggcugccgcccggccugcgcuggcuccccgcggacgugaucuuccuggccaagauccugcaccucgggcugaagauccggggcugccugucccgccagccgcccgacaccuucgucgacgccuucgagcggcgcgcccgggcccagcccgggcgcgcgcuccugguguggaccggccccggggccggcagcgugaccuucggcgagcuggacgcccgggccugccaggccgcgugggcccucaaggccgagcugggggaccccgccucccugugcgccggcgagcccacggcgcuccugguccuggccagccaggccgugcccgcccucugcauguggcuggggcuggccaagcucggcugcccgaccgcguggaucaacccccacggccgcgggaugccccuggcccacuccgugcugagcuccggcgcccggguccucgugguggaccccgaccugcgcgagagccuggaggagauccugccgaagcuccaggccgagaacauccggugcuucuaccugucccacaccagccccacccccggggucggcgcgcugggggccgcccucgacgccgcccccucccacccggugcccgcggaccugcgcgccggcaucacguggcggagccccgcccuguucaucuacaccuccggcaccaccgggcuccccaagccggccauccugacgcacgagcgcgugcugcagaugagcaagaugcucucccugagcggcgccaccgcggacgacgucguguacaccgugcugccccucuaccacgucauggggcugguggugggcauccuggggugccucgaccugggcgcgaccugcguccuggcccccaaguucuccacgagcugcuucugggacgacugccggcagcacggcgugaccgucauccucuacgugggggagcugcugcgcuaccucugcaacaucccgcagcagcccgaggaccggacccacaccgugcgccuggccaugggcaacgggcugcgcgccgacgucugggagacguuccagcagcgguucggccccauccgcaucugggagguguacggguccaccgagggcaacaugggccucgugaacuacgucgggcggugcggcgcccuggggaagaugagcugccugcuccgcaugcugagccccuucgagcuggugcaguucgacauggaggccgccgagccggugcgggacaaccagggcuucugcauccccgucggccucggggagcccggccugcugcucaccaagguggugucccagcagcccuucgucggguaccgcggcccgcgggagcugagcgagcgcaagcuggugcggaacgugcgccaguccggggacgucuacuacaacaccggcgacgugcucgccauggaccgggagggcuuccuguacuuccgcgaccggcugggggacacguuccgcuggaagggcgagaacgugagcacccacgaggucgagggggugcucucccagguggacuuccugcagcaggucaacguguacggcgugugcguccccgggugcgagggcaaggugggcauggcggccgugcagcuggcccccgggcagaccuucgacggcgagaagcucuaccagcacguccgggccuggcugcccgccuacgcgaccccgcacuucauccgcauccaggacgccauggaggugacgagcaccuucaagcugaugaagacccggcucgugcgcgagggguucaacgucggcaucgugguggacccccuguucguccuggacaaccgggcccaguccuuccgcccccucaccgccgagauguaccaggccgugugcgaggggacguggcgccuguga

SEQ ID NO: 36568 - RNA, 1950 nt, Artificial Sequence
  derived and/or modified sequence opt1 from SLC28A1__Homo_sapiens__NP_004204
auggagaacgaccccagccgccggcgcgaguccaucagccugaccccgguggccaagggccucgagaacaugggggccgacuuccuggagucccuggaggagggccagcucccccggagcgaccugucccccgcggagauccgcagcuccuggagcgaggccgcccccaagccguucucccgguggcgcaaccugcagcccgcccuccgggcccgcagcuucugccgggagcacaugcagcuguuccgcuggaucgggaccggccugcucugcacggggcuguccgcguuccugcucgucgccugccugcuggacuuccagcgggcccucgcccuguucgugcugaccugcgugguccucaccuuccugggccaccgccugcucaagcggcugcugggccccaagcuccgccgguuccugaagccccaggggcacccgcgccugcuccugugguucaagcggggccuggcgcucgccgccuuccuggggcuggugcucuggcugagccuggacaccucccagcgccccgagcagcucgugagcuucgccggcaucugcgucuucguggcccugcuguucgcgugcuccaagcaccacugcgccgugagcuggcgggccgucuccugggggcucggccugcaguucgugcugggccuccuggugauccgcacggagcccggguucaucgccuucgaguggcugggcgagcagauccggaucuuccucagcuacaccaaggccggguccagcuucgucuucggcgaggcgcuggugaaggacguguucgccuuccagguccugcccaucaucguguucuucagcugcgugaucuccguccucuaccacgugggccugaugcagugggugauccugaagaucgccuggcugaugcaggucaccauggggaccacggccaccgagacccucagcguggccggcaacaucuucgugucccagaccgaggcgccgcugcugauccgccccuaccucgccgacaugacgcugagcgagguccacguggucaugaccgggggcuacgccaccaucgccgggucccugcucggcgccuacaucagcuucggcaucgacgcgaccucccugaucgccgccagcgugauggccgcgcccugcgcccuggcccucuccaagcugguguaccccgaggucgaggagagcaaguuccgccgggaggagggggugaagcugacguacggcgacgcccagaaccucaucgaggccgcguccaccggggccgccaucagcgugaaggucguggccaacaucgccgcgaaccugaucgccuuccuggccgugcucgacuucaucaacgccgcccuguccuggcugggcgacauggucgacauccaggggcucagcuuccagcugaucugcuccuacauccugcgcccgguggcguuccucaugggcguggccugggaggacugccccgucguggccgagcugcugggcaucaagcuguuccucaacgaguucguggccuaccaggaccugagcaaguacaagcagcggcgccucgcgggggccgaggagugggucggcgaccggaagcaguggaucuccgugcgcgccgaggugcugaccaccuucgcccugugcggguucgccaacuucagcuccaucggcaucaugcucgggggccugacgagcauggucccccagcgcaagagcgacuucucccagaucgugcugcgggcccucuucaccggcgcgugcgugagccuggucaacgccugcauggccgggauccuguacaugccccggggcgccgagguggacugcaugucccuccugaacaccacccugagcuccagcuccuucgagaucuaccagugcugccgcgaggcguuccagagcgugaacccggaguucucccccgaggcccucgacaacugcugccgguucuacaaccacacgaucugcgcccaguga

SEQ ID NO: 36569 - RNA, 1977 nt, Artificial Sequence
  derived and/or modified sequence opt1 from SLC28A2__Homo_sapiens__XP_011520500
auggagaaggccagcggccgccaguccaucgcccugagcaccguggagaccgggacggucaaccccggccucgagcugauggagaaggagguggagcccgagggguccaagcggaccgacgcgcagggccacagccugggggacggccucggccccuccaccuaccagcgccggagccgcuggcccuucuccaaggcccggagcuucugcaagacccacgccucccuguucaagaagauccugcucgggcugcugugccucgccuacgccgcguaccugcuggccgccugcauccucaacuuccagcgcgcccuggcgcuguucgugaucacgugccucgucaucuucgugcuggugcacagcuuccugaagaagcuccugggcaagaagcugacccggugccucaagcccuucgagaacucccgccugcggcuguggaccaagugggucuucgccggggugagccucgugggccugauccuguggcucgcccuggacaccgcccagcgcccggagcagcugauccccuucgccgggaucugcauguucauccucauccuguucgcgugcuccaagcaccacagcgccgucuccuggcggacgguguucagcggccugggccuccaguucguguucgggauccuggucauccgcaccgaccugggcuacaccguguuccaguggcucggggagcagguccagaucuuccugaacuacaccguggccggcuccagcuucguguucggcgacacgcuggugaaggacgucuucgccuuccaggcccuccccaucaucaucuucuucgggugcgugguguccauccuguacuaccugggccucguccaguggguggugcagaaggucgcgugguuccugcagaucaccauggggaccaccgccacggagacccuggccguggccggcaacaucuucgucgggaugaccgaggcgccccuccugauccggccguaccugggcgacaugacccucagcgagauccacgccgugaugacgggcggguucgccaccaucagcggcaccgugcugggggccuucaucgccuucggcgucgacgccuccagccugaucuccgcgagcgugauggccgcccccugcgcccuggcguccagcaagcucgccuaccccgagguggaggaguccaaguucaagagcgaggagggggucaagcugccccgcggcaaggagcggaacgugcuggaggccgccuccaacggcgccguggacgcgaucgggcucgccaccaacgucgccgccaaccugaucgccuuccuggcggugcucgccuucaucaacgccgcccugagcuggcugggcgagcucguggacauccaggggcugacguuccaggucaucugcuccuaccugcuccgcccgaugguguucaugaugggcguggaguggaccgacugccccauggucgccgagaugguggggaucaaguucuucaucaacgaguucguggcguaccagcagcugagccaguacaagaacaagcggcuguccggcauggaggaguggaucgagggcgagaagcaguggaucagcguccgcgccgagaucaucaccaccuucucccucugcggguucgccaaccugagcuccaucggcaucacgcucgggggccugaccagcaucgugccccaccggaaguccgaccugagcaagguggucgugcgcgcccuguucaccggcgcgugcgugagccucaucuccgccugcauggccgggauccuguacgucccccggggcgccgaggccgacugcgugagcuucccgaacaccuccuucacgaaccgcaccuacgagaccuacaugugcugccgcgggcuguuccagagcaccucccucaacggcacgaacccgcccagcuucuccgggcccugggaggacaaggaguucagcgcgauggcccugaccaacugcugcggcuucuacaacaacaccgugugcgccuga

SEQ ID NO: 36570 - RNA, 2076 nt, Artificial Sequence
  derived and/or modified sequence opt1 from SLC28A3__Homo_sapiens__NP_001186562
auggagcugcgcagcaccgccgcgccccgggccgagggcuacuccaacgugggguuccagaacgaggagaacuuccucgagaacgagaacaccagcggcaacaacuccauccgcagccgggccguccagucccgcgagcacacgaacaccaagcaggacgaggagcaggucaccguggagcaggacagcccgcggaaccgcgagcacauggaggacgacgacgaggagaugcagcagaaggggugccuggagcggcgcuacgacaccgugugcggcuucugccggaagcacaagacgacccugcgccacaucaucugggggauccuccuggccggcuaccuggugauggugaucuccgccugcguccucaacuuccaccgggcccugccccuguucgugaucaccguggcggccaucuucuucgucgugugggaccaccucauggccaaguacgagcaccgcaucgacgagaugcugagccccggccggcgccugcucaacucccacugguucuggcugaagugggugaucuggagcucccugguccucgccgugaucuucuggcuggcguucgacaccgccaagcuggggcagcagcagcucgugagcuucggcgggcugaucauguacaucguccuccucuuccuguucuccaaguaccccacgcggguguacuggcgcccggugcuguggggcaucgggcuccaguuccugcugggccuccugauccugcggaccgaccccggcuucaucgccuucgacuggcucgggcgccagguccagaccuuccuggaguacaccgacgccggcgccagcuucguguucggggagaaguacaaggaccacuucuucgcguucaaggugcugcccaucgucguguucuucuccacggugaugagcaugcucuacuaccugggccugaugcaguggaucauccggaaggucggcuggaucaugcucgugaccaccggguccagccccaucgaguccgucguggccagcggcaacaucuucguggggcagaccgagagcccgcugcugguccgccccuaccuccccuacaucacgaaguccgagcugcacgccaucaugaccgccggcuucagcaccaucgccggguccgugcugggcgcguacaucagcuucggcgugcccuccagccaccuccugaccgccuccgucaugagcgccccggccucccuggccgcggccaagcuguucuggcccgagacggagaagcccaagaucacccugaagaacgccaugaagauggagagcggggacuccggcaaccugcucgaggccgccacccagggggcgagcuccagcaucucccugguggccaacaucgccgugaaccugaucgccuuccuggcgcuccugagcuucaugaacuccgcccugagcugguucggcaacauguucgacuacccccagcucuccuucgagcugaucugcagcuacaucuucaugccguucagcuucaugaugggggucgaguggcaggacuccuucaugguggcccggcugaucggcuacaagaccuucuucaacgaguucguggccuacgagcaccucagcaaguggauccaccuccgcaaggagggcgggcccaaguucgucaacggcgugcagcaguacaucuccauccgcagcgagaucaucgccacguacgcgcugugcggguucgccaacaucggcucccuggggaucgugaucggcggccugaccagcauggcccccucccggaagcgcgacaucgccagcggggccguccgggcgcugaucgccggcaccguggccugcuucaugaccgccugcaucgccgggauccucuccagcacgcccguggacaucaacugccaccacguccuggagaacgcguucaacuccaccuucccgggcaacaccaccaaggugaucgccugcugccagagccugcucuccagcacgguggccaagggccccggggaggucauccccggcgggaaccacucccuguacagccugaagggcugcugcacccuccugaaccccuccaccuucaacugcaacgggaucagcaacaccuucuga

SEQ ID NO: 36571 - RNA, 1371 nt, Artificial Sequence
  derived and/or modified sequence opt1 from SLC29A1__Homo_sapiens__NP_001071643
augaccaccagccaccagccccaggaccgcuacaaggccguguggcugaucuucuucaugcucggccuggggacgcugcucccguggaacuucuucaugaccgccacccaguacuucaccaaccggcuggacaugucccagaacgucagccuggugacggcggagcucuccaaggacgcccaggccagcgccgcccccgcggcgccccugcccgagcgcaacucccugagcgccaucuucaacaacgugaugacccucugcgccaugcugccgcugcuccuguucaccuaccugaacuccuuccuccaccagcggaucccccagagcguccgcauccugggcucccugguggccauccuccugguguuccugaucaccgccauccucgucaaggugcagcuggacgcccugcccuucuucgugaucacgaugaucaagaucguccucaucaacagcuucggggccauccugcagggcucccuguucgggcucgccggccugcugcccgcgagcuacaccgccccgaucauguccggccaggggcucgccggcuucuucgccagcguggccaugaucugcgcgaucgccuccgggagcgagcuguccgagagcgccuucggcuacuucaucaccgccugcgccgugaucauccugaccaucaucugcuaccucgggcugccccggcuggaguucuaccgcuacuaccagcagcucaagcuggagggccccggcgagcaggagacgaagcuggaccucaucuccaagggggaggagccccgggcgggcaaggaggagagcggggucagcguguccaacagccagccgaccaacgagucccacagcaucaaggccauccugaagaacaucuccgugcuggccuucagcgucugcuucaucuucaccaucaccaucggcauguuccccgccgugacgguggaggucaaguccagcaucgccggcuccagcaccugggagcgcuacuucauccccguguccugcuuccucaccuucaacaucuucgacuggcuggggcggagccugaccgcgguguucauguggcccggcaaggacucccgcuggcucccgagccugguccuggcccggcucguguucgugccccugcugcugcucugcaacaucaagccccgccgguaccugacggucguguucgagcacgacgccugguucaucuucuucauggccgcguucgccuucuccaacggguaccuggccagccucugcaugugcuucggccccaagaaggucaagccggccgaggccgagaccgcgggggccaucauggccuucuuccugugccugggccucgcccugggcgccguguucuccuuccuguuccgcgcgaucguguga

SEQ ID NO: 36572 - RNA, 1371 nt, Artificial Sequence
  derived and/or modified sequence opt1 from SLC29A2__Homo_sapiens__XP_011543277
auggcccgcggcgacgcgccccgggacagcuaccaccugguggggaucuccuucuucauccucggccuggggacccugcucccguggaacuucuucaucaccgccauccccuacuuccaggcccgccuggccggcgccgggaacagcacggcccggauccuguccaccaaccacaccggccccgaggacgcguucaacuucaacaacugggucacccuccugagccagcugccccuccugcuguucacgcuccugaacuccuuccuguaccagugcgugccggagaccgugcgcauccucggcagccugcuggccauccuccugcuguucgcccucaccgccgcgcuggucaagguggacaugucccccgggcccuucuucagcaucaccauggccuccgugugcuucaucaacagcuucuccgccguccugcagggcagccucuucgggcagcugggcacgaugcccuccaccuacagcacccuguuccucuccgggcagggccuggccggcaucuucgccgcgcuggccaugcuccugagcauggccuccgggguggacgccgagaccagcgcccugggcuacuucaucacgccgugcguggggauccucauguccaucgucugcuaccugagccugccccaccucaaguucgcgcgguacuaccuggccaacaagagcucccaggcccaggcccaggagcuggagaccaaggccgagcuccugcagagcgacgagaacggcauccccuccagcccccagaagguggcgcugacccucgaccuggaccuggagaaggagccggaguccgagcccgacgagccccagaagcccggcaagccgagcguguucaccgucuuccagaagaucuggcucacggcccugugccuggugcucguguucaccgucacccuguccguguuccccgccaucaccgccauggugacgagcuccaccagccccgggaaguggucccaguucuucaaccccaucugcugcuuccugcuguucaacaucauggacuggcucggccgcagccugaccuccuacuuccuguggccggacgaggacagccggcuccugccccugcucgucugccugcgcuuccuguucgugccccucuucaugcugugccacgugccccagcggucccgccugccgauccucuucccccaggacgccuacuucaucaccuucaugcugcuguucgcggucagcaacggguaccucgugucccugacgaugugccuggcgccccgccaggugcucccccacgagcgggaggucgccggcgcccugaugaccuucuuccuggcccucgggcugagcugcggcgccucccugagcuuccucuucaaggcccugcuguga

SEQ ID NO: 36573 - RNA, 1428 nt, Artificial Sequence
  derived and/or modified sequence opt1 from SLC29A3__Homo_sapiens__NP_060814
auggccguggucagcgaggacgacuuccagcacuccagcaacuccaccuaccgcaccacgagcuccagccugcgggccgaccaggaggcgcuccuggagaagcugcucgaccggcccccgcccggccugcagcgccccgaggaccgcuucugcgggaccuacaucaucuucuucucccugggcaucgggagccuccugcccuggaacuucuucaucaccgccaaggaguacuggauguucaagcugcggaacuccagcuccccggccaccggcgaggaccccgaggggagcgacauccucaacuacuucgaguccuaccuggccguggccagcacggugcccuccaugcugugccucgucgcgaacuuccugcuggugaaccgcguggccguccacauccgggugcucgccagccugaccgugauccuggccaucuucauggucaucaccgcgcucgugaagguggacaccuccagcuggacgcgcggcuucuucgccgucaccaucgugugcauggugauccuguccggcgccagcaccgucuucagcuccagcaucuacgggaugaccggcuccuuccccaugcggaacagccaggcccugaucuccgggggcgccaugggcgggacggugagcgcgguggccucccucgucgaccuggccgccagcuccgacgugcgcaacagcgcccuggcguucuuccucaccgccaccguguuccugguccugugcaugggccucuaccugcugcucucccggcuggaguacgcccgcuacuacaugcggccggugcuggccgcccacguguucagcggggaggaggagcucccccaggacucccugagcgcgcccuccgucgccagccgcuucaucgacucccacacgcccccgcugcggcccauccucaagaagaccgccagccugggcuucugcgugaccuacgucuucuucaucaccucccugaucuaccccgccaucugcaccaacaucgagagccucaacaaggggagcggcucccuguggacgaccaaguucuucaucccccugaccaccuuccuccuguacaacuucgccgaccugugcggccgccagcucacggcguggauccaggugccggggcccaacagcaaggcccugcccggcuucgugcugcuccggaccugccugaucccccuguucguccugugcaacuaccagccgcgcgugcaccucaagaccguggucuuccaguccgacguguaccccgcccugcugagcucccuccuggggcugagcaacggcuaccucuccacccuggcccugcucuacgggcccaagaucgugccccgggagcuggcggaggccacgggcgucgugaugagcuucuacgugugccugggccucacccugggguccgccugcagcacccugcucguccaccugaucuga

SEQ ID NO: 36574 - RNA, 1593 nt, Artificial Sequence
  derived and/or modified sequence opt1 from SLC29A4__Homo_sapiens__XP_006715730
augggcagcguggggucccagcgccuggaggagcccagcgucgccggcaccccggaccccgggguggugauguccuucaccuucgacagccaccagcucgaggaggccgcggaggccgcccagggccaggggcugcgggcccgcggcguccccgccuucacggacaccacccuggacgagcccgugccggacgaccgguaccacgcgaucuacuucgccaugcuccuggccggcgugggguuccugcuccccuacaacuccuucaucaccgacgucgacuaccugcaccacaaguaccccggcacgagcaucguguucgacaugucccugaccuacauccucguggcccuggcggccguccugcucaacaacgugcugguggagcgccugacccuccacacccggaucacggccggguaccugcuggcccucggcccccugcuguucaucagcaucugcgacgucuggcuccagcuguucucccgcgaccaggccuacgcgaucaaccuggccgccguggggaccguggccuucggcugcaccguccagcagagcuccuucuacggcuacaccgggaugcucccgaagcgguacacgcagggcgugaugaccggggagagcaccgccggcgugaugaucucccugagccgcauccugaccaagcuccugcugcccgacgagcgggcguccacgcucaucuucuuccuggucagcguggcccuggagcuccugugcuuccugcuccaccuccuggugcgccggucccgcuucguccuguucuacaccacccggccccgcgacagccaccggggccgccccgggcugggccggggguacggcuaccgcgugcaccacgacguggucgccggggacgugcacuucgagcacccggcccccgcccuggcgcccaacgagucccccaaggacagcccggcccacgaggucaccggcagcggcggggccuacaugcgguucgacgugccccgcccccgggugcagcgcuccuggcccacguuccgcgcccuccugcugcaccgguacgucguggcccgcgugaucugggcggacaugcucagcaucgccgucaccuacuucaucacccugugccuguucccgggccucgaguccgagauccggcacugcauccugggggaguggcugcccauccugaucauggccguguucaaccucagcgacuucgugggcaagauccuggccgcgcugcccgucgacuggcgcgggacccaccuccuggccugcuccugccugcgggugguguucaucccccucuucauccugugcgucuacccgagcggcaugcccgcccugcgccaccccgccuggcccugcaucuucucccuccugaugggcaucagcaacggguacuucggcuccgugccgaugauccuggccgcggggaaggugagccccaagcagcgggagcucgccggcaacacgaugaccgucuccuacaugagcgggcugacccugggcuccgccguggccuacugcaccuacagccucacgcgcgacgcccacggcuccugccugcacgcgagcaccgccaacggguccauccuggccggccucuga

SEQ ID NO: 36575 - RNA, 1626 nt, Artificial Sequence
  derived and/or modified sequence opt1 from SLC2A10__Homo_sapiens__NP_110404
augggccacagcccgcccgugcugccccucugcgccuccgucagccugcucgggggccugaccuucggguacgagcuggccgugaucuccggcgcgcugcucccccugcagcuggacuucgggcucagcugccuggagcaggaguuccuggugggcucccuccugcugggcgcccuccuggccagccuggucgggggcuuccucaucgacugcuacgggcgcaagcaggccauccugggcuccaaccuggugcuccuggccgggagccugacccucggccuggcgggcucccuggccuggcucgugcuggggcgggccgucgugggcuucgccaucagccuguccagcauggcgugcugcaucuacguguccgagcucgucgggccccgccagcggggcgugcuggugagccuguacgaggccggcaucacggucgggauccuccuguccuacgcccugaacuacgcccucgccggcaccccguggggguggcgccacauguucggcugggcgaccgcccccgccgugcugcagagccugucccuccuguuccugcccgccgggaccgacgagacggccacccacaaggaccucaucccccugcagggcggcgaggcgccgaagcuggggcccggccggccccgcuacagcuuccucgaccuguuccgggcccgcgacaacaugcgggggcgcaccaccgugggccuggggcucguccuguuccagcagcugacgggccagcccaacgugcugugcuacgccuccaccaucuucagcagcgugggcuuccacgggggcuccagcgccguccucgccuccguggggcugggcgcggugaaggucgccgccacccugaccgccauggggcucguggaccgggccggccgccgggcgcugcugcucgccggcugcgcccugauggcccugagcguguccgggaucggccucgucagcuucgcggugccgauggacuccgggcccagcugccuggccguccccaacgccacgggccagaccggccugcccggggacuccggccuccugcaggacagcucccugccgcccaucccccgcaccaacgaggaccagcgggagcccauccucagcaccgccaagaagacgaagccgcacccccgcuccggggaccccagcgcgcccccgcggcuggcccuguccagcgcccuccccggcccgccccugcccgcccgcgggcacgcccugcuccgguggaccgcccugcugugccucaugguguucguguccgcguucagcuucggcuucggccccgucaccuggcuggugcuguccgagaucuaccccguggagauccgcgggcgggccuucgccuucugcaacagcuucaacugggccgccaaccucuucaucagccuguccuuccuggaccucaucggcaccaucgggcugagcuggacguuccugcucuacggccugaccgcgguccuggggcucggcuucaucuaccuguucgugccggagaccaagggccagucccuggccgagaucgaccagcaguuccagaagcgccgcuucacccucagcuucgggcaccggcagaacuccacgggcauccccuacagccgcaucgagaucuccgccgccagcuga

SEQ ID NO: 36576 - RNA, 1491 nt, Artificial Sequence
  derived and/or modified sequence opt1 from SLC2A11__Homo_sapiens__NP_001020109
augcgcgcccugcggcgccucauccagggccggauccugcugcucaccaucugcgccgcggggaucggcgggaccuuccaguucggcuacaaccugagcaucaucaacgcccccacgcugcacauccaggaguucaccaacgagaccuggcaggcccgcaccggggagccgcuccccgaccaccuggugcugcucauguggucccugaucgucagccuguacccccucggcggccuguucggggcccugcucgccggcccccuggcgaucacgcuggggcggaagaagucccuccuggugaacaacaucuucguggucagcgccgccauccuguucggcuucucccgcaaggccgggagcuucgagaugaucaugcucggccggcugcuggugggcgugaacgcgggggucuccaugaacauccagccgauguaccucggcgagagcgcccccaaggagcugcgcggggccguggccauguccagcgccaucuucaccgcgcugggcaucgugaugggccaggucguggggcuccgggagcugcugggcgggccccaggccuggccccuccugcuggccuccugccucgugccgggcgcccugcagcuggccagccucccccugcugcccgagagcccccgcuaccuccugaucgacugcggggacaccgaggcgugccuggccgcccuccggcgccugcggggcuccggcgaccuggccggggagcucgaggagcuggaggaggagcgcgccgcgugccagggcugccgggcccgccggccgugggagcuguuccagcaccgcgcccuccggcgccaggucaccucccugguggugcuggggagcgccauggagcugugcggcaacgacuccgucuacgccuacgcgagcuccguguuccggaaggccggggugcccgaggccaagauccaguacgccaucaucggcacgggcagcugcgagcuccugaccgcggucgugagcugcguggucaucgagcgcguggggcgccgggugcugcucaucggcggguacucccugaugaccugcuggggcagcaucuucaccgucgcccugugccuccaguccagcuuccccuggacgcuguaccuggccauggccugcaucuucgccuucauccucuccuucgggaucggccccgcgggcgugaccgggauccuggccaccgagcuguucgaccagauggcccgcccggccgccugcauggucugcggcgcgcucauguggaucaugcugauccugguggggcucggcuuccccuucaucauggaggcccugagccacuuccuguacgugcccuuccucggcgucugcgugugcggggccaucuacaccggccuguuccugcccgagacgaaggggaagaccuuccaggagaucuccaaggagcuccaccggcugaacuucccgcgccgggcccagggccccaccuggcgcagccuggaggugauccaguccaccgagcucuga

SEQ ID NO: 36577 - RNA, 1854 nt, Artificial Sequence
  derived and/or modified sequence opt1 from SLC2A12__Homo_sapiens__NP_660159
auggugcccgucgagaacaccgagggcccgagccugcucaaccagaaggggaccgccguggagacggagggcuccgggagccgccacccgcccugggcccggggcugcgggauguucaccuuccuguccagcgugaccgcggccgucuccggccugcucgugggcuacgagcuggggaucaucagcggcgcccugcuccagaucaagacccugcuggcccucuccugccacgagcaggagaugguggucagcucccuggugaucggggcccugcucgcgagccugacgggcggggugcugaucgaccgcuacggccggcgcaccgccaucauccucuccagcugccugcugggccucgggucccugguccugauccucagccuguccuacaccgugcugaucgugggccggaucgccaucggggucagcaucucccucagcuccaucgcgaccugcguguacaucgccgagaucgcgccccagcaccgccggggccugcuggugagccucaacgagcugaugaucgucaucggcauccugagcgccuacaucuccaacuacgccuucgccaacguguuccacggguggaaguacauguucggccucgugaucccccuggggguccugcaggccaucgccauguacuuccucccgcccagcccccgcuuccuggugaugaagggccaggagggggccgccuccaaggugcugggccggcuccgcgcccugagcgacacgaccgaggagcugaccgucaucaaguccagccucaaggacgaguaccaguacuccuucugggaccuguuccggagcaaggacaacaugcgcacccggaucaugaucggccugacgcucguguucuucgugcagaucaccgggcagcccaacauccuguucuacgcguccaccguccucaagagcgugggcuuccaguccaacgaggccgccagccucgccuccaccggggucggcguggugaaggucaucagcacgauccccgccacccugcugguggaccacgugggguccaagaccuuccucugcaucggcagcuccgucauggcggccagccuggugaccaugggcaucgugaaccugaacauccacaugaacuucacgcacaucugccgcucccacaacagcaucaaccagagccuggacgaguccgucaucuacgggcccggcaaccucagcaccaacaacaacacccugcgggaccacuucaaggggaucuccagccacucccgcagcucccugaugccccuccggaacgacguggacaagcgcggcgagaccacgagcgccucccugcugaacgccgggcucagccacaccgaguaccagaucgugaccgacccgggcgacguccccgccuuccugaaguggcugucccucgcgagccugcugguguacguggccgccuucuccaucggccucgggcccaugcccuggcugguccugagcgagaucuucccgggcgggauccggggccgcgccauggcgcucaccuccagcaugaacuggggcaucaaccugcugaucucccucacguuccugaccgugaccgaccugaucgggcuccccugggugugcuucaucuacaccaucaugagccuggccagccugcuguucgucgugauguucauccccgagacgaagggcugcucccuggagcagaucagcauggagcuggccaaggugaacuacgucaagaacaacaucugcuucaugucccaccaccaggaggagcucgugcccaagcagccgcagaagcggaagccccaggagcagcugcuggagugcaacaagcucugcgggcgcggccagagccgccagcugucccccgagaccuga

SEQ ID NO: 36578 - RNA, 1947 nt, Artificial Sequence
  derived and/or modified sequence opt1 from SLC2A13__Homo_sapiens__NP_443117
augagccgcaaggccuccgagaacguggaguacacccugcggagccucuccagccugaugggcgagcgccggcgcaagcagcccgagccggacgccgcguccgccgccggggagugcagccugcucgccgccgcggaguccagcaccucccugcagagcgccggcgccgggggcgggggcgucggcgaccuggagcgggccgcgcgccggcaguuccagcaggacgagacgcccgccuucguguacguggucgccguguucuccgcccucgggggcuuccuguucggguacgacaccggcguggucagcggggccaugcugcuccugaagcgccagcugucccucgacgcgcuguggcaggagcugcucgugagcuccaccgugggcgccgccgccgucagcgcccuggcgggcggggcccugaacggcguguucgggcggcgcgccgccauccuccuggccuccgcgcuguucaccgccggcagcgccgugcucgccgccgcgaacaacaaggagacgcugcuggccggccggcucgucguggggcugggcaucgggaucgccuccaugaccgugcccgucuacaucgccgaggugagcccgcccaaccugcgcggccggcucgugaccaucaacacccuguucaucaccgggggccaguucuucgcgagcgucguggacggcgccuucuccuaccugcagaaggacggguggcgcuacaugcucggccuggccgccgugcccgccgucauccaguucuucggguuccuguuccuccccgagagcccccgguggcugauccagaagggccagacccagaaggcgcgccggauccugucccagaugcgcgggaaccagaccaucgacgaggaguacgacagcaucaagaacaacaucgaggaggaggagaaggaggugggcuccgccggcccggugaucugccggaugcucagcuacccgcccacccgccgggcccugaucgucgggugcggccugcagauguuccagcagcucuccgggaucaacacgaucauguacuacagcgccaccauccugcagauguccggcguggaggacgaccgccuggccaucuggcucgcgagcgucaccgccuucaccaacuucaucuucacgcugguggggguguggcuggucgagaaggugggccgccggaagcucaccuucggcucccuggccgggaccaccguggcccugaucauccucgcccugggcuucguccugagcgcccaggugagcccccgcaucacguucaagcccaucgcccccuccgggcagaacgcgaccugcacccgguacuccuacugcaacgagugcaugcuggaccccgacugcggcuucugcuacaagaugaacaagagcaccgugaucgacuccagcugcguccccgugaacaaggccuccacgaacgaggcggccuggggccgcugcgagaacgagaccaaguucaagaccgaggacaucuucugggccuacaacuucugcccgacccccuacagcuggacggcccuccuggggcugauccucuaccugguguucuucgcccccggcauggggcccaugccguggaccgucaacagcgagaucuacccccugugggcgcgguccaccggcaacgccugcagcuccgggaucaacuggaucuucaacgugcucgugagccugaccuuccugcacacggccgaguaccucaccuacuacggcgccuucuuccuguacgccggcuucgcggccgucgggcuccuguucaucuacggcugccugcccgagaccaaggggaagaagcuggaggagaucgagucccucuucgacaaccgccugugcacgugcggcacgagcgacuccgacgaggggcgguacaucgaguacauccgcgugaagggcagcaacuaccaccuguccgacaacgacgccagcgacguggaguga

SEQ ID NO: 36579 - RNA, 1494 nt, Artificial Sequence
  derived and/or modified sequence opt1 from SLC2A14__Homo_sapiens__NP_001273163
auggacaaccgccagaacgugacccccgcccugaucuucgccaucaccgucgcgacgaucggcagcuuccaguucggguacaacaccggcgugaucaacgccccggagaccaucaucaaggaguucaucaacaagacccucacggacaaggccaacgccccgcccuccgaggugcugcugaccaaccucuggagccuguccgucgccaucuucagcgucgggggcaugaucggguccuucagcgugggccuguucgugaaccgguucggccgccggaacuccaugcucaucgugaaccugcuggcggccaccgggggcugccucauggggcugugcaagaucgccgagagcguggagaugcugauccucggccgccuggucaucgggcuguucugcggccucugcaccggcuucgugcccauguacaucggggagaucucccccacggcccugcggggcgcguucgggacccugaaccagcucggcaucgugaucggcauccuggucgcccagaucuucgggcuggagcucauccugggcagcgaggagcuguggcccgugcuccugggguucaccauccugcccgccauccuccaguccgccgcccugcccugcugcccggagagcccccgcuuccugcucaucaaccggaagaaggaggagaacgcgacccgcauccugcagcggcuguggggcacgcaggacgugucccaggacauccaggagaugaaggacgagagcgcccgcaugucccaggagaagcaggucaccgugcucgagcuguuccgggugagcuccuaccgccagcccaucaucaucagcaucguccugcagcucucccagcagcugagcgggaucaacgccguguucuacuacagcaccggcaucuucaaggacgccggcgugcagcagcccaucuacgccaccaucuccgcgggggucgugaacacgaucuucacccugcucagccuguuccugguggagcgggccggccgccggacccuccacaugaucgggcugggcgggauggccuucugcuccacccugaugacggucagccuccugcugaagaaccacuacaacggcauguccuucgugugcaucggcgccauccucgucuucguggccugcuucgagaucgggccgggccccauccccugguucaucguggcggagcuguucagccaggggccccgcccggccgccauggccgucgccggcugcuccaacuggaccagcaacuuccugguggggcuccuguuccccuccgcggccuacuaccugggcgccuacguguucaucaucuucaccggcuuccugaucaccuuccucgccuucacguucuucaagguccccgagacccgggggcgcaccuucgaggacaucacccgggcguucgagggccaggcccacggggccgaccgcagcggcaaggacggcgugauggggaugaacuccaucgagcccgccaaggagacgaccaccaacguguga

SEQ ID NO: 36580 - RNA, 1575 nt, Artificial Sequence
  derived and/or modified sequence opt1 from SLC2A2__Homo_sapiens__NP_000331
augaccgaggacaaggugaccggcacgcuggucuucaccgugaucaccgccgugcucgggagcuuccaguucggcuacgacaucggggucaucaacgcgccccagcaggucaucaucucccacuaccgccacgugcugggcgugccgcuggacgaccggaaggccaucaacaacuacgugaucaacagcaccgacgagcuccccacgaucuccuacagcaugaaccccaagcccaccccgugggccgaggaggagaccguggccgccgcccagcugaucaccaugcuguggucccucagcgucuccagcuucgcggucgggggcaugacggccuccuucuucggcggguggcugggcgacacccuggggcgcaucaaggccaugcucguggccaacauccugagccuggugggcgcgcuccugaugggguucuccaagcugggccccagccacauccucaucaucgccggccgguccaucagcgggcuguacugcggccugaucuccgggcucgugcccauguacaucggcgagaucgcccccaccgcccugcgcggcgcccuggggaccuuccaccagcucgcgaucgugacgggcauccugaucagccagaucaucgggcuggaguucauccucggcaacuacgaccuguggcacauccugcucgggcuguccggcguccgggccauccugcagagccuccugcuguucuucugcccggagagcccccgcuaccucuacaucaagcuggacgaggaggugaaggccaagcagagccugaagcggcuccgcggcuacgacgacgugaccaaggacaucaacgagaugcggaaggagcgcgaggaggccagcuccgagcagaaggucagcaucauccagcuguucaccaacuccagcuaccggcagcccauccugguggcccucaugcugcacguggcgcagcaguucuccgggaucaacggcaucuucuacuacagcaccuccaucuuccagacggccgggaucagcaagcccgucuacgccaccaucggcgugggggccgugaacauggucuucaccgccguguccgucuuccugguggagaaggcgggccgccggagccucuuccugaucggcauguccgggauguucgugugcgccaucuucaugagcgucggccuggugcuccugaacaaguucuccuggaugagcuacguguccaugaucgccaucuuccuguucgucagcuucuucgagaucgggccgggccccauccccugguucaugguggccgaguucuucucccaggggccccgcccggccgcgcucgccaucgccgccuucagcaacuggaccugcaacuucaucguggcgcugugcuuccaguacaucgccgacuucugcggccccuacgucuucuuccuguucgccggcgugcugcucgccuucacgcuguucaccuucuucaaggugcccgagaccaaggggaaguccuucgaggagaucgccgcggaguuccagaagaaguccggcagcgcccaccggcccaaggccgccgucgagaugaaguuccugggggccaccgagacgguguga

SEQ ID NO: 36581 - RNA, 1491 nt, Artificial Sequence
  derived and/or modified sequence opt1 from SLC2A3__Homo_sapiens__NP_008862
augggcacccagaaggugacccccgcccugaucuucgccaucacggucgcgaccaucgggagcuuccaguucggcuacaacaccggggugaucaacgccccggagaagaucaucaaggaguucaucaacaagacccucacggacaagggcaacgccccgcccuccgaggugcugcugaccagccucuggucccugagcgucgccaucuucuccgucgggggcaugaucggcagcuucuccguggggcuguucgugaaccgcuucggccggcgcaacagcaugcucaucgugaaccugcuggccgugaccgggggcugcuucauggggcucugcaaggucgcgaaguccguggagaugcugauccugggccggcucgugaucggccuguucugcgggcugugcaccggcuucguccccauguacaucggggagaucagccccacggcccuccgcggcgccuucggcacccugaaccagcuggggaucguggugggcauccucgucgcccagaucuucgggcuggaguucauccugggcuccgaggagcucuggccccugcugcucggguucaccauccugcccgcgauccugcagagcgccgcccuccccuucugcccggagagcccccgguuccugcugaucaaccgcaaggaggaggagaacgccaagcagauccuccagcggcuguggggcacccaggacgugucccaggacauccaggagaugaaggacgaguccgcccgcaugagccaggagaagcaggucacggugcuggagcuguuccggguguccagcuaccgccagcccaucaucaucuccaucgugcuccagcugagccagcagcucagcggcaucaacgcggucuucuacuacuccaccgggaucuucaaggacgccggcgugcaggagcccaucuacgccaccaucggggccggcguggucaacaccaucuucacgguggucagccuguuccugguggagcgggccgggcgccggacccuccacaugaucggccugggcgggauggcguucugcuccacccugaugaccgugagccuccugcugaaggacaacuacaacggcauguccuucgucugcaucggggccauccucguguucguggccuucuucgagaucggcccggggcccauccccugguucaucgucgccgagcuguucagccagggcccccgcccggccgcgauggccguggccggcugcuccaacuggacgagcaacuuccugguggggcuccuguuccccuccgccgcccacuaccugggcgcguacgucuucaucaucuucaccggguuccugaucaccuuccucgccuucaccuucuucaaggugcccgagacgcggggccgcaccuucgaggacaucacccgggccuucgagggccaggcccacggggcggaccgcagcggcaaggacggggugauggagaugaacuccaucgagcccgccaaggagaccacgaccaacgucuga

SEQ ID NO: 36582 - RNA, 1164 nt, Artificial Sequence
  derived and/or modified sequence opt1 from SLC2A4RG__Homo_sapiens__NP_064446
auggagcggcccccgccccgcgccgccggccgcgaccccagcgcgcugcgggccgaggcccccuggcuccgcgccgaggggcccggcccccgggccgcgcccgugaccguccccaccccgccccagggguccagcgugggcgggggcuucgccggccuggaguucgcccgcccccaggaguccgagccccgggccagcgaccugggggcgccgcgcacguggaccggcgccgccgccgggccccggacccccuccgcccacauccccgugccggcgcagcgcgccacccccggcaaggcccggcucgacgaggucauggccgccgcggcccugacgagccuguccaccagcccccuccugcugggggcccccguggccgccuucuccccggagcccggccucgagcccuggaaggaggcgcuggugcggcccccgggcagcuacuccagcuccagcaacuccggggacuggggcugggaccuggccagcgaccaguccagccccuccacccccagcccgccccucccgcccgaggccgcccacuuccuguucggggagcccacccugcgcaagcgcaagagccccgcccaggucauguuccagugccucuggaaguccugcggcaaggugcugagcacggcguccgccaugcagcggcacauccgccuggugcaccucggccggcaggccgagcccgagcagagcgacggggaggaggacuucuacuacaccgagcuggacgucggcguggacacccugaccgacgggcucuccagccugacgcccguguccccgaccgccagcaugccgcccgcguucccccgccuggagcuccccgagcugcuggagccgcccgcccuccccagcccccugcggccgcccgcgccgccccugcccccgccgcccguccucuccaccguggccaacccccaguccugccacagcgaccgcguguaccagggcugccugacccccgcccggcuggagccccagcccacggaggucggggccugcccgcccgcccucuccagccgcaucggcgugacccugcgcaagccccggggcgacgccaagaagugccgcaagguguacgggauggagcggcgcgaccuguggugcaccgccugccgguggaagaaggccugccagcgcuuccucgacuga

SEQ ID NO: 36583 - RNA, 1476 nt, Artificial Sequence
  derived and/or modified sequence opt1 from SLC2A5__Homo_sapiens__XP_011540307
augcgccugacccucgugcuggcccuggccacccucaucgcggccuucggcagcuccuuccaguacggguacaacgucgccgccgugaacagccccgcccugcugaugcagcaguucuacaacgagacguacuacggccggaccggggaguucauggaggacuucccccucacccugcugugguccgugaccgucagcauguuccccuucggcggguucaucggcucccuccuggugggcccccuggugaacaaguucgggcgcaagggcgcgcuccuguucaacaacaucuucagcaucguccccgccauccugauggggugcucccggguggccacgagcuucgagcucaucaucaucucccgccugcuggugggcaucugcgccggggucagcuccaacguggugccgauguaccucggcgagcuggcgcccaagaaccugcggggcgcccucggggucgugccccagcuguucaucaccgugggcauccuggucgcccagaucuucgggcuccgcaaccugcuggccaacguggacggcuggcccauccuccugggccugaccggggugccggccgcgcuccagcugcugcuccugcccuucuuccccgagagcccccgguaccugcucauccagaagaaggacgaggccgccgccaagaaggcccugcagacccugcgcggcugggacuccgucgaccgggagguggcggagauccgccaggaggacgaggccgagaaggccgccggguucaucagcgugcucaagcuguuccggaugcgcucccugcgguggcagcuccugagcaucaucguccugaugggcgggcagcagcucuccggcgugaacgccaucuacuacuacgcggaccagaucuaccugagcgccggcgugccggaggagcacguccaguacgugacggccgggaccggcgccgucaacguggugaugaccuucugcgccgucuucgugguggagcugcucgggcgccggcugcugcugcuccugggcuucuccaucugccugaucgcgugcugcguccucaccgccgcccuggcccugcaggacacggugagcuggaugcccuacaucagcaucgugugcgucaucuccuacgugaucgggcacgcgcucggccccagccccaucccggcccugcugaucaccgagaucuuccuccaguccagccgccccuccgccuucauggugggcgggagcguccacuggcuguccaacuucaccgugggccugaucuuccccuucauccaggaggggcucggccccuacagcuucaucguguucgccgucaucugccugcugaccacgaucuacaucuuccucaucgugccggagaccaaggccaagaccuucaucgagaucaaccagaucuucaccaagaugaacaagguguccgaggucuaccccgagaaggaggagcugaaggagcugccgcccgugacgagcgagcaguga

SEQ ID NO: 36584 - RNA, 1338 nt, Artificial Sequence
  derived and/or modified sequence opt1 from SLC2A6__Homo_sapiens__NP_001138571
augcaggagccccugcucggcgccgaggggccggacuacgacaccuuccccgagaagcccccgcccagccccggcgaccgcgcccggguggggacccugcagaacaagcgcgucuuccuggcgacguucgccgccgugcucggcaacuucuccuucggguacgcccugguguacaccagccccgucauccccgcccuggagcggucccucgacccggaccugcaccugaccaagagccaggcguccugguucggcagcguguucacccucggcgccgccgccgggggccuguccgcgaugauccugaacgaccuccuggggcgcaagcugagcaucauguucuccgccgugcccagcgccgccggcuacgcccucauggcgggggcccacggccuguggaugcugcuccugggccggacgcugaccggguucgccggcgggcucaccgccgccugcauccccgucuacguguccgagaucgcgcccccgggcgugcgcggcgcccugggggccacgccccagcugauggccgucuucggcagccucucccuguacgcccuggggcuccugcugcccuggcgguggcucgcgguggccggcgaggcccccgugcugaucaugauccugcuccugagcuucaugccgaacagcccccgcuuccugcucucccgggggcgcgacgaggaggcccugcgggcccuggcguggcuccgcggcacggacgucgacgugcacugggaguucgagcagauccaggacaacgugcggcgccaguccagccgggucuccugggccgaggcccgcgcgccccacgugugccggcccaucaccguggcccugcugaugcgccuccugcagcagcugaccggcaucaccccgauccucgucuaccugcagagcaucuucgacagcacggccgugcugcucccgcccaaggacgacgccgccaucgugggggccguccggcugcuguccgugcugaucgcggcccucaccauggaccuggccggccgcaaggugcuccuguucgucagcggguacgccgugggcugggggcccaucaccuggcugcugauguccgagguccucccccugcgggcccgcggcguggcgagcggccugugcgugcucgccuccuggcugaccgccuucguccugaccaagagcuuccuccccgugguguccaccuucgggcugcagguccccuucuucuucuucgccgccaucugccuggugagccucguguucaccggcugcugcguccccgagaccaaggggcgcucccuggagcagaucgagagcuucuuccggacgggccgccgguccuuccugcgcuga

SEQ ID NO: 36585 - RNA, 1236 nt, Artificial Sequence
  derived and/or modified sequence opt1 from SLC2A8__Homo_sapiens__NP_001258640
augacccccgaggacccggaggagacccagccccugcucggcccgcccgggggcagcgcgccccgcgggcggcgcguguuccuggccgccuucgccgccgcccugggcccccucuccuucggguucgcccugggcuacagcucccccgcgauccccagccugcagcgggccgccccgcccgcgccccgccucgacgacgccgccgccuccugguucggcgccgucgugacgcugggggccgcggccggcggggugcugggcggguggcucgucgaccgggccggccgcaagcugagccugcuccugugcuccgugcccuucguggccggcuucgccgucaucaccgcggcccaggacguguggaugcugcucgggggccggcugcugaccgggcucgccugcggcguggccagccuggucgccccgguguacaucuccgagaucgcguaccccgccgugcgcggccugcucgggagcugcguccagcugauggugguggucggcauccugcucgccuaccuggccgggugggugcuggaguggcgguggcucgccgugcugggcugcgucccgcccucccugaugcuccugcugaugugcuucaugcccgagacgccccgcuuccuccugacccagcaccggcgccaggaggcgauggccgcccugcgguuccucugggggagcgagcagggcugggaggacccgcccaucggcgccgagcaguccuuccaccuggcgcugcuccgccagcccgggaucuacaagcccuucaucaucggcgugagccugauggccuuccagcagcuguccggggugaacgccgucauguucuacgccgagaccaucuucgaggaggccaaguucaaggacagcucccucgcgagcgugguggucggcgugauccagguccuguucaccgccguggccgcccugaucauggaccgggccgggcgccggcuccugcuggugcucuccggcgucgugaugguguucagcaccagcgcguucggcgccuacuucaagcugacgcagggcgggcccgggaacuccagccacgucgccaucuccgcccccgugagcgcccagccgguggacgcguccgucggccuggccuggcuggccguggggagcaugugccucuucaucgccggcggcccccaggcgcuguggucccugcucgccugccugcgcuuccugcaccuccagugccccuuccacuucgugcugugccccuga

SEQ ID NO: 36586 - RNA, 1536 nt, Artificial Sequence
  derived and/or modified sequence opt1 from SLC2A9__Homo_sapiens__NP_001001290
augaagcugagcaagaaggaccgcggcgaggacgaggaguccgacagcgccaagaagaagcucgacugguccugcagccugcugguggccucccucgcgggggccuucggcagcuccuuccuguacggguacaaccugagcgucgugaacgcccccaccccguacaucaaggccuucuacaacgaguccugggagcggcgccacggccggcccaucgaccccgacacccucacgcugcuguggagcgugaccgucuccaucuucgccaucgggggccucgugggcacccugaucgugaagaugaucgggaagguccugggccgcaagcacacccuccuggcgaacaacggguucgccaucagcgccgcccugcucauggcgugcucccugcaggccggcgccuucgagaugcugaucguggggcgguucaucaugggcaucgacggcgggguggcccucagcguccugcccauguaccuguccgagaucagcccgaaggagauccgcggcucccucggccaggugacggccaucuucaucugcaucgggguguucaccggccagcugcuggggcuccccgagcugcugggcaaggagagcaccuggcccuaccucuucggggucaucguggugcccgcggucgugcagcugcugucccucccguuccugcccgacagcccccgguaccugcuccuggagaagcacaacgaggcccgcgccgugaaggccuuccagaccuuccugggcaaggccgacgucagccaggagguggaggaggugcucgcggagucccggguccagcgcagcauccggcugguguccgugcuggagcuccugcgcgcccccuacguccgguggcaggucgugacggugaucgugaccauggccugcuaccagcugugcgggcucaacgccaucugguucuacaccaacagcaucuucggcaaggccggcaucccgcccgcgaagauccccuacgucacccuguccaccgggggcaucgagacgcuggccgccguguucagcgggcucgugaucgagcaccugggccgccggccccugcucaucgggggcuucggccugauggggcuguucuucggcacccugaccaucacgcucacccugcaggaccacgccccguggguccccuaccuguccaucguggggauccucgccaucaucgcgagcuucugcuccggccccgggggcauccccuucauccugaccggcgaguucuuccagcagagccagcgcccggccgccuucaucaucgccgggaccgugaacuggcuguccaacuucgcggucggccuccuguuccccuucauccagaagucccuggacacguacugcuuccucguguucgccaccaucugcaucaccggggccaucuaccuguacuucgugcugcccgagaccaagaaccggacguacgccgagaucagccaggccuucagcaagcgcaacaaggcguacccgcccgaggagaagaucgacuccgccgucaccgacggcaagaucaacggccggcccuga

SEQ ID NO: 36587 - RNA, 1458 nt, Artificial Sequence
  derived and/or modified sequence opt1 from SLC30A10__Homo_sapiens__NP_061183
augggccgcuacagcgggaagaccugccggcuccuguucaugcuggugcugaccgucgccuucuucguggccgagcucguguccggcuaccuggggaacagcaucgcgcugcucuccgacagcuucaacaugcuguccgaccugaucagccucugcgucggccuguccgccggguacaucgcccgccggcccacgcgcggcuucagcgccaccuacggcuacgcccgggcggagguggugggggcccuguccaacgccgucuuccucaccgcccugugcuucaccaucuucguggaggcggugcugcgccucgcccggccggagcgcaucgacgaccccgagcugguccugaucgugggcgugcucgggcugcuggucaacguggugggccuccugaucuuccaggacugcgccgccugguucgccugcugccugcgggggcgcagccggcgccuccagcagcggcagcagcuggcggagggcugcguccccggcgccuucgggggcccccagggggccgaggacccgcgccgggccgccgaccccacggcgcccggcuccgacagcgccgugacccugcgcggcaccuccguggagcggaagcgcgagaagggggccaccgucuucgccaacguggccggcgacagcuucaacacgcagaacgagcccgaggacaugaugaagaaggagaagaaguccgaggcgcucaacauccgcggggugcugcugcacgucaugggcgacgcccucgggagcgugguggucgugaucaccgccaucaucuucuacguccugccgcugaaguccgaggaccccugcaacuggcagugcuacaucgaccccagccucaccgugcugauggugaucaucauccuguccagcgccuucccccucaucaaggagaccgccgcgauccugcugcagauggucccgaagggcgugaacauggaggagcucaugagcaagcuguccgccgugcccggcaucagcuccguccacgaggugcacaucugggagcuggugagcgggaagaucaucgccacgcuccacaucaaguaccccaaggaccggggcuaccaggacgccuccaccaagauccgggagaucuuccaccacgcggggauccacaacgucaccauccaguucgagaacguggaccugaaggagccccuggagcagaaggaccuccugcugcucugcaacagcccgugcaucuccaagggcugcgccaagcagcugugcugcccgcccggggcccugccccuggcccacgugaacggcugcgccgagcacaacggcgggcccagccucgacaccuacggcuccgacgggcugagccgccgcgacgcgcgggaggucgccaucgaggugucccuggacagcugccucuccgaccacggccagagccugaacaagacgcaggaggaccagugcuacgugaaccgcacccacuucuga

SEQ ID NO: 36588 - RNA, 1524 nt, Artificial Sequence
  derived and/or modified sequence opt1 from SLC30A1__Homo_sapiens__NP_067017
augggcugcugggggcgcaaccggggccgccugcucugcaugcuggcccugaccuucauguucauggugcucgaggucguggugagccgggucaccuccagccuggccaugcuguccgacagcuuccacaugcucuccgacgugcuggcgcugguggucgcccucguggccgagcgcuucgcccggcgcacgcacgccacccagaagaacaccuucggguggauccgggcggaggugaugggcgcccuggucaacgccaucuuccugaccgggcucugcuucgccauccugcuggaggcgaucgagcgcuucaucgagccccacgagaugcagcagccgcucguggugcugggcgucggcguggccgggcugcucgugaacguccugggccugugccucuuccaccaccacagcggguucucccaggacagcggccacgggcacucccacggcggccacgggcacggccacgggcugcccaagggcccccgggucaagagcacgcgccccggcuccagcgacaucaacguggccccgggggagcagggccccgaccaggaggagaccaacacccugguggccaacaccuccaacagcaacgggcucaagcuggaccccgccgaccccgagaacccgcgguccggcgacacgguggaggugcaggucaacgggaaccuggugcgcgagcccgaccacauggagcucgaggaggaccgggcgggccagcugaacaugcgcggcguguuccugcacguccucggggacgcccugggcagcgugaucgucguggugaacgcccuggucuucuacuucuccuggaaggggugcagcgagggcgacuucugcgugaaccccugcuuccccgacccgugcaaggccuucguggagaucaucaacuccacccacgccagcgucuacgaggcggggcccugcugggugcucuaccuggaccccacccugugcguggucauggugugcauccuccuguacaccacguacccccugcucaaggagagcgcccugauccugcuccagaccgugccgaagcagaucgacauccggaaccugaucaaggagcugcgcaacgucgagggcguggaggaggugcacgagcuccacgucuggcagcuggccggcucccggaucaucgccaccgcccacaucaagugcgaggaccccaccagcuacauggagguggcgaagacgaucaaggacguguuccacaaccacgggauccacgccaccaccauccagcccgaguucgccuccgucggcagcaaguccagcguggugcccugcgagcuggccugccgcacccagugcgcccucaagcagugcugcgggacgcugccgcaggcgcccuccggcaaggacgccgagaagacccccgccgucagcaucuccugccuggagcugagcaacaaccucgagaagaagccccggcgcaccaaggccgagaacaucccggcgguggugaucgagaucaagaacaugcccaacaagcagcccgaguccagccuguga

SEQ ID NO: 36589 - RNA, 1167 nt, Artificial Sequence
  derived and/or modified sequence opt1 from SLC30A3__Homo_sapiens__NP_003450
auggagcccagcccggccgccggcgggcuggagaccacccgccucgugagcccccgggaccgcggcggggcgggcgggucccugcggcugaagucccucuucacggagcccagcgagccccugccggaggaguccaagcccgucgagaugcccuuccaccacugccaccgcgacccccugccgccgcccggccucacccccgagcggcugcacgcccgccggcagcuguacgccgccugcgccgugugcuucguguucauggcgggcgaggucgucgggggcuaccucgcccacagccuggccaucaugaccgacgccgcgcaccuccuggccgacgugggguccaugaugggcagccuguucucccuguggcucagcacccgccccgccacgcggaccaugaccuucggguggcaccgcuccgagacccugggcgcccuggccagcguggugucccucuggauggugacgggcauccugcuguaccucgcguucguccggcugcugcacagcgacuaccacaucgagggcggggccaugcuccugaccgccuccaucgccgugugcgccaaccugcucauggcguucgugcugcaccaggccgggccgccccacagccacggcucccgcggcgccgaguacgcgccccuggaggaggggcccgaggagccccucccccugggcaacaccagcguccgggccgccuucgugcacgugcugggggaccuccugcaguccuucggcguccuggccgccagcauccucaucuacuucaagccccaguacaaggccgccgacccgaucagcaccuuccuguucuccaucugcgcgcuggggagcacggcccccacccuccgcgacgugcugcggauccugauggagggcacgccccgcaacgugggcuucgagcccguccgggacacccuccuguccgugccgggggugcgcgccacccacgagcugcaccucugggcccugacccugaccuaccacgucgcgagcgcccaccucgccaucgacuccaccgccgaccccgaggccgugcuggcggaggccagcucccggcuguacagccgcuucggcuucuccagcugcacgcuccagguggagcaguaccagcccgagauggcccagugccugcggugccaggagcccccgcaggccuga

SEQ ID NO: 36590 - RNA, 1290 nt, Artificial Sequence
  derived and/or modified sequence opt1 from SLC30A4__Homo_sapiens__XP_011520299
auggccggcagcggggccuggaagcgccugaaguccaugcuccggaaggacgacgcgccccuguuccugaacgacaccagcgccuucgacuucuccgacgaggccggcgacgaggggcucagccgcuucaacaagcugcggguggucguggccgacgacggcuccgaggccccggagcgccccgugaacggggcgcaccccacccugcaggccgacgacgacagccuccuggaccaggaccugccccucacgaacucccagcugagccugaaggucgacuccugcgacaacugcagcaagcagcgggagauccucaagcagcgcaaggugaaggcccggcugaccaucgccgcggugcuguaccuccuguucaugaucggcgagcuggucggcggguacaucgccaacucccucgccaucaugaccgacgcccugcacaugcugaccgaccucagcgccaucauccugacgcugcucgcgcuguggcuguccagcaaguccccgaccaagcgcuucaccuucggcuuccaccggcucgaggugcugagcgccaugaucuccgugcugcucgucuacauccugaugggguuccugcucuacgaggccgugcagcgcaccauccacaugaacuacgagaucaacggcgacaucaugcugaucacggccgccgugggggucgcggugaacgugaucaugggcuuccugcucaaccagagcggccaccggcacucccacagccacagccugcccuccaacagccccacccgcggguccggcugcgagcggaaccacgggcaggacagccuggccguccgcgccgccuucgugcacgcccucggcgaccuggugcaguccgucggcgugcugaucgcggccuacaucauccgguucaagcccgaguacaagaucgccgacccgaucugcaccuacguguucagccuccuggucgccuucaccacguuccgcaucaucugggacaccguggugaucauccuggaggggguccccucccaccucaacguggacuacaucaaggaggcccugaugaagaucgaggacgucuacagcguggaggaccugaacaucuggucccucaccagcggcaaguccaccgcgaucgugcacauccagcugauccccgggagcuccagcaagugggaggagguccaguccaaggccaaccaccuccugcugaacacguucggcauguaccggugcaccauccagcugcagagcuaccgccaggagguggaccggaccugcgccaacugccaguccagcucccccuga

SEQ ID NO: 36591 - RNA, 2298 nt, Artificial Sequence
  derived and/or modified sequence opt1 from SLC30A5__Homo_sapiens__NP_075053
auggaggagaaguacggcggggacgugcuggccggccccgggggcgggggcggccucgggccggucgacgugcccagcgcccgccugaccaaguacaucgugcugcucugcuucaccaaguuccugaaggcggucggccuguucgaguccuacgaccuccugaaggccgugcacaucgugcaguucaucuucauccugaagcucgggacggccuucuucaugguccuguuccagaagcccuucagcuccggcaagaccaucaccaagcaccaguggaucaagaucuucaagcacgccguggccgggugcaucaucagccugcucugguucuucggccugacccugugcggcccccuccggacgcugcuccucuucgagcacuccgacaucguggucaucagccugcuguccgugcuguucaccagcuccgggggcgggccggcgaagacccgcggcgccgccuucuucaucaucgccgugaucugccugcuccucuucgacaacgacgaccugauggcgaagauggccgagcaccccgagggccaccacgacagcgcccugacccacaugcucuacacggccaucgccuuccugggggucgcggaccacaagggcggggugcugcuccuggugcuggcccucugcugcaaggucggcuuccacaccgccucccggaagcugagcguggacgucgggggcgccaagcgccugcaggcccucucccaccuggugagcgugcugcuccugugccccugggugaucguccuguccgugaccaccgagagcaagguggaguccugguucagccucaucaugcccuucgcgacggucaucuucuucgugaugauccuggacuucuacgucgacuccaucugcagcgugaagauggaggugagcaagugcgcccgguacggcuccuucccgaucuucaucagcgcccuccucuucgggaacuucuggacccaccccaucaccgaccagcugcgcgccaugaacaaggccgcgcaccaggaguccaccgagcacguccugagcggcggggugguggucuccgccaucuucuucauccucagcgccaacauccuguccagccccuccaagcggggccagaaggggacgcugaucggcuacagccccgagggcaccccgcuguacaacuucaugggggacgccuuccagcacuccagccaguccaucccccgcuucaucaaggagagccucaagcagauccuggaggaguccgacagccggcagaucuucuacuuccugugccucaaccugcuguucaccuucguggagcuguucuacggcgugcugaccaacucccuggggcucaucagcgacggcuuccacaugcuguucgacugcuccgcccuggucauggggcuguucgcggcccugaugagccgcuggaaggccacgcggaucuucagcuacggcuacggccgcaucgagauccuguccggguucaucaacggccucuuccugaucgugaucgccuucuucguguucauggagagcgucgcgcggcugaucgacccgcccgagcucgacacccacaugcugacccccguguccgucgggggccugaucgugaaccucaucggcaucugcgccuucagccacgcccacucccacgcccacggggccagccagggcuccugccacagcuccgaccacagccacucccaccacaugcacgggcacagcgaccacggccacgggcacucccacggcagcgcgggcgggggcaugaacgccaacaugcgcgggguguuccugcacgugcuggccgacacccucggcuccaucggggucaucgugagcacggugcugaucgagcaguucggcugguucaucgccgacccccugugcucccucuucaucgccauccugaucuuccugagcgucgugccccucaucaaggacgcgugccaggugcugcugcuccggcugcccccggaguacgagaaggagcugcacaucgcccucgagaagauccagaagaucgagggccugaucagcuaccgcgacccccacuucuggcggcacuccgccagcaucgucgccgggaccauccacauccaggugaccuccgacgugcuggagcagcgcaucguccagcaggucaccggcauccucaaggacgccggggugaacaaccugacgauccagguggagaaggaggcguacuuccagcacaugagcggccuguccaccggguuccacgacgugcucgccaugaccaagcagauggagagcaugaaguacugcaaggacggcaccuacaucauguga

SEQ ID NO: 36592 - RNA, 1506 nt, Artificial Sequence
  derived and/or modified sequence opt1 from SLC30A6__Homo_sapiens__NP_001180442
augggcaccauccaccuguuccgcaagccccagcggagcuucuucgggaagcuccugcgcgaguuccggcugguggccgccgaccgccgguccuggaagauccuccuguucggcgucaucaaccugaucugcaccggguuccuccugauguggugcagcuccacgaacagcaucgcgcugaccgccuacaccuaccucaccaucuucgaccuguuccgcgacggcguguccccguucuggcugggguggagccagacgcccgaccucaagugguccacccaccugggccugcccaagugcugggacaaccggcgcgagcuccccugccugagcaacucccugaugaccugccucaucagcuacugggugacccugcggaagccgucccccgucuacagcuucggcuucgagcgccuggaggugcucgccguguucgccuccacgguccuggcccagcugggggcccucuucauccugaaggagagcgcggagcgguuccuggagcagcccgagauccacaccggccgccuccugguggggaccuucguggcccugugcuucaaccucuucaccaugcuguccauccggaacaagcccuucgccuacgucagcgaggcggccuccacgagcuggcugcaggagcacguggccgaccucucccgcagccugugcggcaucaucccggggcugagcuccaucuuccucccccggaugaaccccuucgugcugaucgaccuggccggcgccuucgcgcucugcaucaccuacaugcugaucgagaucaacaacuacuucgccgucgacaccgccagcgccaucgccaucgcgcugaugaccuucggcacgauguaccccauguccguguacagcgggaaggugcuccugcagaccaccccgccccacgucaucggccagcuggacaagcucauccgcgagguguccacccuggacggggugcuggagguccggaacgagcacuucuggacgcucggcuucggcagccuggccggguccgugcacgugcgcauccggcgcgacgccaacgagcagaugguccuggcccacgugaccaaccggcuguacacccucgugagcacccugacgguccagaucuucaaggacgacuggauccgccccgcccugcucuccggccccguggcggccaacguccugaacuucagcgaccaccacgugaucccgaugccccugcucaaggggaccgacgaccugaaccccgugaccuccacccccgccaagccgagcuccccgccgcccgaguucagcuucaacacgcccggcaagaacgucaaccccgugauccugcucaacacccagacccgccccuacggguucggccugaaccacggccacacccccuacuccagcaugcugaaccaggggcucggcgugcccgggaucggcgccacgcaggggcugcggaccggcuucaccaacauccccucccgcuacggcaccaacaaccggaucgggcagccccgcccguga

SEQ ID NO: 36593 - RNA, 921 nt, Artificial Sequence
  derived and/or modified sequence opt1 from SLC30A7__Homo_sapiens__XP_011539081
auguucuucgacagcaccgccauccuggccggccucgcggccuccgugaucagcaaguggcgcgacaacgacgccuucuccuacggguacguccgggccgaggugcuggccggcuucgugaacgggcuguuccucaucuucaccgcguucuucaucuucagcgagggcgucgagcgcgcccuggcgcccccggacgugcaccacgagcggcugcuccugguguccauccugggguucgucgugaaccucaucggcaucuucguguucaagcacggcgggcacggccacagccacggguccggccacgggcacagccacucccuguucaacggcgcccuggaccaggcccacggccacgucgaccacugccacagccacgaggugaagcacggggccgcccacucccacgaccacgcccacggccacgggcacuuccacagccacgacggccccucccucaaggagacgaccggccccagccgccagauccugcaggggguguuccugcacauccucgccgacacccugggcuccaucggggucaucgcgagcgccaucaugaugcagaacuucggccugaugaucgccgaccccaucugcuccauccucaucgccauccugaucguggugagcgucaucccgcugcuccgggaguccguggggauccugaugcagcgcaccccgccccugcucgagaacagccugccccagugcuaccagcgggugcagcagcugcagggcgucuacagccuccaggagcagcacuucuggacgcugugcuccgacguguacgugggcacccugaagcucaucgucgcccccgacgcggacgcccgcuggauccugagccagacccacaacaucuucacccaggccggggugcggcagcuguacgugcagaucgacuucgccgccauguga

SEQ ID NO: 36594 - RNA, 963 nt, Artificial Sequence
  derived and/or modified sequence opt1 from SLC30A8__Homo_sapiens__NP_001166286
auguaccacugccacagcggcuccaagcccaccgagaagggggccaacgaguacgccuacgcgaaguggaagcugugcagcgccuccgccaucugcuucaucuucaugaucgccgagguggucggcgggcacaucgccggcagccucgcgguggugaccgacgccgcccaccuccugaucgaccugacguccuuccugcugagccucuucucccuguggcugagcuccaagccgcccagcaagcgccucaccuucggguggcaccgggccgagauccugggcgcgcugcucuccauccugugcaucugggucgugaccggcgugcuggucuaccucgccugcgagcgccugcuguaccccgacuaccagauccaggccaccgugaugaucaucgugagcuccugcgccgucgccgcgaacaucgugcucacggugguccugcaccagcggugccuggggcacaaccacaaggaggugcaggccaacgccagcgugcgcgccgccuucguccacgcgcucggcgaccuguuccaguccaucagcgugcugaucuccgcccucaucaucuacuucaagcccgaguacaagaucgccgacccgaucugcaccuucaucuucagcauccuggugcuggccuccaccaucaccauccucaaggacuucagcauccugcugauggaggggguccccaagagccucaacuacuccggcgugaaggagcugauccuggccguggacgggguccucagcgugcacucccugcacaucuggagccugacgaugaaccaggugauccucuccgcgcacgucgccaccgccgccagccgggacucccaggugguccgccgggagaucgccaaggcgcugagcaaguccuucaccaugcacagccugaccauccagauggagucccccguggaccaggaccccgacugccucuucugcgaggacccgugcgacuga

SEQ ID NO: 36595 - RNA, 1707 nt, Artificial Sequence
  derived and/or modified sequence opt1 from SLC30A9__Homo_sapiens__NP_006336
augcugcccggccucgccgccgcggccgcccaccgcugcagcugguccagccugugccggcugcgccuccggugccgcgccgccgcgugcaacccguccgaccggcaggaguggcagaaccuggugaccuucgggagcuucuccaacaugguccccugcagccaccccuacaucggcacccugucccaggugaagcucuacagcacgaacgugcagaaggaggggcagggcucccagacccugcgcgucgagaaggugcccagcuucgagaccgccgaggggaucggcaccgagcugaaggccccgcucaagcaggagccccugcagguccgggugaaggccgugcugaagaagcgcgaguacggcuccaaguacacgcagaacaacuucaucaccggggugcgggcgaucaacgaguucugccucaagagcuccgaccuggagcagcugcgcaagauccggcgccggagcccccacgaggacaccgaguccuucaccgucuaccuccgcagcgacguggaggccaagucccuggagguguggggcagccccgaggcccuggcccgggagaagaagcuccgcaaggaggccgagaucgaguaccgggagcgccuguuccggaaccagaagauccugcgcgaguaccgggacuuccucgggaacacgaagccgcgcucccgcaccgcgagcgucuucuucaagggccccgggaagguggugauggucgccaucugcaucaacggccugaacugcuucuucaaguuccuggccuggaucuacaccggcagcgccuccauguucagcgaggccauccacucccucagcgacacgugcaaccaggggcugcuggcgcucggcaucuccaagagcgugcagacccccgaccccucccacccguacggguucagcaacaugcgguacaucuccagccugaucuccggcgugggcaucuucaugaugggggccggccugagcugguaccacggggucaugggccuccugcacccccagcccaucgagucccugcucugggccuacugcauccuggccgggagccugguguccgagggcgccacccuccugguggcggucaacgagcugcgccggaacgcccgcgccaagggcaugagcuucuacaaguacgugauggagucccgggaccccagcaccaacgugauccuccuggaggacaccgccgccguccugggggugaucaucgcggccacgugcaugggccucaccuccaucaccgggaacccgcuguacgacagccugggcagccucggggucggcacccugcugggcaugguguccgccuuccucaucuacacgaacaccgaggcccugcuggggcgcagcauccagcccgagcagguccagcggcugaccgagcuccuggagaacgaccccuccgugcgcgcgauccacgacgugaaggccaccgaccugggccucgggaaggugcgguucaaggccgaggucgacuucgacggccgcguggugacgcggagcuaccuggagaagcaggacuucgaccagaugcugcaggagauccaggaggucaagacccccgaggagcucgagaccuucaugcugaagcacggggagaacaucaucgacacccugggcgccgagguggaccgccucgagaaggagcugaagaagcggaacccggaggugcgccacgucgaccuggagauccucuga

SEQ ID NO: 36596 - RNA, 573 nt, Artificial Sequence
  derived and/or modified sequence opt1 from SLC31A1__Homo_sapiens__NP_001850
auggaccacagccaccacaugggcauguccuacauggacagcaacuccaccaugcagcccagccaccaccacccgaccacguccgccagccacucccacgggggcggggacagcuccaugaugaugaugcccaugaccuucuacuucggcuucaagaacguggagcuccuguucagcgggcuggucaucaacaccgccggcgagauggcgggcgccuucguggccguguuccugcucgccauguucuacgaggggcugaagaucgcccgcgagucccugcuccgcaagagccaggucuccauccgguacaacagcaugcccgugcccggcccgaacgggaccauccugauggagacgcacaagaccgugggccagcagaugcuguccuucccccaccuccugcagaccguccugcacaucauccagguggugaucagcuacuuccucaugcugaucuucaugaccuacaacggguaccugugcaucgcggucgccgccggcgccggcacgggguacuuccucuucuccuggaagaaggcggugguggucgacaucaccgagcacugccacuga

SEQ ID NO: 36597 - RNA, 432 nt, Artificial Sequence
  derived and/or modified sequence opt1 from SLC31A2__Homo_sapiens__NP_001851
auggccaugcacuucaucuucagcgacaccgccgugcuccuguucgacuucugguccguccacagccccgcgggcauggcccuguccgugcuggugcuccugcugcucgccguccuguacgaggggaucaaggugggcaaggccaagcugcucaaccaggugcuggucaaccugccgaccagcaucucccagcagacgaucgccgagaccgacggggacagcgcgggcuccgacagcuuccccguggggcgcacccaccaccggugguaccucugccacuucggccagucccugauccacgugauccaggucgugaucggcuacuucaucaugcuggccgugaugagcuacaacaccuggaucuuccucggggucgugcugggcuccgccgugggguacuaccuggccuacccccuccugagcacggcguga

SEQ ID NO: 36598 - RNA, 1578 nt, Artificial Sequence
  derived and/or modified sequence opt1 from SLC32A1__Homo_sapiens__NP_542119
auggccacccugcuccgcagcaagcuguccaacguggccaccagcgucuccaacaagagccaggcgaagauguccggcauguucgcccggaugggguuccaggccgccacggacgaggaggccgugggcuucgcgcacugcgacgaccuggacuucgagcaccgccaggggcuccagauggacauccugaaggccgagggcgagcccugcggggacgagggcgccgaggccccgguggagggcgacauccacuaccagcgggggagcggcgcgccccugccgcccuccgggagcaaggaccaggucggcgggggcggcgaguucgggggccacgacaagcccaagaucaccgccugggaggccggguggaacgugaccaacgccauccagggcauguucgugcucggccugcccuacgccauccugcacgggggcuaccucgggcuguuccugaucaucuucgcggccgucgugugcugcuacaccggcaagauccucaucgccugccuguacgaggagaacgaggacggggaggugguccgcgugcgggacuccuacguggccaucgccaacgcgugcugcgcgccccgcuuccccacgcugggcggccgggucgugaacguggcccagaucaucgagcucgucaugaccugcauccuguacgugguggucagcgggaaccugauguacaacuccuucccgggccuccccgugagccagaaguccuggagcaucaucgccaccgccgugcugcugcccugcgccuuccucaagaaccugaaggccgucuccaaguucagccugcucugcacccuggcccacuucgugaucaacauccuggugaucgccuacugccucucccgcgcccgggacugggcgugggagaaggucaaguucuacaucgacgugaagaaguuccccaucagcaucgggaucaucgucuucuccuacacgagccagaucuuccugccgagccuggagggcaacaugcagcagcccuccgaguuccacugcaugaugaacuggacccacaucgccgccugcgugcucaaggggcuguucgcccugguggcguaccucaccugggccgacgagaccaaggaggucaucacggacaaccugcccggcagcauccgcgccguggugaacaucuuccuggucgccaaggcccuccuguccuacccccugccguucuucgcggccguggaggugcucgagaagucccuguuccaggagggcagccgggccuucuuccccgccugcuacagcggggacggccgccugaaguccugggggcucacccugcggugcgcccuggucguguucacccuccugauggcgaucuacgugccccacuucgcccugcucaugggccugaccgggagccugacgggcgccggccugugcuuccuccugcccucccuguuccaccuccgccugcuguggcggaagcuccuguggcaccaggucuucuucgacguggccaucuucgugaucgggggcaucugcagcgucuccggguucgugcacagccuggagggccucaucgaggccuaccgcaccaacgcggaggacuga

SEQ ID NO: 36599 - RNA, 1650 nt, Artificial Sequence
  derived and/or modified sequence opt1 from SLC33A1__Homo_sapiens__NP_001177921
augagccccaccaucucccacaaggacagcucccgccagcggcgcccgggcaacuucagccacucccuggacaugaaguccgggccccucccgcccggcgggugggacgacagccaccuggacagcgccggccgggagggggaccgcgaggcccugcucggcgacaccggcacgggggacuuccugaaggcgccccaguccuuccgggccgagcugagcuccauccuccugcuccuguuccuguacgugcugcagggcaucccccucgggcuggccggcagcaucccccugauccuccaguccaagaacgucagcuacaccgaccaggccuucuucuccuucguguucuggcccuucagccugaagcugcucugggccccgcugguggacgcggucuacgugaagaacuucgggcgccggaaguccuggcuggugcccacccaguacauccucggccuguucaugaucuaccugagcacccaggucgaccgccuccugggcaacacggacgaccggacccccgacgugaucgcccugaccguggccuucuuccucuucgaguuccuggccgcgacccaggacaucgccgucgacgggugggcccugacgaugcucucccgcgagaacgugggcuacgccagcacgugcaacagcguggggcagaccgccggcuacuuccugggcaacguccuguuccucgcgcuggaguccgccgacuucugcaacaaguaccugcgguuccagccccagccgcgcgggaucgugacccucagcgacuuccuguucuucuggggcaccguguuccugaucaccaccacccucgucgcccugcugaagaaggagaacgagguguccguggucaaggaggagacgcaggggaucaccgacaccuacaagcuccuguucgccaucaucaagaugcccgccgugcugaccuucugccuccugauccugacggcgaagaucggcuucagcgccgccgacgccgugaccgggcucaagcuggucgaggagggcgugcccaaggagcaccuggcccugcucgcggugcccauggucccgcugcagaucauccugccccucaucaucuccaaguacaccgccggcccccagccccugaacaccuucuacaaggccaugccguaccggcugcuccuggggcuggaguacgcccuccuggugugguggacgcccaaggucgagcaccagggcggguuccccaucuacuacuacaucguggugcugcucagcuacgcccugcaccaggucaccguguacuccauguacgugagcaucauggcguucaacgccaaggucuccgacccccugaucggcgggaccuacaugacccuccugaacacggugagcaaccugggcggcaacuggccguccaccguggcccucuggcuggucgacccccugaccgugaaggagugcgugggggccagcaaccagaacugccgcacccccgacgcggucgagcucugcaagaagcugggcggguccugcgugacggcccuggacggcuacuacguggagagcaucaucugcgucuucaucggguucggcuggugguucuuccucggccccaaguucaagaagcugcaggacgagggguccagcuccuggaagugcaagcggaacaacuga

SEQ ID NO: 36600 - RNA, 1023 nt, Artificial Sequence
  derived and/or modified sequence opt1 from SLC34A1__Homo_sapiens__NP_001161051
augcugagcuacggcgagcgccucgggucccccgccgugagcccgcugcccguccggggcgggcacgugaugcgcggcaccgccuucgcguacgugcccagcccccagguccugcaccggaucccggggaccuccgccuacgccuuccccucccucggccccguggcccuggccgagcacacgugccccugcggcgaggugcuggagcgccacgagccgcuccccgcgaagcuggcccuggaggaggagcagaagcccgagagccggcucguccccaagcugcgccaggccggggccaugcugcucaaggugccgcugaugcugaccuuccucuaccuguucgugugcucccuggacaugcucagcuccgcguuccagcuggccggcgggaaggucgccggcgacaucuucaaggacaacgccauccugagcaaccccguggccgggcucguggucggcauccuggugaccgugcugguccaguccagcuccaccagcacguccaucaucgugagcaugguguccagcggccuccuggaggucuccagcgcgauccccaucaucauggggagcaacaucggcaccuccgugaccaacaccaucguggcccugaugcaggccggggaccggacggacuuccgccgggccuucgccggcgcgaccguccacgacugcuucaacuggcucagcgugcuggugcugcucccccuggaggccgccaccggcuaccugcaccacaucacccgccucgucguggccuccuucaacauccacgggggccgggacgccccggaccugcugaagaucaucacggagcccuucaccaagcucaucauccagcuggacgagagcgucaucaccuccaucgcgaccggggacgagagccugcgcaaccacucccucauccagaucuggugccaccccgacagccugcagcagaaccuggagggccgggagaucacgcacuucgaccuccgcaagaagcaggccauggaggacuccagcgugccccacugcccguga

SEQ ID NO: 36601 - RNA, 2070 nt, Artificial Sequence
  derived and/or modified sequence opt1 from SLC34A2__Homo_sapiens__NP_001171470
auggcccccuggccggagcugggcgacgcccagcccaaccccgacaaguaccucgagggggcggccggccagcagcccaccgccccggacaagagcaaggagaccaacaagaacaacacggaggcccccgugaccaagaucgagcugcugcccuccuacagcaccgccacccucaucgacgagcccacggaggucgacgacccguggaaccugcccacccugcaggacuccgggaucaaguggagcgagcgcgacaccaagggcaagauccucugcuucuuccaggggaucggccggcugauccugcuccugggcuuccuguacuucuucgugugcucccucgacauccugagcuccgcguuccagcuggucgggggcaagauggccgggcaguucuucagcaacuccagcaucauguccaacccccuccugggccuggugaucggggugcucgugaccguccuggugcagagcuccagcacguccaccagcaucguggucuccauggugagcuccagccugcucaccgugcgcgccgccauccccaucaucaugggcgcgaacaucggcaccagcaucacgaacaccaucgucgcccugaugcaggucggggaccgguccgaguuccgccgggccuucgccggcgccaccgugcacgacuucuucaacuggcugagcgugcucgugcugcugccgguggaggucgcgacccacuaccucgagaucaucacgcagcugaucguggaguccuuccacuucaagaacggggaggacgcccccgaccugcucaaggugaucaccaagcccuucaccaagcugaucguccagcuggacaagaaggugaucagccagaucgccaugaacgacgagaaggccaagaacaagucccucgugaagaucuggugcaagaccuucacgaacaagacccagaucaacgucaccgugcccagcaccgccaacugcacguccccgagccugugcuggaccgacggcauccagaacuggaccaugaagaacgucaccuacaaggagaacaucgcgaagugccagcacaucuucgugaacuuccaccuccccgaccuggccgugggcacgauccugcugauccucucccugcugguccucugcgggugccugaucaugaucgugaagauccugggcagcgugcucaaggggcaggucgccaccgugaucaagaagaccaucaacaccgacuuccccuuccccuucgccuggcugacgggcuaccuggccauccucgugggggcgggcaugaccuucaucguccaguccagcuccguguucaccagcgcccugaccccgcugaucggcaucggggugaucacgaucgagcgcgccuacccccugacccucggcuccaacaucgggaccaccaccacggccauccuggccgcgcuggccagccccggcaacgcccuccgguccagccugcagaucgcccugugccacuucuucuucaacaucuccgggauccuccugugguaccccaucccguucacccgccugcccauccggauggcgaagggccucggcaacaucagcgccaaguaccgcugguucgccgucuucuaccugaucaucuucuucuuccugaucccccucaccguguucgggcugagccuggccggcuggcgggugcucgucggggugggcgugcccgucguguucaucaucauccuggugcugugccuccgccugcugcagucccggugcccgcgcguccuccccaagaagcugcagaacuggaacuuccugccccucuggaugcggagccugaagccgugggacgccgugguguccaaguucaccgggugcuuccagaugcgcugcugcugcugcugccgggucugcugccgcgcgugcugccugcucugcggcugccccaagugcugccggugcagcaagugcugcgaggaccuggaggaggcccaggagggccaggacgugcccgugaaggcccccgagacguucgacaacaucaccaucucccgcgaggcccagggggaggucccggccagcgacuccaagaccgagugcaccgcgcuguga

SEQ ID NO: 36602 - RNA, 1800 nt, Artificial Sequence
  derived and/or modified sequence opt1 from SLC34A3__Homo_sapiens__NP_001170788
augcccagcucccugcccggcagccaggugccccaccccacccucgacgccgucgaccugguggagaagacccugcgcaacgaggggacguccagcuccgcccccgugcucgaggagggcgacaccgacccguggacccugccccagcugaaggacaccagccagcccuggaaggagcuccgggucgcggggcgccugcggcgcguggccggcuccgugcugaaggccugcgggcuccugggcagccuguacuucuucaucugcucccucgacguccugagcuccgccuuccagcugcucggcagcaagguggccggggacaucuucaaggacaacgugguccuguccaaccccguggcgggccuggugaucgggguccucgugacggcccuggugcagagcuccagcaccuccagcuccaucgucgugagcaugguggccgccaagcugcucaccguccgggugagcgugccgaucaucaugggcgucaacguggggaccuccaucacgagcacccugguguccauggcgcagagcggcgaccgcgacgaguuccagcgggccuucuccggcagcgccguccacgggaucuucaacuggcugaccgugcucguccugcugccccucgaguccgccaccgcccugcuggagcgccucagcgagcuggcgcugggcgccgccucccucacgccccgggcccaggcccccgacauccugaaggugcugaccaagccgcucacccaccugaucgugcagcuggacagcgacaugaucauguccagcgcgaccgggaacgccacgaacuccagccucaucaagcacuggugcggcaccaccggccagcccacccaggagaacuccagcugcggggccuucggccccugcacggagaagaacuccaccgcccccgccgaccgccugccgugccggcaccuguucgcggggaccgagcucaccgaccuggccgucggcugcauccugcucgccgggagccugcuggugcucugcggcugccuggugcugaucgucaagcugcucaacuccgugcugcgcggccggguggcccaggucgugcgcacggugaucaacgccgacuuccccuucccccugggguggcucggcggguaccuggcgguccuggccggcgccgggcucaccuucgcccugcagagcagcuccguguucaccgcggccguggucccccugaugggcgugggcgugaucagccucgaccgggccuacccgcugcugcucggguccaacaucggcaccacgaccaccgcccugcuggccgcgcucgccagccccgccgaccgcaugcuguccgcccugcaggucgcccucauccacuucuucuucaaccuggcggggauccugcucugguaccuggugcccgcccugcggcuccccaucccgcuggcccgccacuucggcguggucaccgcccgguaccgcuggguggccgggguguaccugcuccugggcuuccugcuccugccccuggcggccuucggccucagccuggccgggggcaugguccuggccgcggucgggggcccccucgugggccuggugcugcucgugauccuggugacgguccugcagcggcgccgccccgccuggcucccggugcggcugcgcuccugggccuggcugcccguguggcuccacagccuggagcccugggaccggcuggucacccgcugcugcccgugcaacgugugcuccccgcccaaggccaccaccaaggaggccuacugcuacgagaaccccgagauccucgcgagccagcagcuguga

SEQ ID NO: 36603 - RNA, 837 nt, Artificial Sequence
  derived and/or modified sequence opt1 from SLC35A1__Homo_sapiens__NP_001161870
auggccgcgccccgcgacaacgugacccuccuguucaagcuguacugccuggccgucaugacccucauggccgccguguacacgaucgcccugcgguacacccgcaccagcgacaaggagcuguacuucuccaccacggccgugugcaucaccgaggucaucaagcuccugcugagcgugggcauccucgcgaaggagaccgggucccugggccgguucaaggccagccugcgcgagaacgugcucggguccccgaaggagcugcugaagcucagcguccccucccugguguacgccgugcagaacaacauggccuuccuggcgcucagcaaccuggacgccgccgucuaccaggugaccuaccagcugaagauccccugcacggcccucugcaccgugcugaugcugaaccggacccucuccaagcugcagugggucagcguguucaugcugugcgccggcgugacccucguccaguggaagcccgcgcaggccacgaaggugguggucgagcagaacccgcugcugggguucggcgccaucgccaucgccgugcucugcuccggcuucgcggugcuggccagcgucgggggccuguacaccuccgugguggucaaguacaccgacaacaucaugaagggguucagcgccgccgccgcgaucgugcucuccaccaucgccagcgucaugcuguucggccugcagaucacgcucaccuucgcccuggggacccugcucgugugcguguccaucuaccuguacggccugccccgccaggacaccacgagcauccagcagggcgagaccgccuccaaggagcgggucaucgggguguga

SEQ ID NO: 36604 - RNA, 729 nt, Artificial Sequence
  derived and/or modified sequence opt1 from SLC35A2__Homo_sapiens__NP_001027460
auggccgccgugggcgccgggggcagcaccgcggcccccgggccgggcgccgucuccgccggggcgcuggagcccggcaccgccagcgccgcccaccgccggcugaaguacaucucccuggcggugcuggugguccagaacgccagccucauccuguccauccgcuacgcccggacgcugcccggcgaccgcuucuucgccaccaccgccguggugauggcggagguccucaaggggcugaccugccugcuccugcuguucgcccagaagcggggcaacgugaagcaccucgugcuguuccugcacgaggccguccucgugcaguacguggacacgcugaagcuggccguccccagccucaucuacacccugcagaacaaccugcaguacguggccaucuccaaccucccggcggccaccuuccagcccagcccccgcugcucccagagccacucccugugccugugccuccggcugcgcgcccugcggagccccgccgccucccgcgcggccaccacgaccgccgccguguucccgcccuggcggccccaccacggggcccucagcgcgaaggucuccgccggcgaggugcgcgccgggagcaacggcggcacccaggggcggggcaccgggguggagggcgucggccaccuccaggaccccucccgccacccgcccgggcccggcagcuccggguucggccgguggagcuuccugcccgggcacuga

SEQ ID NO: 36605 - RNA, 936 nt, Artificial Sequence
  derived and/or modified sequence opt1 from SLC35A3__Homo_sapiens__XP_011539439
augagcucccgcagcgugcugucccccgucgugggcaccgacgccccggaccagcaccucgagcugaagaagccccaggagcugaaggagauggagcggcucccccuggccaacgaggacaagaccauguucgcgaaccugaaguacgugagccucgggauccuggucuuccagacgaccucccuggugcucaccaugcgcuacagccggacccugaaggaggagggcccccgcuaccuguccagcacggccguggucguggccgagcuccugaagaucauggccugcauccugcucguguacaaggacuccaagugcagccugcgggcccugaaccgcguccuccacgacgagauccugaacaagccgauggagacccugaagcucgcgauccccuccgggaucuacacccugcagaacaaccugcucuacguggcccugagcaaccuggacgccgccaccuaccaggugacguaccagcucaagauccugaccaccgcgcuguucuccgucagcaugcucuccaagaagcugggcguguaccaguggcugagccucgugauccugaugaccggggucgccuucgugcaguggcccuccgacagccagcuggacuccaaggagcucagcgccggcagccaguucgugggccugauggccguccugacggccugcuucuccagcggguucgcgggcguguacuucgagaagauccucaaggagaccaagcaguccguguggauccggaacauccagcugggguucuucggcagcaucuucgggcugaugggcgucuacaucuacgacggcgagcucguguccaagaacggguucuuccagggcuacaaccgccugaccuggaucguggucgugcugcagugccucuuccccuggagccacccgugcaacaacuccuacuucuucgucuggcuguga

SEQ ID NO: 36606 - RNA, 975 nt, Artificial Sequence
  derived and/or modified sequence opt1 from SLC35A4__Homo_sapiens__NP_542401
augagcguggaggacggcgggaugcccggccuggggcgcccgcggcaggcccgcuggacccucaugcugcugcucuccaccgccauguacggcgcgcacgcgccccugcuggcccucugccacgucgacgggcgggugcccuuccgccccagcuccgccgugcugcugacggagcucaccaagcugcugcucugcgccuucagccugcuggucggcuggcaggccuggccgcaggggcccccgcccuggcggcaggccgcccccuucgcccucuccgcgcugcuguacggcgccaacaacaaccucgugaucuaccugcagcgcuacauggaccccagcaccuaccaggugcuguccaaccucaagaucggcagcaccgccguccuguacugccugugccuccggcaccgccuguccgugcggcaggggcuggcccuccugcugcucauggccgcgggcgccugcuacgccgccgggggccuccaggugcccggcaacacgcugcccagcccgccgcccgccgcggccgccucccccaugccccugcacaucacgccccuggggcugcuccugcugauccucuacugccugaucagcggccuguccagcgucuacaccgagcuccugaugaagcgccagcggcugccccucgcccugcagaaccuguuccucuacaccuucggggugcugcugaaccugggccuccacgccggcgggggcuccgggcccggccugcuggagggguucagcggcugggcggcccucgugguccugucccaggcccugaacggccuccugaugagcgccgugaugaagcacggguccagcaucacccgccuguucguggucagcugcucccucguggugaacgccguccugagcgcggugcugcuccggcugcagcugaccgccgccuucuuccucgccacccugcugaucggccucgcgaugcgccuguacuacgggucccgguga

SEQ ID NO: 36607 - RNA, 1020 nt, Artificial Sequence
  derived and/or modified sequence opt1 from SLC35B2__Homo_sapiens__NP_001273442
augcugcucgccaugcccgcccugugguaccuggcgaccagcuggugcuccaccagcggcgggcgcacgaccuggcggccgguguccuaccucaccuggggcguccugcaggagcgcgugaugacccggagcuacggggccacggccaccucccccggcgagcgcuucaccgacagccaguuccuggugcucaugaaccggguccuggcccugaucguggccgggcucuccugcgugcugugcaagcagccccgccacggcgcgcccauguaccgguacagcuucgccucccugagcaacguccucuccagcuggugccaguacgaggcccugaaguucguguccuucccgacccaggugcuggccaaggcgagcaaggucauccccgugaugcucaugggcaagcuggugucccgccggagcuacgagcacugggaguaccugacggccacccucaucuccaucggggucagcauguuccugcuguccagcggccccgagccccgcagcuccccggccaccacccucagcgggcugauccugcucgccggcuacaucgccuucgacuccuucacgagcaacuggcaggacgcgcuguucgccuacaagauguccagcgugcagaugauguucggggugaacuucuucuccugccuguucaccgucggcagccuccuggagcagggcgcccugcucgaggggacccgguucaugggccgccacuccgaguucgccgcccacgcgcugcugcucagcaucugcuccgccugcgggcagcuguucaucuucuacaccaucggccaguucggcgccgccguguucacgaucaucaugacccugcggcaggccuucgcgauccuccugagcugccugcucuacgggcacaccgugaccgucgugggcgggcugggcguggccgucguguucgccgcccugcuccugcgcguguacgcccgggggcgccugaagcagcggggcaagaaggcgguccccguggagucccccguccagaagguguga

SEQ ID NO: 36608 - RNA, 996 nt, Artificial Sequence
  derived and/or modified sequence opt1 from SLC35B4__Homo_sapiens__NP_116215
augcgccccgcccuggccgugggccucgucuucgcggggugcugcagcaacgugaucuuccuggagcugcucgcccggaagcacccgggcugcgggaacaucgugaccuucgcccaguuccuguucaucgccgucgagggcuuccuguucgaggccgaccucgggcgcaagccgcccgcgauccccauccgguacuacgccaucauggugaccauguucuucacgguguccgucgugaacaacuacgcccugaaccugaacaucgccaugccccuccacaugaucuuccgcagcggcucccugaucgcgaacaugauccugggcaucaucauccucaagaagcgguacagcaucuucaaguacaccuccaucgcccuggugagcgucgggaucuucaucugcaccuucauguccgccaagcaggucaccagccaguccagccuguccgagaacgacggcuuccaggccuucgugugguggcuccuggggaucggcgcccugacguucgcgcuccugaugagcgcccgcauggggaucuuccaggagacccuguacaagcgguucggcaagcacuccaaggaggcccucuucuacaaccacgcccugccccugcccggcuucguguuccucgccagcgacaucuacgaccacgcggugcuguucaacaaguccgagcuguacgagauccccgugaucggggucacccucccgaucaugugguucuaccugcugaugaacaucaucacccaguacgugugcauccgcggcguguucauccucacgaccgagugcgccagccugaccgucacccugguggugacgcuccggaaguucgucucccugaucuucagcauccuguacuuccagaaccccuucacccucuggcacuggcuggggacccuguucguguucaucggcacccucauguacacggagguguggaacaaccugggcaccaccaaguccgagccccagaaggacagcaagaagaacuga

SEQ ID NO: 36609 - RNA, 1056 nt, Artificial Sequence
  derived and/or modified sequence opt1 from SLC35C1__Homo_sapiens__NP_001138738
auggcccugaccggcgccagcgaccccagcgcggaggccgaggccaacggggagaagccguuccuccugcgcgcccugcagaucgcccucguggucagccuguacugggugaccuccaucagcaugguguuccugaacaaguaccuccuggacucccccagccugcggcucgacacgcccaucuucgucaccuucuaccagugccuggugaccacccugcucugcaagggccuguccgcgcuggccgccugcugccccggggccguggacuucccgagccuccgccuggaccugcgggucgcgcgcuccgugcucccccugagcguggucuucaucggcaugaucacguucaacaaccugugccucaaguacguggggguggccuucuacaacgucggccggucccugaccaccguguucaacgugcugcucagcuaccugcugcucaagcagaccacguccuucuacgcccugcugaccugcggcaucaucaucgggggcuucuggcucggggucgaccaggagggcgccgaggggacccugagcuggcugggcaccguguucggcgugcucgccucccugugcgucagccugaacgcgaucuacacgaccaaggugcuccccgccguggacggguccaucuggcgccugaccuucuacaacaacgucaacgccugcauccuguuccucccccugcugcuccugcugggcgagcuccaggcccugcgggacuucgcccagcuggggagcgcgcacuucuggggcaugaugacccucggcgggcuguucggcuucgccaucggguacgugacgggccugcagaucaaguucaccuccccgcugacccacaacgugagcgggaccgccaaggccugcgcccagacgguccucgcggugcuguacuacgaggagaccaagagcuuccugugguggaccuccaacaugaugguccucggcggcagcuccgccuacaccugggugcgcgggugggagaugaagaagacgcccgaggagcccagccccaaggacuccgagaaguccgccaugggcguguga

SEQ ID NO: 36610 - RNA, 1251 nt, Artificial Sequence
  derived and/or modified sequence opt1 from SLC35D3__Homo_sapiens__NP_001008783
augcgccagcugugccggggccgcgugcucgggaucagcgucgccaucgcccacggcguguucuccgggagccugaacauccugcucaaguuccugaucucccgguaccaguucagcuuccugacccucgugcagugccugaccuccagcacggcggcccugucccucgagcugcugcgccggcucggccugaucgccgugcccccguucgggcugagccucgcccgcuccuucgccggcgucgcggugcugagcacccugcaguccagccucacccuguggucccugcggggccucagccugcccauguacgucguguucaagcgcugccugccccucgugaccaugcugaucgggguccuggugcucaagaacggcgcccccuccccgggggugcuggccgccguccugaucacgaccugcggcgcggcccucgccggggccggcgaccugaccggcgaccccaucggguacgugaccggcgugcuggccguccucgugcacgcggccuaccuggugcugauccagaaggccagcgccgacacggagcacgggccccucaccgcccaguacgucaucgcgguguccgccacgccccugcuggugaucugcagcuucgccuccaccgacagcauccacgccuggaccuucccgggcuggaaggaccccgccauggucugcaucuucguggcgugcauccucaucggcugcgccaugaacuucaccacccugcacugcaccuacaucaacagcgccgugacgaccuccuucgucgggguggucaagagcaucgccaccaucaccgugggcaugguggccuucuccgacgucgagcccacgagccuguucaucgcgggggugguggucaacacccucggcuccaucaucuacugcguggccaaguucauggagacccggaagcagagcaacuacgaggaccuggaggcccagccccgcggggaggaggcccagcuguccggcgaccagcucccguucgugauggaggagcugcccggcgagggcgggaacgggcggagcgagggcggggaggcggccggcggccccgcccaggagucccgccaggagguccgggggagcccccgcggcgugccgcugguggccggguccagcgaggagggcucccggcgcagccucaaggacgccuaccuggaggucuggcggcuggugcgcgggacccgguacaugaagaaggacuaccugaucgagaacgaggagcuccccucccccuga

SEQ ID NO: 36611 - RNA, 1227 nt, Artificial Sequence
  derived and/or modified sequence opt1 from SLC35F1__Homo_sapiens__NP_001025029
augaucccgcccgagcagccccagcagcagcugcagccgcccagccccgccccgcccaaccacguggucaccaccaucgagaaccuccccgccgagggcuccgggggcgggggcagccuguccgcgagcucccgcgccggggugcggcagcgcauccggaaggugcugaaccgcgagaugcucaucagcgucgcccugggccaggugcugucccuccugaucugcggcaucgggcugacgagcaaguaccucuccgaggacuuccacgccaacacccccguguuccagagcuuccugaacuacauccuccuguuccuggucuacaccaccacgcuggccgugcggcagggcgaggagaaccuccuggcgauccugcgccggcgcugguggaaguacaugauccucgggcugaucgaccuggaggccaacuaccucguggucaaggccuaccaguacaccacccugaccuccauccagcugcucgacugcuucgugauccccguggucauccugcugagcugguucuuccuccugauccgguacaaggccgugcacuucaucggcaucguggucugcauccuggggaugggcugcauggugggcgcggacgugcucgucgggcgccaccagggcgccggggagaacaagcuggugggcgaccugcucgugcugggcggggccacgcuguacggcaucuccaacgucugggaggaguacaucauccggacccucagccgcguggaguuccuggggaugaucggccuguucggggccuucuucuccggcauccagcucgccaucauggagcacaaggagcugcugaaggugcccugggacuggcagaucggccuccuguacgucggguucagcgcgugcauguucggccuguacuccuucaugcccguggucaucaagaagaccagcgccaccuccgugaaccucagccugcugacggccgaccucuacagccuguucugcgggcuguuccuguuccacuacaaguucuccggccucuaccugcugagcuucuucaccauccucaucgggcuggugcuguacuccagcaccuccaccuacaucgcccaggacccgcgggucuacaagcaguuccgcaaccccagcggccccgugguggaccuccccacgaccgcccaggucgagccguccgugaccuacaccagccugggccaggagacggaggaggagccccacgugcgggucgcguga

SEQ ID NO: 36612 - RNA, 1125 nt, Artificial Sequence
  derived and/or modified sequence opt1 from SLC35F2__Homo_sapiens__NP_059985
auggaggccgacagccccgccggcccgggggcgcccgagccccuggccgagggcgccgccgccgaguucuccagccuccugcgccggaucaaggggaagcuguucaccuggaacauccucaagaccaucgcgcugggccagaugcugucccucugcaucugcgggacggccaucaccagccaguaccuggccgagcgcuacaaggugaacacccccaugcugcaguccuucaucaacuacugccuccuguuccugaucuacaccgucaugcucgccuuccggagcggcuccgacaaccugcuggugauccucaagcgcaagugguggaaguacauccugcugggccucgcggacguggaggccaacuacgucaucgugcgggccuaccaguacacgacccugaccagcgugcagcugcucgacugcuucgggaucccgguccugauggcccuguccugguucauccuccacgcccgcuaccgggugauccacuucaucgcgguggccgucugccugcugggcguggggaccauggugggcgccgacauccucgccgggcgcgaggacaacagcggcuccgacguccugaucggcgacauccuggugcuccugggggccagccuguacgcgaucuccaacgugugcgaggaguacaucgucaagaagcucagccggcaggaguuccugggcaugguggggcuguucggcacgaucaucuccggcauccagcuccugaucguggaguacaaggacaucgccagcauccacugggacuggaagaucgcccuccuguucgucgccuucgcccugugcauguucugccuguacuccuucaugccccucgugaucaaggugaccagcgcgaccuccgucaaccuggggauccugaccgccgaccucuacagccuguucgugggccuguuccucuucggguacaaguucagcggccuguacauccuguccuucacggugaucauggucggguucauccuguacugcagcacccccacccgcaccgccgagcccgccgaguccagcgugccgcccgucacguccaucggcaucgacaaccucggccugaagcuggaggagaaccuccaggagacccacagcgccgugcuguga

SEQ ID NO: 36613 - RNA, 1266 nt, Artificial Sequence
  derived and/or modified sequence opt1 from SLC35F3__Homo_sapiens__NP_001287774
augaagaagcacagcgcccgcguggcgccccuguccgcgugcaacagcccgguccucacccugaccaagguggagggcgaggagcggccccgcgacucccccgggcccgccgaggcccaggccccggccggcguggaggccgggggccgggccagccgccggugcuggacgugcucccgcgcccagcugaagaagaucuucuggggcgucgccguggugcucugcgucugcagcuccugggcggggagcacccagcuggccaagcugaccuuccggaaguucgacgcccccuucacccucacgugguucgccaccaacuggaacuuccuguucuucccccuguacuacgugggccacgugugcaaguccaccgagaagcagagcgucaagcagcgcuaccgggagugcugccgcuucuucggggacaacggccucacccugaagguguucuucacgaaggccgcgcccuucggggugcuguggacccucaccaacuaccuguaccugcacgccaucaagaagaucaacaccacggacgucuccguccucuucugcugcaacaaggccuucguguuccugcugagcuggaucgugcuccgggaccgcuucaugggcgugcggaucguggccgccauccuggcgaucgccgggaucgucaugaugaccuacgccgacggcuuccacucccacagcgugaucggcaucgcccugguggucgccuccgcgagcauguccgcccucuacaaggugcuguucaagcugcuccuggggagcgccaaguucggcgaggccgcccuguuccucuccauccuggggguguucaacauccuguucaucacgugcaucccgaucauccucuacuucaccaaggucgaguacuggagcagcuucgacgacauccccuggggcaaccugugcggcuucuccgugcugcuccugaccuucaacaucguccugaacuucgggaucgcggugaccuaccccacccucaugagccugggcaucgugcuguccauccccgucaacgccgugaucgaccacuacaccagccagaucguguucaacgggguccgcgugaucgccaucaucaucaucggccucggguuccugcugcuccugcugccggaggagugggacguguggcucaucaagcugcugacgcggcucaagguccgcaagaaggaggagcccgccgagggcgcggccgaccuguccagcggcccccaguccaagaaccggcgcgcccggcccagcuucgcccgcuga

SEQ ID NO: 36614 - RNA, 1599 nt, Artificial Sequence
  derived and/or modified sequence opt1 from SLC35F4__Homo_sapiens__XP_011535022
augcuggugcaccuccgcgacagccuguacccccagcugggcaucaaccagcuguccuacacccggaagcuggccacccgcugcagcuccgucgugacggccagcuacaccgugcugaagccggagaagcggaagauccuccugcaguacaaguuccagaaggagaccuuccagcugcccuucaagaccacguucuggaucaacaacuuccagaucgucaucuucccccucgggucccugugcagcaccucccgcagcuccgugacccggugcaagcccggcgcgaacugcccgagcucccacagcgggaucucccgccagcugagcccccucuccgugaccgaggacagcuccgcccccauccuggagcugcagaaccagggcagcuccggggucugcggccaccggguggagcgccagaaccggagcgccgacgacggcacgcagacccacagcgagaacuccagccaggagaaccgcaucaaggcccggugccucuccugcaccagcauggugcugaaggggaucuggggccugcucaucauccuguccgucagcuccagcuggguggggaccacgcagaucgugaagaucaccuacaagaacuucuacugccccuucuucaugaccugguucuccaccaacuggaacaucauguucuucccggucuacuacagcggccaccuggccacggcgcaggagaagcagucccccaugaagaaguuccgcgagugcagccggaucuucggggaggacggccucacccugaagcuguuccucaagcgcaccgcccccuucuccauccuguggacccugacgaacuaccucuaccugcuggcccucaagaagcugaccgccaccgacgugagcgcgcuguucugcugcaacaaggccuucguguuccuccuguccuggaucguccugaaggaccgguucaugggcgugcgcaucguggccgccaucauggccaucaccgggaucgucaugauggcguacgccgacaacuuccacgccgacagcaucaucggcguggccuucgccgugggguccgcgagcacguccgcccucuacaagguccuguucaagauguuccugggcagcgccaacuucggcgaggccgcccacuucgugagcacccucggguucuucaaccugaucuucaucuccuucacccccgugauccuguacuucaccaaggucgagcacuggagcuccuucgcggcccucccguggggcugccugugcgggauggccggccuguggcucgccuucaacauccuggugaacgucgggguggugcugacguaccccauccucaucagcaucggcaccguccuguccgugcccggcaacgccgcgguggaccugcugaagcaggaggucaucuucaacguggugcggcucgccgccaccaucaucaucugcaucggguuccugcugaugcuccugcccgaggagugggacgagaucacccugcgcuucaucaacagccucaaggagaagaaguccgaggagcacgucgacgacgugacggacccgagcauccaccuccggggccgcgggcgggccaacggcaccguguccaucccccuggcguga

SEQ ID NO: 36615 - RNA, 1116 nt, Artificial Sequence
  derived and/or modified sequence opt1 from SLC35F6__Homo_sapiens__NP_060347
auggccuggaccaaguaccagcuguuccuggccggccugaugcuggugaccgggagcaucaacacgcucuccgcgaagugggccgacaacuucauggccgagggcugcgggggcagcaaggagcacuccuuccagcaccccuuccugcaggccgucgggauguuccugggcgaguucagcugccucgccgcguucuaccugcugcgcugccgggccgccggccaguccgacagcuccguggacccgcagcagcccuucaacccccuccuguuccugcccccggcccucugcgacaugaccgggaccagccugauguacguggcgcugaacaugaccuccgccagcuccuuccagaugcuccgcggcgccgucaucaucuucacggggcuguucagcguggccuuccugggccggcgccucgugcugucccaguggcuggggauccucgccaccaucgcgggccuggucguggugggccuggccgaccuccugagcaagcacgacucccagcacaagcugagcgaggucaucaccggggaccuccugaucaucauggcccagaucaucguggccauccagauggugcuggaggagaaguucgucuacaagcacaacgugcacccccuccgggccgugggcaccgaggggcuguucggcuucgucauccugucccuccugcuggugcccauguacuacauccccgcgggcagcuucuccgggaacccgcgcggcacgcucgaggacgcccuggacgccuucugccagguggggcagcagccccugaucgccgucgcccuccugggcaacaucagcagcaucgcguucuucaacuucgccgggaucuccgugaccaaggagcugagcgccaccacccggauggugcucgacucccugcgcacggucgugaucugggcccugagccucgcccugggcugggaggcguuccacgcccugcagauccucggcuuccugauccugcugaucgggaccgcccucuacaacggccugcaccggccccugcucgggcgccugucccggggccgcccccuggccgaggagagcgagcaggagcggcuccucgggggcacccgcaccccgaucaacgacgcguccuga

SEQ ID NO: 36616 - RNA, 1098 nt, Artificial Sequence
  derived and/or modified sequence opt1 from SLC35G1__Homo_sapiens__NP_001128130
augcgcccccaggacagcaccggcguggccgagcugcaggagccggggcucccccugaccgacgacgccccgcccggcgcgacggaggagcccgccgccgccgaggccgcgggggcccccgaccggggccgcugcuggcugugccucuccagccccugcugcucccggaccgagcccgaggccaagaagaaggccccgugccccgggcugggccuguucuacacccuccugagcgcguuccuguucuccgucggcagccucuucgugaagaaggugcaggacguccacgccguggagaucuccgccuuccgcugcguguuccagaugcuggucgugauccccugccugaucuaccggaagaccggguucaucggccccaaggggcagcgcaucuuccucauccugcggggcgugcuggggagcacggccaugaugcucaucuacuacgccuaccagaccaugucccuggcggacgccaccgucaucaccuucagcuccccgguguucacgagcaucuucgccuggaucugccugaaggagaaguacucccccugggacgcccucuucaccguguucaccaucaccggcgucauccugaucgugcgcccgcccuuccuguucggcagcgacacguccgggauggaggagagcuacuccggccaccucaaggggaccuucgccgcgaucggcagcgccguguucgccgccuccacccuggucauccugcggaagaugggcaagagcguggacuacuuccucagcaucugguacuacgugguccuggggcugguggaguccgugaucauccucagcguccugggcgaguggucccugcccuacugcgggcucgaccgccuguuccugaucuucaucggccucuucgggcugggcggccagaucuucaucaccaaggcccugcagaucgagaaggcggggcccguggccaucaugaagacgauggacguggucuucgccuucaucuuccagaucaucuucuucaacaacgugcccaccugguggaccgucggcggggcccucugcgugguggccagcaacgucggcgcggccauccggaagugguaccaguccagcaaguga

SEQ ID NO: 36617 - RNA, 1239 nt, Artificial Sequence
  derived and/or modified sequence opt1 from SLC35G2__Homo_sapiens__NP_001091069
auggacaccagccccucccgcaaguacccggugaagaagcgggucaagauccaccccaacaccgugauggugaaguacacgagccacuacccccagcccggcgacgacggguacgaggagaucaacgagggcuacgggaacuucauggaggagaacccgaagaagggccugcucuccgagaugaagaagaaggggcgcgccuucuucggcaccauggacacccugcccccgcccaccgaggaccccaugaucaacgagaucggccaguuccagagcuucgccgagaagaacaucuuccagucccggaagauguggaucguccuguucgggagcgcgcucgcccacggcugcguggcccugaucacgcgccugguguccgaccggagcaagguccccucccucgagcugaucuucauccgcagcguguuccaggugcuguccguccucguggugugcuacuaccaggaggcccccuucgggcccagcggcuaccggcugcgccuguucuucuacggggucugcaacgugaucuccaucacgugcgccuacaccagcuucuccaucgugccgcccagcaacggcaccaccauguggcgggcgaccaccaccgucuucuccgccauccucgccuuccugcugguggacgagaagauggccuacguggacauggcgacggucgugugcagcauccucggcgugugccuggucaugauccccaacaucguggacgaggacaacucccugcucaacgccuggaaggaggccuucggguacaccaugaccgugauggccggccugaccacggcccugagcaugaucgucuaccgcagcaucaaggagaagaucuccauguggaccgcccucuucaccuucggguggaccggcacgaucuggggcaucagcaccauguucauccugcaggagcccaucaucccgcuggacggggagaccugguccuaccucaucgcgaucugcgugugcagcaccgccgccuuccugggcgucuacuacgcccuggacaaguuccaccccgcgcucguguccacggugcagcaccuggagaucgucguggccauggugcugcagcuccugguccugcacaucuuccccagcaucuacgacguguucgggggcgugaucaucaugaucuccgucuucgugcucgccggguacaagcuguacuggcggaaccugcgcaagcaggacuaccaggagauccucgacagccccaucaaguga

SEQ ID NO: 36618 - RNA, 1017 nt, Artificial Sequence
  derived and/or modified sequence opt1 from SLC35G5__Homo_sapiens__NP_473369
auggccggcagccaccccuacuucaaccugccggacuccacccaccccagcccgcccuccgccccgcccagccuccgcuggcaccagcggugccagcccuccggggcgaccaacggccugcugguggcccuccucgggggcgggcugcccgccggcuucgucggcccccugagccgcauggccuaccagggguccaaccugcccagccuggagcuccugaucugccggugccuguuccaccuccccaucgcccugcugcucaagcugcgcggcgacccccugcucgggccgcccgacauccggggcugggcgugcuucugcgcccugcugaacgugcucuccaucgggugcgccuacagcgccgugcaggucgugcccgcgggcaacgccgccacggugcgcaagggcuccagcaccgucugcuccgccgugcugacccugugccucgagagccaggggcugggcggguacgaguggugcggccugcucggcuccauccuggggcugaucaucauccucggccccgggcuguggacccugcaggagggcacgaccgggguguacaccacccucggcuacguccaggccuuccugggcgggcuggcgcucagccugggccugcucguguaccggucccugcacuucccgagcugccugcccacgguggccuuccucuccgggcuggucggccugcucgggugcgugcccggccuguucgugcugcagacccccguccucccgagcgaccugcugagcugguccugcgugggcgccgaggggauccuggcccucgugagcuucacgugcgucggcuacgccgugaccaaggcgcaccccgcccuggugugcgccguccugcacuccgaggugguggucgcccucauccugcaguacuacaugcugcacgagaccguggcccucagcgacaucaugggggcgggcgucgugcugggguccaucgccaucaucaccgcccgcaaccugagcugcgagcggaccggcaagguggaggaguga

SEQ ID NO: 36619 - RNA, 1017 nt, Artificial Sequence
  derived and/or modified sequence opt1 from SLC35G6__Homo_sapiens__NP_001096084
auggccggcagccaccccuaccugaacccgcccgacuccacccaccccagcccgcccuccgccccgcccagccuccgcuggcaccagugcugccagcccuccgacgcgaccaacgggcugcugguggcccuccugggcgggggccugcccgccggguucgucggcccccucagccacauggccuaccaggccuccaaccugcccagccuggagcuccugaucugccggugccuguuccaccuccccaucgcgcugcugcucaagcugcgcggcgacccgcugcucgggccgcccgacauccggggccgcgccuacuucuacgcccugcugaacgugcucuccaucgggugcgccuacagcgcggugcaggucgugcccgccggcaacgccgccacggugcggaagggguccagcaccgucugcuccgccgugcugacccugugccucgagagccagggccuguccggcuacgacuggugcgggcugcucggcagcauccuggggcugaucaucaucgugggccccggccucuggacccugcaggaggggaucacgggcgucuacaccgcgcugggguacggccaggccuucgucgggggccucgcccugucccugggccuccugguguaccgcagccugcacuuccccuccugccuccccaccguggccuuccugagcgggcuggugggccuccuggggagcgugcccggccuguucguccuccagccgcccgugcugcccuccgaccugcccagcugguccugcgugggggccgucggcauccucgcgcuggugagcuucacgugcguguccuacgccgucaccaaggcccacccggcccuggugugcgccgugcugcacagcgaggucguggucgcgcucauccugcaguacuacaugcugcacgagaccguggcccccuccgacaucgugggcgccggggucgugcucggcagcaucgccaucaucaccgccuggaaccuguccugcgagcgggaggggaagguggaggaguga

SEQ ID NO: 36620 - RNA, 1431 nt, Artificial Sequence
  derived and/or modified sequence opt1 from SLC36A1__Homo_sapiens__NP_510968
augagcacccagcgccugcggaacgaggacuaccacgacuacuccagcaccgacgugucccccgaggagagcccguccgagggccucaacaaccugagcucccccgggagcuaccagcgcuucggccaguccaacagcaccaccugguuccagacccugauccaccuccugaaggggaacaucggcaccgggcugcucggccugccccuggccgucaagaacgccggcaucgugauggggcccaucucccuccugaucaucggcaucguggcgguccacugcauggggauccuggugaagugcgcccaccacuucugccggcgccucaacaagagcuucguggacuacggcgacacggucauguacgggcuggaguccagcccgugcuccuggcugcggaaccacgcccacuggggccgccgggugguggacuucuuccucaucgucacccagcugggcuucugcugcguguacuucguguuccuggccgacaacuucaagcaggucaucgaggccgcgaacgggaccaccaacaacugccacaacaacgagacggugauccucacccccaccauggacagccgccuguacaugcuguccuuccuccccuuccuggugcugcucgucuucauccggaaccugcgcgcccugagcaucuucucccuccuggccaacaucaccaugcuggugagccucgugaugaucuaccaguucaucguccagcggauccccgacccgagccaccucccccugguggcccccuggaagacguacccccucuucuucggcaccgcgaucuucuccuucgaggggaucggcauggugcugccgcuggagaacaagaugaaggacccccgcaaguucccccucauccuguaccugggcauggucaucgugaccauccucuacaucagccuggggugccugggcuaccuccaguucggggccaacauccagggcuccaucacccugaaccugcccaacugcuggcucuaccagagcgugaagcugcuguacuccaucgggaucuucuucacguacgcccuccaguucuacgucccggccgagaucaucauccccuucuucgugagccgggcccccgagcacugcgagcuggucguggaccuguucgugcgcaccguccuggugugccugaccugcauccuggcgauccugaucccccggcucgaccuggugaucucccuggucggcagcguguccagcuccgcccucgcccugaucaucccgccccugcucgaggugaccacguucuacagcgagggcaugagcccccugaccaucuucaaggacgcccugaucuccauccucggguucgucggcuucgugguggggaccuacgaggcccuguacgagcugauccagcccuccaacgcgccgaucuucaucaacagcacgugcgccuucaucuga

SEQ ID NO: 36621 - RNA, 1452 nt, Artificial Sequence
  derived and/or modified sequence opt1 from SLC36A2__Homo_sapiens__NP_861441
augagcgugaccaaguccaccgagggcccccagggggccgucgccaucaagcuggaccucaugagcccgcccgaguccgcgaagaagcuggagaacaaggacagcacguuccuggacgagucccccagcgaguccgccggccucaagaagaccaaggggaucaccguguuccaggcccugauccaccuggugaagggcaacauggggaccggcauccucggccugccccuggccgucaagaacgccgggauccucaugggcccgcugagccugcucgugaugggguucaucgcgugccacugcaugcacauccuggugaagugcgcccagcgcuucugcaagcggcugaacaagcccuucauggacuacggcgacacggucaugcacgggcucgaggccaaccccaacgccuggcugcagaaccacgcgcacuggggccgccacaucguguccuucuuccugaucaucacccagcucggcuucugcugcguguacaucgucuuccuggccgacaaccugaagcaggucguggaggccgugaacagcaccaccaacaacugcuacuccaacgagacggugauccucacccccaccauggacagccggcuguacaugcuguccuuccucccguuccuggugcugcucguccugauccgcaaccugcggauccucaccaucuucagcaugcuggccaacaucuccaugcuggugagccucgugaucaucauccaguacaucacgcaggagauccccgaccccucccgccugccccuggucgccagcuggaagaccuacccccucuucuucgggaccgcgaucuucuccuucgagagcaucggcguggugcugccccuggagaacaagaugaagaacgcccggcacuuccccgccauccucagccuggggauguccaucgucaccagccuguacaucggcauggccgcccucggcuaccugcgcuucggggacgacaucaaggcguccaucagccugaaccuccccaacugcuggcuguaccaguccgugaagcugcucuacaucgccggcauccugugcacguacgcccugcaguucuacgugccggccgagaucaucauccccuucgccaucagccgggucuccacccgcugggcgcugccccucgaccugagcauccggcuggugauggucugccugaccugccuccuggccauccucaucccccgccuggaccuggugaucucccucguggggagcgucuccggcaccgcccuggcccugaucaucccgccccuccuggaggugacgaccuucuacagcgaggggauguccccgcugaccaucuucaaggacgcccucaucagcauccugggcuucgugggcuucgucguggggaccuaccaggcgcuggacgagcuccugaaguccgaggacagccaccccuucuccaacagcacgaccuucgugcgguga

SEQ ID NO: 36622 - RNA, 1602 nt, Artificial Sequence
  derived and/or modified sequence opt1 from SLC37A1__Homo_sapiens__NP_061837
auggcccgccugcccgccggcauccgguucaucaucagcuucucccgcgaccagugguaccgggcguucaucuucauccucaccuuccugcuguacgccagcuuccaccucucccgcaagccgaucagcaucgugaagggggagcugcacaaguacugcaccgccugggacgaggccgacguccgguucuccagccagaaccgcaaguccggcagcgccgcgccccaccagcugcccgacaacgagacggacugcgggugggcccccuucgacaagaacaacuaccagcagcuccugggcgcccuggacuacuccuuccucugcgccuacgcgguggggauguaccugagcggcaucaucggcgagcggcugccgauccgcuacuaccucaccuucgggaugcuggccuccggcgccuucaccgcccuguucgggcucggcuacuucuacaacauccacagcuucggguucuacguggucacccaggugaucaacggccuggugcagacgaccggcuggcccuccgucgugaccugccuggggaacugguucggcaaggggcggcgcggccucaucaugggcguguggaacagccacaccuccgucgggaacauccugggcagccugaucgccggguacuggguguccacgugcuggggccucagcuucgugguccccggggcgaucguggccgccaugggcaucgugugcuuccuguuccugaucgagcaccccaacgacguccggugcuccagcacccucgugacccacagcaagggcuacgagaacgggaccaaccgccugcggcugcagaagcagauccucaaguccgagaagaacaagccgcuggaccccgagaugcagugccugcuccugagcgacggcaagggguccauccaccccaaccacguggucauccugcccggcgacgggggcagcggcacggccgccaucuccuucaccggggcgcucaagaucccgggcgugaucgaguucagccugugccugcuguucgccaagcugguguccuacaccuuccuguucuggcucccccuguacaucaccaacgucgaccaccuggacgccaagaaggccggggagcucagcacgcuguucgacgugggcgggaucuucggcggcauccuggccggggugaucuccgaccgccucgagaagcgggcgagcacgugcggccugaugcugcuccuggccgcccccacccuguacaucuucuccaccgucagcaagauggggcuggaggccaccaucgccaugcuccugcuguccggcgcgcucgugagcggccccuacacccugaucaccaccgccgucuccgccgaccuggggacgcacaagagccucaagggcaacgcccacgcgcuguccaccgugaccgccaucaucgacgggaccggcagcgugggggccgcccugggcccgcuccuggccggccugcucucccccagcggguggagcaacgucuucuacaugcugauguucgcggacgccugcgcccuccucuuccugauccgccugauccacaaggagcucuccugccccggcagcgccacgggggaccaggugcccuucaaggagcaguga

SEQ ID NO: 36623 - RNA, 1506 nt, Artificial Sequence
  derived and/or modified sequence opt1 from SLC37A2__Homo_sapiens__NP_001138762
augcgcagcucccuggcccccggcgugugguucuuccgggccuucagccgcgacuccugguuccgggggcucauccugcugcucaccuuccugaucuacgcgugcuaccacaugagccgcaagccgaucuccaucgucaagagccggcugcaccagaacugcuccgagcagaucaagcccaucaacgacacccacagccucaacgacacgauguggugcuccugggcccccuucgacaaggacaacuacaaggagcugcugggcgggguggacaacgccuuccucaucgccuacgccaucggcauguucaucagcgggguguucggcgagcgccugccccugcgguacuaccucuccgcgggcaugcugcugagcggccucuucaccucccuguucgggcugggguacuucuggaacauccacgagcucugguacuucgucgugauccaggugugcaacggccugguccagaccaccggguggccgagcguggugacgugcgucggcaacugguucggcaaggggaagcgcggcuucaucauggggaucuggaacucccacaccagcgugggcaacauccugggcucccucaucgccgggaucugggugaacggccagugggggcugagcuucaucguccccggcaucaucaccgccgugaugggggugaucaccuuccuguuccucaucgagcaccccgaggacgucgacugcgcgcccccgcagcaccacggcgagcccgccgagaaccaggacaaccccgaggaccccggcaacuccccgugcagcauccgggagagcgggcuggagacgguggccaagugcuccaagggccccugcgaggagcccgccgccaucagcuucuucggggcccugcgcauccccggcguggucgaguucucccucugccugcuguucgcgaagcucgugagcuacaccuuccuguacuggcugccgcucuacaucgccaacguggcccacuucuccgccaaggaggccggggaccugagcacccuguucgacgucggcggcaucaucgggggcaucguggcggggcucguguccgacuacaccaacggccgggccacgaccugcugcgucaugcugauccuggccgcccccaugauguuccucuacaacuacaucgggcaggacggcaucgccagcuccaucgugaugcugaucaucugcggcgggcuggucaacggccccuacgcgcucaucaccaccgccgugagcgccgaccuggggacgcacaagucccugaagggcaacgccaaggcccucagcaccgugaccgcgaucaucgacggcaccggguccaucggcgccgcccuggggccccugcucgccggccugaucagcccgacgggguggaacaacgucuucuacaugcugaucuccgcggacgugcuggccugccuccugcugugccgccucguguacaaggagauccuggccuggaaggucagccugucccggggcagcggcuacaaggagaucuga

SEQ ID NO: 36624 - RNA, 1290 nt, Artificial Sequence
  derived and/or modified sequence opt1 from SLC37A4__Homo_sapiens__NP_001157749
auggccgcccagggcuacggguacuaccgcaccgugaucuucagcgcgauguucggcggguacucccuguacuacuucaaccggaagaccuucagcuucgucaugcccucccucguggaggagaucccccuggacaaggacgaccugggcuucaucacgagcucccagagcgccgccuacgccaucuccaaguucgugagcgggguccucuccgaccagaugagcgcccgcuggcuguucuccagcggccugcuccuggugggccuggugaacaucuucuucgcgugguccagcaccguccccguguucgccgcccucugguuccugaacgggcuggcccagggccucggguggccgcccugcggcaaggugcugcggaagugguucgagcccucccaguucgggaccuggugggcgauccugagcaccuccaugaaccucgccggcggccuggggcccauccuggccacgauccucgcccagagcuacuccuggcgcagcacccuggcccugagcggcgcgcucugcgucgugguguccuuccugugccugcuccugauccacaacgagcccgccgacgucgggcugcggaaccucgaccccaugccgagcgagggcaagaagggcucccugaaggaggagagcacccugcaggagcuccugcugucccccuaccucugggugcugagcaccggguaccugguggucuucggcgugaagacgugcugcaccgacugggggcaguucuuccucauccaggagaagggccaguccgcccugguggggagcuccuacaugagcgcccuggaggucggcggccucgugggguccaucgccgcgggcuaccugagcgaccgcgccauggccaaggccgggcuguccaacuacggcaacccccggcacgggcuccugcuguucaugauggccggcaugaccgugagcauguaccucuuccgcgucaccgugacguccgacagccccaagcuguggauccuggugcucggcgcggucuucggguucuccagcuacggcccgaucgcccuguucggggugaucgccaacgaguccgccccgcccaaccugugcggcaccagccacgccaucgucgggcugauggcgaacgugggcggcuuccucgccgggcugcccuucagcaccaucgccaagcacuacuccuggagcaccgccuucuggguggcggaggucaucugcgccgccuccacggccgccuucuuccugcuccggaacauccgcaccaagaugggccgggugagcaagaaggcggaguga

SEQ ID NO: 36625 - RNA, 1464 nt, Artificial Sequence
  derived and/or modified sequence opt1 from SLC38A1__Homo_sapiens__NP_001265316
augaugcacuucaagagcggccuggagcucaccgagcugcagaacaugaccgugcccgaggacgacaacaucuccaacgacagcaacgacuucacggaggucgagaacgggcagaucaacuccaaguucaucagcgaccgcgagucccggcgcagccugaccaacucccaccucgagaagaagaagugcgacgaguacaucccgggcaccaccagccuggggauguccguguucaaccugagcaacgccaucaugggcuccgggauccucggccuggccuucgcgcuggccaacacgggcauccuccuguuccuggugcuccugaccagcgucacccugcucuccaucuacagcaucaaccugcugcucaucugcuccaaggagaccgggugcaugguguacgagaagcugggcgagcaggucuucgggacgaccggcaaguucgucaucuucggggccaccagccugcagaacaccggcgccaugcucuccuaccuguucaucgugaagaacgagcugcccagcgccaucaaguuccucaugggcaaggaggagacguucuccgcgugguacguggacgggcggguccugguggugaucgucaccuucggcaucauccugccccucugccugcugaagaaccucggguaccugggcuacaccagcggcuucagccuguccugcaugguguucuuccucaucguggucaucuacaagaaguuccagauccccugcaucgugccggagcugaacagcaccaucuccgccaacagcacgaacgccgacacgugcacccccaaguacgugaccuucaacuccaagaccgucuacgcccugcccaccaucgcguucgccuucgugugccaccccagcgugcucccgaucuacuccgagcugaaggaccgcagccagaagaagaugcagauggucuccaacaucagcuucuucgccauguucgugauguacuuccugaccgccaucuucggguaccucaccuucuacgacaacgugcaguccgaccugcugcacaaguaccagagcaaggacgacauccucauccugacgguccggcuggccgugaucgucgcggugauccucaccgugcccguccuguucuucaccgugcgcuccagccuguucgagcucgccaagaagaccaaguucaaccugugccggcacacgguggugaccugcauccugcugguggugaucaaccuccuggucaucuucauccccuccaugaaggacaucuucggcguggugggggucaccagcgccaacaugcugaucuucauccuccccuccagccuguaccugaagaucaccgaccaggacggcgacaaggggacgcagcgcaucugggccgcccucuuccugggccugggcguccucuucucccuggugagcaucccgcuggugaucuacgacugggcgugcagcuccagcuccgacgaggggcacuga

SEQ ID NO: 36626 - RNA, 1521 nt, Artificial Sequence
  derived and/or modified sequence opt1 from SLC38A2__Homo_sapiens__NP_061849
augaagaaggccgagaugggccgcuucagcaucucccccgacgaggacagcuccagcuacuccagcaacuccgacuucaacuacagcuacccgaccaagcaggccgcgcugaagucccacuacgccgacguggaccccgagaaccagaacuuccuccuggagagcaaccuggggaagaagaaguacgagaccgaguuccaccccggcacgaccuccuucgggaugagcgucuucaaccucuccaacgccaucgugggcagcgggauccugggccuguccuacgccauggccaacaccggcaucgcgcuguucaucauccugcugaccuucgugagcaucuucucccucuacagcguccaccuccugcucaagacggccaacgagggcgggucccugcuguacgagcagcucggguacaaggccuucggccugguggggaagcuggccgcgagcggcagcaucaccaugcagaacaucggcgccauguccagcuaccucuucaucgugaaguacgagcugccccuggucauccaggcccucaccaacaucgaggacaagaccgggcugugguaccugaacggcaacuaccucgugcugcuggugucccucgucgugauccugccgcugagccucuuccggaaccugggguaccugggcuacacguccggccucagccugcugugcaugguguucuuccucaucgucgugaucugcaagaaguuccaggugcccugccccgucgaggccgcccugaucaucaacgagaccaucaacaccacccugacgcagcccaccgcgcucgugccggcccugucccacaacgugaccgagaacgacagcugccgcccccacuacuucaucuucaacucccagaccgucuacgccgugcccauccugaucuucagcuucgugugccaccccgccguccucccgaucuacgaggagcugaaggaccggucccgccggcgcaugaugaacgugagcaagaucuccuucuucgccauguuccugauguaccuccuggcggcccuguucggguaccucacguucuacgagcacguggagagcgagcugcugcacaccuacuccagcauccugggcaccgacauccuccugcugaucguccggcucgccgugcugauggccgucacccugacggugcccguggucaucuuccccauccgcuccagcgugacccaccuccugugcgccuccaaggacuucagcugguggcggcacagccugaucaccguguccauccucgcguucaccaaccugcuggucaucuucgugcccacgauccgcgacaucuucggguucaucggcgccagcgccgccuccaugcucaucuucauccugccgagcgccuucuacaucaagcuggugaagaaggagcccaugaaguccguccagaagaucggggcccucuucuuccugcugagcggcgugcucgugaugaccggcuccauggcgcugaucguccuggacugggugcacaacgcccccgggggcgggcacuga

SEQ ID NO: 36627 - RNA, 1644 nt, Artificial Sequence
  derived and/or modified sequence opt1 from SLC38A4__Homo_sapiens__NP_001137296
auggaccccauggagcugcgcaacgugaacaucgagccggacgacgagagcuccagcggcgaguccgcccccgacagcuacaucgggaucggcaacuccgagaaggccgcgaugagcucccaguucgccaacgaggacaccgagagccagaaguuccucaccaacggguuccugggcaagaagaagcuggccgacuacgccgacgagcaccaccccgggacgaccuccuucggcaugagcuccuucaaccucagcaacgccaucaugggcuccgggauccugggccugagcuacgcgauggccaacaccgggaucauccucuucaucaucaugcugcuggccgucgccauccucucccuguacagcgugcaccuccuccugaagaccgcgaaggagggcgggucccugaucuacgagaagcucggcgagaaggccuucggcuggcccgggaagaucggcgccuucgugagcaucacgaugcagaacaucggggccauguccagcuaccuguucaucaucaaguacgagcugccggaggucauccgggccuucaugggccucgaggagaacaccggcgagugguaccugaacgggaacuaccugaucaucuucgugagcgugggcaucauccucccccugucccugcucaagaaccugggguaccugggcuacaccagcggguucucccugaccugcauggucuucuucgugagcguggucaucuacaagaaguuccagauccccugcccccugccggugcuggaccacuccgugggcaaccucagcuucaacaacacgcugcccaugcacgucgugaugcugcccaacaacuccgagagcuccgacgugaacuucaugauggacuacacccaccgcaaccccgcgggccucgacgagaaccaggccaaggggagccugcacgacuccggcgucgaguacgaggcccacagcgacgacaagugcgagccgaaguacuucguguucaacucccggaccgccuacgccauccccauccugguguucgcguucgucugccaccccgaggugcuccccaucuacagcgagcugaaggaccgcucccggcgcaagaugcagaccgugagcaacaucuccaucacggggaugcuggucauguaccuccuggccgcccuguucggcuaccucaccuucuacggggagguggaggacgagcugcugcacgccuacagcaagguguacacccucgacaucccgcugcugaugguccggcucgccgugcuggucgcggugacccugacggugcccaucguccuguuccccauccgcaccuccgugaucacccuccuguuccccaagcggccguucagcuggauccgccacuuccugaucgccgccgugcucaucgcccugaacaacguccuggugauccucgugcccaccaucaaguacaucuucggcuucaucggcgccagcuccgcgacgaugcugaucuucauccugcccgccgucuucuaccucaagcuggugaagaaggagaccuuccggagcccccagaaggugggggcccugaucuuccucgucgugggcaucuucuucaugaucggguccauggcccugaucaucaucgacuggaucuacgacccgcccaacagcaagcaccacuga

SEQ ID NO: 36628 - RNA, 1419 nt, Artificial Sequence
  derived and/or modified sequence opt1 from SLC38A5__Homo_sapiens__NP_277053
auggagcugcaggaccccaagaugaacggcgcccucccgagcgacgccgugggguaccgccaggagcgggagggcuuccugcccucccgcgggcccgcgcccggcagcaagccgguccaguucauggacuucgaggggaagaccuccuucggcaugagcguguucaaccuguccaacgccaucaugggcagcgggauccucggccuggccuacgccauggcccacaccggggugaucuucuuccuggcgcuccugcugugcaucgcccuccuguccagcuacuccauccaccuccugcugacgugcgccggcaucgccgggauccgggcguacgagcagcugggccagcgcgccuucggccccgccgggaaggucgugguggccaccgucaucugccuccacaacgugggcgccaugagcuccuaccuguucaucaucaagagcgagcugccccucgugaucgggaccuuccuguacauggaccccgagggcgacugguuccugaagggcaaccuccugaucaucaucgucuccgugcugaucauccucccgcuggcgcugaugaagcaccucggguaccugggcuacaccagcgggcugucccucacgugcaugcuguucuuccuggugagcgucaucuacaagaaguuccagcucggcugcgccaucgggcacaacgagaccgccauggaguccgaggcccuggugggccugcccagccagggccucaacuccagcugcgaggcccagauguucaccguggacagccagauguccuacaccguccccaucauggcguucgccuucgugugccaccccgaggugcugccgaucuacacggagcugugccggcccagcaagcgccggaugcaggccgucgccaacguguccaucggggccauguucugcauguacggccucaccgcgaccuucggguaccugaccuucuacagcuccgugaaggccgagaugcugcacauguacagccagaaggacccccucauccugugcguccgccuggccgugcuccuggccgugacgcugaccguccccgugguccucuucccgauccggcgcgcccugcagcagcugcuguuccccggcaaggcguucuccuggccccggcacguggccaucgcccucauccugcuggugcucgucaacgugcuggugaucugcguccccaccauccgcgacaucuucggggugaucggcagcaccuccgccccgagccugaucuucauccuccccuccaucuucuaccugcggaucgugcccagcgaggucgagcccuuccuguccuggccgaagauccaggcgcucugcuucggcgugcugggggugcuguucauggccgucagccucggcuucauguucgccaacugggccacggggcagucccgcaugagcggccacuga

SEQ ID NO: 36629 - RNA, 1566 nt, Artificial Sequence
  derived and/or modified sequence opt1 from SLC38A6__Homo_sapiens__NP_001166173
auggaggccagcuggggcuccuucaacgccgagcgcgggugguacgugagcguccagcagcccgaggaggcggaggccgaggagcuguccccgcuccugagcaacgagcugcaccggcagcgcucccccggcgugagcuucgggcucuccguguucaaccugaugaacgccaucaugggcagcgggauccugggccucgccuacguccuggccaacaccggcguguucggguucuccuuccugcuccugaccguggcgcugcucgccagcuacuccguccaccuccugcucagcaugugcauccagacggccgugaccuccuacgaggaccugggccuguucgccuucgggcuccccggcaagcugguggucgcggggaccaucaucauccagaacaucggcgccaugagcuccuaccugcucaucaucaagaccgagcugcccgccgccaucgccgaguuccugacgggcgacuacagccgguacugguaccucgacgggcagacccugcugaucaucaucugcgugggcaucguguucccgcucgcgcugcugcccaagaucggguuccucggcuacaccuccagccuguccuucuucuucaugauguucuucgcccuggucgugaucaucaagaaguggagcauccccugcccccucacccugaacuacguggagaagggcuuccagaucagcaacgucacggacgacugcaagccgaagcuguuccacuucuccaaggagagcgccuacgcccuccccaccauggccuucuccuuccugugccacaccagcauccugcccaucuacugcgagcuccagucccccagcaagaagcgcaugcagaacgugaccaacacggcgaucgcccuguccuuccugaucuacuucaucagcgcccucuucggguaccugaccuucuacgacaagguggaguccgagcugcucaagggcuacagcaaguaccugucccacgacgucguggugaugaccgucaagcugugcauccucuucgccgugcugcugaccgugccgcugauccacuuccccgcccggaaggcggucacgaugauguucuucagcaacuuccccuucuccuggauccgccacuuccucaucacccuggcccugaacaucaucaucgugcuccuggccaucuacguccccgacauccggaacguguucgggguggucggcgccagcaccuccacgugccugaucuucaucuucccggggcuguucuaccugaagcugagccgcgaggacuuccucuccuggaagaagcugggcggccugauccucagccaccggcuggccugcuccggggugaucagcgcgcacugcaaccugugccuccccgacagcuccaacccgcccaccagcgccucccgcguggccgagaccaccggccgggacaccauggagaugugcacgcagcgcaaggggcacgcccggacccagcaggagggcaacugccugcaggcgaaggggcgcggccugcggcgcaccaagcggguccacacccucauccugcacuuccccacgagccgcaccguguccaaguga

SEQ ID NO: 36630 - RNA, 1389 nt, Artificial Sequence
  derived and/or modified sequence opt1 from SLC38A7__Homo_sapiens__NP_060701
auggcccaggugagcaucaacaacgacuacuccgagugggaccugagcaccgacgccggcgagcgcgcgcggcuccugcagucccccugcgucgacaccgccccgaaguccgagugggaggccagccccgggggccuggaccgcgggacgaccagcacccucggcgccaucuucaucguggugaacgccugccugggggcgggccugcucaacuuccccgccgccuucuccaccgccggcggggucgcggccggcaucgcccugcagauggggaugcugguguucaucaucagcggccucgugauccuggccuacugcucccaggccagcaacgagcggacguaccaggaggucgugugggcggugugcgggaagcugaccggcguccucugcgagguggccaucgccguguacaccuucgggaccugcaucgccuuccugaucaucaucggggaccagcaggacaagaucaucgccgucauggcgaaggagcccgagggcgccuccgggccgugguacacggaccgcaaguucaccaucagccugaccgccuuccucuucauccugccccuguccaucccccgggagaucggcuuccagaaguacgccagcuuccucuccguggugggcaccugguacgucacggccaucgugaucaucaaguacaucuggcccgacaaggagaugaccccggggaacauccugacccgccccgcgagcuggauggccguguucaacgccaugcccaccaucugcuucggcuuccagugccacgucuccagcgugcccguguucaacuccaugcagcagccggaggucaagacguggggcggcguggugaccgccgccauggucaucgcgcuggccguguacauggggaccggcaucugcggcuuccucaccuucggggccgccgucgaccccgacgugcugcugagcuaccccagcgaggacauggcgguggccgucgcccgggccuucaucauccucuccgugcugacgagcuaccccauccugcacuucugcggccgcgccguggucgaggggcucuggcugcgguaccagggcgugccgguggaggaggacgucgggcgcgagcggcgccggcgcgugcugcagacccucgugugguuccugcugacccuccugcuggcccucuucauccccgacaucggcaaggucaucuccgugaucggcgggcuggcggccugcuucaucuucguguuccccggccugugccucauccaggccaagcugagcgagauggaggaggucaagcccgccuccuggugggugcuggugagcuacgggguccuccuggugacccugggcgcguucaucuucgggcagacgaccgccaacgccaucuucguggaccuccuggccuga

SEQ ID NO: 36631 - RNA, 1308 nt, Artificial Sequence
  derived and/or modified sequence opt1 from SLC38A8__Homo_sapiens__NP_001073911
auggagggccagacccccgggagccgcggccugccggagaagccccaccccgccaccgccgcggccacgcucuccagcaugggggccguguucauccugaugaaguccgcccugggcgccgggcuccugaacuuccccugggcguucagcaaggccggcggcgucgugccggccuuccugguggagcucgucucccugguguuccugaucagcgggcucgugauccugggcuacgccgcggccgucuccgggcaggccaccuaccagggcguggugcgggggcugugcggccccgccaucggcaagcucugcgaggccugcuuccugcugaaccuccugaugaucagcgucgcguuccugcgcgugaucggggaccagcucgagaagcugugcgacucccugcucagcggcaccccgcccgcgccccagcccugguacgccgaccagcgguucacccugccccugcucuccgugcuggucauccugccccucagcgccccgcgcgagaucgccuuccagaaguacacguccauccuggggacccuggccgccugcuaccucgcccuggugaucaccgugcaguacuaccuguggccccagggccucguccgggagagccaccccucccugagccccgccuccuggaccagcguguucuccguguucccgacgaucugcuucggcuuccagugccacgaggccgcggucagcaucuacugcagcaugcgcaagcggucccugagccacugggcccucguguccgugcugagccugcucgccugcugccugaucuacucccugaccggggucuacggcuuccucaccuucgggaccgaggugagcgccgacgugcugauguccuaccccggcaacgacauggucaucaucguggcccgcguccuguucgcggugagcaucgugacggucuaccccaucguccucuuccuggggcgguccgugaugcaggacuucuggcgccggagcugccugggcggcugggggcccuccgcccucgccgacccgagcggccugugggugcgcaugccccugaccauccugugggugaccgugacccucgccauggcgcuguucaugcccgaccuguccgagaucgucagcaucaucgggggcaucuccagcuucuucaucuucaucuuccccgggcucugccugaucugcgccaugggcguggagccgaucggcccccgggugaagugcugccuggaggucuggggcgugguguccguccucguggggacguucaucuucgggcagagcaccgccgccgccgugugggagauguucuga

SEQ ID NO: 36632 - RNA, 1497 nt, Artificial Sequence
  derived and/or modified sequence opt1 from SLC38A9__Homo_sapiens__NP_001245215
augaacaagcgcauccacuacuacagccggcugaccacccccgccgacaaggcccucaucgcgccggaccacgugguccccgcccccgaggagugcuacguguacagcccccugggcuccgccuacaagcugcaguccuacacggagggguacggcaagaacaccagccucgugaccaucuucaugaucuggaacaccaugauggggacguccauccugagcaucccguggggcaucaagcaggccggguucaccaccggcaugugcgucaucauccugaugggccuccugacccuguacugcugcuaccgcguggugaagucccggacgaugauguucagccucgacaccaccuccugggaguaccccgacgucugccgccacuacuucgggagcuucggccagugguccagccugcuguucucccucgugagccugaucggggccaugaucguguacuggguccugauguccaacuuccucuucaacaccggcaaguucaucuucaacuucauccaccacaucaacgacacggacaccauccugagcaccaacaacuccaaccccgugaucugccccagcgcgggguccggcggccacccggacaacagcagcaugaucuucuacgccaacgacaccggggcccagcaguucgagaaguggugggacaagucccggacggugcccuucuaccuggucggccuccugcugccccuccugaacuucaagagccccuccuucuucagcaaguucaacauccuggggaccguguccgugcucuaccugaucuuccuggucaccuucaaggccgugcgccucggcuuccaccuggaguuccacugguucaucccgaccgaguucuucgugcccgagauccgguuccaguucccccagcugacgggcguccucacccuggcguucuucauccacaacugcaucaucacccugcucaagaacaacaagaagcaggagaacaacgugcgcgaccugugcaucgccuacaugcuggugacccucacguaccuguacaucgggguccugguguucgccagcuuccccuccccgccccucagcaaggacugcaucgagcagaacuuccuggacaacuuccccuccagcgacacccuguccuucaucgcccggaucuuccuccuguuccagaugaugaccguguacccccugcucggcuaccuggcccgcguccagcugcucgggcacaucuucggcgacaucuacccgagcaucuuccacgugcugauccugaaccugaucaucgucggggcgggcgugaucauggccugcuucuaccccaacaucggcgggaucauccgguacuccggcgccgccugcgggcucgccuucguguucaucuaccccagccugaucuacaucaucucccugcaccaggaggagcgccucaccuggcccaagcugaucuuccacgucuucaucaucauccugggcguggcgaaccucaucgugcaguucuucauguga

SEQ ID NO: 36633 - RNA, 2496 nt, Artificial Sequence
  derived and/or modified sequence opt1 from SLC39A10__Homo_sapiens__NP_001120729
augaaggugcacaugcacaccaaguucugccugaucugccuccugaccuucaucuuccaccacugcaaccacugccacgaggagcacgaccacggccccgaggcccugcaccgccagcaccgggggaugacggagcucgagccgagcaaguucuccaagcaggccgcggagaacgagaagaaguacuacaucgagaagcuguucgagcgcuacggcgagaacgggcggcugagcuucuucggccucgagaagcugcugaccaaccucgggcugggcgagcgcaaggucguggagaucaaccacgaggaccugggccacgaccacgugucccaccucgacauccuggccguccaggaggggaagcacuuccacagccacaaccaccagcacucccacaaccaccugaacagcgagaaccagaccgugaccuccgugagcacgaagcggaaccacaagugcgaccccgagaaggagaccgucgagguguccgucaagagcgacgacaagcacaugcacgaccacaaccaccgccuccggcaccaccaccgccugcaccaccaccuggaccacaacaacacccaccacuuccacaacgacuccaucacccccagcgagcggggcgagcccuccaacgagccgagcacggagaccaacaagacccaggagcaguccgacgugaagcuccccaaggggaagcgcaagaagaagggccgcaagagcaacgagaacuccgaggugaucacccccggguucccgcccaaccacgaccagggcgagcaguacgagcacaaccgggugcacaagcccgaccggguccacaaccccggccacagccacgugcaccuccccgagcgcaacgggcacgacccgggccgggggcaccaggaccuggaccccgacaacgagggcgagcugcgccacacgcggaagcgcgaggcgccccacgugaagaacaacgccaucaucucccugcggaaggaccugaacgaggacgaccaccaccacgagugccucaacgucacccagcugcugaaguacuacggccacggggccaacagccccaucagcaccgaccucuucaccuaccugugcccggcccugcucuaccagaucgacucccgccugugcaucgagcacuucgacaagcugcucguggaggacaucaacaaggacaagaaccuggugcccgaggacgaggccaacaucggcgccagcgccuggaucugcgggaucaucuccaucacggucaucagccugcucucccugcugggcgugauccucgugcccaucaucaaccaggggugcuucaaguuccugcugaccuuccucgucgcgcuggccgugggcaccaugagcggcgacgcccugcuccaccuccugccccacucccagggcgggcacgaccacagccaccagcacgcccacgggcacggccacucccacgggcacgagagcaacaaguuccuggaggaguacgacgccgugcugaagggccuggucgcgcugggcgggaucuaccuccuguucaucaucgagcacugcauccggauguucaagcacuacaagcagcagcgcggcaagcagaagugguucaugaagcagaacaccgaggaguccacgaucgggcgcaagcugagcgaccacaagcucaacaacaccccggacuccgacuggcugcagcugaagccccucgccggcaccgacgacagcguggucuccgaggaccggcugaacgagaccgagcugacggaccucgaggggcagcaggagagcccgcccaagaacuaccugugcaucgaggaggagaagaucaucgaccacucccacagcgacggccugcacaccauccacgagcacgaccuccacgccgccgcccacaaccaccacggcgagaacaagaccgugcugcgcaagcacaaccaccaguggcaccacaagcacucccaccacagccacgggcccugccacagcggcuccgaccugaaggagaccgggaucgcgaacaucgccuggauggugaucaugggcgacggcauccacaacuucagcgacgggcucgccaucggcgccgccuucuccgcggggcugacgggcgggaucagcaccuccaucgccgucuucugccacgagcugccccacgagcucggcgacuucgccgugcugcugaaggccggcaugaccgugaagcaggccaucgucuacaaccuccugagcgcgaugauggccuacaucgggaugcugaucggcaccgccguggggcaguacgccaacaacaucacgcucuggaucuucgcggugaccgccggcauguuccuguacgucgcccugguggacaugcuccccgagaugcugcacggggacggcgacaacgaggagcacggcuucugccccguggggcaguucauccugcagaaccucggccugcuguucggguucgccaucaugcucgucaucgcccuguacgaggacaagaucguguucgacauccaguucuga

SEQ ID NO: 36634 - RNA, 1029 nt, Artificial Sequence
  derived and/or modified sequence opt1 from SLC39A11__Homo_sapiens__NP_001153242
augcugcagggccacagcuccguguuccaggcccuccuggggaccuucuucaccuggggcaugacggccgcgggggccgcccuggucuucguguucagcuccggccagcgccggauccucgacgggagccugggcuucgccgccggcgugaugcuggcggccuccuacuggagccuccuggcccccgccgucgagauggcgaccuccagcgggggcuucggggccuucgccuucuucccgguggccgugggcuucacccugggggccgcguucgucuaccucgccgaccugcugaugccccaccucggcgccgccgaggacccccagaccacgcuggcccugaacuucggcuccacccucaugaagaagaaguccgaccccgaggggccggcgcugcuguuccccgagagcgagcucagcauccgcaucggccgggccgggcugcuguccgacaagagcgagaacggcgaggccuaccagcgcaagaaggccgccgcgaccggccuccccgaggggcccgccgugccggugcccucccggggcaaccuggcccagcccgggggcagcuccuggcgccggaucgcccugcucauccuggccaucaccauccacaacguccccgaggggcuggcggugggcgugggcuucggggccaucgagaagacggccagcgccaccuucgaguccgcgcgcaaccucgccaucggcaucgggauccagaacuucccggagggccuggccgucagccugccccuccgcggggccggcuucagcaccuggcgggccuucugguacggccagcuguccgggaugguggagccccuggcgggcguguucggggccuucgccgucgugcucgccgagcccauccugccguacgcccuggcguucgccgccggcgccaugguguacgucgugauggacgacaucauccccgaggcccagaucagcgggaacggcaagcucgcguccugggccagcauccugggcuucguggucaugaugucccuggacguggggcucggcuga

SEQ ID NO: 36635 - RNA, 2076 nt, Artificial Sequence
  derived and/or modified sequence opt1 from SLC39A12__Homo_sapiens__NP_001138667
augugcuuccgcaccaagcugagcguguccugggucccccucuuccugcugcucagccggguguucuccaccgagacggacaagccgagcgcccaggacucccgcagccggggcuccagcgggcagcccgccgaccugcuccaggugcuguccgcgggcgaccacccgccccacaaccacagccgcucccugaucaagacccugcucgagaagaccgggugcccccggcgccggaacggcaugcagggggacugcaaccugugcuucgagcccgacgcccugcuccugaucgccggcggcaacuucgaggaccagcugcgcgaggaggucgugcagcgggugagccuccugcugcucuacuacaucauccaccaggaggagaucugcuccagcaagcugaacauguccaacaaggaguacaaguucuaccugcacagccuccugucccugcgccaggacgaggacagcuccuuccucagccagaacgagaccgaggacauccuggccuucacgcggcaguacuucgacaccagccagucccagugcauggagaccaagacccugcagaagaaguccgggaucgucagcagcgagggcgccaacgaguccacgcucccccagcuggcggccaugaucaucacccugagccuccagggggugugccugggccaggggaaccugcccuccccggacuacuucaccgaguacaucuucagcucccucaaccgcaccaacacgcugcggcugagcgagcucgaccagcugcugaacacccucuggacccgcuccacgugcaucaagaacgagaagauccaccaguuccagcggaagcagaacaacaucaucacccacgaccaggacuacagcaacuucuccagcuccauggagaaggagagcgaggacggccccguguccugggaccagaccugcuucagcgcccgccagcuggucgagaucuuccugcagaagggccucucccugaucagcaaggaggacuucaagcagaugagccccgggaucauccagcagcugcucuccugcagcugccaccuccccaaggaccagcaggccaagcugccgcccaccacccuggagaaguacggcuacuccacgguggcggugacccugcugacccuggggagcaugcucggcaccgcccugguccuguuccacuccugcgaggagaacuaccggcucauccugcagcuguucgugggccucgccguggggacgcugagcggcgacgcccugcuccaccugaucccccagguccuggggcuccacaagcaggaggcccccgaguucggccacuuccacgaguccaaggggcacaucuggaagcugaugggccugaucggcgggauccacggcuucuuccucaucgagaagugcuucauccugcuggugagcccgaacgacaagcaggggcucucccuggugaacggccacgucgggcacagccaccaccuggcgcucaacuccgagcugagcgaccaggccggccgcggcaaguccgccagcaccauccagcugaagucccccgaggacagccaggccgccgagaugcccaucggguccaugaccgcgagcaaccggaagugcaaggccaucagccuccuggccaucaugauccuggugggcgacucccuccacaacuucgccgacgggcuggccaucggcgcggccuucagcuccagcuccgagagcggggugaccacgaccaucgccauccugugccacgagaucccccacgagaugggcgacuucgccguccuccuguccagcggccuguccaugaagaccgccauccucaugaacuucaucagcucccugaccgcguucauggggcuguacaucggccucagcguguccgccgacccgugcgugcaggacuggaucuucacggucaccgccgggauguuccuguaccugagccucguggagaugcugcccgagaugacccacguccagacccagcgccccuggaugauguuccugcuccagaacuucggccugauccugggcuggcucucccugcugcuccuggccaucuacgagcagaacaucaagaucuga

SEQ ID NO: 36636 - RNA, 1116 nt, Artificial Sequence
  derived and/or modified sequence opt1 from SLC39A13__Homo_sapiens__NP_001121697
augcccggcugcccgugccccgggugcggcauggccgggccccgccugcuguuccugaccgcccuggcgcucgagcugcugggccgggccgggggcagccagcccgcccuccgcucccggggcaccgccacggccugccgccuggacaacaaggagagcgaguccuggggcgcgcugcucagcggggagcggcuggacaccuggaucugcucccugcucgggagccugauggugggccuguccggggucuucccgcuccuggugaucccccuggagaugggcaccaugcuccgcagcgaggccggcgccuggcggcugaagcagcugcucuccuucgcccucgggggccugcucgggaacguguuccugcaccuccugcccgaggcgugggccuacacgugcagcgccucccccggcggcgaggggcagagccugcagcagcagcagcagcugggccucugggucaucgccgggauccugaccuuccuggcccucgagaagauguuccuggacuccaaggaggagggcaccagccaggcgccgaacaaggaccccaccgccgccgccgccgcgcugaacgggggccacugccucgcccagcccgccgccgagcccggccugggggccguggugcgcuccaucaaggucagcggcuaccugaaccuccuggcgaacaccaucgacaacuucacgcacgggcuggccguggccgccuccuuccucgugagcaagaagaucggccugcugaccaccauggccauccuccugcacgagaucccgcacgaggucggggacuucgcgauccugcuccgggccggcuucgaccgcugguccgccgccaagcugcagcugagcaccgcgcugggcgggcuccugggcgccggguucgccaucugcacgcagagccccaagggcgugguggggugcucccccgccgccgaggagaccgcggccuggguccugcccuucaccagcggcggcuuccucuacaucgcccuggugaacgugcugccggaccuccuggaggaggaggaccccuggcggucccugcagcagcuccugcugcucugcgccgggaucgucgugauggugcuguucagccuguucgucgacuga

SEQ ID NO: 36637 - RNA, 1479 nt, Artificial Sequence
  derived and/or modified sequence opt1 from SLC39A14__Homo_sapiens__NP_001121903
augaagcugcuccugcugcaccccgccuuccagagcugccuccugcugacccuccugggccuguggcgcaccacgccggaggcccacgcguccagccucggggcccccgccaucuccgccgccagcuuccugcaggaccugauccaccgguacggcgagggggacucccucacccugcagcagcugaaggcgcuccugaaccaccuggacgugggcgucgggcgcggcaacgugacccagcacgugcagggccaccggaaccucagcacgugcuucuccagcggggaccuguucaccgcccacaacuucuccgagcagagccgcaucggcuccagcgagcugcaggaguucugccccaccauccuccagcagcuggacucccgggccugcaccagcgagaaccaggagaacgaggagaacgagcagaccgaggaggggcgccccuccgccgucgagguguggggcuacgggcugcucugcgugacggucaucagccugugcucccugcucggcgcgagcguggugccguucaugaagaagaccuucuacaagcggcugcugcucuacuucaucgcccuggccaucggcacccuguacuccaacgcccucuuccagcugauccccgaggccuucggguucaacccccuggaggacuacuacgucagcaagagcgcggugguguucggcggguucuaccucuucuucuucaccgagaagauccugaagauccugcucaagcagaagaacgagcaccaccacggccacucccacuacgccagcgagucccugcccagcaagaaggaccaggaggagggcgucauggagaagcugcagaacggggaccucgaccacaugaucccgcagcacugcuccagcgagcuggacggcaaggcccccaugguggacgagaaggugaucgucgggucccugagcgugcaggaccuccaggccucccagagcgccugcuacuggcugaagggcgugcgcuacuccgacaucgggacgcuggcguggaugaucacccucagcgacggccugcacaacuucaucgacggccuggccaucggggccuccuucaccgucagcguguuccagggcaucuccaccagcguggccauccugugcgaggaguucccccacgagcucggggacuucgucauccugcugaacgccggcauguccauccagcaggcccucuucuucaacuuccugagcgcgugcugcugcuaccuggggcucgccuucggcauccuggccggcucccacuucagcgccaacuggaucuucgcgcuggccgggggcauguuccucuacaucagccuggccgacauguuccccgagaugaacgaggugugccaggaggacgagcggaagggguccauccugaucccguucaucauccagaaccucggccugcugacgggguucaccaucauggugguccucaccauguacagcggccagauccagaucggcuga

SEQ ID NO: 36638 - RNA, 975 nt, Artificial Sequence
  derived and/or modified sequence opt1 from SLC39A1__Homo_sapiens__NP_001258888
augggccccuggggcgagccggagcugcucguguggcgccccgaggccgucgccagcgagccgcccgugcccguggggcuggaggucaagcugggggcgcucgugcugcugcucgugcugacccugcucugcucccugguccccaucugcgugcugcggcgccccggcgccaaccacgaggggagcgccucccggcagaaggcccucagccugguguccugcuucgccggcggcgucuuccuggcgaccugccuccuggaccugcuccccgacuaccuggccgccaucgacgaggcccuggcggcccuccacgugacgcugcaguucccgcugcaggaguucauccucgccaugggguucuuccuggugcuggucauggagcagaucacccucgccuacaaggagcagagcggccccagcccccuggaggagacccgcgcccugcucgggaccgugaacggcgggccccagcacuggcacgacggcccgggcgugccccaggcguccggggcccccgccacgcccuccgcccugcgggccugcguccugguguucagccucgcgcugcacuccguguucgagggccuggccgucgggcuccagcgcgaccgggcccgcgccauggagcugugccuggcccuccugcugcacaagggcauccucgcggugagccugucccugcggcuccugcagagccaccuccgcgcccagguggucgccggcugcgggauccuguucuccugcaugaccccgcugggcaucgggcugggcgccgcccuggcggagagcgccgggccccuccaccagcuggcccaguccgugcuggagggcauggccgcgggcaccuuccucuacaucaccuuccuggagauccugccccaggagcucgccagcuccgagcagcggauccugaaggugauccugcuccuggccggguucgcccugcucacgggccugcuguucauccagaucuga

SEQ ID NO: 36639 - RNA, 930 nt, Artificial Sequence
  derived and/or modified sequence opt1 from SLC39A2__Homo_sapiens__NP_055394
auggagcagcugcucggcaucaagcuggggugccuguucgcccuccuggcccugacccucggcugcgggcugacccccaucugcuucaagugguuccagaucgacgcggcccgcggccaccaccggcuggugcuccgccugcuggggugcaucagcgccggcgucuuccucggcgccggguucaugcacaugacggccgaggcgcuggaggagaucgagucccagauccagaaguucauggugcagaaccggagcgccuccgagcgcaacagcuccggcgacgccgacagcgcccacauggaguacccguacggggagcugaucaucucccucggcuucuucuucguguucuuccuggagagccuggcgcuccagugcugccccggggccgccggcggcuccaccguccaggacgaggaguggggcggggcccacaucuucgagcugcacagccacgggcaccuccccucccccagcaagggcccgcugcgggcccuggugcugcuccugucccugagcuuccacuccguguucgagggccucgcggucgggcugcagcccaccguggccgccaccgugcagcugugccucgccguccuggcccacaagggccuggugguguucggggucggcaugcgccucgugcaccuggggacgagcucccggugggcgguguucagcauccugcuccuggcccugaugagcccccucggccuggccgucggccuggccgugaccgggggcgacuccgagggcgggcgcgggcucgcccaggcggugcuggagggcgucgccgccggcaccuuccuguacgugaccuuccucgagauccugccccgggagcuggccagcccggaggcgccccucgccaagugguccugcguggccgccggguucgccuucauggcguucaucgcccugugggccuga

SEQ ID NO: 36640 - RNA, 945 nt, Artificial Sequence
  derived and/or modified sequence opt1 from SLC39A3__Homo_sapiens__NP_653165
auggugaagcugcucgucgccaagauccugugcauggugggcguguucuucuucaugcugcucgggagccugcugcccgucaagaucaucgagaccgacuucgagaaggcccaccgcuccaagaagauccucagccugugcaacaccuucggcgggggcguguuccuggcgacgugcuucaacgcccuccugccggccgugcgggagaagcugcagaagguccucucccuggggcacaucagcaccgacuacccccuggccgagaccauccuccugcugggcuucuucaugaccguguuccucgagcagcugauccugacguuccgcaaggagaagcccuccuucaucgaccucgagaccuucaacgccggcagcgacgugggguccgacagcgaguacgagucccccuucaugggcggggcgcggggccacgcccuguacgucgagccgcacgggcacggccccagccuguccgugcagggccucagccgcgccucccccgugcggcugcugagccucgccuucgcgcuguccgcccacagcgucuucgaggggcuggcccucggccugcaggaggagggggagaagguggugucccuguucgucggcguggccgugcacgagacccucgucgccguggcgcugggcaucagcauggcccgcuccgccaugccccugcgggacgccgccaagcucgcggugaccgucagcgccaugaucccgcuggggaucggccuggggcucggcaucgagagcgcccagggggugcccggcuccguggccagcguccugcugcagggccucgccgggggcacguuccuguucaucaccuuccuggagauccucgcgaaggagcuggaggagaaguccgaccgccugcucaaggugcuguuccugguccugggguacaccgugcucgccggcaugguguuccugaagugguga

SEQ ID NO: 36641 - RNA, 1869 nt, Artificial Sequence
  derived and/or modified sequence opt1 from SLC39A4__Homo_sapiens__NP_060237
augguggacgucgugggccuggagcgcgagaccgggccccggggcagcccguggcccgggcucccccugcccucccuggugggcccggcgccccuccugaccugccugugcccccagugccucagcgucgaggacgcccuggggcugggcgagcccgagggcuccgggcucccgcccggccccgugcuggaggcccgcuacguggcccggcugagcgccgccgccguccucuaccuguccaaccccgaggggacgugcgaggacgcgcgcgccggccugugggccagccacgccgaccaccuccuggcgcugcucgaguccccgaaggcccugacccccgggcugagcuggcuccugcagcggaugcaggcccgcgccgccggccagacccccaagaccgcgugcguggacaucccccagcugcucgaggaggccgugggcgccggggccccgggcuccgccgggggcguccuggcggcccugcucgaccacgugcggagcggcuccugcuuccacgcccugcccagcccccaguacuucguggacuucgucuuccagcagcacuccagcgaggugcccaugacgcuggccgagcucuccgcccugaugcagcgccugggggugggccgggaggcgcacagcgaccacucccaccgccaccgcggggccagcucccgggacccggucccccucaucagcagcuccaacagcuccagcgugugggacaccgugugccuguccgcccgggacgucauggccgccuacggccugagcgagcaggcgggggugacccccgaggccugggcccagcucucccccgcccugcugcagcagcagcucagcggcgcgugcaccucccagagccgcccgcccgugcaggaccagcugucccagagcgagcgguaccuguacggcucccucgccacgcugcugaucugccucugcgccgucuucgggcugcugcuccugaccugcaccggcugccgcggggugacccacuacauccugcagacguuccugagccucgccgugggcgcccugaccggggacgcgguccugcaccucacccccaaggugcugggccugcacacccacuccgaggagggccucagcccccagccgacguggcggcugcuggccaugcucgccgggcuguacgccuucuuccuguucgagaaccucuucaaccugcugcucccccgcgaccccgaggaccuggaggacggcccgugcgggcacuccagccacucccacggcgggcacagccacggcgucagccugcagcucgcccccuccgagcugcggcagcccaagcccccgcacgagggcagccgcgcggaccugguggccgaggagucccccgagcuccugaaccccgagccccggcgccugagcccggagcuccgccugcugcccuacaugaucacccucggggacgccgugcacaacuucgccgacggccuggccgucggggcggccuucgccuccagcuggaagaccggccuggccaccucccucgcgguguucugccacgagcugccccacgagcugggcgacuucgccgcccuccugcacgccgggcugagcgugcggcaggcccuccugcugaaccucgcguccgcccugacggccuucgccggccuguacgucgcccucgcggugggggugagcgaggaguccgaggccuggauccuggccgucgccaccggccuguuccucuacguggcccugugcgacaugcugcccgcgaugcucaaggugcgcgacccgcggcccuggcugcuguuccuccugcacaacgucgggcugcucggcggcuggaccgugcugcugcuccugagccuguacgaggacgacaucaccuucuga

SEQ ID NO: 36642 - RNA, 1302 nt, Artificial Sequence
  derived and/or modified sequence opt1 from SLC39A6__Homo_sapiens__NP_001092876
augggcauccaggugccccugaacgccaccgaguucaacuaccucugcccggccaucaucaaccagaucgacgcgcgcagcugccugauccacaccuccgagaagaaggccgagaucccgcccaagacguacagccugcagaucgccugggucgggggcuucaucgccaucuccaucaucagcuuccucucccugcugggggugauccucgugccccugaugaaccgggucuucuucaaguuccugcucagcuuccugguggcccuggcggugggcacccucuccggggacgccuuccugcaccuccugccccacagccacgccucccaccaccacagccacucccacgaggagcccgccauggagaugaagcgcggcccccuguucagccaccuguccagccagaacaucgaggaguccgcguacuucgacagcaccuggaagggccucaccgcccucgggggccuguacuucauguuccuggucgagcacgugcugacgcugaucaagcaguucaaggacaagaagaagaagaaccagaagaagcccgagaacgacgacgacguggagaucaagaagcagcucuccaaguacgagagccagcuguccaccaacgaggagaaggucgacaccgacgaccggaccgagggguaccugcgcgccgacagccaggagccgagccacuucgacucccagcagcccgccgugcucgaggaggaggaggugaugaucgcccacgcgcacccccaggaggucuacaacgaguacgugccccggggcugcaagaacaagugccacagccacuuccacgacacgcuggggcaguccgacgaccugauccaccaccaccacgacuaccaccacauccuccaccaccaccaccaccagaaccaccacccgcacagccacucccagcgcuacagccgggaggagcugaaggacgccggcguggccacccuggccuggauggucaucaugggcgacgggcuccacaacuucuccgacggccuggccaucggggcggccuucaccgagggccugagcuccggccucagcaccuccguggccguguucugccacgagcugccccacgagcugggggacuucgccguccuccugaaggccggcaugacggugaagcaggcggugcuguacaacgcccucagcgccaugcuggccuaccuggggauggccaccggcaucuucaucgggcacuacgcggagaacgucuccauguggaucuucgcccucaccgccggccuguucauguacguggcccugguggacauggucagcuucuga

SEQ ID NO: 36643 - RNA, 1410 nt, Artificial Sequence
  derived and/or modified sequence opt1 from SLC39A7__Homo_sapiens__NP_001070984
auggcccgcggccugggggcgccccacuggguggccgucggccuccugaccugggccacccuggggcuccugguggccggccucgggggccacgacgaccugcacgacgaccugcaggaggacuuccacggccacagccaccggcacucccacgaggacuuccaccacgggcacagccacgcccacggccacgggcacacgcacgaguccaucuggcacggccacacccacgaccacgaccacgggcacagccacgaggaccugcaccacggccacucccacggcuacagccacgagucccucuaccaccgcgggcacggccacgaccacgagcacagccacgggggcuacggcgaguccggggccccgggcaucaagcaggaccuggacgcggugacccugugggccuacgcccucggggccaccguccugaucagcgcggcccccuucuucgugcuguuccucauccccguggaguccaacagcccccggcaccgcucccugcugcagauccuccugagcuucgccuccggcgggcugcucggcgacgccuuccugcaccugaucccgcacgcccucgagccccacagccaccacacgcuggagcagcccggccacgggcacucccacagcggccaggggcccauccuguccgucggccucugggugcugagcgggaucguggcguuccuggucguggagaaguucgugcggcacgucaagggcggccacgggcacagccacggccacgggcacgcccacucccacacccgcggcagccacgggcacggccggcaggagcgcuccaccaaggagaagcagagcuccgaggaggaggagaaggagacccggggcgugcagaagcgccgcgggggcagcacggugccgaaggacgggcccguccggccccagaacgccgaggaggagaagcggggccucgaccugcgcguguccggcuaccugaaccucgccgccgaccuggcgcacaacuucaccgacgggcuggccaucggcgccagcuuccgcgggggccgggggcucggcauccugaccaccaugacggugcugcuccacgaggucccccacgaggugggcgacuucgccauccuggugcaguccgggugcagcaagaagcaggccaugcggcugcagcuccugaccgcggucggcgcccuggccgggaccgccugcgcccuccugaccgagggcggggcggugggcuccgagaucgccggcggggccggcccggggugggugcugcccuucacggccggcggguucaucuacgucgcgaccgugagcguccuccccgagcugcugcgcgaggccagcccccugcagucccuccuggaggugcugggccuccugggcggggugaucaugaugguccugaucgcccaccucgaguga

SEQ ID NO: 36644 - RNA, 1383 nt, Artificial Sequence
  derived and/or modified sequence opt1 from SLC39A8__Homo_sapiens__NP_001128618
auggcccccggccgcgccguggcggggcugcuccugcuggccgccgccggccucgggggcgucgccgaggggccgggccuggcguucagcgaggacgugcuguccguguucggcgccaaccucagccuguccgccgcccagcugcagcaccuccuggagcagaugggggcggccagccgggucggcgugcccgagcccgggcagcugcacuucaaccagugccucaccgccgaggagaucuucucccugcacggcuucagcaacgccacccagaucacguccagcaaguucuccgugaucugccccgccguccugcagcagcucaacuuccacccgugcgaggaccgccccaagcacaagacccggcccagccacuccgagguguggggguacggcuuccugagcgugaccaucaucaaccuggcgucccuccugggccugauccucacgccccugaucaagaaguccuacuucccgaagauccugaccuucuucgucgggcucgccaucggcacccuguucagcaacgccaucuuccagcugauccccgaggccuucggguucgaccccaagguggacagcuacguggagaaggccgucgcgguguucggcggcuucuaccuccuguucuucuucgagcgcaugcugaagaugcuccugaagaccuacgggcagaacggccacacccacuucgggaacgacaacuucggcccccaggagaagacgcaccagccgaaggcccugcccgccaucaacggggugaccugcuacgccaaccccgccgucaccgaggcgaacggccacauccacuucgacaacguguccguggucagccuccaggacggcaagaaggagcccuccagcugcacgugccugaaggggccgaagcugagcgagaucggcaccaucgccuggaugaucacccucugcgacgcccugcacaacuucaucgacgggcuggccaucggcgccuccugcacccucagccugcugcaggggcucuccaccagcaucgcgauccugugcgaggaguucccccacgagcugggcgacuucgugauccuccugaacgccggcauguccacgcggcaggcccuccuguucaacuuccugagcgccugcuccugcuacguggggcuggcguucggcauccuggucgggaacaacuucgcccccaacaucaucuucgcccucgccggcgggauguuccuguacaucagccuggccgacauguuccccgagaugaacgacaugcuccgcgagaaggugaccggccggaagaccgacuucaccuucuucaugauccagaacgcgggcaugcugacgggguucaccgccauccugcucaucacccuguacgccggcgagaucgagcuggaguga

SEQ ID NO: 36645 - RNA, 699 nt, Artificial Sequence
  derived and/or modified sequence opt1 from SLC39A9__Homo_sapiens__NP_001239079
auggacgacuucaucagcaucucccugcucagccuggccaugcuggugggcugcuacgucgccgggaucaucccccucgcggugaacuucuccgaggagcgccugaagcuggugaccguccucggcgccgggcugcugugcggcaccgcccucgccgugaucgugccggaggggguccacgcccuguacgaggacauccuggagggcaagcaccaccaggcgagcgagacgcacaacgugaucgccuccgacaaggccgccgagaaguccgugguccacgagcacgagcacagccacgaccacacccagcuccacgcguacaucggcgugagccuggugcugggguucgucuucaugcuccugguggaccagaucggcaacucccacgugcacagcaccgacgaccccgaggccgcccgguccagcaacuccaagaucaccacgacccuggggcucgucgugcacgccgccgcggacggcguggcccugggggccgccgccagcaccucccagaccagcguccagcugaucguguucguggcgaucaugcuccacaaggcccccgccgccuucggccuggucuccuuccugaugcacgccggccucgagcgcaaccggauccgcaagcaccuccugguguucgcgcuggccgcccccgugaugagcauggucacguaccuggggcuguccaaggacuga

SEQ ID NO: 36646 - RNA, 2058 nt, Artificial Sequence
  derived and/or modified sequence opt1 from SLC3A1__Homo_sapiens__NP_000332
auggccgaggacaagagcaagcgcgacuccaucgagaugagcaugaagggcugccagaccaacaacggguucgugcacaacgaggacauccuggagcagacccccgacccgggcuccagcacggacaaccucaagcacuccacccgggggauccugggcagccaggagcccgacuucaaggggguccagcccuacgccggcaugcccaaggaggugcuguuccaguucuccggccaggcgcgcuaccggaucccgcgcgagauccucuucuggcugaccguggccagcguccuggugcucaucgccgccaccaucgccaucaucgcgcugucccccaagugccuggacugguggcaggaggggcccauguaccagaucuacccccggagcuucaaggacuccaacaaggacggcaacggggaccucaagggcauccaggacaagcuggacuacaucacggcccugaacaucaagaccguguggaucaccagcuucuacaaguccagccucaaggacuuccgcuacggggucgaggacuuccgggagguggacccgaucuucggcaccauggaggacuucgagaaccugguggccgccauccacgacaagggccugaagcucaucaucgacuucauccccaaccacacguccgacaagcacaucugguuccagcugagccgcacccggaccgggaaguacaccgacuacuacaucuggcacgacugcacgcacgagaacggcaagaccaucccgcccaacaacuggcuguccgucuacgggaacagcuccuggcacuucgacgaggugcgcaaccagugcuacuuccaccaguucaugaaggagcagcccgaccucaacuuccggaaccccgacgugcaggaggagaucaaggagauccugcgcuucuggcugaccaagggcgucgacggcuucagccucgacgcggugaaguuccugcuggaggccaagcaccuccgggacgagauccaggugaacaagacccagauccccgacacggucacccaguacagcgagcuguaccacgacuucaccaccacccagguggggaugcacgacaucgugcgcuccuuccggcagacgauggaccaguacagcaccgagcccggccgcuaccgguucauggggaccgaggccuacgccgaguccaucgaccgcacggucauguacuacggccugccguucauccaggaggccgacuuccccuucaacaacuaccucagcaugcuggacaccguguccgggaacagcguguacgaggucaucaccuccuggauggagaacaugcccgagggcaaguggcccaacuggaugaucggcgggccggacagcucccggcugaccagccgccucggcaaccaguacgugaacgugaugaacaugcugcuguucacgcuccccgggacccccaucaccuacuacggcgaggagaucgggaugggcaacaucgucgcggccaaccugaacgaguccuacgacaucaacacccugcggagcaagucccccaugcagugggacaacagcuccaacgccggcuucagcgaggccuccaacacguggcucccgaccaacagcgacuaccacaccgugaacgucgacgugcagaagacccagccccgcuccgcccugaagcuguaccaggaccucagccugcugcacgcgaacgagcuccugcugaaccgcgggugguucugccaccuccggaacgacagccacuacguggucuacacgcgcgagcuggacggcaucgaccggaucuucaucguggugcugaacuucggggaguccacccuccugaaccugcacaacaugaucagcggccugcccgccaagaugcgcauccggcucuccaccaacagcgccgacaagggguccaaggucgacaccagcggcaucuuccuggacaagggcgaggggcugaucuucgagcacaacaccaagaaccuccugcaccgccagacggccuuccgggaccgcugcuucguguccaaccgggccugcuacagcuccgugcugaacauccucuacaccagcugcuga

SEQ ID NO: 36647 - RNA, 1896 nt, Artificial Sequence
  derived and/or modified sequence opt1 from SLC3A2__Homo_sapiens__NP_001012680
auggagcugcagcccccggaggccagcaucgccguggucuccaucccccgccagcuccccggcagccacuccgaggcgggggugcagggccugagcgccggggacgacuccgagaccggcagcgacugcgugacccaggccgggcugcagcuccuggccuccagcgacccgcccgcccuggcguccaagaacgccgaggucacgguggagaccggcuuccaccacgugagccaggccgacaucgaguuccucaccuccaucgaccccaccgccagcgcguccggcagcgccgggaucacgggcaccaugucccaggacaccgaggucgacaugaaggagguggagcugaacgagcuggagcccgagaagcagcccaugaacgccgccagcggggccgcgaugucccucgccggcgccgagaagaacgggcuggugaagaucaaggucgccgaggacgaggccgaggcggccgccgccgccaaguucaccggccugagcaaggaggagcuccugaagguggcgggcuccccggggugggugcggacgcgcugggcccugcuccugcuguucuggcucggcuggcuggggaugcuggccggcgccgucgugaucaucgugcgggcgccccgcugccgggagcuccccgcccagaagugguggcacaccggcgcccuguaccgcaucggggaccugcaggccuuccagggccacggggccggcaaccucgcggggcugaagggccggcuggacuaccucagcagccugaaggucaagggccuggugcucgggcccauccacaagaaccagaaggacgacguggcccagaccgaccugcugcagaucgacccgaacuucggcuccaaggaggacuucgacagccuccugcaguccgccaagaagaaguccauccgcgucauccuggaccucacccccaacuaccgcggggagaacuccugguucagcacccagguggacacgguggccaccaaggucaaggacgcccuggaguucuggcugcaggcgggcguggacggguuccaggugcgggacaucgagaaccucaaggacgccuccagcuuccuggccgaguggcagaacaucaccaagggcuucuccgaggaccggcugcucaucgccggcacgaacagcuccgaccugcagcagauccugagccuccuggaguccaacaaggaccugcuccugaccagcuccuaccugagcgacuccgggagcaccggcgagcacaccaagucccuggucacgcaguaccucaacgccaccgggaaccgcuggugcagcuggagccugucccaggcgcggcugcucaccagcuuccugcccgcccagcugcuccgccuguaccagcugaugcuguucacccuccccggcacgccgguguucuccuacggggacgagaucggccuggacgccgccgcccuccccggccagcccauggaggcgcccgucaugcugugggacgagagcuccuucccggacauccccggggccgugagcgccaacaugaccgugaagggccaguccgaggaccccgggagccugcucucccuguuccggcgccugagcgaccagcgguccaaggagcgcagccuccugcacggcgacuuccacgccuucuccgcgggccccgggcuguucagcuacauccggcacugggaccagaacgagcgcuuccucgucgugcugaacuucggcgacguggggcuguccgccggccuccaggccagcgaccugccggccuccgccagccugcccgcgaaggccgaccuccugcugagcacccagcccgggcgggaggagggcagcccccucgagcuggagcgccugaagcucgagccgcacgagggccugcugcuccgcuuccccuacgccgccuga

SEQ ID NO: 36648 - RNA, 1716 nt, Artificial Sequence
  derived and/or modified sequence opt1 from SLC40A1__Homo_sapiens__NP_055400
augacccgcgccggcgaccacaaccggcagcgcgggugcugcggcagccuggccgacuaccucaccuccgcgaaguuccugcuguaccucgggcacagccuguccacguggggcgaccggauguggcacuucgccgugagcgucuuccugguggagcucuacgggaacucccugcugcucaccgccguguacggccuggucguggccggcagcgugcugguccucggggccaucaucggcgacuggguggacaagaacgcgcgccugaagguggcccagaccucccuggucgugcagaacgugagcgucauccucugcgggaucauccugaugaugguguuccugcacaagcacgagcuccugaccauguaccacggcugggugcugacguccugcuacauccucaucaucaccaucgccaacaucgccaaccuggcgagcaccgccaccgccaucacgauccagcgggacuggaucgucgugguggccggggaggaccgcuccaagcuggccaacaugaacgcgaccauccggcgcaucgaccagcucaccaacauccuggcccccauggccgucggccagaucaugaccuucggcagcccggugaucgggugcggcuucaucuccggguggaaccuggugagcaugugcgucgaguacgugcuccuguggaagguguaccagaagacgcccgcccuggccgucaaggcgggccucaaggaggaggagaccgagcugaagcagcugaaccuccacaaggacaccgagcccaagccccuggagggcacccaccugaugggggugaaggacuccaacauccacgagcucgagcacgagcaggagccgacgugcgccagccagauggccgagcccuuccggaccuuccgcgacggcugggucuccuacuacaaccagcccguguuccuggccgggaugggccuggccuuccucuacaugaccgugcugggguucgacugcaucaccacgggcuacgcguacacccagggccugagcggguccauccucagcauccugaugggcgccagcgccaucaccgggaucaugggcaccgucgccuucacguggcugcggcgcaagugcgggcucgugcggaccggccugaucuccggccuggcccagcucagcugccugauccugugcgugaucuccgucuucaugcccgggagcccgcuggaccucuccgugagccccuucgaggacauccgcucccgguucauccagggcgagagcaucacccccaccaagauccccgagaucacgaccgagaucuacauguccaacgggagcaacuccgcgaacaucgugccggagaccagccccgaguccguccccaucaucagcgugucccugcuguucgccggcgugaucgccgcccgcaucgggcucuggagcuucgaccugaccgucacgcagcugcuccaggagaacgugaucgaguccgagcggggcaucaucaacggcgugcagaacagcaugaacuaccugcuggaccuccugcacuucaucauggucauccuggcgcccaacccggaggccuucgggcuccuggugcugaucuccgugagcuucgucgccaugggccacaucauguacuuccgcuucgcccagaacacccucgggaacaagcuguucgccugcggccccgacgcgaaggaggugcggaaggagaaccaggccaacaccagcguggucuga

SEQ ID NO: 36649 - RNA, 1542 nt, Artificial Sequence
  derived and/or modified sequence opt1 from SLC41A1__Homo_sapiens__XP_005245126
augagcuccaagcccgagccgaaggacgugcaccagcugaacggcaccgggcccagcgccucccccugcagcuccgacggccccgggcgcgagccgcucgccggcaccagcgaguuccuggggcccgacggcgcgggcgucgagguggugaucgagucccgggccaacgccaaggggguccgcgaggaggacgcccugcucgagaacggcagccaguccaacgagagcgacgacguguccacggaccgggggcccgcgcccccgagcccccugaaggagaccuccuucagcaucggccugcagguccucuuccccuuccugcuggccggguucggcaccguggccgccggcauggugcucgacaucgugcagcacugggaggucuuccagaaggugaccgagguguucauccugguccccgcccugcucgggcugaagggcaaccuggagaugacgcucgcgucccgccugagcaccgccgccaacaucgggcacauggacaccccgaaggagcuguggcggaugaucaccggcaacauggcccucauccaggugcaggccacgguggucggcuuccuggcguccaucgccgccgugguguucggguggauccccgacggccacuucagcaucccccacgccuuccugcucugcgccuccagcgucgcgaccgccuucaucgccagccuggugcuggggaugaucaugaucggcgugaucaucgggucccgcaagaucggcaucaaccccgacaacgucgccaccccgaucgccgcgagccucggcgaccugaucacccuggcccuccuguccgggaucagcuggggccuguaccucgagcugaaccacuggcgguacaucuacccccuggugugcgccuucuucguggcccuccugcccgucugggugguccuggcccgccggucccccgcgacgcgcgaggugcucuacagcgggugggagccggugaucaucgccauggccaucuccagcgucggcgggcugauccuggacaagaccguguccgaccccaacuucgccggcauggcgguguucacccccgucaucaacggcgucgggggcaaccucguggccgugcaggccagccggaucuccaccuuccugcacaugaacgggaugcccggcgagaacagcgagcaggccccgcgccggugccccucccccugcacgaccuucuucagccccgacgugaacucccgcagcgcccgggugcuguuccuccuggucgugccggggcaccugguguuccucuacaccaucuccugcaugcagggcggccacaccacgcugacccugaucuucaucaucuucuacaugaccgcggcccuccugcagguccugauccugcucuacaucgccgacuggauggugcacuggaugugggggcgcggccuggaccccgacaacuucagcauccccuaccugaccgcccucggggaccugcugggcacgggccuccuggcccuguccuuccacgugcucuggcugaucggggaccgggacaccgacgucggcgacuga

SEQ ID NO: 36650 - RNA, 1680 nt, Artificial Sequence
  derived and/or modified sequence opt1 from SLC43A1__Homo_sapiens__NP_001185739
auggcccccacccugcagcaggccuaccgccggcgcugguggauggcgugcaccgccgugcucgagaaccuguucuucagcgccguccugcucggcugggggucccugcugaucauccucaagaacgagggcuucuacagcuccacgugcccggccgagagcuccaccaacaccacccaggacgagcagcggcgcuggcccgggugcgaccagcaggacgagaugcugaaccugggcuucacgaucgggagcuucgugcucuccgccaccacccugccccugggcauccucauggaccgguucggcccccgcccggugcggcuggucgggagcgcgugcuucaccgccuccugcacgcugauggcccucgccagccgcgacguggaggcgcugagcccccugaucuuccucgcccugucccugaacggcuucgggggcaucugccucaccuucaccucccugacccugcccaacauguucgggaaccuccggagcacgcugauggcccugaugaucggcuccuacgccagcuccgccaucaccuuccccggcaucaagcucaucuacgacgcggggguggccuucgucgugaucauguucaccuggagcggccuggccugccugaucuuccucaacugcacccugaacuggccgaucgaggccuuccccgcccccgaggaggugaacuacacgaagaagaucaagcuguccgggcucgcgcuggaccacaaggucaccggcgaccuguucuacacccacgugaccacgaugggccagcgccucagccagaaggcccccagccuggaggacggguccgacgccuucaugagcccgcaggacgugcggggcaccuccgagaaccugcccgagcgcagcgucccccuccggaagucccugugcagccccaccuuccuguggucccuccugaccauggggaugacgcagcugcgcaucaucuucuacauggccgccgugaacaagaugcucgaguaccuggugaccggcgggcaggagcacgagaccaacgagcagcagcagaaggucgcggagaccgugggcuucuacagcuccguguucggcgccaugcagcugcucugccugcugacgugcccgcugaucggguacaucauggacuggcggaucaaggacugcgucgacgcccccacccagggcaccgugcucggggacgcccgcgacggcguggccaccaagagcauccggccccgcuacugcaagauccagaagcugacgaacgcgaucuccgccuucacccugaccaaccuccugcuggucggguucggcaucacgugccucaucaacaaccugcaccuccaguucgugaccuucgugcuccacaccaucguccggggcuucuuccacagcgccugcgggucccuguacgccgcgguguuccccagcaaccacuucggcacccugaccgggcuccagucccugaucagcgccgucuucgcccugcuccagcagccgcuguucauggccauggugggcccccugaagggggagcccuucugggugaaccucggccugcugcuguucucccugcugggcuuccuccugcccagcuaccuguucuacuaccgcgcccggcuccagcaggaguacgcggccaacgggaugggcccgcugaagguccuguccgggagcgaggugaccgccuga

SEQ ID NO: 36651 - RNA, 1299 nt, Artificial Sequence
  derived and/or modified sequence opt1 from SLC43A2__Homo_sapiens__NP_001271428
augaccuacggcagcccccaggccaacgccuccccgagcgacgcgguggcccuggaccacggggaggucucccgccggcagcagcaggagcuccccaacauguucggcgaccugcgcagcaccuucaucgcccugaugaucggguccuacgccagcuccgccgugacguuccccggcaucaagcucaucuacgacgcgggggugagcuucaucgucgugcugguggucugggccggcugcuccggccugguguuccucaacugcuucuucaacuggccccuggagccguuccccgggcccgaggacauggacuacagcgugaagaucaaguucuccuggcugggcuucgaccacaagaucaccgggaagcaguucuacaagcaggucaccaccgugggccggcgccucagcgugggguccagcaugcgguccgccaaggagcaggucgcccugcaggagggccacaagcugugccucagcacgguggaccuggaggugaagugccagcccgacgcggccgucgccccguccuucaugcacagcguguucucccccauccugcuccugagccuggugaccaugugcgucacccagcuccgccugaucuucuacaugggcgccaugaacaacauccugaaguuccucgugagcggggaccagaagaccgugggccuguacacguccaucuucgggguccugcagcuccugugccugcucaccgcccccgugaucggcuacaucauggacuggcggcugaaggagugcgaggacgcgagcgaggagcccgaggagaaggacgccaaccagggcgagaagaagaagaagaagcgcgaccggcagauccagaagaucaccaacgccaugcgcgccuucgccuucaccaaccugcuccuggugggguucggcgucacgugccugaucccgaaccucccccugcagauccuguccuucauccuccacaccaucgugcggggguucauccacagcgcggucggcgggcuguacgccgccguguaccccuccacccaguucggcagccugaccggccuccagucccugaucagcgcccuguucgcccuccugcagcagccccuguuccucgcgaugauggggccgcugcagggcgacccccugugggugaacgucgggcuccugcugcugucccuccugggcuucugccugccccucuaccugaucugcuaccgccggcagcuggagcgccagcuccagcagcggcaggaggacgacaagcuguuccugaagaucaacgggagcuccaaccaggaggccuucguguga

SEQ ID NO: 36652 - RNA, 1515 nt, Artificial Sequence
  derived and/or modified sequence opt1 from SLC43A3__Homo_sapiens__NP_001265135
auggccggccaggggcugccccuccacguggccacccugcugaccggccuccuggagugccugggguucgcgggcguccucuucggguggccgagccugguguucguguucaagaacgaggacuacuucaaggaccugugcggccccgacgccggccccaucgggaacgccacgggccaggccgggcgccucggcugcaugggggaccuguucuccacccccgacugcaaggcccaggacgagcgguucagccugaucuucacccucggcuccuucaugaacaacuucaugaccuucccgacgggcuacaucuucgaccgcuucaagaccaccgucgcgcggcugaucgccaucuucuucuacaccacggccacccugaucaucgccuucaccagcgcgggguccgccgugcuccuguuccuggccaugcccaugcucaccaucggcgggauccuguuccugaucacgaaccuccagaucggcaaccuguucggccagcaccgcagcaccaucaucacccuguacaacggggccuucgacuccagcuccgccguguuccucaucaucaagcugcuguacgagaagggcaucagccuccgggcguccuucaucuucaucagcgucugcuccaccuggcacguggcccgcacguuccugcugaugccccgggggcacauccccuacccgcucccgcccaacuacagcuacggccugugccccgggaacggcaccaccaaggaggagaaggagaccgccgagcacgagaaccgcgagcugcaguccaaggaguuccucagcgccaaggaggagacgcccggcgccgggcagaagcaggagcugcgguccuucuggagcuacgcguucucccgccgguucgccuggcaccugguguggcucagcgucauccagcuguggcacuaccuguucaucggcacccucaacagccugcugaccaacauggccgggggcgacauggcccgcguguccaccuacacgaacgccuucgcguucacccaguucggggugcucugcgcccccuggaacggccugcugauggaccggcucaagcagaaguaccagaaggaggcccgcaagaccggcagcuccacccuggccgucgcccugugcagcacggugcccucccucgcgcugaccagccugcugugccucggguucgcccugugcgccuccgugcccauccugccgcuccaguaccugaccuucauccugcaggucaucagccgguccuuccucuacggcagcaacgccgcguuccugacccuggccuuccccuccgagcacuucgggaagcuguucggccucgugauggcccugagcgccguggucucccuccugcaguuccccaucuucacgcugaucaaggggagccuccagaacgaccccuucuacgugaacgugauguucaugcuggccauccugcucaccuucuuccacccguuccuggucuaccgcgagugccggaccuggaaggagucccccagcgcgaucgccuga

SEQ ID NO: 36653 - RNA, 1959 nt, Artificial Sequence
  derived and/or modified sequence opt1 from SLC44A1__Homo_sapiens__NP_001273659
augggcugcugcagcuccgccagcuccgccgcgcagagcuccaagcgcgaguggaagccccuggaggaccggagcugcaccgacaucccguggcuccugcuguucauccucuucugcaucgggaugggcuucaucugcggguucuccaucgccaccggcgccgccgcccgccuggugagcggguacgacuccuacggcaacaucugcggccagaagaacacgaagcuggaggcgauccccaacagcgggauggaccacacccagcggaaguacgucuucuuccucgaccccugcaaccuggaccugaucaaccgcaagaucaaguccguggcccucugcguggccgccugcccccggcaggagcugaagacccugagcgacguccagaaguucgcggagaucaacggcuccgcccucugcagcuacaaccugaagccguccgaguacaccacgagccccaaguccagcgugcugugccccaagcuccccgugccggccuccgcccccauccccuucuuccaccgcugcgcccccgucaacaucagcugcuacgcgaaguucgccgaggcccugaucaccuucgugagcgacaacuccgugcugcaccggcucaucagcggggucaugaccuccaaggagaucauccugggccugugccuccugagccuggugcucuccaugauccugauggugaucauccgcuacaucagccggguccugguguggauccucaccauccuggugauccuggggucccucggcggcacggggguccugugguggcuguacgccaagcagcgccggagcccgaaggagaccgugacccccgagcagcuccagaucgccgaggacaaccugcgcgcgcugcucaucuacgccaucuccgccaccguguucacggucauccuguuccugaucaugcucgugaugcggaagcgcguggcccugaccaucgcccuguuccacgucgcgggcaagguguucauccaccucccccugcugguguuccagcccuucuggaccuucuucgcccucguccuguucuggguguacuggaucaugacccuccucuuccuggggacgaccggcagcccgguccagaacgagcagggcuucguggaguucaagaucuccgggccccugcaguacauguggugguaccacguggucggccugaucuggaucagcgaguucauccucgccugccagcagaugaccguggccggggccguggucaccuacuacuucacgcgggacaagcgcaaccugcccuucacccccauccuggcguccgugaaccggcucauccgcuaccaccugggcaccguggccaaggggagcuucaucaucacccuggucaagaucccgcggaugauccucauguacauccacucccagcugaagggcaaggagaacgccugcgcccgcugcgugcucaagagcugcaucugcugccuguggugccuggagaagugccugaacuaccucaaccagaacgcguacacggccaccgccaucaacuccaccaacuucugcaccagcgccaaggacgccuucgugauccuggucgagaacgcgcugcggguggccacgaucaacaccgugggcgacuucaugcuguuccuggggaagguccugaucgugugcuccaccggccucgccgggaucaugcugcugaacuaccagcaggacuacaccguguggguccucccccugaucaucgugugccuguucgccuuccucguggcccacugcuuccugagcaucuacgagauggucguggacgugcuguuccucugcuucgcgaucgacacgaaguacaacgacggcagccccgggcgcgaguucuacauggacaagguccugauggaguucguggagaacucccgcaaggccaugaaggaggccggcaagggcgggguggccgacagccgggagcugaagcccaugaucaaguga

SEQ ID NO: 36654 - RNA, 2115 nt, Artificial Sequence
  derived and/or modified sequence opt1 from SLC44A2__Homo_sapiens__NP_001138528
auggaggacgagcgcaagaacggcgccuacgggacgccccagaaguacgacccgaccuucaagggccccaucuacaaccgggggugcaccgacaucaucugcugcguguuccugcuccuggccaucgucggcuacguggcgguggggaucaucgccuggacccacggcgacccccgcaaggucaucuaccccaccgacagccggggcgaguucugcgggcagaagggcaccaagaacgagaacaagccguaccuguucuacuucaacaucgugaagugcgccagcccccucgugcugcuggaguuccagugccccacgccccagaucugcgucgagaagugcccggaccgcuaccucaccuaccugaacgcccgguccucccgcgacuucgaguacuacaagcaguucugcgugcccggguucaagaacaacaagggcguggccgagguccugcaggacggggacugccccgcggugcucauccccagcaagccgcuggcccggcgcugcuuccccgccauccacgccuacaagggcgugcugauggucggcaacgagaccaccuacgaggacgggcacggcucccggaagaacaucacggaccucguggagggggcgaagaaggccaacggcgugcuggaggcccgccagcuggccaugcggaucuucgaggacuacaccgucagcugguacuggaucaucaucggccucgugaucgccauggcgaugucccugcuguucaucauccuccugcgcuuccuggccgggaucauggugugggucaugaucaucauggugauccucgugcugggcuacgggaucuuccacugcuacauggaguacagccggcugcgcggcgaggccggguccgacgucagccucguggaccugggcuuccagaccgacuuccggguguaccugcaccuccgccagaccuggcuggccuucaugaucauccuguccauccucgaggucaucaucauccugcugcucaucuuccugcggaagcgcauccugaucgccaucgcgcucaucaaggaggccagccgggccgugggcuacgucaugugcucccugcuguacccccucgugacguucuuccugcugugccucugcaucgccuacugggccagcaccgcgguguuccuguccaccagcaacgaggccgucuacaagaucuucgacgacucccccugcccguucaccgccaagacgugcaaccccgagaccuuccccagcuccaacgagagccgccagugccccaacgcccggugccaguucgccuucuacgggggcgagagcggguaccaccgcgcgcugcucggccugcagaucuucaacgccuucauguucuucuggcuggccaacuucgugcucgcccugggccaggugacccuggcgggggccuucgccuccuacuacugggcccugcgcaagccggacgaccuccccgccuucccccuguucagcgcguucggccgggcccugcgcuaccacaccgggucccucgccuucggcgcccugauccuggccaucguccagaucauccgggugauccucgaguaccuggaccagcgccugaaggcggccgagaacaaguucgccaagugccucaugacgugccugaagugcugcuucuggugccuggagaaguucaucaaguuccucaaccggaacgccuacaucaugaucgccaucuacgggaccaacuucugcaccagcgcgcgcaacgccuucuuccugcugaugcggaacaucauccgcguggccguccucgacaaggugaccgacuuccuguuccugcucggcaagcugcugaucgugggguccgucggcauccucgccuucuucuucuucacgcaccggauccgcaucgugcaggacaccgcgcccccgcugaacuacuacugggugcccauccugaccgucaucgugggcagcuaccucaucgcccacggguucuucuccguguacggcaugugcgucgacacccuguuccugugcuuccucgaggaccuggagcggaacgacgggagcgccgagcgccccuacuucauguccagcacgcugaagaagcuccugaacaagaccaacaagaaggccgccgaguccuga

SEQ ID NO: 36655 - RNA, 2007 nt, Artificial Sequence
  derived and/or modified sequence opt1 from SLC44A4__Homo_sapiens__NP_001171515
augggcgggaagcagcgcgacgaggacgacgaggccuacggcaagcccgugaaguacgaccccagcuuccgggggcccaucaagaaccgcuccugcacggacgucaucugcugcgugcuguuccuccuguucauccugggcuacaucguggucgggaucguggccuggcucuacggcgacccccgccaggugcuguacccccggaacagcaccggcgcguacugcgggaugggcgagaacaaggacaagccguaccugcucuacuucaacaucuucuccugcauccugagcuccaacaucaucagcgucgccgagaacgggcugcagugccccacgccccagaccgugaucaccucccuccagcaggagcugugccccagcuuccugcucccguccgcccccgcccugggccggugcuuccccuggaccaacgugacgcccccggcccugcccgggaucaccaacgacaccaccauccagcagggcaucagcggccucaucgacucccugaacgcgcgcgacaucagcgucaagaucuucgaggacuucgcccaguccugguacuggauccugguggcccucgggguggcccugguccugagccuccuguucauccugcuccugcggcugguggcgggcccccucgugcugguccugauccucggggugcugggcgugcuggccuacggcaucuacuacugcugggaggaguaccgcguccuccgggacaagggggccuccaucagccagcugggcuucacgaccaaccuguccgccuaccagagcgugcaggagaccuggcucgccgcgcugaucgugcuggccguccucgaggccauccugcugcucaugcugaucuuccugcgccagcggauccgcaucgccaucgcccuccugaaggaggcguccaaggccguggggcagaugaugagcaccauguucuacccccuggugacguucguccuccugcugaucugcaucgccuacugggccaugaccgcccuguaccucgcgaccagcggccagccgcaguacgugcugugggccuccaacaucagcucccccgggugcgagaagguccccaucaacaccagcugcaaccccacggcccaccuggugaacuccagcugcccgggccucaugugcguguuccagggcuacuccagcaaggggcugauccagcgguccgucuucaaccugcagaucuacggcgugcucgggcuguucuggacccugaacugggugcucgcccugggccagugcguccuggccggggcguucgccagcuucuacugggccuuccacaagccccaggacauccccaccuucccccucaucuccgccuucauccgcacccugcgguaccacacgggcagccuggcguucggcgcccucauccugacccuggugcagaucgcccgcgugauccucgaguacaucgaccacaagcugcgcgggguccagaacccgguggcccggugcaucaugugcugcuucaagugcugccuguggugccucgagaaguucaucaaguuccugaaccggaacgccuacaucaugaucgcgaucuacggcaagaacuucugcguguccgccaagaacgccuucaugcugcucaugcgcaacaucguccggguggugguccuggacaaggugaccgaccugcuccuguucuucgggaagcugcucguggucggcggggugggcgugcugagcuucuucuucuucuccggccgcauccccgggcugggcaaggacuucaagagcccccaccucaacuacuacuggcugcccaucaugaccuccauccugggggccuacgucaucgccagcggcuucuucuccguguucggcaugugcguggacacccucuuccugugcuuccuggaggaccucgagcgcaacaacgggagccuggaccggccguacuacaugagcaagucccugcucaagauccugggcaagaagaacgaggcgccgcccgacaacaagaagcgcaagaaguga

SEQ ID NO: 36656 - RNA, 2169 nt, Artificial Sequence
  derived and/or modified sequence opt1 from SLC44A5__Homo_sapiens__XP_011539285
augggccugcaggcccucagcgagaagcccgccgacaccccguccgaggaggaggacuucggggacccccgcaccuacgaccccgacuucaagggccccguggcgaaccggagcugcacggacguccugugcugcaugaucuuccugcucugcaucaucggguacaucgugcugggccugguggccuggguccacggggacccgcgccgggccgccuaccccaccgacucccagggccacuucugcggccagaaggggacccccaacgagaacaagaccauccucuucuacuucaaccugcugcgcugcacgagccccuccgugcuccugaaccugcagugcccgaccacccagaucugcgugagcaagugccccgagaaguuccucaccuacgucgagaugcagcugcuguacacgaaggacaaguccuacugggaggacuaccggcaguucugcaagaccaccgccaagcccgucaagagccucacccagcugcugcucgacgacgacugccccacggcgaucuucccguccaagcccuuccugcagcgcugcuuccccgacuucagcaccaagaacggcacccugaccaucggguccaagaugauguuccaggacggcaacgggggcacgcggagcgugguggagcucggcaucgccgccaacgggaucaacaagcugcuggacgccaagucccucggccugaagguguucgaggacuacgcgcgcaccugguacuggauccugaucgggcucaccaucgccauggugcugagcuggaucuuccugauccuccugcgguucaucgccggcugccuguucugggucuucaugaucggcgugaucgggaucaucggcuacgggaucuggcacugcuaccagcaguacaccaaccuccaggagcgccccuccagcgugcugacgaucuacgacaucggcauccagaccaacaucuccauguacuucgagcugcagcagaccugguucaccuucaugaucauccucugcaucaucgaggucaucgugauccugaugcugaucuuccuccggaaccgcauccggguggccaucauccugcugaaggaggggagcaaggccaucggcuacgucccguccacgcucguguaccccgcgcugaccuucauccugcucagcaucugcaucugcuacuggguggucaccgccguguuccuggccaccagcggcgugcccgucuacaaggugaucgcccccgggggccacugcauccacgagaaccagacgugcgacccggagaucuucaacaccaccgagaucgccaaggcgugccccggggcccugugcaacuucgccuucuacggcgggaagucccucuaccaccaguacauccccaccuuccacgucuacaaccuguucguguuccuguggcugaucaacuucgugaucgcccucggccagugcgcccuggcgggcgccuucgccacguacuacugggccaugaagaagcccgacgacaucccgcgcuacccccuguucaccgccuucgggcgggcgauccgcuaccacaccggcagccucgccuucgggucccugaucaucgcccugauccagauguucaagaucguccucgaguaccuggaccaccggcugaagcgcacccagaacacgcucagcaaguuccugcagugcugccugcggugcugcuucuggugccucgagaacgccaucaaguuccugaaccgcaacgcguacaucaugaucgccaucuacggccggaacuucugccgcuccgccaaggacgccuucaaccugcucaugcgcaacgugcugaagguggccgucaccgacgaggugaccuacuucgugcuguuccucgggaagcugcuggucgcgggcagcaucggcgugcucgccuuccuguucuucacccagcggcugcccgugaucgcccaggggcccgccucccucaacuacuacugggucccgcugcugaccgugaucuucggcagcuaccucaucgcccacggguucuucuccguguacgcgaugugcgucgagacgaucuucaucugcuucugcgaggaccuggagcgcaacgacggcagcaccgagaagcccuacuucgugacccccaaccugcacggcauccucaucaagaagcagcuggugccgcagaagcagaaggaguga

SEQ ID NO: 36657 - RNA, 1383 nt, Artificial Sequence
  derived and/or modified sequence opt1 from SLC45A2__Homo_sapiens__NP_001012527
augggcagcaacuccgggcaggccggccgccacaucuacaagagccuggccgacgacgggcccuucgacuccguggagccgcccaagcggcccaccagccgccucaucaugcacuccauggcgauguucggccgggaguucugcuacgccgucgaggccgccuacgugacccccgugcugcugagcgucgggcucccguccagccuguacuccaucgugugguuccugagccccauccucggcuuccugcugcagcccguggucggcuccgccagcgaccacugccgcucccggugggggcgccggcgccccuacauccucacgcugggcgugaugaugcugguggggauggcgcucuaccugaacggcgccaccgucguggccgcccugaucgcgaacccgcggcgcaagcucgugugggccaucagcgucaccaugaucgggguggugcuguucgacuucgccgccgacuucaucgacggccccaucaaggccuaccuguucgacgucugcucccaccaggacaaggagaagggccuccacuaccacgcgcuguucaccggguucggcggggcccugggcuaccuccugggcgccaucgacugggcccaccuggagcucgggcggcugcugggcacggaguuccaggugauguucuucuucagcgcccucgugcugacccugugcuucaccguccaccucugcuccaucagcgaggcgccccugaccgagguggccaaggggaucccgccccagcagacgccccaggacccgccccuguccagcgacggcauguacgaguacgggagcaucgagaaggugaagaacggcuacgucaaccccgagcucgccaugcagggcgccaagaacaagaaccacgccgagcagacccgccgggcgaugacccugaagucccugcuccgcgcccuggugaacaugccgccccacuaccgguaccugugcaucagccaccucaucggguggaccgccuuccuguccaacaugcuguucuucacggacuucaugggccagaucguguaccgcggggaccccuacagcgcccacaacuccaccgaguuccucaucuacgagcggggcgucgagguggggugcuggggcuucugcaucaacagcgucuucuccagccuguacuccuacuuccagaaggugcuggugagcuacaucggccucaaggggcuguacuucaccggcuaccuccuguucgggcugggcaccggguucaucggccuguuccccaacgucuacuccacgcuggugcucugcagccuguucggcgugauguccagcacccuguacaccguccccuucaaccucaucaccgaguaccaccgcgaggaggagaaggaggugugcugccacuga

SEQ ID NO: 36658 - RNA, 1662 nt, Artificial Sequence
  derived and/or modified sequence opt1 from SLC45A3__Homo_sapiens__NP_149093
auggugcagcgccugugggucagccggcuccugcgccaccggaaggcccagcugcuccuggugaaccugcucaccuucggccuggaggugugccuggccgcggggaucaccuacgugcccccgcuccugcuggaggugggcguggaggagaaguucaugacgaugguccucgggaucggccccgugcuggggcuggugugcgucccccuccugggcuccgccagcgaccacuggcgcggccgguacgggcgccggcgccccuucaucugggcccugucccucggcauccugcugagccucuuccugaucccgcgggccggguggcuggccggccuccugugccccgacccccgcccccuggagcucgcgcugcugauccucggggugggccugcuggacuucugcggccaggugugcuucaccccgcucgaggcccugcuguccgaccucuuccgggaccccgaccacugccgccaggccuacagcgucuacgccuucaugaucucccucgggggcugccugggguaccugcugcccgcgaucgacugggacaccagcgcccuggcccccuaccucggcacccaggaggagugccuguucggccugcucacgcugaucuuccugaccugcguggccgccacccuccugguggcggaggaggccgcccuggggcccaccgagcccgccgagggccuguccgcccccagccucagcccccacugcugcccgugccgggcgcgccuggccuuccggaaccugggggcccuccugccccgccugcaccagcucugcugccggaugccccgcacgcugcggcgccuguucgucgccgagcucugcuccuggauggcccugaugaccuucacccuguucuacaccgacuucgugggcgaggggcucuaccagggcgugccccgggcggagccgggcacggaggcccgccgccacuacgacgaggggguccggaugggcucccuggggcuguuccuccagugcgccaucagccugguguucucccuggugauggaccgccucguccagcgguucggcacccgcgccguguaccuggccagcguggcggccuuccccgucgccgccggggcgaccugccugucccacagcguggccgucgugaccgccuccgccgcccucacgggcuucaccuucagcgcgcugcagauccugcccuacacccucgccagccuguaccaccgggagaagcaggucuuccugcccaaguaccgcggcgacaccgggggcgccuccagcgaggacucccucaugacgagcuuccugccggggcccaagcccggcgcccccuucccgaacgggcacgucggcgccggcggguccggccugcucccgccgccgcccgcgcugugcggggccagcgccugcgacguguccgugcgggucguggugggcgagcccaccgaggcccgcgucgugcccggccgggggaucugccuggaccucgccauccuggacagcgcguuccugcucucccagguggcccccagccuguucaugggcuccaucguccagcugagccaguccgugaccgccuacauggugagcgccgcggggcucggccuggucgccaucuacuucgccacccaggugguguucgacaaguccgaccuggccaaguacagcgccuga

SEQ ID NO: 36659 - RNA, 2397 nt, Artificial Sequence
  derived and/or modified sequence opt1 from SLC45A4__Homo_sapiens__NP_001073900
augggcaaggccagccccgccuccgggcugagccgcccgaagacccucgugagcccccugcgguccaaccaguggucccugcagaagggccuccccgagcaguacuacagccugaccugguuccugucccccauccucgggcugaucuucacgccgcugaucggcagcgcguccgaccgcugcacccucagcugggggcggcgccggcccuucauccuggcccugugcgucggcgugcuguucggcguggcccuguuccugaacggguccgccaucggccucgcccugggggacguccccaaccgccagcccaucggcaucgugcugaccgugcucggggucguggugcuggacuucagcgcggacgccaccgagggcccgauccgggccuaccugcucgacgucguggacuccgaggagcaggacauggcccugaacauccacgcguucagcgccggccucgggggcgccaucggguacgugcucggcggccuggacuggacgcagaccuuccugggguccugguuccgcacccagaaccagguccucuucuucuucgccgccaucaucuucaccgugagcguggcgcugcaccuguucuccaucgacgaggagcaguacagcccccagcaggagcgguccgccgaggagcccggcgcccucgacgggggcgagccccacggggucccggccuuccccgacgaggugcagagcgagcacgagcuggcccuggacuaccccgacguggacaucaugcgcagcaaguccgacagcgcgcuccacguccccgacacggcccuggaccuggagccggagcuccuguuccugcacgacaucgagcccuccaucuuccacgacgccagcuaccccgccacgccccgguccaccagccaggagcucgccaagaccaagcugccgcgccuggcgaccuuccucaaggaggccgccaaggaggacgagacccugcuggacaaccaccucaacgaggccaaggugcccaacggcuccggcagccccaccaaggacgcccucgggggcuacacccggguggacacgaagcccuccgcgaccagcuccagcaugcgccggcgccggcacgccuuccgccggcaggccuccagcaccuucuccuacuacgggaagcugggcagccacugcuaccgcuaccggcgcgccaacgcggucgugcugaucaagccgucccgcagcauguccgaccuguacgacaugcagaagcggcagcgccagcaccggcaccgcaaccagagcggggccaccacgagcuccggcgacaccgagagcgaggagggcgagggggagaccaccgugcggcugcuguggcucuccaugcugaagaugccccgcgagcugaugcggcucugccugugccaccuccugacgugguucagcgucaucgccgaggccguguucuacaccgacuucaugggccaggucaucuucgagggggaccccaaggcccccuccaacagcaccgcguggcaggccuacaacgccggcgugaagauggggugcuggggccuggugaucuacgccgccaccggcgcgaucugcuccgcccugcuccagaaguaccuggacaacuacgaccugagcguccgcgugaucuacgugcucgggacgcugggcuucuccgucgggaccgccgugauggccauguucccgaacguguacgucgccauggugaccaucagcaccaugggcaucguguccaugagcaucuccuacugccccuacgcgcugcucggccaguaccacgacaucaagcaguacauccaccacagccccgggaacuccaagcggggcuucgggaucgacugcgccauccugagcugccaggucuacaucucccagauccugguggccagcgcccucggcgggguggucgacgcggugggcacggugcgcgucaucccgaugguggccagcgugggcuccuuccugggguuccugaccgccaccuuccucgucaucuaccccaacgugagcgaggaggccaaggaggagcagaagggccuguccagcccccuggccggggagggccgggccgggggcaacuccgagaagcccaccgugcucaagcugacgcgcaaggagggccugcaggggccggucgagaccgagcggcuccaggugcugaccagcgugcgcucccggcacaucggcuggugccgcagcugcuggcgggucuucuucuucaugaucauccuggagaagaaguucuccuucccccagugcgggagccuccgccggaugaccuaccugcuguuccucuccgagcuggacacccugugccccggccagcccugcccgugggcggccacggcccaccagagcugggaggaggccgggcccggcggccucgggcgccgccaguga

SEQ ID NO: 36660 - RNA, 1296 nt, Artificial Sequence
  derived and/or modified sequence opt1 from SLC46A1__Homo_sapiens__NP_001229295
auggagggcagcgccuccccgcccgagaagccccgcgcccggcccgcggccgccgugcugugccgcgggcccgucgagccgcucguguuccuggccaacuucgcccuggugcuccagggcccccugaccacccaguaccuguggcaccgguucagcgcggaccucggguacaacggcacgcgccagcgcgggggcugcuccaaccggagcgccgaccccaccaugcaggaggucgagacccugaccucccacuggacgcuguacaugaacgugggcggguuccucgugggccuguucagcuccacccugcucggggccuggagcgacuccgucggccggcgcccccugcuggugcucgccagccuggggcugcuccugcaggcgcugguguccgucuucguggugcagcuccagcugcacgucggcuacuucgugcugggccggauccucugcgcccugcugggggacuucggcgggcuccuggccgccagcuucgccuccguggcggacgucagcuccagccgcucccggaccuuccgcauggcccugcucgaggccagcaucggcguggccggcaugcuggccucccugcucgggggccacuggcugcgggcgcagggguacgccaacccguucuggcuggcccucgcccugcugaucgccaugacccucuacgcggccuucugcuucggcgagacgcugaaggagcccaagagcacccgccuguucaccuuccggcaccaccgcagcaucgugcagcucuacgucgcccccgcccccgagaagucccggaagcaccuggcccuguacagccucgcgaucuucguggugaucaccguccacuucggggcccaggacauccugacgcuguacgagcucuccaccccgcugugcugggacagcaagcugaucggcuacggcuccgccgcccagcaccuccccuaccugaccagccugcuggcgcucaagcugcugcaguacugccucgccgacgccuggguggccgagaucgggcuggccuucaacauccugggcaugguggucuucgcguucgccaccaucacgccccucauguucaccggggcccuguucuccgccguggccugcgucaacagccuggcgaugcucaccgccuccggcaucuucaacagccuguaccccgccacccugaacuucaugaagggguucccguuccuccugggcgccggccugcuccugauccccgccgugcugaucgggaugcucgagaaggcggacccccaccuggaguuccagcaguucccccaguccccguga

SEQ ID NO: 36661 - RNA, 1428 nt, Artificial Sequence
  derived and/or modified sequence opt1 from SLC46A2__Homo_sapiens__NP_149040
augagccccgaggugaccugcccgcgccggggccaccucccccgcuuccacccccggaccugggucgagcccgugguggccuccagccaggucgccgcgucccuguacgacgccgggcugcugcucguggugaaggccagcuacggcaccgggggcuccagcaaccacuccgccagcccguccccgcgcggggcccuggaggaccagcagcagcgggcgaucagcaacuucuacaucaucuacaaccuggucgugggccucagcccccugcuguccgccuacggccucggguggcuguccgaccgcuaccaccggaagaucagcaucugcaugucccugcucggcuuccugcugagccgccucgggcugcugcucaaggugcugcuggacuggcccgucgaggugcucuacggcgccgccgcgcugaacgggcuguucggcggcuucuccgccuucuggagcggggugauggcccucggcucccuggggagcagcgagggccggcgcuccguccggcugauccucaucgaccugaugcugggccucgccggguucugcggcagcauggccuccgggcaccuguucaagcagauggcgggccacagcgggcagggccugauccucacggccugcuccgugagcugcgccuccuucgcccugcuguacagccuccuggugcugaaggucccggaguccguggccaagcccagccaggagcuccccgcgguggacaccgucuccggcaccguggggacguaccgcacccuggaccccgaccagcuggaccagcaguacgccgugggccacccgcccagccccgggaaggccaagccccacaagaccaccaucgcccuccuguucgucggcgccaucaucuacgaccuggcggugguggggacggucgacgugaucccccucuucguccugcgggagccccugggcuggaaccagguccaggugggcuacgggauggccgccggcuacaccaucuucaucaccuccuuccucggggugcugguguucagccgcugcuuccgggacaccacgaugaucaugaucggcaugguguccuucgggagcggcgcccugcugcucgccuucgucaaggagaccuacauguucuacaucgcgcgcgccgugaugcuguucgcccugauccccgugaccaccauccgguccgccaugagcaagcucaucaagggcuccagcuacgggaaggucuucgugauccugcagcugagccucgcgcugacgggcguggucaccuccacccuguacaacaagaucuaccagcucaccauggacauguucguggggagcugcuucgcccuguccagcuuccuguccuuccucgccaucauccccaucagcaucguggccuacaagcaggucccgcugucccccuacggcgacaucaucgagaaguga

SEQ ID NO: 36662 - RNA, 1713 nt, Artificial Sequence
  derived and/or modified sequence opt1 from SLC47A1__Homo_sapiens__NP_060712
auggaggcccccgaggagccggcccccgugcgcggcgggcccgaggcgacccuggagguccggggcagccgcugccuccggcuguccgccuuccgcgaggagcugcgggcccuccuggugcuggccgggcccgccuuccucgugcagcugauggucuuccugaucagcuucaucuccagcguguucugcggccaccucgggaagcuggagcuggacgcggugacccucgccaucgccgucaucaacgugacgggcguguccgucggcuucgggcugagcuccgccugcgacacccugaucagccagaccuacggcucccagaaccucaagcacgugggggugauccugcagcgcagcgcgcugguccuccugcugugcugcuucccgugcugggcccucuuccugaacacccagcacauccugcuccuguuccggcaggaccccgacgugucccgccugacgcagaccuacgugaccaucuucauccccgcccuccccgccaccuuccuguacaugcugcaggucaaguaccuccugaaccagggcaucgugcugccgcagaucgugacgggggucgccgcgaaccucgugaacgcccuggccaacuaccuguuccuccaccagcugcaccugggcgugaucggcagcgcccucgccaaccugaucucccaguacacccuggcgcuccugcuguuccucuacauccuggggaagaagcugcaccaggccaccuggggcggguggagccucgagugccugcaggacugggccuccuuccugcggcuggccauccccagcaugcucaugcugugcauggaguggugggccuacgaggucggcuccuuccugagcggcauccucgggaugguggagcugggcgcgcaguccaucguguacgagcuggccaucaucgucuacauggugcccgccggguucagcgucgccgccagcgugcgcgugggcaacgcgcucggggccggcgacauggagcaggcccggaaguccagcaccgucucccugcugaucacgguccucuucgccguggcguucagcgugcugcugcucuccugcaaggaccacgugggcuacaucuucaccaccgaccgcgacaucaucaaccugguggcccaggucgugcccaucuacgccgugagccaccuguucgaggcccucgccugcaccuccgggggcguccugcgggggagcggcaaccagaaggugggggcgaucgugaacacgaucggcuacuacgucgugggccugccgaucgggaucgcccucauguucgccaccacccugggcgugauggggcugugguccggcaucaucaucugcaccgucuuccaggccgugugcuuccucggguucaucauccagcugaacuggaagaaggccugccagcaggcccaggugcacgcgaaccugaaggucaacaacgugccccgcagcggcaacuccgcccucccccaggacccccugcacccgggcugccccgagaaccuggaggggauccucacgaacgacgugggcaagaccggggagccccagagcgaccagcagaugcggcaggaggagccccugccggagcacccccaggacggcgccaagcugucccgcaagcagcucguccugcggcgcggccugcuccugcuggggguguuccucauccugcuggugggcauccucguccgguucuacgugcgcauccaguga

SEQ ID NO: 36663 - RNA, 441 nt, Artificial Sequence
  derived and/or modified sequence opt1 from SLC48A1__Homo_sapiens__NP_060312
auggcccccagccgccugcagcucggccugcgggccgcguacuccgggaucagcuccguggccggcuucagcaucuuccuggucuggaccgugguguaccgccagccggggaccgccgccaugggcgggcucgccggcguccuggcgcugugggugcucgugacgcacgucauguacaugcaggacuacuggcggaccuggcugaagggccugcgcggguucuucuucgugggcguccucuucuccgccgugagcaucgccgccuucugcaccuuccuggugcuggcgaucacccggcaccagucccucacggaccccaccagcuacuaccuguccagcgugugguccuucaucagcuucaagugggccuuccugcucucccuguacgcccaccgcuaccgggccgacuucgccgacaucagcauccuguccgacuucuga

SEQ ID NO: 36664 - RNA, 3357 nt, Artificial Sequence
  derived and/or modified sequence opt1 from SLC4A10__Homo_sapiens__NP_001171486
auggagaucaaggaccagggcgcccagauggagccccugcucccgacccgcaacgacgaggaggccguggucgaccggggcggcacccgcagcauccugaagacgcacuucgagaaggaggaccuggaggggcaccggacccucuucaucggcgugcacgugccccucgggggccgcaagucccaccggcgccaccggcaccgcggccacaagcaccggaagcgcgaccgggagcgcgacagcgggcuggaggacggccgggagucccccagcuucgacacccccucccagcgcguccaguucauccuggggaccgaggacgacgacgaggagcacaucccgcacgaccuguucacggagcuggacgagaucugcuggcgggagggcgaggacgcggaguggcgcgagaccgcccgguggcucaaguucgaggaggacguggaggacgggggcgagcgcuggagcaagcccuacguggccacccugucccugcacagccucuucgagcugcgguccugcauccugaacggcaccguccuccuggacaugcacgccaacacgcuggaggagaucgccgacauggugcucgaccagcaggucagcuccgggcagcugaacgaggacgugcgccaccgggugcacgaggcgcugaugaagcagcaccaccaccagaaccagaagaagcucaccaaccgcauccccaucgugcgcagcuucgccgacaucggcaagaagcaguccgagcccaacagcauggacaagaacgccgggcaggucguguccccgcagagcgcccccgcgugcguggagaacaagaacgacgucucccgggagaacagcaccguggacuucuccaagggccugggcgggcagcagaagggccacaccagccccugcgggaugaagcagcgccacgagaaggggcccccgcaccagcaggagcgggagguggaccugcacuucaugaagaagaucccgcccggggccgaggccagcaacauccucgucggcgagcuggaguuccuggaccgcacggugguggccuucguccggcucucccccgccgugcugcugcagggccucgcggaggugcccauccccacccgcuuccuguucauccugcucgggccccugggcaaggggcagcaguaccacgagaucggccggagcaucgccacccugaugaccgacgaggucuuccacgacguggccuacaaggccaaggaccgcaacgaccucgucuccgggaucgacgaguuccuggaccaggugacggugcugcccccgggcgagugggaccccagcauccggaucgagccgcccaagaacguccccucccaggagaagcgcaagauccccgccgugcccaacggcaccgcggcccacggggaggccgagccccacggcgggcacagcggcccggagcuccagcggaccgggcgcaucuucggcggccugauccuggacaucaagcggaaggcccccuacuucugguccgacuuccgcgacgccuucagccuccagugccuggcguccuuccuguuccucuacugcgccugcaugagccccgugaucaccuucgggggccugcugggggaggccacggagggccggaucuccgccaucgagagccucuucggcgccuccaugaccgggaucgcguacagccuguucggcgggcagccgcugaccauccugggcuccaccgggcccguccucguguucgagaagauccuguucaaguucugcaaggaguacggccugagcuaccucucccugcgcgccagcaucggccuguggacggccacccucugcaucauccugguggccaccgacgcguccagccuggucugcuacaucacccgguucacggaggaggccuucgccagccucaucugcaucaucuucaucuacgaggcccuggagaagcuguucgagcucuccgaggccuaccccaucaacaugcacaacgaccuggagcugcucacccaguacagcugcaacugcguggagccccacaacccguccaacgggacccugaaggaguggcgcgagagcaacaucuccgcgagcgacaucaucugggagaaccugaccguguccgagugcaagagccuccacggcgaguacgucgggcgggccugcggccacgaccaccccuacgugcccgacgugcuguucugguccgucauccuguucuucagcacggugacccucuccgccacccugaagcaguucaagaccagccgcuacuuccccacgaaggugcgcuccaucgucagcgacuucgccguguuccugaccauccucugcauggugcugaucgacuacgccaucgggaucccgucccccaagcugcagguccccagcguguucaagcccacccgggacgaccgcggcugguucgugaccccgcucggccccaaccccugguggaccgucaucgcggccaucauccccgcccugcugugcacgauccucaucuucauggaccagcagaucaccgccgugaucaucaaccggaaggagcacaagcugaagaaggggugcggcuaccaccuggaccuccugaugguggccgucaugcugggggugugcuccaucaugggccucccgugguucguggcggccaccguccugagcaucacccacgugaacagccugaagcucgaguccgagugcagcgcccccggggagcagcccaaguuccugggcauccgcgagcagcgggugacgggccugaugaucuucauccucaugggguccagcgucuucaugaccuccauccugaaguucauccccaugccggugcuguacggcguguuccucuacaugggggccagcucccugaagggcauccaguucuucgaccgcaucaagcuguucuggaugcccgcgaagcaccagcccgacuucaucuaccuccggcacgucccccugcgcaaggugcaccuguucaccaucauccagaugagcugccucgggcugcuguggaucaucaaggugucccgggccgccaucgucuucccgaugauggugcucgcccugguguucguccgcaagcugauggaccuccuguucaccaagcgggagcugagcuggcucgacgaccugaugcccgaguccaagaagaagaagcuggaggacgccgagaaggaggaggagcagagcaugcucgcgauggaggacgagggcacggugcagcugccccuggagggccacuaccgcgacgacccguccgugaucaacaucagcgacgagauguccaagaccgcccucuggcggaaccugcugaucaccgccgacaacagcaaggacaaggaguccagcuuccccuccaagagcagccccuccuga

SEQ ID NO: 36665 - RNA, 2628 nt, Artificial Sequence
  derived and/or modified sequence opt1 from SLC4A11__Homo_sapiens__NP_001167560
auggccgccgcgacccgccggguguuccaccuccagcccugcgagaacagcccgaccaugucccagaacggcuacuucgaggacagcuccuacuacaagugcgacacggacgacaccuucgaggcccgcgaggagauccucggggacgaggccuucgacaccgccaacagcuccaucgucagcggcgaguccauccgguucuucgugaacgugaaccuggagaugcaggccaccaacacggagaacgaggcgaccagcgggggcugcguccugcuccacaccucccgcaaguaccugaagcugaagaacuucaaggaggagauccgggcccaccgcgaccucgacggguuccuggcccaggccagcaucgugcugaacgagaccgcgacgucccucgacaacgugcugcggaccaugcugcgccgguucgcccgcgaccccgacaacaacgagcccaacugcaaccucgaccugcugauggccaugcuguucaccgacgccggcgcccccaugcggggcaagguccaccuccugagcgacaccauccagggggugacggcgaccgugaccggcguccgcuaccagcaguccuggcucugcaucaucugcaccaugaaggcccugcagaagcggcacgugugcaucagccgccuggugcggccgcagaacuggggcgagaacuccugcgagguccgcuucgugauccucgugcuggccccgcccaagaugaaguccacgaagaccgccauggaggucgcccggaccuucgcgaccauguucagcgacaucgccuuccgccagaagcugcucgagacgcggaccgaggaggaguucaaggaggcccuggugcaccagcgccagcugcucaccauggugagccacgggcccgucgcgccccggaccaaggagcgcuccacggugagccugcccgcccaccgccaccccgagcccccgaagugcaaggacuucgugcccuucgggaagggcauccgggaggacaucgcccgccgguucccccuguacccccucgacuucaccgacggcaucaucgggaagaacaaggccgucggcaaguacaucaccaccacgcuguuccuguacuucgccugccuccugccgaccaucgccuucgggagccugaacgacgagaacaccgacggcgccaucgacgugcagaagaccaucgcgggccaguccaucgggggccuccuguacgcccuguucagcgggcagccccucgugauccugcugacgaccgcgccccucgcccuguacauccaggucauccgcgugaucugcgacgacuacgaccuggacuucaacuccuucuacgccuggaccggccucuggaacagcuucuuccuggcccuguacgccuucuucaaccucucccuggucaugagccuguucaagcgguccaccgaggagaucaucgcccuguucaucagcaucacguucgugcucgacgccgugaaggggaccgucaagaucuucuggaaguacuacuacggccacuaccuggacgacuaccacaccaagcgcaccuccagccuggugucccucagcggccugggggcgucccugaacgccagccuccacaccgcccugaacgccuccuuccuggccagccccacggagcucccguccgcgacccacagcggccaggccaccgccgugcugucccugcucaucaugcuggggacccuguggcucggcuacacgcuguaccaguucaagaagucccccuaccugcaccccugcguccgggagauccucagcgacugcgcccugcccaucgccgugcuggcguucagccucaucagcucccacggguuccgcgagaucgagaugagcaaguuccgguacaacccguccgagagccccuucgccauggcccagauccagucccugagccugcgcgccguguccggcgcgaugggccucggguuccugcugagcaugcuguucuucaucgagcagaaccuggucgccgcccuggugaacgcccccgagaaccggcucgugaagggcaccgccuaccacugggaccugcugcuccuggcgaucaucaacaccgggcugucccucuucggccugcccuggauccacgccgccuacccgcacagcccccugcacguccgcgcccucgcccugguggaggagcggguggagaacgggcacaucuacgacaccaucgucaacgugaaggagacgcgccugaccucccucggcgcgagcgugcuggucggccugucccuccugcugcuccccgugccgcugcaguggauccccaagcccgugcuguacggccucuuccuguacaucgcccugaccagccucgacgggaaccagcugguccagcggguggcccugcuccugaaggagcagaccgccuacccgcccacgcacuacauccgccgggugccccagcgcaagauccacuacuucaccgggcugcagguccuccagcugcugcuccugugcgccuucggcauguccagccugcccuacaugaagaugaucuucccccucaucaugaucgcgaugaucccgauccgguacauccugcugccccgcaucaucgaggccaaguaccucgacgugauggacgccgagcaccgccccuga

SEQ ID NO: 36666 - RNA, 2391 nt, Artificial Sequence
  derived and/or modified sequence opt1 from SLC4A1AP__Homo_sapiens__NP_060628
augcuggcgccccuccgcaacgccccgggccgggagggggccaccagccccuccccgcccaccgacgccacgggcagccugggggagugggacguggaccgcaacgucaagaccgagggcuggguguccaaggagcggaucagcaagcugcaccgccuccggauggccgacauccugucccagagcgagacccuggccucccaggaccucagcggggacuucaagaagcccgcccugcccgugucccccgcggcccgcagcaaggcccccgccuccagcuccagcaacccggaggagguccagaaggagggccccaccgcgcugcaggacuccaacagcggcgagcccgacaucccgccgccccagcccgacugcggggacuuccggucccuccaggaggagcagagccggcccccgacggccguguccagccccggcgggcccgcccgcgcgcccccguaccaggagccgcccuggggcgggcccgccaccgcccccuacagccuggagacccugaagggcggcaccauccucgggacgcgcucccugaagggcaccagcuacugccuguucgggcggcucuccggcugcgacgugugccuggagcaccccagcgucucccgcuaccacgccgugcugcagcaccgggccagcggccccgacggggagugcgacuccaacggccccggguucuaccucuacgaccugggcagcacccacgggaccuuccugaacaagacgcgcaucccgccccggaccuacugccgcgugcacgucggccacguggugcgguucggcggguccacccgccucuucauccugcagggccccgaggaggaccgggaggccgagagcgagcugaccgucacgcagcucaaggagcugcgcaagcagcagcagauccugcucgagaagaagaugcugggggaggacuccgacgaggaggaggagauggacaccagcgagcggaagaucaacgccggcucccaggacgacgagauggggugcaccuggggcaugggcgaggacgcgguggaggacgacgccgaggagaaccccaucgugcuggaguuccagcaggagcgcgaggccuucuacaucaaggaccccaagaaggcccuccagggguucuucgaccgcgagggcgaggagcuggaguacgaguucgacgagcaggggcacagcaccuggcugugccggguccgccuccccguggacgacuccacgggcaagcagcugguggccgaggcgauccacagcgggaagaagaaggaggccaugauccagugcucccuggaggccugccggauccucgacacccugggccugcuccgccaggaggccgucagccggaagcgcaaggccaagaacugggaggacgaggacuucuacgacuccgacgacgacaccuuccuggaccggaccggccugaucgagaagaagcgccucaaccggaugaagaaggcggggaagaucgacgagaagcccgagacguucgagagccugguggccaagcugaacgacgccgagcgcgagcucagcgagaucuccgagcggcugaaggccagcucccaggugcugagcgaguccccgagccaggacucccucgacgcguucaugagcgagaugaaguccggcagcacccuggacggggucucccgcaagaagcugcaccuccggaccuucgagcuccgcaaggagcagcagcggcugaagggccugaucaagaucgugaagcccgccgagauccccgagcucaagaagaccgagacgcagaccaccggcgccgagaacaaggccaagaagcugacccugccccucuucggggccaugaagggcgggagcaaguucaagcugaagacgggcaccguggggaagcugccgcccaagcgccccgagcugcccccgacccugaugcggaugaaggacgagcccgaggucgaggaggaggaggaggaggaggaggaggaggagaaggagaaggaggagcacgagaagaagaagcuggaggacggcucccucagccgcccccagcccgagaucgagccggaggcggccgugcaggagaugcggccgcccaccgaccugacgcacuucaaggagacccagacccacgagaacaugucccagcugagcgaggaggagcagaacaaggacuaccaggacugcuccaagaccaccagccucugcgccggccccagcgccuccaagaacgaguacgagaagucccgcggggagcugaagaagaagaagacgcccggccccgggaagcugccgcccacccucagcagcaaguaccccgaggacgaccccgacuacugcgucugggugcccccggagggccaguccggggacggccgcacccaccugaacgacaaguacggcuacuga

SEQ ID NO: 36667 - RNA, 2736 nt, Artificial Sequence
  derived and/or modified sequence opt1 from SLC4A1__Homo_sapiens__NP_000333
auggaggagcugcaggacgacuacgaggacaugauggaggagaaccucgagcaggaggaguacgaggaccccgacaucccggagagccagauggaggagcccgccgcccacgacaccgaggcgaccgccacggacuaccacaccaccucccaccccggcacccacaagguguacgucgagcugcaggagcuggugauggacgagaagaaccaggagcuccgcuggauggaggccgcccggugggugcagcuggaggagaaccugggggagaacggcgccugggggcgcccccaccucagccaccugacguucuggucccugcucgagcugcggcgcgucuucaccaagggcaccgugcugcucgaccugcaggagaccagccuggcggggguggccaaccagcuccuggaccgguucaucuucgaggaccagauccgcccgcaggaccgggaggagcugcuccgcgcccugcugcucaagcacucccacgccggcgagcuggaggcgcugggcggggucaagcccgccgugcucacgcggagcggcgaccccucccagccccugcugccgcagcacagcucccucgagacccagcuguucugcgagcagggggacggcgggaccgagggccacagccccuccggcauccuggagaagaucccgcccgacagcgaggccacccucgugcuggucgggcgcgccgacuuccuggagcagcccgugcucggcuucgugcggcugcaggaggccgcggagcuggaggccgucgagcuccccgugcccauccgcuuccuguucgugcugcucgggcccgaggccccgcacaucgacuacacgcagcugggccgggccgccgcgacccugauguccgagcgcgucuuccggaucgacgccuacauggcccagagccgcggcgagcuccugcacucccuggagggguuccucgacugcagccuggugcugccgcccaccgacgcccccuccgagcaggcccuccugagccuggugcccguccagcgggagcugcuccgccggcgcuaccaguccagccccgcgaagcccgacagcuccuucuacaagggccuggaccugaacgggggccccgacgacccgcuccagcagaccgggcagcuguucggcggccuggugcgggacauccgccgccgguaccccuacuaccucagcgacaucacggacgccuucagcccccaggugcuggccgccgucaucuucaucuacuucgccgcgcugagccccgccaucaccuucgggggccuccugggggagaagacccgcaaccagaugggcguguccgagcugcucaucagcaccgccgugcaggggauccuguucgcccugcucggcgcgcagccgcugcuggucgugggcuucuccgggccccuccuggucuucgaggaggccuucuucagcuucugcgagacgaacggccuggaguacaucguggggcggguguggaucggcuucuggcucauccugcuggucgugcucguggucgccuucgagggguccuuccuggugcgcuucaucagccgguacacccaggagaucuucuccuuccugaucagccucaucuucaucuacgagaccuucuccaagcugaucaagaucuuccaggaccacccccugcagaagaccuacaacuacaacgugcucauggucccgaagccccagggcccccugcccaacacggcccugcucagccuggugcugauggccggcaccuucuucuucgcgaugaugcuccgcaaguucaagaacuccagcuacuucccggggaagcugcggcgcgugaucggcgacuucgggguccccaucuccauccugaucauggugcucguggacuucuucauccaggacaccuacacccagaagcugagcguccccgacggcuucaagguguccaacagcagcgcccggggcugggugauccacccccuggggcuccgcuccgaguucccgaucuggaugauguucgccagcgcccugcccgcccugcucgucuucauccugaucuuccuggagucccagaucacgacccucaucgugagcaagcccgagcggaagauggugaagggcuccggguuccaccuggaccugcuccuggucgugggcaugggcgggguggcggcccuguucggcaugcccuggcucagcgccaccaccguccgcuccgugacgcacgccaacgcccugaccgugauggggaaggcgagcaccccgggcgccgccgcccagauccaggaggucaaggagcagcggaucuccgggcugcucguggcggugcuggucggccugagcauccucauggagcccauccugucccgcaucccccuggccguccucuucgggaucuuccuguacaugggcgugaccagccuguccggcauccagcuguucgaccggauccugcuccucuucaagcccccgaaguaccaccccgacgugcccuacgugaagcgcgugaagacguggcggaugcaccuguucaccgggauccagaucaucugccuggccguccucuggguggugaaguccacccccgccucccuggcccugccguucguccucauccugaccgugccccugcgccgggugcuccugccccugaucuuccgcaacgucgagcuccagugccuggacgcggacgacgccaaggccaccuucgacgaggaggagggccgcgacgaguacgacgagguggccaugcccguguga

SEQ ID NO: 36668 - RNA, 3699 nt, Artificial Sequence
  derived and/or modified sequence opt1 from SLC4A2__Homo_sapiens__NP_001186622
auggacuuccugcuccgcccccagccggagcccgagagccugggccccgggacccccggcuucccggagcaggaggaggacgagcugcaccggacccucgggguggagcgcuucgaggagauccugcaggaggccggcucccgcgggggcgaggagcccggccggagcuacggggaggaggacuucgaguaccaccggcaguccagccaccacauccaccacccccuguccacgcaccucccgcccgacgcccgccggcgcaagacgccccagggccccgggcggaagccccgccggcgcccgggcgcgagccccaccggggagacccccaccaucgaggagggcgaggaggacgaggacgaggccuccgaggccgagggcgcccgggcccugacccagcccagcccggucuccacccccagcuccgugcaguucuuccugcaggaggacgacagcgcggaccgcaaggccgagcggaccucccccagcucccccgccccgcucccccaccaggaggccacgccccgcgcgagcaagggggcccaggccggcacccagguggaggaggccgaggccgaggcggucgccguggccuccgggaccgccggcggcgacgacgggggcgccagcgggcggccccugccgaaggcgcagcccggccaccgcuccuacaaccugcaggagcggcgccggaucgggagcaugaccggcgccgagcaggcccuccugccccgcgugcccacggacgagaucgaggcccagacccuggccaccgcggaccucgaccugaugaagucccaccgcuucgaggacgucccgggcgugcggcgccaccuggugcggaagaacgccaaggggagcacccagagcggccgcgaggggcgggagcccggccccacgccgcgcgcccggccccgcgcgccccacaagccccacgaggucuucguggagcucaacgagcugcugcucgacaagaaccaggagccgcaguggcgggagaccgcccgcuggaucaaguucgaggaggacguggaggaggagaccgagcggugggggaagccccacgucgccucccugagcuuccgcucccugcucgagcugcggcgcacccuggcccacggcgccgugcuccuggaccuggaccagcagacgcuccccggcguggcccaccaggucguggagcagauggugaucagcgaccagaucaaggcggaggaccgggccaacguccugcgcgcccugcuccugaagcacucccaccccagcgacgagaaggacuucuccuucccgcggaacaucagcgccgggucccugggcagccuccuggggcaccaccacggccagggggccgaguccgacccccacgugaccgagccccugaugggcggcgugcccgagacccgccucgaggucgagcgggagcgcgagcugccgccgcccgcgccgcccgccgggaucacccgcagcaaguccaagcacgagcugaagcuccuggagaagauccccgagaacgccgaggccacgguggugcuggucggcugcguggaguuccucagccggcccaccauggccuucguccgccugcgggaggcgguggagcuggacgccgugcucgagguccccgugcccgugcgcuuccuguuccugcugcucgggcccuccagcgccaacauggacuaccacgagaucggccgguccaucagcacccugaugagcgacaagcaguuccacgaggccgccuaccuggcggacgagcgcgaggaccuccugaccgccaucaacgccuuccuggacugcuccgucgugcucccgcccagcgaggugcagggcgaggagcugcugcgguccgucgcccacuuccagcgccagaugcucaagaagcgggaggagcaggggcgccugcugcccacgggcgcggggcucgagcccaagagcgcccaggacaaggcccugcugcagaugguggaggccgccggcgcggccgaggacgacccccuccggcgcaccgggcggccguucggcggccugauccgcgacgugcggcgccgguacccccacuaccuguccgacuuccgcgacgcccucgacccccagugccuggccgccgucaucuucaucuacuucgcggcccugagccccgccaucaccuucgggggccuccugggggagaagacccaggaccugaucggcguguccgagcucaucaugagcacggcccugcaggggguggucuucugccugcucggcgcccagccgcugcuggugaucggcuucuccgggccccuccugguguucgaggaggcguucuucagcuucugcuccagcaaccaccuggaguaccucgucggccggguguggaucggguucuggcugguguuccuggcccuccugauggucgcccuggagggcuccuuccucgugcgcuucgugagccgguucacccaggagaucuucgccuuccugaucucccugaucuucaucuacgagaccuucuacaagcucgucaagaucuuccaggagcacccccugcacgggugcagcgcguccaacagcagcgagguggacggcggcgagaacaugaccugggccggggcccgccccacgcugggcccggggaaccgcucccucgccggccagagcgggcagggcaagccccggggccagcccaacaccgcccugcugucccucgugcugauggcggggaccuucuucaucgccuucuuccugcgcaaguucaagaacagccgguucuuccccggccgcauccggcgcgucaucggggacuucggcgugccgaucgccauccucaucauggugcuggucgacuacuccaucgaggacaccuacacccagaagcugagcgugcccuccggcuucagcgugacggcccccgagaagcgggggugggucaucaacccccucggcgagaaguccccguuccccguguggaugaugguggccagccugcugcccgcgauccucgucuucauccugaucuucauggagacccagaucaccacccugaucaucuccaagaaggagcgcaugcuccagaaggggagcggcuuccaccuggaccugcuccugaucguggccaugggcgggaucugcgcccuguucggccuccccuggcuggccgccgcgacggugcgguccgucacccacgccaacgcccugaccgugaugagcaaggccguggccccgggggacaagcccaagauccaggaggucaaggagcagcgcgugaccggccuccugguggcgcugcucgucgggcuguccaucgugaucggcgaccugcuccggcagaucccccuggccgugcuguucgggaucuuccucuacaugggcgucacgagccugaacggcauccaguucuacgagcgccugcaccuccugcugaugcccccgaagcaccaccccgacgugaccuacgugaagaagguccggacccuccgcaugcaccuguucaccgcccugcagcuccugugccuggcccuccugugggcggugauguccacggccgccagccuggccuuccccuucauccucauccugaccgucccccugcggaugguggugcugacccgcaucuucaccgaccgggagaugaagugccucgacgccaacgaggcggagccggucuucgacgagcgcgaggggguggacgaguacaacgagaugcccaugcccguguga

SEQ ID NO: 36669 - RNA, 3699 nt, Artificial Sequence
  derived and/or modified sequence opt1 from SLC4A3__Homo_sapiens__NP_005061
auggccaacggcgugauccccccgcccgggggcgccagcccccugccccagguccgcgugccgcucgaggagcccccccugucccccgacguggaggaggaggacgacgaccuggggaagacccucgcggucagccgguucggcgaccugaucuccaagccgcccgccugggaccccgagaagcccagccgcuccuacagcgagcgggacuucgaguuccaccgccacaccucccaccacacgcaccacccgcugagcgcccggcucccccccccccacaagcugcgccggcugccgcccaccuccgcccgccacacccggcgcaagcggaagaaggagaagaccagcgccccccccuccgaggggacgccgcccauccaggaggagggcggcgcggggguggacgaggaggaggaggaggaggaggaggaggagggcgagagcgaggccgagcccguggagcccccgcccuccgggaccccccagaaggccaaguucagcaucggcuccgacgaggacgacagccccgggcucccgggccgcgccgcggucaccaagccccugcccuccgugggcccgcacaccgacaagagcccccagcacuccagcagcucccccagcccccgggcccgcgccucccggcuggccggggagaagagccgcccguggucccccagcgccuccuacgaccuccgggagcgccugugccccggcagcgcgcuggggaaccccggcggcccggagcagcaggugcccacggacgaggccgaggcccagaugcucggguccgccgaccuggacgacaugaagagccaccggcuggaggacaaccccggcguccgccggcaccucgugaagaagcccucccgcacccaggggggccgcgggagcccguccggccuggcccccauccugcggcgcaagaagaagaagaagaagcucgaccggcgcccccacgagguguucgucgagcugaacgagcugaugcucgaccggagccaggagccccacuggcgcgagaccgcgcgguggaucaaguucgaggaggacguggaggaggagaccgagcgcuggggcaagccgcacguggccucccugagcuuccggucccugcucgagcugcgccggacgaucgcccacggggccgcccugcucgaccuggagcagaccacccugcccggcaucgcgcaccucgucguggagaccaugaucgugagcgaccagauccgccccgaggaccgggccuccguccugcgcacgcugcuccugaagcacagccaccccaacgacgacaaggacagcggguucuucccgcggaaccccuccagcuccagcaugaacuccgugcugggcaaccaccaccccacccccagccacgggccggacggcgccgugcccaccauggccgacgaccucggcgagcccgccccgcuguggccccacgaccccgacgcgaaggagaagccccugcacaugccggggggcgacgggcaccgcggcaagucccucaagcugcuggagaagauccccgaggacgccgaggccaccgucgugcucguggggugcguccccuuccuggagcagcccgccgcggccuucgugcggcugaacgaggccguccuccuggagagcgugcuggaggugccgguccccgugcgcuuccuguucgugaugcucggccccucccacacgagcaccgacuaccacgagcugggccgguccaucgccacccugaugagcgacaagcucuuccacgaggccgcguaccaggccgacgaccgccaggaccugcuguccgccaucagcgaguuccucgacggguccaucgucauccccccgagcgagguggagggccgcgaccugcugcgguccguggccgccuuccagcgcgagcuccugcggaagcgccgggagcgcgagcagaccaaggucgagaugacgacccgggggggcuacaccgcgcccggcaaggagcugagccucgagcuggggggcagcgaggccacccccgaggacgacccccugcuccgcacgggguccguguucggcgggcuggugcgggacguccgccggcgcuacccgcacuaccccagcgaccugcgggacgcccuccacucccagugcguggccgccgugcuguucaucuacuucgcggcccugagccccgccaucaccuucggcggccuccugggggagaagaccgagggccugaugggggucuccgagcucaucgugagcaccgccgugcugggcguccuguucucccuccugggggcgcagccccugcucguggugggcuucagcggcccgcugcuggucuucgaggaggccuucuucaaguucugccgcgcccaggaccucgaguaccugacggggcgggugugggugggccuguggcucgucguguucgugcuggcccuggucgccgcggagggguccuuccucgugcgcuacaucagccccuucacccaggagaucuucgccuuccugaucucccugaucuucaucuacgagaccuucuacaagcucuacaagguguucaccgagcacccccugcugcccuucuacccgcccgagggcgcccucgaggggagccuggacgccggccuggagcccaacggcuccgcccuccccccgacggaggggccccccagcccgcggaaccagcccaacaccgcgcugcugucccucauccugaugcugggcaccuucuucaucgccuucuuccuccgcaaguuccggaacagccgcuuccuggggggcaaggcccggcgcaucaucggggacuucggcauccccaucuccauccuggucauggugcucguggacuacagcaucaccgacaccuacacgcagaagcugaccguccccaccggccuguccgugaccagcccggacaagcgcagcugguucauccccccccucggguccgcccggcccuucccgcccuggaugaugguggccgcggccguccccgcccugcuggugcucauccugaucuucauggagacgcagaucaccgcccugaucgugagccagaaggcgcgccggcuccugaagggcuccggguuccaccuggaccuccugcugaucggcagccucggcgggcugugcggccuguucgggcuccccuggcugaccgccgccaccguccgcuccgugacgcacgugaacgcccugaccgucaugcggaccgccaucgcgccgggcgacaagccccagauccaggaggugcgcgagcagcgggugaccgggguccucaucgccagccuggugggccuguccaucgugaugggcgccguccuccgccggaucccccuggccgugcuguucgggaucuuccucuacaugggcgugacgagccuguccgggauccagcugagccagcgccuccugcugauccucaugcccgccaagcaccacccggagcagcccuacgucaccaaggugaagaccuggcggaugcaccuguucaccugcauccagcugggcugcaucgcgcuccugugggucgugaaguccacggccgccagccuggccuuccccuuccugcuccugcugaccgugccccuccgccacugccugcugccgcggcucuuccaggaccgcgagcugcaggcccuggacuccgaggacgcggagcccaacuucgacgaggacgggcaggacgaguacaacgagcuccacaugcccgucuga

SEQ ID NO: 36670 - RNA, 3240 nt, Artificial Sequence
  derived and/or modified sequence opt1 from SLC4A4__Homo_sapiens__NP_001091954
auggaggacgaggccgugcuggaccgcggcgccagcuuccucaagcacgucugcgacgaggaggagguggaggggcaccacaccaucuacaucggcgugcacguccccaaguccuaccggcgccggcgccggcacaagcgcaagaccgggcacaaggagaagaaggagaaggagcggaucagcgagaacuacuccgacaagagcgacaucgagaacgcggacgaguccagcuccagcauccugaagccgcugaucucccccgccgccgagcgcauccgguucauccucggcgaggaggacgacagccccgcgcccccgcagcuguucacggagcuggacgagcuccuggccguggacgggcaggagauggaguggaaggagaccgcccgcuggaucaaguucgaggagaagguggagcagggcggcgagcggugguccaagccccacgucgccacccugagccuccacucccuguucgagcugcggaccugcauggagaaggggagcaucaugcucgaccgcgaggccuccagccugccccagcugguggagaugaucguggaccaccagaucgagacgggccuccugaagcccgagcugaaggacaaggucaccuacacccuccugcgcaagcaccggcaccagaccaagaaguccaaccugcgcagccucgccgacaucgggaagacgguguccagcgcgagccggauguucaccaacccggacaacggcucccccgccaugacccaccgcaaccugaccagcuccagccugaacgacaucuccgacaagcccgagaaggaccagcucaagaacaaguucaugaagaagcugccccgggacgccgaggccagcaacgugcuggucggggagguggacuuccucgacacgccguucaucgccuucgugcgccugcagcaggcggucaugcugggcgcccucaccgaggugcccgugcccacccgguuccuguucauccugcucggccccaaggggaaggccaaguccuaccacgagaucggccgcgccaucgccacccugaugagcgacgaggucuuccacgacaucgcguacaaggccaaggaccgccacgaccugaucgccgggaucgacgaguuccucgacgaggugaucgugcugccgcccggcgagugggaccccgccauccggaucgagcccccgaagucccugcccagcuccgacaagcgcaagaacauguacagcggcggggagaacguccagaugaacggcgacacgccccacgacgggggccacgggggcggcgggcacggcgacugcgaggagcuccagcggaccgggcgcuucugcggcgggcugaucaaggacaucaagcggaaggcccccuucuucgcguccgacuucuacgacgcccugaacauccaggcccucagcgccauccuguucaucuaccuggccaccgugaccaacgcgaucacguucggcggccuccugggggacgccaccgacaacaugcagggcgugcuggaguccuuccucgggaccgccgucagcggcgccaucuucugccuguucgcggggcagccgcugaccauccuguccagcacgggccccgugcucgucuucgagcgccugcuguucaacuucuccaaggacaacaacuucgacuaccucgaguuccggcuguggaucggccuguggagcgccuuccucugccugauccugguggccaccgacgccagcuuccucgugcaguacuucacccgcuucaccgaggagggguucuccagccugaucuccuucaucuucaucuacgacgccuucaagaagaugaucaagcuggcggacuacuaccccaucaacagcaacuucaaggucggcuacaacacccucuucuccugcacgugcgugcccccggaccccgccaacaucagcaucuccaacgacaccacccuggcccccgaguaccugccgacgaugagcuccaccgacauguaccacaacaccaccuucgacugggccuuccucagcaagaaggagugcuccaaguacgggggcaaccuggugggcaacaacugcaacuucguccccgacaucacgcugaugagcuucauccucuuccuggggaccuacaccuccagcauggcccugaagaaguucaagaccucccccuacuuccccaccacggcgcggaagcucaucagcgacuucgccaucauccuguccauccugaucuucugcgugaucgacgcccucgugggcgucgacaccccgaagcugaucgugcccagcgaguucaagcccaccagccccaaccgcgggugguucgugccgcccuucggcgagaaccccuggugggucugccuggccgccgcgauccccgcccuccuggugaccauccugaucuucauggaccagcagaucacggccgugaucgucaaccggaaggagcacaagcucaagaagggggccggcuaccaccuggaccuguucuggguggcgauccucauggugaucugcucccugauggcccugccgugguacgucgccgccaccgugaucagcaucgcccacaucgacucccucaagauggagaccgagaccagcgcgcccggcgagcagcccaaguuccugggggugcgcgagcagcgggucacgggcacccugguguucauccucaccgggcuguccguguucauggcccccauccugaaguucaucccgaugcccguccucuacggcguguuccuguacauggggguggccagccugaacggcguccaguucauggaccgccucaagcugcugcucaugccccugaagcaccagcccgacuucaucuaccugcggcacgugccgcuccgccgggugcaccuguucaccuuccugcagguccucugccuggcccugcucuggauccugaaguccacgguggccgcgaucaucuuccccgugaugauccuggcccucgucgccgugcgcaagggcauggacuaccuguucagccagcacgaccuguccuuccucgacgacgugauccccgagaaggacaagaagaagaaggaggacgagaagaagaagaagaagaagaaggggagccuggacuccgacaacgacgacagcgacugccccuacuccgagaaggucccgagcaucaagauccccauggacaucauggagcagcagcccuuccuguccgacagcaagccguccgaccgggagcgcagccccaccuuccucgagcgccacaccuccugcuga

SEQ ID NO: 36671 - RNA, 3414 nt, Artificial Sequence
  derived and/or modified sequence opt1 from SLC4A5__Homo_sapiens__NP_067019
augaaggugaaggaggagaaggccggcgucgggaagcuggaccacaccaaccaccgccggcgcuuccccgaccagaaggagugcccgcccauccacaucggccuccccgugcccaccuacccccagcggaagacggaccagaaggggcaccugagcggccugcagaaggugcacugggggcuccgccccgaccagccccagcaggagcugaccggccccggcuccggggccagcucccaggacagcuccauggaccugaucagccggacccgcuccccggcggccgagcagcuccaggacauccugggcgaggaggacgaggcccccaaccccacccuguucacggagauggacacccuccagcacgacggggaccagauggaguggaaggagagcgcccgguggaucaaguucgaggagaaggucgaggagggcggggagcgcugguccaagccccacgugagcacccugucccugcacagccucuucgagcugcggaccugccugcagacgggcaccgugcuccuggaccuggacuccggcagccucccgcagaucaucgacgacgucaucgagaagcagaucgaggacgggcugcugcgccccgagcuccgggagcgcguguccuacgugcugcugcggcgccaccggcaccagaccaagaagcccauccaccgcagccucgccgacaucggcaaguccgucagcaccacgaaccggucccccgcgcgcagcccgggggccggccccagccugcaccacuccaccgaggaccugcggaugcgccagagcgccaacuacggccggcucugccacgcccagucccgcagcaugaacgacaucucccugacccccaacaccgaccagcgcaagaacaaguucaugaagaagauccccaaggacagcgaggcguccaacgugcuggugggggaggucgacuuccucgaccagccguucaucgccuucgugcggcugauccagagcgccaugcugggcggggugacggagguccccgugcccacccgcuuccucuucauccugcugggccccuccgggcgggccaagagcuacaacgagaucggccgcgccaucgcgacccucaugguggacgaccuguucuccgacgucgccuacaaggcccggaaccgcgaggaccugaucgccggcaucgacgaguuccucgacgaggugaucgugcugccgcccggggagugggaccccaacauccggaucgagcccccgaagaagguccccagcgccgacaagcgcaaguccguguucagccuggcggagcucggccagaugaacggguccgugggcgggggcggcggggcccccggcgggggcaacgggggcggcgggggcgggggcagcggcgggggcgccggguccggcggggccggcggcaccagcuccggggacgacggcgagaugccggccaugcacgagaucggggaggagcugaucuggacgggccgguucuucgggggccugugccucgacaucaagcgcaagcugcccugguuccccagcgacuucuacgacggcuuccacauccagagcaucuccgcgauccuguucaucuaccucgggugcaucaccaacgccaucaccuucggcgggcugcugggcgacgccaccgacaacuaccagggggucauggagagcuuccugggcacggccauggccggcucccucuucugccuguucagcgggcagccccugaucauccucuccagcaccggcccgauccugaucuucgagaagcuccuguucgacuucuccaaggggaacggccuggacuacauggaguuccggcuguggaucgggcuccacagcgcggugcagugccugauccuggucgccaccgacgccuccuucaucaucaaguacaucacccgcuucacggaggagggcuucagcacccucaucuccuucaucuucaucuacgacgccaucaagaagaugaucggcgcguucaaguacuaccccaucaacauggacuucaagcccaacuucaucaccaccuacaagugcgagugcguggcccccgacacggugaacaccaccgucuucaacgccagcgccccgcuggcccccgacaccaacgcgucccuguacaaccuccugaaccugacggcccucgacuggagccugcuguccaagaaggagugccucagcuacgggggccggcugcuggggaacuccugcaaguucauccccgaccucgcccugaugagcuucauccuguucuucggcaccuacagcaugacccucacccugaagaaguucaaguucucccgcuacuuccccaccaaggugcgggcccugguggccgacuucagcaucgucuucuccauccucauguucugcggcaucgacgcgugcuucgggcuggagacgccgaagcugcacgugcccagcgugaucaagcccacccgccccgaccggggcugguucgucgccccguucgggaagaaccccugguggguguaccccgccuccauccuccccgcccugcuggugaccauccucaucuucauggaccagcagaucaccgccgucaucgugaaccgcaaggagaacaagcugaagaaggcggccggcuaccaccuggaccucuucuggguggggauccugauggcccugugcagcuucaugggccucccgugguacgucgccgcgacggugaucuccaucgcccacaucgacagccugaagauggagaccgagaccuccgcccccggcgagcagccccaguuccugggggugcgggagcagcgcgucaccggcaucaucguguucauccucacggggaucagcguguuccuggcccccauccugaagugcaucccgcuccccguccuguacggcguguuccuguacauggggguggccucccucaacggcauccagaugggcaccgggggcagcgaguucaagauccagaagaagcugacccccuucugggagcgcugcaagcuguuccucaugccggcgaagcaccagcccgaccacgccuuccugcggcacgucccccugcgccggauccaccucuucacccuggugcagauccugugccucgccgugcuguggauccugaaguccacggucgccgccaucaucuuccccgugaugauccucgggcugaucaucgugcgccggcugcucgacuucaucuucagccagcacgaccuggcguggaucgacaacauccugccggagaaggagaagaaggagaccgacaagaagcgcaagcggaagaagggcgcccacgaggacugcgacgaggagccccaguucccgccgcccuccgucaucaagauccccauggagagcgugcaguccgacccccagaacgggauccacugcaucgcccgcaagcggagcuccagcuggagcuacucccucuga

SEQ ID NO: 36672 - RNA, 3396 nt, Artificial Sequence
  derived and/or modified sequence opt1 from SLC4A7__Homo_sapiens__NP_001245308
auggaggccgacggcgccggggagcagaugcgcccccugcucacccggggcccggacgaggaggcgguggucgaccuggggaagaccagcuccacggugaacaccaaguucgagaaggaggagcuggagagccaccgcgccguguacaucggcguccacgugcccuucuccaaggagagccggcgccggcaccgccaccgggggcacaagcaccaccaccgccggcgcaaggacaaggaguccgacaaggaggacggccgggagagccccuccuacgacacccccagccagcgcgugcaguucauccucggcaccgaggacgacgacgaggagcacaucccgcacgaccuguucacggagauggacgagcugugcuaccgggacggggaggaguacgaguggaaggagaccgcccgcuggcucaaguucgaggaggacgucgaggacggcggggaccggugguccaagcccuacguggccacccugagccugcacucccucuucgagcugcgcagcugcauccugaacggcaccgugaugcucgacaugcgggccuccacgcuggacgagaucgcggacaugguccuggacaacaugaucgccagcgggcagcucgacgaguccauccgcgagaacgugcgggaggcccugcugaagcgccaccaccaccagaacgagaagcgguucaccagccgcaucccccucgugcgcuccuucgccgacaucggcaagaagcacagcgacccccaccuccuggagcggaacggcauccucgcguccccgcagagcgcccccgggaaccuggacaacagcaaguccggcgagaucaaggggaacggcagcggcgggucccgcgagaacagcaccgucgacuucuccaagguggacaugaacuucaugcggaagauccccaccggcgccgaggccagcaacgugcuggucggggagguggacuuccucgagcgccccaucaucgccuucgugcggcuggcgccggccguccugcucacgggccugaccgaggugcccgugcccacccgcuuccuguuccuccugcuggggcccgccggcaaggccccgcaguaccacgagaucggccgguccaucgccacccucaugacggacgagaucuuccacgacgucgcguacaaggccaaggaccgcaacgaccugcugagcgggaucgacgaguuccucgaccaggugaccgugcugccgcccggcgagugggaccccuccauccggaucgagccgcccaagagcguccccucccaggagaagcgcaagauccccguguuccacaacgggagcacccccacccugggcgagacgcccaaggaggccgcccaccacgccgggcccgagcuccagcggaccggccgccuguucggcgggcugauccucgacaucaagcggaaggcgcccuucuuccuguccgacuucaaggacgcccugagccuccagugccuggccuccauccuguuccucuacugcgccugcaugagcccggucaucaccuucggcgggcugcugggcgaggccaccgaggggcgcaucuccgcgaucgagagccuguucggcgccucccucacgggcaucgccuacagccuguucgccgggcagccccugaccauccucggcagcaccgggcccgugcugguguucgagaagauccuguacaaguucugccgggacuaccagcucuccuaccugagccugcgcaccuccaucggccucuggacgagcuuccugugcaucguccugguggcgaccgacgccuccagccucgugugcuacaucacccgguucaccgaggaggccuucgccgcccugaucugcaucaucuucaucuacgaggcgcuggagaagcuguucgaccugggcgagacguacgccuucaacaugcacaacaaccuggacaagcucaccuccuacagcugcgucugcaccgagccgcccaaccccuccaacgagacccuggcccaguggaagaaggacaacaucacggcccacaacaucagcuggcgcaaccugaccguguccgagugcaagaagcuccgcgggguguuccugggcagcgccugcgggcaccacggccccuacaucccggacguccuguucuggugcgugauccucuucuucaccaccuucuuccuguccagcuuccugaagcaguucaagaccaagcgguacuuccccacgaaggugcgcuccaccaucagcgacuucgcggucuuccucaccaucgugaucauggugaccaucgacuaccuggucggggugcccucccccaagcugcacgugccggagaaguucgagcccacgcaccccgagcggggcuggaucaucagcccccucggcgacaacccgugguggacccugcugaucgccgccauccccgcccuccugugcaccauccugaucuucauggaccagcagaucaccgccgucaucaucaaccgcaaggagcacaagcucaagaagggggcgggcuaccaccuggaccugcucauggugggggugaugcugggcgucugcagcgugauggggcugcccugguucguggccgccacgguccucuccaucagccacgugaacucccugaagguggagagcgagugcuccgcccccggcgagcagccgaaguuccugggcauccgggagcagcgcgucaccgggcucaugaucuucauccugaugggccugagcguguucaugaccuccgugcucaaguucauccccaugcccguccuguacgggguguuccuguacaugggcgugagcucccucaaggggauccagcuguucgaccggaucaagcuguucggcaugcccgcgaagcaccagccggaccucaucuaccugcgcuacgucccccuguggaaggugcacaucuucaccgugauccagcucacgugccugguccugcucugggugaucaaggugagcgccgccgccgucguguuccccaugauggugcuggcccuggucuucgugcggaagcucauggaccugugcuucaccaagcgcgagcuguccuggcucgacgaccugaugcccgagagcaagaagaagaaggaggacgacaagaagaagaaggagaaggaggaggcggagcggaugcugcaggacgacgacgacaccgugcaccucccguucgagggcgggucccugcugcagauccccgucaaggcccucaaguacagcguggaccccuccaucgugaacaucagcgacgagauggccaagaccgcccaguggaaggcccuguccaugaacacggagaacgcgaaggucacccgcagcaacauguccccggacaagcccgugagcgugaagaucagcuucgaggacgagccccggaagaaguacgucgacgccgagaccucccuguga

SEQ ID NO: 36673 - RNA, 2838 nt, Artificial Sequence
  derived and/or modified sequence opt1 from SLC4A9__Homo_sapiens__NP_001245355
auggagaugaagcugcccggccaggagggguucgaggccagcuccgccccgcgcaacauccccagcggcgagcucgacuccaaccccgaccccgggaccggcccgagccccgacgggcccuccgacaccgagagcaaggagcugggcgugcccaaggacccgcugcuguucauccagcugaacgagcugcucggcuggccccaggcgcuggaguggcgggagacggggcgcuggguccuguucgaggagaagcucgagguggccgccggccggugguccgcgccccacgugcccacccuggcccugccgagccuccagaagcugcgcucccugcucgccgaggggcugguccugcucgacugccccgcccagagccugcuggagcucguggagcaggucacccggguggagucccugagccccgagcugcgcggccagcuccaggcccugcugcuccagcggccccagcacuacaaccagaccacggggacccgcccgugcuggggcuccacccacccccggaaggccagcgacaacgaggaggcgccccugcgcgagcagugccagaacccccugcggcagaagcucccgcccggcgccgaggccgggaccgugcuggccggcgagcugggguuccucgcccagccccugggcgcguucgugcgccugcggaaccccgucgugcucggcucccugacggaggugagccugccgucccgcuucuucugccuccugcuggggcccugcaugcucggcaagggguaccacgagaugggccgggccgccgccguccugcugagcgacccccaguuccagugguccgugcgccgggccagcaaccuccacgaccugcuggcggcccucgacgccuuccuggaggaggugaccguccugcccccggggcgcugggaccccaccgcccggaucccgccgcccaagugccugcccagccagcacaagcgccuccccucccagcagcgggagauccgcggcccggccgugccccgccugaccagcgcggaggaccggcaccgccacggcccccacgcccacucccccgagcugcagcggacggggcgcaaggugccgugguaccccagcgacuuccucgacgcccugcaccuccagugcuucuccgccguccucuacaucuaccuggccaccgugaccaacgcgaucaccuucggcgggcugcucggcgacgccacggacggggcccagggcgugcuggagagcuuccugggcaccgccgucgcgggggccgccuucugccucauggccggccagccccugaccauccuguccagcaccgggcccgugcucguguucgagcggcugcuguucuccuucagccgcgacuacucccucgacuaccugccguuccggcugugggucggcaucuggguggccacguucugccucguccugguggcgaccgaggccagcgugcugguccgcuacuucacccgguucaccgaggagggguucugcgcccucaucucccugaucuucaucuacgacgccgugggcaagaugcugaaccucacgcacaccuaccccauccagaagcccggcagcuccgccuacgggugccugugccaguaccccggccccgggggcaacgagagccaguggauccgcacccggcccaaggaccgcgacgacaucgaccugggccucaucaacgcgucccugcugcccccgcccgagugcacccggcagggcgggcacccccgcgggcccggcugccacacggugcccgacaucgccuucuucagccuccugcuguuccucaccuccuucuucuucgccauggcccugaagugcgucaagaccagccgguucuucccgagcguggugcgcaaggggcuguccgacuucagcuccguccucgccauccugcugggcugcggccucgacgcguuccuggggcuggccacccccaagcucauggugccccgggaguucaagccgacgcugcccggccgcggguggcuggugagccccuucggcgccaaccccugguggugguccgucgccgcggcccucccggcccugcugcucagcauccugaucuucauggaccagcagaucaccgccgugauccugaaccggauggaguaccgccuccagaagggggccggcuuccaccuggaccuguucugcguggcgguccucaugcugcugaccuccgcccucggccugcccugguacgugagcgccaccgugaucucccuggcccacauggacagccuccgccgggagucccgcgccugcgcgcccggggagcggcccaacuuccugggcauccgcgagcagcggcugacggggcucgucguguucauccugaccggcgccagcaucuuccuggccccggugcucaaguucauccccaugcccguccuguacgggaucuuccuguacaugggcguggccgcccucuccagcauccaguucaccaaccgcgugaagcugcugcucaugcccgcgaagcaccagccggaccugcugcuccugcggcacgucccccugacccgcgugcaccucuucaccgccauccagcuggccugccugggccuccuguggaucaucaaguccacgcccgccgcgaucaucuucccccugaugcuccuggggcuggugggcguccggaaggcccucgagcgcguguucagcccgcaggagcugcuguggcucgacgagcugaugcccgaggaggagcgguccauccccgagaaggggcuggagcccgagcacagcuucagcggcuccgacagcgaggacuccgagcugauguaccagccgaaggcccccgagaucaacaucagcgugaacuga

SEQ ID NO: 36674 - RNA, 501 nt, Artificial Sequence
  derived and/or modified sequence opt1 from SLC50A1__Homo_sapiens__NP_001116309
augcgcggccugcaccccuggcacgugcuccggcgcccgcuggggccccaggcccacgccaacgaccccgagugcggccagcggcccgucccggcgcugagccaccacgggucccagcgcguggugcuccugcagaccgccacccugcucggcguccugcugcucggguacggcuacuucuggcugcuggugcccaaccccgaggcccggcuccagcagcugggccuguucugcagcguguucacgaucuccauguaccucagcccccuggccgaccuggccaaggucauccagaccaaguccacccagugccucagcuacccgcugaccaucgcgacgcugcucaccuccgccagcuggugccuguacggguuccgccugcgggaccccuacaucaugguguccaacuuccccggcaucgugaccagcuucauccgcuucuggcuguucuggaaguacccccaggagcaggaccggaacuacuggcuccugcagaccuga

SEQ ID NO: 36675 - RNA, 1023 nt, Artificial Sequence
  derived and/or modified sequence opt1 from SLC51A__Homo_sapiens__NP_689885
auggagcccggccgcacccagaucaagcuggacccgcgguacaccgccgaccuccuggaggugcugaagacgaacuacgggauccccagcgccugcuucucccagccgcccaccgcggcccagcuccugcgcgcccugggccccgucgagcucgcccugaccagcauccugacccuccuggcccugggguccaucgcgaucuuccucgaggacgccguguaccuguacaagaacacgcugugccccaucaagcggcgcacccuccuguggaaguccagcgcccccaccguggucagcgugcugugcugcuucggccucuggaucccccggucccuggugcuggucgagaugaccaucacgagcuucuacgccgugugcuucuaccuccugaugcuggugauggucgagggguucggcggcaaggaggcggugcuccgcacccugcgggacaccccgaugauggugcacaccgggcccugcugcugcugcugccccugcugcccccgccugcuccugacgcggaagaagcugcagcuccugaugcugggcccguuccaguacgccuuccucaagaucacccugacccuggucggccucuuccuggugcccgacgggaucuacgaccccgccgacaucuccgaggggagcaccgcccuguggaucaacacguuccucggcguguccacccugcuggcccucuggacccugggcaucaucagccgccaggcgcggcugcaccucggggagcagaacaugggcgccaaguucgcccuguuccagguccugcucauccugaccgcccugcagcccuccaucuucagcgugcuggccaacgggggccagaucgcgugcuccccgcccuacagcuccaagacgcgcagccaggugaugaacugccaccuccugauccuggagaccuuccucaugaccguccugacccggauguacuaccgccggaaggaccacaaggugggcuacgagacguucuccagccccgaccuggaccucaaccugaaggccuga

SEQ ID NO: 36676 - RNA, 387 nt, Artificial Sequence
  derived and/or modified sequence opt1 from SLC51B__Homo_sapiens__NP_849190
auggagcacagcgagggcgcccccggggacccggccggcaccguggucccccaggagcugcucgaggagaugcugugguucuuccgcguggaggacgcgucccccuggaaccacagcauccuggcccucgccgccguggucgugaucaucuccauggugcugcuggggcggagcauccaggccucccgcaaggagaagaugcagcccccggagaaggagacccccgagguccuccaccuggacgaggcgaaggaccacaacagccugaacaaccuccgggagacgcugcuguccgagaagcccaaccucgcccagguggagcuggagcugaaggagcgcgacgugcucagcgucuuccugcccgacgugccggagaccgaguccuga

SEQ ID NO: 36677 - RNA, 1347 nt, Artificial Sequence
  derived and/or modified sequence opt1 from SLC52A1__Homo_sapiens__NP_060456
auggccgcccccacccugggccgccucgugcugacccaccugcucgucgcgcuguucgggaugggcagcugggccgccgugaacgggaucuggguggagcugccggucguggugaaggaccuccccgagggcuggucccugcccagcuaccuguccgucgugguggcccucgggaaccugggccugcucgucgugacgcuguggcggcagcuggcccccggcaagggggagcaggugccgauccaggucgugcaggugcucagcgucgugggcaccgcgcugcuggccccccucuggcaccacguggcccccgucgccgggcagcugcacuccguggcguuccugacccucgcccuggugcuggccauggccugcugcaccagcaacgucacguuccuccccuuccugucccaccugccgccccccuuccuccgcagcuucuuccugggccaggggcuguccgcccuccugcccugcgugcuggcgcucgugcagggcgucggccggcuggagugcccgcccgcccccaccaacgggaccagcggccccccgcuggacuuccccgagcgcuuccccgccuccaccuucuucugggcccucacggcccugcuggugaccagcgcggccgccuuccgggggcuccugcugcuccugcccucccugccgagcgucaccaccggcggcuccgggcccgagcuccagcugggcagccccggggccgaggaggaggagaaggaggaggaggaggcccugccccuccaggagccgcccucccaggcggccggcacgauccccgggcccgacccggaggcccaccagcuguucagcgcccacggcgccuuccugcugggccucauggcguucaccuccgccgugaccaacggggugcugcccagcguccagagcuucuccugccugcccuacggccgccucgccuaccaccuggccguggugcuggggagcgcggccaacccgcucgccugcuuccuggccaugggcguccugugccggucccucgccgggcuggugggccugagccuccugggcaugcuguucggggcguaccucauggcccuggccauccugucccccugccccccccucgugggcaccacggccggggucgugcuggugguccugagcugggugcucugccugugcguguucuccuacgucaagguggccgcgagcucccugcuccacggcgggggccgcccggcccugcuggccgccggcguggccauccaggucgggagccuccugggcgcgggggccauguucccccccaccuccaucuaccacguguuccagagccggaaggacugcguggaccccugcggcccguga

SEQ ID NO: 36678 - RNA, 1338 nt, Artificial Sequence
  derived and/or modified sequence opt1 from SLC52A2__Homo_sapiens__NP_001240745
auggccgcccccaccccggcgcgccccgugcugacccaccuccuggucgcccuguucggcauggggagcugggccgccgugaacggcaucuggguggagcuccccgucguggugaaggagcugcccgagggguggucccugccgagcuacgucuccgugcucguggcccugggcaaccuggggcuccuggucgugacgcuguggcggcgccucgcgcccggcaaggacgagcagguccccauccgggugguccaggugcugggcaugguggggaccgcccugcucgccagccuguggcaccacguggcccccguggcgggccagcugcacuccgucgccuuccucgcccuggccuucgugcuggcccucgcgugcugcgccagcaacgugaccuuccugccguuccugucccaccucccgccccgcuuccugcggagcuucuuccuggggcagggccucuccgcccugcugcccugcguccucgcccuggugcagggggugggccgccuggagugcccgcccgcccccaucaacggcacccccgggccgccccucgacuuccuggagcgguuccccgcgagcacguucuucugggcccugaccgcccuccuggucgccuccgccgcggccuuccagggccugcuccugcugcugcccccgccgcccagcgugcccaccggggagcucggcuccggccugcaggucggggcccccggcgccgaggaggagguggaggagagcagcccccuccaggagccgcccucccaggccgcggggaccacgcccggccccgaccccaaggccuaccagcugcuguccgcccgcagcgccugccuccuggggcugcuggcggccaccaacgcccucaccaacggcgugcugcccgccguccaguccuucagcugccugcccuacggccggcucgccuaccaccuggcgguggugcuggggagcgccgccaacccccucgccugcuuccuggccaugggcguccugugccgcucccucgcggggcugggcgggcugagccuccugggcguguucugcggcggguaccugauggcccucgccgugcugucccccugcccgccccuggucggcaccagcgccgggguggugcucgucgugcuguccugggugcugugccucggcgucuucagcuacgugaagguggccgcguccagccugcugcacgggggcggccggcccgcccuccuggccgccggggucgcgauccaggugggcucccugcucggggccguggccauguucccgcccacgagcaucuaccacgucuuccacucccgcaaggacugcgccgaccccugcgacagcuga

SEQ ID NO: 36679 - RNA, 1410 nt, Artificial Sequence
  derived and/or modified sequence opt1 from SLC52A3__Homo_sapiens__XP_011527450
auggccuuccugaugcaccuccuggugugcgucuucggcauggggagcugggugaccaucaacggccuguggguggagcucccccugcuggucauggagcucccggaggggugguaccugcccuccuaccugaccguggugauccagcucgccaacaucggcccccugcuggucacgcuccugcaccacuuccgccccagcugccuguccgaggugccgaucaucuucacccuccugggggugggcaccgugaccugcaucaucuucgcguuccuguggaacaugacgagcuggguccucgacggccaccacuccaucgccuuccuggugcugaccuucuuccucgcccuggucgacugcaccagcuccgugaccuuccugcccuucaugagccggcuccccacguacuaccugaccaccuucuucgugggggagggccuguccgggcuccugcccgcccuggucgcccucgcgcagggcagcgggcugaccacgugcgugaacgugaccgagaucuccgacagcgucccgucccccgugcccacccgcgagaccgacaucgcccagggcgugccccgggcccuggucagcgcccucccgggcauggaggcgccccugucccaccuggagagccgcuaccuccccgcccacuucagcccccugguguucuuccugcuccuguccaucaugauggccugcugccugguggccuucuucguccuccagcggcagccgcgcugcugggaggccuccguggaggaccugcugaacgaccaggucacgcuccacagcauccggccccgcgaggagaacgaccuggggcccgcgggcaccguggacagcucccaggggcagggcuaccuggaggagaaggccgcccccugcugcccggcccaccucgccuucaucuacacccugguggcguucgucaacgcccugaccaacggcaugcugcccagcgugcagacguacuccugccucagcuacgggcccguggccuaccaccuggccgccacccuguccaucgucgcgaacccccucgccagccugguguccauguuccugccgaaccggagccuccuguuccugggcgugcucuccguccuggggaccugcuucggcggguacaacauggccauggccgugaugagccccugcccccugcuccagggccacuggggcggggaggugcugaucgucgccuccugggugcuguucagcggcugccucuccuacgugaaggucaugcuggggguggugcugcgcgaccucagccgguccgcgcugcuguggugcggcgccgccguccagcucgggagccugcugggcgcccuccugauguucccccuggugaacgugcuccgccuguucuccagcgcggacuucugcaaccugcacugcccggccuga

SEQ ID NO: 36680 - RNA, 1923 nt, Artificial Sequence
  derived and/or modified sequence opt1 from SLC5A11__Homo_sapiens__NP_001245340
auggagagcggcaccuccagcccccagccgccccagcuggacccccucgacgccuucccccagaaggggcuggagccgggcgacaucgccgugcugguccucuacuuccuguucgugcuggcgguggggcucugguccaccgucaagacgaagcgcgacaccgugaagggcuacuuccuggccgggggcgacauggugugguggcccgucggcgccagccuguucgccuccaacguggggagcggccacuucaucgggcucgccggcuccggggcggccaccggcaucagcguguccgccuacgagcugaacggccuguucagcguccucaugcuggccuggaucuuccugcccaucuacaucgcgggccagguggacauguacgccggggccaucuucauccagcagucccuccaccuggaccuguaccucgccaucguggggcugcuggccaucaccgcggucuacacgguggccggcggccucgccgccgugaucuacaccgacgcccugcagacccugaucaugcucaucggggcgcugacccugaugggcuacagcuucgccgccgucgggggcauggaggggcucaaggagaaguacuuccuggcccuggccuccaaccggagcgagaacuccagcugcggccucccccgcgaggacgcguuccacaucuuccgggacccgcugacguccgaccugcccuggcccggcguccucuucgggaugagcauccccucccugugguacuggugcaccgaccaggugaucgugcagcgcacccuggccgccaagaaccucagccacgccaagggcggggcccugauggcggccuaccugaaggugcucccgcuguucaucaugguguuccccggcauggucagccggauccuguuccccgaccagguggccugcgccgaccccgagaucugccagaagaucugcuccaacccgagcgggugcuccgacaucgcguaccccaagcucgugcuggagcugcuccccaccggccugcgcggccugaugauggccgucaugguggccgcccucaugagcucccugacgagcaucuucaacuccgccagcaccaucuucaccauggaccuguggaaccaccuccggccccgcgcguccgagaaggagcucaugaucgucgggcggguguucgugcugcugcucguccuggugagcauccuguggaucccggugguccaggccucccagggcgggcagcuguucaucuacauccagagcaucuccagcuaccugcagccgcccguggccguggucuucaucaugggcugcuucuggaagcgcaccaacgagaagggggccuucuggggccugaucuccggccuccugcuggggcucgugcggcuggugcuggacuucaucuacguccagccccgcugcgaccagcccgacgagcggcccgugcucgucaagagcauccacuaccuguacuucuccaugauccugagcacggugacccucaucaccguguccaccgugagcugguucacggagccgcccagcaaggagauggucucccaccugaccugguucacccgccacgaccccguggugcagaaggagcaggccccgcccgcggcgccccugagccucacccugucccagaacggcaugcccgaggccagcuccagcuccagcguccaguucgagauggugcaggagaacacguccaagacccacagcugcgacaugacccccaagcaguccaagguggucaaggccauccuguggcucugcgggauccaggagaagggcaaggaggagcugcccgcccgggccgaggccaucaucgugagccuggaggagaacccgcucgugaagacccugcuggacgucaaccucaucuucugcguguccugcgccaucuucaucuggggcuacuucgccuga

SEQ ID NO: 36681 - RNA, 1857 nt, Artificial Sequence
  derived and/or modified sequence opt1 from SLC5A12__Homo_sapiens__NP_848593
auggaggugaagaacuucgccgucugggacuacgugguguucgccgcgcuguucuucaucagcuccggcaucggggucuucuucgccaucaaggagcgcaagaaggccaccagccgggaguuccucgugggcgggcgccagauguccuucggccccguggggcugagccugaccgccuccuucaugagcgccgucacggugcucggcaccccguccgagguguaccgguucggcgcgagcuuccuggucuucuucaucgccuaccuguucgugauccuccugaccuccgagcuguuccuccccguguucuaccgcagcgggaucaccuccacguacgaguaccugcagcugcgguucaacaagcccguccgcuacgccgccaccgugaucuacaucgugcagaccauccucuacaccggcgucgugguguacgcgcccgcccuggcccugaaccaggucacgggguucgaccucuggggcagcguguucgccaccgggaucgugugcaccuucuacugcacccugggcggccugaaggccgucguguggacggacgcguuccagaugguggucaugaucgugggguuccucaccguccugauccagggcuccacccacgccgggggcuuccacaacgugcuggagcagagcaccaacggcucccggcuccacaucuucgacuucgacguggacccgcugcgccggcacacguucuggaccaucaccgucgggggcaccuucacguggcuggggaucuacggcgugaaccagagcaccauccagcgcugcaucuccugcaagaccgagaagcacgccaagcucgcccuguacuucaaccugcucgggcuguggaucauccuggugugcgccgucuucagcggccucaucauguacucccacuucaaggacugcgaccccuggaccagcggcaucaucagcgcgcccgaccagcugaugcccuacuucgugauggagaucuucgccacgaugccggggcugcccggccucuucguggccugcgccuucuccgggacccugagcaccgucgccuccagcaucaacgcgcuggccaccgugacguucgaggacuucgugaaguccugcuucccccaccucagcgacaagcuguccaccuggaucagcaagggccugugccuccuguucggggucaugugcaccuccauggccguggccgccagcgugaugggcggcgucgugcaggcgucccugagcauccacgggaugugcggcgggcccaugcucggccuguucucccuggggaucguguucccguucgucaacuggaagggcgcccucggcgggcugcugaccggcaucacgcucagcuucuggguggccaucggggccuucaucuaccccgcgcccgccuccaagaccuggccccugccgcugagcaccgaccagugcaucaaguccaacgugaccgccacgggcccgcccguccugagcucccggcccggcaucgccgacaccugguacagcaucagcuaccucuacuacuccgccguggggugccugggcugcaucguggcgggggucaucaucagccugaucaccggccgccagcgcggggaggacauccagccccuccugauccggcccgugugcaaccuguucugcuucugguccaagaaguacaagacccucugcuggugcggcgugcagcacgacagcggcaccgagcaggagaaccuggagaacggguccgcccggaagcagggcgccgagagcguccugcagaacgggcuccgccgggagucccuggugcacgugcccggcuacgaccccaaggacaagagcuacaacaacauggccuucgagacgacccacuucuga

SEQ ID NO: 36682 - RNA, 1995 nt, Artificial Sequence
  derived and/or modified sequence opt1 from SLC5A1__Homo_sapiens__NP_000334
auggacagcuccaccuggagccccaagaccacggccgugacccgcccggucgagacccacgagcugauccggaacgccgcggacaucuccaucaucgugaucuacuucguggucgugauggccgugggccucugggccauguucagcaccaaccgcgggacggucggcggguucuuccuggccggccgguccauggugugguggcccaucggggccagccuguucgcguccaacaucggcagcggccacuucguggggcucgccggcaccggggccgccuccggcaucgcgaucgggggcuucgaguggaacgcccugguccugguggugguccucggcuggcuguucgugcccaucuacaucaaggccgggguggucaccaugcccgaguaccugcgcaagcgguucggcgggcagcgcauccagguguaccucagccugcugucccuccugcuguacaucuucaccaagaucagcgccgacaucuucuccggcgccaucuucaucaaccucgcgcugggccugaaccucuaccuggccaucuuccugcuccuggccaucacggcccuguacaccaucaccgggggccucgccgcggugaucuacaccgacacgcugcagaccgucaucaugcugguggggagccucauccugaccggcuucgccuuccacgaggucgggggcuacgacgccuucauggagaaguacaugaaggccaucccgaccaucguguccgacggcaacacgaccuuccaggagaagugcuacacgccccgggccgacagcuuccacaucuuccgcgacccccugaccggggaccuccccuggccgggcuucaucuucgggauguccauccugacgcugugguacuggugcaccgaccaggugaucgugcagcggugccucagcgcgaagaacaugucccacgucaagggcgggugcauccugugcggcuaccugaagcucaugcccauguucaucauggugaugcccggcaugaucagccgcauccuguacaccgagaagaucgccugcgucgugcccagcgagugcgagaaguacugcgggaccaaggugggcugcacgaacaucgccuacccgacccuggucguggagcucaugcccaacgggcugcggggccugaugcucuccgugaugcuggccagccugauguccagccucaccuccaucuucaacagcgccuccacccuguucacgauggacaucuacgcgaagguccgcaagcgggccagcgagaaggagcugaugaucgccgggcgccucuucauccuggugcugaucggcaucuccaucgccugggugcccaucguccagagcgcgcaguccggccagcuguucgacuacauccagagcaucaccuccuaccucgggcccccgaucgccgccguguuccugcuggccaucuucuggaagcgggugaacgagcccggcgccuucugggggcucauccugggccugcucaucggcaucagccgcaugaucaccgaguucgcguacgggaccggcuccugcauggagcccagcaacugccccacgaucaucugcgggguccacuaccuguacuucgccaucauccuguucgccaucuccuucaucaccaucguggugaucagccuccugaccaagccgauccccgacguccaccuguaccggcucugcuggucccugcgcaacagcaaggaggagcggaucgaccuggacgccgaggaggagaacauccaggagggccccaaggagaccaucgagaucgagacccaggugcccgagaagaagaaggggaucuuccgccgggccuacgaccucuucugcggccuggagcagcacggcgcgccgaagaugaccgaggaggaggagaaggccaugaagaugaagaugaccgacaccagcgagaagccccuguggcgcaccgugcucaacgucaacgggaucauccuggugacgguggccgucuucugccacgccuacuucgccuga

SEQ ID NO: 36683 - RNA, 2019 nt, Artificial Sequence
  derived and/or modified sequence opt1 from SLC5A2__Homo_sapiens__NP_003032
auggaggagcacaccgaggccggcagcgcccccgagaugggggcgcagaaggcccugaucgacaaccccgccgacauccucgugaucgccgccuacuuccugcuggucaucggcguggggcucugguccaugugccgcaccaaccggggcacggucgggggcuacuuccuggcgggccgcagcauggugugguggcccgugggggccucccuguucgccagcaacaucggcuccgggcacuucgugggccucgccgggaccggcgcggccagcggccuggccgucgccggguucgaguggaacgcccuguucguggugcuccugcugggcuggcuguucgcgcccgucuaccugaccgccggggugaucaccaugccccaguaccugcggaagcgcuucggcggccggcgcauccggcucuaccuguccgugcugagccucuuccuguacaucuucacgaagaucuccgucgacauguucagcggggccguguucauccagcaggcccugggcuggaacaucuacgccuccgugaucgcgcuccuggggaucaccaugaucuacaccgucaccggcgggcuggccgcccucauguacacggacaccgugcagaccuucgugauccugggcggcgccugcauccugaugggguacgccuuccacgaggucggcggguacagcggccucuucgacaaguaccugggggcggccaccucccugacggugagcgaggacccggccgugggcaacaucuccagcuucugcuaccgcccccggcccgacuccuaccaccuccugcgccaccccgucaccggcgaccugccguggcccgcccuccugcuggggcucaccaucgugagcggcugguacuggugcuccgaccaggugaucguccagcggugccuggccggcaagagccugacccacaucaaggcggggugcauccucugcggguaccugaagcugacgcccauguuccucauggugaugcccggcaugaucagccgcauccuguacccggacgaggucgccugcguggugcccgaggucugccggcgcgugugcggcaccgagguggggugcuccaacaucgccuacccccggcuggucgugaagcucaugcccaacggccugcgcgggcugaugcucgccgugaugcuggcggcccugaugagcucccuggccagcaucuucaacuccagcuccacccucuucaccauggacaucuacacgcggcugcgcccgcgggccggcgaccgcgagcugcuccuggucggccggcugugggugguguucaucgucguggugagcgucgccuggcuccccguggugcaggcggcccagggcgggcagcuguucgacuacauccaggccgucuccagcuaccuggccccgcccguguccgccguguucguccucgcgcuguucgugccccgcgugaacgagcagggggccuucuggggccugaucgggggccuccugaugggccuggcccgccucauccccgaguucagcuucggguccggcagcugcguccagcccuccgccugccccgccuuccugugcggggugcacuaccuguacuucgcgaucguccucuucuucugcagcggccugcugacccucaccgugucccugugcaccgccccgaucccccggaagcaccuccaccgccucguguucagccugcggcacuccaaggaggagcgcgaggaccuggacgccgacgagcagcaggggagcagccuccccgugcagaacggcugccccgaguccgccauggagaugaacgagccgcaggcgcccgcccccagccuguuccggcagugccugcucugguucugcggcaugucccgcgggggcgucgggagcccgccgccccugacgcaggaggaggccgccgccgcggcccggcgccuggaggacaucuccgaggaccccagcugggcccggguggugaaccucaacgcccugcugaugauggccgucgcgguguuccucuggggcuucuacgccuga

SEQ ID NO: 36684 - RNA, 2157 nt, Artificial Sequence
  derived and/or modified sequence opt1 from SLC5A3__Homo_sapiens__NP_008864
augcgggccgugcuggacaccgccgacaucgcgaucgucgcccucuacuucauccuggugaugugcaucggcuucuucgccauguggaaguccaaccggagcaccgugagcggguacuuccuggccggccgcuccaugacgugggucgccaucggggcgagccucuucguguccaacaucggcagcgagcacuucaucgggcuggccggcuccggcgccgccagcggguucgcggugggcgccugggaguucaacgcccugcuccugcugcagcuccuggggugggucuucauccccaucuacauccgguccggcguguacaccaugccggaguaccugagcaagcgcuucgggggccaccggauccagguguacuucgccgcccucucccugauccuguacaucuucaccaagcucagcgucgaccuguacuccggcgcgcuguucauccaggagagccucggguggaaccuguacguguccgugauccugcucaucggcaugaccgcccugcugacggucaccgggggccucguggccgugaucuacaccgacacccugcaggcccugcucaugaucaucggcgcccugacgcugaugaucaucagcaucauggagaucgggggcuucgaggaggucaagcgccgguacaugcucgcgucccccgacgugaccagcauccugcugaccuacaaccucuccaacaccaacagcugcaacgugagccccaagaaggaggcccugaagaugcugcgcaaccccacggacgaggacgucccguggcccggguucauccucggccagacccccgccuccgugugguacuggugcgccgaccaggugaucguccagcgggugcuggccgcgaagaacaucgcccacgccaaggggagcacccugauggccggcuuccucaagcugcugcccauguucaucaucguggucccgggcaugaucucccgcauccucuucaccgacgacaucgccugcaucaaccccgagcacugcaugcuggugugcgggagccgggcgggcugcuccaacaucgccuacccccgccuggucaugaagcucgugcccguggggcugcggggccugaugauggccgucaugaucgccgcgcucaugagcgaccuggacuccaucuucaacagcgccuccacgaucuucacccuggacguguacaagcugauccgcaagagcgccuccagccgggagcucaugaucguggggcgcaucuucgucgccuucaugguggugaucuccaucgccugggucccgaucaucguggagaugcagggcggccagauguaccuguacauccaggagguggcggacuaccugaccccgcccgucgccgcccucuuccugcuggccaucuucuggaagcggugcaacgagcagggggccuucuacggcgggauggcgggcuucgugcucggggccgugcgccugauccuggccuucgccuaccgggcccccgagugcgaccagcccgacaaccgccccggcuucaucaaggacauccacuacauguacgucgcgaccggccucuucugggugacggggcugaucaccgugaucgucagccugcucaccccgccgcccaccaaggagcagauccggacgaccaccuucugguccaagaagaaccugguggugaaggagaacugcagccccaaggaggagcccuacaagaugcaggagaaguccauccugcgcugcagcgagaacaacgagaccaucaaccacaucauccccaacggcaaguccgaggacagcaucaaggggcuccagcccgaggacgucaaccugcuggugacgugccgcgaggagggcaaccccguggccagccucggccacuccgaggccgagacccccgucgacgccuacagcaacgggcaggcggcccugaugggcgagaaggagcggaagaaggagaccgacgacgggggccgcuacuggaaguucaucgacugguucugcggguucaaguccaagagccuguccaagcggagccuccgcgaccugauggaggaggaggccgugugccugcagaugcucgaggagacccgccaggugaaggucauccugaacaucggccuguucgccgugugcucccucggcaucuucauguucguguacuucagccuguga

SEQ ID NO: 36685 - RNA, 1980 nt, Artificial Sequence
  derived and/or modified sequence opt1 from SLC5A4__Homo_sapiens__NP_055042
auggccagcaccgugucccccagcaccaucgccgagacgccggagcccccgccccuguccgaccacauccgcaacgcggccgacaucagcgucaucgugaucuacuuccucguggucauggccgugggccugugggccaugcugaagaccaaccgggggaccaucggcggguucuuccucgccggccgcgacauggcgugguggcccaugggggccucccuguucgccagcaacaucggcuccaaccacuacgugggccuggccgggaccggcgcggccagcggggucgccacggugaccuucgaguggaccuccagcgugaugcuccugauccugggcuggaucuucguccccaucuacaucaaguccggggugaugaccaugcccgaguaccucaagaagcgguucggcggcgagcgccuccagguguaccugagcauccugucccuguucaucugcgucgugcugcucaucagcgccgacaucuucgccggggcgaucuucaucaagcuggcccugggccucgaccuguaccuggccaucuucauccuccuggccaugacggccguguacaccaccaccgggggccuggcguccgucaucuacacggacacccuccagaccaucaucaugcugaucggcagcuucauccugaugggguucgccuucaacgaggugggcggguacgaguccuucaccgagaaguacgugaacgccacgcccagcgucguggagggcgacaaccucaccaucuccgccagcugcuacaccccgcgggccgacagcuuccacaucuuccgcgacgcggugaccggggacauccccuggcccggcaucaucuucggcaugcccaucacggcccugugguacuggugcaccaaccaggucaucgugcagcggugccugugcgggaaggacaugucccacgugaaggccgccugcaucaugugcgccuaccucaagcugcugccgauguuccucauggucaugcccggcaugaucagccgcauccuguacaccgacaugguggcgugcgucgugcccuccgagugcgugaagcacugcggggucgacgugggcugcaccaacuacgccuaccccacgauggugcuggagcucaugccgcaggggcugcggggccugaugcucagcgucaugcuggccucccugaugagcucccucaccagcaucuucaacuccgccagcacccuguucaccaucgaccuguacacgaagaugcgcaagcaggcguccgagaaggagcuccugaucgccggccggaucuucgugcugcuccugaccguggucagcaucgugugggugccccugguccaggugucccagaacgggcagcugauccacuacaccgagagcaucuccagcuaccucggcccgcccaucgccgccguguucguccuggccaucuucugcaagcgcgugaacgagcagggggcguucuggggccugaugguggggcucgccaugggccugauccggaugaucaccgaguucgccuacggcacgggguccugccuggcccccagcaacugccccaagaucaucugcggcguccacuaccucuacuucuccaucgugcuguucuucgggagcaugcuggugacccucggcaucagccugcugaccaagcccauccccgacguccaccucuaccgccugugcugggugcugcggaacuccaccgaggagcgcaucgacaucgacgccgaggagaagucccaggaggagacggacgacggcguggaggaggacuacccggagaagucccgggggugccucaagaaggcguacgaccuguucugcggccugcagaaggggcccaagcucaccaaggaggaggaggaggcccugagcaagaagcugaccgacaccagcgagcgccccagcuggcggaccaucgucaacaucaacgccauccuccugcuggccgugguggucuucauccacggcuacuacgccuga

SEQ ID NO: 36686 - RNA, 1932 nt, Artificial Sequence
  derived and/or modified sequence opt1 from SLC5A5__Homo_sapiens__NP_000444
auggaggccguggagaccggcgagcgccccaccuucggggccugggacuacggcgucuucgcgcugaugcuccuggugagcacggggaucggccuguggguggggcucgcccggggcggccagcgcuccgccgaggacuucuucaccgggggccggcgccuggccgcccugccggucgggcucagccuguccgcgagcuucauguccgccguccaggugcugggcgugcccagcgaggccuaccgguacgggcucaaguuccuguggaugugccugggccagcuccugaacuccgugcugaccgcccuccuguucaugcccguguucuaccgccugggccucaccagcacguacgaguaccuggagaugcgguucucccgcgcgguccggcugugcgggacccuccaguacaucguggccaccaugcuguacaccggcaucgugaucuacgcccccgcccugauccucaaccaggucacggggcuggacaucugggccagccugcucuccaccggcaucaucugcaccuucuacaccgcggugggcgggaugaaggccguggucuggacggacguguuccagguggucgugaugcugagcggcuucugggugguccuggcccgcggggugaugcucgugggcgggccgcggcagguccugacccuggcccagaaccacucccgcaucaaccucauggacuucaaccccgacccccggagccgcuacaccuucuggaccuucguggucggcggcacgcugguguggcuguccauguacggggugaaccaggcccagguccagcgguacguggcgugccgcaccgagaagcaggccaagcucgcccugcugaucaaccaggugggccucuuccugaucgucagcuccgccgccugcugcgggaucgugauguucguguucuacaccgacugcgacccccugcuccugggccggaucagcgcgccggaccaguacaugccccugcucguccuggacaucuucgaggaccugcccggggugcccggccucuuccuggccugcgccuacuccggcacccugagcacggccagcaccuccaucaacgccauggcggccgugaccgucgaggaccugaucaagccgcgccuccggagccuggcgccccgcaagcuggugaucaucuccaaggggcucagccugaucuacggcuccgccugccugaccguggccgcccucagcucccugcucgggggcgggguccugcagggcagcuucacggugaugggcgugaucuccgggccccugcugggcgccuucauccucgggauguuccugcccgccugcaacaccccgggcguccuggccggccucggggcgggccuggcccugagccucuggguggcccugggggccacccuguacccgcccuccgagcagaccaugcgggugcuccccagcuccgccgcgcgcugcgucgcccugagcgugaacgccuccggccugcucgaccccgcccugcugcccgccaacgacagcucccgcgcgcccagcuccgggauggacgccagccggcccgcccucgccgacagcuucuacgcgaucuccuaccuguacuacggcgcccugggcacgcucaccaccgugcugugcggggcccugaucagcugccucaccggcccgacgaagcgcuccacccuggcccccgggcugcucuggugggaccuggcccggcagaccgcgagcgucgcccccaaggaggagguggccauccuggacgacaaccucgugaagggccccgaggagcugccgaccgggaacaagaagccgcccggcuuccugcccacgaacgaggaccgccucuucuuccugggccagaaggagcuggagggggccggcuccuggacccccugcgucgggcacgacggcgggcgggaccagcaggagaccaaccucuga

SEQ ID NO: 36687 - RNA, 1908 nt, Artificial Sequence
  derived and/or modified sequence opt1 from SLC5A6__Homo_sapiens__XP_006712193
augagcgugggcgucuccaccagcgcgccccuguccccgaccagcgggacguccgugggcaugagcaccuucuccaucauggacuacguggucuucgugcuccugcuggugcucagccuggccaucgggcuguaccacgccugccgcggcugggggcggcacaccgucggcgagcuccugauggccgaccgcaagaugggcugccugcccguggcccucucccugcuggccaccuuccagagcgccguggcgauccucgggguccccuccgagaucuaccgguucggcacgcaguacugguuccuggggugcugcuacuuccugggccuccugauccccgcccacaucuucaucccgguguucuaccgccugcaccucaccagcgccuacgaguaccuggagcugcgguucaacaagaccgugcgcgucugcgggaccgugacguucaucuuccagauggugaucuacaugggcgucgugcucuacgcccccucccuggcgcugaacgccgugaccggcuucgaccucuggcugagcguccuggcccucgggaucgugugcaccguguacaccgcccugggcgggcugaaggccgucaucuggacggacguguuccagacccucgugauguuccugggccagcuggcggucaucaucgugggcuccgccaaggucgggggccucgggcgggugugggccguggccagccagcacggccgcaucuccggguucgagcuggaccccgaccccuucguccggcacaccuucuggacccuggccuucggcggcguguucaugaugcucagccuguacggggugaaccaggcgcagguccagcgcuaccuguccagccggacggagaaggccgccgugcucagcugcuacgccguguucccguuccagcaggucucccugugcgugggcugccugaucgggcucgugauguucgccuacuaccaggaguaccccaugagcauccagcaggcgcaggccgcccccgaccaguucguccuguacuucgugauggaccugcucaagggccugcccgggcugccgggccucuucaucgccugccuguucuccggcagccuguccaccaucagcuccgccuucaacagccuggcgaccgugaccauggaggaccucauccgccccugguuccccgaguucuccgaggcccgggccaucaugcugagccgcgggcuggccuucggcuacgggcuccugugccugggcauggcguacaucuccagccagauggggcccguccuccaggccgccaucuccaucuucggcauggugggcgggccgcugcugggccucuucugccuggggauguucuuccccugcgccaacccgcccggcgccguggucggccugcucgcggggcuggugauggccuucuggaucggcaucgggagcaucgugacguccaugggcagcuccaugccgcccagccccuccaacgggagcagcuucucccugcccaccaaccucaccgucgccaccgugacgacccugaugccccugaccaccuucagcaagcccacgggccuccagcgguucuacucccugagcuaccugugguacuccgcccacaacagcaccaccgugaucgucgugggccucaucgugucccugcugaccgggcgcaugcggggccgcagccucaaccccgccacgaucuaccccguccugccgaagcugcucucccugcugccccucagcugccagaagcggcugcacugccgcuccuacgggcaggaccaccuggacaccggccucuuccccgagaagccgcggaacggggugcugggcgacagccgcgacaaggaggcgauggcccuggacggcaccgccuaccagggguccagcuccacgugcauccuccaggagaccagccuguga

SEQ ID NO: 36688 - RNA, 1743 nt, Artificial Sequence
  derived and/or modified sequence opt1 from SLC5A7__Homo_sapiens__NP_001291934
auggccuuccacguggagggccugaucgccaucaucgucuucuaccuccugauccugcucguggggaucugggcggccuggcgcaccaagaacagcggcuccgccgaggagcggagcgaggccaucaucgucgggggccgcgacaucgggcugcuggugggcggcuucaccaugacggccaccugggucgggggcggguacaucaacggcaccgcggaggccguguacgugcccggguacggccucgccugggcccaggcgccgaucggcuacucccugagccugauccucgggggccuguucuucgccaagcccaugcgguccaagggguacgugaccaugcuggaccccuuccagcagaucuacggcaagcgcaugggcgggcuccuguucauccccgcccugaugggcgagauguucugggccgccgcgaucuucagcgcccucggggccacgaucuccgugaucaucgacgucgacaugcacaucagcgugaucaucuccgcccugaucgccacccuguacacccucgugggcgggcuguacagcgucgcguacaccgacguggugcagcuguucugcaucuucgucggccucuggaucuccgugccguucgcccugagccaccccgccguggccgacaucggcuucacggccguccacgcgaaguaccagaagcccuggcuggggaccguggacuccagcgagguguacuccuggcucgacagcuuccugcugcucaugcugggcgggauccccuggcaggccuacuuccagcggguccuguccagcuccagcgccaccuacgcccaggugcucagcuuccuggccgcguucggcugccuggugauggccaucccggccauccucaucggggccaucggcgcguccaccgacuggaaccagacggccuacggccugcccgaccccaagaccaccgaggaggccgacaugauccugcccaucguccuccaguaccugugcccgguguacaucagcuucuucgggcugggcgccgucuccgccgcggugaugagcuccgccgacagcuccauccucagcgccuccagcauguucgcccgcaacaucuaccagcuguccuuccggcagaacgccagcgacaaggagaucgugugggucaugcgcaucaccguguucguguucggggcguccgccacggccauggcccugcucaccaagaccgucuacggccugugguaccugagcuccgaccucguguacaucgugaucuucccccagcugcugugcguccucuucgugaaggggaccaacacguacggcgccguggcgggcuacgucagcgggcuguuccugcggaucaccggcggggagcccuaccuguaccuccagccccugaucuucuacccgggcuacuaccccgacgacaacggcaucuacaaccagaaguuccccuucaagacccuggccauggugaccuccuuccucacgaacaucugcaucagcuaccuggccaaguaccuguucgaguccgggacccugcccccgaagcucgacguguucgacgccgucguggcgcgccacagcgaggagaacauggacaagaccauccuggugaagaacgagaacaucaagcucgacgagcuggcccuggucaagccccggcagagcaugacccucuccagcacguucaccaacaaggaggccuuccuggacguggacuccagccccgagggcuccgggaccgaggacaaccugcaguga

SEQ ID NO: 36689 - RNA, 1833 nt, Artificial Sequence
  derived and/or modified sequence opt1 from SLC5A8__Homo_sapiens__NP_666018
auggacacgccccgcggcaucgggaccuucguggucugggacuacgugguguucgccggcaugcuggucaucagcgccgcgaucgggaucuacuacgccuucgccggcgggggccagcagaccuccaaggacuuccucaugggcgggcggcgcaugaccgccgugccgguggcccugagccugaccgcguccuucaugagcgccgucaccgugcucggcacgcccuccgagguguaccgguucggggccaucuucagcaucuucgccuucaccuacuucuucgucguggugaucuccgcggaggucuuccugcccguguucuacaagcugggcaucaccagcaccuacgaguaccucgagcugcgcuucaacaagugcgugcggcugugcgggacgguccucuucaucgugcagaccauccuguacaccggcaucgugaucuacgcccccgcccuggcccucaaccaggucaccggcuucgaccuguggggcgccgugguggcgacgggggucgugugcaccuucuacugcacccucgggggccugaaggccgugaucuggaccgacgucuuccaggugggcaucauggucgccggguucgccuccgugaucauccaggccguggucaugcagggcgggaucagcacgauccugaacgacgcguacgacggcgggcgccugaacuucuggaacuucaacccgaacccccuccagcggcacaccuucuggaccaucaucaucggcggcaccuucacguggaccuccaucuacggggugaaccagagccaggugcagcgcuacaucuccugcaagagccgguuccaggccaagcugucccuguacaucaaccucgucggccugugggccauccugaccugcagcguguucugcgggcucgcccuguacucccgcuaccacgacugcgaccccuggaccgccaagaaggugagcgcgcccgaccagcugaugccguaccucguccuggacauccugcaggacuaccccggccuccccgggcuguucguggccugcgccuacuccggcacgcugagcaccgugagcuccagcaucaacgcccucgccgcggucaccguggaggaccugaucaagcccuacuuccggucccugagcgagcgcucccucagcuggaucucccagggcaugagcguggucuacggggcccugugcaucggcauggccgcccuggcgucccucaugggggcccugcugcaggccgcccucagcguguucggcauggucgggggcccgcugaugggccuguucgcccucgggauccuggugcccuucgcgaacuccaucggcgcccugguggggcucauggccggcuucgccaucagccugugggugggcaucggggcccagaucuacccgccccugcccgagcggacccugccccuccaccuggacauccagggcugcaacuccacguacaacgagaccaaccugaugaccaccacggagaugcccuucaccaccagcgucuuccagaucuacaacgugcagcgcacgccccucauggacaacugguacucccugagcuaccuguacuucuccaccguggggacccucgucacccugcuggugggcauccucgugagccuguccaccgggggccggaagcagaaccuggacccgcgcuacauccucaccaaggaggacuuccugagcaacuucgacaucuucaagaagaagaagcacguccugagcuacaagucccaccccguggaggacggcgggacggacaaccccgcguucaaccacaucgagcucaacagcgaccaguccggcaagagcaacgggacccggcuguga

SEQ ID NO: 36690 - RNA, 1899 nt, Artificial Sequence
  derived and/or modified sequence opt1 from SLC6A11__Homo_sapiens__NP_055044
augaccgccgagaaggcccugccccucggcaacgggaaggcggccgaggaggcccgcgagagcgaggccccgggcgggggcugcuccagcgggggcgccgcgcccgcccggcacccccgcgugaagcgggacaaggccguccacgagcgcggccacuggaacaacaagguggaguucgugcuguccgucgccggggagaucaucggccuggggaacguguggcgguuccccuaccucugcuacaagaacggcgggggcgcguuccugaucccguacguggucuucuucaucugcugcggcauccccguguucuuccuggagaccgcccucgggcaguucacgagcgagggcgggaucacgugcuggcgcaaggugugcccccuguucgagggcaucggcuacgccacccaggucaucgaggcccaccugaacguguacuacaucaucauccucgccugggcgaucuucuaccuguccaacugcuucaccaccgagcugcccugggcgaccugcgggcacgaguggaacaccgagaacugcguggaguuccagaagcucaacgucagcaacuacucccacgugagccugcagaacgccaccuccccggugauggaguucugggagcaccggguccuggccaucagcgacggcaucgagcacaucgggaaccuccgcugggagcuggcccugugccuccuggccgccuggacgaucugcuacuucugcaucuggaagggcaccaaguccaccgggaaggugguguacgucaccgccacguuccccuacaucaugcugcucauccugcugauccggggcgugacccuccccggcgccagcgaggggaucaaguucuaccuguaccccgaccugucccgccucagcgacccccaggugugggucgacgccggcacccagaucuucuucuccuacgcgaucugccuggggugccugaccgcccucggcagcuacaacaacuacaacaacaacugcuaccgggacugcaucaugcugugcugccugaacuccgggacgagcuucguggccggcuucgccaucuucuccgugcucggcuucauggccuacgagcagggggucccgaucgcggagguggccgagagcggccccgggcuggccuucaucgccuaccccaaggcggucaccaugaugccgcugagcccccucugggccacccuguucuucaugaugcugaucuuccucggccuggacucccaguucgugugcguggagagccuggucaccgccgugguggacauguaccccaaggucuuccgccggggguaccgccgggagcuccugauccuggcccucuccgugaucagcuacuuccugggccuggugaugcucacggagggcgggauguacaucuuccagcuguucgacuccuacgccgcgagcggcaugugccugcuguucgucgccaucuucgagugcaucugcaucggguggguguacggcuccaaccgcuucuacgacaacaucgaggacaugaucggcuaccggcccccgagccucaucaaguggugcuggaugaucaugacccccgggaucugcgccggcaucuucaucuucuuccugaucaaguacaagccccugaaguacaacaacaucuacaccuaccccgccuggggguacggcaucggguggcucauggcccuguccagcaugcugugcaucccgcucuggaucugcaucaccguguggaagacggagggcacccugcccgagaagcugcagaagcucaccacccccuccacggaccugaagaugcgcggcaagcugggggucagcccccggauggugaccgugaacgacugcgacgcgaagcucaaguccgacggcaccaucgccgccaucaccgagaaggagacgcacuucuga

SEQ ID NO: 36691 - RNA, 1845 nt, Artificial Sequence
  derived and/or modified sequence opt1 from SLC6A12__Homo_sapiens__XP_005253803
auggacggcaagguggccguccaggagugcgggcccccggccgugagcugggugcccgaggagggcgagaagcuggaccaggaggacgaggaccaggucaaggaccgcgggcaguggaccaacaagauggaguucgugcucuccguggcgggcgagaucaucgggcugggcaacgucuggcgguuccccuaccugugcuacaagaacggcgggggcgccuucuucauccccuacuucaucuucuucuucgugugcgggaucccgguguucuuccucgaggucgcccugggccaguacaccagccagggguccgugacggccuggcgcaagaucugcccccuguuccagggcaucggccucgccagcguggucaucgaguccuaccugaacguguacuacaucaucauccuggcgugggcccucuucuaccuguucagcuccuucaccagcgagcugcccuggacgaccugcaacaacuucuggaacaccgagcacugcaccgacuuccucaaccacuccggggccggcaccgugacccccuucgagaacuucacgagcccggucauggaguucugggagcggcgcgugcuggggaucaccuccggcauccacgaccugggcagccuccggugggagcuggcccugugccuccugcuggcgugggugaucugcuacuucugcaucuggaagggggucaaguccaccggcaaggugguguacuucaccgccacguuccccuaccucaugcuggucauccugcucauccgcggggugacccugcccggcgccuaccaggggaucaucuacuaccugaagcccgaccucuuccggcugaaggacccccagguguggauggacgccggcacccagaucuucuucagcuucgccaucugccagggcugccugaccgcgcucggguccuacaacaaguaccacaacaacugcuacaaggacugcaucgcccugugcuuccugaacagcgccacguccuucgucgccggcuucguggucuucagcauccucggguucaugucccaggagcagggcgugcccaucagcgagguggccgagagcgggcccggccuggcguucaucgccuuccccaaggccgucaccaugaugccgcugucccagcucuggagcugccuguucuucaucaugcugaucuuccucggccuggacucccaguucgugugcguggagugccuggucaccgccagcaucgacauguucccccgccagcuccggaaguccgggcgccgggagcugcugauccucaccaucgccgugaugugcuaccugaucggccuguuccucgugacggagggcgggauguacaucuuccagcuguucgacuacuacgcgagcuccgggaucugccugcuguuccucagccuguucgaggucgugugcaucuccuggguguacggcgccgaccgcuucuacgacaacaucgaggacaugaucggcuaccggcccuggccccuggucaagaucagcuggcuguuccucaccccggggcugugccucgccaccuuccuguucucccugagcaaguacaccccgcucaaguacaacaacguguacguguacccgcccuggggcuacuccaucgggugguuccuggcccugagcuccauggucugcgugccccucuucguggucaucacgcugcugaagacccgcggccccuuccggaagcgccuccggcagcugaucacccccgacagcucccugccccagccgaagcagcaccccugccucgacggcagcgccgggcgcaacuucggccccuccccgacccgggaggggcugaucgcgggcgagaaggagacgcaccuguga

SEQ ID NO: 36692 - RNA, 1533 nt, Artificial Sequence
  derived and/or modified sequence opt1 from SLC6A13__Homo_sapiens__NP_001177926
auggacagccgcguguccggcaccaccagcaacggggagacgaagcccgucuacccggugauggagaagaaggaggaggacggcacccuggagcgggggcacuggaacaacaagauggaguucgugcucuccgucgccggcgagaucaucgggcugggcaacguguggcgcuuccccuaccugugcuacaagaacggcggggagcacugcauggaguuccagaagaccaacggcagccucaacgggaccuccgagaacgccacgagccccgugaucgaguucugggagcggcgcguccugaagaucuccgacggcauccagcaccugggggcgcuccggugggagcuggcccugugccuccugcuggccugggugaucugcuacuucugcaucuggaagggcgugaaguccaccggcaaggucguguacuucaccgccaccuuccccuaccucaugcuggugguccugcucauccgcggggugacgcugccgggcgccgcgcaggggauccaguucuaccuguaccccaaccucacccggcugugggacccccagguguggauggacgccggcacccagaucuucuucuccuucgccaucugccugggcugccucaccgcccuggggagcuacaacaaguaccacaacaacugcuaccgcgacugcaucgcgcugugcuuccucaacuccggcacgagcuucgucgccggguucgccaucuucuccauccugggcuucaugagccaggagcagggggugcccaucuccgagguggccgagagcggcccgggccuggccuucaucgcguacccccgggccgucgugaugcuccccuucagcccccugugggccugcugcuucuucuucauggugguccugcucgggcuggacagccaguucgugugcguggagucccuggucaccgcccucguggacauguacccgcacgucuuccgcaagaagaaccggcgcgaggugcugauccugggcgugagcgucgugagcuuccucguggggcugaucaugcugaccgagggcgggauguacgucuuccagcuguucgacuacuacgccgcguccggcaugugccuccuguucguggccaucuucgagagccucugcguggccugggucuacggcgccaagcgguucuacgacaacaucgaggacaugaucggguaccgccccuggccccugaucaaguacugcuggcuguuccucacccccgccgugugcacggcgaccuuccuguucucccugaucaaguacaccccgcucaccuacaacaagaaguacacguaccccugguggggcgacgcccugggguggcugcuggcccucagcuccauggugugcauccccgccuggagccuguaccggcugggcacccucaaggggcccuuccgcgagcggauccgccagcugaugugcccggccgaggaccugccccagcggaaccccgcgggccccuccgccccggccacgccccgcaccagccuccugcggcugaccgagcucgagucccacugcuga

SEQ ID NO: 36693 - RNA, 1929 nt, Artificial Sequence
  derived and/or modified sequence opt1 from SLC6A14__Homo_sapiens__NP_009162
auggacaagcugaagugccccagcuucuucaagugccgcgagaaggagaagguguccgccagcuccgagaacuuccacgucggcgagaacgacgagaaccaggaccgggggaacuggagcaagaaguccgacuaccuccugagcaugaucggcuacgccguggggcugggcaacguguggcgcuucccguaccucaccuacuccaacgggggcggcgcguuccugauccccuacgccaucaugcuggcccucgccgggcugccccuguucuuccucgagugcagccugggccaguucgccucccuggggcccgucagcguguggcggauccucccgcuguuccagggcguggggaucaccaugguccugaucuccaucuucgugacgaucuacuacaacgugaucaucgcguacagccucuacuacauguucgccuccuuccagagcgagcugcccuggaagaacugcuccagcugguccgacaagaacugcagccgcucccccaucgucacccacugcaacgugagcaccgugaacaagggcauccaggagaucauccagaugaacaagagcugggucgacaucaacaacuucacgugcaucaacggcuccgagaucuaccagcccgggcagcugccgagcgagcaguacuggaacaagguggcccuccagcgguccagcggcaugaacgagaccggggugaucgucugguaccuggcccugugccuccugcuggcguggcucaucgugggcgccgcccuguucaagggcaucaaguccagcgggaagguggucuacuucaccgcccuguuccccuacguggugcuccugauccugcucguccgcggcgccacccuggagggggcguccaagggcaucagcuacuacaucggggcccaguccaacuucaccaagcugaaggaggccgagguguggaaggacgccgccacgcagaucuucuacagccucuccguggcguggggcggccuggucgcccugagcuccuacaacaaguucaagaacaacugcuucagcgacgccaucguggucugccucaccaacugccugaccuccguguucgccggguucgccaucuucagcauccugggccacauggcgcacaucuccgggaaggaggugagccaggucgugaaguccggcuucgaccucgccuucaucgccuaccccgaggcccuggcccagcugcccgggggcccguucuggagcauccucuucuucuucaugcugcugacccucggccuggacagccaguucgcguccaucgagacgaucaccaccaccauccaggaccuguuccccaaggugaugaagaagaugcggguccccaucacgcucgggugcugccuggugcuguuccugcucggccuggugugcgucacccaggccgggaucuacugggugcaccugaucgaccacuucugcgccggcugggggauccucaucgccgcgauccuggagcuggugggcaucaucuggaucuacggcgggaaccgcuucaucgaggacaccgagaugaugaucggcgccaagcgguggaucuucuggcucugguggcgcgccugcugguucgucaucacccccauccugcugaucgccaucuucaucuggagccucgugcaguuccaccggccgaacuacggggccauccccuaccccgacuggggcguggcgcugggcuggugcaugaucgucuucugcaucaucuggauccccaucauggccaucaucaagaucauccaggccaaggggaacaucuuccagcgccugaucuccugcugccggccggccagcaacuggggccccuaccucgagcagcaccgcggggagcgguacaaggacaugguggaccccaagaaggaggccgaccacgagauccccacgguguccggcagccgcaagccggaguga

SEQ ID NO: 36694 - RNA, 870 nt, Artificial Sequence
  derived and/or modified sequence opt1 from SLC6A15__Homo_sapiens__NP_060527
augcccaagaacagcaagguggucaagcgcgagcuggacgacgacgugaccgaguccgugaaggaccuccugagcaacgaggacgccgccgacgacgcguucaagaccuccgagcugaucgucgacggccaggaggagaaggacacggacguggaggaggggagcgagguggaggacgagcggccggccuggaacuccaagcuccaguacauccuggcccaggucggcuucagcguggggcugggcaacguguggcgcuuccccuaccucugccagaagaacgggggcggcgccuaccugcugcccuaccucauccugcugauggucaucgggaucccccucuucuuccuggagcuguccgugggccagcggauccgccgggggagcaucggcguguggaacuacaucuccccgaagcucgggggcaucggcuucgccagcugcgucgugugcuacuucguggcgcuguacuacaacgucaucaucggguggucccuguucuacuucagccaguccuuccagcagccccuccccugggaccagugcccccuggugaagaacgccagccacaccuucguggagccggagugcgagcaguccagcgccaccaccuacuacugguaccgcgaggcccugaacaucuccagcuccaucagcgagagcggcgggcucaacuggaagaugacgaucugccugcuggcggccugggucauggugugccucgccaugaucaagggcauccaguccagcggcaagguguccaugcuggagcccuuccugauccuccugaucaccaucagcggguucaucccccuguccaacagcgucaccgacuucugcggccagaucacccacaacacguccuucuga

SEQ ID NO: 36695 - RNA, 1887 nt, Artificial Sequence
  derived and/or modified sequence opt1 from SLC6A18__Homo_sapiens__NP_872438
auggcccacgcccccgagccggaccccgcggccugcgaccugggcgacgagcgccccaagugggacaacaaggcccaguaccuccugagcugcaccggguucgccgugggccuggggaacaucuggcgguuccccuaccucugccagaccuacggcgggggcgccuuccugaucccguacgucaucgcgcugguguucgagggcauccccaucuuccacguggagcucgccaucgggcagcgccugcggaagggcuccgucgggguguggacggccaucagccccuaccuguccggcguggggcucggcugcgucacccugagcuuccugaucucccucuacuacaacaccaucguggccugggugcugugguaccugcucaacagcuuccagcacccccugccgugguccagcugcccgcccgaccugaaccgcaccggcuucgucgaggagugccagggguccagcgcgguguccuacuucugguaccggcagacgcucaacaucaccgccgacaucaacgacagcggcuccauccagugguggcugcugaucugccucgccgccagcugggccguggucuacaugugcgugauccgcgggaucgagaccaccggcaaggugaucuacuucacggcgcuguuccccuaccugguccucaccaucuuccugauccggggccugacccuccccggggccaccaagggccugaucuaccuguucacgcccaacaugcacauccuccagaacccccgcguguggcuggacgccgccacccagaucuucuucucccugagccucgccuucgggggccacaucgcguucgccuccuacaacagcccccggaacgacugccagaaggacgccguggucaucgcccuggugaaccgcaugaccucccuguacgccagcaucgcgguguucagcguccucggguucaaggccaccaacgacuacgagcacugccuggaccggaacauccugucccucaucaacgacuucgacuucccggagcagagcaucucccgcgacgacuaccccgccgugcugaugcaccugaacgccacguggcccaagcggguggcccagcucccccugaaggcgugccugcucgaggacuuccuggacaagagcgccuccggcccgggccuggccuucgucguguucaccgagaccgaccuccacaugcccggggcccccgucugggcgaugcuguucuucggcaugcuguucacccuggggcucagcacgauguucggcaccguggaggccgugaucaccccgcugcuggacgucggggugcucccccgcugggugcccaaggaggcccugaccggccuggucugccucgugugcuuccuguccgccacgugcuucacccugcagagcggcaacuacuggcucgagaucuucgacaacuucgccgcgucccccaaccugcugaugcucgccuuccuggagguggucggggugguguacgucuacggcaugaagcgguucugcgacgacaucgccuggaugaccgggcgccggcccagcccguacuggcgccugaccuggcggguggugagcccccuccugcugacgaucuucgucgccuacaucauccuccuguucuggaagccccugcgcuacaaggccuggaacccgaaguacgagcuguuccccucccggcaggagaagcucuaccccggcugggcgcgcgccgccugcgugcugcucucccugcugcccgugcucugggucccgguggccgcccuggcgcagcugcucacccgccggcgccggaccuggcgcgaccgggacgcccgccccgacaccgacaugcggcccgacacggacacccgccccgacaccgacaugcggccggacaccgacaugcgcuga

SEQ ID NO: 36696 - RNA, 1905 nt, Artificial Sequence
  derived and/or modified sequence opt1 from SLC6A19__Homo_sapiens__NP_001003841
auggugcgccugguccuccccaacccgggccuggacgcccggauccccagccuggccgagcucgagaccaucgagcaggaggaggcguccagccgccccaagugggacaacaaggcccaguacaugcugaccugccugggguucugcgugggccucgggaacguguggcgguuccccuaccugugccagucccacggcgggggcgccuucaugaucccguuccugauccuccugguccuggagggcaucccccuccuguaccuggaguucgccaucgggcagcgccuccggcgcggcagccugggggugugguccagcauccaccccgcccugaagggccucgggcuggcguccaugcugacgagcuucauggugggccucuacuacaacaccaucaucuccuggaucaugugguaccuguucaacagcuuccaggagccccugccgugguccgacugcccccucaacgagaaccagaccggcuacgucgacgagugcgcccggagcucccccguggacuacuucugguaccgcgagacccugaacaucagcacguccaucagcgacuccgggagcauccagugguggaugcugcucugccuggccugcgccugguccgugcuguacaugugcaccauccggggcaucgagaccaccgggaaggcggucuacaucacgagcacccuccccuacguggugcugaccaucuuccugauccgcggccucacccugaagggcgccacgaacgggaucgucuuccuguucaccccgaacgugaccgagcucgcccagcccgacaccuggcuggacgccggcgcccagguguucuucagcuucucccuggcguucgggggccucaucagcuucuccagcuacaacuccguccacaacaacugcgagaaggacagcgugaucguguccaucaucaacggguucacgagcgucuacguggccaucguggucuacuccgugaucggcuuccgggccacccagcgcuacgacgacugcuucagcaccaacauccugacccugaucaacggcuucgaccuccccgaggggaacgugacgcaggagaacuucgucgacaugcagcagcggugcaacgccuccgaccccgccgcguacgcccagcugguguuccagaccugcgacaucaacgccuuccugagcgaggccgucgagggcaccgggcucgccuucaucguguucaccgaggcgaucacgaagaugccgcugagcccccugugguccguccucuucuucaucaugcuguucugccugggccuguccagcauguucgggaacauggagggcgugguggugccccuccaggaccugcgcgucaucccgcccaaguggcccaaggaggugcugaccggccucaucugccuggggaccuuccugaucggcuucaucuucacccucaacuccgggcaguacuggcugagccugcucgacuccuacgccggcagcaucccccugcugaucaucgccuucugcgagauguucagcguggucuacguguacgggguggaccgguucaacaaggacaucgaguucaugaucggccacaagcccaacaucuucuggcaggucacguggcgcgugguguccccgcuccugaugcugaucaucuuccucuucuucuucgucguggaggugagccaggagcugaccuacuccaucugggaccccggcuacgaggaguuccccaagagccagaagaucuccuaccccaacugggucuacgugguggucgugaucguggccggggucccgagccugaccauccccggcuacgccaucuacaagcucauccggaaccacugccagaagcccggggaccaccagggccugguguccacccugagcacggcguccaugaacggcgaccucaaguacuga

SEQ ID NO: 36697 - RNA, 1800 nt, Artificial Sequence
  derived and/or modified sequence opt1 from SLC6A1__Homo_sapiens__NP_003033
auggccaccaacggcagcaagguggccgacgggcagaucuccaccgaggucagcgaggcgcccguggccaacgacaagccgaagacgcugguggucaaggugcagaagaaggccgccgaccuccccgaccgcgacaccuggaagggccgguucgacuuccugauguccugcgugggguacgccaucggccuggggaacgucuggcgcuuccccuaccucugcggcaagaacggcgggggcgcguuccugauccccuacuuccugacccucaucuucgccggggugccgcuguuccugcucgagugcagccugggccaguacaccuccaucgggggccugggcguguggaagcucgcccccauguucaagggggucggccuggccgcggccgugcugagcuucuggcucaacaucuacuacaucgugaucaucuccugggccaucuacuaccuguacaacagcuucacgaccacccugcccuggaagcagugcgacaaccccuggaacaccgaccggugcuucuccaacuacagcauggucaacacgaccaacaugaccuccgccgugguggaguucugggagcgcaacaugcaccagaugaccgacgggcucgacaagccgggccagauccgguggccccuggccaucacgcuggcgaucgccuggauccucgucuacuucugcaucuggaagggcgugggguggaccggcaagguggucuacuucagcgccaccuaccccuacaucaugcugaucauccuguucuuccgcggggugacccuccccggcgccaaggaggggauccuguucuacaucacgccgaacuuccggaagcuguccgacagcgagguguggcucgacgccgcgacccagaucuucuucuccuacggccugggccuggggagccucaucgcccugggcuccuacaacagcuuccacaacaacgucuaccgcgacuccaucaucgugugcugcaucaacagcugcaccagcauguucgccggguucgugaucuucuccaucgucggcuucauggcccacgugaccaagcggagcaucgccgacgucgcggccuccgggcccggccuggccuuccucgccuaccccgaggccgugacgcagcugcccaucagcccgcugugggcgauccucuucuucuccaugcugcugaugcucggcaucgacagccaguucugcaccguggagggguucaucaccgcccuggucgacgaguacccccgccugcuccggaaccgccgggagcuguucaucgccgccgugugcaucaucuccuaccugaucggccucagcaacaucacccagggcgggaucuacguguucaagcuguucgacuacuacuccgcgagcgggaugucccuccuguuccuggucuucuucgagugcgugagcaucuccugguucuacggcgugaaccgcuucuacgacaacauccaggagauggucggcagccggcccugcaucugguggaagcugugcugguccuucuucacgcccaucaucguggccgggguguucaucuucagcgccguccagaugaccccgcugaccaugggcaacuacguguuccccaagugggggcagggcgugggcuggcucauggcccuguccagcaugguccugauccccggguacauggccuacauguuccucacccugaagggcucccugaagcagcgcauccaggugauggugcagcccagcgaggacaucguccggccggagaacgggcccgagcagccccaggcgggcagcuccacgagcaaggaggccuacaucuga

SEQ ID NO: 36698 - RNA, 1779 nt, Artificial Sequence
  derived and/or modified sequence opt1 from SLC6A20__Homo_sapiens__NP_064593
auggagaaggcccggccccugugggccaacagccuccaguucguguucgcgugcaucuccuacgccgucggccuggggaacguguggcgguucccguaccugugccagauguacggcgggggcagcuuccucgugcccuacaucaucaugcugaucgucgaggggaugccccugcucuaccuggagcuggccgugggccagcgcaugcggcagggcuccaucggggccuggcgcaccaucagccccuaccucuccggcgugggggucgccagcgugguggucuccuucuuccugagcauguacuacaacgugaucaacgcgugggccuucugguaccuguuccacuccuuccaggacccgcuccccuggagcgugugcccccugaacggcaaccacaccggguacgacgaggagugcgagaaggccuccagcacgcaguacuucugguaccggaagacccugaacaucucccccagccuccaggagaacggcggcguccagugggagccggcccugugccugcuccuggcguggcuggugguguaccucugcauccugcgcgggaccgaguccaccggcaaggucguguacuucacggccagccugcccuacugcgugcucaucaucuaccugauccgggggcugacccuccacggcgccaccaacggccugauguacauguucacccccaagaucgagcagcuggccaaccccaaggccuggaucaacgcggccacgcagaucuucuucucccucgggcugggcuucgggagccugaucgccuucgccuccuacaacgagccgagcaacaacugccagaagcacgccaucaucgucagccucaucaacuccuucaccagcaucuucgcguccaucgugaccuucagcaucuacggcuucaaggccaccuucaacuacgagaacugccugaagaaggugucccugcuccugacgaacaccuucgaccuggaggacggguuccucaccgccagcaaccuggagcaggucaagggcuaccuggccuccgccuaccccagcaaguacuccgagauguucccccagaucaagaacugcagccucgaguccgagcuggacaccgcggugcagggcacggggcuggccuucaucguguacaccgaggccaucaagaacauggaggucagccagcucugguccgugcuguacuucuucaugcugcucaugcugggcaucgggagcaugcugggcaacaccgccgccauccugacgccccucaccgacuccaagaucaucagcucccaccucccgaaggaggcgaucagcgggcuggucugccuggugaacugcgccaucggcaugguguucaccauggaggccggcaacuacugguucgacaucuucaacgacuacgccgcgacccugucccugcuccugaucguccugguggagaccaucgccgugugcuacgucuacgggcuccgccgguucgagagcgaccugaaggccaugacgggccgcgccgugagcugguacuggaaggugaugugggccggggucagcccccugcucaucgugucccuguucguguucuaccuguccgacuacauccucaccggcacccugaaguaccaggcgugggacgccagccaggggcagcuggucaccaaggacuaccccgccuacgcccucgccgugaucggccugcugguggcguccagcacgaugugcaucccccucgccgcccugggcaccuucguccagcggcgccugaagcgcggggacgccgacccgguggccuga

SEQ ID NO: 36699 - RNA, 1854 nt, Artificial Sequence
  derived and/or modified sequence opt1 from SLC6A2__Homo_sapiens__NP_001165972
augcugcucgcccgcaugaacccccaggugcagccggagaacaacggcgccgacaccgggcccgagcagccccugcgggcgcgcaagaccgccgagcugcucgucgugaaggagcggaacggcgugcagugccugcuggcgccccgcgacggggacgcccagccgcgggagacguggggcaagaagaucgacuuccuccugagcgucgugggguucgccguggaccuggccaacgucuggcgcuuccccuaccucugcuacaagaacggcggcggggccuuccugauccccuacacccuguuccucaucaucgccggcaugccccuguucuacauggagcuggcccucgggcaguacaaccgggagggcgcggccaccguguggaagaucugcccguucuucaagggggugggcuacgccgucauccugaucgcccuguacgugggcuucuacuacaacgugaucaucgccuggucccucuacuaccuguucagcuccuucacccugaaccuccccuggacggacugcgggcacaccuggaacagccccaacugcaccgaccccaagcugcugaacggcuccguccucgggaaccacaccaaguacagcaaguacaaguucacgccggcggccgaguucuacgagcgcggcgugcugcaccuccacgaguccagcggcauccacgacaucgggcucccccaguggcagcugcugcucugccugaugguggucgugaucgugcuguacuucucccucuggaagggcgucaagaccagcgggaaggugguguggaucaccgccacccugcccuacuucguccuguucgugcuccuggugcacggcgucacgcugcccggggccuccaacggcaucaacgccuaccuccacaucgacuucuaccggcugaaggaggcgaccguguggaucgacgccgccacccagaucuucuucagccugggcgccggguucggcguccucaucgccuucgcguccuacaacaaguucgacaacaacugcuaccgcgacgcccugcugaccagcuccaucaacugcaucacgagcuucguguccggguucgccaucuucagcauccucggcuacauggcccacgagcacaaggugaacaucgaggacgucgccaccgagggggcgggccugguguucauccuguacccggaggccaucuccacccucagcggcagcaccuucugggccguggucuucuucgugaugcugcuggcccuggggcucgacuccagcaugggcgggauggaggcggugaucacgggccuggccgacgacuuccagguccugaagcggcaccgcaagcuguucaccuucggggugaccuucuccaccuuccugcuggcccucuucugcaucacgaagggcggcaucuacgugcugacccugcucgacaccuucgccgccgggaccagcauccuguucgcgguccugauggaggccaucggcguguccugguucuacgggguggaccgguucagcaacgacauccagcagaugaugggcuuccgccccggccucuacuggcggcugugcuggaaguucgucucccccgccuuccuccuguucgugguggucgugagcaucaucaacuucaagccccugacguacgacgacuacaucuucccgcccugggccaacugggugggguggggcaucgcccuguccagcaugguccucgugcccaucuacgugaucuacaaguuccuguccacccaggggagccugugggagcgccucgcguacggcaucacccccgagaacgagcaccaccuggucgcccagcgggacauccgccaguuccagcugcagcacuggcucgccaucuga

SEQ ID NO: 36700 - RNA, 1893 nt, Artificial Sequence
  derived and/or modified sequence opt1 from SLC6A4__Homo_sapiens__NP_001036
auggagaccacgccccugaacagccagaagcagcucuccgccugcgaggacggcgaggacugccaggagaacggggugcugcagaaggucgugccgacccccggcgacaagguggagagcgggcagaucuccaacggcuacagcgccguccccucccccggggcgggcgacgacacccgccacagcaucccggccaccaccacgacccugguggccgagcuccaccagggcgagcgggagaccugggggaagaagguggacuuccugcuguccgucaucggcuacgccguggaccucgggaacguguggcgcuuccccuacaucugcuaccagaacggcgggggcgccuuccugcugcccuacaccaucauggcgaucuucggcgggaucccccucuucuacauggagcuggcccugggccaguaccaccggaacgggugcaucagcaucuggcgcaagaucugcccgaucuucaagggcaucggcuacgccaucugcaucaucgccuucuacaucgcguccuacuacaacacgaucauggccugggcccucuacuaccugaucagcuccuucaccgaccagcugcccuggaccagcugcaagaacuccuggaacaccgggaacugcacgaacuacuucagcgaggacaacaucaccuggacccuccacuccaccagccccgccgaggaguucuacacgcggcacguccugcagauccaccgcuccaagggccugcaggaccucgggggcaucagcuggcagcuggcccugugcaucaugcucaucuucaccgugaucuacuucuccaucuggaagggggugaagaccagcggcaaggucgugugggugaccgcgacguuccccuacaucauccugagcguccugcucgugcggggcgccacccugccgggggccuggcgcggcgugcuguucuaccucaagcccaacuggcagaagcugcuggagaccggggucuggaucgacgccgccgcgcagaucuucuucucccucggccccggguucggcgugcugcuggccuucgccagcuacaacaaguucaacaacaacugcuaccaggacgcccucgugaccuccgucgugaacugcaugacgagcuucguguccggcuucgucaucuucaccgugcugggguacauggccgagaugcggaacgaggacgucagcgagguggcgaaggacgccggccccucccuccuguucaucaccuacgccgaggccaucgccaacaugccggcgagcaccuucuucgccaucaucuucuuccugaugcugaucacgcucgggcuggacuccaccuucgccggccuggagggggugaucaccgccguccucgacgaguucccccacgugugggcgaagcgccgggagcgcuucgugcuggccgucgugaucacgugcuucuucggcagccuggugacccucaccuucggcggggccuacgucgugaagcugcuggaggaguacgccaccggccccgccgugcucaccgucgcgcugaucgaggccguggccguguccugguucuacgggaucacgcaguucugccgggacgucaaggagaugcugggcuucagccccggcugguucuggcgcaucugcuggguggccaucuccccgcuguuccuccuguucaucaucugcagcuuccugauguccccgccccagcuccggcuguuccaguacaacuaccccuacuggagcaucauccugggguacugcaucggcaccuccagcuucaucugcauccccaccuacaucgccuaccgccucaucaucacccccgggaccuucaaggagcggaucaucaaguccaucacgcccgagacccccaccgagaucccgugcggcgacauccgccugaacgcgguguga

SEQ ID NO: 36701 - RNA, 2394 nt, Artificial Sequence
  derived and/or modified sequence opt1 from SLC6A5__Homo_sapiens__XP_011518775
auggacugcagcgcccccaaggagaugaacaagcugccggccaacucccccgaggcggccgccgcccagggccaccccgacgggcccugcgccccgcgcaccagccccgagcaggagcuccccgcggccgccgcgcccccgccgccccgggugccccgcuccgccagcaccggcgcccagacguuccaguccgccgacgcccgggccugcgaggcggagcgccccggggucggcagcugcaagcuguccagcccccgggcccaggccgccuccgccgcgcugcgcgaccuccgggaggcccagggggcccaggccagcccgccgcccggcuccagcggccccgggaacgcccugcacugcaagauccccuuccugcgcggccccgagggggacgcgaacguguccgugggcaaggggacccucgagcggaacaacacccccgucgugggcugggugaacaugagccaguccaccgucgugcuggccacggacggcaucaccagcgugcugcccggguccgucgccaccguggccacccaggaggacgagcagggcgacgagaacaaggcccgcgggaacuggagcuccaagcucgacuucauccugagcauggugggcuacgcggucggccuggggaacguguggcgguuccccuaccucgccuuccagaacggcgggggcgccuuccugauccccuaccugaugaugcucgcccuggcggggcugccgaucuucuuccucgaggugagccugggccaguucgccucccagggccccgucagcguguggaaggccauccccgcccugcaggggugcggcaucgccaugcucaucaucuccgugcugaucgcgaucuacuacaacgucaucaucugcuacacgcuguucuaccucuucgccagcuucguguccgugcugcccugggggagcugcaacaacccguggaacacccccgagugcaaggacaagaccaagcugcuccuggacuccugcgucaucagcgaccaccccaagauccagaucaagaacuccaccuucugcaugacggccuacccgaacgugaccauggugaacuucaccagccaggccaacaagaccuucgucuccggcagcgaggaguacuucaaguacuucgugcugaagaucuccgccgggaucgaguaccccggcgagauccgcuggccccucgcgcugugccuguuccucgccugggucaucguguacgccagccuggccaagggcaucaagacguccgggaagguggucuacuucaccgccaccuuccccuacguggugcuggucauccuccugauccggggcgugacccugccgggggcgggcgccgggaucugguacuucaucacgcccaagugggagaagcucaccgacgccaccguguggaaggacgccgcgacccagaucuucuucagccuguccgccgccuggggcggccugaucacgcucagcuccuacaacaaguuccacaacaacugcuaccgcgacacccugaucgugaccugcaccaacagcgccacgagcaucuucgccggguucgucaucuucuccgugaucggcuucauggcgaacgagcggaaggucaacaucgagaacguggccgaccaggggcccggcaucgccuucguggucuaccccgaggcccugacccgccucccgcugagccccuucugggccaucaucuucuuccugaugcuccugacccugggccuggacaccauguucgcgacgaucgagaccaucgugaccuccaucagcgacgaguuccccaaguaccuccggacccacaagcccguguucacgcuggggugcugcaucugcuucuucaucaugggcuucccgaugaucacccagggcgggaucuacauguuccagcuggucgacaccuacgccgccuccuacgcccucgugaucaucgccaucuucgagcugguggggaucagcuacgucuacggccugcagcgcuucugcgaggacaucgagaugaugaucggcuuccagcccaacaucuucuggaaggugugcugggcguucgugacccccaccauccucacguucauccugugcuucuccuucuaccagugggagcccaugaccuacgggagcuaccgguacccgaacugguccaugguccugggcuggcucaugcuggccugcagcgugaucuggauccccaucauguucgugaucaagaugcaccuggcccccgggcgcuucaucgagcggcucaagcuggucugcagcccccagccggacuggggccccuuccuggcccagcaccgcggggagcgcuacaagaacaugaucgacccccucggcaccuccucccugggccugaagcuccccgugaaggaccuggagcuggggacccagugcuga

SEQ ID NO: 36702 - RNA, 2166 nt, Artificial Sequence
  derived and/or modified sequence opt1 from SLC6A6__Homo_sapiens__NP_001127839
augggcgacgccgagagcugccugcuccgccagcagacccgggaggugcgcaagaagccccugaucaacuaccgguuccugcgcgccgcggccaacgccgagccgcgggggccccaggcccagcgcaccuccugcgccaagcgggagugcggcgcguucacgcagcgcguccgggagcgcgccgggcggcagccgcccgccggcgggacccgccacagccgggccgagcgcggccggcgccggucccacccccgcagccggacccgcaccacggcgcuccugcgguccagccagaccaaggagauggccaccaaggagaagcugcagugccucaaggacuuccacaaggacauccugaagcccucccccggcaagagccccgggacccgcccggaggacgaggccgagggcaagccgccccagcgcgagaagugguccagcaagaucgacuucgugcuguccguggccgggggcuucgucgggcucggcaacguguggcgguuccccuaccugugcuacaagaacggcgggggcgccuuccugauccccuacuucaucuuccucuucgggagcggccugcccguguucuuccuggagaucaucaucggccaguacacguccgagggcgggaucacgugcugggagaagaucugcccccucuucagcgggaucggcuacgcguccgucgugaucgugagccugcugaacgucuacuacaucgugauccucgccugggccaccuacuaccuguuccaguccuuccagaaggagcugcccugggcccacugcaaccacagcuggaacaccccgcacugcauggaggacaccaugcgcaagaacaaguccguguggaucaccaucagcagcaccaacuucaccucccccgucaucgaguucugggagcggaacgugcucagccugucccccgggaucgaccaccccggcagccugaagugggaccucgcccugugccugcuccugguguggcuggucugcuucuucugcaucuggaagggcgugcgcuccacggggaagguggucuacuucaccgcgaccuucccguucgccaugcuccuggugcugcucgugcggggccugacccugcccggggccggcgccgggaucaaguucuaccucuaccccgacaucacgcgccuggaggacccccaggucuggaucgacgccggcacccagaucuucuucagcuacgcgaucugccugggcgccaugaccucccucgggagcuacaacaaguacaaguacaacuccuaccgggacugcaugcugcugggcugccucaacagcgggaccuccuucgugagcggcuucgccaucuucuccauccugggguucauggcccaggagcagggcguggacaucgccgacgucgcggagagcggcccggggcuggccuucaucgccuaccccaaggccgugacgaugaugccccuccccaccuucugguccauccuguucuucaucaugcugcuccugcugggccuggacagccaguucgucgagguggaggggcagaucaccucccucguggaccuguacccgagcuuccugcgcaagggcuaccggcgcgagaucuucaucgcguucgucugcuccaucagcuaccuccugggccugaccauggugacggagggcgggauguacguguuccagcuguucgacuacuacgccgccagcggggucugccuccuguggguggccuucuucgagugcuucgugaucgccuggaucuacggcggggacaaccucuacgacggcaucgaggacaugaucggcuaccggcccgggcccuggaugaaguacuccugggcggucaucaccccggugcugugcgugggcugcuucaucuucagccuggucaaguacgugccccucaccuacaacaagaccuacguguaccccaacugggccaucgggcugggcuggucccuggcccucagcuccaugcugugcgucccccuggugaucgugauccgccucugccagacggaggggccguuccugguccgggugaaguaccugcucacgccccgcgagcccaaccggugggccguggagcgcgagggcgccacccccuacaacagccggaccgucaugaacggcgcgcuggugaagccgacccacaucaucguggagaccaugauguga

SEQ ID NO: 36703 - RNA, 1911 nt, Artificial Sequence
  derived and/or modified sequence opt1 from SLC6A7__Homo_sapiens__NP_055043
augaagaagcugcagggcgcccaccuccgcaagcccgugaccccggaccugcugaugacccccagcgaccagggggacgucgaccucgacguggacuucgccgcgcaccggggcaacuggacggggaagcuggacuuccugcucuccugcaucggcuacugcguggggcugggcaacgucuggcgcuuccccuaccgggccuacaccaacggcgggggcgccuuccuggugcccuacuuccucaugcuggccaucugcgggaucccgcuguucuuccucgagcugagccugggccaguucuccagccucgggccccuggccguguggaagaucagcccccuguucaagggcgcgggcgccgccaugcuccugaucgucgggcugguggccaucuacuacaacaugaucaucgcguacguccucuucuaccuguucgccagccugaccuccgaccuccccugggagcacugcggcaacugguggaacaccgagcugugccuggagcaccgcgugagcaaggacgggaacggcgcccucccgcugaaccugacgugcaccgugucccccagcgaggaguacuggucccgguacgugcuccacauccagggcagccaggggaucggcucccccggggagauccgcuggaaccugugccugugccuccugcuggccugggucaucguguuccucugcauccugaagggcgugaaguccuccgggaaggucguguacuucaccgccaccuuccccuaccugauccuccugaugcugcucgugcggggcgucacgcugccgggcgcguggaaggggauccaguucuaccugacgccccaguuccaccaccuccugagcuccaagguguggaucgaggccgcccugcagaucuucuacagccucggcgugggguucggcgggcugcugaccuucgccuccuacaacaccuuccaccagaacaucuaccgcgacaccuucaucgucacccugggcaacgccaucaccagcauccucgcgggcuucgccaucuucagcgugcugggguacaugucccaggagcugggcgugcccgucgaccagguggccaaggccgggcccggccucgccuucgucguguacccgcaggcgaugaccaugcugccccugagccccuucugguccuuccucuucuucuucaugcugcugacgcucgggcuggacagccaguucgccuuccuggagaccaucgugaccgccgucaccgacgaguuccccuacuaccuccggccgaagaaggccguguucuccggccugaucugcguggccauguaccugaugggccucauccugacgaccgacgggggcauguacuggcugguccuccuggacgacuacagcgcguccuucgggcugauggugguggucaucacgaccugccucgccgugacccgcguguacggcauccagcgguucugccgcgacauccacaugaugcugggcuucaagcccgggcuguacuuccgggccugcuggcuguuccucagccccgccacccugcucgcgcugauggucuacuccaucgugaaguaccagcccagcgaguacggcuccuaccgcuucccgcccugggccgagcugcucgggauccugaugggccugcucagcugccugaugauccccgccgggaugcugguggccguccuccgggaggagggcucccugugggagcgccugcagcaggccagccggcccgcgauggacuggggcccgucccucgaggagaaccgcaccgggauguacguggccacccuggccggcagccagucccccaagccccugauggugcacaugcggaaguacgggggcaucacgagcuucgagaacaccgccaucgaggucgaccgcgagaucgccgaggaggaggaguccaugauguga

SEQ ID NO: 36704 - RNA, 1878 nt, Artificial Sequence
  derived and/or modified sequence opt1 from SLC6A8__Homo_sapiens__NP_001136277
auggccaagaaguccgccgagaacggcaucuacuccgugagcggggacgagaagaagggcccccugaucgcgccggggcccgacggcgcccccgccaagggggacggccccgucggccucgggaccccgggcgggcgccuggccgugccgccccgggagaccuggacgcgccagauggacuucaucauguccugcgugggcuucgccgucgggcugggcaacguguggcgguuccccuaccucugcuacaagaacggcgggggcguguuccugauccccuacguccugaucgcgcucgucgggggcauccccaucuucuuccuggagaucagccugggccaguucaugaaggccggguccaucaacguguggaacaucugcccccucuucaagggccugggguacgccagcauggugaucguguucuacugcaacaccuacuacaucauggugcuggccuggggcuucuacuaccucgucaaguccuucaccaccacgcugcccugggcgaccugcgggcacaccuggaacaccccggacugcguggagaucuuccgccacgaggacugcgccaacgccagccuggccaaccucacgugcgaccagcuggccgaccggcgcucccccgugaucgaguucugggagaacaagguccugcggcucagcggcggccuggaggugcccggggcgcugaacugggaggugacccucugccugcuggccugcuggguccucguguacuucugcguguggaagggcgucaaguccaccgggaagaucguguacuucaccgccacguuccccuacgugguccuggugguccugcucgugcgcggcgugcugcugccgggggcccucgacggcaucaucuacuaccugaagcccgacuggagcaagcugggcagcccccaggucuggaucgacgccgggacccagaucuucuucagcuacgcgaucggccucggggcccugaccgcccugggcuccuacaaccgguucaacaacaacugcuacaacgggaccagcuucuucgccggcuucgugguguucuccauccucggcuucauggccgcggagcaggggguccacaucagcaagguggccgaguccggccccgggcuggccuucaucgccuacccgcgcgccgugacgcugaugcccgucgcgccccucugggccgcccuguucuucuucaugcugcuccugcugggccucgacagccaguucgugggcguggagggguucaucaccggccugcuggaccuccugcccgccagcuacuacuuccgguuccagcgcgagaucuccgucgcgcugugcugcgcccugugcuucgugaucgaccucagcauggugaccgacgggggcauguacgucuuccagcuguucgacuacuacuccgccagcgggaccacgcugcucuggcaggccuucugggagugcgugguggucgccuggguguacggcgcggaccgguucauggacgacaucgccugcaugaucggcuaccgcccgugccccuggaugaaguggugcugguccuucuucacgccccuggugugcauggggaucuucaucuucaacgucguguacuacgagccccugguguacaacaacaccuacgucuacccgugguggggcgaggccauggggugggccuucgcccucagcuccaugcugugcgugccccugcaccuccugggcugccugcuccgggcgaaggggaccauggccgagcgcuggcagcaccugacccagcccaucuggggccugcaccaccucgaguaccgggcccaggacgccgacgugcgcggccugaccacccugaccccggucagcgaguccagcaaggugguggucguggaguccgugauguga

SEQ ID NO: 36705 - RNA, 1857 nt, Artificial Sequence
  derived and/or modified sequence opt1 from SLC6A9__Homo_sapiens__XP_011540319
augagcggcggggacacccgcgccgccaucgcgcggccccgcauggccgccgcccacggcccgguggcccccuccagccccgagcaggucacccugcuccccgugcagcgguccuucuuccugccgcccuucagcggggcgacgcccuccaccagccuggccgaguccgugcucaaggucuggcacggcgccuacaacagcgggcugcugccccagcucauggcccagcacucccuggcgauggcccagaacggcgccgugccgagcgaggccaccaagcgcgaccagaaccugaagcggggcaacugggggaaccagaucgaguucgugcucaccuccgucggcuacgccguggggcugggcaacguguggcgcuuccccuaccugugcuaccggaacgggggcggcgcguucauguuccccuacuucaucaugcucaucuucugcgggaucccccuguucuucauggagcugagcuucggccaguucgccucccaggggugccucggcgucuggcgcaucagcccgauguucaagggcgugggguacggcaugaugguggucuccacguacaucgggaucuacuacaacguggugaucugcaucgccuucuacuacuucuucagcuccaugacccacguccugcccugggccuacugcaacaaccccuggaacacccacgacugcgccggcgugcuggacgcgagcaaccucaccaacgggucccggcccgccgcccugccgagcaaccugagccaccuccugaaccacucccugcagcgcacgagccccuccgaggaguacuggcggcucuacgugcugaagcugagcgacgacaucggcaacuucggcgagguccgccucccccugcuggggugccucggcguguccuggcugguggucuuccugugccucauccggggcgucaagagcuccgggaaggugguguacuucaccgccaccuuccccuacgugguccugaccauccuguucgugcgcggggugacgcucgagggcgccuucgacggcaucauguacuaccugaccccgcagugggacaagauccuggaggcgaaggucuggggcgacgccgccagccagaucuucuacucccucgggugcgccuggggcgggcugaucaccauggccagcuacaacaaguuccacaacaacugcuaccgggacuccgugaucaucagcaucaccaacugcgcgacguccguguacgccggguucgucaucuucagcauccugggcuucauggccaaccaccucggcguggacgugucccgcgucgccgaccacgggcccggccuggcguucguggccuaccccgaggcccugacccuccugcccaucagcccgcuguggucccuccuguucuucuucaugcugauccugcucgggcugggcacccaguucugccugcucgagacccuggugacggccaucgucgacgaggugggcaacgaguggauccugcagaagaagaccuacgugacccucggggucgccguggcgggcuuccugcuggggaucccccucaccagccaggccggcaucuacuggcugcugcucauggacaacuacgccgccuccuucagccugguggucaucagcugcaucaugugcguggccaucauguacaucuacgggcaccggaacuacuuccaggacauccagaugaugcugggcuucccgccgccccucuucuuccagaucugcuggcgcuucgugucccccgcgaucaucuucagccugcccacgcaccgggcccccgcccccggccccgccugcuucuuccacgggcccgacgucgacuccugcccgugcagcgcccccaacgcgcuguucuga

SEQ ID NO: 36706 - RNA, 1572 nt, Artificial Sequence
  derived and/or modified sequence opt1 from SLC7A10__Homo_sapiens__NP_062823
auggccggccacacccagcagcccagcgggcgcggcaacccgcggcccgcccccucccccagcccggugcccgggaccguccccggcgcguccgagcgcguggcccugaagaaggagaucgggcuccugagcgccugcacgaucaucaucggcaacaucaucggcuccgggaucuucaucagccccaagggcgugcuggagcacuccgggagcgucggccucgcccuguucgugugggugcucgggggcggcgucaccgcccuggggucccugugcuacgcggagcugggcguggccauccccaagagcgggggcgacuacgccuacgugaccgagaucuucggcgggcucgccggcuuccugcugcucugguccgcgguccugaucauguaccccaccagccuggccgugaucuccaugacguucagcaacuacgugcuccagcccgucuuccccaacugcaucccgcccaccaccgccucccgggugcugagcauggccugccugaugcuccugaccugggugaacuccagcuccguccgcugggccacgcggauccaggacauguucaccgggggcaagcugcucgcgcugagccugaucaucggggugggccuccugcagaucuuccagggccacuucgaggagcugcgccccagcaacgccuucgccuucuggaugacccccuccguggggcaccucgcccuggccuuccugcagggcagcuucgcguucuccggguggaacuuccucaacuacgucaccgaggagaugguggacgcccggaagaaccugccgcgcgccaucuucaucagcaucccccuggugacguucgucuacaccuucaccaacaucgccuacuucaccgccaugagcccccaggagcuccuguccuccaacgcgguggccgugacguucggcgagaagcugcucggguacuucagcugggucaugcccguguccgucgcccugagcaccuucggcggcaucaacggguaccuguucaccuacucccggcucugcuucagcggcgcccgcgaggggcaccucccgucccugcuggccaugauccacgugcggcacugcacccccauccccgcgcugcuggugugcugcggcgccacggccgucaucaugcucgugggggacaccuacacccugaucaacuacgugagcuucaucaacuaccugugcuacggcgucaccauccucggccugcugcugcuccgcuggcggcgccccgcccugcaccggccgaucaaggugaaccugcucauccccguggcguaccuggucuucugggccuuccugcucguguucuccuucaucagcgagcccauggugugcggggucggcgugaucaucauccugacgggggugcccaucuucuuccugggcgucuucuggcgcuccaagccgaagugcgugcaccggcucaccgagagcaugacccacuggggccaggagcugugcuucguggucuacccccaggacgcccccgaggaggaggagaacgggccgugcccgcccucccugcuccccgccaccgacaagccgagcaagccccaguga

SEQ ID NO: 36707 - RNA, 1506 nt, Artificial Sequence
  derived and/or modified sequence opt1 from SLC7A11__Homo_sapiens__NP_055146
auggugcgcaagcccgucgugagcaccaucuccaagggcggguaccugcagggcaacgugaacgggcggcucccgagccugggcaacaaggagccgcccgggcaggagaagguccagcugaagcgcaaggugacccuccugcggggcguguccaucaucaucggcacgaucaucggggccggcaucuucaucagccccaaggggguccugcagaacaccggcuccguggggaugagccucaccaucuggaccgugugcggcguccugucccuguucggcgcccucagcuacgcggagcuggggacgaccaucaagaaguccggcgggcacuacaccuacauccuggagguguucggcccccuccccgccuucgugcgcgucuggguggagcugcugaucauccggcccgccgccaccgccgugaucagccucgcguucggccgcuacauccuggagcccuucuucauccagugcgagaucccggagcuggccaucaagcucaucacggccgucgggaucaccguggugaugguccugaacuccaugagcguguccuggagcgcccggauccagaucuuccugaccuucugcaagcucaccgcgauccugaucaucaucgugcccggcgucaugcagcugaucaaggggcagacgcagaacuucaaggacgccuucuccggccgcgacagcuccaucacccggcucccccuggccuucuacuacgggauguacgccuacgccggcugguucuaccugaacuucgugaccgaggagguggagaaccccgagaagaccaucccgcucgcgaucugcaucagcauggccaucgucacgaucggcuacgugcugaccaacgucgccuacuucaccaccaucaacgccgaggagcugcuccuguccaacgccguggcggugacguucagcgagcgccugcucgggaacuucagccuggccguccccaucuucguggcccuguccugcuucggcagcaugaacgggggcguguucgccgucucccgccucuucuacguggccagccgggaggggcaccuccccgagauccuguccaugauccacgugcggaagcacacgccccucccggcggucaucgugcugcacccccugaccaugaucaugcuguucagcggcgaccuggacucccugcucaacuuccugagcuucgcccgcuggcuguucaucggccucgccguggccgggcugaucuaccugcgguacaagugccccgacaugcaccgccccuucaaggucccgcuguucauccccgcccucuucuccuucacgugccuguucaugguggcgcugagccucuacuccgaccccuucagcaccggcaucggguucgugaucacccugaccggcguccccgccuacuaccuguucaucaucugggacaagaagccgcggugguuccgcaucauguccgagaagaucacccggacccuccagaucauccuggagguggugcccgaggaggacaagcuguga

SEQ ID NO: 36708 - RNA, 1413 nt, Artificial Sequence
  derived and/or modified sequence opt1 from SLC7A13__Homo_sapiens__NP_620172
auggaccgcggcgagaagauccagcugaagcggguguucggguacugguggggcaccagcuuccuccugaucaacaucaucggggccggcaucuucgucucccccaagggggugcuggccuacagcugcaugaacgugggcgucucccucugcgugugggcgggcugcgccauccuggccaugaccagcacgcugugcuccgccgagaucagcaucuccuucccgugcagcggggcccaguacuacuuccucaagcgcuacuucggcuccaccguggcguuccugaaccuguggaccagccucuuccugggguccggcgucguggccgggcaggcccugcuccuggccgaguacagcauccagcccuucuuccccuccugcagcgugcccaagcugccgaagaagugccucgcgcuggccaugcuguggaucgucggcauccucaccucccggggcgugaaggaggugacguggcugcagaucgccagcuccguccugaaggugagcauccucuccuucaucagccugaccgggguggucuuccugauccgcggcaagaaggagaacguggagcgguuccagaacgccuucgacgccgagcuccccgacaucagccaccugauccaggcgaucuuccagggguacuucgccuacuccggcggcgccugcuucacccugaucgccggggagcucaagaagccccgcaccacgauccccaagugcaucuucaccgcccugccgcuggugaccgucguguaccuccuggugaacaucagcuaccugaccguccucacgccccgggagauccuguccagcgacgcgguggccaucaccugggccgaccgcgccuuccccucccuggccuggaucaugcccuucgcgaucagcaccucccucuucagcaaccugcugaucuccaucuucaagagcucccggccgaucuaccucgccagccaggagggccagcugccccuccuguucaacacccugaacucccacagcucccccuucacggccgugcugcuccuggucacccuggggagccucgccaucauccugaccucccugaucgaccugaucaacuacaucuucuucaccggcagccucugguccauccugcugaugaucgggauccuccgccggcgcuaccaggagcccaaccugagcaucccguacaagguguuccugagcuucccccucgccacgaucgucaucgacgugggccugguggucaucccccuggugaagucccccaacgugcacuacgucuacgugcuccugcuggugcucagcggccugcuguucuacaucccgcucauccacuucaagauccggcuggcgugguucgagaagaugaccugcuaccugcagcuccuguucaacaucugccugcccgacgucuccgaggaguga

SEQ ID NO: 36709 - RNA, 2316 nt, Artificial Sequence
  derived and/or modified sequence opt1 from SLC7A14__Homo_sapiens__NP_066000
augagcggcuucuucaccucccuggacccccgccgggugcaguggggcgccgccugguacgcgaugcacagccgcauccuccggaccaagccggucgaguccaugcuggaggggacggggaccaccaccgcccacggcacgaagcuggcccaggugcucaccaccguggaccugaucagccugggggucggcuccugcgugggcaccgggauguacguggucagcggccucguggccaaggagauggccgggcccggcgugaucgucuccuucaucaucgcggccguggccagcauccuguccggggugugcuacgccgaguucggcguccgcgugcccaagacgaccggcagcgcguacaccuacuccuacgugaccgucggggaguucguggccuucuucaucggcuggaaccugauccucgaguaccugaucgggacggccgccggcgccagcgcgcuguccagcauguucgacucccucgccaaccacaccaucagccgguggauggccgacuccgugggcacccugaacgggcugggcaagggggaggagagcuaccccgaccuccuggcccugcucaucgccgucaucgugaccaucaucguggcgcugggcgucaagaacuccaucggguucaacaacgugcugaacgugcucaaccuggccgucuggguguucaucaugaucgccggccuguucuucaucaacggcaaguacugggccgaggggcaguuccucccgcacggcuggagcgggguccugcagggcgccgcgacgugcuucuacgccuucaucggguucgacaucaucgccaccaccggcgaggaggccaagaaccccaacaccagcauccccuacgccaucacggcgucccuggugaucugccucaccgccuacgugagcgucuccgugauccugacccugauggugcccuacuacaccaucgacacggagagcccgcucauggagauguucgucgcccacggcuucuacgccgcgaaguucgugguggccaucggguccgucgccggccugaccgugagccugcucgggucccuguuccccaugccccgcgugaucuacgccauggccggcgacgggcuccuguuccgguuccuggcgcacgucagcuccuacaccgagacccccgugguggccugcaucgucagcggcuuccuggccgcccuccuggcccugcucgugucccugcgcgaccugaucgagaugaugagcaucggcacgcuccuggcguacacccugguguccgucugcgugcuccugcugcgguaccagccggagagcgacaucgacggguucgugaaguuccuguccgaggagcacaccaagaagaaggagggcauccucgccgacugcgagaaggaggccugcagccccgucuccgagggggacgaguucagcggccccgccaccaacacgugcggcgccaagaaccugcccucccugggggacaacgagaugcucaucggcaagagcgacaagagcaccuacaacgugaaccacccgaacuacgggaccguggacaugaccacgggcaucgaggcggacgaguccgagaacaucuaccugaucaagcugaagaagcucaucgggccccacuacuacaccaugcgcauccggcugggccugcccggcaagauggaccgccccaccgccgccaccgggcacaccgucacgaucugcgugcuccugcuguucauccucauguucaucuucugcagcuucaucaucuucggcuccgacuacaucagcgagcaguccuggugggccauccugcuggugguccucauggugcugcugaucagcacccucguguucgucauccugcagcagccggagaaccccaagaagcugcccuacauggcgcccugccucccguucgugcccgccuucgccaugcuggugaacaucuaccugaugcucaagcuguccaccaucaccuggauccgguucgccgucuggugcuucguggggcugcucaucuacuucggcuacgggaucuggaacagcacgcuggagaucuccgcccgcgaggaggcgcugcaccagagcaccuaccagcgguacgacguggacgaccccuucuccgucgaggagggcuucagcuacgccaccgagggcgagucccaggaggacuggggcgggcccaccgaggacaagggguucuacuaccagcagaugagcgacgccaaggccaacggccgcacguccagcaaggccaaguccaagagcaagcacaagcagaacagcgaggcgcucaucgccaacgacgagcuggacuacuccccggaguga

SEQ ID NO: 36710 - RNA, 1890 nt, Artificial Sequence
  derived and/or modified sequence opt1 from SLC7A1__Homo_sapiens__XP_005266564
augggcugcaaggugcugcucaacaucgggcagcagaugcugcgccggaaggucguggacugcagccgcgaggagacccggcugucccgcugccucaacaccuucgaccugguggcccugggcgucgggagcacgcucggcgccgggguguacgugcuggcgggcgccgucgcccgggagaacgccggccccgccaucgugaucuccuuccugaucgcggcccucgccagcgugcuggccgggcugugcuacggcgaguucggggcgcgcgucccgaagaccggcuccgccuaccucuacagcuacgugaccgugggggagcugugggccuucaucaccggcuggaaccugauccucuccuacaucaucggcacgagcuccgucgcccgggccuggagcgcgaccuucgacgagcugaucgggcgccccaucggcgaguucucccggacccacaugacccugaacgcccccggggugcucgccgagaaccccgacaucuucgccgugaucaucauccugauccugacgggccuccugacccugggcgucaaggagagcgccauggugaacaagaucuucacgugcaucaacgugcucguccugggguucaucaugguguccggcuucgugaaggggagcgucaagaacuggcagcugaccgaggaggacuucggcaacaccuccgggcgccucugccugaacaacgacaccaaggagggcaagccgggcgucgggggcuucaugcccuucggguucagcggcgugcuguccggggcggcgaccugcuucuacgccuucgugggcuucgacugcaucgccaccacgggcgaggaggugaagaacccccagaaggccauccccgucgggaucguggccagccuccugaucugcuucaucgccuacuucggcguguccgccgcccugacccucaugaugccguacuucugccuggacaacaacagcccccugcccgacgccuucaagcacgucgggugggagggcgcgaaguacgccguggccguggggagccucugcgcccuguccgcgagccugcucggcuccauguuccccaugccgcgggucaucuacgccauggccgaggacggccugcuguucaaguuccucgccaacgugaacgaccgcaccaagacccccaucaucgccacgcuggcgagcggggccguggccgccgucauggccuuccuguucgaccucaaggaccugguggaccugauguccaucggcacccuccuggcguacagccugguggccgccugcguccuggugcuccgguaccagcccgagcagcccaaccugguguaccagauggccuccaccagcgacgagcuggacccggccgaccagaacgagcucgcguccaccaacgacagccagcugggguuccugcccgaggccgagauguucucccucaagacgauccugagccccaagaacauggagcccuccaagaucagcggccugaucgucaacaucuccaccagccucaucgccgugcugaucaucaccuucugcaucgugaccguccugggccgcgaggcccucacgaagggggcgcugugggccguguuccugcucgccggcuccgcccugcugugcgccguggucaccggggugaucuggcggcagccggagagcaagaccaagcucuccuucaaggugcccuuccugcccguccugcccauccucagcaucuucgugaacguguaccugaugaugcagcuggaccagggcaccuggguccgcuucgcgguguggaugcucaucggguucaucaucuacuucggcuacggccuguggcacagcgaggaggccucccuggacgccgaccaggcccggacgccggacgggaaccucgaccagugcaaguga

SEQ ID NO: 36711 - RNA, 2097 nt, Artificial Sequence
  derived and/or modified sequence opt1 from SLC7A2__Homo_sapiens__NP_001158243
augaagaucgagaccagcggcuacaacuccgacaagcugaucugccgcggguucaucggcacccccgccccgcccgugugcgacagcaaguuccuccugucccccagcuccgacguccggaugauccccugccgcgccgcgcugacguucgcccggugccucauccgccggaagaucgugacccuggacagccuggaggacaccaagcucugccgcugccuguccaccauggaccugaucgcccucggggugggcagcacgcugggggccggcgucuacgugcuggccggcgagguggcgaaggccgacuccgggccgagcaucgucguguccuuccucaucgccgcccuggcgagcgugauggccggccugugcuacgccgaguucggggcccggguccccaagaccggcuccgccuaccucuacaccuacgugaccgugggggagcugugggcguucaucacgggcuggaaccugauccucagcuacgucaucggcaccuccagcguggcccgcgccugguccgggaccuucgacgagcugcugagcaagcagaucggccaguuccuccggaccuacuuccgcaugaacuacacggggcuggccgaguaccccgacuucuucgccgugugccugauccuccugcuggcgggccuccuguccuucggcgucaaggagagcgccugggugaacaagguguucaccgccgucaacauccuggugcuccuguucgugauggucgccggguucgugaagggcaacguggccaacuggaagaucagcgaggaguuccugaagaacaucuccgcgagcgcccgggagcccccguccgagaacgggaccagcaucuacggcgccgggggcuucaugcccuacggcuucaccgggacgcucgccggcgccgcgaccugcuucuacgccuucgucggguucgacugcaucgccaccaccggcgaggaggugcgcaacccccagaaggccauccccaucgggaucgucacgucccugcuggugugcuucauggcguacuucggcgugagcgccgcccucacccugaugaugccguacuaccugcucgacgagaaguccccgcugcccgucgccuucgaguacgugggcugggggcccgccaaguacguggucgcggccggcagccugugcgcccucuccaccagccugcugggguccaucuuccccaugccccgggugaucuacgccauggccgaggacggccuccuguucaagugccuggcgcagaucaacagcaagaccaagacgcccaucaucgccacccucuccagcggggccguggccgcccugauggcguuccuguucgaccugaaggcccucgucgacaugauguccaucggcacccugauggccuacagccugguggccgcgugcgugcucauccugcgcuaccagcccggccuguccuacgaccagccgaagugcagccccgagaaggacgggcucggcuccagcccccgggucaccagcaaguccgagagccaggugacgaugcugcagcgccagggguucuccaugcggacccuguucugccccagccuccugccgacccagcaguccgccagccugguguccuuccucgucggcuuccuggccuuccuggugcucggccugagcgugcugaccacguacgggguccacgccaucacccgccucgaggccuggucccuggcgcugcucgcccuguuccugguccucuucguggccaucgugcugaccaucuggcggcagccccagaaccagcagaagguggccuucauggugcccuuccugcccuuccucccggccuucagcauccuggucaacaucuaccugauggugcagcucuccgcggacaccugggugcgcuucagcaucuggauggccaucggcuuccugaucuacuucuccuacgggauccggcacagccuggagggccaccuccgcgacgagaacaacgaggaggacgccuaccccgacaacguccacgccgccgcggaggagaaguccgccauccaggccaacgaccaccacccccgcaaccugagcuccccguucaucuuccacgagaagacgagcgaguucuga

SEQ ID NO: 36712 - RNA, 1860 nt, Artificial Sequence
  derived and/or modified sequence opt1 from SLC7A3__Homo_sapiens__NP_001041629
augcccuggcaggccuuccgccgguucggccagaagcuggugcgccggcgcacccucgagagcgggauggccgagacccggcuggcgcgcugccuguccacgcucgaccuggucgcccugggcguggggagcacccucggcgccgggguguacguccuggccggcgagguggccaaggacaaggcgggcccguccaucgugaucugcuuccuggucgccgcccucagcuccgugcuggccgggcugugcuacgcggaguucggcgcccgggugccccgcagcggguccgccuaccucuacagcuacgucaccgugggcgagcugugggccuucaccacgggguggaaccugauccucuccuacgugaucggcaccgccagcgucgcgcgggccugguccagcgccuucgacaaccugaucggcaaccacaucuccaagacccugcaggggagcaucgcccuccacgugccccacgugcuggccgaguaccccgacuucuucgcgcugggccucguccugcugcucaccgggcugcuggcccucggcgccuccgagagcgcccuggugacgaagguguucaccggcgucaaccugcucgugcugggguucgugaugaucuccggcuucgucaagggggacgugcacaacuggaagcugaccgaggaggacuacgagcucgccauggcggagcugaacgacaccuacagccugggcccgcucggguccggcggcuucgugcccuucggguucgagggcauccugcgcggggccgccacgugcuucuacgccuucgucggcuucgacugcaucgccaccaccggggaggaggcgcagaacccccagcggagcauccccaugggcaucgugaucagccuguccgucugcuuccucgccuacuucgccgugagcuccgcccugacccugaugaugccguacuaccagcuccagcccgagagcccccugcccgaggcguuccuguacaucggcugggccccggcccgcuacguggucgccguggggucccucugcgcccugagcacgucccugcucggcagcauguuccccaugccccgggugaucuacgcgauggccgaggacgggcugcuguuccgcguccuggcccggauccacaccggcacccgcacccccaucaucgccacggugguguccgggaucaucgccgcguucauggccuuccucuucaagcugaccgaccuggucgaccucaugagcaucggcacccugcuggccuacucccucgugagcaucugcgugcugauccugcgguaccagccggaccaggagaccaagacgggcgaggaggucgagcuccaggaggaggccaucaccaccgaguccgagaagcugacccuguggggccucuucuucccccugaacagcauccccacgccccuguccgggcagaucguguacgugugcagcucccuccuggccguccugcucaccgcgcugugccuggugcucgcccaguggagcgugccgcugcuguccggggaccuccuguggaccgccgucguggugcugcuccugcugcucaucaucggcaucaucgucgugaucuggcgccagccccagagcagcacgccccugcacuucaaggugcccgcccugccgcuccugccccugauguccaucuucgucaacaucuaccucaugaugcagaugaccgcgggcaccugggcccgguucgggguguggaugcugaucggcuucgccaucuacuucggguacggcauccagcacagccuggaggagaucaaguccaaccagcccagccgcaagucccgggccaagaccguggaccucgaccccgggacccuguacguccacagcguguga

SEQ ID NO: 36713 - RNA, 1908 nt, Artificial Sequence
  derived and/or modified sequence opt1 from SLC7A4__Homo_sapiens__NP_004164
auggcccgcggccugcccaccaucgccagccucgcgcggcugugccagaagcugaaccgccucaagccgcuggaggacuccaccauggagacgagccugcggcgcugccucuccacccuggaccugacccuccugggggugggcgggauggucggcagcgggcuguacgugcucaccggcgccguggccaaggaggucgccggccccgccgugcugcuguccuucgggguggcggccgucgccagccuccuggccgcgcugugcuacgccgaguucggcgcccgggugccccgcacgggguccgccuaccucuucaccuacgugagcaugggcgagcugugggccuuccugaucggguggaacguccuccuggaguacaucaucggcggcgcggccguggcccgggccugguccggguaccuggacagcauguucucccacagcauccgcaacuucaccgagacccacgugggcuccuggcaggucccccuccuggggcacuacccggacuuccuggccgcgggcaucauccuccuggccagcgccuucguguccugcggcgcccgggugagcuccuggcugaaccacacguucagcgccaucucccuccuggucauccuguucaucgugauccucggguucauccuggcgcagccccacaacuggagcgccgacgagggcggguucgcccccuucggcuucagcggggugauggccggcaccgccuccugcuucuacgcguucgucggcuucgacgugaucgccgccagcuccgaggaggcccagaacccccgccggagcgugccgcuggcgaucgccaucucccucgccaucgccgccggggcguacauccuggucagcaccgugcugacccucauggugcccuggcacucccuggaccccgacagcgcccuggccgacgccuucuaccagcgcggcuaccggugggccggguucaucgucgcggccggcuccaucugcgccaugaacacggugcuccugagccugcuguucucccugccccgcaucgucuacgccauggccgcggacgggcuguucuuccagguguucgcccacgugcacccgcggacccagguccccguggccggcacccucgccuucggccugcugaccgcguuccuggcccuccugcuggaccucgagagccuggugcaguuccugucccucgggacgcugcuggccuacaccuucgucgccaccagcaucaucgugcuccgcuuccagaaguccagcccgcccuccagccccggccccgccucccccgggccccugaccaagcagcagagcagcuucuccgaccaccuccagcucgugggcacgguccacgcgagcgugccggagcccggggagcugaagcccgcccugcggcccuaccucggcuuccuggacggcuacuccccgggggccguggucaccugggcccugggcgugaugcucgccagcgcgaucaccaucgggugcgugcuggucuucggcaacuccacccugcaccucccccacuggggcuacauccugcugcuccugcugacgagcgugauguuccuccugucccugcucgugcugggggcccaccagcagcaguaccgcgaggaccuguuccagauccccauggucccccucaucccggcccugagcaucgugcugaacaucugccucaugcugaagcuguccuaccucaccugggugcgguucagcaucuggcugcugaugggccucgccgucuacuucggguacggcauccgccacuccaaggagaaccagcgggagcugcccgggcugaacagcacccacuacgugguguucccccgcggcucccucgaggagaccguccaggccaugcagccgcccagccaggcgcccgcccaggaccccggccacauggaguga

SEQ ID NO: 36714 - RNA, 1524 nt, Artificial Sequence
  derived and/or modified sequence opt1 from SLC7A5__Homo_sapiens__NP_003477
auggccggcgccgggcccaagcgccgggcgcuggccgccccggccgccgaggagaaggaggaggcgcgcgagaagaugcucgccgccaagagcgccgacggcuccgcgcccgccggggagggcgagggggugacccugcagcggaacaucacccugcucaacggcgucgccaucaucgugggcacgaucaucgggagcggcaucuucgugacccccaccgggguccugaaggaggccggcucccccgggcuggcccucguggugugggcggccugcggcgucuucagcaucgugggcgcccugugcuacgccgagcuggggaccacgaucuccaagagcggcggggacuacgccuacaugcucgagguguacggcucccugccggcguuccugaagcucuggaucgagcugcugaucauccgccccagcucccaguacaucgucgcccucguguucgccaccuaccugcugaagccccucuucccgaccugccccgugcccgaggaggccgccaagcuggucgcgugccugugcgugcuccugcugaccgccgugaacugcuacagcgucaaggccgccacgcgggugcaggacgccuucgcggccgccaagcuccuggcccuggcgcucaucauccugcugggcuucgugcagaucgggaagggcgacgucuccaaccucgaccccaacuucagcuucgaggggaccaagcuggacgugggcaacaucgugcuggcccucuacuccgggcuguucgccuacggcggcuggaacuaccugaacuucgucaccgaggagaugaucaaccccuaccgcaaccucccgcuggccaucaucaucagccugcccaucgugacccucguguacguccugacgaaccuggccuacuucaccacccucuccaccgagcagaugcugagcuccgaggcgguggccgucgacuucgggaacuaccaccugggcgugaugagcuggaucauccccguguucgucgggcucuccugcuucggcagcgugaacgggagccuguucacguccagccggcuguucuucgugggcucccgcgagggccaccuccccagcauccuguccaugauccacccgcagcugcugacccccguccccagccucguguucacgugcgugaugacccugcuguacgccuucuccaaggacaucuucagcgucaucaacuucuucuccuucuucaacuggcucugcguggcccuggccaucaucgggaugaucuggcugcggcaccgcaagcccgagcucgagcggccgaucaaggugaaccuggcgcugcccgucuucuucauccucgccugccuguuccugaucgccgugagcuucuggaagacccccguggagugcggcaucggguucaccaucauccucuccggccugcccgucuacuucuucggggugugguggaagaacaagccgaaguggcugcuccagggcaucuucagcaccaccgugcugugccagaagcugaugcaggucgugccccaggagacguga

SEQ ID NO: 36715 - RNA, 1548 nt, Artificial Sequence
  derived and/or modified sequence opt1 from SLC7A6__Homo_sapiens__NP_003974
auggaggcccgcgagcccggccggccgacccccaccuaccaccuggugcccaacacgagccagucccaggucgaggaggacgugagcuccccgccccagcgcagcuccgagaccaugcagcucaagaaggagaucagccugcugaacggggugucccucgucgugggcaacaugaucgggagcggcaucuucgugucccccaaggggguccuggugcacaccgccagcuacggcaugucccugaucgugugggcgaucggcgggcuguucagcgucgugggcgcccugugcuacgccgagcuggggaccacgaucaccaaguccggcgccagcuacgccuacauccucgaggcguucgggggcuucaucgccuucauccggcugugggugucccugcucgucguggagcccaccggccaggccaucaucgccaucaccuucgcgaacuacaucauccagcccagcuucccguccugcgacccgcccuaccuggccugccgccugcucgccgccgccugcaucugccugcugacguucgugaacugcgcguacgucaagugggggacccgggugcaggacaccuucaccuacgccaagguggucgcccucaucgccaucaucgugaugggccuggugaagcugugccaggggcacagcgagcacuuccaggacgccuucgagggcuccagcugggacaugggcaaccucagccuggcgcuguacuccgcccucuucagcuacuccgggugggacacgcugaacuucgucaccgaggagaucaagaaccccgagcgcaaccugccccucgccaucggcaucagcaugcccaucgugacccugaucuacauccugaccaacguggccuacuacacgguccucaacaucuccgacgugcugagcuccgacgccgucgcggugaccuucgccgaccagaccuucgggauguucagcuggaccauccccaucgccguggcccuguccugcuucggcgggcucaacgccagcaucuucgcguccagccggcuguucuucgucggcucccgcgagggccaccuccccgaccuccugagcaugauccacaucgagcgguucacgccgauccccgcccuccuguucaacugcaccauggcccugaucuaccugaucguggaggacguguuccagcucaucaacuacuucuccuucagcuacugguucuucgucgggcuguccguggugggccagcuguaccuccgcuggaaggagcccaagcggccccgcccgcugaagcugagcgucuucuuccccaucguguucugcaucugcuccguguuccucgucaucgugccccuguucaccgacaccaucaacagccugaucgggaucggcaucgcccugagcggggugcccuucuacuucaugggcgucuaccucccggagucccggcgcccccuguucauccggaacgugcuggcggccaucacgcgcggcacccagcagcucugcuucugcgugcugaccgagcuggacgucgccgaggagaagaaggacgagcggaagaccgacuga

SEQ ID NO: 36716 - RNA, 1536 nt, Artificial Sequence
  derived and/or modified sequence opt1 from SLC7A7__Homo_sapiens__XP_011535601
augguggacagcaccgaguacgaggucgccucccagccggagguggagaccagcccgcugggcgacggggccucccccggccccgagcaggucaagcucaagaaggagaucagccugcugaacggggugugccucaucgugggcaacaugaucggguccggcaucuucgugagccccaagggcguccugaucuacuccgcgagcuucgggcugucccucgugaucugggccgugggcgggcuguucagcgucuucggcgcccugugcuacgccgagcucgggacgaccaucaagaaguccggcgccagcuacgcguacauccuggaggccuucggcggguuccuggccuucauccgccucuggaccucccugcugaucaucgagccgaccagccaggccaucaucgcgaucacguucgccaacuacauggugcagccccucuuccccuccugcuucgcccccuacgccgccagccggcugcuggcggccgccugcaucugccuccugaccuucaucaacugcgccuacgugaaguggggcacccugguccaggacaucuucaccuacgccaaggugcucgcgcugaucgccgugaucgucgccgggaucgugcgccugggccagggcgccuccacgcacuucgagaacagcuucgagggguccagcuucgccgugggcgacaucgcgcucgcccuguacagcgcccuguucuccuacagcgggugggacacccucaacuacgucaccgaggagaucaagaacccggagcggaaccugccccuguccaucggcaucagcaugcccaucgugaccaucaucuacauccucacgaacguggccuacuacaccguccuggacaugcgcgacauccuggccuccgacgcgguggccgugaccuucgccgaccagaucuucgggaucuucaacuggaucaucccccucagcgucgcccuguccugcuucggcggccugaacgcgagcaucguggccgccucccggcuguucuucgucgggagccgcgagggccaccucccggacgccaucugcaugauccacguggagcgguucacccccgugcccucccuccuguucaacgggaucauggcccugaucuaccugugcgucgaggacaucuuccagcucaucaacuacuacagcuucuccuacugguucuucgugggccugagcaucguggggcagcuguaccuccgcuggaaggagcccgaccggccgcgcccccugaagcuguccgucuucuuccccaucguguucugccucugcacgaucuuccugguggcggucccccuguacagcgacaccaucaacucccugaucggcaucgccaucgcccucagcggccugccguucuacuuccugaucauccgggugcccgagcacaagcgcccccucuaccugcggcgcaucgugggguccgccacccgguaccugcagguccucugcaugagcguggccgcggagauggaccuggaggacggcggggagaugcccaagcagcgcgaccccaagagcaacuga

SEQ ID NO: 36717 - RNA, 1293 nt, Artificial Sequence
  derived and/or modified sequence opt1 from SLC7A8__Homo_sapiens__NP_001253965
augggccaguacgggcaggagcugagcuggaagugccucgugaaggccgucugccugcaggagcacucccagcccagccagcugcucugcacccugcugcucugcuggugcgugcugggccgcgagcggccguuccgcaaggcccaguccaccagcagcccccuggagggggugccccgguuccucaagcgccugcugcucacgugggucaacugcuccuccgugcggugggcgacccgcgugcaggacaucuucaccgccggcaagcugcuggcccucgcccugaucaucaucauggggaucguccagaucugcaagggcgaguacuucuggcuggagcccaagaacgccuucgagaacuuccaggagccggacaucggccucguggcgcuggccuuccugcaggggagcuucgccuacggcggguggaacuuccucaacuacgugaccgaggagcuggucgaccccuacaagaaccugccccgggccaucuucaucuccaucccccucgugacguucguguacgucuucgcgaacguggccuacgugaccgccaugagcccgcaggagcugcuggccuccaacgccgucgcggugaccuucggcgagaagcuccugggggugauggccuggaucaugcccaucagcgucgcccuguccaccuucggcggcgugaacgggagccucuucacguccagccgccuguucuucgccggcgcccgggaggggcaccuccccuccgugcucgcgaugauccacgucaagcgcugcacccccaucccggcccugcuguucacgugcaucagcacccuccugaugcuggugaccuccgacauguacacccucaucaacuacgugggcuucaucaacuaccuguucuacggcgucaccguggccgggcagaucguccugcgguggaagaagcccgacaucccccgccccaucaagaucaaccuccuguucccgaucaucuaccugcuguucugggccuuccugcugguguucagccucuggagcgagcccguggucugcggcaucgggcuggccaucaugcugaccggcgugcccguguacuuccugggggucuacuggcagcacaagcccaagugcuucuccgacuucaucgagcuccugacgcuggugagccagaagaugugcguggucguguacccggagguggagcggggcuccggcaccgaggaggcgaacgaggacauggaggagcagcagcagcccauguaccagcccacccccaccaaggacaaggacgucgccgggcagccgcagcccuga

SEQ ID NO: 36718 - RNA, 1464 nt, Artificial Sequence
  derived and/or modified sequence opt1 from SLC7A9__Homo_sapiens__XP_011524704
augggcgacaccgggcugcgcaagcggcgcgaggacgagaaguccauccagagccaggagcccaagaccacgagccuccagaaggagcugggccugaucuccgggaucagcaucaucgucggcaccaucaucggguccggcaucuucgucagcccgaaguccgugcucagcaacaccgaggccgugggccccugccugaucaucugggccgcgugcgggguccuggccacccucggcgcccugugcuucgccgagcuggggacgaugaucaccaaguccggcggggaguaccccuaccucauggaggccuacggccccaucccggcguaccuguucagcugggccucccugaucgugaucaagcccaccagcuucgccaucaucugccucuccuucagcgaguacgugugcgcccccuucuacgucggcugcaagcccccgcagaucguggugaagugccuggcggccgccgccauccuguucaucuccaccgucaacagccucuccgugcggcuggggagcuacgugcagaacaucuucacggccgcgaagcuggucaucguggccaucaucaucaucuccggccucgugcugcuggcccaggggaacaccaagaacuucgacaacagcuucgagggcgcccagcucagcgucggcgccaucucccuggcguucuacaacgggcugugggccuacgacggcuggaaccagcucaacuacaucaccgaggagcugcgcaaccccuaccggaaccugccccucgccaucaucaucgggaucccccuggugaccgccugcuacauccugaugaacgugagcuacuucacggucaugaccgccaccgagcuccugcagucccaggcgguggccgugaccuucggcgaccgcguccuguacccggccagcuggaucgugccccucuucguggccuucuccacgaucggggccgcgaacgggaccugcuucaccgccggccggcugaucuacgucgccggccgcgagggccacaugcugaaggugcucagcuacaucuccguccggcgccugacccccgcccccgcgaucaucuucuacgggaucaucgccacgaucuacaucaucccgggcgacaucaacagccuggugaacuacuucuccuucgccgccuggcuguucuacgggcugaccauccugggccucaucgugaugcgguucacccgcaaggagcuggagcggcccaucaagguccccguggugauccccguccugaugacccucaucagcguguuccuggugcuggccccgaucaucuccaagcccacgugggaguaccucuacugcguccuguucauccugagcggccuccucuucuacuuccuguucgugcacuacaaguucgggugggcgcagaagaucuccaagcccaucaccaugcaccuccagaugcugauggagguggugcccccggaggaggaccccgaguga

SEQ ID NO: 36719 - RNA, 2907 nt, Artificial Sequence
  derived and/or modified sequence opt1 from SLC8A1__Homo_sapiens__NP_001106271
auguacaacaugcgccggcugagccucucccccaccuucagcaugggcuuccaccuccuggugaccgucucccugcuguucagccacguggaccacgugaucgccgagacggagauggagggggagggcaacgagaccggggagugcaccggcuccuacuacugcaagaagggggucauccugccgaucugggagccccaggaccccagcuucggcgacaagaucgcccgcgcgaccguguacuucguggccauggucuacauguuccucggcguguccaucaucgccgaccgguucaugagcuccaucgaggugaucacgagccaggagaaggagaucaccaucaagaagcccaacggggagaccaccaagacgaccguccgcaucuggaacgagaccguguccaaccugacccugauggcccucggcagcuccgccccggagauccugcugagcgugaucgaggucugcgggcacaacuucacggcgggcgaccucgggcccuccaccaucgugggcagcgccgccuucaacauguucaucaucaucgcccugugcguguacgucgugcccgacggcgagacccggaagaucaagcaccuccgcguguucuucgucaccgcggccugguccaucuucgccuacacguggcuguacaucauccugagcgugaucucccccgggguggucgaggugugggagggccugcucaccuucuucuucuucccgaucugcguggucuucgccuggguggccgaccggcgccugcuguucuacaaguacgucuacaagcgguaccgcgcggggaagcagcggggcaugaucaucgagcacgagggcgaccgccccagcagcaagaccgagaucgagauggacgggaagguggugaacucccacgucgagaacuuccucgacggcgcccuggugcuggagguggacgagcgggaccaggacgacgaggaggcccgccgggagauggcccgcauccucaaggagcugaagcagaagcaccccgacaaggagaucgagcagcugaucgagcucgccaacuaccagguccugagccagcagcagaagucccgggcguucuaccgcauccaggccacccggcugaugacgggggccggcaacauccucaagcgccacgccgccgaccaggcgcggaaggccgugagcaugcacgaggugaacaccgaggucaccgagaacgaccccguguccaagaucuucuucgagcaggggaccuaccagugccuggagaacugcggcacgguggcccugaccaucauccgccgcggcggggaccucaccaacaccgucuucguggacuuccggacggaggacggcaccgccaacgccgggagcgacuacgaguucaccgagggcaccguggucuucaagccgggggacacgcagaaggagauccgcgugggcaucaucgacgacgacaucuucgaggaggacgagaacuuccuggugcaccuguccaacgucaaggugagcuccgaggcgagcgaggacggcauccucgaggccaaccacguguccacccuggccugccuggggagccccuccaccgccaccgucacgaucuucgacgacgaccacgcgggcaucuucaccuucgaggagcccgugacccacgugagcgaguccaucgggaucauggaggucaaggugcuccggaccagcggcgcccgcgggaacgugaucguccccuacaagaccaucgagggcacggcccggggcgggggcgaggacuucgaggacacgugcggggagcuggaguuccagaacgacgagaucgugaagaccaucuccgugaaggucaucgacgacgaggaguacgagaagaacaagaccuucuuccuggagaucggcgagccgcgccucguggagaugagcgagaagaaggcccugcugcucaacgagcugggcggguucaccaucaccggccagcccguguuccggaagguccacgcccgcgagcaccccauccuguccaccgugaucaccaucgcggacgaguacgacgacaagcagccccucacgagcaaggaggaggaggagcggcgcaucgccgagauggggcggccgauccugggcgagcacaccaagcuggaggugaucaucgaggagagcuacgaguucaaguccaccgucgacaagcugaucaagaagaccaaccucgcccuggugguggggacgaacagcuggcgcgagcaguucaucgaggccaucaccgucuccgccggcgaggacgacgacgacgacgagugcggcgaggagaagcugcccagcugcuucgacuacgugaugcacuuccucaccguguucuggaagguccuguucgcguucgugccgcccaccgaguacuggaacgggugggccugcuucaucguguccauccugaugaucggccuccugacggccuucaucggggaccuggccagccacuucggcugcaccaucgggcucaaggacuccgucaccgccgugguguucgucgcgcugggcaccagcgugcccgacacguucgccuccaagguggccgccacccaggaccaguacgcggacgccagcaucggcaacgucaccggguccaacgccgugaacgucuuccugggcaucgggguggccuggagcaucgccgcgaucuaccacgccgccaacggcgagcaguucaaggugucccccgggacccucgccuucagcgucacgcuguucaccaucuucgccuucaucaacgugggcgugcugcucuaccggcgccggcccgagaucggcggggagcugggcgggccccgcaccgcgaagcugcucaccuccugccuguucguccugcucuggcugcuguacaucuucuucagcucccucgaggccuacugccacaucaagggcuucuga

SEQ ID NO: 36720 - RNA, 2766 nt, Artificial Sequence
  derived and/or modified sequence opt1 from SLC8A2__Homo_sapiens__NP_055878
auggcgccccuggcccucgugggcgucacccugcugcucgcggccccgcccugcagcggggccgccacccccacgcccucccugccgcccccgcccgccaacgacagcgacaccuccaccggcgggugccagggcagcuaccgcugccagcccggggugcugcuccccgugugggagcccgacgaccccucccugggcgacaaggcggcccgggccgucguguacuucguggccauggucuacauguuccugggcgugagcaucaucgcggaccgcuucauggccgccaucgaggugaucaccuccaaggagaaggagaucacgaucaccaaggccaacggggagaccagcgucggcaccgugcggaucuggaacgagacgguguccaaccucacccugauggcccuggggagcuccgcgccggagauccuccugagcgucaucgaggugugcggccacaacuuccaggccggggagcugggccccggcaccaucgugggguccgccgccuucaacauguucgucgugaucgccgugugcaucuacgucauccccgcgggcgagagccgcaagaucaagcaccuccggguguucuucgugaccgccuccuggagcaucuucgccuacgucuggcuguaccugauccucgccguguucucccccggggugguccaggugugggaggcccugcugacgcucgucuucuucccggugugcguggucuucgcguggauggccgacaagcgccugcuguucuacaaguacguguacaagcgguaccgcaccgacccccggagcggcaucaucaucggcgccgagggggacccgcccaaguccaucgagcucgacggcaccuucgugggggccgaggcccccggcgagcucgggggccugggccccgggcccgcggaggcccgcgagcuggacgccagccggcgcgaggucauccagauccugaaggaccugaagcagaagcaccccgacaaggaccucgagcagcuggugggcaucgccaacuacuacgcgcugcuccaccagcagaagucccgggccuucuaccgcauccaggccacccggcugaugacgggggccggcaacgugcugcgccggcacgccgcggacgccagccgccgggccgccccggccgagggggcgggcgaggacgaggacgacggcgccagccgcaucuucuucgagcccucccucuaccacugccuggagaacugcgggagcguccugcucuccgugaccugccagggcggggagggcaacagcaccuucuacguggacuaccggaccgaggacggguccgccaaggccggcagcgacuacgaguacuccgagggcacgcuggucuucaagcccggggagacccagaaggagcugcgcaucggcaucaucgacgacgacaucuucgaggaggacgagcacuucuucgugcgccuccugaaccugcgggugggggacgcccagggcauguucgagcccgacggcgggggccgcccgaaggggcggcucgucgcgccccugcuggccaccgugaccauccucgacgacgaccacgccggcaucuucagcuuccaggaccgccugcugcacguguccgagugcauggggacggucgacgugcgggugguccgcagcuccggcgcccggggcaccgugcgccugcccuaccggaccguggacgggaccgcgcgcggcgggggcguccacuacgaggacgccugcggggagcucgaguucggcgacgacgagacgaugaagacccuccaggugaagaucguggacgacgaggaguacgagaagaaggacaacuucuucaucgagcugggccagccgcaguggcugaagcgggggaucagcgcccugcugcucaaccagggcgacggggaccgcaagcugaccgccgaggaggaggaggcccggcgcaucgcggagaugggcaagcccguccugggggagaacugccggcucgaggugaucaucgaggaguccuacgacuucaagaacaccguggacaagcugaucaagaagacgaaccuggcccucgucaucggcacccacagcuggcgcgagcaguuccuggaggccaucaccguguccgccggcgacgaggaggaggaggaggacgggagccgggaggagcgccugcccuccugcuucgacuacgugaugcacuuccucaccgucuucuggaaggugcuguucgccugcgugcccccgacggaguacugccacggcugggcgugcuucggggucagcauccuggugaucggccuccugaccgcccugaucggggaccucgccagccacuucggcugcaccgugggccugaaggacuccgucaacgccgugguguucgucgcccuggggaccagcauccccgacaccuucgcguccaagguggccgcccuccaggaccagugcgccgacgcgagcaucggcaacgugacgggguccaacgccgucaacguguuccugggccugggcguggccuggagcgucgccgccguguacugggcggugcaggggcggcccuucgagguccgcaccggcacccucgccuucuccgugacccuguucacggucuucgccuucguggggaucgccgugcugcucuaccgccggcgcccccacaucggcggggagcugggcggcccgcgggggcccaagcuggccaccaccgcccucuuccugggccuguggcuccuguacauccuguucgccagccucgaggccuacugccacauccgcggguucuga

SEQ ID NO: 36721 - RNA, 897 nt, Artificial Sequence
  derived and/or modified sequence opt1 from SLC8A3__Homo_sapiens__NP_001123889
auggagcgcggcaucagcgacgugaccgaccggaagcugaccauggaggaggaggaggccaagcgcaucgccgagauggggaagcccguccucggcgagcacccgaagcuggaggugaucaucgaggaguccuacgaguucaagacgaccguggacaagcugaucaagaagaccaaccucgcgcuggucguggggacccacagcuggcgggaccaguucauggaggccaucacgguguccgccgccggcgacgaggacgaggacgagagcggggaggagcgccugcccuccugcuucgacuacgucaugcacuuccucaccguguucuggaaggugcuguucgccugcgucccgcccaccgaguacugccacggcugggcgugcuucgccgugagcauccugaucaucggcaugcucaccgccaucaucggggaccuggccucccacuucggcugcacgaucgggcugaaggacagcgugaccgcggucguguucguggccuucggcaccuccguccccgacaccuucgccagcaaggccgccgcgcuccaggacguguacgccgacgccuccaucgggaacgugacgggcagcaacgccgucaacguguuccugggcaucgggcuggccugguccguggcggccaucuacugggcccuccagggccaggaguuccacgucagcgccgggacccuggccuucuccgugacccuguucaccaucuucgcguucgugugcaucagcguccuccuguaccggcgccggccccaccugggcggcgagcucgggggcccccgcgggugcaagcuggccacgaccuggcuguucgugucccucuggcugcuguacauccucuucgccacccuggaggccuacugcuacaucaagggcuucuga

SEQ ID NO: 36722 - RNA, 2118 nt, Artificial Sequence
  derived and/or modified sequence opt1 from SLC9A1__Homo_sapiens__XP_011540323
augggcaaggacgccugccccggguuccacgugaucccgaccaucagcuccaucguccccgagagcugccugcucaucguggugggccugcuggucgggggccucaucaagggggugggcgagaccccgcccuuccugcaguccgacguguucuuccuguuccuccugccgcccaucauccuggacgccggcuacuuccucccccugcgccaguucacggagaaccuggggaccauccucaucuucgcggucgugggcacccuguggaacgccuucuuccucgggggccucauguacgccgugugccuggucgggggcgagcagaucaacaacaucggccugcucgacaaccugcuguucgggagcaucaucuccgccguggaccccguggccguccucgcgguguucgaggagauccacaucaacgagcugcugcacauccucguguucggcgagagccugcugaacgacgccgucaccguggugcucuaccaccuguucgaggaguucgccaacuacgagcacgucgggaucguggacaucuuccugggcuuccucuccuucuucguggucgcccugggcggggugcuggugggcgucguguacggggucaucgcggccuucacgagccgguucaccucccacauccgcgugaucgagccccucuucguguuccuguacagcuacauggccuaccuguccgccgagcuguuccaccugagcggcaucauggcccugaucgcguccggggucgugaugcggcccuacguggaggccaacaucagccacaagucccacaccaccaucaaguacuuccucaagauguggagcuccgucagcgagacgcugaucuucaucuuccugggcguguccaccguggccggcagccaccacuggaacuggaccuucgucaucagcacccuccuguucugccugaucgcccgcgugcucggggugcugggccugacgugguucaucaacaaguuccggaucgucaagcucacccccaaggaccaguucaucaucgccuacgggggccugcgcggggcgaucgccuucucccugggcuaccugcucgacaagaagcacuuccccaugugcgaccuguuccugaccgccaucaucaccgugaucuucuucacgguguucguccagggcaugaccauccggccgcucguggaccugcuggccgugaagaagaagcaggagaccaagcgcagcaucaacgaggagauccacacccaguuccucgaccaccuccugacggggaucgaggacaucugcggccacuacgggcaccaccacuggaaggacaagcugaaccgguucaacaagaaguacgucaagaagugccugaucgccggcgagcgcuccaaggagccccagcugaucgcguucuaccacaagauggagaugaagcaggccaucgagcucguggagagcgggggcaugggcaagauccccuccgccgugagcaccgucuccaugcagaacauccaccccaagagccugccguccgagcggauccugcccgcccucagcaaggacaaggaggaggagauccgcaagauccugcggaacaaccugcagaagacccgccagcggcuccgcuccuacaaccggcacacccugguggccgaccccuacgaggaggcguggaaccagaugcugcuccgccggcagaaggcccgccagcuggagcagaagaucaacaacuaccugacggugcccgcccacaagcucgacagcccgaccaugucccgggcccgcaucgggagcgacccccuggcguacgagcccaaggaggaccugcccgucaucaccaucgacccggccagcccccagucccccgaguccguggaccucgugaacgaggagcugaagggcaagguccuggggcucagccgcgaccccgccaagguggccgaggaggacgaggacgacgacggcggcaucaugaugcgguccaaggagaccagcagcccggggacggacgacguguucacccccgcccccuccgacagcccguccagccagcgcauccagcggugccuguccgaccccggcccccaccccgagccgggggagggcgagcccuucuuccccaaggggcaguga

SEQ ID NO: 36723 - RNA, 2439 nt, Artificial Sequence
  derived and/or modified sequence opt1 from SLC9A2__Homo_sapiens__NP_003039
auggagccccugggcaacuggcgcagccuccgggccccgcugccccccaugcugcuccugcugcuccugcagguggccgggcccgucggcgcgcuggccgagacccuccugaacgccccgcgcgccauggggaccuccagcuccccccccagccccgccuccgugguggcgccgggcacgacccuguucgaggagagccggcuccccgucuucacccuggacuacccccacgugcagauccccuucgagaucacccuguggauccuccuggccucccuggccaagaucggguuccaccucuaccacaagcugccgacgaucgugcccgagagcugccugcucaucauggucggccugcugcucggcgggaucaucuucggcguggacgagaaguccccccccgccaugaagaccgacguguucuuccuguaccugcucccgcccaucguccuggacgcgggguacuucaugcccacccgccccuucuucgagaacaucggcaccaucuucugguacgccgugguggggacgcuguggaacagcaucggcaucggcgucucccucuucgggaucugccagaucgaggccuucggccugagcgacaucacccugcuccagaaccugcuguucgggucccucaucagcgccguggacccgguggccguccuggcgguguucgagaacauccacgugaacgagcagcuguacauccucgucuucggcgagucccugcugaacgacgccgugaccgugguccucuacaaccuguucaagagcuucugccagaugaagaccaucgagacgaucgacguguucgccggcaucgccaacuucuucguggucgggaucggcggggugcugaucggcaucuuccucggguucaucgccgcguucaccacccgguucacccacaacauccgcgucaucgagccccuguucguguuccuguacuccuaccucagcuacaucacggccgagauguuccaccuguccggcaucauggccaucaccgccugcgccaugaccaugaacaaguacguggaggagaacgucagccagaagagcuacaccacgaucaaguacuucaugaagaugcuguccagcguguccgagacccugaucuucaucuucaugggcgugagcaccgucgggaagaaccacgaguggaacugggcguucgugugcuucacccucgccuucugccugauguggcgggcccugggcguguucguccucacgcaggugaucaaccgcuuccggaccaucccccugaccuucaaggaccaguucaucaucgccuacgggggccugcgcggggccaucugcuucgcgcucguguuccugcugcccgccgccgucuucccgcggaagaagcucuucaucaccgccgcgaucguggugaucuucuucacggucuucauccugggcaucaccauccgcccccugguggaguuccucgacgugaagcgguccaacaagaagcagcaggccgucagcgaggagaucuacugccgccuguucgaccacgugaagaccggcaucgaggacgugugcgggcacuggggccacaacuucuggcgggacaaguucaagaaguucgacgacaaguaccugcgcaagcuccugauccgggagaaccagcccaaguccagcaucgucucccuguacaagaagcucgagaucaagcacgccaucgagauggccgagaccgggaugaucagcacggugcccaccuucgccucccugaacgacugccgcgaggagaagauccggaaggugaccagcuccgagaccgacgagauccgcgagcugcucagccggaaccuguaccagauccgccagcgcacgcuguccuacaaccggcacagccucaccgcggacaccuccgagcgccaggccaaggagauccugauccggcgccggcacagccugcgcgaguccauccggaaggacagcagccucaaccgcgagcaccgggccuccaccagcaccucccgcuaccugagccugccgaagaacacgaagcuccccgagaagcugcagaagcggcgcaccaucuccaucgccgacggcaacagcuccgacagcgacgccgacgcggggaccaccguccugaaccuccagccccgggcccgccgguuccugccggagcaguucuccaagaagagcccccaguccuacaagauggaguggaagaacgagguggacguggacagcggccgcgacaugcccuccacgcccccgaccccccacagccgggagaagggcacccagaccuccgggcugcuccagcagccccugcugagcaaggaccaguccggcagcgagcgcgaggacagccucacggaggggauccccccgaagccccccccccggcuggucuggcgcgccuccgagccgggcagccgcaaggcccgguucggcuccgagaagcccuga

SEQ ID NO: 36724 - RNA, 2505 nt, Artificial Sequence
  derived and/or modified sequence opt1 from SLC9A3__Homo_sapiens__NP_004165
auguggggccugggggcccgcggccccgaccgggggcuccugcuggcccucgcgcugggcgggcuggcccgcgccggcggcguggaggucgagcccgggggcgcccacggggagagcggcggguuccagguggugaccuucgagugggcccacguccaggaccccuacgugaucgcgcucuggauccugguggccucccuggccaagaucggcuuccaccucagccacaaggucaccuccguggugcccgagagcgcccugcugaucguccucggccuggugcucgggggcaucgugugggcggccgaccacaucgccuccuucacgcugacccccaccgucuucuucuucuaccugcugccgcccaucgugcucgacgccggguacuucaugcccaaccggcuguucuucggcaaccugggcaccauccuccuguacgccguggucgggacgguguggaacgcggccaccaccggccugagccucuacgggguguuccuguccggccugaugggggaccuccagaucggccugcuggacuuccuccuguucggcagccugauggccgccgucgaccccguggccgugcucgcggucuucgaggaggugcacgugaacgagguccuguucaucaucguguucggggagucccugcucaacgacgccgucaccguggugcuguacaacgucuucgagagcuucguggcccugggcggggacaacgugacgggcgucgacugcgugaaggggaucguguccuucuucgucgugagccucggcggcacccuggugggggucguguucgccuuccugcucucccuggugacccgcuucaccaagcacguccggaucaucgagccgggcuucguguucaucaucagcuaccuguccuaccucacgagcgagaugcugucccugagcgccauccucgcgaucaccuucugcgggaucugcugccagaaguacgugaaggccaacaucuccgagcagagcgccaccaccguccgcuacacgaugaagaugcuggccagcuccgccgagaccaucaucuucauguuccugggcaucagcgcggugaaccccuucaucuggaccuggaacaccgccuucgugcugcucacgcuggucuucaucuccguguaccgggccaucggggugguccugcagaccuggcuccugaaccgcuaccggauggugcagcuggagcccaucgaccaggugguccucagcuacggcggccugcgcggggccguggcguucgcccuggugguccuccuggacggcgacaaggugaaggagaagaaccuguucguguccaccaccaucaucgucguguucuucacggugaucuuccaggggcucaccaucaagccccugguccaguggcugaaggugaagcggagcgagcaccgcgagccgcggcucaacgagaagcugcacggccgcgccuucgaccacauccuguccgccaucgaggacaucagcggccagaucgggcacaacuaccuccgggacaaguggucccacuucgaccgcaaguuccugagccgggugcugaugcgccgguccgcccagaagucccgcgaccggauccucaacgucuuccacgagcugaaccugaaggacgcgaucagcuacguggccgagggcgagcgccgcgggagccucgccuucauccggucccccagcaccgacaacguggucaacguggacuucacgccccgcuccagcaccguggaggccuccgucagcuaccugcugcgggagaacgugagcgccgugugccucgacaugcagucccuggagcagcgccggcgcagcauccgggacgcggaggacauggucacccaccacacccugcagcaguaccucuacaagccccgccaggaguacaagcaccuguacucccggcacgagcugaccccgacggaggacgagaagcaggaccgcgagaucuuccaccggaccaugcgcaagcggcucgagagcuucaaguccaccaagcugggccugaaccagaacaagaaggccgccaagcucuacaagcgcgagcgggcccagaagcgccggaacagcuccauccccaacgggaagcugcccauggagagccccgcccagaacuucaccaucaaggagaaggaccuggagcucuccgacacggaggagccgcccaacuacgacgaggagaugagcggcggcaucgaguuccuggcguccgugaccaaggacaccgccagcgacucccccgccgggaucgacaaccccguguucagcccggacgaggcccuggaccgcucccuccuggcgcggcugccgcccuggcucagccccggcgagaccgucgugccgucccagcgcgcccgcacccagauccccuacagccccgggacguucugccggcugaugccguuccgccugagcuccaagagcgucgacuccuuccuccaggccgacggccccgaggagcggccgcccgccgcccugcccgagagcacccacauguga

SEQ ID NO: 36725 - RNA, 1077 nt, Artificial Sequence
  derived and/or modified sequence opt1 from SLC9A3R1__Homo_sapiens__NP_004243
augagcgccgacgccgccgccggcgcgccccugccgcgccucugcugccuggagaaggggcccaacggcuacggguuccaccuccacggcgagaaggggaagcugggccaguacauccggcugguggagcccggcucccccgccgagaaggccgggcugcucgccggcgaccgccuggucgaggugaacggggagaacguggagaaggagacccaccagcaggucgugagccggauccgcgccgcccugaacgccgugcggcuccuggucguggacccggagaccgacgagcagcugcagaagcucggcgugcagguccgcgaggagcugcugcgggcgcaggaggcccccgggcaggccgagccgcccgccgccgcggaggugcagggcgccggcaacgagaacgagccccgcgaggccgacaagucccaccccgagcagcgggagcuccgcccccggcugugcacgaugaagaaggggcccagcggcuacggguucaaccugcacuccgacaagagcaagccgggccaguucauccgcuccguggaccccgacagccccgccgaggccuccggccuccgggcgcaggaccgcaucgucgaggugaacggggugugcauggagggcaagcagcacggggacgucgugagcgccauccgggccggcggggacgagaccaagcugcugguggucgaccgcgagaccgacgaguucuucaagaagugccgggugauccccucccaggagcaccucaacggcccgcugcccgugcccuucaccaacggcgagauccagaaggagaacagccgcgaggcccuggccgaggcggcccucgagagcccccggccggcccugguccgcuccgccuccagcgacacguccgaggagcugaacagccaggacuccccgcccaagcaggacagcaccgcccccagcuccaccagcuccagcgaccccauccucgacuucaacaucucccuggcgauggccaaggagcgggcccaccagaagcgcagcuccaagcgcgcgccccagauggacuggagcaagaagaacgagcuguucuccaaccucuga

SEQ ID NO: 36726 - RNA, 1014 nt, Artificial Sequence
  derived and/or modified sequence opt1 from SLC9A3R2__Homo_sapiens__NP_001123484
auggccgcccccgagccgcugcgcccccggcucugccgccuggugcggggcgagcagggguacggcuuccaccuccacggggagaagggccgccgggggcaguucauccgccgggucgagcccggcagccccgcggaggccgccgcccugcgcgccggcgaccggcugguggaggugaacggggucaacguggagggcgagacccaccaccaggugguccagcgcaucaaggcgguggaggggcagacccggcugcucguggucgaccaggagacggacgaggagcugcgccggcgccagcugaccugcaccgaggagauggcccagcggggccucccgcccgcccacgaccccugggagcccaagccggacugggcccacaccgggucccacagcuccgaggcgggcaagaaggacgugagcggcccccugcgcgagcugcggccccgccucugccaccuccggaaggggccccagggcuacggguucaaccugcacuccgacaagagccgcccgggccaguacauccgguccguggaccccggcagccccgccgcccgcuccgggcugcgcgcccaggaccggcugaucgaggucaacggccagaacguggaggggcugcgccacgccgagguggucgcgagcaucaaggcccgggaggacgaggcccgccuccuggugguggaccccgagacggacgagcacuucaagcggcugcgcgucaccccgaccgaggagcacguggagggcccccuccccucccccgugaccaacgggacgagcccggcccagcugaacggcggcuccgccugcagcucccggagcgaccugcccggguccgacaaggacaccgaggacggcagcgcguggaagcaggaccccuuccaggaguccgggcuccaccugagccccaccgccgccgaggccaaggagaaggcccgcgcgaugcgggucaacaagcgcgccccgcagauggacuggaaccggaagcgcgagaucuucagcaacuucuga

SEQ ID NO: 36727 - RNA, 2397 nt, Artificial Sequence
  derived and/or modified sequence opt1 from SLC9A4__Homo_sapiens__NP_001011552
auggcccugcagauguucgugaccuacucccccuggaacugccuccugcugcucgucgcccuggagugcuccgaggcgagcuccgaccugaacgagagcgccaacuccaccgcccaguacgccagcaacgccugguucgcggccgccuccagcgagccggaggagggcaucuccguguucgagcucgacuacgacuacgugcagauccccuacgaggucacgcuguggauccugcucgccagccuggcgaagaucggguuccaccuguaccaccgccuccccggccugaugcccgaguccugccugcucauccuggugggggcccuggugggcgggaucaucuucggcaccgaccacaagagcccgcccgucauggacuccagcaucuacuuccucuaccugcugccgcccaucgugcucgagggcggguacuucaugccgacccggcccuucuucgagaacaucggcuccauccuguggugggccgugcugggggcccucaucaacgcccugggcaucgggcugagccucuaccugaucugccaggucaaggcguucggccugggcgacgugaaccuccugcagaaccugcuguucgggucccugaucagcgccguggaccccgucgccgugcuggccguguucgaggaggcccgcgucaacgagcagcucuacaugaugaucuucggcgaggcgcugcugaacgacgggaucaccguggugcucuacaacaugcugaucgccuucacgaagaugcacaaguucgaggacaucgagaccgucgacauccuggccggcugcgcccgguucaucguggugggccucgggggcguccuguucgggaucguguucggcuucaucuccgccuucaucacccgcuucacccagaacaucagcgcgaucgagccccugaucguguucauguucagcuaccucuccuaccuggccgccgagacgcuguaccucagcgggauccuggccaucaccgccugcgcggucaccaugaagaaguacguggaggagaacgucucccagaccagcuacacgaccaucaaguacuucaugaagaugcuguccagcguguccgagacccugaucuucaucuucaugggcgugagcaccgucggcaagaaccacgaguggaacugggccuucaucugcuucacgcucgccuucugccagaucuggcgggccaucuccguguucgcgcuguucuacaucagcaaccaguuccgcaccuucccguucuccaucaaggaccagugcaucaucuucuacagcggggugcggggcgccggguccuucagccuggccuuccuccugccccugucccucuucccccgcaagaagauguucgucaccgccacccugguggugaucuacuucacggucuucauccagggcaucaccguggggccccuggugcgguaccucgacgucaagaagaccaacaagaaggagagcaucaacgaggagcugcacauccgccugauggaccaccucaaggccggcaucgaggacgugugcggccacuggucccacuaccaggugcgggacaaguucaagaaguucgaccaccgcuaccugcggaagauccugauccgcaagaaccuccccaagagcuccaucgucagccuguacaagaagcuggagaugaagcaggcgaucgagaugguggagaccgggauccucagcuccacggccuucagcaucccccaccaggcccagcggauccagggcaucaagcgccugucccccgaggacguggagagcauccgggacauccugaccuccaacauguaccagguccgccagcggacccucagcuacaacaaguacaaccugaagccccagaccuccgagaagcaggccaaggagauccugauccgccggcagaacacgcuccgcgagagcaugcgcaaggggcacucccugccguggggcaagcccgccgggaccaagaacauccgguaccugagcuaccccuacggcaacccccaguccgcgggccgcgacacccgggccgccggguucagcgacgacgacuccagcgacccgggcucccccagcaucaccuucuccgccugcagccgcaucgggagccuccagaagcaggaggcccaggagaucauccccaugaagucccugcaccggggccgcaaggcguucagcuucggcuaccagcggaacacgucccaggaggaguaccucgggggcgugcgccggguggcccuccgccccaagccgcuguuccacgccgucgacgaggagggggagagcggcggggaguccgagggcaaggccagccugguggaggugcggucccgcuggaccgcggaccacggccacgggcgggaccaccaccgcagccacagcccccuccugcagaagaaguga

SEQ ID NO: 36728 - RNA, 2691 nt, Artificial Sequence
  derived and/or modified sequence opt1 from SLC9A5__Homo_sapiens__NP_004585
augcugcgcgccgcccucagccugcuggcgcucccccuggccggcgccgccgaggagccgacccagaagcccgagucccccggggagcccccgcccggccuggagcuguuccgguggcaguggcacgagguggaggcccccuaccuggucgcgcuguggauccucguggccagccuggccaagaucguguuccaccugucccgcaaggucaccagccucgugcccgaguccugccugcugauccuccuggggcuggugcucggcgggaucguccuggccguggcgaagaaggccgaguaccagcuggagccgggcacguucuuccucuuccugcugccgcccaucgugcucgacagcggcuacuucaugcccucccggcuguucuucgacaaccugggggccauccucaccuacgccgucgugggcacccuguggaacgccuucaccacgggggcggcccuguggggccuccagcaggccgggcugguggcgccccgcguccaggccggccugcucgacuuccugcuguucggcagccucaucuccgccguggaccccguggccguccuggccguguucgaggaggugcacgucaacgagacccuguucaucaucguguucggggagagccuccugaacgacgccgugaccgucgugcuguacaaggugugcaacuccuucgucgagaugggcagcgccaacgugcaggcgaccgacuaccucaagggggucgccucccuguucguggugagccugggcggcgccgccgucgggcucguguucgccuuccugcuggcgcucacgacccgguucaccaagcgcgugcggaucaucgagccccugcuggucuuccugcucgccuacgccgccuaccugaccgcggagauggccucccugagcgccauccucgccgugacgaugugcggccuggggugcaagaaguacguggaggccaacaucucccacaagagccgcaccaccgucaaguacaccaugaagacgcuggcguccugcgccgagaccgugaucuucaugcuccugggcaucagcgccguggacagcuccaagugggccugggacagcgggcugguccucggcacccugaucuucauccuguucuuccgggcccucggcguggugcugcagaccuggguccugaaccaguuccgccucgugccccuggacaagaucgaccagguggucauguccuacgggggccugcgcggggcgguggccuucgcccucgugauccugcuggaccggacgaaggucccggccaaggacuacuucguggccaccaccaucguggucguguucuucaccgugaucguccagggccucacgaucaagccccuggugaaguggcugaaggugaagcggagcgagcaccacaagcccacccucaaccaggagcugcacgagcacaccuucgaccacauccuggcggccgucgaggacgugguggggcaccacggcuaccacuacuggcgcgaccggugggagcaguucgacaagaaguaccucucccagcugcugaugcgccggagcgccuaccgcauccgggaccagaucugggacgucuacuaccgccucaacauccgggacgccaucuccuucguggaccagggcgggcacgugcugagcuccaccggccugacgcuccccagcaugccgucccgcaacagcgucgcggagaccuccgugaccaaccugcugcgcgagagcggguccggcgccugccucgaccuccaggugaucgacaccguccggagcgggcgcgaccgggaggacgccgugaugcaccaccuccucugcggcggccuguacaagccccgccggcgcuacaaggccuccugcagccggcacuucaucuccgaggacgcccaggagcgccaggacaaggagguguuccagcagaacaugaagcggcgccuggagagcuucaagagcacgaagcacaacaucugcuucaccaaguccaagccccggccccgcaagaccgggcggcgcaagaaggacggcgucgcgaacgccgaggccaccaacgggaagcaccggggccucggcuuccaggacacggccgccgugauccugaccguggagagcgaggaggaggaggaggaguccgacagcuccgagaccgagaaggaggacgacgaggggaucaucuucgucgcgcgcgccaccagcgaggugcugcaggagggcaagguguccgggagccucgaggucugcccgagcccccggaucaucccgcccucccccacgugcgccgagaaggagcugcccuggaaguccggccagggggaccuggccguguacgugagcuccgagaccaccaagaucguccccguggacaugcagaccggcuggaaccagagcaucuccagccucgagucccuggccagcccgcccugcaaccaggcgcccauccugaccugccugcccccgcacccccgcggcacggaggagccccaggucccccugcaccucccgagcgacccccgguccagcuucgccuucccgcccucccuggccaaggccgggcgcagccgcuccgagagcuccgcggaccugccccagcagcaggagcugcagccccucaugggccacaaggaccacacccaccugagccccgggaccgccaccucccacuggugcauccaguucaaccggggcagccgccuguga

SEQ ID NO: 36729 - RNA, 2106 nt, Artificial Sequence
  derived and/or modified sequence opt1 from SLC9A6__Homo_sapiens__NP_001036002
auggcccgccggggcuggcgccgggcgccccugcgccgcggggugggcagcagcccccgggcccggcgccucaugcggccccuguggcugcuccuggccgucgggguguucgacugggccggcgccuccgacgggggcggcggggaggcccgcgcgauggacgaggagaucguguccgagaagcaggccgaggagagccaccggcaggacuccgccaaccugcucaucuucauccugcugcucacccugaccauccugacgaucuggcuguucaagcaccgccgggcccgcuuccugcacgagaccggccuggcgaugaucuacgggcuccuggucggccuggugcuccgguacgggauccacgugcccagcgacgucaacaacgugacccuguccugcgaggugcagagcucccccaccacgcugcucgucaacgugagcggcaaguucuacgaguacaugcugaagggcgagaucuccagccacgagcugaacaacgugcaggacaacgagaugcuccgcaaggucaccuucgacccggagguguucuucaacauccugcugccgcccaucaucuucuacgccggguacucccucaagcggcgccacuucuuccggaaccugggcagcauccuggccuacgccuuccucgggaccgccaucuccugcuucgugaucggcagcaucauguacggcugcgucacccugaugaaggugacggggcagcuggcgggcgacuucuacuucaccgacugccuccuguucggggccaucguguccgccaccgaccccgucaccgugcuggccaucuuccacgagcuccagguggacgucgagcuguacgcccuccucuucggcgagagcgugcugaacgacgcgguggccaucguccuguccagcagcaucguggccuaccagcccgccggggacaacucccacacguucgacgucaccgccauguucaagagcaucggcaucuuccucggcaucuucuccgggagcuucgcgaugggcgccgccaccgggguggugaccgcccuggucacgaaguucaccaagcugcgcgaguuccagcuccuggagaccggccuguucuuccucauguccuggagcaccuuccugcuggccgaggcguggggguucacgggcgugguggccguccuguucugcggcaucacccaggcccacuacaccuacaacaaccucuccaccgagagccagcaccggacgaagcagcuguucgagcugcucaacuuccuggccgagaacuucaucuucuccuacauggggcugacccucuucaccuuccagaaccacguguucaaccccaccuucguggucggcgcguucguggccaucuuccuggggcgcgccgccaacaucuacccccugagccuccugcugaaccucggccgccgguccaagaucgggagcaacuuccagcacaugaugauguucgccggccugcgcggcgcgauggccuucgcccuggccauccgggacacggccaccuacgcgcgccagaugauguucuccaccacccuccugaucguguucuucacggucuggguguucgggggcgggaccaccgccaugcugagcugccuccacauccgggugggcgucgacuccgaccaggagcaccugggcgugcccgagaacgagcgccggaccacgaaggccgagagcgccuggcuguuccgcaugugguacaacuucgaccacaacuaccucaagccgcugcugacccacuccgggccgccccucaccaccacccugcccgccugcugcggccccaucgcgcggugccugacgagcccccaggccuacgagaaccaggagcagcucaaggacgacgacuccgaccugauccugaacgacggggacaucagccucaccuacggcgacagcaccgugaacaccgagcccgccacguccagcgcgccccgccgguucauggggaacuccagcgaggacgcccuggaccgcgagcuggccuucggcgaccacgagcucgucauccggggcacccgccuggugcugccgauggacgacuccgagccgccccucaaccugcuggacaacacccggcacgggcccgccuga

SEQ ID NO: 36730 - RNA, 2178 nt, Artificial Sequence
  derived and/or modified sequence opt1 from SLC9A7__Homo_sapiens__NP_115980
auggagcccggcgacgccgcccgcccggggagcggccgggcgaccggggcgcccccgccccgccugcuccugcugccccuccugcugggcugggggcuccggguggccgccgccgccuccgccagcuccagcggcgccgccgcggaggacuccagcgccauggaggagcuggccaccgagaaggaggccgaggagucccaccgccaggacagcgucucccugcucacguucauccugcugcucacccugaccauccugaccaucuggcuguucaagcaccggcgcgugcgguuccugcacgagacgggccuggccaugaucuacgggcucaucgugggcgucauccugcgcuacgggacccccgcgaccagcggccgggacaagucccugagcugcacccaggaggaccgcgccuucuccacgcuccuggugaacgugagcgggaaguucuucgaguacacccugaagggcgagaucucccccggcaagaucaacagcgucgagcagaacgacaugcuccggaaggugaccuucgaccccgagguguucuucaacauccugcugccgcccaucaucuuccacgccggguacucccucaagaagcgccacuucuuccggaaccugggcagcauccuggccuacgccuuccucgggaccgcggucuccugcuucaucaucggcaaccugauguacggcguggugaagcugaugaagaucauggggcagcucagcgacaaguucuacuacacggacugccuguucuucggcgccaucaucagcgccaccgaccccgucaccgugcuggccaucuucaacgagcuccacgccgacguggaccuguacgcgcuccucuucggggaguccguccugaacgacgccguggccaucgugcugagcuccagcaucgucgccuaccagcccgccggccucaacacccacgcguucgacgccgccgccuucuucaaguccguggggaucuuccugggcaucuucagcggcuccuucacgaugggggcggugaccggcgucaacgccaacgugaccaaguucaccaagcugcacugcuucccgcuccuggagacggcccuguucuuccucaugagcugguccaccuuccugcuggccgaggccugcggguucaccggcguggucgcggugcuguucugcgggaucacccaggcccacuacacguacaacaaccucagcgucgagucccgcagccggaccaagcagcuguucgaggugcugcacuuccucgccgagaacuucaucuucuccuacaugggccuggcccuguucaccuuccagaagcacguguucagccccaucuucaucaucggcgccuucgucgcgaucuuccucgggcgcgccgcccacaucuacccccuguccuucuuccugaaccucggccggcgccacaagaucggguggaacuuccagcacaugaugauguucagcggccugcgcggggccauggccuucgcgcuggccauccgggacaccgccuccuacgcccggcagaugauguucacgaccacccuccugaucguguucuucaccguguggaucaucggcggcgggacgacccccaugcugagcuggcucaacauccgcgucggcguggaggagccguccgaggaggaccagaacgagcaccacuggcaguacuuccgcgugggggucgaccccgaccaggacccgccgcccaacaacgacagcuuccaggugcugcagggcgacggccccgacagcgcgcgggggaaccgcaccaagcaggaguccgccuggaucuuccggcugugguacagcuucgaccacaacuaccucaagcccauccugacccacuccggcccgccccugacgaccacccuccccgccuggugcgggcugcuggcccgcugccucaccagcccccagguguacgacaaccaggagccccugcgggaggaggacuccgacuucauccugaccgagggcgaccucacgcugaccuacggggacagcaccgucaccgccaacggcuccagcuccagccacacggcguccaccagccuggagggcucccgccggaccaagagcuccagcgaggaggugcucgagcgcgaccuggggaugggcgaccagaagguguccagccgggggacccgccuggucuucccccucgaggacaacgccuga

SEQ ID NO: 36731 - RNA, 1794 nt, Artificial Sequence
  derived and/or modified sequence opt1 from SLC9A8__Homo_sapiens__NP_001247420
augggcgagaagauggccgaggaggagcgcuuccccaacaccacccacgagggguucaacgugacgcugcacaccacccucgucgugaccacgaagcuggugcugccgacccccggcaagcccauccuccccguccagaccggggagcaggcccagcaggaggagcagagcuccggcaugaccaucuucuucagccugcuggugcucgcgaucugcaucauccuggugcaccuccucauccgguaccgccugcacuuccugccggaguccgucgccguggugagccucgggauccugaugggcgccgucaucaagaucaucgaguucaagaagcuggccaacuggaaggaggaggagauguuccggcccaacauguucuuccuccugcugcucccgcccaucaucuucgaguccggcuacagccugcacaaggggaacuucuuccagaacaucggcuccaucacgcuguucgccguguucgggaccgcgaucagcgccuucguggucggcgggggcaucuacuuccucggccagggguucuucuucgugugcgugugcgucuucgugugcuucauccugcaggccgacgugaucuccaagcugaacaugaccgacagcuucgccuucggcucccucaucagcgcggucgaccccguggccaccaucgccaucuucaacgcccugcacguggaccccguccugaacaugcucguguucggggaguccauccugaacgacgccgugagcaucguccugacgaacaccgcggagggccucacccgcaagaacauguccgacgugagcggcuggcagaccuuccugcaggcccuggacuacuuccucaagauguucuucggguccgccgcccugggcacgcugaccgggcucaucagcgcccugguccugaagcacaucgaccuccggaagacccccucccuggaguucggcaugaugaucaucuucgcguaccugcccuacgggcucgccgagggcaucagccugagcggcaucauggccauccuguucuccgggaucgugaugagccacuacacccaccacaaccucuccccggugacgcagauccugaugcagcagacccugcgcaccgucgccuuccucugcgagaccugcguguucgccuuccugggccugagcaucuucuccuucccccacaaguucgagaucagcuucgugaucuggugcaucguccuggugcuguucgggcgggcggugaacaucuucccccuguccuaccugcucaacuucuuccgcgaccacaagaucacgcccaagaugauguucaucaugugguucagcggccugcgcggggccaucccguacgcccugucccuccaccuggaccuggagcccauggagaagcggcagcucaucggcaccaccaccaucgucaucgugcuguucacgauccugcuccugggcgggagcaccaugccccugauccggcucauggacaucgaggacgccaaggcccaccgccggaacaagaaggacgugaaccuguccaagaccgagaagaugggcaacaccgucgagagcgagcaccuguccgagcucacggaggaggaguacgaggcgcacuacauccgccggcaggaccugaagggguucguguggcuggacgccaaguaccucaaccccuucuucacccgccggcugacccaggaggaccugcaccacggccgcauccagaugaagacccucacgaacaagugguacgaggaggugcggcaggggccgagcggcuccgaggacgacgagcaggagcugcuguga

SEQ ID NO: 36732 - RNA, 1938 nt, Artificial Sequence
  derived and/or modified sequence opt1 from SLC9A9__Homo_sapiens__NP_775924
auggagcgccagagccgggugauguccgagaaggacgaguaccaguuccagcaccagggcgccgucgagcugcucguguucaacuuccugcugauccucaccauccugaccaucuggcuguucaagaaccaccgcuuccgguuccuccacgagaccgggggcgccaugguguacgggcugaucaugggccugauccuccgcuacgcgacggcccccaccgacaucgagagcgggaccgucuacgacugcgugaagcugacguucuccccgagcacccugcucgugaacaucaccgaccaggucuacgaguacaaguacaagcgggagaucucccagcacaacaucaacccccaccagggcaacgccauccuggagaagaugaccuucgaccccgagaucuucuucaacgugcugcugcccccgaucaucuuccacgccggcuacagccucaagaagcgccacuucuuccagaaccugggguccauccucacguacgccuuccugggcaccgcgaucagcugcaucgugaucgggcugaucauguacggcuucgucaaggccaugauccacgccgggcagcucaagaacggcgacuuccacuucaccgacugccuguucuucggcucccugaugagcgccaccgaccccgugacggugcucgcgaucuuccacgagcugcacgucgaccccgaccuguacacccuccuguucggggaguccgugcugaacgacgccguggccaucguccucaccuacagcaucuccaucuacagccccaaggagaacccgaacgccuucgacgccgcggccuucuuccaguccgugggcaacuuccuggggaucuucgccggcagcuucgccaugggcuccgccuacgcgaucaucaccgcccugcucacgaaguucaccaagcugugcgaguuccccaugcuggagaccggccucuucuuccugcugagcugguccgccuuccucagcgccgaggccgcggggcugaccgggaucguggccguccuguucugcggcgugacgcaggcccacuacaccuacaacaaccucagcuccgacagcaagauccggaccaagcagcuguucgaguucaugaacuuccuggccgagaacgugaucuucugcuacauggggcucgcccuguucaccuuccagaaccacaucuucaacgcgcuguucauccucggcgccuuccuggccaucuucgucgcccgcgcgugcaacaucuacccccuguccuuccugcucaaccugggccggaagcagaagauccccuggaacuuccagcacaugaugauguucagcgggcugcgcggcgccaucgccuucgcccucgccauccggaacacggagucccagccgaagcagaugauguucaccaccacccugcugcucguguucuucacggugugggucuucgggggcgggaccacccccaugcugaccuggcugcagauccgcgugggcgucgaccucgacgagaaccugaaggaggaccccagcucccagcaccaggaggcgaacaaccuggacaagaacaugacgaaggccgagagcgcccgccucuuccggaugugguacuccuucgaccacaaguaccugaagcccauccugacccacagcggcccgccccucaccaccacgcugcccgaguggugcgggcccaucucccggcugcucaccagcccgcaggccuacggcgagcagcugaaggaggacgacguggagugcaucgugaaccaggacgagcuggccaucaacuaccaggagcaggcguccagccccugcuccccgcccgcccgccucgggcuggaccagaaggccagcccccagacccccggcaaggagaacaucuacgagggggaccugggccucggcggguacgagcugaagcuggagcagacccucggccagucccagcugaacuga

SEQ ID NO: 36733 - RNA, 1428 nt, Artificial Sequence
  derived and/or modified sequence opt1 from SLC9B1__Homo_sapiens__NP_001094344
augcacaccaccgagagcaagaacgagcaccuggaggacgagaacuuccagacguccaccacgccccagagccucaucgacccgaacaacaccgcccacgaggagaccaagaccgugcuguccgacaccgaggagaucaagccccagaccaagaaggagacguacaucagcugcccccugcgcggcguccucaacgugaucaucaccaacggggugauccuguucgucaucuggugcaugaccugguccauccugggcagcgaggcccuccccgggggcaaccuguucgggcuguucaucaucuucuacuccgcgaucaucggcggcaagauccuccagcugauccggaucccgcuggugccgccccucccgccccugcuggggaugcuccuggccggcuucaccauccgcaacgugcccuucaucaacgagcacguccacgugcccaacacguggagcuccauccugcggagcaucgcccucaccaucauccugauccgcgccgggcugggccucgacccccaggcccugcggcaccugaagguggucugcuuccgccucgcgguggggcccugccugauggaggccuccgccgccgcgguguucagccacuucaucaugaaguuccccuggcagugggccuuccugcucggcuucguccugggcgccgugucccccgccguggucgugcccuacaugauggugcugcaggagaacggguacggcgucgaggaggggaucccgacccuccugauggccgcgagcuccauggacgacauccuggccaucaccggcuucaacacgugccucagcaucguguucuccagcggcgggauccugaacaacgccaucgccuccauccggaacgugugcaucagccugcucgccggcaucguccugggguucuucgugcgcuacuuccccagcgaggaccagaagaagcugacccucaagcggggcuuccuggugcugaccaugugcgucuccgcggugcucgggagccagcgcaucggccugcacggcuccgggggccugugcacccucguccugagcuucaucgccgggacgaaguggucccaggagaagaugaaggugcagaagaucaucaccaccgugugggacaucuuccagccccuccuguucggccuggucggggccgaggugagcguguccagccuggaguccaacaucgucggcaucagcguggccacccugucccucgcccugugcgugcggauccugacgaccuaccuccugaugugcuucgcgggcuucagcuucaaggagaagaucuucaucgcccuggccuggaugcccaaggccaccguccagaucaaccaggccauccuccugcuguuccuccugcgcgaggaguggaccaacugcaagguggcgaagaagugcgaguacacgaaggagcggcaguga

SEQ ID NO: 36734 - RNA, 1254 nt, Artificial Sequence
  derived and/or modified sequence opt1 from SLC9B2__Homo_sapiens__NP_001287685
augggcgacgaggacaagcgcaucaccuacgaggacagcgagcccuccaccgggaugaacuacacgccgagcaugcaccaggaggcccaggaggagaccgugaugaagcugaagggcaucgacgccaacgagcccaccgagggguccauccuccucaagagcuccgagaagaagcugcaggagacccccacggaggcgaaccacguccagcggcugcgccagaugcuggccugcccgccccacggccugcucgaccgggugaucaccaacgggaugcugcuggccggcuuccucauccgcaacauccccgugaucaacgacaacguccagaucaagcacaaguggagcuccagccugcgguccaucgcccugagcaucauccucgugcgcgccggccuggggcuggacuccaaggcgcucaagaagcugaagggcgugugcguccggcugagcauggggcccugcaucguggaggccugcaccuccgcccuccuggcccacuaccugcucggccugcccuggcaguggggguucauccugggcuucgugcucggcgcggucagcccggccguggugguccccuccaugcugcugcuccagggcggcggguacgggguggagaagggcgugcccacccugcugauggccgccgggagcuucgacgacauccucgccaucacgggcuucaacacgugccuggggaucgcguucuccaccggcagcaccgucuucaacgugcugcgcggggugcucgaggucgugaucggcguggccaccggcuccguccugggguucuucauccaguacuuccccagccgggaccaggacaagcuggugugcaagcgcaccuuccucgugcugggccugagcguccucgccguguucuccagcguccacuucggguucccgggcuccgggggccugugcacccuggugauggccuuccucgccggcaugggguggaccagcgagaaggcggagguggagaagaucaucgccgucgccugggacaucuuccagccccugcuguucggccucaucggggccgagguguccaucgccagccugcggcccgagacggugggcugcaaccgcaucugcggguucggccacuccaaggucaccuggcgggagaccauccgccggcuguggaacggcugcguggacagcgggaucuucgugcacccccaccacuccccgaacuggaaguccgcguacugguucaccggcccccaggccagcgccgagagcuga

SEQ ID NO: 36735 - RNA, 3534 nt, Artificial Sequence
  derived and/or modified sequence opt1 from SLC9C1__Homo_sapiens__NP_898884
auggccggcaucuucaaggaguucuucuucagcaccgaggaccugcccgaggugauccucacccugucccugaucagcuccaucggggccuuccucaaccgccaccuggaggacuucccgauccccguccccgugauccuguuccuccugggcugcagcuucgaggugcuguccuucacgagcucccagguccagcgguacgcgaacgccauccaguggaugagccccgaccucuucuuccgcaucuucaccccggugguguucuucaccaccgccuucgacauggacacguacaugcugcagaagcuguucuggcagauccuccugaucuccauccccggguuccuggucaacuacauccucgugcuguggcaccuggccagcgugaaccagcuccugcugaagcccacccaguggcuccuguucuccgccauccuggucagcuccgaccccaugcucaccgcggccgccauccgggaccugggccugagccgcucccucaucagccugaucaacggggagucccugaugaccagcgugaucucccucaucacguucaccagcaucauggacuucgaccagcggcugcagagcaagcgcaaccacacccuggccgaggagaucgugggcggcaucugcuccuacaucaucgcgagcuuccucuucgggauccuguccagcaagcugauccaguucuggauguccaccgucuucggcgacgacgugaaccacaucagccucaucuucuccauccuguaccugaucuucuacaucugcgagcucguggggaugagcggcaucuucacgcuggccaucgucgggcugcuccugaacuccaccagcuucaaggccgccaucgaggagacccugcuccuggaguucuggaccuuccugucccggaucgccuuccucaugguguucacguucuucggccugcugaucccggcgcacaccuaccuguacaucgaguucguggacaucuacuacagccucaacaucuaccugacccugaucguccuccgcuuccugacccugcuccugaucucccccgugcugagccgggugggccacgaguucuccuggcgcuggaucuucaucauggucugcagcgagaugaaggggaugcccaacaucaacauggcccuccugcuggccuacuccgaccucuacuucggcagcgacaaggagaagucccagauccuguuccacggggugcuggugugccucaucacgcuggucgugaaccgguucauccugcccgucgccgugaccauccucggccugcgcgacgccaccagcaccaaguacaagagcgugugcugcacguuccagcacuuccaggagcugaccaaguccgcggccagcgcccucaaguucgacaaggaccuggccaacgccgacuggaacaugaucgagaaggcgaucacccuggagaacccguacaugcucaacgaggaggagaccacggagcaccagaaggucaagugcccccacugcaacaaggagaucgacgagaucuucaacaccgaggccauggagcuggccaaccggcgccugcucuccgcccagaucgccagcuaccagcggcaguaccgcaacgagauccugucccagagcgcgguccaggugcuggugggcgccgccgaguccuucggggagaagaagggcaagugcaugagccucgacaccaucaagaacuacuccgagagccagaagaccgugacguucgcccggaagcugcugcucaacuggguguacaacacccgcaaggagaaggaggggcccuccaaguacuucuucuuccggaucugccacaccaucgucuucaccgaggaguucgagcacgugggcuaccuggugauccugaugaacaucuuccccuucaucaucagcuggaucucccagcucaacgucaucuaccacagcgagcugaagcacacgaacuacugcuuccugacccucuacauccuggaggcgcugcucaagaucgccgccaugcgcaaggacuucuucucccacgccuggaacaucuucgagcuggccaucacccugaucgggauccuccacgugauccugaucgagaucgacaccaucaaguacaucuucaacgagaccgaggugaucgucuucaucaagguggugcaguucuuccggauccugcgcaucuucaagcucaucgcgccgaagcugcugcagaucaucgacaagcgcaugagccaccagaagacguucugguacggcauccucaagggcuacguccagggggaggccgacaucaugaccaucaucgaccagaucaccuccagcaagcagaucaagcagaugcugcugaagcaggucauccggaacauggagcacgccaucaaggagcucggcuaccuggaguacgaccaccccgagaucgccgugaccgugaagacgaaggaggagaucaacgugaugcugaacauggccaccgagauccucaaggcguucgggcugaagggcaucaucagcaagaccgagggggccggcaucaacaagcugaucauggccaagaagaaggaggugcucgacucccagagcaucauccgcccccugaccgucgaggaggugcuguaccacauccccuggcucgacaagaacaaggacuacaucaacuucauccaggagaaggccaagguggucacguucgacugcggcaacgacaucuucgaggagggggacgagccgaagggcaucuacaucaucaucuccgggauggugaagcuggagaaguccaagcccggccuggggaucgaccagaugguggagagcaaggagaaggacuuccccaucaucgacaccgacuacaugcucagcggcgagaucaucggcgagaucaacugccugaccaacgagcccaugaaguacuccgcgaccugcaagacggucguggagaccugcuucaucccgaagacccaccuguacgacgccuucgagcagugcagcccccucaucaagcagaagauguggcugaagcuggggcucgccaucaccgcccggaagauccgcgagcaccuguccuacgaggacuggaacuacaacaugcagcugaagcucagcaacaucuacguggucgacauccccauguccacgaagaccgacaucuacgacgagaaccugaucuacgugauccugauccacggcgccguggaggacugccuccugcggaagaccuaccgcgcgcccuuccugaucccgaucacgugccaccagauccagagcaucgaggacuucaccaaggucgugaucauccagacccccaucaacaugaagaccuuccggcgcaacauccggaaguucgugcccaagcacaaguccuaccucaccccggggcugaucggcagcgucggcacgcuggaggaggggauccaggaggagcgcaacgugaaggaggacggcgcccacuccgccgccaccgcccggagcccccagcccugcucccuccuggggaccaaguucaacugcaaggagagcccccgcaucaaccugcggaaggugcgcaaggaguga

SEQ ID NO: 36736 - RNA, 3375 nt, Artificial Sequence
  derived and/or modified sequence opt1 from SLC9C2__Homo_sapiens__NP_848622
augagcuccuacuucugggcccagaacgagagcaaccgccccgaccugcucugcggccagccggccgacuaccugguggaggagaagcacuucaccacccuggucugcuucaucguggugcucgggggccugcugaagaugugccucaagaacugcgaggucaucgugcugacgauccugucccucagcggguucgugaucggccacauggcguacaacuccgucgaggugcaccagaucguguacccccugcugcggaccagcuccuucagccucuacuccuacuucagcccccugaucaucuucauggucgcccuggacguggaguucuacacccucaagaagauguucuggcagguccugcugaccgggcucaucuccuucagcacggccuccaucaucaucggcuacguggugaucaaguucaacaaggacagcugggaccugcaguccugccuccuguucagcaucacccugggcaucaucgacccccugcgcuccgugaacagccucaagaccaucgggaucuccaagaucuacaucgaccugauccggggcgagagccugaucaucugcagcaucgccuccaucuucuucgggaacuuccgcggcaaccggauccacuucagcaucuuccgcgaccuccacgucgggaucgagcuguccuacgacauccugggcagcaucaucuucggcuacuggugcgccaagaucauccagugcauccucgcggacguguucuccaacaugcugaccaacaucauccugugcuucagcaugguguacaugacguucuacaucgucgaguuccucgggauguccggcacccuggcccuggccgccguggggcucaaccuggacagccugaccuucaagccgaagaucgagcucgugaucaccaaguuccugcggaucuucuccagcgucuacgagcaccugaucuacgcguucuucggcaucgugaucggcugcggggagcucucccacuacgaguuccacacgauccccuucaucuucauccuguucaccaccgugaaccugguccgccuccugaccauccugcucgugagccccauccugaugcacuccaacuacgaguacaacuggcgguggggcgucgugaucacguggagcgggaucaagggcguguucaaccugcugugggcccccgacgucuacaaccucgccgagcgcaagguggaggugccgcagauguucauccuguacguccaggugaucucccugcucaccauggggaucaacagcuacgugaugacccaguccgcccggaagcuggaccugugcguccucagccugccccgccagaugauccugcagaacgccacccagcacauccaggagaucgugcagaacacgaucacccucuucaagaccgagaagauccugaccaacgugaacuggacgcuggucgaggacaagacccggaucgaguacauccccuucucccacgugagccacaacgacaugaagaccgagagcaccacggacgaggcgcucauggaggaggcccgccugcacguggccgccauccagauguccagcuucgagaagcagcggaacaacggcauccuggagaucgaggccgcgcgcauccucaucggcgccgccaagugcuacuacuccauccaggggaaguucaugagcaucuacgacgucuccaccuacaugcggacccgcagcuggcugaucaaguucaagaacgugcugaccuuccucgaguacugcaucgagaagauccacuucaucccgccggaguccaacacguuccugaccuucaucuuccacaucguguucagcgaggaguucgaguacaccggccagaucaucaaccugaucuacaucuaccccaugaucauccaccucuggcccauggcccgggggcugaacgucuccgcccugaucagcaucaacuacuacuucauguuccucuacgugcuggaguccacccugaagaucaucauccucaagcgcaaguacuuccagcagugcuggaacacgcuggaguucuucauccuggugaucggcaucaucgacaucuucugcgucuacuucgugaagcuccggcccgacaaccuggcgcugauccagcucaccgugaucaugggguaccugcgcaucauccgcuuccugccccucuucaagaucaucguccccauccugauccggaucgccgacgugcagaucaagaagcgccugagccucauguacuccaucaccaagggcuacaucaagagccaggaggacgccaagcugcugaucaagcagaucgccgugugcgaguccaucuaccagaagcucugcgagauccuggagaccaacaagcaggacgccgucaaggagcuggugcucauggagcacgagggccgggacguggucaucgcgcugaagaccaagcaggccauccgcaacgugaucgccaaggcccugaagaaccucacguuccugugcagccgggggaucaucgacaagcacgaggugaucgagaucaacaagguccugcucaagaagcugaaggcgcugaacaacuuccccaaggccaucccgccgcccacccccgacaucuaccuccacaacaucaucuggcuggagggcaaggacgugcugaucgacuucuucaaggagcgcgccaagcucgccugcuucgacuccggggacaccaucugcaagggcggggagaugccccagggcaucuaccugaucaucagcggcauggccauccugcacagccucucccccaccuucgggaucgagagcaaccagcggugcgaccgcggcucccgggacauguucacggaguucugcaccaccggggacaucaucggcgagcugagcugccugcucaagcgcgagaucgaguacaccgugaucugcgagacgucccugcaggcgugcuucaucagccuggaggaccucuacgagggcuucgacgccuucuggcccucccuggaguacaagaucuggcugaagcucgcccugagcaccgccuaccaguacuucgaguccagccugaucgacgaggaccuccgguuccagaacugcgucauguucaaccaggccuacguggagacccuguccagcuacuccgacaugaucaucgacaacaugaccaugaaguucgugaucaucgucuacgggagcgugaucgacacgaagaccgaggagcccuacuucgcgcccugcaucaucccgacgaccugcgagcagguccagggcaccuccgaccugagcaagcuccugaucauccaggccuccgagcugacccagcgcaacagcaacaccaacgugauggccuccgugaacaccguguucgagcagcccgggaagaacaucaacggccggcagaagaugagcuga

SEQ ID NO: 36737 - RNA, 2013 nt, Artificial Sequence
  derived and/or modified sequence opt1 from SLCO1A2__Homo_sapiens__NP_602307
augggcgagaccgagaagcgcaucgagacccaccggauccgcugccugagcaagcucaagauguuccugcuggccaucacgugcgccuucgugagcaagacccucagcggguccuacaugaacagcaugcugacccagaucgagcggcaguucaacauccccaccucccuggucggcuucaucaacgggagcuucgagaucggcaaccuccugcugaucaucuucguguccuacuucgggacgaagcuccaccgcccgaucaugaucggcaucggcugcguggucauggggcugggcugcuuccucaagagccucccccacuuccugaugaaccaguacgaguacgaguccaccgugagcguguccgggaaccugagcuccaacagcuuccucugcauggagaacggcacccagauccugcggcccacccaggaccccuccgagugcacgaaggaggucaagagccugauguggguguacgugcucgucgggaacaucgugcgcggcaugggcgagaccccgauccugccccuggggaucuccuacaucgaggacuucgcgaaguucgagaacagcccccucuacaucggccugguggagaccggggccaucaucggcccccugaucggccuccugcuggccuccuucugcgccaacgucuacguggacaccggguucgugaacacggacgaccucaucaucaccccgaccgacacccggugggucggcgccuggugguucggguuccugaucugcgcgggcgugaacgugcugacggccauccccuucuucuuccuccccaacacccugcccaaggaggggcuggagaccaacgccgacaucaucaagaacgagaacgaggacaagcagaaggaggaggucaagaaggagaaguacggcaucaccaaggacuuccucccguucaugaagucccugagcugcaaccccaucuacaugcuguucauccucgugagcgugauccaguucaacgccuucgucaacaugaucagcuucaugcccaaguaccuggagcagcaguacggcaucuccagcuccgacgcgaucuuccugauggggaucuacaaccugcccccgaucugcaucggcuacaucaucgggggccugaucaugaagaaguucaagaucacggugaagcaggccgcccacaucgggugcuggcugagccuccuggaguaccugcucuacuuccuguccuuccugaugaccugcgagaacagcuccguggucggcaucaacaccagcuacgagggcaucccccaggaccucuacguggagaacgacaucuucgccgacugcaacgucgacugcaacugccccuccaagaucugggaccccgugugcgggaacaacggccugagcuaccuguccgccugccuggcggggugcgagaccagcaucggcacggggaucaacaugguguuccagaacugcuccugcauccagaccagcggcaacuccagcgccguccucggccugugcgacaaggggccggacugcucccugaugcuccaguacuuccugauccugagcgccaugagcuccuucaucuacagccucgccgccauccccggcuacauggugcugcugcgcugcaugaaguccgaggagaagucccucggggugggccugcacaccuucugcacccgggucuucgcgggcauccccgcccccaucuacuucggggcccugauggacagcacgugccuccacuggggcacccugaagugcggggagagcggcgccugccgcaucuacgacuccaccaccuuccgguacaucuaccuggggcucccggccgcgcugcgcggcagcuccuucgugcccgcccugaucauccucauccugcugcggaagugccaccuccccggcgagaacgccagcuccgggacggagcugaucgagaccaaggugaagggcaaggagaacgagugcaaggacaucuaccagaaguccaccguccugaaggacgacgagcucaagaccaagcuguga

SEQ ID NO: 36738 - RNA, 2076 nt, Artificial Sequence
  derived and/or modified sequence opt1 from SLCO1B1__Homo_sapiens__NP_006437
auggaccagaaccagcaccugaacaagaccgccgaggcccagcccagcgagaacaagaagacccgcuacugcaacggccucaagauguuccuggcggcccugucccucagcuucaucgccaagacgcugggggccaucaucaugaaguccagcaucauccacaucgagcggcgcuucgagaucuccagcucccuggugggcuucaucgacgggagcuucgagaucggcaaccuccuggucaucguguucguguccuacuucgggagcaagcugcaccggccgaagcucaucggcaucggcugcuucaucauggggaucggcgggguccugaccgcccugccccacuucuucaugggcuacuaccgcuacuccaaggagaccaacaucaacagcuccgagaacagcaccuccacgcucagcacgugccugaucaaccagauccugucccucaaccgggcgagccccgagaucguggggaagggcugccugaaggaguccggcagcuacauguggaucuacguguucauggggaacaugcugcgcggcaucggggagacccccaucgucccgcucggccugagcuacaucgacgacuucgccaaggagggccacuccagccuguaccucgggauccugaacgccaucgccaugaucggccccaucaucggguucacccugggcucccucuucagcaagauguacguggacaucggguacguggaccuguccaccauccggaucacccccaccgacagccgcugggucggcgcgugguggcugaacuuccucguguccggccuguucagcaucaucuccagcauccccuucuucuuccugccgcagacccccaacaagccccagaaggagcggaaggccucccucagccugcacgugcuggagacgaacgacgagaaggaccagaccgccaaccucaccaaccaggggaagaacaucaccaagaacgucacgggcuucuuccaguccuucaagagcauccugaccaacccccuguacgugauguucgugcuccugacccugcuccaggucuccagcuacaucggggccuucaccuacguguucaaguacguggagcagcaguacggccagccguccagcaaggccaacauccugcugggggucaucacgauccccaucuucgcguccggcauguuccucggcggguacaucaucaagaaguucaagcugaacaccgugggcaucgccaaguucagcugcuucaccgccgugaugagccuguccuucuaccuccuguacuucuucauccugugcgagaacaagagcgucgccgggcucaccaugacguacgacggcaacaaccccgugaccucccaccgcgacgugccccugagcuacugcaacuccgacugcaacugcgacgagagccagugggagccggucugcgggaacaacggcaucaccuacaucucccccugccuggccggcugcaagagcuccagcgggaacaagaagcccaucguguucuacaacugcuccugccuggaggucaccggccuccagaaccggaacuacagcgcgcaccugggggagugcccccgcgacgacgccugcacgcggaaguucuacuucuucguggccauccaggugcugaaccucuucuucuccgcccugggcggcaccagccacgucaugcugaucgugaagaucgugcagccggagcucaagucccuggcccugggguuccacagcauggucauccgcgcgcucggcgggauccuggcccccaucuacuucggcgcccugaucgacacgaccugcaucaagugguccaccaacaacugcgggacccggggcagcugccgcaccuacaacagcaccuccuucagccggguguaccucggccuguccagcaugcugcgcguguccagccucguccuguacaucauccugaucuacgccaugaagaagaaguaccaggagaaggacaucaacgccuccgagaacgggagcgugauggacgaggcgaaccucgagucccugaacaagaacaagcacuucgugcccagcgccggcgccgacuccgagacgcacugcuga

SEQ ID NO: 36739 - RNA, 2109 nt, Artificial Sequence
  derived and/or modified sequence opt1 from SLCO1B3__Homo_sapiens__NP_062818
auggaccagcaccagcaccugaacaagaccgccgagagcgccuccagcgagaagaagaagacccgccggugcaacggcuucaagauguuccucgcggcccuguccuucagcuacaucgccaaggcccucgggggcaucaucaugaagaucuccaucacgcagaucgagcgccgguucgacaucagcuccagccuggccgggcugaucgacggcuccuucgagaucgggaaccugcucgugaucgucuucgugagcuacuucggcuccaagcugcaccgccccaagcugaucggcaucgggugccuccugaugggcaccgggagcauccugaccucccucccgcacuucuucaugggcuacuaccgguacagcaaggagacccacaucaaccccuccgagaacagcacguccagccuguccacgugccugaucaaccagacccucagcuucaacgggaccagccccgagaucguggagaaggacugcgucaaggaguccggcagccacauguggaucuacguguucaugggcaacaugcugcgcgggaucggcgagacccccaucgugccgcuggggaucuccuacaucgacgacuucgcgaaggagggccacagcucccucuaccugggcagccugaacgccaucgggaugaucggccccgucaucggguucgcccucggcucccuguucgccaagauguacguggacaucggguacguggaccugagcaccauccggaucacccccaaggacucccgcugggucggcgcgugguggcucggcuuccuggugagcgggcuguucuccaucaucagcuccauccccuucuucuuccucccgaagaaccccaacaagccccagaaggagcggaagaucagccugucccugcacgugcucaagaccaacgacgaccgcaaccagacggccaaccugaccaaccagggcaagaacgucaccaagaacgugaccggguucuuccagagccugaaguccauccucacgaacccccuguacgugaucuuccugcuccugacccugcuccaggucagcuccuucaucggcagcuucaccuacguguucaaguacauggagcagcaguacgggcagagcgccucccacgccaacuuccugcugggcaucaucaccaucccgacgguggccaccggcauguuccucgggggcuucaucaucaagaaguucaagcugagccuggucgggaucgcgaaguucuccuuccucaccagcaugaucuccuuccuguuccagcugcucuacuucccccugaucugcgagagcaaguccguggccggccugacccugacguacgacgggaacaacagcguggccucccacgucgacgugccccucagcuacugcaacuccgagugcaacugcgacgagagccagugggagcccgugugcggcaacaacggcaucaccuaccuguccccgugccuggccgggugcaagagcuccagcggcaucaagaagcacaccgucuucuacaacugcuccugcguggaggucaccgggcuccagaaccggaacuacagcgcccaccugggcgagugcccccgcgacaacacgugcacccggaaguucuucaucuacguggcgauccaggugaucaacagccuguucuccgccaccggcgggaccacguucauccuccugaccgucaagaucgugcagcccgagcugaaggcccucgccaugggcuuccagagcauggugauccgcacccucgggggcauccuggcccccaucuacuucggggcgcugaucgacaagaccugcaugaagugguccacgaacagcugcggcgcccagggcgccugccggaucuacaacuccgucuucuucgggcgcguguaccugggccugagcaucgcccuccgguucccggcccuggugcuguacaucgucuucaucuucgcgaugaagaagaaguuccaggggaaggacaccaaggccuccgacaacgagcgcaaggugauggacgaggccaaccucgaguuccugaacaacggcgagcacuucgugcccagcgccgggaccgacuccaagaccugcaaccuggacaugcaggacaacgcggccgccaacuga

SEQ ID NO: 36740 - RNA, 1923 nt, Artificial Sequence
  derived and/or modified sequence opt1 from SLCO1B7__Homo_sapiens__NP_001009562
augaagaucagcaccacccagaucgagcgccgguucgagaucuccagcucccuggugggccucaucgacgggagcuucgagaucggcaaccuguucgucaucguguucguguccuacuucgggagcaagcugcaccgccccaagcucaucggcaucgggugcuuccugaugggcacgggcuccauccugauggcccucccgcacuucuucaugggguacuaccgguacagcaaggagaccaacaucgaccccuccgagaacagcaccuccaaccugcccaacugccugaucaaccagaugcucagccugaaccgcacccccuccgagaucaucgagcggggcugcgucaaggagagcgggucccacauguggaucuacguguucaugggcaacaugcugcgcgggaucggcgagacgccgaucgugccccucggcaucagcuacaucgacgacuucgccaaggaggggcacuccagccuguaccugggcaccgucaacgugauggggaugaccggccucguguucgcguucaugcugggcucccuguucgccaagauguacgucgacaucggguacguggaccucagcaccauccggaucacgcccaaggacagccgcugggugggcgccugguggcugggguuccuggucuccggcaucgugagcaucaucuccagcauccccuucuucuuccucccgcugaaccccaacaagccccagaaggagcggaaggugucccuguuccuccacguccugaagaccaacgacaagcgcaaccagaucgccaaccugaccaaccggcgcaaguacaucaccaagaacgugacgggguucuuccagagccucaaguccauccugaccaacccccuguacgugaucuucgucaucuucacccuccugcacaugagcuccuacaucgccagccugaccuacaucaucaagaugguggagcagcaguacggcugguccgcgagcaagacgaacuuccuccugggcgugcuggcccucccggccgucgccaucgggauguucuccggcggguacaucaucaagaaguucaagcugagccuggugggccucgcgaagcuggccuucugcuccgccaccgugcaccuccugagccagguccuguacuucuuccugaucugcgaguccaagagcguggccgggcucacccugaccuacgacggcaacucccccguccggagccacguggacgugccccugagcuacugcaacuccgagugcaacugcgacgagagccagugggagcccgucugcggcaacaacgggaucacguaccucuccccgugccuggccggcugcaagagcuccagcgggaacaaggagcccaucguguucuacaacugcuccugcguggaggucaucggccugcagaacaagaacuacagcgcgcaccugggggagugcccccgcgacgacgccugcacccggaaguccuacguguacuucgugauccagguccucgacgccuuccugugcgccgugggccugaccagcuacuccgugcucgucauccgcaucgugcagcccgagcugaaggcccuggcgaucggcuuccacagcaugaucaugcggucccucgggggcauccuggugccgaucuacuucggggcccugaucgacaccacgugcaugaaguggagcaccaacuccugcggcgcccgcggcgccugccggaucuacaacagcaccuaccucgggcgcgccuucuucggccugaaggucgcgcugaucuuccccgugcucgugcugcugaccgucuucaucuucguggugcggaagaagucccacgggaaggacacgaagguccucgagaacgagcgccaggugauggacgaggccaaccuggaguuccugaacgacagcgagcacuucgugcccagcgccgaggagcaguga

SEQ ID NO: 36741 - RNA, 1992 nt, Artificial Sequence
  derived and/or modified sequence opt1 from SLCO1C1__Homo_sapiens__NP_001139417
auggacaccagcuccaaggagaacauccagcuguucugcaagaccagcgugcagcccgucggccgcccguccuucaagacggaguaccccagcuccgaggagaagcagcccugcugcggggagcucaagguguuccugugcgcccugagcuucguguacuucgccaaggcgcucgccgagggcuaccugaaguccaccaucacccagaucgagcggcgcuucgacauccccagcucccuggucggggugaucgacggcagcuucgagaucgggaaccuccuggugaucaccuucgucuccuacuucggcgccaagcugcaccggccgaagaucaucggcgccgggugcgugaucaugggcguggggacgcuccugaucgccaugccccaguucuucauggagcaguacaaguacgagcgcuacagccccuccagcaacuccacccugagcaucucccccugccuccuggagagcuccagccagcugccggucagcgugauggagaaguccaagagcaagaucuccaacggcugcgugcagaccgucgcgaucaucgggcccaucuucggcuuccuccugggcagccugugcgccaagcucuacguggacaucggguucgugaaccuggaccacaucaccaucacgcccaaggacccccagugggucggcgccugguggcugggguaccucaucgccggcaucaucucccugcuggcggccgugccguucugguaccuccccaagagccugccccggucccagagccgcgaggacuccaacagcuccagcgagaaguccaaguucaucaucgacgaccacaccgacuaccagacgccccagggcgagaacgccaagaucauggagauggcccgggacuuccugccgagccucaagaaccuguucgggaaccccguguacuuccuguaccucugcaccuccaccguccaguucaacagccuguucggcauggugaccuacaagcccaaguacaucgagcagcaguacgggcaguccagcucccgcgccaacuucgugaucggccugaucaacauccccgcggucgcccucgggaucuucagcggcggcaucgugaugaagaaguuccggaucagcgugugcggggccgccaagcuguaccugggcuccagcgucuucggguaccuccuguuccugucccucuucgcccugggcugcgagaacagcgacguggcggggcugaccgucuccuaccagggcaccaagccggugagcuaccacgagcgcgcccucuucuccgacugcaacagccggugcaagugcuccgagacgaagugggagcccaugugcggcgagaacgggaucaccuacgugagcgccugccuggccggcugccagaccuccaaccgcagcgggaagaacaucaucuucuacaacugcacgugcgucggcaucgccgcguccaagagcgggaacuccagcggcaucgugggccggugccagaaggacaacgggugcccccagauguuccuguacuuccucgugaucuccgucaucaccagcuacacccugagccugggcgggauccccggcuacauccuccugcugcgcugcaucaagccgcagcugaaguccuucgcccucggcaucuacacccuggccauccgggugcuggccgggauccccgcccccguguacuucggcguccucaucgacaccagcugccugaaguggggguucaagcgcugcggcucccgggggagcugccgccuguacgacuccaacguguuccggcacaucuaccucggccugacggugauccugggcaccgucagcauccuccuguccaucgcggugcuguucauccucaagaagaacuacgugagcaagcaccgcuccuucaucaccaagcgggagcgcaccauggucagcacgcgcuuccagaaggagaacuacaccaccuccgaccaccuccugcagcccaacuacuggccggggaaggagacccagcuguga

SEQ ID NO: 36742 - RNA, 1932 nt, Artificial Sequence
  derived and/or modified sequence opt1 from SLCO2A1__Homo_sapiens__NP_005621
augggccugcuccccaagcugggggccagccagggcuccgacaccagcaccucccgcgccgggcggugcgcgcgcagcguguucggcaacaucaaggucuucgugcugugccaggggcuccugcagcugugccagcuccuguacuccgccuacuucaagagcucccugacgaccaucgagaagcgguucggccucagcuccagcuccagcggccugaucuccagccugaacgagaucuccaacgccauccucaucaucuucgugagcuacuucgggucccgcguccaccggccgcgccugaucggcaucgggggccuguuccucgccgccggggcguucauccugacccugccccacuuccucagcgagcccuaccaguacacccuggccuccacgggcaacaacagccggcugcaggccgagcucugccagaagcacuggcaggaccugcccccgagcaagugccacuccaccacccagaacccccagaaggagaccagcuccauguggggccugauggugguggcccagcuccuggcggggaucggcacgguccccauccagcccuucgggaucagcuacguggacgacuucuccgagccgagcaacagcccccuguacaucuccauccucuucgccaucuccguguucggccccgccuucggcuaccugcuggggagcgucaugcuccagaucuucguggacuacggccgcgugaacaccgccgccgucaaccuggugcccggggacccgcgguggaucggcgcgugguggcuggggcuccugaucuccagcgcccugcucgugcugaccuccuuccccuucuucuucuucccccgcgccaugcccaucggcgccaagcgggccccggcgaccgccgacgaggcccgcaagcuggaggaggccaagagccggggcucccucgucgacuucaucaagcgcuuccccugcaucuuccugcggcugcucaugaacagccuguucgugcuggugguccucgcccagugcacguucuccagcgugaucgcggggcuguccaccuuccugaacaaguuccucgagaagcaguacggcaccagcgccgccuacgccaacuuccugaucggggccgugaaccugcccgcggccgcccugggcaugcuguucgggggcauccucaugaagcgcuucgucuucagccugcaggccaucccccggaucgcgaccacgaucaucaccaucuccaugauccucugcgugccgcuguucuucaugggcugcagcacccccaccguggccgaggucuacccgcccuccacgagcuccagcauccacccccagucccccgccugccgccgggacugcagcugccccgacuccaucuuccaccccgugugcggggacaacggcaucgaguaccugagcccgugccacgccgggugcuccaacaucaacaugagcuccgccaccagcaagcagcucaucuaccugaacugcuccugcgucaccggcgggagcgcguccgccaagaccggcagcugccccgugcccugcgcccacuuccugcucccggccaucuuccugaucagcuucgugucccugaucgccugcaucagccacaacccccucuacaugaugguccugcgcguggugaaccaggaggagaaguccuucgcgaucggcguccaguuccugcucaugcggcugcuggccuggcuccccagccccgcccuguacgggcugacgaucgaccacuccugcauccgcuggaacagccucugccugggccgccgcggggccugcgccuacuacgacaacgacgcgcugcgggaccgguaccucggccugcagaugggcuacaaggcccuggggaugcuccugcugugcuucaucuccuggcgcgugaagaagaacaaggaguacaacgugcagaaggccgccggccucaucuga

SEQ ID NO: 36743 - RNA, 2064 nt, Artificial Sequence
  derived and/or modified sequence opt1 from SLCO2B1__Homo_sapiens__NP_001138683
augggcaccgagaacacccccgggggcaaggccagcccggacccccaggacgugcgccccuccgucuuccacaacaucaagcuguucgugcucugccacagccugcugcagcucgcccagcugaugaucuccggguaccugaaguccuccaucagcacgguggagaagcgguucggccucuccagccagaccuccgggcugcuggcgagcuucaacgaggucggcaacaccgcccucaucguguucguguccuacuucggcagccgcguccaccggccccgcaugaucggguacggcgccauccugguggcccuggccgggcuccugaugacccugccgcacuucaucuccgagcccuaccgguacgacaacacgagccccgaggacaugccccaggacuucaaggcgucccucugccugccgaccaccagcgcccccgccuccgcccccagcaacggcaacugcuccagcuacaccgagacgcagcaccugagcguggucgggaucauguucguggcgcagacccuccugggcgugggcgggguccccauccagccguucggcaucuccuacaucgacgacuucgcccacaacagcaacagcccccuguaccucgggauccuguucgccgugaccaugaugggccccggccuggccuucgggcucggcagccugaugcugcgccucuacguggacaucaaccagaugcccgagggcgggaucucccugaccaucaaggacccgcggugggucggggccugguggcugggcuuccucaucgcggccggcgccguggcccuggccgcgauccccuacuucuucuuccccaaggagaugcccaaggagaagcgcgagcugcaguuccggcgcaaggugcucgccgucacggacagcccggcccggaaggggaaggacucccccagcaagcagucccccggcgagagcaccaagaagcaggacgggcuggugcagaucgcccccaaccugaccgugauccaguucaucaaggucuucccgcgcgugcuccugcagacccugcggcaccccaucuuccuccuggugguccugucccaggugugccucagcuccauggccgcgggcauggccacguuccugcccaaguuccuggagcgccaguucagcaucaccgccuccuacgccaaccuccugaucgggugccugagcuuccccuccgucaucgugggcaucguggucggcggggugcucgugaagcggcugcaccugggcccggucgggugcggcgcccugugccuccuggggaugcugcucugccuguucuucagccugccccucuucuucaucggcugcuccagccaccagaucgcgggcaucacccaccagaccagcgcccaccccgggcuggagcuguccccgagcugcauggaggccugcuccugcccccucgacggcuucaaccccgugugcgaccccagcacgcgcguggaguacaucaccccgugccacgccgggugcuccagcugggucgugcaggacgcgcuggacaacucccagguguucuacaccaacugcagcugcgucguggagggcaaccccgugcuggccggcuccugcgacagcacgugcucccaccucgucgugcccuuccugcugcucgugagccugggguccgcccuggccugccucacccacacccccagcuucaugcugauccugcggggcgucaagaaggaggacaagacccucgccguggggauccaguucauguuccugcgcauccuggcguggaugccgucccccgugauccacggcagcgccaucgacaccacgugcguccacugggcccucuccugcgggcggcgcgccgugugccgguacuacaacaacgaccugcugcgcaaccgcuucaucggccuccaguucuucuucaagaccggcagcgugaucugcuucgcccugguccuggcggugcuccggcagcaggacaaggaggcccgcaccaaggagagccgguccagccccgccguggagcagcagcugcuggucuccgggcccggcaagaagccggaggacagccgcguguga

SEQ ID NO: 36744 - RNA, 2079 nt, Artificial Sequence
  derived and/or modified sequence opt1 from SLCO3A1__Homo_sapiens__NP_001138516
augcagggcaagaagcccgggggcagcuccgggggcgggcgcagcggcgagcugcagggcgacgaggcccagcggaacaagaagaagaagaagaagguguccugcuucagcaacaucaagaucuuccucgucuccgagugcgcccugaugcuggcgcaggggaccgugggcgccuaccucgugagcguccugaccacgcuggagcgccgguucaaccuccaguccgccgacgugggggugaucgccagcuccuucgagaucggcaaccuggcccugauccucuucgucagcuacuucggggcgcgcggccaccggccccgccugaucggcugcgggggcaucgugauggcccugggggcccuccuguccgcccugcccgaguuccucacccaccaguacaaguacgaggcgggcgagauccgguggggcgccgaggggcgcgacgugugcgccgccaacggcagcgggggcgacgaggggcccgaccccgaccugaucugccggaaccgcaccgccaccaacaugauguaccugcuccugaucggcgcgcagguccugcucggcaucggggccacgccggugcagccccugggcguguccuacaucgacgaccacguccggcgcaaggacagcucccuguacaucgggauccucuucaccaugcugguguucggccccgccugcggguucauccugggcagcuucugcaccaagaucuacguggacgccgucuucaucgacaccuccaaccucgacaucacgcccgacgacccgcgguggaucggcgccugguggggcggguuccugcugugcggggcgcuccuguucuucagcucccugcucauguucggcuucccccagagccugccgccccacagcgagcccgccauggaguccgagcaggccaugcugagcgagcgcgaguacgagcggcccaagcccuccaacggggugcuccgccacccccuggagccggacagcuccgccagcugcuuccagcagcugcgggugauccccaaggucaccaagcaccuccuguccaaccccguguucacgugcaucauccuggccgcgugcauggagaucgccguggucgccggcuucgccgccuuccucggcaaguaccuggagcagcaguucaaccugaccaccagcuccgcgaaccagcuccuggggaugaccgccauccccugcgccugccugggcaucuuccucgggggccugcuggugaagaagcugagccucuccgcccugggcgcgauccgcauggccaugcuggugaaccucgucagcaccgccugcuacguguccuuccuguuccuggggugcgacaccggcccggucgccggggugacggugcccuacggcaacagcaccgcccccggguccgcgcucgaccccuacagcccgugcaacaacaacugcgagugccagaccgacuccuucacccccgucugcggcgccgacggcaucacguaccugagcgccugcuucgccgggugcaacuccaccaaccugaccggcugcgccugccucaccacggugcccgcggagaacgccaccgugguccccgggaagugcccgagccccggcugccaggaggccuuccugaccuuccugugcgugaugugcaucugcagccucaucggggccauggcccagacccccuccgugaucauccugauccggacggucagcccggagcugaaguccuacgcgcucggcgugcuguuccugcuccugcgccugcucggcuucaucccgccgccccugaucuucggggccggcaucgacagcacgugccuguucugguccaccuucugcggggagcagggcgccugcgugcucuacgacaacgucguguaccgguaccuguacgugagcaucgccaucgcgcugaaguccuucgccuucauccucuacaccaccaccuggcagugccugcgcaagaacuacaagcgcuacaucaagaaccacgagggcgggcugagcaccuccaccgaguaccaggacaucgagacggagaagaccugccccgagagccacucccccagcgaggacuccuucguccggagcuga

SEQ ID NO: 36745 - RNA, 2169 nt, Artificial Sequence
  derived and/or modified sequence opt1 from SLCO4A1__Homo_sapiens__NP_057438
augccccugcaccagcucggcgacaagccgcugaccuuccccagccccaacuccgccauggagaacgggcuggaccacaccccgcccagccgccgggccucccccggcacgccccucagccccgggucccugcgcagcgcggcccacuccccgcuggacaccagcaagcagccccucugccagcugugggccgagaagcacggcgcccgggggacccacgaggugcgcuacgucuccgccggccagagcguggcgugcggcuggugggccuucgccccgcccugccuccaggugcugaacacccccaaggggauccuguucuuccugugcgccgcggccuuccuccagggcaugacggucaacggguucaucaacaccgugaucaccucccuggagcggcgcuacgaccugcacagcuaccaguccggccucaucgccagcuccuacgacaucgccgccugccugugccugaccuucgugagcuacuucgggggcuccggccacaagccccgguggcucggguggggcguccugcugauggggacgggcagccucguguucgcgcugccccacuucaccgccggccgcuacgagguggagcuggacgccgggguccggaccugccccgccaacccgggcgccgugugcgcggacuccaccagcgggcucagccgcuaccagcugguguucaugcugggccaguuccuccacggggucggcgccacgccccuguacacccugggcgugaccuaccucgacgagaacgugaaguccagcugcucccccgucuacaucgccaucuucuacaccgccgccauccuggggcccgcggccggcuaccugaucgggggcgcccuccugaacaucuacacggagauggggcggcgcaccgagcugaccaccgagagcccgcucugggugggcgccuggugggugggcuuccugggguccggcgccgcggccuucuucacggccguccccauccugggguacccccggcagcuccccggcagccagcgcuacgccgugaugcgggcggccgagaugcaccagcugaaggacuccagccgcggggaggccuccaacccggacuucggcaagaccauccgggaccugccccucagcaucuggcugcugcucaagaaccccaccuucauccugcugugccucgccggcgccaccgaggcgacgcugaucaccgggauguccaccuucagccccaaguuccuggagucccaguucagccuguccgccagcgaggccgccacccucuucggcuaccugguggucccggccgggggcggcgggacguuccugggcggguucuucgugaacaagcuccgccugcggggcuccgcggugaucaaguucugccuguucugcaccgucgugagccuccuggggauccuggucuucucccuccacugccccagcgugcccauggccggcgugaccgccagcuacggcgggucccugcugccggagggccaccucaaccugaccgcccccugcaacgccgcgugcagcugccagcccgagcacuacucccccgucugcgggagcgacggccugauguacuucucccucugccacgccgggugcccggccgccacggagaccaacguggacggccagaagguguaccgcgacugcagcugcaucccccagaaccuguccagcggcuucgggcacgcgaccgccggcaagugcaccuccacgugccagcggaagccccugcuccuggucuucaucuucguggugaucuucuucaccuuccugagcuccauccccgcccucaccgccacccugcgcugcguccgcgacccgcagcggagcuucgcccuggggauccaguggaucguggugcgcauccucggcgggauccccggccccaucgcguucggcugggucaucgacaaggccugccugcuguggcaggaccagugcgggcagcagggcuccugccucguguaccagaacagcgccaugucccgguacauccugaucauggggcugcucuacaaggugcugggcguccuguucuucgccaucgccugcuuccucuacaagccccugagcgaguccagcgacgggcuggagaccugccucccgagccaguccagcgcgcccgacuccgccacggacagccagcugcaguccagcguguga

SEQ ID NO: 36746 - RNA, 2175 nt, Artificial Sequence
  derived and/or modified sequence opt1 from SLCO4C1__Homo_sapiens__NP_851322
augaaguccgccaagggcaucgagaaccuggccuucgugcccagcagccccgacauccuccgccggcuguccgcgagccccucccagaucgaggucagcgcccuguccagcgacccccagcgcgagaacucccagccccaggagcuccagaagccgcaggagccccagaagucccccgagcccagccugccgagcgccccgcccaacguguccgaggagaagcugcggagccucucccugagcgaguucgaggagggguccuacggcuggcgcaacuuccacccccagugccugcagcggugcaacacccccgggggcuuccuccugcacuacugccugcucgccgugacccaggggaucgucgugaacggccuggugaacaucagcaucuccacggucgagaagcgcuacgagaugaaguccagccugaccggccucaucagcagcuccuacgacaucagcuucugccugcugucccucuucgugagcuucuucggggagcggggccacaagccccgcuggcuggccuucgcggccuucaugaucgggcugggcgcccucguguucucccugccccaguucuucagcggggaguacaagcugggcucccucuucgaggacacgugcgucaccacccggaacagcaccuccugcaccagcuccaccagcucccugagcaacuaccuguacguguucauccucggccagcugcugcucggggccggcgggacgccccuguacacccugggcaccgcguuccucgacgacuccgugccgacccacaagagcucccuguacaucggcacgggguacgccaugagcauccugggccccgccaucggguacguccucggcgggcagcugcugaccaucuacaucgacguggccaugggcgagagcaccgacgugaccgaggacgacccccgcuggcucggcgccugguggaucggguuccugcuguccuggaucuucgcguggagccucaucauccccuucuccugcuucccgaagcaccuccccggcacggccgagauccaggccgggaagaccagccaggcccaccaguccaacagcaacgccgacgucaaguucggcaaguccaucaaggacuuccccgcggcccugaagaaccugaugaagaacgccguguucaugugccuggugcugagcaccuccagcgaggcccucaucaccacgggguucgccaccuuccugcccaaguucaucgagaaccaguucggccugaccuccagcuucgcggccacccugggcggggccguccucaucccgggcgccgcccuggggcagauccugggcggguuccucguguccaaguuccggaugacgugcaagaacaccaugaaguucgcgcuguucaccagcggcguggcccugacccucuccuucgucuucauguacgccaagugcgagaacgagcccuucgccggcgugagcgaguccuacaacgggacgggcgagcuggggaaccugaucgcgcccugcaacgccaacugcaacugcagccgcagcuacuacuaccccgugugcggcgacggcguccaguacuucuccccgugcuucgccgggugcagcaaccccguggcccaccggaagcccaaggucuacuacaacugcuccugcaucgagcgcaagaccgagaucaccagcaccgccgagacguucggcuucgaggcgaaggccgggaagugcgagacccacugcgccaagcucccgaucuuccugugcaucuucuucaucgugaucaucuucaccuucauggccggcacccccaucacgguguccauccugcggugcgucaaccaccgccagcggagccucgcccuggggauccaguucauggugcugcgccuccugggcaccauccccggccccaucaucuucggguucaccaucgacuccacgugcauccugugggacaucaacgacugcggcaucaagggggcgugcuggaucuacgacaacaucaagauggcccacaugcucguggccaucagcgugaccugcaaggucaucaccauguucuucaacggcuucgccaucuuccuguacaagccgccgcccuccgccaccgacgugagcuuccacaaggagaacgcggucgugaccaacgugcuggccgagcaggaccucaacaagaucgucaaggagggguga

SEQ ID NO: 36747 - RNA, 2064 nt, Artificial Sequence
  derived and/or modified sequence opt1 from SLCO5A1__Homo_sapiens__NP_001139480
auggacgagggcaccgggcugcagcccggcgccggggagcagcucgaggccccggcgaccgccgaggccgugcaggagcgcugcgagcccgagacgcugcggagcaagucccugcccguccucagcuccgccagcugccgccccucccugagcccgaccuccggcgacgccaaccccgcguucgggugcguggacagcuccggccaccaggagcugaagcagggccccaacccccucgccccgagccccuccgcccccagcaccuccgccgggcugggcgacugcaaccaccggguggaccugagcaagaccuucuccgucagcuccgcgcucgccaugcugcaggagcgccggugccuguacguggugcucacggacagccgcugcuuccuggucugcaugugcuuccugaccuucauccaggcccucaugguguccggguaccugagcagcgugaucaccaccaucgagcggcgcuacucccucaagagcuccgagagcggccuccuggucuccugcuucgacaucgggaaccuggugguggucguguucgugagcuacuucggcggccgggggcgccggccccucuggcuggccgucggcgggcugcucaucgccuucggcgcggcccuguucgcccugccgcacuucaucuccccgcccuaccagauccaggagcucaacgccagcgcccccaacgacggccugugccagggcgggaacuccacggcgacccuggagccgcccgccugccccaaggacagcgggggcaacaaccacuggguguacguggcccucuucaucugcgcccagauccugaucgggaugggcuccacccccaucuacacccugggccccacguaccucgacgacaacgucaagaaggagaacagcucccuguaccuggccaucauguacgugaugggggcgcucggccccgccgugggguaccugcugggcgggcuccugaucggcuucuacgucgacccccgcaaccccgugcaccuggaccagaacgacccgcgguucaucggcaacugguggagcggguuccuccugugcgccaucgccauguuccuggugaucuuccccauguucaccuuccccaagaagcugcccccgcgccacaagaagaagaagaagaagaaguucuccgucgacgccgugagcgacgacgacguccugaaggagaaguccaacaacagcgagcaggcggacaagaagguguccagcaugggcuucgggaaggacgugcgggaccugccccgcgccgccguccggauccucagcaacaugaccuuccuguucgugucccugagcuacaccgccgaguccgcgaucgugacggccuucaucaccuucauccccaaguucaucgagagccaguucggcaucccggccuccaacgccagcaucuacaccggggucaucaucgugcccuccgccggcgugggcaucguccucgggggcuacaucaucaagaagcugaagcugggggcgcgcgagagcgccaagcuggccaugaucugcuccggcgugagccuccugugcuucuccacccuguucaucgugggcugcgagagcaucaaccucgggggcaucaacauccccuacacgaccgggcccucccugaccaugccgcaccggaaccugaccggcagcugcaacgucaacugcgggugcaagauccacgaguacgagcccgugugcggcuccgacggcaucacguacuucaaccccugccucgccgggugcgugaacagcggcaaccuguccaccgggauccgcaacuacaccgagugcacgugcguccagagccgccaggugaucacgcccccgaccgugggccagcggagccagcugcgcgucgugaucgugaagaccuaccucaacgagaacggguacgccgucuccggcaagugcaagcggaccugcaacacccugauccccuuccugguguuccucuucaucgugaccuucaucaccgcgugcgcccagcccagcgccaucaucgucacccuguccauccacagcuacuccaaccugcucuggagcucccacuga

SEQ ID NO: 36748 - RNA, 2160 nt, Artificial Sequence
  derived and/or modified sequence opt1 from SLCO6A1__Homo_sapiens__NP_001275931
auguucgugggcgucgcccgccacagcgggucccaggacgaggugagccggggcguggagccccuggaggccgcgcgcgcccagccggccaaggaccggcgcgccaaggggacccccaaguccagcaagcccggcaagaagcaccgguaccuccgccugcugcccgaggcccucauccgguucgggggcuuccgcaagcggaagaaggcgaaguccagcgucuccaagaagccgggcgagguggacgacagccuggagcagcccugcgggcugggcugccucguguccacgugcugcgagugcugcaacaacauccgcugcuucaugaucuucuacugcauccugcugaucugccagggggucguguucggccucaucgacgugagcaucggggacuuccagaaggaguaccagcugaagaccaucgagaagcuggcccucgagaaguccuacgacaucagcuccggccuggucgccaucuucaucgccuucuacggcgaccggaagaaggugaucugguucguggcgagcuccuuccugaucgggcucggcagccugcugugcgccuuccccuccaucaacgaggagaacaagcagagcaaggucgggaucgaggacaucugcgaggagaucaaggugguguccggcugccagagcagcggcaucuccuuccagagcaaguaccucuccuucuucauccuggggcagaccguccagggcaucgccgggaugccccuguacauccucggcaucaccuucaucgacgagaacguggccacccacagcgccgggaucuaccugggcaucgcggagugcacguccaugaucggcuacgcccugggguacgugcucggcgccccgcuggucaaggugcccgagaacaccaccagcgccaccaacacgaccgugaacaacgggucccccgaguggcuguggaccugguggaucaacuuccucuucgccgcggucguggccuggugcacccugaucccccugagcugcuucccgaacaacaugcccggcuccacgcgcaucaaggcccggaagcgcaagcagcuccacuucuucgacagccggcugaaggaccugaagcucgggaccaacaucaaggaccugugcgccgcccuguggauccucaugaagaaccccgugcugaucugccuggcgcucuccaaggccaccgaguaccuggucaucaucggcgccagcgaguuccugcccaucuaccucgagaaccaguucauccugaccccgacgguggccaccacccuggccggccucguccugauccccgggggcgcgcuggggcagcuccugggcggggugaucguguccacccuggagaugagcugcaaggcccugaugcgcuucaucauggucacguccgugaucagccucauccugcugguguucaucaucuucguccggugcaaccccgugcaguucgccggcaucaacgaggacuacgacggcaccgggaagcucggcaaccugaccgcccccugcaacgagaagugccgcugcuccagcuccaucuacagcagcaucugcgggcgggacgacaucgaguacuucuccccgugcuucgcgggcugcaccuacagcaaggcccagaaccagaagaagauguacuacaacugcuccugcaucaaggagggccugaucacggccgacgccgagggggacuucaucgacgcccgccccggcaagugcgacgcgaagugcuacaagcucccccuguucaucgccuucaucuucagcacccugaucuucuccggguucagcggcgugcccaucguccucgccaugacccggguggugccggacaagcugcgcucccuggcccucggggucagcuacgugauccugcgcaucuucggcaccauccccggccccuccaucuucaagaugagcggggagacguccugcauccugcgggacgugaacaagugcggccacaccgggcgcugcuggaucuacaacaagaccaagauggccuuccuccuggucggcaucugcuuccugugcaagcucugcaccaucaucuucacgaccaucgcguucuucaucuacaagcggcgccugaacgagaacaccgacuuccccgacgugaccgugaagaacccgaaggucaagaagaaggaggagacggaccuguga

SEQ ID NO: 36749 - RNA, 1737 nt, Artificial Sequence
  derived and/or modified sequence opt1 from SLFN12__Homo_sapiens__NP_001275938
augaacaucagcguggaccuggagaccaacuacgccgagcucguccuggacgugggccgcgugacccugggggagaacucccggaagaagaugaaggacugcaagcuccgcaagaagcagaacgagagcgucucccgggccaugugcgcgcugcugaacagcggcgggggcgugaucaaggccgagaucgagaacgaggacuacuccuacacgaaggacgggaucggccucgaccuggagaacagcuucuccaacauccuccuguucgugcccgaguaccuggacuucaugcagaacggcaacuacuuccugaucuucgucaagagcuggucccucaacaccagcgggcugcgcaucaccacccuguccagcaaccucuacaagcgggacaucacguccgccaaggugaugaacgccaccgccgcgcuggaguuccugaaggacaugaagaagacccgcggccggcucuaccugcgcccggagcugcucgccaagcggcccugcguggacauccaggaggagaacaacaugaaggcccuggccggggucuucuucgaccgcaccgagcuggaccggaaggagaagcucacguucaccgagagcacccacguggagaucaagaacuucuccaccgagaagcugcugcagcgcaucaaggagauccucccccaguacgugagcgcguucgccaacacggacggcggguaccuguucaucggccugaacgaggacaaggagaucaucggcuucaaggccgagauguccgaccucgacgaccuggagcgggagaucgagaaguccauccgcaagaugcccguccaccacuucugcauggagaagaagaagaucaacuacagcugcaaguuccuggggguguacgacaagggcagccucugcggguacgugugcgcccugcgggucgagcgcuucugcugcgccguguucgcgaaggagccggacagcuggcacgugaaggacaaccgggucaugcagcugacccgcaaggaguggauccaguucaugguggaggccgagcccaaguucuccagcuccuacgaggaggugaucagccagaucaacaccucccuccccgcgccccacagcuggccgcugcuggaguggcagcggcagcgccaccacugccccggccucuccggccggaucaccuacacgcccgagaaccugugccgcaagcuguuccuccagcacgaggggcugaagcagcugaucugcgaggagauggacagcguccgcaagggcucccucaucuucagccgguccuggagcguggaccuggggcugcaggagaaccacaaggugcucugcgacgcccugcugaucucccaggacagcccgcccguccuguacaccuuccacauggugcaggacgaggaguucaagggcuacuccacccagaccgcccucacgcugaagcagaagcuggccaagaucgggggcuacaccaagaaggucugcgugaugaccaagaucuucuaccucagccccgagggcaugaccuccugccaguacgaccugcgcagccaggugaucuaccccgaguccuacuacuucacgcggcgcaaguaccugcucaaggcccuguucaaggcccugaagcggcucaagagccugcgcgaccaguucagcuucgccgagaaccuguaccagaucaucgggaucgacugcuuccagaagaacgacaagaagauguucaaguccugccggcgccucaccuga

SEQ ID NO: 36750 - RNA, 1767 nt, Artificial Sequence
  derived and/or modified sequence opt1 from SLFN12L__Homo_sapiens__XP_011522471
auggaccuggcccgcaaggaguuccuccggggcaacgggcuggccgcgggcaagaugaacaucagcaucgaccuggacaccaacuacgccgagcucgugcugaacgucgggcgcgugacccugggcgagaacaaccggaagaagaugaaggacugccagcuccgcaagcagcagaacgagaacgugucccgggccgucugcgcccugcugaacagcgggggcggcgugaucaaggccgagguggagaacaagggguacuccuacaagaaggacggcaucgggcucgaccuggagaacagcuucuccaacaugcugcccuucgucccgaacuuccucgacuucaugcagaacggcaacuacuuccacaucuucgucaagagcuggucccuggagacgagcgggccccagaucgcgacccuguccagcucccucuacaagcgcgacgugaccagcgccaaggugaugaacgccuccgccgcgcuggaguuccugaaggacauggagaagaccggcggccgggccuaccuccgccccgaguuccccgccaagcgggccugcguggacgugcaggaggagagcaacauggaggcccuggcggccgacuucuucaaccgcacggagcugggguacaaggagaagcucaccuucaccgaguccacccacgucgagaucaagaacuucagcacggagaagcugcugcagcggaucaccgagauccucccgcaguacguguccgccuucgccaacaccgacggcggguaccuguucgugggccugaacgaggacaaggaggucaucggcuucaaggccgagaaguccuaccucaccaagcuggaggaggugacgaagaacagcaucgggaagcugcccgugcaccacuucugcgucgagaagggcaccaucaacuaccucugcaaguuccuggggguguacgacaagggccgccugugcggguacguguacgcgcuccgggucgagcgcuucugcugcgccguguucgccaagaagcccgacagcuggcacgugaaggacaaccgggucaagcagcugaccgagaaggaguggauccaguucaugguggacagcgagcccgucugcgaggagcugccgucccccgccagcaccuccagccccgugucccagagcuacccccuccgcgaguacaucaacuucaagauccagccgcugcgguaccaccuccccggccuguccgagaagaucacgugcgcccccaagaccuucugccgcaaccuguucagccagcacgagggccugaagcagcucaucugcgaggagaugggguccgugaacaagggcagccugaucuucucccggagcuggucccuggaccucgggcugcaggagaaccacaagguccugugcgacgcgcuccugaucagccaggacaagcccccggugcuguacaccuuccacauggugcaggacgaggaguucaaggacuacuccacccagacggcccagacccugaagcagaagcucgccaagaucggcggguacaccaagaaggucugcgugaugaccaagaucuucuaccugagccccgagggcaagacguccugccaguacgaccugaacagccaggugaucuaccccgaguccuacuacuggaccaccgcccagaccaugaaggaccucgagaaggcccugagcaacauccugcccaaggagaaccagaucuuccucuucgucugccuguuccgcuucugccuguucgugugcugguucgugugcuucuuccuccgguga

SEQ ID NO: 36751 - RNA, 2739 nt, Artificial Sequence
  derived and/or modified sequence opt1 from SLFN14__Homo_sapiens__NP_001123292
auggagagccugaagaccgacaccgagaugcccuacccggaggugaucgucgacgugggccgcgugaucuucggggaggagaaccggaagaagaugacgaacuccugccucaagcgcagcgagaacucccggaucauccgcgccaucugcgcccugcugaacagcggcgggggcgucaucaaggcggagaucgacgacaagaccuacuccuaccagugccacgggcucggccaggaccuggagaccagcuuccagaagcugcuccccuccggcagccagaaguaccuggacuacaugcagcaggggcacaaccugcucaucuucgugaaguccuggagccccgacguguucucccugccccugcggaucugcagccuccgcuccaaccuguaccggcgcgacgucaccagcgccaucaaccuguccgccagcuccgcccucgagcugcugcgggagaagggcuuccgcgcccagcgggggcgcccgcgggugaagaagcuccacccccagcagguccugaaccgcugcauccaggaggaggaggacaugcggauccuggcgagcgaguucuucaagaaggacaagcucauguacaaggagaagcugaacuucacggaguccacccacguggaguucaagcgcuucaccaccaagaaggugaucccccggaucaaggagaugcugccccacuacgugagcgccuucgccaacacgcagggcggguacguccucaucggcguggacgacaagagcaaggagguggucggcugcaagugggagaaggugaacccggaccugcugaagaaggagaucgagaacugcaucgagaagcuccccaccuuccacuucugcugcgagaagcccaaggugaacuucaccaccaagauccugaacgucuaccagaaggacgugcuggacggguacgugugcgucauccagguggagcccuucugcugcguggucuucgccgaggcgccggacuccuggaucaugaaggacaacagcgugacgcgccucaccgccgagcagugggucgugaugaugcuggacacccaguccgccccgcccagccuggugaccgacuacaacuccugccucaucagcuccgccagcuccgcccgcaagagccccggcuaccccaucaagguccacaaguucaaggaggcgcugcagcggcaccuguuccccgugacgcaggaggaggugcaguucaagcccgagucccucugcaagaagcuguucagcgaccacaaggagcuggaggggcucaugaagacccugauccaccccugcucccagggcaucgucaucuucagccgguccugggccggcgacgugggguuccgcaaggagcagaacgugcugugcgacgcccuccugaucgccgucaacagcccgguggugcuguacaccauccucaucgaccccaacuggcccggcgggcuggaguacgcccgcaacaccgcgcaccagcugaagcagaagcuccagacggucggcggguacaccggcaaggugugcaucaucccccggcugauccaccuguccagcacccagucccgcccgggcgagaucccccugcgguacccccgcagcuaccggcucgccgacgaggaggagauggaggaccugcugcaggcccucguggucgugagccuguccagccgcucccugcucagcgaccagauggggugcgaguucuucaaccugcugaucauggagcagucccagcuccugagcgagucccugcagaagacccgggagcuguucaucuacugcuuccccggcgugcgcaagacggcccucgccaucaagaucauggagaagaucaaggaccuguuccacugcaagccgaaggagauccucuacgucugcgagagcgacucccugaaggacuucgugacccagcagacgaccugccaggcggugacccggaagaccuucaugcagggggaguuccugaagaucaagcacaucgucauggacgagaccgagaacuucugcagcaaguacggcaacugguacaugaaggccaagaacaucacccaccccaaggccaaggggacgggcuccgagaaccuccaccacggcauccuguggcuguuccucgaccccuuccagauccaccacgccgacgugaacgggcugccgccgcccagcgcccaguucccccgcaagaccaucaccuccggcauccacugcgcgcuggagaucgccaaggugaugaaggaggagaugaagcggaucaaggagaacccgcccagcaacaugucccccgacacccucgcccuguucagcgagacggccuacgaggaggcgaccugcgcccaggcccugcccggggucugcgagaccaagaccaaccucaccacggagcagaucgccaacuacguggcccgcaagugccacucccuguuccagugcggcuaccugcccaaggacaucgcgauccucugccggcgcggggaggaccggggccgcuaccggcuggcccugcucaaggccauggagcugaucgagacccaccgccccagcgagguggucuucagccccgccaccggcgugugggggucccacaucgugcuggacagcauccagcaguucuccggccucgagcggaccgucguguucgggcugagccccgagugcgaccaguccgaggaguuccacaagcugugcuucgccagccgcgcgaucaagcaccucuaccugcuguacgagaagcgcgccgccuacuga

SEQ ID NO: 36752 - RNA, 2676 nt, Artificial Sequence
  derived and/or modified sequence opt1 from SLFN5__Homo_sapiens__NP_659412
augagccugcgcaucgacguggacaccaacuuccccgagugcgucguggacgccggcaaggugacccucgggacgcagcagcggcaggagauggacccccgccugcgggagaagcagaacgagaucauccugcgcgccgucugcgcgcuccugaacuccggcgggggcaucaucaaggccgagaucgagaacaagggguacaacuacgagcggcacggcgugggccuggacgugccgcccaucuuccgcagccaccucgacaagaugcagaaggagaaccacuuccugaucuucgucaaguccuggaacaccgaggccggggugccccuggccacccucugcagcaaccuguaccaccgggagcgcaccuccacggacgugauggacagccaggaggcccuggcguuccucaagugccggacccagacccccaccaacaucaacgucuccaacagccugggcccccaggccgcccagggguccgugcaguacgagggcaacaucaacgugagcgccgcggcccuguucgaccgcaagcggcuccaguaccuggagaagcugaaccuccccgaguccacgcacgucgaguucgugauguucagcaccgacgugucccacugcgucaaggaccgccugcccaagugcgugagcgccuucgccaacaccgagggcggguacguguucuucggcguccacgacgagaccugccaggugaucgggugcgagaaggagaagaucgaccugacgucccuccgggccagcaucgacggcugcaucaagaagcugccggugcaccacuucugcacccagcgccccgagaucaaguacguccugaacuuccucgaggugcacgacaagggggcgcugcggggcuacgugugcgccaucaaggucgagaaguucugcugcgccguguucgccaagguccccuccagcuggcaggucaaggacaaccgcgugcggcagcugcccacccgcgaguggaccgccuggaugauggaggcggacccggaccucucccggugccccgagauggugcugcagcugagccucagcuccgccacgccccgcagcaagcccgugugcauccacaagaacuccgagugccugaaggagcagcagaagcgguacuucccgguguucagcgaccgcgucguguacacccccgagucccuguacaaggagcuguucagccagcacaagggccuccgcgaccugaucaacaccgagaugcggcccuucucccaggggauccucaucuucagccaguccugggccguggaccugggccugcaggagaagcagggggucaucugcgacgcccuccugaucagccagaacaacacccccauccuguacacgaucuucuccaagugggacgccggcugcaagggguacagcaugaucguggcguacucccucaagcagaagcuggugaacaagggcggcuacaccgggcgccugugcaucaccccgcucgucugcgugcugaacagcgaccggaaggcccaguccguguacagcuccuaccugcagaucuaccccgagagcuacaacuucaugacgccccagcacauggaggcccuccugcagucccuggucaucgugcugcucggcuucaagagcuuccugagcgaggagcugggguccgaggugcucaaccugcugaccaacaagcaguacgagcuccugagcaagaaccugcgcaagacccgggagcuguucguccacggccuccccggguccggcaagaccauccuggcccuccgcaucauggagaagauccggaacguguuccacugcgagccggccaacauccuguacaucugcgagaaccagccccugaagaagcucgugagcuucuccaagaagaacaucugccagcccgucacccgcaagacguucaugaagaacaacuucgagcacauccagcacaucaucaucgacgacgcgcagaacuuccggaccgaggacggcgacugguacgggaaggccaaguucaucacccagaccgcccgcgacggccccggggugcuguggaucuuccuggacuacuuccagacguaccaccucagcugcuccggccugccgccgcccagcgaccaguacccccgggaggagaucaaccgcgugguccggaacgccgggcccaucgcgaacuaccugcagcaggucaugcaggaggcccgccagaacccgccgcccaaccucccgcccggcucccuggugaugcuguacgagcccaagugggcccagggcgugcccgggaaccucgagaucaucgaggaccugaaccuggaggagauccucaucuacguggccaacaagugccgguuccugcugcgcaacggcuacagccccaaggacaucgccguccucuucaccaaggcguccgagguggagaaguacaaggaccggcugcugaccgccaugcgcaagcggaagcucagccagcugcacgaggaguccgaccugcuccugcagaucggggacgccagcgacgugcugaccgaccacaucgugcucgacuccgucugccgcuucagcggccuggagcgcaacaucguguucggcaucaaccccgggguggccccgcccgccggcgcguacaaccugcuccugugccuggccucccgggccaagcgccaccucuacauccugaaggccagcgucuga

SEQ ID NO: 36753 - RNA, 4605 nt, Artificial Sequence
  derived and/or modified sequence opt1 from SLIT1__Homo_sapiens__NP_003052
auggcccugacccccggcugggggagcuccgccggcccggugcgccccgagcucuggcugcugcucugggcggccgccuggcggcugggggccagcgccugccccgcgcugugcaccugcacgggcaccaccgucgacugccacgggaccggccuccaggccauccccaagaacaucccgcgcaacacggagcggcuggagcugaacggcaacaacaucacccgcauccacaagaacgacuucgccgggcucaagcagcugcgggugcugcagcucauggagaaccagaucggcgccguggagcgcggggcguucgacgacaugaaggagcuggagcggcugcgccucaaccggaaccagcugcacaugcugcccgagcuccuguuccagaacaaccaggcccugucccgccucgaccugagcgagaacgccauccaggccaucccccggaaggccuuccgcggcgcgaccgaccugaagaaccuccagcuggacaagaaccagaucuccugcaucgaggagggggccuuccgggcccugcgcggccucgagguccugacccugaacaacaacaacaucacgaccauccccgugagcuccuucaaccacaugccgaagcuccggaccuuccgccugcacagcaaccaccuguucugcgacugccaccucgccuggcugucccaguggcugcggcagcgccccaccaucggccucuucacgcagugcagcgggcccgccucccugcggggccugaacguggcggagguccagaagagcgaguucuccugcagcgggcagggcgaggccggccgcgugcccaccugcacccucuccagcggguccugcccggccaugugcaccugcagcaacggcaucguggacugccgggggaagggccugacggccauccccgccaaccugcccgagaccaugaccgagauccgccucgagcugaacgggaucaaguccauccccccgggcgcguucagccccuaccgcaagcugcggcgcaucgaccucagcaacaaccagaucgccgagaucgcccccgacgccuuccagggccugcggucccugaacagccucguccuguacgggaacaagaucaccgaccugccccgcggcguguucgggggccuguacacgcuccagcugcugcuccugaacgccaacaagaucaacugcauccggccggacgcguuccaggaccugcagaaccucucccugcugagccucuacgacaacaagauccagucccuggccaaggggaccuucaccagccugcgcgccauccagacccuccaccuggcccagaaccccuucaucugcgacugcaaccugaaguggcucgcggacuuccugcggacgaaccccaucgagaccuccggcgcccgcugcgccagcccccggcgccuggccaacaagcggaucggccagaucaaguccaagaaguuccgcugcagcgccaaggagcaguacuucaucccggggaccgaggacuaccagcucaacuccgagugcaacagcgacguggucugcccccacaagugccggugcgaggcgaacgugguggagugcuccagccugaagcugaccaagauccccgagcgcaucccccaguccacggccgagcuccggcugaacaacaacgagaucagcauccuggaggccaccggcauguucaagaagcucacccaccugaagaagaucaaccuguccaacaacaaggucagcgagaucgaggacggggccuucgagggcgccgcguccgugagcgagcuccaccugaccgccaaccagcuggagagcauccgcuccgggauguuccggggccucgacggccugcgcacgcugaugcuccggaacaaccgcaucagcugcauccacaacgacuccuucaccgggcugcgcaacgugcggcugcucagccuguacgacaaccagaucaccaccgucuccccgggcgccuucgacacgcugcagagccucuccacccugaaccugcucgccaaccccuucaacugcaacugccagcuggccuggcuggggggcuggcuccgcaagcggaagaucgugaccggcaacccccgcugccagaacccggacuuccugcggcagaucccccugcaggacguggcguuccccgacuuccgcugcgaggaggggcaggaggagggcgggugccucccccggccgcagugcccccaggagugcgccugccuggacaccgucgugcgcugcagcaacaagcaccugcgggcccuccccaagggcauccccaagaacgugaccgagcuguaccuggacgggaaccaguucacgcucgucccgggccagcuguccaccuucaaguaccugcagcucguggaccugagcaacaacaagaucuccagccuguccaacagcuccuucaccaacaugagccagcucaccacgcugauccuguccuacaacgcccuccagugcauccccccccuggcguuccagggccugcgcagccuccggcugcugagccuccacgggaacgacaucuccacccugcaggagggcaucuucgccgacgucaccagccugucccaccucgccaucggggccaacccccuguacugcgacugccaccugcgcuggcucagcuccugggugaagaccggcuacaaggagccggggaucgcccggugcgcgggcccccaggacauggagggcaagcugcugcucacgacccccgccaagaaguucgagugccaggggcccccgacccuggccgugcaggccaagugcgaccugugccucagcucccccugccagaaccagggcaccugccacaacgacccccuggaggucuaccgcugcgccugccccagcggguacaagggccgggacugcgaggugucccuggacagcugcuccagcgggccgugcgagaacggcggcacgugccacgcgcaggagggggaggacgcccccuucaccugcuccugccccaccggcuucgaggggcccaccugcggcgugaacacggacgacugcgucgaccacgccugcgccaacgggggcgugugcguggacggcgucgggaacuacaccugccagugcccgcuccaguacgagggcaaggccugcgagcagcugguggaccugugcagccccgaccucaaccccugccagcacgaggcgcagugcguggggaccccggacggcccccgcugcgagugcaugcccggcuacgccggggacaacugcuccgagaaccaggacgacugccgggaccaccgcugccagaacggcgcccagugcauggacgaggucaacagcuacuccugccugugcgccgagggguacagcggccagcugugcgagauccccccgcaccuccccgcgcccaagucccccugcgaggggaccgagugccagaacggcgccaacugcguggaccagggcaaccggccggugugccagugccugcccggguucggcgggcccgagugcgagaagcugcucagcgucaacuucguggaccgcgacacguaccugcaguucaccgaccugcagaacuggccccgggccaacaucacccugcaggugagcaccgccgaggacaacggcauccuccuguacaacggggacaacgaccacaucgccgucgagcuguaccagggccacgugcgcguguccuacgacccgggcagcuaccccuccagcgcgaucuacuccgccgagacgaucaacgacgggcaguuccacaccgucgagcucguggccuucgaccagauggugaaccugagcaucgacggcgggucccccaugaccauggacaacuucggcaagcacuacacccugaacagcgaggccccccucuacgucgggggcaugccgguggacgugaacuccgccgcguuccgccuguggcagauccugaacggcacgggguuccacggcugcauccggaaccucuacaucaacaacgagcugcaggacuucaccaagacccagaugaagcccggggucgugcccggcugcgagcccugccgcaagcuguacugccuccacggcaucugccagccgaacgccacccccgggcccaugugccacugcgaggccggcuggguggggcugcacugcgaccagcccgccgacggcccgugccacgggcacaagugcguccacggccagugcgugccccuggacgcccucagcuacuccugccagugccaggacggcuacagcggggcgcugugcaaccaggccggcgcccuggccgagcccugccgggggcuccagugccugcacggccacugccaggccuccgggacgaagggcgcgcacugcgugugcgaccccggcuucagcggggagcugugcgagcaggaguccgagugccgcggcgacccgguccgggacuuccaccaggugcagcgcggguacgccaucugccagaccacccggccccucagcuggguggagugccgcggcuccugccccgggcagggcugcugccagggccugcggcugaagcgccggaaguucaccuucgagugcagcgacgggacguccuucgccgaggaggucgagaagccgaccaagugcggcugcgcccucugcgcguga

SEQ ID NO: 36754 - RNA, 4578 nt, Artificial Sequence
  derived and/or modified sequence opt1 from SLIT2__Homo_sapiens__NP_001276064
augcgcggcgugggguggcagaugcugagccucucccugggccugguccucgccauccugaacaagguggccccccaggcgugcccggcccagugcagcugcuccgggagcaccguggacugccacggccuggcccuccgguccgucccccgcaacaucccccggaacaccgagcgccuggaccugaacgggaacaacaucacgcggaucaccaagaccgacuucgccggccuccgccaccugcgggugcugcagcucauggagaacaagaucagcaccaucgagcgcggcgccuuccaggaccugaaggagcuggagcggcuccgccugaaccggaaccaccugcagcucuuccccgagcugcuguuccucgggacggcgaagcuguaccgccuggaccucuccgagaaccagauccaggccaucccgcggaaggccuuccgcggcgccguggacaucaagaaccugcagcuggacuacaaccagaucagcugcaucgaggacggggcguuccgggcccuccgcgaccuggagguccugacccucaacaacaacaacaucacccggcuguccguggccagcuucaaccacaugcccaagcugcgcaccuuccggcuccacuccaacaaccuguacugcgacugccaccuggccuggcucagcgacuggcugcgccagcggccccgcgugggccuguacacgcagugcauggggcccucccaccuccgcggccacaacgucgccgaggugcagaagcgggaguucgugugcagcgacgaggaggagggccaccaguccuucauggcgccgagcugcuccguccugcacugccccgccgccugcaccugcagcaacaacaucguggacugccgcgggaagggccugaccgagauccccaccaaccuccccgagacgaucaccgagauccggcuggagcagaacaccaucaaggugaucccgcccggggccuucucccccuacaagaagcugcgccggaucgaccucagcaacaaccagaucagcgagcuggcccccgacgcguuccagggccugcgcucccucaacagccugguccuguacggcaacaagaucaccgagcugccgaagucccucuucgaggggcuguucagccugcagcuccugcugcucaacgccaacaagaucaacugccugcggguggacgccuuccaggaccugcacaaccucaaccugcugucccucuacgacaacaagcugcagacgaucgccaagggcaccuucagcccccugcgcgccauccagaccaugcaccucgcgcagaaccccuucaucugcgacugccaccugaaguggcuggccgacuaccuccacaccaaccccaucgagacguccggggcccggugcaccagcccgcgccggcuggccaacaagcgcaucggccagaucaaguccaagaaguuccggugcagcgggaccgaggacuaccgcuccaagcugagcggcgacugcuucgccgaccucgcgugccccgagaagugccggugcgagggcaccacgguggacugcuccaaccagaagcugaacaagauccccgagcacaucccccaguacaccgccgagcugcgccucaacaacaacgaguucaccguccuggaggccaccgggaucuucaagaagcugccgcagcuccggaagaucaacuucagcaacaacaagaucacggacaucgaggagggcgccuucgagggggcguccggcgugaacgagauccugcugaccagcaaccgccucgagaacgugcagcacaagauguucaaggggcuggagucccugaagacccucaugcugcggagcaaccgcaucaccugcgucggcaacgacuccuucaucggccugagcagcgugcgccuccugucccuguacgacaaccagaucacgaccguggcccccggggccuucgacacccuccacagccuguccacccugaaccuccuggccaaccccuucaacugcaacugcuaccuggccuggcucggcgaguggcugcggaagaagcgcaucgucacggggaacccccggugccagaagccguacuuccugaaggagauccccauccaggacguggcgauccaggacuucaccugcgacgacggcaacgacgacaacagcugcuccccccucagccgcugcccgaccgagugcaccugccuggacaccgucgugcggugcuccaacaaggggcugaaggugcuccccaagggcaucccccgcgacgucacggagcuguaccuggacggcaaccaguucacccucgugcccaaggagcugagcaacuacaagcaccugacccucaucgaccuguccaacaaccggaucagcacccuguccaaccagagcuucuccaacaugacgcagcuccugacccugauccucagcuacaaccgccugcggugcaucccgccccgcaccuucgacgggcugaagucccuccggcugcugagccuccacggcaacgacaucuccgugguccccgagggggccuucaacgaccugagcgcccugagccaccucgccaucggcgccaacccccuguacugcgacugcaacaugcaguggcuguccgacugggugaagagcgaguacaaggagccgggcaucgcgcgcugcgccgggcccggcgagauggccgacaagcuccugcugaccacgcccuccaagaaguucaccugccaggggcccguggacgucaacauccucgccaagugcaacccgugccugagcaaccccugcaagaacgacggcaccugcaacuccgaccccguggacuucuaccggugcaccugccccuacggguucaagggccaggacugcgacgugccgauccacgccugcaucagcaaccccugcaagcacggcgggacgugccaccugaaggagggcgaggaggacggguucuggugcaucugcgcggacggcuucgagggggagaacugcgaggucaacguggacgacugcgaggacaacgacugcgagaacaacuccaccugcguggacggcaucaacaacuacaccugccucugcccccccgaguacaccggcgagcugugcgaggagaagcuggacuucugcgcccaggaccucaacccgugccagcacgacagcaagugcauccugacgcccaagggguucaagugcgacugcacccccggcuacgucggggagcacugcgacaucgacuucgacgacugccaggacaacaagugcaagaacggcgcccacugcaccgacgccgugaacggguacaccugcaucugccccgagggcuacuccggccuguucugcgaguucagcccgcccauggugcucccccgcacguccccgugcgacaacuucgacugccagaacggggcgcagugcaucguccggaucaacgagcccaucugccagugccugcccggcuaccagggggagaagugcgagaagcuggugagcgugaacuucaucaacaaggaguccuaccuccagauccccagcgccaagguccgcccgcagaccaacaucacccugcagaucgccaccgacgaggacuccggcauccugcucuacaagggggacaaggaccacaucgccguggagcuguaccggggccgcgugcgggccagcuacgacacgggcucccaccccgcgagcgccaucuacuccgucgagaccaucaacgacgggaacuuccacaucguggagcugcuggcccucgaccagagccugagccuguccguggacggcgggaaccccaagaucaucaccaaccucagcaagcaguccacccugaacuucgacagcccccuguacgucggcggcaugccggggaaguccaacguggccagccuccgccaggcccccggccagaacgggacguccuuccacggcugcauccggaaccuguacaucaacagcgagcugcaggacuuccagaaggugcccaugcagaccgggauccuccccggcugcgagccgugccacaagaaggucugcgcgcacggcaccugccagcccuccagccaggccggguucaccugcgagugccaggagggcuggauggggccccugugcgaccagcgcacgaacgaccccugccugggcaacaagugcgugcacgggaccugccucccgaucaacgccuucuccuacagcugcaagugccuggagggccacggcggggugcugugcgacgaggaggaggaccucuucaaccccugccaggccaucaagugcaagcacggcaagugccgccuguccgggcugggccagcccuacugcgagugcagcuccggguacaccggcgacagcugcgaccgggagaucuccugccgcggcgagcggauccgcgacuacuaccagaagcagcagggguacgccgcgugccagaccacgaagaaggucagccggcucgagugccgcggcgggugcgccggcggccagugcugcgggccccugcgguccaagcgccggaaguacagcuucgagugcaccgacggcagcuccuucguggacgagguggagaaggucgugaagugcgggugcacccgcugcgugagcuga

SEQ ID NO: 36755 - RNA, 4572 nt, Artificial Sequence
  derived and/or modified sequence opt1 from SLIT3__Homo_sapiens__NP_003053
auggcccccggcugggccggggugggcgcggccguccgcgcccggcuggcccucgcccuggcgcuggccagcgugcucuccgggccgcccgccguggccugccccaccaagugcaccugcagcgcggccuccgucgacugccacggccuggggcugcgcgccgugccccggggcaucccgcgcaacgccgagcggcucgaccuggaccgcaacaacaucacgcggaucaccaagauggacuucgccggccugaagaaccuccgcgugcugcaccuggaggacaaccaggucagcgugaucgagcggggggcguuccaggaccucaagcagcuggagcgccugcggcucaacaagaacaagcugcaggugcugcccgagcuccuguuccaguccacccccaagcugacccgccucgaccugagcgagaaccagauccagggcaucccccggaaggccuuccgcgggaucacggacgucaagaaccugcagcucgacaacaaccacaucuccugcaucgaggacggcgccuuccgggcccugcgcgaccuggagauccucacccugaacaacaacaacaucagccggauccuggugaccuccuucaaccacaugccgaagauccgcacccuccggcugcacagcaaccaccuguacugcgacugccaccucgccuggcuguccgacuggcugcgccagcggcgcacgguggggcaguucacccucugcauggcgcccguccaccugcgcggcuucaacguggccgacgugcagaagaaggaguacgucugccccgccccccacagcgagccgcccuccugcaacgccaacagcaucuccugccccagccccugcaccugcuccaacaacaucguggacugccggggcaaggggcugauggagaucccggccaaccuccccgagggcaucguggagauccgccuggagcagaacagcaucaaggcgauccccgccggggccuucacccaguacaagaagcugaagcggaucgacaucuccaagaaccagaucagcgacaucgcccccgacgccuuccagggccucaagagccugacgucccugguccucuacggcaacaagaucaccgagaucgcgaaggggcuguucgacggccuggugagccuccagcugcugcugcucaacgccaacaagaucaacugccugcgcgugaacaccuuccaggaccugcagaaccucaaccugcugucccucuacgacaacaagcugcagaccaucagcaaggggcuguucgccccgcuccaguccauccagacgcugcaccuggcccagaaccccuucgucugcgacugccaccucaaguggcuggcggacuaccugcaggacaaccccaucgagaccagcggcgcccggugcuccagcccccgccggcucgccaacaagcgcaucucccagaucaagagcaagaaguuccggugcuccgggagcgaggacuaccgcucccgguucagcuccgagugcuucauggaccuggugugcccggagaagugccgcugcgagggcaccaucguggacugcagcaaccagaagcugguccggauccccucccaccuccccgaguacgugaccgaccugcgccugaacgacaacgaggucagcgugcucgaggccacgggcaucuucaagaagcugcccaaccugcggaagaucaaccucuccaacaacaagaucaaggaggugcgcgagggggccuucgacggcgcggccagcguccaggagcugaugcugaccgggaaccagcucgagaccgugcacggccggguguuccgcgggcugagcggccugaagacccucaugcugcgguccaaccugaucggcugcgucagcaacgacacguucgccgggcucuccagcgugcgccugcugucccucuacgacaaccgcaucaccaccaucaccccgggcgccuucacgacccuggugagccuguccaccaucaaccuccugagcaaccccuucaacugcaacugccaccuggccuggcucgggaaguggcugcggaagcgccggaucgucuccggcaacccccgcugccagaagccguucuuccugaaggagauccccauccaggacguggcgauccaggacuucaccugcgacgggaacgaggagagcuccugccagcucagcccccggugccccgagcagugcacgugcauggagaccgugguccgcugcuccaacaagggccugcgggcccugccgcgcggcaugcccaaggacgugaccgagcucuaccuggaggggaaccaccugaccgccgugccccgggagcucagcgcccugcgccaccugacgcucaucgaccuguccaacaacagcaucuccaugcugaccaacuacaccuucagcaacaugagccaccucuccacccugauccugagcuacaaccggcuccgcugcauccccguccacgccuucaacggccugcggucccugcgcgugcucacccugcacgggaacgacaucagcuccgugccggagggcagcuucaacgaccugacgucccucagccaccuggcgcugggcaccaacccccuccacugcgacugcucccugcgguggcugagcgagugggucaaggccggguacaaggagcccggcaucgcccgcugcuccagccccgagccgauggccgaccggcuccugcugaccacccccacgcaccgcuuccagugcaaggggcccguggacaucaacaucguggcgaagugcaacgccugccucuccagccccugcaagaacaacggcaccugcacccaggacccggucgagcuguaccggugcgccugccccuacuccuacaaggggaaggacugcaccgugcccaucaacacgugcauccagaaccccugccagcacggcggcaccugccaccugagcgacucccacaaggacggguucagcugcuccugcccgcucggcuucgaggggcagcgcugcgagaucaaccccgacgacugcgaggacaacgacugcgagaacaacgccaccugcguggacggcaucaacaacuacgucugcaucugcccccccaacuacaccggggagcugugcgacgaggugaucgaccacugcgugccggagcugaaccucugccagcacgaggccaagugcaucccccuggacaagggcuucagcugcgagugcguccccggcuacagcgggaagcugugcgagacggacaacgacgacugcguggcgcacaagugccggcacggcgcccagugcguggacaccaucaacggguacaccugcaccugcccgcagggcuucuccgggcccuucugcgagcacccccccccgaugguccuccugcagacgagccccugcgaccaguacgagugccagaacggcgcccagugcaucguggugcagcaggagcccaccugccgcugccccccgggcuucgccgggccccgcugcgagaagcugaucaccgucaacuucgugggcaaggacuccuacguggagcucgccagcgcgaagguccggccccaggccaacaucucccugcagguggccaccgacaaggacaacgggauccugcucuacaagggcgacaacgacccccuggcccuggagcucuaccaggggcacgugcgccuggucuacgacagccuguccagcccgcccacgaccguguacuccguggagaccgucaacgacggccaguuccacagcguggagcuggugacccucaaccagacgcugaaccuggucguggacaagggcacccccaagucccucgggaagcugcagaagcagcccgccgugggcaucaacagcccgcuguaccucgggggcauccccaccuccaccggccugagcgcgcugcggcaggggacggaccgcccccucggcggguuccacggcugcauccacgagguccggaucaacaacgagcugcaggacuucaaggcccugcccccgcagucccucggggugagccccggcugcaaguccugcaccgugugcaagcacggccugugccgcagcgucgagaaggacuccguggucugcgagugccggcccggguggaccggcccccugugcgaccaggaggcccgcgacccgugccucgggcaccggugccaccacggcaagugcguggccaccgggacgagcuacaugugcaagugcgcggagggcuacggcggggaccugugcgacaacaagaacgacagcgccaacgccugcuccgccuucaagugccaccacggccagugccacaucagcgaccagggggagcccuacugccugugccagcccggcuucuccggggagcacugccagcaggagaaccccugccucggccaggugguccgcgaggugauccggcgccagaagggcuacgccagcugcgcgaccgccuccaaggugccgaucauggagugccgggggggcugcgggccccagugcugccagcccacccgcagcaagcggcgcaaguacgucuuccagugcaccgacggcuccagcuucguggaggagguggagcggcaccuggagugcggcugccuggccugcuccuga

SEQ ID NO: 36756 - RNA, 2091 nt, Artificial Sequence
  derived and/or modified sequence opt1 from SLITRK1__Homo_sapiens__NP_001268432
augcugcucuggauccugcugcucgagaccagccugugcuucgccgccggcaacgugaccggggacgucugcaaggagaagaucugcuccugcaacgagaucgagggcgaccugcacguggacugcgagaagaagggguucacgagccuccagcgcuucaccgcgcccaccucccaguucuaccaccuguuccugcacggcaacagccucacccggcuguucccgaacgaguucgccaacuucuacaacgccgugucccugcacauggagaacaacgggcuccacgagaucguccccggcgccuuccugggccugcagcucgugaagcgccugcacaucaacaacaacaagaucaagagcuuccggaagcagacguuccuggggcucgacgaccuggaguaccugcaggccgacuucaaccuccugcgcgacaucgaccccggcgcguuccaggaccugaacaagcucgaggugcugauccugaacgacaaccucaucuccacccugcccgccaacgucuuccaguacgugccgaucacccaccuggaccuccgggggaaccgccugaagacccugcccuacgaggaggugcucgagcagauccccggcaucgccgagauccugcuggaggacaaccccugggacugcacgugcgaccuccugagccugaaggaguggcucgagaacaucccgaagaacgcccugaucgggcgggucgugugcgaggcgcccacccgccugcagggcaaggaccucaacgagaccaccgagcaggaccugugcccccugaagaaccggguggacuccagccuccccgccccgcccgcccaggaggagacguucgcccccggcccccugccgacccccuucaagaccaacgggcaggaggaccacgccacccccggcuccgcgcccaacgggggcacgaagaucccgggcaacuggcagaucaagauccgccccaccgccgccaucgccaccgggagcucccggaacaagccccuggccaacagccuccccugcccgggcgggugcuccugcgaccacauccccggcagcgggcugaagaugaacugcaacaaccgcaacgucuccagccuggcggaccugaagcccaagcucuccaacgugcaggagcuguuccugcgggacaacaagauccacagcauccgcaagagccacuucguggacuacaagaaccucauccugcuggaccucggcaacaacaacaucgccaccgucgagaacaacacguucaagaaccugcuggaccuccgguggcuguacauggacuccaacuaccuggacacccucagccgcgagaaguucgccggccugcagaaccuggaguaccucaacguggaguacaacgccauccagcugauccugcccgggaccuucaacgccaugccgaagcuccggauccugauccugaacaacaaccuccugcgcucccugcccguggacgucuucgcgggcgugagccucuccaagcugagccugcacaacaacuacuucauguaccuccccguggccgggguccuggaccagcugaccuccaucauccagaucgaccuccacggcaacccgugggagugcagcugcacgaucgugcccuucaagcagugggccgagcggcugggguccgaggugcugaugagcgaccucaagugcgagacccccgucaacuucuuccgcaaggacuucaugcugcuguccaacgacgagaucugcccccagcucuacgcccggaucagcccgacccugaccucccacagcaagaacuccacgggccuggccgagaccggcacccacagcaacuccuaccucgacaccagccgcguguccaucagcguccuggugcccgggcugcuccugguguucgucacgagcgcguucaccguggugggcaugcuggucuucauccuccgcaaccggaagcgcuccaagcggcgcgacgccaacagcuccgccagcgagaucaacucccugcagaccgugugcgacagcuccuacuggcacaacgggcccuacaacgccgacggcgcgcaccggguguacgacugcgggagccacucccugagcgacuga

SEQ ID NO: 36757 - RNA, 2538 nt, Artificial Sequence
  derived and/or modified sequence opt1 from SLITRK2__Homo_sapiens__NP_115928
augcugagcggcgugugguuccucuccguccugaccguggccgggauccugcagaccgagagccgcaagacggccaaggacaucugcaagauccggugccucugcgaggagaaggagaacgugcugaacaucaacugcgagaacaagggcuucaccaccgucucccugcuccagcccccgcaguaccgcaucuaccagcuguuccugaacgggaaccuccugacccggcuguaccccaacgaguucgugaacuacagcaacgcggugacgcuccaccugggcaacaacgggcugcaggagauccgcaccggcgccuucuccggccucaagacccugaagcggcugcaccucaacaacaacaagcuggagauccugcgcgaggacaccuuccucgggcuggagagccuggaguaccuccaggccgacuacaacuacaucuccgccaucgaggccggcgcguucagcaagcugaacaagcugaagguccucauccugaacgacaaccugcuccugucccugcccagcaacguguuccgguucgugcuccugacgcaccuggaccuccgcgggaaccggcugaaggucaugcccuucgccggcgugcuggagcacaucgggggcaucauggagauccagcucgaggagaacccguggaacugcacgugcgaccugcugccccucaaggccuggcuggacaccaucaccguguucgucggcgagaucgugugcgagacgcccuuccgccugcacgggaaggacgugacccagcucacccggcaggaccugugcccccgcaaguccgccagcgacuccagccagcggggcucccacgcggacacccacguccagcgccugagcccgacgaugaaccccgcccucaaccccacccgggcccccaaggccucccgcccgcccaagaugcggaaccgccccacgccccgggugaccgugagcaaggaccgccaguccuucgggccgaucauggucuaccagaccaagagccccgugccccugaccugccccagcuccugcgugugcaccagccaguccagcgacaacggccugaacgucaacugccaggagcggaaguucaccaacaucuccgaccugcagccgaagcccaccagccccaagaagcucuaccugaccggcaacuaccugcagaccguguacaagaacgaccuccuggaguacuccagccuggaccuccugcaccuggggaacaaccgcaucgccgugauccaggagggcgcguucaccaaccucacgucccugcgccggcuguaccucaacgggaacuaccuggagguccuguaccccagcauguucgacggccuccagucccugcaguaccuguaccucgaguacaacgugaucaaggagaucaagccgcugaccuucgacgcccugaucaaccuccagcugcuguuccucaacaacaaccugcugcgcagccuccccgacaacaucuucgggggcaccgcccugacccggcugaaccuccgcaacaaccacuucucccaccuccccgucaagggcgugcuggaccagcugcccgccuucauccagaucgaccugcaggagaacccgugggacugcacgugcgacaucauggggcugaaggacuggaccgagcacgccaacagccccgugaucaucaacgaggugaccugcgagucccccgcgaagcacgccggcgagauccucaaguuccuggggcgggaggccaucugcccggacagccccaaccuguccgacggcaccguccucagcaugaaccacaacacggacacgccccgcucccugagcgugagccccuccagcuacccggagcugcacaccgaggucccccucuccgugcugauccuggggcuccugguggucuucauccugagcgugugcuucggcgccggccucuucguguucguccugaagcggcgcaagggggugcccuccgugccccggaacaccaacaaccuggacgucagcuccuuccagcuccaguacggcagcuacaacaccgagacccacgacaagaccgacgggcacguguacaacuacaucccgccgcccgugggccagaugugccagaaccccaucuacaugcagaaggagggggaccccgucgccuacuaccgcaaccugcaggaguucuccuacagcaaccuggaggagaagaaggaggagcccgcgacccccgccuacaccaucuccgccacggagcuccuggagaagcaggccacgccccgggagccggagcugcucuaccagaacaucgccgagcgcgugaaggagcugcccagcgcgggccuggugcacuacaacuucugcacccuccccaagcggcaguucgcccccuccuacgagagccgccggcagaaccaggaccgcaucaacaagaccguccuguacggcaccccgcggaagugcuucguggggcaguccaagcccaaccacccccugcuccaggccaagccccagagcgagccggacuaccuggaggugcuggagaagcagaccgccaucucccagcucuga

SEQ ID NO: 36758 - RNA, 2934 nt, Artificial Sequence
  derived and/or modified sequence opt1 from SLITRK3__Homo_sapiens__NP_055741
augaagcccagcaucgccgagaugcugcaccgcggccggaugcucuggaucauccugcuguccaccaucgcccucggguggaccacgccgaucccccugaucgaggacagcgaggagaucgacgagcccugcuucgaccccugcuacugcgaggugaaggagucccuguuccacauccacugcgacagcaagggcuucaccaacaucucccagaucaccgaguucuggagccgcccguucaagcucuaccugcagcggaacuccaugcgcaagcuguacaccaacagcuuccuccaccugaacaacgcggucuccaucaaccuggggaacaacgcccuccaggacauccagacgggcgccuucaacgggcugaagauccugaagcggcucuaccugcacgagaacaagcuggacguguuccgcaacgacaccuuccucggccuggagagccuggaguaccuccaggccgacuacaacgugaucaagcggaucgaguccggcgccuuccgcaaccugagcaagcugcggguccucauccugaacgacaaccugauccccaugcuccccaccaaccuguucaaggcggugucccugacccaccucgaccugcgcgggaaccggcugaagguccucuucuaccgcggcaugcuggaccacaucgggcggagccugauggagcuccagcuggaggagaaccccuggaacugcacgugcgagaucguccagcugaaguccuggcucgagcgcaucccguacaccgcccuggugggcgacaucacgugcgagacccccuuccacuuccacgggaaggaccugcgggagauccgcaagacggagcucugcccccugcugagcgacuccgagguggaggccagccucggcaucccccacuccagcagcuccaaggagaacgccuggccgaccaagcccagcuccaugcugagcuccguccacuucaccgcgagcuccguggaguacaagagcuccaacaagcagcccaagcccaccaagcagccgcggaccccgcgcccgcccagcaccucccaggcccuguaccccggccccaaccagccgcccaucgcccccuaccagacccggccgcccauccccaucaucugccccaccgggugcacgugcaaccuccacaucaacgaccugggccugaccgugaacugcaaggagcgcggguucaacaacaucagcgagcugcucccccggccccugaacgccaagaagcuguaccucuccagcaaccugauccagaagaucuaccgcuccgacuucuggaacuucagcucccuggaccuccugcaccugggcaacaaccgcaucagcuacgugcaggacggcgccuucaucaaccucccgaaccugaagucccuguuccucaacgggaacgacaucgagaagcugacccccggcauguuccgggggcugcagagccuccacuaccuguacuucgaguucaacgugauccgcgagauccagcccgcggccuucagccugaugcccaaccucaagcugcuguuccucaacaacaaccugcugcggacccucccgacggacgccuucgccggcaccucccuggcccgccugaaccuccggaagaacuacuuccuguaccugcccguggcggggguccucgagcaccugaacgccaucgugcagaucgaccugaacgagaaccccugggacugcacgugcgaccucgugcccuucaagcaguggaucgagaccaucagcuccgucagcguggugggcgacguccugugccgcuccccggagaaccugacccaccgggacgugcgcaccaucgagcucgaggugcugugccccgagaugcugcacgucgcccccgccggcgagagccccgcccagccgggggacucccaccucaucggcgcgcccaccagcgccucccccuacgaguucagcccgcccgggggccccgugccccuguccguccugauccucagccugcugguccucuucuucuccgccguguucguggccgccgggcuguucgcguacgugcugcggcgccggcgcaagaagcuccccuuccggagcaagcgccaggagggcguggaccugaccggcauccagaugcagugccaccggcuguucgaggacgggggcgggggcgggggcggcuccgggggcgggggccgccccacgcucagcucccccgagaaggccccgcccgucggccacguguacgaguacaucccccaccccgugacccagaugugcaacaaccccaucuacaagccgcgggaggaggaggaggucgccgugagcagcgcccaggaggcgggguccgccgagcgcggcgggcccggcacccagccgcccgggaugggcgaggcccugcugggcagcgagcaguucgccgagacccccaaggagaaccacuccaacuaccggacgcuccuggagaaggagaaggagugggcccuggcggugagcuccagccagcucaacaccaucgucaccgugaaccaccaccacccccaccaccccgccgucgggggcguguccgggguggugggcgggaccggcggcgaccuggccggguuccgccaccacgagaagaacggcggggucgugcuguucccgcccggcgggggcugcggcagcggguccaugcuccuggaccgcgagcggccccagcccgcccccugcaccgugggcuucgucgacugccuguacgggacggugccgaagcucaaggagcugcacgugcacccgcccggcaugcaguaccccgaccugcagcaggacgcccgccucaaggagacccugcuguucagcgcggggaagggcuucaccgaccaccagacccagaaguccgacuaccucgagcugcgggccaagcugcagacgaagcccgacuaccucgagguccuggagaagaccaccuaccgcuucuga

SEQ ID NO: 36759 - RNA, 2877 nt, Artificial Sequence
  derived and/or modified sequence opt1 from SLITRK5__Homo_sapiens__NP_056382
augcacaccugcugccccccggugacccuggagcaggaccuccaccgcaagaugcacagcuggaugcugcagacgcuggccuucgccgucaccucccucgugcugagcugcgcggagaccaucgacuacuacggcgagaucugcgacaacgccugccccugcgaggagaaggacgggauccugaccguguccugcgagaaccggggcaucaucagccucuccgagaucagccccccccgcuucccgaucuaccaccugcugcucuccgggaaccugcugaaccggcucuaccccaacgaguucgucaacuacacgggcgccagcauccugcaccugggguccaacgugauccaggacaucgagaccggcgccuuccacggccuccgcgggcugcggcgccugcaccucaacaacaacaagcuggagcugcuccgggacgacaccuuccugggccuggagaaccucgaguaccugcagguggacuacaacuacaucagcgucaucgagcccaacgccuucgggaagcugcaccuccugcaggugcugauccucaacgacaaccugcuguccagccuccccaacaaccuguuccgcuucgugccgcugacccaccucgaccugcggggcaaccgccugaagcuccugcccuacgucgggcugcuccagcacauggacaaggugguggagcugcagcuggaggagaaccccuggaacugcuccugcgagcucaucagccugaaggacuggcuggacuccaucagcuacuccgcgcucgucggcgacguggugugcgagacgcccuuccggcugcacggccgcgaccuggacgaggucagcaagcaggagcugugcccgcggcgccucaucuccgacuacgagaugcggccccagaccccccugagcaccaccggguaccugcacacgacccccgccagcgugaacuccguggccaccagcuccagcgccgucuacaagccgccccucaagccccccaagggcacccgccagccgaacaagccccgggugcgccccacgucccggcagcccagcaaggaccugggguacuccaacuacggcccgagcaucgcguaccagaccaagucccccgugccccuggagugccccaccgccugcagcugcaaccuccagaucuccgaccugggccugaacgucaacugccaggagcgcaagaucgagagcaucgccgagcuccagccgaagcccuacaaccccaagaagauguaccugaccgagaacuacaucgccguggugcggcgcacggacuuccuggaggccaccgggcucgaccugcugcaccucggcaacaaccgcaucuccaugauccaggaccgggcguucggggaccugaccaaccugcgccggcucuaccugaacggcaaccgcaucgagcggcugagcccggagcucuucuacgggcugcagucccugcaguaccucuuccugcaguacaaccugauccgcgagauccagagcggcaccuucgaccccguccccaaccuccagcugcuguuccucaacaacaaccugcugcaggccaugcccuccggcguguucagcgggcucacgcugcugcggcucaaccugcgcuccaaccacuucaccagccugccggucagcggcgugcucgaccagcugaagucccugauccagaucgaccuccacgacaaccccugggacugcaccugcgacaucguggggaugaagcugugggucgagcagcugaaggugggcgugcucgucgacgaggugaucugcaaggcccccaagaaguucgccgagaccgacaugcggagcaucaaguccgagcugcugugccccgacuacagcgacguggucguguccacgccgacccccagcuccauccaggugcccgcccgcaccagcgcggucacccccgccgugcggcucaacuccacgggggccccggccagccugggcgccggcgggggcgcguccagcgugccccuguccguccucauccugagccugcuccugguguucaucauguccguguucgucgccgccgggcuguucgugcucgugaugaagcgccggaagaagaaccagagcgaccacaccuccaccaacaacagcgacgucagcuccuucaacaugcaguacagcguguacggcgggggcggcgggaccggcgggcacccccacgcccacgugcaccaccgcggccccgcccugccgaaggucaagacgcccgcgggccacguguacgaguacaucccccacccccuggggcacaugugcaagaacccgaucuaccggucccgcgagggcaacagcguggaggacuacaaggaccuccacgagcugaaggucaccuacuccagcaaccaccaccugcagcagcagcagcagcccccccccccgccccagcagccccagcagcagccgcccccccagcuccagcugcagcccggggaggaggagcggcgcgagucccaccaccugcggagcccggccuacuccgugagcaccaucgagccccgcgaggaccuccugucccccgugcaggacgccgaccgcuucuaccggggcauccuggagcccgacaagcacugcagcaccaccccggccgggaacucccuccccgaguaccccaaguuccccugcagcccggcggccuacacguucucccccaacuacgaccugcgccggccccaccaguaccugcaccccggcgccggcgacagccgccuccgggagccgguccuguacuccccccccagcgccguguucguggagcccaaccgcaacgaguaccuggagcucaaggccaagcugaacgucgagccggacuaccuggaggugcucgagaagcagaccaccuucucccaguucuga

SEQ ID NO: 36760 - RNA, 2526 nt, Artificial Sequence
  derived and/or modified sequence opt1 from SLITRK6__Homo_sapiens__NP_115605
augaagcuguggauccaccucuucuacagcucccugcuggccugcaucagccuccacucccagacccccgugcugagcucccgcggcagcugcgacucccugugcaacugcgaggagaaggacgggaccaugcucaucaacugcgaggccaagggcaucaagauggucagcgagaucuccgugccgcccagccggcccuuccagcugucccugcucaacaacgggcugacgaugcugcacaccaacgacuucagcggccucaccaacgcgaucuccauccaccugggguucaacaacaucgccgacaucgagaucggcgccuucaacggccuggggcuccugaagcagcugcacaucaaccacaacagccucgagauccugaaggaggacaccuuccacggccuggagaaccucgaguuccugcaggccgacaacaacuucaucacggugaucgagcccuccgccuucagcaagcugaaccgccucaagguccugauccugaacgacaacgcgaucgagucccucccgcccaacaucuuccgguucgugccccugacccaccuggaccuccgcgggaaccagcugcagacccugcccuacgugggcuuccucgagcacaucgggcggauccuggaccugcagcucgaggacaacaagugggccugcaacugcgaccugcugcagcucaagaccuggcuggagaacaugccgccccagagcaucaucggcgacgucgugugcaacuccccgcccuucuucaagggcagcauccugagccgccucaagaaggaguccaucugccccacgccgcccguguacgaggagcacgaggaccccagcgggucccugcaccuggccgccaccagcuccaucaacgacagccggauguccaccaagaccacgagcauccucaagcugcccaccaaggcgcccggccugauccccuacaucaccaagcccuccacccagcucccggggcccuacugccccauccccugcaacugcaagguccugagcccguccggccugcugauccacugccaggagcgcaacaucgagagccucuccgaccugcggcccccgccccagaacccccgcaagcugauccucgccggcaacaucauccacagccugaugaaguccgaccugguggaguacuucacgcucgagaugcugcaccuggggaacaaccggaucgaggugcucgaggagggcagcuucaugaaccugacccgccugcagaagcucuaccugaacgggaaccaccugaccaagcucuccaagggcauguuccuggggcugcacaaccucgaguaccuguaccuggaguacaacgccaucaaggagauccuccccggcaccuucaaccccaugccgaagcugaagguccuguaccucaacaacaaccugcuccaggugcugccgccccacaucuucagcggcgugccccugacgaaggucaaccugaagaccaaccaguucacccaccuccccguguccaacauccuggacgaccuggaccuccugacccagaucgaccuggaggacaaccccugggacugcagcugcgaccucguggggcugcagcaguggauccagaagcugagcaagaacacggucaccgacgacauccucugcaccucccccggccaccuggacaagaaggagcugaaggcccucaacagcgagauccugugccccgggcuggugaacaacccguccaugcccacccagacgagcuaccucauggugaccacccccgccaccacgaccaacaccgcggacaccauccugcggucccugacggacgccgucccccucagcgugcugauccugggccuccugaucauguucaucaccaucguguucugcgccgccgggaucgucgugcugguccuccaccgccggcgccgguacaagaagaagcaggucgacgagcagaugcgcgacaacuccccggugcaccuccaguacagcauguacggccacaagaccacccaccacaccacggagcggcccuccgccagccuguacgagcagcacauggugucccccauggugcacguguaccgcagccccuccuucggcccgaagcaccuggaggaggaggaggagcggaacgagaaggaggggagcgacgcgaagcaccuccagcgcucccugcuggagcaggagaaccacagcccccugaccggcuccaacaugaaguacaagaccaccaaccagagcacggaguuccugagcuuccaggacgccuccagccucuaccgcaacauccuggagaaggagcgggagcugcagcagcucgggaucaccgaguaccugcgcaagaacaucgcccagcugcagcccgacauggaggcccacuaccccggcgcccacgaggagcucaagcugauggagacccugauguacucccggccgcgcaagguccucguggagcagaccaagaacgaguacuucgagcugaaggcgaaccugcacgccgagcccgacuaccucgaggugcuggagcagcagacguga

SEQ ID NO: 36761 - RNA, 3615 nt, Artificial Sequence
  derived and/or modified sequence opt1 from SLK__Homo_sapiens__NP_001291672
augagcuucuucaacuuccgcaagaucuucaagcugggcuccgagaagaagaagaagcaguacgagcacgugaagcgggaccucaaccccgaggacuucugggagaucaucggggagcugggcgacggggccuucggcaaggucuacaaggcccagaacaaggagaccagcgugcuggcggccgccaaggugaucgacaccaaguccgaggaggagcucgaggacuacauggucgagaucgacauccuggccagcugcgaccacccgaacaucgugaagcugcucgacgccuucuacuacgagaacaaccuguggauccugaucgaguucugcgccgggggcgcgguggacgccgucaugcucgagcuggagcgcccccugacggagucccagauccagguggugugcaagcagacccucgacgcccugaacuaccugcacgacaacaagaucauccaccgggaccucaaggcgggcaacauccuguucacccuggacggggacaucaagcucgccgacuucggcgucagcgccaagaacacccgcacgauccagcggcgcgacuccuucaucgggacccccuacuggauggcccccgagguggugaugugcgagaccagcaaggaccggccguacgacuacaaggccgacgucuggucccugggcaucacccugaucgagauggcggagaucgagccgccccaccacgagcucaaccccaugcgcgugcugcugaagaucgccaagagcgagccgcccacgcucgcccagcccucccgguggagcuccaacuucaaggacuuccugaagaagugccuggagaagaacguggacgcccgcuggaccaccagccagcuccugcagcaccccuucgucaccguggacuccaacaagcccauccgggagcugaucgccgaggcgaaggccgaggugacggaggaggucgaggacgggaaggaggaggacgaggaggaggagaccgagaacagccuccccauccccgccuccaagcgcgccagcuccgaccugagcaucgccagcuccgaggaggacaagcugagccagaacgcgugcauccucgaguccgugagcgagaagaccgagcgguccaacagcgaggacaagcugaacuccaagauccugaacgagaagcccaccacggacgagccggagaaggccguggaggacaucaacgagcacaucaccgacgcccagcucgaggccaugaccgagcugcacgaccgcaccgccgucaucaaggagaacgagcgggagaagcgccccaagcuggagaaccuccccgacacggaggaccaggagaccguggacaucaacagcguguccgagggcaaggagaacaacaucaugaucacccuggagaccaacaucgagcacaaccucaagagcgaggaggagaaggaccaggagaagcagcagauguucgagaacaagcugaucaaguccgaggagaucaaggacacgauccugcagaccgucgaccuggugagccaggagaccggcgagaaggaggcgaacauccaggccgucgacuccgagguggggcucaccaaggaggacacgcaggagaagcugggcgaggacgacaagacccagaaggacgugaucagcaacaccuccgacgucaucgggaccugcgaggccgccgacguggcgcagaagguggacgaggacagcgccgaggacacgcaguccaacgacggcaaggaggucguggaggugggccagaagcugaucaacaagcccauggucgggccggaggccggcgggaccaaggaggugcccaucaaggagaucguggagaugaacgagaucgaggagggcaagaacaaggagcaggccaucaacagcuccgagaacaucauggacaucaacgaggagcccgggaccaccgagggcgaggagaucacggagagcagcuccaccgaggagauggagguccggagcgugguggccgacaccgaccagaaggcgcucggcuccgagguccaggacgccagcaaggugaccacccagaucgacaaggagaagaaggagauccccguguccaucaagaaggagccggaggucacgguggugagccagcccaccgagccccagcccguccugaucccguccaucaacaucaacagcgacuccggggagaacaaggaggagaucggcagccuguccaagaccgagaccauccugccgcccgagagcgagaaccccaaggagaacgacaacgacuccgggacgggcagcaccgccgacaccuccagcaucgaccucaaccuguccaucagcagcuuccuguccaagaccaaggacagcggguccaucagccuccaggagacgcgccggcagaagaagacccugaagaagacccgcaaguucaucguggacggcguggaggucuccgugaccacgagcaagaucgugaccgacuccgacagcaagaccgaggagcugcgguuccuccgccgccaggagcugcgggagcugcgcuuccuccagaaggaggagcagcgggcccagcagcagcugaacuccaagcugcagcagcagcgcgagcagaucuuccggcgcuucgagcaggagaugaugagcaagaagcggcaguacgaccaggagaucgagaaccucgagaagcagcagaagcagaccaucgagcgccuggagcaggagcacacgaaccggcugcgcgacgaggccaagcggaucaagggcgagcaggagaaggagcucuccaaguuccagaacaugcugaagaaccgcaagaaggaggagcaggaguucguccagaagcagcagcaggagcuggacgggagccucaagaagaucauccagcagcagaaggcggagcuggccaacaucgagcgggagugccugaacaacaagcagcagcucaugcgcgcccgggaggccgccaucugggagcuggaggagcgccaccuccaggagaagcaccagcugcugaagcagcagcugaaggaccaguacuucaugcagcggcaccagcuccugaagcgccacgagaaggagaccgagcagaugcagcgguacaaccagcgccugaucgaggagcucaagaaccgccagacccaggagcgggcgcgccugcccaagauccagcgguccgaggccaagacccgcauggccauguucaagaagucccugcggaucaacagcacggccacccccgaccaggaccgcgacaagaucaagcaguucgcggcccaggaggagaagcggcagaagaacgagcgcauggcccagcaccagaagcacgagaaccagaugcgggaccuccagcugcagugcgaggccaacgugcgcgagcugcaccagcuccagaacgagaagugccaccuccugguggagcacgagacccagaagcugaaggagcuggacgaggagcacagccaggagcugaaggaguggcgggagaagcuccgcccccggaagaagacccuggaggaggaguucgcccgcaagcugcaggagcaggaggucuucuucaagaugacgggcgaguccgagugccucaacccgagcacccagucccggaucagcaaguucuaccccauccccagccugcacuccaccgggagcuga

SEQ ID NO: 36762 - RNA, 2487 nt, Artificial Sequence
  derived and/or modified sequence opt1 from SLMAP__Homo_sapiens__NP_001291349
augcccagcgcccuggccaucuucacgugccgcccgaacucccaccccuuccaggagcggcacguguaccucgacgagcccaucaagaucggccgcagcgucgcgcggugccgccccgcccagaacaacgccaccuucgacugcaaggugcugucccggaaccacgcccuggugugguucgaccacaagaccgggaaguucuaccuccaggacaccaagagcuccaacggcaccuucaucaacagccagcgccugucccgggggagcgaggaguccccgcccugcgagauccugagcggcgacaucauccaguucggggucgacgugaccgagaacacgcgcaaggugacccacggcugcaucgucuccaccaucaagcuguuccugcccgacggcauggaggcccggcugcgcagcgacgugauccacgcgccccucccgucccccguggacaaggucgccgccaacacccccagcauguacucccaggagcuguuccagcugagccaguaccuccaggaggcccugcaccgggagcagaugcuggagcagaagcucgcgacgcugcagcgccugcucgccaucacccaggaggccuccgacaccagcuggcaggcccugaucgacgaggaccggcugcucucccgccuggaggugauggggaaccagcugcaggccugcagcaagaaccagaccgaggacagccuccggaaggagcugaucgcgcugcaggaggacaagcacaacuacgagacgaccgccaaggagucccuccgccgggugcugcaggagaagaucgaggucgugcgcaagcugagcgagguggagcggucccucagcaacaccgaggacgagugcacccaccugaaggagaugaacgagcgcacgcaggaggagcugcgggagcucgccaacaaguacaacggcgccgucaacgagaucaaggaccuguccgacaagcugaagguggccgaggggaagcaggaggagauccagcagaagggccaggcggagaagaaggagcuccagcacaagaucgacgagauggaggagaaggagcaggagcugcaggccaagaucgaggcccugcaggccgacaacgacuucaccaacgagcgccucaccgcccuccaggugcgccuggagcaccuccaggagaagacccugaaggagugcagcucccuggagcaccuccugagcaaguccgggggcgacugcacguucauccaccaguucaucgagugccagaagaagcugaucgucgagggccaccucaccaaggcgguggaggagaccaagcugagcaaggagaaccagacccgggccaaggaguccgacuucagcgacacgcugucccccagcaaggagaaguccagcgacgacaccaccgacgcccagauggacgagcaggaccugaacgagccgcucgccaaggugucccugcugaaggacgaccuccagggggcccagagcgagaucgaggcgaagcaggagauccagcaccuccgcaaggagcugaucgaggcccaggagcuggcccggaccuccaagcagaagugcuucgagcugcaggcccugcucgaggaggagcgcaaggcguaccggaaccaggucgaggagagcacgaagcagauccaggugcugcaggcccagcugcagcgccuccacaucgacaccgagaaccugcgggaggagaaggacagcgagaucaccuccacccgcgacgagcugcucagcgcccgggacgagauccugcugcuccaccaggccgccgcgaagguggccuccgagcgcgacacggacaucgccagccugcaggaggagcugaagaagguccgggccgagcucgagcgcuggcggaaggccgcguccgaguacgagaaggagaucaccagccugcagaacuccuuccagcugcgcugccagcagugcgaggaccagcagcgggaggaggccacccgccuccagggcgagcuggagaagcugcggaaggaguggaacgcccucgagaccgagugccacagccugaagcgcgagaacgugcugcucuccagcgagcugcagcggcaggagaaggagcugcacaacucccagaagcagagccucgagcugacguccgaccugagcauccuccagaugucccgcaaggagcuggagaaccaggucgggagccugaaggagcagcaccuccgcgacuccgccgaccugaagacccugcucagcaaggccgagaaccaggcgaaggacgugcagaaggaguacgagaagacccagaccgugcugagcgagcugaagcucaaguucgagaugaccgagcaggagaagcaguccaucacggacgagcugaagcagugcaagaacaaccugaagcuccugcgggagaagggcaacaacaagcccuggcccuggaugcccaugcuggccgcccucgucgccgugaccgcgaucgugcuguacgucccgggccuggcccgcgccagccccuga

SEQ ID NO: 36763 - RNA, 585 nt, Artificial Sequence
  derived and/or modified sequence opt1 from SLMO2__Homo_sapiens__NP_057129
augaagaucuggaccagcgagcacguguucgaccaccccugggagaccgucacgaccgccgccaugcagaaguacccgaaccccaugaaccccuccguggugggcgucgacgugcuggaccgccacaucgaccccagcgggaagcuccacucccaccggcugcugagcaccgaguggggccucccguccaucgucaagagccugaucggggcggcccgcaccaagacguacgugcaggagcacuccgugguggaccccgucgagaagaccauggagcucaagagcaccaacaucuccuucaccaacauggugagcguggacgagcggcugaucuacaagccccacccccaggacccggagaagacgguccugacccaggaggccaucaucaccgugaagggcgugucccugagcuccuaccucgaggggcugauggccagcaccaucuccagcaacgccuccaagggccgcgaggcgauggagugggucauccacaagcugaacgccgagaucgaggagcucacggccagcgcccggggcaccauccgcacccccauggcggccgccgccuucgccgagaaguga

SEQ ID NO: 36764 - RNA, 96 nt, Artificial Sequence
  derived and/or modified sequence opt1 from SLN__Homo_sapiens__NP_003054
augggcaucaacacccgcgagcuguuccucaacuucaccaucgugcugaucacggucauccugauguggcuccuggugcggagcuaccaguacuga

SEQ ID NO: 36765 - RNA, 399 nt, Artificial Sequence
  derived and/or modified sequence opt1 from SLPI__Homo_sapiens__NP_003055
augaaguccagcggccuguuccccuuccucgugcugcuggcccucgggacccuggccccgugggcggucgagggcagcgggaaguccuucaaggccggcgugugcccgcccaagaaguccgcccagugccugcgcuacaagaagcccgagugccagagcgacuggcagugccccgggaagaagcggugcugccccgacacgugcggcaucaagugccucgaccccguggacacccccaacccgacccgccggaagcccggcaagugccccgucaccuacgggcagugccugaugcugaacccgcccaacuucugcgagauggacggccagugcaagcgcgaccucaagugcugcauggggaugugcggcaagagcugcgugucccccgugaaggccuga

SEQ ID NO: 36766 - RNA, 3051 nt, Artificial Sequence
  derived and/or modified sequence opt1 from SLTM__Homo_sapiens__NP_001013865
auggccgccgcgaccggcgccguggccgccagcgccgcguccgggcaggccgagggcaagaagaucaccgaccugcgcgucaucgaccucaagagcgagcugaagcggcgcaaccuggacaucacgggggugaagaccgugcucaucucccggcugaagcaggccaucgaggaggagggcggggaccccgacaacaucgagcugaccgucagcaccgacacgccgaacaagaagcccaccaagggcaagggcaagaagcacgaggccgacgagcucuccggggacgcgagcguggaggacgacgccuucaucaaggacugcgagcuggagaaccaggaggcccacgagcaggacggcaacgacgagcugaaggacuccgaggaguucggggagaacgaggaggagaacgugcacagcaaggagcuccuguccgccgaggagaacaagcgcgcccacgagcugaucgaggcggagggcaucgaggacaucgagaaggaggacaucgagagccaggagaucgaggcccaggagggggaggacgacaccuuccucaccgcccaggacggcgaggaggaggagaacgagaaggagggcucccuggccgaggccgaccacacggcgcacgaggagauggaggcccacaccaccgucaaggaggccgaggacgacaacaucagcgugaccauccaggccgaggacgccaucacgcuggacuucgacggggacgaccuccuggagaccggcaagaacgugaagaucaccgacuccgaggcgagcaagcccaaggacgggcaggacgccaucgcccagucccccgagaaggagagcaaggacuacgagaugaacgccaaccacaaggacggcaagaaggaggacugcgucaagggcgacccgguggagaaggaggcccgggaguccagcaagaaggcggaguccggggacaaggagaaggacacccugaagaagggccccagcagcacgggggccuccggccaggccaagagcuccagcaaggaguccaaggacagcaagaccuccagcaaggacgacaagggguccaccagcuccaccagcggcuccagcggcuccagcacgaagaacaucuggguguccgggcucagcuccaacaccaaggccgcggaccugaagaaccuguucggcaaguacgggaagguccucagcgccaagguggugaccaacgcccgcagccccggcgccaagugcuacgggaucgucaccauguccagcuccacggaggugagccggugcaucgcccaccuccaccgcaccgagcugcacggccagcugaucuccguggagaaggucaagggcgaccccagcaagaaggagaugaagaaggagaacgacgagaaguccagcucccggagcuccggggacaagaagaacaccagcgaccgcuccagcaagacccaggcguccgugaagaaggaggagaagcggagcuccgagaaguccgagaagaaggagagcaaggacacgaagaagaucgagggcaaggacgagaagaacgacaacggggccagcggccagaccagcgaguccaucaagaaguccgaggagaagaagcgcaucagcagcaaguccccggggcacauggugauccuggaccagaccaagggcgaccacugccggcccagccgccggggccgcuacgagaagauccacgggcgguccaaggagaaggagcgcgccagccuggacaagaagcgggacaaggacuaccgccggaaggagauccuccccuucgagaagaugaaggagcagcgccugcgcgagcaccugguccgguucgagcgccuccggcgcgccauggagcugcggcgccggcgcgagaucgccgagcgggagcgccgggagcgcgagcggauccgcaucauccgggagcgcgaggagcgggagcgccugcagcgggagcgcgagcgccucgagaucgagcggcagaagcuggagcgcgagcggauggagcgcgagcggcuggagcgcgagcggauccgcaucgagcaggagcggcgcaaggaggcggagcggaucgcccgcgagcgggaggagcuccgccggcagcagcagcagcugcgcuacgagcaggagaagcggaacucccugaagcgcccccgggacguggaccaccgccgggacgacccguacuggagcgagaacaagaagcucucccuggacaccgacgcccgcuucggccacgggagcgacuacucccgccagcagaaccgguucaacgacuucgaccaccgcgagcggggccgcuuccccgagagcuccgccgugcagagcuccagcuucgagcggcgcgaccgguucgucggccagagcgaggggaagaaggcccgccccacggcgcggcgcgaggaccccuccuucgagcgguacccgaagaacuucagcgacucccgccggaacgagcccccgccgccccgcaacgagcugcgggagagcgaccgccgggaggugcgcggcgagcgggacgagcgccgcaccgucaucauccacgaccggcccgacaucacccacccccgccacccccgggaggccgggcccaaccccucccgccccaccagcuggaaguccgagggcagcauguccacggacaagcgggagacccgcguggagcggcccgagcgcagcgggcgggagguguccggccacagcguccgcggcgccccgcccgggaaccgguccagcgccuccggcuacgggagccgcgagggcgaccgcggggugaucaccgaccggggcggcgggucccagcacuaccccgaggagcggcacguggucgagcgccacggccgggacaccagcgggccgcgcaaggaguggcacggcccgcccucccaggggcccagcuaccacgacacccggcgcaugggcgacggccgggcgggggccggcaugaucacgcagcacagcuccaacgccagccccaucaaccgcaucgugcagaucuccgggaacagcaugccccgcggcuccgggagcggcuucaagcccuucaagggcgggcccccgcggcgcuucuga

SEQ ID NO: 36767 - RNA, 1761 nt, Artificial Sequence
  derived and/or modified sequence opt1 from SLU7__Homo_sapiens__NP_006416
augagcgccaccguggucgacgccgugaacgcggcgccccuguccggcagcaaggagaugucccucgaggagccgaagaagaugacccgcgaggacuggcggaagaagaaggagcuggaggagcagcgcaagcuggggaacgcccccgccgagguggacgaggagggcaaggacaucaacccccacaucccccaguacaucagcuccgucccgugguacaucgaccccagcaagcggcccacgcucaagcaccagcgcccccagccggagaagcagaagcaguucuccagcuccggggagugguacaagcggggcgugaaggagaacagcaucaucaccaaguaccgcaagggggccugcgagaacugcggcgccaugacccacaagaagaaggacugcuucgagcggccccgccgggugggcgccaaguucaccgggacgaacaucgcccccgacgagcacguccagccccagcugauguucgacuacgacggcaagcgcgaccgguggaacggguacaacccggaggagcacaugaagaucguggaggaguacgccaagguggaccuggcgaagcgcacccucaaggcccagaagcugcaggaggagcuggccuccggcaagcucgucgagcaggccaacagccccaagcaccaguggggcgaggaggagcccaacucccagauggagaaggaccacaacagcgaggacgaggacgaggacaaguacgccgacgacaucgacaugcccgggcagaacuucgacuccaagcggcgcaucaccgugcggaaccugcgcauccgggaggacaucgcgaaguaccugcgcaaccucgacccgaacagcgccuacuacgaccccaagacccgggccaugcgcgagaaccccuacgccaacgccggcaagaaccccgacgagguguccuacgcgggggacaacuucguccgguacacgggcgacaccaucagcauggcccagacccagcuguucgccugggaggccuacgacaagggguccgaggugcaccuccaggccgacccgaccaagcuggagcugcuguacaagagcuucaaggugaagaaggaggacuucaaggagcagcagaaggagagcauccucgagaaguacggcggccaggagcaccuggacgcgccgcccgccgagcugcuccuggcccagacggaggacuacgucgaguacucccgccacgggaccgugaucaagggccaggagcgcgccguggccugcagcaaguacgaggaggacgucaagauccacaaccacacccacaucuggggguccuacuggaaggagggccgguggggguacaagugcugccacagcuucuucaaguacuccuacugcaccggcgaggcgggcaaggagaucgugaacagcgaggagugcaucaucaacgagaucacgggggaggaguccgugaagaagccccagacccugauggagcuccaccaggagaagcugaaggaggagaagaagaagaagaagaagaagaagaagaagcaccgcaagagcuccagcgacuccgacgacgaggagaagaagcacgagaagcugaagaaggcccucaacgccgaggaggcccggcugcugcacgucaaggagaccaugcagaucgacgagcgcaagcggcccuacaacagcauguacgagacccgcgagcccacggaggaggagauggaggcguaccggaugaagcgccagcggcccgacgaccccauggccuccuuccucggccaguga

SEQ ID NO: 36768 - RNA, 312 nt, Artificial Sequence
  derived and/or modified sequence opt1 from SLURP1__Homo_sapiens__NP_065160
auggccagccgcugggccgugcagcugcuccuggucgcggccugguccaugggcugcggggaggcccugaagugcuacacgugcaaggagcccaugaccagcgccuccugccggaccaucacccgcugcaagccggaggacaccgccugcaugaccacgcucgugaccguggaggcggaguaccccuucaaccagagccccgucgugacccgguccugcagcuccagcugcguggccaccgaccccgacuccaucggcgccgcccaccugaucuucugcugcuuccgcgaccugugcaacagcgagcucuga

SEQ ID NO: 36769 - RNA, 5505 nt, Artificial Sequence
  derived and/or modified sequence opt1 from SLX4__Homo_sapiens__NP_115820
augaagcugagcgugaacgaggcccagcucggcuucuaccuggggucccugagccaccucuccgccugccccggcaucgacccgcgcagcuccgaggaccagcccgagagccugaagaccgggcagaugauggacgaguccgacgaggacuucaaggagcugugcgcgagcuucuuccagcgggucaagaagcacggcaucaaggagguguccggggagcgcaagacccagaaggccgccagcaacggcacgcagauccgguccaagcucaagcgcaccaagcagaccgccaccaagacgaagacccugcagggccccgccgagaagaagcccccgagcgggucccaggcgccccggaccaagaagcagcgcgugaccaaguggcaggccagcgagcccgcccacuccgucaacggcgaggggggcgugcuggccagcgcgcccgacccgcccgugcuccgggagacggcccagaacacccagaccgggaaccagcaggagcccucccccaaccugagccgcgagaagacccgggagaacgucccgaacuccgacagccagcccccccccagcugccugacgaccgccgugccgucccccagcaagccccgcaccgcccagcucgugcugcagcggaugcagcaguucaagcgcgccgaccccgagcggcugcgccacgcguccgaggagugcagccucgaggccgcccgggaggagaacgucccgaaggacccccaggaggagaugauggccggcaacguguacggccuggggccccccgccccggaguccgacgcggccguggcccugacccuccagcaggaguucgcccgcgucggcgccagcgcgcacgacgacucccuggaggagaaggggcuguucuucugccagaucugccagaagaaccucagcgccaugaacgugacgcggcgcgagcagcacgugaaccggugccuggacgaggccgagaagacccugcgccccuccgucccccagauccccgagugcccgaucugcggcaagcccuuccucacccugaagagccggaccucccaccugaagcagugcgccgugaagauggaggugggcccccagcuccugcugcaggccguccgccuccagacggcgcagccggaggggagcuccagcccccccauguucuccuucagcgaccacucccgcggccugaagcggcgcgggcccaccagcaagaaggagccgcggaagcgccggaagguggacgaggcccccuccgaggaccugcucguggccauggcccugagccgcagcgagauggagcccggcgcggccguccccgcccugcggcucgaguccgccuucagcgagcgcauccggccggaggccgagaacaagucccgcaagaagaagccccccgugagccccccgcugcugcucgugcaggacuccgagaccaccgggcggcagaucgaggaccgcgucgcgcugcugcucagcgaggagguggagcuguccagcacgcccccccugcccgccucccggauccucaaggagggcugggagcgcgccggccagugcccgcccccccccgagcggaagcagagcuuccugugggagggguccgcccugaccggcgccugggcgauggaggacuucuacaccgcccgccucgucccgccccuggugccccagcggcccgcccaggggcugaugcaggagccggugcccccccuggucccgcccgagcacagcgagcucuccgagcgccggagccccgcccugcacggcacccccacggccgggugcggcucccgcggcccgagccccuccgcgagccagcgcgagcaccaggcccugcaggaccucguggaccuggcccgggaggggcugagcgccucccccuggcccggcagcgggggccucgcgggguccgagggcaccgccggccuggacguggucccggggggccugccccucaccggguucguggugcccagccaggacaagcaccccgaccgcggcggccggacccugcugucccucgggcugcuggucgccgacuucggcgccauggugaacaacccgcaccucagcgacgugcaguuccagacggacuccggggagguccuguacgcccacaaguucgugcuguacgcgcgcugcccccuccugauccaguacgugaacaacgagggcuucagcgccgucgaggacggggugcugacccagcgggugcuccugggcgacgucuccaccgaggccgcccgcaccuuccugcacuaccucuacacggccgacaccggccugccccccgggcugagcuccgagcucagcucccuggcgcaccgguucggcgugagcgagcuggugcaccucugcgagcaggucccgaucgccaccgacuccgaggggaagcccugggaggagaaggaggccgagaacugcgagagccgcgccgagaacuuccaggagcugcugcgguccaugugggccgacgaggaggaggaggcggagacccuccugaagagcaaggaccacgaggaggaccaggagaacgugaacgaggccgagauggaggagaucuacgaguucgccgccacccagcgcaagcugcuccaggaggagcgggcggccggcgccggggaggacgccgacuggcuggagggcggcucccccgugagcgggcagcugcucgccggcguccaggugcagaagcagugggacaagguggaggagauggagccccuggagccggggcgcgacgaggcggccacgaccugggagaagaugggccagugcgcccugccccccccccaggggcagcacagcggcgcccggggcgccgaggcgccggagcaggaggcccccgaggaggcccucgggcacuccagcugcuccagccccucccgcgacugccaggccgagcggaaggagggcagccugccccacuccgacgacgccggggacuacgagcagcuguucagcuccacccagggcgagaucagcgagccgucccagaucaccagcgagcccgaggagcaguccggggcgguccgcgagcggggccucgaggugagccaccgccuggcccccuggcaggccuccccgccccaccccugccgguuccugcucggccccccgcaggggggcagcccccgcgggucccaccacacgagcggcuccagccugagcaccccccggucccgcggcgggaccagccaggugggcucccccacccugcucagcccggccguccccuccaagcagaagcgcgaccggagcauccugacgcuguccaaggagcccgggcaccagaagggcaaggagcgccggagcgugcucgagugccgcaacaagggggugcugauguuccccgagaaguccccgagcaucgaccugacccaguccaaccccgaccacagcuccagccggucccagaagagcuccagcaagcucaacgaggaggacgaggucauccugcugcucgacuccgacgaggagcuggagcuggagcagaccaagaugaagagcaucagcuccgacccccucgaggagaagaaggcccuggagaucagcccccgcuccugcgagcuguucagcaucaucgacguggacgcggaccaggagccgucccagagccccccccgguccgaggccgugcuccagcaggaggacgagggcgcccugcccgagaaccgcggcagccuggggcggcgcggcgccccguggcucuucugcgaccgggaguccagccccuccgaggcgagcaccacggacaccuccuggcugguccccgccaccccccuggccagccgcucccgggacugcagcucccagacccagaucagcucccuccgcagcgggcuggccgugcaggccgugacgcagcacaccccgcgggcgagcgucggcaaccgcgaggggaacgagguggcccagaaguucuccgugauccggccccagaccccccccccgcagacccccagcuccugccugacgcccgucagcccgggcaccuccgacggccgccggcaggggcaccgcagccccucccgcccccaccccggcgggcacccgcacagcuccccccucgccccccaccccaucagcggcgaccgggcccacuucucccgccgguuccugaagcacagcccgcccgggcccuccuuccugaaccagacccccgccggcgaggugguggaggucggcgacagcgacgacgagcaggagguggcgucccaccaggccaaccgcagcccgccccucgacuccgacccccccaucccgaucgacgacugcugcuggcacauggagccccugagccccauccccaucgaccacuggaaccuggagcggaccgggccgcucuccacgagcagccccucccgccggaugaacgaggccgccgacagccgcgacugccggucccccggccugcuggacaccacccccauccgcgggagcugcaccacgcagcggaagcuccaggagaaguccagcggcgccggcucccuggggaacagccgcccguccuuccugaacagcgcgcucugggacgugugggacggcgaggagcagcggccccccgagaccccgccccccgcccagaugcccuccgccgggggcgcccagaagccggaggggcuggagacccccaagggcgcgaaccgcaagaagaaccugccccccaaggucccgaucacccccaugccccaguacagcaucauggagacgcccgugcucaagaaggagcuggaccgguucggcgugcgcccgcugcccaagcggcagaugguccucaagcugaaggagaucuuccaguacacccaccagacccuggacuccgacagcgaggacgagucccagagcucccagccccugcuccaggccccccacugccagacccuggccagccagacguacaagccgagccgcgccggggugcacgcccagcaggaggcgaccaccggccccggggcccaccggcccaagggccccgccaagaccaaggggccgcgccaccagcggaagcaccacgaguccaucaccccccccagccgcucccccacgaaggaggccccgcccggccugaacgacgacgcccagauccccgcgagccaggaguccgucgccaccagcguggacggcuccgacagcucccucagcucccagagcuccagcuccugcgaguucggggccgccuucgagagcgccggcgaggaggagggggagggcgagguguccgcgagccaggccgccguccaggccgcggacaccgacgaggcccugcgcugcuacauccgguccaagcccgcccuguaccagaaggugcuccuguaccagccguucgagcugcgcgagcuccaggccgagcugcggcagaacgggcugcgcgugagcagccggcgccuccuggacuuccuggacacccacugcaucacguucaccaccgccgcgacccggcgcgagaagcuccagggccggcgccggcagccccgcggcaagaagaaggucgagcggaacuga

SEQ ID NO: 36770 - RNA, 1227 nt, Artificial Sequence
  derived and/or modified sequence opt1 from SLX4IP__Homo_sapiens__NP_001009608
auggccagcaagaaguucgccgugaagugcggcaacuucgcgguccugguggaccuccacauccugccccagggguccaacaaggacaccagcugguucuccgagcagaagaaggaggaggugugccugcuccugaaggagaccaucgacagccgcguccaggaguaccuggaggugcggaagcagcaccgcccguccaacgccgaguucacgcggagcaacccccucucccugaagggcuacggguuccagaucaccgccuacuuccugaagcgcggcauccggcuccgcugcauccggagcacccagaacgccgagcugugcguguuccccgaccgcuucgucgugugcgugucccagcuggccuucagccgggaccuccuggcgucccagaacgaggaccugaccgagcgcguccuccacggggugagcgacuacuucgccgagugcgccgaguccagccugcccccguccgccaagcugcggcgcaacgcgcucaaggagaucgugaagcggacggagaccaagagcuccgucaccagcaagucccagacccgccgggacacgguggagaccagcagcgacuccgugaucgccgagaucgcccgccggcgcaacgacggccaggccagcuccagcccgcccuccgagagcaugggccaggccaaggacuccaucaaggcggccgagagccacugggggcugcccguccagaagcuggagaaggugaaccagacccagcccgaggacaccuccggccagcagaagccccaccccggggagcggcucaagacgggccugcugagccgcucccccgugugcagcugcgaguccgccagcccgugccccaagcagagcccccgggucgccaagacccagcagaagcgccgcaacugcagcuccgccgaggacuucgaccaccacgggcgggugagccucggcuccgaccgccuggugccccgggagaucaucgucgagaaguccaaggcggugcgcgugcugccggccagcgagcucuccgaccccggccugcugcucaagcaggaccuggccaagaccaccagcaaggaggagcugcacguccucgagucccugagcucccggcaccugaugaagaacaaccccgggcaggcccagcagacgggccucgccaccaacaccgagcgccugagcaccauccagaacucccccacgaagaagcggaagaaguacgagcgcgggcacuga

SEQ ID NO: 36771 - RNA, 1398 nt, Artificial Sequence
  derived and/or modified sequence opt1 from SMAD1__Homo_sapiens__NP_005891
augaacgugaccagccuguucuccuucaccagccccgccgucaagcgccuccugggcuggaagcagggggacgaggaggagaagugggccgagaaggcgguggacgcccuggugaagaagcucaagaagaagaagggcgccauggaggagcuggagaaggcccuguccugcccggggcagcccagcaacugcgucacgaucccccggucccucgacggccgccuccaggugagccaccggaaggggcugccccacgugaucuacugccgcgucuggcgguggccggaccuccagucccaccacgagcugaagccccuggagugcugcgaguuccccuucggcagcaagcagaaggaggugugcaucaaccccuaccacuacaagcgcguggaguccccgguccucccgcccgugcuggugccccggcacagcgaguacaacccccagcacucccugcucgcccaguuccgcaaccugggccagaacgagccccacaugccccugaacgcgaccuuccccgacagcuuccagcagccgaacucccaccccuucccccacagccccaacuccagcuacccgaacucccccgggagcuccagcagcaccuacccccacucccccaccagcuccgacccgggcagccccuuccagaugcccgccgacacgcccccgcccgccuaccugcccccggaggaccccaugacccaggacgggucccagcccauggacaccaacaugauggcgcccccgcugcccagcgagaucaaccggggcgacguccaggccguggccuacgaggagcccaagcacuggugcuccaucguguacuacgagcugaacaaccgcgucggggaggccuuccacgccagcuccaccagcgugcucguggacggcuucacggaccccuccaacaacaagaaccgguucugccugggccugcucagcaacgucaaccgcaacuccaccaucgagaacacccggcgccacaucgggaagggcgugcaccuguacuacgucgggggcgagguguacgccgagugccugagcgacuccagcaucuucgugcagucccggaacugcaacuaccaccacggcuuccacccgaccacggugugcaagauccccagcgggugcucccucaagaucuucaacaaccaggaguucgcgcagcugcuggcccagagcgucaaccacggcuucgagaccguguacgagcucaccaagaugugcaccauccgcaugagcuucgucaagggguggggcgccgaguaccaccggcaggacgugacguccacccccugcuggaucgagauccaccuccacgggccccugcaguggcuggacaaggugcugacccagaugggcagcccgcacaaccccaucuccagcgucuccuga

SEQ ID NO: 36772 - RNA, 1404 nt, Artificial Sequence
  derived and/or modified sequence opt1 from SMAD2__Homo_sapiens__XP_006722514
augagcuccauccugcccuucaccccgcccguggucaagcgccuccugggcuggaagaaguccgccgggggcagcgggggcgccgggggcggcgagcagaacgggcaggaggagaaguggugcgagaaggcggucaagagccuggugaagaagcucaagaagaccggccggcuggacgagcuggagaaggccaucacgacccagaacugcaacaccaagugcgugaccauccccuccacgugcagcgagaucugggggcucuccacccccaacaccaucgaccagugggacaccacgggccuguacagcuucuccgagcagacccgcagccuggacgggcggcuccaggugucccaccgcaagggccugccgcacgugaucuacugccggcuguggcgcuggcccgaccuccacagccaccacgagcugaaggccaucgagaacugcgaguacgccuucaaccugaagaaggacgaggucugcgugaaccccuaccacuaccagcggguggagacccccguccucccgcccgugcuggugccccgccacaccgagauccugacggagcugcccccgcucgacgacuacacccacuccauccccgagaacaccaacuuccccgccggcaucgagccccagagcaacuacaucccggagaccccgccgcccggguacaucuccgaggacggcgagacgagcgaccagcagcugaaccaguccauggacaccgggagccccgcggagcucucccccaccacccugagccccgucaaccacagccuggaccuccagcccgugacguacuccgagcccgccuucuggugcagcaucgccuacuacgagcugaaccagcgggugggcgagaccuuccacgccucccagcccagccugaccgucgacggcuucaccgaccccuccaacagcgagcgcuucugccucgggcugcuguccaacgugaaccggaacgcgacgguggagaugacccgccggcacaucggccgcgggguccggcucuacuacaucggcggggagguguucgccgagugccugagcgacuccgccaucuucgugcagagccccaacugcaaccagcgcuacggcuggcacccggccaccgucugcaagaucccgcccggcugcaaccugaagaucuucaacaaccaggaguucgccgcgcuccuggcccaguccgugaaccagggguucgaggccguguaccagcugacccggaugugcacgauccgcaugagcuucgucaagggcuggggcgccgaguaccggcgccagaccgugaccuccacccccugcuggaucgagcuccaccugaacgggccccugcaguggcucgacaagguccugacgcagauggggagccccuccgugcggugcagcuccaugagcuga

SEQ ID NO: 36773 - RNA, 963 nt, Artificial Sequence
  derived and/or modified sequence opt1 from SMAD3__Homo_sapiens__NP_001138574
auggagcugugcgaguucgccuucaacaugaagaaggacgaggugugcgucaaccccuaccacuaccagcgcguggagaccccggugcucccgcccguccuggugccccggcacaccgagauccccgccgaguucccgccccuggacgacuacagccacuccauccccgagaacacgaacuuccccgcgggcaucgagccccagagcaacauccccgagacgcccccgcccggguaccucuccgaggacggcgagaccagcgaccaccagaugaaccacuccauggacgccgggagccccaaccugucccccaacccgaugagccccgcccacaacaaccuggaccuccagcccgugaccuacugcgagcccgccuucuggugcuccaucagcuacuacgagcugaaccagcgcgucggcgagaccuuccacgccucccagccgagcaugaccguggacggguucaccgaccccuccaacagcgagcgguucugccugggccuccuguccaacgugaaccgcaacgcggccgucgagcugacccggcgccacaucggccgcggggugcggcucuacuacaucggcggggagguguucgccgagugccugagcgacuccgccaucuucguccagagccccaacugcaaccagcgguacggcuggcaccccgcgacggugugcaagaucccgcccgggugcaaccugaagaucuucaacaaccaggaguucgccgcccuccuggcccaguccgugaaccagggcuucgaggccgucuaccagcugacccgcaugugcaccauccggaugagcuucgugaagggcuggggcgcggaguaccgccggcagaccgugacgagcacccccugcuggaucgagcuccaccugaacgggccccugcaguggcucgacaagguccugacccagaugggguccccgagcauccgcugcuccagcguguccuga

SEQ ID NO: 36774 - RNA, 1659 nt, Artificial Sequence
  derived and/or modified sequence opt1 from SMAD4__Homo_sapiens__NP_005350
auggacaacaugagcaucaccaacacccccacguccaacgacgccugccugagcaucgugcacucccucaugugccaccgccagggcggggagagcgagaccuucgccaagcgggcgaucgagucccuggucaagaagcugaaggagaagaaggacgagcucgacagccugaucaccgccaucaccacgaacggcgcccacccguccaagugcgugaccauccagcgcacccuggacgggcggcuccagguggccggccgcaagggguucccccacgucaucuacgcccggcuguggcgcuggcccgaccugcacaagaacgagcucaagcacgugaaguacugccaguacgcguucgaccugaagugcgacagcgugugcgucaaccccuaccacuacgagcgggugguguccccgggcaucgaccugagcggccucacccugcaguccaacgcccccagcuccaugauggucaaggacgaguacgugcacgacuucgaggggcagcccagccuguccacggagggccacagcauccagaccauccagcacccgcccuccaaccgcgccagcaccgagaccuacuccacgcccgcccuccuggcgcccagcgagagcaacgccaccuccaccgccaacuuccccaacaucccgguggccagcaccucccagcccgccagcauccucgggggcucccacagcgaggggcugcugcagaucgcguccggcccccagcccggccagcagcagaacggguucacgggccagccggccaccuaccaccacaacagcaccaccacguggaccgggucccggaccgcccccuacacccccaaccugccccaccaccagaacggccaccuccagcaccacccgcccaugccgccccaccccggccacuacuggcccguccacaacgagcuggccuuccagccgcccaucagcaaccaccccgcccccgaguacuggugcuccaucgcguacuucgagauggacguccaggugggggagacguucaaggugcccagcuccugcccgaucgugaccguggacggcuacgucgaccccagcgggggcgaccgcuucugccuggggcagcucuccaacgugcaccggaccgaggccaucgagcgcgcccggcugcacaucggcaagggcgugcagcuggagugcaagggggagggcgacgucugggugcgcugccucagcgaccacgccguguucguccaguccuacuaccuggaccgggaggccgggcgcgcgcccggcgacgccgugcacaagaucuaccccagcgccuacaucaaggucuucgaccugcggcagugccaccgccagaugcagcagcaggccgccaccgcgcaggccgccgccgcggcccaggccgccgccguggcggggaacaucccgggccccggcuccgucgggggcaucgcccccgccaucagccucagcgccgccgcggggaucggcguggacgaccugcggcgccugugcauccuccggauguccuucgugaagggguggggccccgacuacccgcgccagagcaucaaggagacgcccugcuggaucgagauccaccuccaccgcgcccugcagcugcuggacgaggugcugcacaccaugcccaucgccgacccccagccgcucgacuga

SEQ ID NO: 36775 - RNA, 1398 nt, Artificial Sequence
  derived and/or modified sequence opt1 from SMAD5__Homo_sapiens__NP_001001420
augaccagcauggccucccuguucagcuucaccucccccgccgugaagcgccuccugggcuggaagcagggggacgaggaggagaagugggcggagaaggccgucgacgcccuggugaagaagcucaagaagaagaagggcgccauggaggagcuggagaaggcccugagcuccccggggcagcccagcaagugcgugacgaucccccggucccucgacggccgccugcaggucagccaccggaaggggcugccccacgugaucuacugccgcguguggcgguggccggaccuccagucccaccacgagcugaagccccuggacaucugcgaguuccccuucggcagcaagcagaaggaggucugcaucaaccccuaccacuacaagcgcguggaguccccggugcucccgcccguccuggugccccggcacaacgaguucaacccccagcacagccugcucgugcaguuccgcaaccugucccacaacgagccccacaugccccagaacgcgaccuuccccgacagcuuccaccagccgaacaacacccccuucccccugucccccaacagcccguacccgcccucccccgccagcuccaccuaccccaacagccccgccagcuccggccccgggagccccuuccagcucccggccgacacgcccccgcccgcguacaugccgcccgacgaccagaugggccaggacaacucccagcccauggacaccagcaacaacaugaucccccagaucaugcccuccaucagcucccgggacguccagcccguggccuacgaggagcccaagcacuggugcagcaucguguacuacgagcugaacaaccgcgucggggaggccuuccacgccuccagcaccuccgugcugguggacggcuucaccgacccgagcaacaacaagucccgguucugccucgggcugcugagcaacgucaaccgcaacuccacgaucgagaacacccggcgccacaucggcaagggcgugcaccucuacuacgucgggggcgagguguacgccgagugccugagcgacuccagcaucuucgugcagucccggaacugcaacuuccaccacggguuccaccccaccaccgugugcaagauccccagcagcugcucccugaagaucuucaacaaccaggaguucgcgcagcuccuggcccagagcgucaaccacggcuucgaggccguguacgagcugacgaagaugugcaccauccgcauguccuucgucaagggcuggggcgccgaguaccaccggcaggacgugaccagcacccccugcuggaucgagauccaccuccacgggccgcugcaguggcuggacaaggugcucacgcagauggggagcccccugaaccccaucuccuccgucagcuga

SEQ ID NO: 36776 - RNA, 1491 nt, Artificial Sequence
  derived and/or modified sequence opt1 from SMAD6__Homo_sapiens__NP_005576
auguuccgcagcaagcgguccggccuggugcgccggcucuggcgcagccgggucgugcccgaccgcgaggaggggggcuccgggggcgggggcggcggggacgaggacggcagccuggggucccgggccgagccggccccccgcgcgcgggagggcgggggcugcggccgcagcgaggugcggcccgucgccccccgccggccgcgcgacgccguggggcagcggggcgcccagggggccggccgccggcgccgggcgggcgggcccccccgccccauguccgagccgggcgccggggccggcagcucccugcucgacguggccgagcccgggggccccggcuggcugcccgagagcgacugcgagaccgucaccugcugccuguucuccgagcgggacgcggccggggccccgcgcgacgccagcgacccccucgccggcgcggcccuggagcccgccgggggcgggcgcucccgggaggcccgcagccggcugcuccugcuggagcaggagcucaagacggugaccuacucccugcugaagcgccucaaggagcggagccuggacacccugcucgaggccguggagucccgcggcggcguccccgggggcugcgugcuggugccgcgggcggaccugcgccucgggggccagcccgcccccccccagcugcugcucgggcggcuguuccgcuggccggaccugcagcacgccgucgagcucaagccccugugcggcugccacagcuucgccgccgcggccgacggccccaccgugugcugcaaccccuaccacuucucccggcugugcgggccggagagccccccccccccguacagccgccucuccccccgggacgaguacaagccccuggaccugagcgacuccacgcucagcuacaccgagaccgaggccaccaacucccugaucacggccccgggcgaguucagcgacgccuccaugagccccgacgcgaccaagcccucccacuggugcagcguggccuacugggagcaccgcacccgggucgggcgccuguacgccguguacgaccaggccguguccaucuucuacgaccucccccagggcagcggcuucugccuggggcagcugaaccucgagcagcgguccgagagcguccgccggacccgcuccaagaucggcuucgggauccugcugagcaaggagccggacggcgugugggcguacaaccgcggggagcaccccaucuucgugaacucccccacgcucgacgcccccggcggccgggcccuggucgugcgcaaggugccgcccggguacagcaucaaggucuucgacuucgagcgguccggccugcagcacgcccccgagcccgacgccgcggacgggccguacgaccccaacagcgugcgcaucagcuucgccaagggcugggggcccugcuacucccggcaguucaucaccagcugccccugcuggcucgagauccugcugaacaacccgcgcuga

SEQ ID NO: 36777 - RNA, 636 nt, Artificial Sequence
  derived and/or modified sequence opt1 from SMAD7__Homo_sapiens__NP_001177751
auggacuuccugaagcccaccgccgacugcccggacgccgugcccagcuccgcggagaccggcgggacgaacuaccucgcccccggcgggcugagcgacucccagcugcuccuggagcccggcgaccgcagccacuggugcgucguggccuacugggaggagaagacccggguggggcgccuguacugcguccaggagccgucccucgacaucuucuacgaccugccccagggcaacggcuucugccuggggcagcucaacagcgacaacaagucccagcuggugcagaaggugcggagcaagaucggcugcgggauccagcugacccgcgaggucgacggcguguggguguacaaccgguccagcuaccccaucuucaucaaguccgccacccucgacaaccccgacagccgcacgcugcugguccacaagguguucccgggguucuccaucaaggccuucgacuacgagaaggcguacagccuccagcggcccaacgaccacgaguucaugcagcagcccuggaccggcuucaccgugcagaucuccuucgucaagggcugggggcagugcuacacccgccaguucaucagcuccugccccugcuggcuggaggugaucuucaacagccgguga

SEQ ID NO: 36778 - RNA, 1404 nt, Artificial Sequence
  derived and/or modified sequence opt1 from SMAD9__Homo_sapiens__NP_001120689
augcacagcaccacccccaucuccagccuguucuccuucacgagcccggccgugaagcgccuccugggcuggaagcagggggacgaggaggagaagugggccgagaaggcggucgacucccuggugaagaagcucaagaagaagaagggcgccauggacgagcuggagcgggcccugagcugccccgggcagcccuccaagugcgugaccaucccccgcagccucgacggccggcugcaggucucccaccgcaaggggcugccgcacgugaucuacugccggguguggcgcuggcccgaccuccagagccaccacgagcugaagccccuggagugcugcgaguuccccuucggcuccaagcagaaggaggucugcaucaacccguaccacuaccggcgcguggagacccccgugcucccgcccguccuggugccccggcacagcgaguacaacccccagcugucccuccuggccaaguuccgcagcgccucccugcacagcgagccccucaugccccacaacgcgaccuacccggacuccuuccagcagccgcccugcagcgcccugccgcccucccccagccacgccuucagccagucccccugcacggccagcuacccccacucccccggcagccccuccgagcccgagagccccuaccagcacuccguggacaccccgccccugcccuaccacgcgaccgaggccagcgagacccaguccgggcagccggucgacgccacggccgaccggcacguggugcucagcauccccaacggcgacuuccgccccgucugcuacgaggagccccagcacuggugcuccguggccuacuacgagcugaacaaccgggugggggagaccuuccaggcgagcucccgcagcguccugaucgacggcuucaccgacccguccaacaaccggaaccgcuucugccucgggcugcugagcaacgugaaccggaacuccaccaucgagaacacgcgccggcacaucggcaagggcgugcaccucuacuacgucgggggcgagguguacgccgagugcgugagcgacuccagcaucuucguccagagccgcaacugcaacuaccagcacggguuccaccccgccaccgugugcaagauccccuccggcugcagccugaaggucuucaacaaccagcuguucgcccagcuccuggcccaguccgugcaccacggcuucgagguggucuacgagcugaccaagaugugcaccauccggaugagcuucgugaagggguggggcgcggaguaccaccgccaggacgugacguccacccccugcuggaucgagauccaccuccacgggccgcugcaguggcuggacaagguccucacccagaugggcagcccccacaaccccaucuccagcguguccuga

SEQ ID NO: 36779 - RNA, 294 nt, Artificial Sequence
  derived and/or modified sequence opt1 from SMAGP__Homo_sapiens__NP_001029045
augaccagccugcucaccacgcccuccccgcgcgaggagcugaugaccacccccauccugcagcccaccgaggcccucagccccgaggacggcgccuccacggcgcugaucgccguggucaucaccgugguguuccugacccuccugagcgucgugauccugaucuucuucuaccucuacaagaacaagggguccuacgugaccuacgagccgacggagggcgagcccagcgccaucguccagauggaguccgaccuggccaaggggagcgagaaggaggaguacuucaucuga

SEQ ID NO: 36780 - RNA, 1404 nt, Artificial Sequence
  derived and/or modified sequence opt1 from SMAP1__Homo_sapiens__NP_001037770
auggccacccgcagcugccgggagaaggcccagaagcugaacgagcagcaccagcucauccuguccaagcugcuccgcgaggaggacaacaaguacugcgcggacugcgaggccaagggcccccggugggccagcuggaacaucgggguguucaucugcauccgcugcgccggcauccaccggaaccuggggguccacaucucccgcgucaagagcgugaaccuggaccaguggaccgccgagcagauccagugcaugcaggacaugggcaacacgaaggcgcggcuccuguacgaggccaaccugccggagaacuuccgccggccccagaccgaccaggccguggaguucuucauccgcgacaaguacgagaagaagaaguacuacgacaagaacgccaucgcgaucaccaacaucuccagcuccgacgcgccccuccagccccuggugagcuccccgagccugcaggccgccguggacaagaacaagcucgagaaggagaaggagaagaagaaggaggagaagaagcgggagaaggagcccgagaagcccgccaagccccugaccgccgagaagcugcagaagaaggaccagcagcucgagccgaagaaguccacgagccccaagaaggccgccgagcccaccgucgaccugcuggggcucgacggccccgccguggccccggugaccaacggcaacaccacggucccgccccugaacgacgaccuggacaucuucgggcccaugaucuccaacccccuccccgcgaccgugaugccgcccgcccagggcacccccagcgcccccgccgccgcgacccuguccacggugaccagcggggaccuggaccucuucaccgagcagaccacgaaguccgaggaggucgccaagaagcagcugagcaaggacuccauccugagccucuacggcaccgggaccauccagcagcagagcacccccggcguguucaugggccccacgaacaucccguucaccucccaggcccccgccgccuuccagggguuccccagcaugggcgugcccgucccggcggcccccgggcugaucggcaacgugaugggccagucccccagcaugaugguggggaugccgaugcccaacggcuucauggggaacgcccagaccggcgucaugccccugccccagaacgugguggggccgcagggcggcauggucgggcagaugggcgcgccccaguccaaguucgggcucccccaggcccagcagccccaguggagccugucccagaugaaccagcagauggccggcaugagcaucuccagcgccaccccgacggccggguucggccagcccuccagcaccaccgccggcugguccgggagcuccagcggccagacccuguccacgcagcucuggaaguga

SEQ ID NO: 36781 - RNA, 3213 nt, Artificial Sequence
  derived and/or modified sequence opt1 from SMARCA1__Homo_sapiens__NP_001269803
auggagcaggacaccgccgccguggcggccaccguggccgccgccgacgcgacggccaccaucguggugaucgaggacgagcagcccggcccgagcaccucccaggaggagggggccgccgcggccgccaccgaggccacggccgcgaccgagaagggcgagaagaagaaggagaagaacgucagcuccuuccagcugaagcucgccgccaaggcccccaagagcgagaaggagauggaccccgaguacgaggagaagaugaaggccgaccgcgcgaagcgguucgaguuccugcugaagcagaccgagcuguucgcccacuucauccagcccuccgcccagaaguccccgaccagcccccucaacaugaagcuggggcgcccccggaucaagaaggacgagaagcagagccucaucuccgccggcgacuaccgccaccggcgcacggagcaggaggaggacgaggagcugcugagcgagucccggaagaccagcaacgugugcauccgcuucgaggugucccccagcuacgucaagggcgggccgcuccgggacuaccagauccgcggccugaacuggcugaucucccucuacgagaacggggugaacggcauccuggccgacgagauggggcugggcaagacccuccagaccaucgcgcugcugggguaccucaagcacuaccggaacauccccggcccccacauggugcugguccccaagagcacgcugcacaacuggaugaacgaguucaagcgcugggugccgucccuccgggugaucugcuucgucggcgacaaggacgcccgcgccgccuucauccgggacgagaugaugcccggggagugggacgugugcgugaccagcuacgagauggucaucaaggagaaguccguguucaagaaguuccacuggcgcuaccuggugaucgacgaggcccaccggaucaagaacgagaaguccaagcugagcgagaucguccgcgaguucaagagcaccaaccggcuccugcugaccggcacgccccuccagaacaaccugcacgagcugugggcgcuccugaacuuccugcuccccgacguguucaacagcgccgacgacuucgacuccugguucgacaccaagaacugccugggggaccagaagcugguggagcgccuccacgccguccugaagccguuccugcuccggcgcaucaagaccgacguggagaagucccugccgcccaagaaggagaucaagaucuaccugggccucagcaagaugcagcgcgagugguacaccaagauccugaugaaggacaucgacgugcugaacagcuccggcaagauggacaagaugcggcuccugaacauccugaugcagcuccgcaagugcugcaaccaccccuaccuguucgacggggccgagcccggcccgcccuacacgaccgacgagcacaucgucagcaacuccgggaagauggugguccuggacaagcugcucgcgaagcugaaggagcagggcagccgggugcugaucuucucccagaugacccgccuccuggacauccuggaggacuacugcauguggcggggguacgaguacugccgccucgacggccagacgccccacgaggagcgggaggacaaguuccuggagguggaguuccugggccagcgcgaggccaucgaggccuucaacgcccccaacagcuccaaguucaucuucaugcucagcacccgggccgggggccuggggaucaaccuggcguccgccgacgucgugauccucuacgacagcgacuggaacccccagguggaccugcaggccauggaccgcgcccaccggaucggccagaagaagcccguccgcguguuccggcugaucaccgacaacaccguggaggagcgcaucgucgagcgggccgagaucaagcuccgccuggacuccaucgugauccagcaggggcggcugaucgaccagcagagcaacaagcucgcgaaggaggagaugcugcagaugauccgccacggcgccacccacguguucgccuccaaggagagcgagcugacggacgaggacaucaccaccauccucgagcggggcgagaagaagaccgccgagaugaacgagcgccugcagaagaugggggagagcucccugcgcaacuuccggauggacaucgagcagagccucuacaaguucgagggcgaggacuaccgcgagaagcagaagcuggggauggucgaguggaucgagcccccgaagcgggagcgcaaggccaacuacgcgguggacgccuacuuccgggaggcccugcgcguguccgagcccaagauccccaaggccccgcggccgcccaagcagcccaacguccaggacuuccaguucuucccgccccgccucuucgagcugcuggagaaggagauccucuacuaccggaagacgaucggcuacaaggugccccgcaaccccgacauccccaaccccgcgcuggcccagcgggaggagcagaagaagaucgacggggccgagccccugacccccgaggagaccgaggagaaggagaagcuccugacccagggcuucacgaacuggaccaagcgcgacuucaaccaguucaucaaggccaacgagaaguacggccgggacgacaucgacaacaucgcccgcgagguggagggcaagagcccggaggaggucauggaguacuccgcgguguucugggagcggugcaacgagcugcaggacaucgagaagaucauggcccagaucgagcgcggggaggcccggauccagcgccggaucagcaucaagaaggcccucgacgccaagaucgcgcgcuacaaggcccccuuccaccagcugcggauccaguacgggaccuccaagggcaagaacuacaccgaggaggaggaccgcuuccugaucugcaugcuccacaagaugggcuucgaccgcgagaacguguacgaggagcugcggcagugcguccgcaacgcgccccaguuccgguucgacugguucaucaagagccgcaccgccauggaguuccagcggcgcugcaacacgcugaucucccucaucgagaaggagaacauggagaucgaggagcgggagcgcgccgagaagaagaagcgggccaccaagacccccaugagccagaagcgcaaggccgaguccgccaccgagagcuccgggaagaaggacgugaagaaggucaagagcuga

SEQ ID NO: 36782 - RNA, 4545 nt, Artificial Sequence
  derived and/or modified sequence opt1 from SMARCA2__Homo_sapiens__NP_001276326
augagcacccccaccgacccgggcgccaugccccaccccgggcccuccccgggccccgggcccagccccggcccgauccuggggcccucccccggccccggcccgagccccggguccgugcacagcaugaugggccccucccccgggccgcccagcgucucccaccccaugcccacgaugggcagcaccgacuucccgcaggaggggaugcaccagaugcacaagcccaucgacggcauccacgacaagggcaucguggaggacauccacugcggguccaugaagggcaccgggaugcgccccccccacccgggcaugggccccccccagagccccauggaccagcacucccagggguacaugagcccgcaccccuccccccucggcgccccggagcacgugagcucccccaugagcgggggcgggcccacccccccgcagaugccccccucccagcccggcgcgcugaucccgggcgacccccaggccaugagccagcccaaccgggggcccagcccguucucccccguccagcugcaccagcuccgcgcccagauccuggccuacaagaugcuggcccggggccagccccuccccgagacgcugcagcuggcggugcaggggaagcgcacccucccgggccugcagcagcagcagcagcagcagcagcagcagcagcagcagcagcagcagcagcagcagcagcagcagcagccccagcagcagcccccccagccgcagacccagcagcagcagcagcccgcccuggugaacuacaaccggcccagcgggcccggcccggagcucuccggccccagcaccccccagaagcugccgguccccgcccccgggggccgccccuccccggccccccccgcggccgcccagcccccggccgccgcggugcccgggcccagcgugccccagccggcccccggccagcccucccccguccugcagcuccagcagaagcagagccggaucuccccgauccagaagccccaggggcuggaccccguggagauccugcaggagcgcgaguaccggcuccaggcccgcaucgcccaccggauccaggagcuggagaaccugcccggcagccucccgcccgaccugcgcacgaaggccaccguggagcugaaggcgcuccggcugcugaacuuccagcgccagcuccggcaggaggucguggccugcaugcgccgggacaccacccuggagacggcccugaacuccaaggccuacaagcgcagcaagcggcagacccuccgcgaggcccggaugaccgagaagcuggagaagcagcagaagaucgagcaggagcgcaagcgccggcagaagcaccaggaguaccugaacuccauccuccagcacgcgaaggacuucaaggaguaccaccgcagcguggccggcaagauccagaagcuguccaaggccgucgccaccuggcacgccaacacggagcgggagcagaagaaggagaccgagcgcaucgagaaggagcggaugcgccggcugauggcggaggacgaggagggguaccgcaagcucaucgaccagaagaaggaccggcgccuggccuaccugcuccagcagaccgacgaguacguggccaaccugaccaaccuggugugggagcacaagcaggcccaggcggccaaggagaagaagaagcggcgccggcgcaagaagaaggccgaggagaacgccgagggcggggagagcgcccucggccccgacggcgagcccaucgacgaguccagccagauguccgaccugccggucaaggugacgcacaccgagaccgggaaggugcuguucggccccgaggcgcccaaggccagccagcucgacgccuggcuggagaugaaccccggguacgaggucgccccgcggagcgacuccgaggagagcgacuccgacuacgaggaggaggacgaggaggaggagagcucccgccaggagaccgaggagaagauccugcucgaccccaacagcgaggagguguccgagaaggacgccaagcagaucaucgagacggcgaagcaggacguggacgacgaguacagcaugcaguacuccgcccggggcagccaguccuacuacaccgucgcccacgccaucagcgagcgcguggagaagcaguccgcccugcugaucaacgggacccugaagcacuaccagcuccagggccuggaguggauggucagccuguacaacaacaaccucaacggcauccuggcggacgagauggggcugggcaagaccauccagacgaucgcccucaucaccuaccugauggagcacaagcggcugaacgggcccuaccucaucaucgugccgcuguccacccugagcaacuggaccuacgaguucgacaagugggcccccuccguggucaagaucagcuacaagggcacgcccgccaugcgccgcagccucgugccccagcugcgguccgggaaguucaacgugcugcucaccaccuacgaguacaucaucaaggacaagcacauccuggcgaagauccgcuggaaguacaugaucgucgacgagggccaccggaugaagaaccaccacugcaagcugacccagguggaccucaacgaggaggagacgauccugaucauccgccggcugcacaaggugcuccgcccguuccugcugcggcgccucaagaaggaggucgagagccagcugcccgagaagguggaguacgugaucaagugcgacauguccgcccugcagaagauccucuaccggcacaugcaggccaagggcauccugcugaccgacgggagcgagaaggacaagaagggcaaggggggcgccaagacccucaugaacaccaucaugcagcugcgcaagaucugcaaccaccccuacauguuccagcacaucgaggaguccuucgccgagcaccugggguacagcaacggcgucaucaacggcgcggagcucuaccgggccuccgggaaguucgagcugcuggaccgcauccuccccaagcugcgggccaccaaccaccgcgugcugcucuucugccagaugacgagccugaugaccaucauggaggacuacuucgccuuccggaacuuccuguaccuccgccuggacggcaccaccaaguccgaggaccgggccgcgcugcucaagaaguucaacgagccggggagccaguacuucaucuuccugcuguccacgcgcgccggcgggcucggccugaaccugcaggccgccgacaccguggucaucuucgacagcgacuggaacccccaccaggaccuccaggcccaggaccgggcgcaccgcaucggccagcagaacgaggugcgggugcugcgccugugcaccgucaacuccguggaggagaagauccucgccgccgccaaguacaagcugaacguggaccagaaggucauccaggcggggauguucgaccagaagagcuccagccacgagcgccgggccuuccugcaggccauccucgagcacgaggaggagaacgaggaggaggacgaggugcccgacgacgagacccugaaccagaugaucgcccgccgggaggaggaguucgaccuguucaugcgcauggacauggaccggcgccgggaggacgcccgcaaccccaagcggaagccgcgccucauggaggaggacgagcugcccuccuggaucaucaaggacgacgcggagguggagcggcugacgugcgaggaggaggaggagaagaucuucggccgcgggagccggcagcgccgggacgucgacuacuccgacgcccucaccgagaagcaguggcugcgcgccaucgaggacggcaaccuggaggagauggaggaggaggugcggcucaagaagcgcaagcggcgccgcaacguggacaaggaccccgccaaggaggacgucgagaaggccaagaagcggcgcggccggcccccggcggagaagcugagccccaacccccccaagcugaccaagcagaugaacgccaucaucgacaccgugaucaacuacaaggacagcuccgggcgccagcucagcgagguguucauccagcugccgucccggaaggagcugcccgaguacuacgagcucauccgcaagcccgucgacuucaagaagaucaaggagcggauccgcaaccacaaguaccggagccugggcgaccuggagaaggacgugaugcuccugugccacaacgcccagacguucaaccuggaggggucccagaucuacgaggacagcaucgugcuccaguccgucuucaagagcgcccgccagaagaucgccaaggaggaggaguccgaggacgagagcaacgaggaggaggaggaggaggacgaggaggaguccgagagcgaggcgaaguccgugaaggugaagaucaagcugaacaagaaggacgacaagggccgggacaaggggaagggcaagaagcgccccaaccggggcaaggccaagccggucgugagcgacuucgacuccgacgaggagcaggacgagcgcgagcagagcgagggguccggcaccgacgacgaguga

SEQ ID NO: 36783 - RNA, 4944 nt, Artificial Sequence
  derived and/or modified sequence opt1 from SMARCA4__Homo_sapiens__NP_001122316
augagcacccccgacccgccccugggcgggacgccccgccccggcccgucccccgggcccggccccagcccgggggccaugcucggccccucccccggccccagcccgggguccgcccacagcaugaugggccccucccccgggcccccgagcgcgggccaccccauccccacccaggggcccggcggcuacccgcaggacaacaugcaccagaugcacaagcccauggaguccaugcacgagaaggggaugagcgacgacccccgguacaaccagaugaagggcauggggaugcgcuccggcggccacgccgggauggggcccccgcccagccccauggaccagcacucccagggcuaccccagcccgcugggcggguccgagcacgccagcucccccgugcccgccagcggcccguccagcggcccccagaugagcuccgggcccggcggggcgccccuggacggcgccgacccgcaggcccucgggcagcagaaccggggccccacccccuucaaccagaaccagcugcaccagcugcgcgcccagaucauggccuacaagaugcucgcgcggggccagccccugccggaccaccuccagauggccguccaggggaagcgccccaugcccggcaugcagcagcagaugcccacccucccgccgcccagcguguccgccaccgggcccggccccgggcccggccccggccccgggccgggccccgggcccgcgcccccgaacuacagccggccccacggcaugggcgggcccaacaugccgccgcccggccccuccggggugccgcccggcaugcccgggcagcccccgggcggcccgcccaagcccuggcccgaggggcccauggccaacgccgccgcccccacgagcacgccccagaagcugaucccgccccagcccaccggccgccccuccccggccccgcccgccgucccgcccgcggccagccccgugaugccgccccagacccagucccccgggcagcccgcccagcccgcccccauggugccccugcaccagaagcagagccggaucacccccauccagaagccccgcggccucgacccggucgagauccugcaggagcgggaguaccgccugcaggcccggaucgcgcaccgcauccaggagcucgagaaccugcccgggucccuggccggcgaccuccggaccaaggccaccaucgagcugaaggcccugcgccuccugaacuuccagcggcagcugcgccaggaggugguggucugcaugcggcgcgacaccgcccucgagacggcgcugaacgccaaggccuacaagcggagcaagcgccagucccugcgcgaggcccggaucaccgagaagcucgagaagcagcagaagaucgagcaggagcgcaagcggcgccagaagcaccaggaguaccugaacagcauccugcagcacgcgaaggacuucaaggaguaccaccgguccgugaccggcaagauccagaagcucaccaaggccguggccacguaccacgccaacaccgagcgcgagcagaagaaggagaacgagcggaucgagaaggagcgcaugcggcgccugauggccgaggacgaggagggguaccggaagcugaucgaccagaagaaggacaagcgccucgcguaccugcugcagcagaccgacgaguacgucgccaaccugaccgagcuggugcggcagcacaaggccgcccagguggccaaggagaagaagaagaagaagaagaagaagaaggcggagaacgccgagggccagacgcccgccaucgggcccgacggcgagccccuggacgagaccagccagauguccgaccuccccgucaaggugauccacguggagagcgggaagauccugaccggcaccgacgcccccaaggccggccagcuggaggcguggcucgagaugaaccccggguacgaggucgccccgcgcuccgacagcgaggagagcggcuccgaggaggaggaggaggaggaggaggaggagcagccccaggccgcccagccgcccacgcugcccguggaggagaagaagaagauccccgaccccgacagcgacgacguguccgaggucgacgcgcggcacaucaucgagaacgccaagcaggacguggacgacgaguacggggugagccaggcccuggcccgcggccuccaguccuacuacgccgucgcgcacgccgugaccgagcgggucgacaagcagagcgcccugauggugaacggggugcugaagcaguaccagaucaagggccucgaguggcuggucucccuguacaacaacaaccugaacggcauccucgccgacgagauggggcugggcaagaccauccagaccaucgcccugaucacguaccucauggagcacaagcgcaucaacgggcccuuccugaucaucgugccgcugagcacccucuccaacugggcguacgaguucgacaagugggcccccagcguggucaagguguccuacaagggcagccccgccgcccggcgcgccuucgugccccagcugcgcuccggcaaguucaacguccugcucaccaccuacgaguacaucaucaaggacaagcacauccuggcgaagauccgguggaaguacaugaucguggacgaggggcaccgcaugaagaaccaccacugcaagcugacccaggugcucaacacgcacuacgucgccccgcggcgccugcugcucaccggcacgccccugcagaacaagcugcccgagcucugggcccugcugaacuuccuccugcccaccaucuucaagagcugcuccaccuucgagcagugguucaacgccccguucgcgaugaccggggagaagguggaccugaacgaggaggagaccauccucaucauccggcgccugcacaaggugcugcggcccuuccuccugcgccggcugaagaaggaggucgaggcccagcuccccgagaagguggaguacgugaucaagugcgacaugagcgcccugcagcgcguccuguaccggcacaugcaggccaagggcgugcuccugaccgacggguccgagaaggacaagaagggcaagggcgggacgaagacccugaugaacaccaucaugcagcuccgcaagaucugcaaccacccguacauguuccagcacaucgaggagagcuucagcgagcaccugggcuucaccgggggcaucgugcaggggcuggaccucuaccgggccuccggcaaguucgagcugcuggaccgcauccuccccaagcugcgggcgacgaaccacaagguccuccuguucugccagaugaccagccugaugaccaucauggaggacuacuucgccuaccgcggcuucaaguaccugcggcucgacgggaccacgaaggccgaggaccgcggcaugcugcugaagaccuucaacgagcccggguccgaguacuucaucuuccuccugagcacccgggccggcgggcugggccucaaccugcaguccgccgacaccgugaucaucuucgacagcgacuggaacccccaccaggaccugcaggcgcaggaccgcgcccaccggaucggccagcagaacgaggugcgcguccuccgccugugcacggugaacuccguggaggagaagauccuggccgccgccaaguacaagcucaacgucgaccagaaggugauccaggcggggauguucgaccagaaguccagcagccacgagcggcgcgccuuccugcaggccauccuggagcacgaggagcaggacgagucccggcacugcagcaccggcuccgggagcgccuccuucgcccacaccgcgccgccgcccgccggcgugaaccccgaccucgaggagccgccccugaaggaggaggacgagguccccgacgacgagaccgugaaccagaugaucgcccgccacgaggaggaguucgaccuguucaugcggauggaccucgaccgccggcgcgaggaggcccggaaccccaagcgcaagccccggcugauggaggaggacgagcugcccagcuggaucaucaaggacgacgcggagguggagcgccucacgugcgaggaggaggaggagaagauguucggccgggggucccgccaccggaaggaggucgacuacagcgacucccugaccgagaagcaguggcugaaggccaucgaggagggcacccucgaggagaucgaggaggaggugcgccagaagaaguccagccggaagcgcaagcgggacagcgacgccgggagcuccacccccacgaccagcacccgcucccgcgacaaggacgacgagagcaagaagcagaagaagcggggccggcccccggccgagaagcugucccccaacccgcccaaccugaccaagaagaugaagaagaucguggacgccgucaucaaguacaaggacagcuccagcgggcgccagcucuccgagguguucauccagcugcccagccgcaaggagcugcccgaguacuacgagcucauccggaagcccguggacuucaagaagaucaaggagcgcauccggaaccacaaguaccgcucccugaacgaccuggagaaggacgucaugcuccugugccagaacgcgcagacguucaaccuggagggcagccucaucuacgaggacuccaucgugcugcagagcguguucaccuccguccggcagaagaucgagaaggaggacgacagcgagggcgaggaguccgaggaggaggaggagggggaggaggagggcagcgagagcgagucccgcagcgugaaggugaagaucaagcuggggcggaaggagaaggcccaggaccgccucaagggcgggcggcgccggcccucccgcggcagccgggccaagccggucguguccgacgacgacagcgaggaggagcaggaggaggaccgcuccggcagcggguccgaggaggacuga

SEQ ID NO: 36784 - RNA, 3159 nt, Artificial Sequence
  derived and/or modified sequence opt1 from SMARCA5__Homo_sapiens__NP_003592
augagcuccgccgccgagcccccgcccccgccgccgcccgagagcgcgcccuccaagcccgccgccagcaucgccuccggcgggagcaacuccagcaacaagggcgggcccgagggcguggccgcgcaggccgucgccuccgccgcgagcgccgggcccgccgacgccgagauggaggagaucuucgacgacgccucccccggcaagcagaaggagauccaggagcccgaccccaccuacgaggagaagaugcagaccgaccgcgcgaaccgguucgaguaccugcucaagcagacggagcuguucgcccacuucauccagcccgccgcccagaagacccccaccagcccccugaagaugaagccgggccgcccccggaucaagaaggacgagaagcagaaccuccuguccgugggggacuaccgccaccggcgcaccgagcaggaggaggacgaggagcugcucacggagagcuccaaggccaccaacgugugcacccgguucgaggacagccccuccuacgucaaguggggcaagcugcgcgacuaccaggugcgggggcugaacuggcucaucagccuguacgagaacggcaucaacgggauccuggcggacgagaugggccucggcaagacccugcagacgaucucccugcucggguacaugaagcacuaccgcaacauccccggcccgcacauggugcugguccccaagagcacccugcacaacuggaugagcgaguucaagcggugggugcccacccuccgcuccgugugccugaucggggacaaggagcagcgggccgccuucguccgcgacgugcugcuccccggcgagugggacgugugcgucaccagcuacgagaugcugaucaaggagaaguccguguucaagaaguucaacuggcgguaccuggugaucgacgaggcccaccgcaucaagaacgagaaguccaagcucuccgagaucguccgggaguucaagacgaccaaccgccugcugcucaccggcaccccgcugcagaacaaccugcacgagcucuggagccugcugaacuuccuccugcccgacguguucaacagcgccgacgacuucgacagcugguucgacacgaacaacugccugggggaccagaagcucguggagcggcugcacaugguccugcgccccuuccuccugcggcgcaucaaggcggacguggagaagucccugcccccgaagaaggaggugaagaucuacgucggccucagcaagaugcagcgcgagugguacacccggauccugaugaaggacaucgacauccugaacuccgccgggaagauggacaagaugcgccuccugaacauccugaugcagcuccggaagugcugcaaccaccccuaccuguucgacggcgccgagcccgggccgcccuacaccaccgacaugcaccuggugacgaacagcggcaagauggugguccuggacaagcuccugcccaagcugaaggagcagggcucccgcgugcucaucuucagccagaugacccggguccuggacauccuggaggacuacugcauguggcgcaacuacgaguacugccggcucgacgggcagacgccccacgacgagcgccaggacuccaucaacgccuacaacgagccgaacagcaccaaguucguguucaugcuguccacccgggccggcgggcugggcaucaaccucgcgaccgccgacguggucauccuguacgacagcgacuggaacccccagguggaccugcaggccauggaccgcgcccaccggaucgggcagaccaagaccgugcgcgucuuccgguucaucacggacaacaccguggaggagcgcaucguggagcgggcggagaugaagcuccgccuggacuccaucgucauccagcagggccggcugguggaccagaaccucaacaagaucggcaaggacgagaugcugcagaugauccgccacggggccacccacguguucgccagcaaggagagcgagaucaccgacgaggacaucgacggcauccuggagcgcggggccaagaagacggccgagaugaacgagaagcucuccaagaugggcgagagcucccugcggaacuucaccauggacaccgagagcuccgucuacaacuucgagggggaggacuaccgcgagaagcagaagaucgcguucaccgaguggaucgagccgcccaagcgggagcgcaaggccaacuacgccguggacgccuacuuccgggaggcccugcgcgugagcgagcccaaggcgcccaaggcgccccggcccccgaagcagcccaacguccaggacuuccaguucuucccgccccgccucuucgagcugcuggagaaggagauccucuucuaccggaagacgaucggcuacaaggugccccgcaaccccgagcugcccaacgccgcccaggcccagaaggaggagcagcugaagaucgacgaggccgagucccucaacgacgaggagcuggaggagaaggagaagcugcucacccagggcuucaccaacuggaacaagcgggacuucaaccaguucaucaaggccaacgagaagugggggcgcgacgacaucgagaacaucgcccgggagguggagggcaagacccccgaggaggucaucgaguacagcgccguguucugggagcgcugcaacgagcugcaggacaucgagaagaucauggcgcagaucgagcgcggggaggcccggauccagcggcgcaucuccaucaagaaggcccuggacaccaagaucggccgguacaaggccccguuccaccagcuccgcaucagcuacggcacgaacaaggggaagaacuacaccgaggaggaggaccgguuccugaucugcaugcugcacaagcucggcuucgacaaggagaacguguacgacgagcugcgccagugcauccggaacagcccccaguuccgcuucgacugguuccucaagucccgcaccgccauggagcugcagcggcgcugcaacacccugaucacgcugaucgagcgggagaacauggagcucgaggagaaggagaaggcggagaagaagaagcgcgggcccaagcccuccacccagaagcggaagauggacggcgccccggacgggcgcggccggaagaagaagcugaagcuguga

SEQ ID NO: 36785 - RNA, 3087 nt, Artificial Sequence
  derived and/or modified sequence opt1 from SMARCAD1__Homo_sapiens__NP_001121901
augaaccuguucaaccucgaccgcuuccgguucgagaagcgcaacaagaucgaggaggcccccgaggccaccccgcagcccagccagcccggccccuccagcccgaucucccugagcgcggaggaggagaacgccgagggggaggugucccgggccaacacccccgacagcgacaucacggagaagaccgaggacuccagcguccccgagacccccgacaacgagcgcaaggccuccaucagcuacuucaagaaccagcggggcauccaguacaucgaccuguccagcgacuccgaggacguggugagcccgaacugcuccaacaccguccaggagaagacguucaacaaggacaccgugaucaucgugagcgagcccuccgaggacgaggagagccaggggcuccccaccauggcccgccggaacgacgacaucuccgagcuggaggaccugagcgagcucgaggaccugaaggacgcgaagcugcagacccucaaggagcuguucccccagcgcagcgacaacgaccugcucaagcugaucgaguccacgagcaccauggacggcgccaucgccgccgcgcugcucauguucggggacgccggcggcgggccgcggaagcgcaagcuguccagcuccagcgagcccuacgaggaggacgaguucaacgacgaccaguccaucaagaagacccggcuggaccacggcgaggagagcaacgaguccgccgagagcuccagcaacugggagaagcaggaguccaucguccucaagcugcagaaggaguuccccaacuucgacaagcaggagcugcgcgaggugcucaaggagcacgaguggauguacaccgaggcccuggagagccugaagguguucgccgaggaccaggacaugcaguacgucucccagagcgaggugcccaacgggaaggagguguccagccggucccagaacuacccgaagaacgcgacgaagaccaagcucaagcagaaguucagcaugaaggcccagaacggcuucaacaagaagcgcaagaagaacgucuucaaccccaagcgggugguggaggacagcgaguacgacuccgggagcgacgucggcuccagccuggacgaggacuacuccagcggcgaggaggugauggaggacggguacaagggcaagauccugcacuuccuccaggacgccuccaucggggagcugacccugaucccccagugcagccagaagaaggcccagaagaucaccgagcuccgccccuucaacuccugggaggcccuguucacgaagaugagcaagaccaacggccuguccgaggaccucaucuggcacugcaagacccugauccaggagcgggacguggucauccgccugaugaacaagugcgaggacaucagcaacaagcucaccaagcaggucacgaugcugaccggcaacgggggcggguggaacaucgagcagccguccauccugaaccagagccucucccugaagcccuaccagaaggugggccugaacuggcucgcgcuggugcacaagcacgggcugaacggcauccucgccgacgagaugggccuggggaagaccauccaggccaucgccuuccuggccuaccucuaccaggagggcaacaacgggccccaccugaucguggugcccgcgagcaccaucgacaacuggcugcgggaggucaaccuguggugcccgacgcucaaggugcugugcuacuacggcucccaggaggagcgcaagcagauccgguucaacauccacagccgcuacgaggacuacaacgucaucgugaccaccuacaacugcgccaucagcuccagcgacgaccgcucccuguuccggcgccucaagcugaacuacgccaucuucgacgaggggcacaugcugaagaacaugggcagcauccgguaccagcaccucaugaccaucaacgccaacaaccgccugcugcucacgggcacccccgugcagaacaaccugcuggagcucaugucccugcugaacuucgucaugccccacauguucagcuccagcaccuccgagauccggcgcauguucagcuccaagaccaagagcgccgacgagcaguccaucuacgagaaggagcggaucgcgcacgccaagcagaucaucaagcccuucauccuccgccgggugaaggaggaggugcugaagcagcugccgcccaagaaggaccgcaucgagcucugcgccaugagcgagaagcaggagcagcuguaccugggccucuucaaccggcugaagaaguccaucaacaaccuggucacggagaagaacaccgagaugugcaacgugaugaugcagcuccgcaagauggccaaccacccccugcugcaccggcaguacuacaccgcggagaagcucaaggagaugagccagcugaugcugaaggagccgacccacugcgaggccaaccccgaccucaucuucgaggacauggaggugaugacggacuucgagcugcacguccugugcaagcaguaccgccacaucaacaacuuccagcucgacauggaccugauccuggacuccgggaaguuccgggugcucgggugcauccugagcgagcugaagcagaagggcgaccgcgugguccucuucucccaguucaccaugaugcuggacauccuggaggugcuccugaagcaccaccagcaccgguaccugcgccucgacgggaagacccagaucagcgagcggauccaccugaucgacgaguucaacaccgacauggacaucuucguguuccugcucagcaccaaggccggcggccuggggaucaaccugacguccgccaacgucgugauccuccacgacaucgacugcaaccccuacaacgacaagcaggccgaggaccgcugccaccgcgugggccagaccaaggagguccuggugaucaagcugaucagccaggggaccaucgaggaguccaugcucaagaucaaccagcagaagcugaagcuggagcaggacaugaccacgguggacgagggcgacgagggcagcaugcccgcggacaucgccacccuccugaagaccuccauggggcuguga

SEQ ID NO: 36786 - RNA, 2865 nt, Artificial Sequence
  derived and/or modified sequence opt1 from SMARCAL1__Homo_sapiens__XP_005246688
augagccugccccucaccgaggagcagcgcaagaagaucgaggagaaccggcagaaggcccuggcccgccgggcggagaagcugcucgccgagcagcaccagcgcaccuccagcggcacguccaucgccgggaacccguuccaggccaagcagggccccagccagaacuucccccgggaguccugcaagcccgugagccacggggucaucuucaagcagcagaaccuguccagcuccagcaacgccgaccagcgcccgcacgacucccacagcuuccaggcgaagggcaucuggaagaagcccgaggagaugcccaccgccugccccgggcacuccccgcggagccagauggcccugaccggcaucuccccgccccucgcccagagcccgcccgaggugcccaagcagcagcugcuguccuacgagcucggccaggggcacgcgcaggccagccccgagauccgcuucacccccuucgccaaccccacgcacaagccccuggccaagcccaaguccagccaggagacccccgcccacagcuccggccagccgccccgggacgcgaagcuggaggccaagaccgccaaggccagccccuccgggcagaacaucagcuacauccacuccagcuccgagagcgugacgccccgcaccgagggccggcuccagcagaaguccgggagcuccguccagaagggcgugaacagccagaagggcaagugcgugcgcaacggggaccgguuccagguccugaucggcuacaacgccgagcugaucgcgguguucaagacccucccguccaagaacuacgaccccgacaccaagaccuggaacuucagcaugaacgacuacuccgcccugaugaaggccgcccagagccugcccacggugaaccuccagccccuggagugggccuacggguccagcgaguccccgagcaccagcuccgagggccaggcgggccugcccagcgcccccucccucagcuucgucaaggggcgcugcaugcugaucucccgggccuacuucgaggccgacaucagcuacucccaggaccugaucgcccucuucaagcagauggacagccgccgguacgacgugaagacccgcaagugguccuuccugcuggaggagcacagcaagcucaucgcgaaggugcggugccugccgcagguccagcuggacccccuccccaccacgcugacccuggccuucgccucccagcucaagaagaccagccugucccugacccccgacgugccggaggccgaccucagcgagguggaccccaagcuggucuccaaccugaugcccuuccagcgcgcgggcgugaacuucgccaucgccaagggcgggcggcuccugcuggccgacgacauggggcucggcaagacgauccaggccaucugcaucgcggccuucuaccgcaaggaguggccccugcugguggucgugccgagcuccgugcgcuucaccugggagcaggccuuccuccgguggcugcccagccugagccccgacugcaucaacgucguggugaccggcaaggaccgccucaccgccgggcugaucaacaucgucuccuucgaccugcugagcaagcucgagaagcagcugaagacgcccuucaagguggucaucaucgacgagucccacuuccugaagaacagccggaccgcccgcugccgggcggccaugccggugcucaagguggccaagcgcgucauccugcuguccggcacccccgccaugagccggcccgccgagcucuacacccagaucaucgcggugaagcccacguucuucccgcaguuccacgccuucgggcugcgcuacugcgacgccaagcggaugcccuggggcugggacuacuccgggagcuccaaccugggcgagcucaagcugcugcucgaggaggccgugaugcugcgccggcucaagagcgacguccugucccagcugcccgcgaagcagcgcaagaucguggugaucgcccccggccggaucaacgcccgcacccgggccgcccuggacgcggccgccaaggagaugaccaccaaggacaagacgaagcagcagcagaaggacgcccucauccuguucuucaaccgcaccgccgaggcgaagaucccgagcgucaucgaguacauccuggaccuccuggaguccgggcgggagaaguuccugguguucgcccaccacaaggugguccucgacgccaucacccaggagcuggagcgcaagcacgugcagcacauccggaucgacggcagcaccuccagcgccgagcgcgaggaccugugccagcaguuccagcucuccgagcgccacgccguggcgguccugagcaucacggccgccaacauggggcugaccuucuccagcgccgaccucgugguguucgcggagcuguucuggaaccccggcguccugauccaggccgaggaccgggugcaccgcaucgggcagaccagcuccgugggcauccacuaccucgucgccaagggcaccgccgacgacuaccuguggccccugauccaggagaagaucaaggugcucgccgaggcggggcugagcgagaccaacuucuccgagaugacggagagcaccgacuaccuguacaaggaccccaagcagcagaagaucuacgaccucuuccagaaguccuucgagaaggagggcagcgacauggagcugcuggaggccgccgaguccuucgacccggggagcgccuccggcaccagcggcuccagcucccagaacaugggggacacccucgacgagagcucccugacggccagcccccagaagaagcggcgcuucgaguucuucgacaacugggacuccuucaccagcccccuguga

SEQ ID NO: 36787 - RNA, 1131 nt, Artificial Sequence
  derived and/or modified sequence opt1 from SMARCB1__Homo_sapiens__NP_001007469
augaugaugauggcccugagcaagaccuucggccagaagcccgugaaguuccagcucgaggacgacggggaguucuacaugaucggcuccgaggucgggaacuaccugcgcauguuccggggcagccuguacaagcgcuacccgucccucuggcggcgccuggccaccguggaggagcggaagaagaucguggcgagcucccacgaccacggguacacgacccuggccaccagcgucacccuccugaaggccuccgagguggaggagauccuggacggcaacgacgagaaguacaaggccgugagcaucuccacggagccgcccaccuaccuccgcgagcagaaggccaagcggaacagccaguggguccccacccugcccaacuccagccaccaccuggacgcggugcccugcuccaccacgaucaaccgcaaccggaugggccgcgacaagaagcggaccuucccccucugcuucgacgaccacgaccccgccgugauccacgagaacgccagccagccggagguccuggugcccauccgccuggacauggagaucgacgggcagaagcuccgggacgccuucaccuggaacaugaacgagaagcugaugacccccgagauguucuccgagauccugugcgacgaccucgaccugaacccccugacguucgugccggcgaucgccagcgccauccgccagcagaucgaguccuaccccaccgacagcauccucgaggaccaguccgaccagcgggucaucaucaagcugaacauccacgugggcaacaucagccugguggaccaguucgagugggacaugagcgagaaggagaacucccccgagaaguucgcccucaagcugugcagcgagcuggggcucggcggggaguucgucaccaccaucgccuacuccauccgcggccagcugagcuggcaccagaagacguacgcguucuccgagaacccccugccgaccguggagaucgccauccggaacaccggcgacgccgaccaguggugcccccuccuggagacccugacggacgccgagauggagaagaagauccgcgaccaggaccggaacacccgccggaugcgccgccucgccaacaccgcgcccgccugguga

SEQ ID NO: 36788 - RNA, 3318 nt, Artificial Sequence
  derived and/or modified sequence opt1 from SMARCC1__Homo_sapiens__NP_003065
auggccgccgcggccggcgggggcgggcccggcaccgccgugggggccaccggcagcggcaucgccgcggccgccgccgggcuggcggucuaccgccggaaggacggcgggcccgccaccaaguucugggagucccccgagaccgugagccagcucgacuccgugcgcgucuggcugggcaagcacuacaagaaguacgugcacgccgacgcccccaccaacaagacccuggccgggcucgugguccagcugcugcaguuccaggaggacgcguucggcaagcacgugacgaaccccgccuucaccaagcuccccgccaagugcuucauggacuucaaggccggcggggcccugugccacauccugggcgcggccuacaaguacaagaacgagcagggguggcggcgcuucgaccuccagaaccccagccggauggaccgcaacguggagauguucaugaacaucgagaagacccugguccagaacaacugccugacccggcccaacaucuaccucauccccgacaucgaccugaagcuggccaacaagcucaaggacaucaucaagcgccaccagggcacguucaccgacgagaaguccaaggccagccaccacaucuaccccuacuccagcucccaggacgacgaggaguggcugcggcccgugaugcgcaaggagaagcagguccugguccacuggggcuucuaccccgacagcuacgacaccugggugcacuccaacgacguggacgccgagaucgaggacccgcccauccccgagaagcccuggaagguccacgugaaguggauccucgacaccgacaucuucaacgaguggaugaacgaggaggacuacgagguggacgagaaccggaagcccgucagcuuccgccagcggaucuccacgaagaacgaggagccggugcgcagccccgagcggcgcgaccggaaggcguccgccaacgcccgcaagcggaagcacagccccagcccgcccccgcccacccccaccgagucccgcaagaaguccgggaagaagggccaggccagccuguacgggaagcggcgcagccagaaggaggaggacgagcaggaggaccugaccaaggacauggaggaccccacgcccguccccaacaucgaggagguggugcuccccaagaacgugaaccugaagaaggacuccgagaacacccccgucaagggcgggaccguggccgaccuggacgagcaggacgaggagaccgucacggcgggcggcaaggaggacgaggaccccgccaagggggaccagagccgcuccguggaccucggcgaggacaacgugaccgagcagaccaaccacaucaucauccccagcuacgccuccugguucgacuacaacugcauccacgucaucgagcggcgcgcccugccggaguucuucaacgggaagaacaagagcaagacccccgagaucuaccuggcguaccggaacuucaugaucgacacguaccgccucaacccccaggaguaccugaccuccaccgccugccggcgcaaccugaccggcgacgugugcgccgugaugcggguccacgccuuccucgagcagugggggcuggugaacuaccagguggaccccgagagccgcccgauggccaugggcccgccgcccacgccccacuucaacguccuggcggacacccccuccggccucgugccccugcaccuccggagcccccaggugcccgccgcccagcagaugcugaacuuccccgagaagaacaaggagaagcccgucgaccugcagaacuucgggcugcgcaccgacaucuacuccaagaagacccucgccaagagcaagggcgccuccgcggggcgggaguggacggagcaggagacccugcugcuccuggaggcccuggagauguacaaggacgacuggaacaaggugagcgagcacgugggcucccgcacccaggacgagugcauccuccacuuccugcggcugcccaucgaggacccguaccucgagaacagcgacgccucccuggggccccuggccuaccagcccguccccuucagccaguccggcaacccggugaugagcaccguggccuuccuggcgagcgucguggacccccgcguggccuccgccgccgcgaaggccgcccucgaggaguucagccggguccgcgaggaggugccccuggagcugguggaggcccacgucaagaaggugcaggaggccgcgcgggccuccggcaagguggaccccacguacgggcucgagagcuccugcaucgccggcaccgggccggacgagcccgagaagcuggagggcgccgaggaggagaagauggaggccgaccccgacggccagcagccggagaaggcggagaacaaggucgagaacgagaccgacgagggggacaaggcccaggacggcgagaacgagaagaacagcgagaaggagcaggacuccgaggugagcgaggacaccaaguccgaggagaaggagaccgaggagaacaaggagcugacggacacgugcaaggagcgcgagagcgacaccgggaagaagaagguggagcacgagaucuccgagggcaacgucgccaccgccgccgcggccgcccucgccagcgcggccaccaaggccaagcaccuggccgccguggaggagcggaagaucaagucccugguggcgcuccuggucgagacccagaugaagaagcuggagaucaagcuccgccacuucgaggagcuggagaccaucauggaccgcgagaaggaggcccuggagcagcagcggcagcagcuccugaccgagcgccagaacuuccacauggagcagcugaaguacgccgagcuccgggcccgccagcagauggagcagcagcagcacgggcagaacccccagcaggcccaccagcacagcggcggccccgggcuggcgccccugggcgccgccgggcacccgggcaugaugccccaccagcagcccccgcccuacccccucaugcaccaccagaugccgccgccccacccgccccagcccgggcagauccccggccccggcuccaugaugcccgggcagcacaugcccggccggaugauccccacgguggccgccaacauccaccccagcggguccggccccacgcccccggggaugccgcccaugcccggcaacauccugggcccccgcgugccccugaccgcgcccaacgggauguacccgcccccgccccagcagcagccgccgcccccgccgcccgccgacggcgugcccccgccgcccgcccccgggccgcccgccagcgccgcgcccuga

SEQ ID NO: 36789 - RNA, 3459 nt, Artificial Sequence
  derived and/or modified sequence opt1 from SMARCC2__Homo_sapiens__NP_001123892
auggccgugcgcaagaaggacggcgggcccaacgucaaguacuacgaggccgcggacaccgugacccaguucgacaacgugcggcuguggcucggcaagaacuacaagaaguacauccaggccgagccgcccacgaacaagagccuguccagccuggucgugcagcuccugcaguuccaggaggagguguucgggaagcacgucuccaacgccccccugaccaagcuccccaucaagugcuuccuggacuucaaggccggcgggagccugugccacauccucgccgcggccuacaaguucaaguccgaccagggcuggcgccgguacgacuuccagaacccgagccgcauggaccggaacguggagauguucaugaccaucgagaagucccuggugcagaacaacugccugagccgccccaacaucuuccucugccccgagaucgagcccaagcugcugggcaagcucaaggacaucaucaagcggcaccaggggaccgucacggaggacaagaacaacgccucccacgugguguacccgguccccggcaaccuggaggaggaggagugggugcgccccgugaugaagcgggacaagcagguccugcuccacuggggguacuaccccgacagcuacgacaccuggaucccggccuccgagaucgaggcgagcguggaggacgcccccacccccgagaagccccgcaaggugcacgccaaguggauccuggacaccgacacguucaacgaguggaugaacgaggaggacuacgaggucaacgacgacaagaacccggugucccggcgcaagaagaucagcgccaagacccugaccgacgaggugaacucccccgacagcgaccggcgcgacaagaagggcgggaacuacaagaagcggaagcgcucccccagccccuccccgacccccgaggccaagaagaagaacgcgaagaagggccccagcacgcccuacaccaagagcaagcggggccaccgcgaggaggagcaggaggaccucaccaaggacauggacgagccgucccccguccccaacguggaggaggugacccugcccaagacggucaacaccaagaaggacagcgaguccgccccggugaaggggggcaccaugaccgaccuggacgagcaggaggacgagagcauggagacgaccgggaaggacgaggacgagaacuccaccggcaacaagggcgagcagaccaagaaccccgaccuccacgaggacaacgucacggagcagacccaccacaucaucauccccagcuacgccgccugguucgacuacaacuccgugcacgccaucgagcggcgcgcgcugccggaguucuucaacgggaagaacaagagcaagacccccgagaucuaccuggccuaccggaacuucaugaucgacaccuaccgccucaacccccaggaguaccugacguccaccgccugccgccggaaccuggccggcgacgugugcgccaucaugcgcguccacgcguuccucgagcagugggggcugaucaacuaccagguggacgccgagagccggcccaccccgaugggccccccccccaccucccacuuccacgugcuggccgacacgccgagcgggcucgucccccugcagcccaagaccccccagggccgccagguggacgccgacaccaaggccggccggaaggggaaggagcuggacgaccucgugccggagaccgcgaagggcaagcccgagcugcagacguccgccagccagcagaugcugaacuuccccgacaaggggaaggagaagcccaccgacaugcagaacuucggccuccgcaccgacauguacaccaagaagaacgucccguccaagagcaaggccgccgcguccgccacccgggaguggacggagcaggagacccugcugcuccuggaggcccuggagauguacaaggacgacuggaacaaggugagcgagcacguggggucccgcacccaggacgagugcauccuccacuuccugcggcugcccaucgaggaccccuaccucgaggacagcgaggccagccugggcccccuggccuaccagccgauccccuucucccagagcggcaaccccgucauguccaccguggcguuccuggccagcguggucgacccccgcguggccuccgccgccgcgaagagcgcccucgaggaguucuccaagaugaaggaggaggugccgacggcccuggucgaggcccacgugcggaagguggaggaggccgcgaaggucaccgggaaggccgaccccgccuucggccuggagagcuccgggaucgccggcaccaccagcgacgagcccgagcgcaucgaggaguccgggaacgacgaggcgcggguggagggccaggccacggacgagaagaaggagccgaaggagccccgcgagggcgggggcgccaucgaggaggaggccaaggagaagaccagcgaggcccccaagaaggacgaggagaaggggaaggagggcgacuccgagaaggagagcgagaaguccgacggcgaccccaucguggacccggagaaggagaaggagcccaaggaggggcaggaggagguccucaaggaggugguggagagcgagggcgagcggaagaccaaggucgagcgcgacaucggggagggcaaccuguccaccgcggccgccgccgcccuggcggccgccgccgugaaggccaagcaccucgcggccguggaggagcggaagaucaagagccuggucgcccugcucguggagacgcagaugaagaagcuggagaucaagcugcgccacuucgaggagcucgagaccaucauggaccgggagcgcgaggcccuggaguaccagcgccagcagcugcucgcggaccggcaggccuuccacauggagcagcugaaguacgccgagaugcgcgcccggcagcagcacuuccagcagaugcaccagcagcagcagcagccccccccggcccugccccccgggagccagcccaucccgcccaccggcgcggccggcccccccgccgugcacgggcucgccgucgccccggcguccguggugcccgcccccgccggcagcggggcccccccgggcucccuggggcccagcgagcagaucggccaggccggcuccaccgcggggccccagcagcagcagcccgccggcgccccgcagcccggggccgucccccccggcgugccgccccccgggccgcacggccccagccccuuccccaaccagcagacgccgcccuccaugaugcccggcgccgugcccgggagcggccacccgggggucgcggcccagucccccgccaucguggccgcggugcagggcaaccugcuccccagcgccuccccccugccggaccccgggaccccccugcccccggaccccaccgcccccagccccggcaccgucacgccggugccccccccccaguga

SEQ ID NO: 36790 - RNA, 1548 nt, Artificial Sequence
  derived and/or modified sequence opt1 from SMARCD1__Homo_sapiens__NP_003067
auggccgcccgcgcgggcuuccagagcguggcccccuccgggggcgccggggccagcggcggggccggcgcggccgccgcccugggccccgggggcacccccgggccgcccguccggaugggcccggcgcccgggcagggccucuaccgcucccccaugcccggcgccgccuacccgcggcccgggaugcugcccggcagccgcaugacgccccaggggccguccaugggcccgcccggcuacgggggcaaccccagcgugcggcccgggcuggcccaguccggcauggaccagagccgcaagcggcccgcgccccagcagauccagcagguccagcagcaggccgugcagaaccgcaaccacaacgccaagaagaagaagauggccgacaagauccucccccagcggauccgcgagcuggugccggagucccaggccuacauggaccugcucgccuucgagcggaagcuggaccagaccaucaugcgcaagcggcuggacauccaggaggcgcucaagcgccccaucaagcagaagcggaagcugcgcaucuucaucagcaacaccuucaaccccgccaaguccgacgccgaggacggggagggcaccguggccagcugggagcugcgggucgagggccgccuccuggaggacuccgcccugagcaaguacgacgcgaccaagcagaagcggaaguucuccagcuucuucaagucccucgugaucgagcuggacaaggaccuguacgggcccgacaaccaccucguggaguggcaccgcacggccaccacccaggagaccgacggcuuccaggucaagcggccgggggacgugaacgugcgcugcacgguccugcugaugcucgacuaccagccgccccaguucaagcuggacccccgccuggcccggcuccugggcauccacacccagacccgccccgugaucauccaggcccuguggcaguacaucaagacccacaagcuccaggacccccacgagcgggaguucgugaucugcgacaaguaccugcagcagaucuucgagagccagcgcaugaaguucuccgagaucccccagcggcugcacgcccuccugaugccgcccgagcccaucaucaucaaccacgucaucagcguggaccccaacgaccagaagaagacggcgugcuacgacaucgacguggaggucgacgacacccugaagacccagaugaacagcuuccuccuguccaccgccagccagcaggagaucgccacgcuggacaacaagauccacgagaccaucgagaccaucaaccagcucaagacccagcgcgaguucaugcuguccuucgcccgggacccgcagggguucaucaacgacuggcugcagagccagugccgcgaccucaagacgaugaccgacguggugggcaaccccgaggaggagcggcgcgcggaguucuacuuccagcccugggcccaggaggccgucugccgguacuucuacuccaaggugcagcagcgccggcaggagcuggagcaggcccugggcauccgcaacaccuga

SEQ ID NO: 36791 - RNA, 1452 nt, Artificial Sequence
  derived and/or modified sequence opt1 from SMARCD3__Homo_sapiens__NP_001003801
auggccgccgacgagguggcgggcggggcccgcaaggccaccaagagcaagcuguucgaguuccucguccacggcgugcggcccgggaugccguccggcgcccgcaugccccaccagggggcccccauggggcccccgggcagccccuacaugggcucccccgcggugcggcccggccuggccccggccgggauggagcccgcccgcaagcgggcggccccgccgcccggccagagccaggcccagucccaggggcagcccguccccaccgcccccgcccgcagccgguccgcgaagcgccggaagauggccgacaagauccugccccagcgcauccgggagcucgugcccgagagccaggccuacauggaccugcuggccuucgagcgcaagcucgaccagacgaucaugcggaagcgcguggacauccaggaggcccugaagcggcccaugaagcagaagcgcaagcugcggcucuacaucuccaacaccuucaaccccgcgaagccggacgccgaggacagcgacggcuccaucgccagcugggagcugcgcgucgagggcaagcugcucgacgaccccuccaagcagaagcggaaguucagcuccuucuucaagagccuggugaucgagcuggacaaggaccucuacgggcccgacaaccaccugguggaguggcaccgcacccccaccacgcaggagaccgacggcuuccaggucaagcggccgggggaccuguccgugcgcugcacccuccugcugaugcucgacuaccagccgccccaguucaagcuggacccccgccuggcccggcuccugggccugcacacccagagccgcuccgccaucgugcaggcgcucuggcaguacgucaagacgaaccggcugcaggacagccacgacaaggaguacaucaacggcgacaaguacuuccagcagaucuucgacugcccccgccugaaguucagcgagaucccccagcggcucaccgcccugcugcugcccccggaccccaucgugaucaaccacgugaucuccgucgaccccagcgaccagaagaagaccgccugcuacgacaucgacguggagguggaggagccccucaaggggcagauguccagcuuccugcucuccaccgccaaccagcaggagaucagcgcccuggacuccaagauccacgagacgaucgagagcaucaaccagcugaagauccagcgcgacuucaugcucuccuucagccgggacccgaagggcuacguccaggaccugcugcgcucccagagccgggaccucaaggugaugaccgacguggcggggaaccccgaggaggagcgccgggccgaguucuaccaccagcccuggucccaggaggccgucagccgcuacuucuacugcaagauccagcagcggcgccaggagcuggagcagucccugguggugcggaacaccuga

SEQ ID NO: 36792 - RNA, 1236 nt, Artificial Sequence
  derived and/or modified sequence opt1 from SMARCE1__Homo_sapiens__NP_003070
augagcaagcgccccuccuacgccccgccgcccacccccgcccccgcgacccagaugcccagcacgcccggcuucgugggguacaaccccuacucccaccuggccuacaacaacuaccggcucggcgggaacccgggcaccaacagccgcgucaccgccuccagcgggaucaccauccccaagccgcccaagccgcccgacaagccccugaugcccuacaugcgguacucccgcaaggugugggaccaggugaaggccagcaaccccgaccugaagcucugggagaucggcaagaucaucggcgggauguggcgggaccugacggacgaggagaagcaggaguaccugaacgaguacgaggccgagaagaucgaguacaacgaguccaugaaggcguaccacaacagccccgccuaccucgccuacaucaacgccaagucccgcgcggaggccgcccuggaggaggagagccggcagcgccagucccggauggagaagggcgagcccuacaugagcauccagcccgccgaggacccggacgacuacgacgacggguucuccaugaagcacaccgccaccgcgcgcuuccagcggaaccaccgccugaucagcgagauccucuccgagagcgucgugcccgacgugcgguccgucgugaccacggcccgcaugcagguccugaagcgccaggugcagagccugauggugcaccagcggaagcucgaggccgagcugcugcagaucgaggagcggcaccaggagaagaagcgcaaguuccucgagagcaccgacuccuucaacaacgagcugaagcggcugugcggccucaagguggaggucgacauggagaagaucgccgccgagaucgcgcaggccgaggagcaggcccgcaagcggcaggaggagcgcgagaaggaggccgccgagcaggcggagcgcagccaguccagcaucgugcccgaggaggagcaggccgccaacaagggggaggagaagaaggacgacgagaacauccccauggagaccgaggagacccaccuggaggagacgaccgagucccagcagaacggcgaggagggcaccagcaccccggaggacaaggaguccgggcaggagggcguggacagcauggccgaggaggggacguccgacagcaacaccggcuccgagagcaacuccgccaccgucgaggagccgcccaccgaccccauccccgaggacgagaagaaggaguga

SEQ ID NO: 36793 - RNA, 3636 nt, Artificial Sequence
  derived and/or modified sequence opt1 from SMC1A__Homo_sapiens__NP_001268392
augcuggaggugagcauccccaccccgcaccgcuacguccggggcaaguccaaccucauggacgccaucagcuucgugcugggggagaagaccuccaaccugcgcgugaagacgcuccgggaccugauccacggcgcccccgucgggaagcccgcggccaaccgcgccuucgugagcaugguguacuccgaggagggcgccgaggaccggaccuucgcccgcgucaucgucgggggcagcuccgaguacaagaucaacaacaagguggugcagcugcacgaguacagcgaggagcucgagaagcugggcauccugaucaaggcgcggaacuuccucguguuccagggggccguggaguccaucgccaugaagaaccccaaggagcgcaccgcccuguucgaggagaucagccgguccggcgagcuggcgcaggaguacgacaagcgcaagaaggagauggucaaggccgaggaggacacccaguucaacuaccaccggaagaagaacaucgccgccgagcgcaaggaggccaagcaggagaaggaggaggcggaccgguaccagcgccucaaggacgagguggugcgggcccagguccagcugcagcuguucaagcucuaccacaacgagguggagaucgagaagcugaacaaggagcuggccagcaagaacaaggagaucgagaaggacaagaagcgcauggacaagguggaggacgagcucaaggagaagaagaaggagcuggggaagaugaugcgggagcagcagcagaucgagaaggagaucaaggagaaggacuccgagcugaaccagaagcgcccgcaguacaucaaggccaaggagaacacgagccacaagaucaagaagcucgaggccgcgaagaagucccugcagaacgcccagaagcacuacaagaagcggaagggcgacauggacgagcuggagaaggagaugcucagcgucgagaaggcccgccaggaguucgaggagcggauggaggaggagucccagagccaggggcgcgaccugacccuggaggagaaccaggugaagaaguaccaccgccucaaggaggaggccuccaagcgggccgcgacccuggcccaggagcuggagaaguucaaccgcgaccagaaggccgaccaggaccggcucgaccuggaggagcgcaagaagguggagaccgaggccaagaucaagcagaagcugcgggagaucgaggagaaccagaagcgcaucgagaagcucgaggaguacaucacgaccagcaagcagagccuggaggagcagaagaagcuggagggcgagcucaccgaggaggucgagauggccaagcggcgcaucgacgagaucaacaaggagcugaaccaggugauggagcagcugggcgacgcgcggaucgaccgccaggaguccagccggcagcagcgcaaggccgagaucauggaguccaucaagcggcucuaccccgggagcguguacggccgccugaucgaccugugccagcccacccagaagaaguaccagaucgccgucacgaaggugcucgggaagaacauggacgccaucaucgucgacuccgagaagaccggccgggacugcauccaguacaucaaggagcagcgcggcgagcccgagaccuuccugccgcuggacuaccucgaggugaagcccaccgacgagaagcugcgggagcugaagggggcgaagcucgugaucgacgucauccgcuacgagccgccccacaucaagaaggcccugcaguacgccugcggcaacgcccuggugugcgacaacguggaggacgcccggcgcaucgcguucgggggccaccagcgccacaagacggucgcccuggacgggacccucuuccagaaguccggcgugaucagcggcggggccagcgaccugaaggccaaggcccggcgcugggacgagaaggcgguggacaagcugaaggagaagaaggagcggcucaccgaggagcugaaggagcagaugaaggccaagcgcaaggaggccgagcugcggcagguccagucccaggcccacggccuccagaugcgccugaaguacagccaguccgaccuggagcagaccaagacgcggcaccucgcccugaaccugcaggagaaguccaagcucgagagcgagcuggcgaacuucgggccccgcaucaacgacaucaagcggaucauccagagccgcgagcgggagaugaaggaccugaaggagaagaugaaccagguggaggacgagguguucgaggaguucugccgcgagaucggcguccggaacauccgcgaguucgaggaggagaaggugaagcggcagaacgagaucgccaagaagcgccucgaguucgagaaccagaagacccggcuggggauccagcuggacuucgagaagaaccagcucaaggaggaccaggacaaggugcacaugugggagcagaccgucaagaaggacgagaacgagaucgagaagcugaagaaggaggagcagcgccacaugaagaucaucgacgagaccauggcccagcugcaggaccucaagaaccagcaccuggccaagaaguccgaggugaacgacaagaaccacgagauggaggagauccggaagaagcugggcggcgcgaacaaggagaugacgcaccuccagaaggaggugaccgccaucgagaccaagcuggagcagaagcgcagcgaccggcacaaccugcuccaggccugcaagaugcaggacaucaagcugccccuguccaaggggaccauggacgacaucagccaggaggagggcuccagccagggggaggacagcgucuccggcagccagcgcaucuccagcaucuacgcccgcgaggcccucaucgagaucgacuacggggaccugugcgaggaccugaaggacgcgcaggccgaggaggagaucaagcaggagaugaacacgcuccagcagaagcugaacgagcagcaguccgugcugcagcggaucgccgcccccaacaugaaggccauggagaagcucgagagcgugcgcgacaaguuccaggagaccuccgacgaguucgaggcggcccggaagcgcgccaagaaggccaagcaggccuucgagcagaucaagaaggagcgguucgaccgcuucaacgcgugcuucgagagcgucgccaccaacaucgacgagaucuacaaggcccugucccggaacagcuccgcccaggcguuccugggccccgagaacccggaggagcccuaccucgacggcaucaacuacaacugcguggcccccgggaagcgcuuccggcccauggacaaccugagcggcggggagaagaccguggccgcccuggcccuccuguucgcgauccacuccuacaagccggcccccuucuucguccuggacgagaucgacgccgcccucgacaacacgaacaucggcaagguggccaacuacaucaaggagcagagcacgugcaacuuccaggcgaucgugaucucccugaaggaggaguucuacaccaaggccgagagccugaucggcgucuaccccgagcagggggacugcgugaucuccaaggugcucaccuucgaccugaccaaguaccccgacgccaacccgaaccccaacgagcaguga

SEQ ID NO: 36794 - RNA, 3486 nt, Artificial Sequence
  derived and/or modified sequence opt1 from SMC1B__Homo_sapiens__NP_001278430
auggcccaccuggagcuccugcugguggagaacuucaagagcuggcgcggccggcaggucaucgggcccuuccgccgguucacgugcaucaucggcccgaacggguccggcaagagcaacgugauggacgcccucuccuucgugaugggggagaagaucgcgaaccugcgcgucaagaacauccaggagcugauccacggcgcccacaucggcaagcccaucagcuccagcgccuccgugaagaucaucuacguggaggagagcggggaggagaagaccuucgcccggaucauccgcggcgggugcuccgaguuccgguucaacgacaaccucgucagccgcuccguguacaucgccgagcuggagaagaucggcaucaucgugaaggcgcagaacugccuggucuuccaggggaccguggagagcaucuccgugaagaagcccaaggagcggacccaguucuucgaggagaucagcaccuccggcgagcucaucggcgaguacgaggagaagaagcgcaagcugcagaaggccgaggaggacgcccaguucaacuucaacaagaagaagaacaucgccgcggagcggcgccaggccaagcuggagaaggaggaggccgagcgguaccagagccuccuggaggagcugaagaugaacaagauccagcuccagcuguuccagcuguaccacaacgagaagaagauccaccuccugaacaccaagcuggagcacgucaaccgcgaccucuccgugaagcgggagagccugucccaccacgagaacaucgugaaggcccgcaagaaggagcacgggaugcugacgcggcagcuccagcagaccgagaaggagcucaagagcgucgagacccugcugaaccagaagcgcccccaguacaucaaggccaaggagaacaccagccaccaccugaagaagcuggacguggcgaagaaguccaucaaggacagcgagaagcagugcuccaagcaggaggacgacaucaaggcccucgagacggagcuggccgaccuggacgccgccuggcggagcuucgagaagcagaucgaggaggagauccuccacaagaagcgcgacaucgagcuggaggcgucccagcuggaccgguacaaggagcucaaggagcagguccgcaagaagguggccaccaugacccagcagcuggagaagcugcagugggagcagaagaccgacgaggagcgccucgccuucgagaagcggcgccacggcgaggugcaggggaaccugaagcagaucaaggagcagaucgaggaccacaagaagcggaucgagaagcuggaggaguacacgaagaccugcauggacugccucaaggagaagaagcagcaggaggagacccugguggacgagaucgagaagaccaagagccgcauguccgaggucaacgaggagcugaaccucauccggagcgagcugcagaacgccggcaucgacacgcacgagggcaagcgccagcagaagcgggccgaggugcuggagcaccucaagcgccuguacccggacuccguguucgggcggcuguucgaccugugccaccccauccacaagaaguaccagcucgcggucaccaagguguucggccgcuucaucaccgccaucgucguggccagcgagaagguggccaaggacugcauccgguuccugaaggaggagcgcgccgagcccgagaccuuccuggcgcucgacuaccuggacaucaagcccaucaacgagcggcugcgcgagcucaaggggugcaagauggucaucgacgugaucaagacgcaguucccgcagcugaagaaggugauccaguucgucugcggcaacgggcuggugugcgagaccauggaggaggcccggcacaucgcccucuccggccccgagcgccagaagaccguggcccuggacggcacccuguuccucaagagcggggucaucuccggcgggagcuccgaccugaaguacaaggcgcggugcugggacgagaaggagcugaagaaccuccgcgaccggcgcagccagaagauccaggagcugaagggccugaugaagacgcuccgcaaggagaccgaccugaagcagauccagacccugauccaggggacccagacgcggcucaaguacucccagaacgagcuggagaugaucaagaagaagcaccugguggccuucuaccaggagcagagccagcuccaguccgagcugcugaacaucgagagccagugcaucaugcucagcgagggcaucaaggagcgccagcggcgcaucaaggaguuccaggagaagaucgacaagguggaggacgacaucuuccagcacuucugcgaggagaucggcgucgagaacauccgggaguucgagaacaagcacgugaagcgccagcaggagaucgaccagaagcggcuggaguucgagaagcagaagacccgccugaacgugcagcucgaguacucccggagccaccugaagaagaagcugaacaagaucaacacccucaaggagaccauccagaagggguccgaggacaucgaccaccugaagaaggccgaggagaacugccugcagacggucaacgagcucauggccaagcagcagcagcugaaggacauccgcgugacccagaacagcuccgccgagaaggugcagacccagaucgaggaggagcggaagaaguuccuggcggucgaccgcgaggugggcaagcuccagaaggagguggucagcauccagaccucccuggagcagaagcggcuggagaagcacaaccuccugcuggacugcaaggugcaggacaucgagaucauccuccugagcgggucccuggacgacaucaucgagguggagaugggcacggaggccgagagcacccaggccaccaucgacaucuacgagaaggaggaggccuucgagaucgacuacuccagccucaaggaggaccugaaggcccugcaguccgaccaggagaucgaggcgcaccuccgccugcugcuccagcaggucgccagccaggaggacauccugcugaagaccgccgcccccaaccuccgggcccuggagaaccugaagaccgugcgcgacaaguuccaggaguccacggacgcguucgaggccagccggaaggaggcccgccucugccggcaggaguucgagcaggucaagaagcgccgguacgaccuguucacccagugcuucgagcacguguccaucagcaucgaccagaucuacaagaagcugugccgcaacaacagcgcccagguguccagcuacaucaaggagcagacccaggaccaguuccagaugaucgugaucucccucaaggaggaguucuacagccgcgcggacgcccugaucgggaucuaccccgaguacgacgacugcauguucucccggguccugacccucgaccugagccaguacccggacacggagggccaggaguccagcaagcgccacggcgagucccgguga

SEQ ID NO: 36795 - RNA, 3594 nt, Artificial Sequence
  derived and/or modified sequence opt1 from SMC2__Homo_sapiens__XP_011516451
augcacaucaagagcaucauccuggagggcuucaaguccuacgcccagcgcaccgaggugaacggguucgacccccucuucaacgccaucaccggccugaacgggagcggcaaguccaacauccuggacagcaucugcuuccuccuggggaucuccaaccugagccagguccgggcguccaaccuccaggaccugguguacaagaacggccaggccggcaucacgaaggccagcguguccaucaccuucgacaacagcgacaagaagcaguccccgcugggguucgagguccacgacgagaucaccgugacccgccagguggucaucggcgggcggaacaaguaccucaucaacggcgugaacgccaacaacacgcgcgugcaggaccuguucugcagcgucgggcugaacgugaacaacccccacuuccucaucaugcagggccggaucaccaaggugcugaacaugaagccgcccgagauccuguccaugaucgaggaggccgcgggcacccgcauguacgaguacaagaagaucgccgcccagaagaccaucgagaagaaggaggccaagcucaaggagaucaagacgauccuggaggaggagaucacccccaccauccagaagcugaaggaggagcggagcuccuaccucgaguaccagaaggucaugcgcgagaucgagcaccugagccggcuguacaucgcguaccaguuccuccuggccgaggacaccaaggugcgcuccgccgaggagcugaaggagaugcaggacaaggugaucaagcuccaggaggagcugagcgagaacgacaagaagaucaaggcccugaaccacgagaucgaggagcucgagaagcggaaggacaaggagacgggcgggauccugcgcucccuggaggacgcccucgcggaggcccagcgggucaacaccaagagccagagcgccuucgaccugaagaagaagaaccuggccugcgaggaguccaagcgcaaggagcucgagaagaacaugguggaggacagcaagacccuggccgcgaaggagaaggaggugaagaagaucaccgacgggcugcacgcccuccaggaggccuccaacaaggacgccgaggcccuggcggccgcccagcagcacuucaacgccgucagcgccggccuguccagcaacgaggacggcgcggaggccacgcucgccgggcagaugauggccugcaagaacgacaucuccaaggcgcagaccgaggccaagcaggcccagaugaagcugaagcacgcccagcaggagcugaagaacaagcaggccgaggugaagaagauggacagcggcuaccggaaggaccaggaggcgcucgaggccgugaagcgccugaaggagaagcuggaggccgagaugaagaagcucaacuacgaggagaacaaggaggagucccugcuggagaagcggcgccagcucagccgggacaucgggcgccugaaggagaccuacgaggcccugcuggcccgguuccccaaccuccgcuucgcguacaaggaccccgagaagaacuggaaccgcaacugcgucaagggccugguggccucccugaucagcgugaaggacaccuccgccacgaccgcccucgagcuggucgccggggagcggcuguacaacguggucguggacaccgaggugaccggcaagaagcuccuggagcgcggcgagcugaagcggcgcuacacgaucaucccccucaacaagaucagcgcgcggugcaucgccccggagacccugcgcgucgcccagaaccugguggggcccgacaacgugcacgucgcccucucccugguggaguacaagcccgagcugcagaaggcgauggaguucguguucggcaccaccuucgucugcgacaacauggacaacgccaagaagguggccuucgacaagcggaucaugacgcgcaccgugacccucgggggcgacgucuucgacccccacgggacccugagcggcggcgcccggucccaggccgcgagcauccugacgaaguuccaggagcucaaggacgugcaggacgagcugcgcaucaaggagaacgagcugcgggcccucgaggaggagcuggccgggcugaagaacaccgccgagaaguaccgccagcucaagcagcagugggagaugaagaccgaggaggccgaccugcugcagaccaagcuccagcaguccagcuaccacaagcagcaggaggagcuggacgcgcugaagaagacgaucgaggagagcgaggagacccucaagaacaccaaggagauccagcggaaggccgaggagaaguacgaggugcuggagaacaagaugaagaacgccgaggccgagcgcgagcgggagcugaaggacgcccagaagaagcucgacugcgcgaagaccaaggccgacgccuccagcaagaagaugaaggagaagcagcaggaggucgaggccaucacccuggagcuggaggagcucaagcgcgagcacacguccuacaagcagcagcuggaggcggugaacgaggccaucaagagcuacgagucccagaucgaggugauggccgccgaggucgccaagaacaaggagagcgugaacaaggcgcaggaggaggugaccaagcagaaggaggucaucaccgcccaggacaccgugaucaaggccaaguacgccgagguggccaagcacaaggagcagaacaacgacucccagcugaagaucaaggagcucgaccacaacaucagcaagcacaagcgggaggcggaggacggcgccgccaaggucuccaagaugcugaaggacuacgacuggaucaacgccgagcgccaccuguucgggcagccgaacagcgccuacgacuucaagacgaacaaccccaaggaggcgggccagcggcuccagaagcugcaggagaugaaggagaagcuggggcgcaacgugaacaugcgcgccaugaacgugcucaccgaggccgaggagcgguacaacgaccugaugaagaagaagcgcaucgucgagaacgacaaguccaagauccugaccaccaucgaggaccucgaccagaagaagaaccaggcccugaacaucgccuggcagaaggugaacaaggacuucggcagcaucuucuccacgcugcuccccggcgcgaacgccaugcuggcgcccccggaggggcagaccgugcuggacggccucgaguucaaggucgcccuggggaacaccuggaaggagaaccugaccgagcucagcggcggccagcggucccugguggcccugagccucauccuguccaugcuccucuucaagcccgcccccaucuacauccuggacgagguggacgccgcccuggaccucagccacacgcagaacaucgggcagaugcugcgcacccacuucacccacagccaguucaucgucgugucccugaaggagggcauguucaacaacgccaacgugcuguucaagaccaaguucgucgacggggugagcacgguggcgcgguucacccagugccagaacggcaagaucuccaaggaggccaagagcaaggccaagcccccgaagggggcccacgucgagguguga

SEQ ID NO: 36796 - RNA, 3654 nt, Artificial Sequence
  derived and/or modified sequence opt1 from SMC3__Homo_sapiens__NP_005436
auguacaucaagcaggucaucauccagggcuuccgcagcuaccgggaccagaccaucguggaccccuucuccagcaagcacaacgugaucguggggcgcaacggcuccggcaagagcaacuucuucuacgccauccaguucguccuguccgacgaguucagccaccuccggccggagcagcgccuggcccugcuccacgaggggaccgggccccgggugaucuccgcguucguggagaucaucuucgacaacagcgacaaccgccugcccaucgacaaggaggaggucucccugcggcgcgugaucggcgccaagaaggaccaguacuuccucgacaagaagauggugacgaagaacgacgucaugaaccugcuggagagcgccggcuucucccggagcaaccccuacuacaucgugaagcaggggaagaucaaccagauggccaccgccccggacucccagcgccucaagcugcugcgggagguggcgggcacccgcgucuacgacgagcggaaggaggagagcaucucccucaugaaggagaccgaggggaagcgcgagaagaucaacgagcugcugaaguacaucgaggagcggcuccacacgcuggaggaggagaaggaggagcuggcccaguaccagaagugggacaagaugcgccgggcccucgaguacaccaucuacaaccaggagcugaacgagacccgcgccaagcuggacgagcucagcgcgaagcgggagaccuccggcgagaagucccgccagcugcgggacgcccagcaggacgcccgcgacaagauggaggacaucgagcgccaggugcgggagcugaagacgaagaucagcgccaugaaggaggagaaggagcagcucagcgccgagcgccaggagcagaucaagcagcggaccaagcuggagcugaaggcgaaggaccuccaggacgagcuggccgggaacagcgagcagcgcaagcggcugcucaaggagcgccagaagcugcuggagaagaucgaggagaagcagaaggagcucgccgagaccgagcccaaguucaacuccgugaaggagaaggaggagcggggcaucgcccgccuggcccaggcgacccaggagcggacggaccuguacgccaagcagggccgcgggagccaguucaccuccaaggaggagcgggacaaguggaucaagaaggagcucaagagccuggaccaggccaucaacgacaagaagcgccagaucgccgccauccacaaggaccuggaggacaccgaggcgaacaaggagaagaaccucgagcaguacaacaagcuggaccaggaccugaacgaggucaaggcccggguggaggagcucgaccgcaaguacuacgaggugaagaacaagaaggacgagcugcaguccgagcggaacuaccuguggcgcgaggagaacgccgagcagcaggcccucgccgcgaagcgggaggaccuggagaagaagcagcagcugcuccgcgccgccaccggcaaggccauccugaacgggaucgacagcaucaacaagguccuggaccacuuccggcgcaagggcaucaaccagcacgugcagaacggcuaccacgggaucgugaugaacaacuucgagugcgagcccgcguucuacacgugcgucgaggugaccgccggcaaccgccuguucuaccacaucguggacuccgacgaggucagcaccaagauccucauggaguucaacaagaugaaccugcccggggaggugaccuuccugccgcucaacaagcuggacguccgggacacggccuaccccgagaccaacgacgccauccccaugaucuccaagcugcgcuacaacccccgguucgacaaggccuucaagcacguguucggcaagacccucaucugccgcagcauggagguguccacccagcuggcgcgggccuucacgauggacugcaucacccuggagggggaccaggucagccaccgcggcgcccucaccggcggguacuacgacacccggaagucccgccuggagcugcagaaggacgugcggaaggccgaggaggagcucggcgagcuggaggccaagcugaacgagaaccuccgccggaacaucgagcgcaucaacaacgagaucgaccagcugaugaaccagaugcagcagaucgagacgcagcagcggaaguucaaggcgagccgcgacuccauccugagcgagaugaagaugcucaaggagaagcggcagcaguccgagaagaccuucaugccgaagcagcgcagccugcagucccuggaggccagccuccacgccauggagagcacccgggagucccugaaggccgagcuggggaccgaccuccugagccagcugucccucgaggaccagaagcgcguggacgcccugaacgacgagauccggcagcugcagcaggagaaccgccagcuccugaacgagcggaucaagcuggagggcaucaucacgcgcgucgagaccuaccucaacgagaaccugcgcaagcggcuggaccagguggagcaggagcucaacgagcugcgcgagaccgagggcgggaccgugcugacggcgaccaccagcgagcucgaggccaucaacaagcgggucaaggacaccauggcccgcuccgaggaccuggacaacagcaucgacaagaccgaggccggcaucaaggagcugcagaaguccauggagcgguggaagaacauggagaaggagcacauggacgcgaucaaccacgacacgaaggagcucgagaagaugaccaaccgccaggggaugcugcugaagaagaaggaggagugcaugaagaagauccgggagcucggcagccugccccaggaggccuucgagaaguaccagacccugucccucaagcagcuguuccgcaagcuggagcagugcaacaccgagcucaagaaguacagccacgugaacaagaaggcccuggaccaguucgugaacuucuccgagcagaaggagaagcugaucaagcggcaggaggagcucgaccgcggguacaagagcaucauggagcugaugaacguccuggagcuccggaaguacgaggccauccagcugacguucaagcaggucuccaagaacuucagcgagguguuccagaagcuggugcccggcgggaaggccacccucgugaugaagaagggcgacguggagggcucccagagccaggacgagggggagggcuccggggagagcgagcgcggcagcggcucccagagcuccguccccagcguggaccaguucaccggggugggcauccgggucuccuucaccgggaagcagggcgagaugcgcgagaugcagcagcugagcgggggccagaagucccugguggcgcucgcccugaucuucgccauccagaagugcgacccggcccccuucuaccuguucgacgagaucgaccaggcccucgacgcgcagcaccggaaggccgugagcgacaugaucauggagcuggccguccacgcccaguucaucacgaccaccuuccgccccgagcugcucgaguccgccgacaaguucuacggcgugaaguuccggaacaaggugagccacaucgacgucaucaccgcggagauggccaaggacuucguggaggacgacacgacccacggguga

SEQ ID NO: 36797 - RNA, 3867 nt, Artificial Sequence
  derived and/or modified sequence opt1 from SMC4__Homo_sapiens__NP_005487
augccccgcaagggcacccagccgagcaccgcccggcgccgggaggaggggcccccgcccccgucccccgacggcgccagcuccgacgcggagcccgagcccccgagcgggcgcacggagucccccgccaccgccgccgagaccgccagcgaggagcuggacaaccggucccucgaggagauccugaacagcaucccgccgcccccgccgcccgcgaugaccaacgaggccggcgcgccccgccugaugaucacgcacaucgugaaccagaacuucaaguccuacgccggggagaagauccucggccccuuccacaagcgguucagcugcaucaucggccccaacggguccggcaagagcaacgucaucgacuccaugcuguucguguucggguaccgcgcccagaagauccggagcaagaagcuguccgugcucauccacaacagcgacgagcacaaggacauccaguccugcaccgucgaggugcacuuccagaagaucaucgacaaggagggcgacgacuacgaggugauccccaacagcaacuucuacgucucccgcaccgccugccgggacaacaccagcguguaccacaucagcgggaagaagaagacguucaaggacgugggcaaccugcugcgcucccacggcaucgaccucgaccacaaccgguuccugauccugcagggggaggucgagcagaucgccaugaugaagcccaagggccagaccgagcacgacgaggggaugcucgaguaccuggaggacaucaucggcugcggccgccugaacgagcccaucaaggugcucugccggcgcguggagauccugaacgagcaccgcggggagaagcugaaccgggucaagaugguggagaaggagaaggacgcccucgagggcgagaagaacaucgccaucgaguuccugacccuggagaacgagaucuuccggaagaagaaccacgugugccaguacuacaucuacgagcuccagaagcgcaucgcggagauggagacccagaaggagaagauccacgaggacacgaaggagaucaacgagaaguccaacauccuguccaacgagaugaaggccaagaacaaggacgucaaggacaccgagaagaagcugaacaagaucaccaaguucaucgaggagaacaaggagaaguucacccagcucgaccuggaggacguccaggugcgggagaagcugaagcacgccacgagcaaggccaagaagcucgagaagcagcugcagaaggacaaggagaaggucgaggaguucaaguccauccccgccaagagcaacaacaucaucaacgagaccaccacccgcaacaacgcgcuggagaaggagaaggagaaggaggagaagaagcucaaggaggugauggacagccugaagcaggagacgcaggggcugcagaaggagaaggagagccgcgagaaggagcucaugggcuucuccaagagcgugaacgaggcccgguccaagauggacguggcccagagcgagcuggacaucuaccugucccgccacaacaccgccgugagccagcucaccaaggccaaggaggcgcugaucgccgccuccgagacccugaaggagcggaaggccgccauccgcgacaucgaggggaagcucccccagacggagcaggagcugaaggagaaggagaaggagcugcagaagcucacccaggaggagaccaacuucaagagccuggugcacgaccuguuccagaaggucgaggaggcgaaguccagccucgccaugaaccggucccgcggcaaggugcuggacgccaucauccaggagaagaaguccggccggauccccgggaucuacggccgccugggggaccucggcgccaucgacgagaaguacgacgucgcgaucagcagcugcugccacgcccuggacuacaucgugguggacagcaucgacaucgcccaggagugcgucaacuuccugaagcggcagaacaucgggguggccaccuucaucggccuggacaagauggccgugugggcgaagaagaugacggagauccagacccccgagaacacgccccgccucuucgaccuggucaaggugaaggacgagaagauccggcaggccuucuacuucgcccugcgcgacacccucguggccgacaaccuggaccaggccacccgggucgcguaccagaaggaccgccgguggcgcguggugacccugcagggccagaucaucgagcaguccgggaccaugaccggcgggggcagcaaggucaugaaggggcggaugggcuccagccucgugaucgagaucuccgaggaggaggugaacaagauggagagccagcugcagaacgacuccaagaaggccaugcagauccaggagcagaagguccagcuggaggagcgcguggugaagcuccggcacagcgagcgcgagaugcgcaacacgcuggagaaguucaccgccuccauccagcggcugaucgagcaggaggaguaccucaacguccaggugaaggagcuggaggccaacgugcuggccaccgcgcccgacaagaagaagcagaagcuccuggaggagaacgucagcgccuucaagaccgaguacgacgccguggccgagaaggcgggcaagguggaggccgaggucaagcgccugcacaacaccaucguggagaucaacaaccacaagcucaaggcccagcaggacaagcuggacaagaucaacaagcagcuggacgagugcgccuccgccaucacgaaggcccagguggcgaucaagaccgccgaccggaaccuccagaaggcccaggacagcguccugcgcaccgagaaggagaucaaggacaccgagaaggagguggacgaccugacggccgagcucaagucccuggaggacaaggcggccgagguggucaagaacaccaacgccgccgaggagagccugcccgagauccagaaggagcaccggaaccuccugcaggagcugaaggugauccaggagaacgagcacgcccuccagaaggacgcgcuguccaucaagcugaagcucgagcagaucgacgggcacaucgccgagcacaacagcaagaucaaguacuggcacaaggagaucagcaagaucucccugcaccccaucgaggacaaccccaucgaggagaucagcgugcuguccccggaggaccucgaggccaucaagaaccccgacagcaucaccaaccagaucgcccugcuggaggcgcgcugccacgagaugaagcccaaccucggcgccaucgccgaguacaagaagaaggaggagcuguaccugcagcgggucgccgagcucgacaagaucaccuacgagcgcgacuccuuccggcaggccuacgaggaccugcgcaagcagcggcugaacgaguucauggcgggguucuacaucaucacgaacaagcucaaggagaacuaccagaugcugacccugggcggcgacgccgagcucgagcugguggacagccuggaccccuucuccgaggggaucauguucagcgugcgcccgcccaagaaguccuggaagaagaucuucaaccucagcggcggggagaagacccuguccagccuggcccucgucuucgcccugcaccacuacaagcccacgccccuguacuucauggacgagaucgacgccgcgcucgacuucaagaacguguccaucguggccuucuacaucuacgagcagaccaagaacgcccaguucaucaucaucagccugcggaacaacauguucgagaucuccgaccgccugaucggcaucuacaagaccuacaacaucaccaagagcgucgccgugaacccgaaggagaucgccuccaaggggcucugcuga

SEQ ID NO: 36798 - RNA, 3306 nt, Artificial Sequence
  derived and/or modified sequence opt1 from SMC5__Homo_sapiens__NP_055925
auggccacccccagcaagaagaccuccacgccgagcccccagcccuccaagcgcgcccugccccgggacccgagcuccgaggugcccagcaagcgcaagaacuccgcgccccagcucccccugcugcagagcuccggcccguucgucgaggggagcaucgugcggaucuccauggagaacuuccucaccuacgacaucugcgaggugagccccggcccccaccugaacaugaucgucggggccaacggcaccgggaaguccagcaucgugugcgccaucugccugggccucgccggcaagcccgccuucauggggcgcgcggacaaggugggcuucuucgucaagcgggggugcucccgcggcaugguggagaucgagcuguuccgggccagcgggaaccuggugaucacccgcgagaucgacgucgccaagaaccaguccuucugguucaucaacaagaaguccacgacccagaagaucguggaggagaagguggccgcgcucaacauccaggucggcaaccugugccaguuccugccgcaggacaaggugggcgaguucgccaagcucagcaagaucgagcugcuggaggccaccgagaaguccaucgggccgcccgagaugcacaaguaccacugcgagcucaagaaccugcgggagaaggagaagcagcuggagaccagcugcaaggagaagacggaguaccuccagaagauggugcagcgcaacgagcgguacaagcaggacgucgagcgcuucuacgagcggaagcgccaccuggaccugaucgagaugcucgaggccaagcggcccuggguggaguacgagaacgugcgccaggaguacgaggaggucaagcuggugcgggaccgcgugaaggaggagguccggaagcugaaggagggccagauccccgugaccugccgcaucgaggagauggagaacgagcggcacaaccucgaggcccgcaucaaggagaaggcgaccgacaucaaggaggccagccagaagugcaagcagaagcaggacgugaucgagcgcaaggacaagcacaucgaggagcugcagcaggcccugaucgucaagcagaacgaggagcucgaccggcagcgccggaucgggaacacccgcaagaugaucgaggaccugcagaacgagcugaagacgaccgagaacugcgagaaccuccagccccagaucgacgccaucaccaacgaccugcggcgcauccaggacgagaaggcccugugcgagggcgagaucaucgacaagcggcgcgagcgggagacccucgagaaggagaagaaguccguggacgaccacaucguccgcuucgacaaccugaugaaccagaaggaggacaagcugcggcagcgcuuccgggacacguacgacgcggugcucuggcugcgcaacaaccgggacaaguucaagcagcgcgugugcgagcccaucaugcugaccaucaacaugaaggacaacaagaacgccaaguacaucgagaaccacauccccagcaacgaccuccgggccuucgucuucgagagccaggaggacauggagguguuccugaaggaggugcgcgacaacaagaagcugcgggucaacgccgugaucgccccgaaguccagcuacgcggacaaggcccccucccgcagccucaacgagcugaagcaguacggcuucuucuccuaccugcgcgagcuguucgacgcccccgaccccgugaugagcuaccucugcugccaguaccacauccacgaggucccgguggggaccgagaagacccgggagcgcaucgagcgggugauccaggagacgcgccugaagcagaucuacaccgccgaggagaaguacgucgugaagaccuccuucuacagcaacaaggugaucuccagcaacaccucccucaaggucgcccaguuccugacggugaccguggaccuggagcagcggcgccaccuggaggagcagcucaaggagauccaccggaagcugcaggcggucgacagcggccugaucgcccuccgcgagaccuccaagcaccuggagcacaaggacaacgagcugcggcagaagaagaaggagcuccuggagcgcaagaccaagaagcggcagcuggagcagaagaucagcuccaagcucgggagccugaagcugauggagcaggacacgugcaaccucgaggaggaggagcgcaaggccagcaccaagaucaaggagaucaacgugcagaaggccaagcuggugaccgagcugaccaaccucaucaagaucugcacgucccugcacauccagaaggucgaccugauccuccagaacaccaccgugaucagcgagaagaacaagcuggaguccgacuacauggcggccagcucccagcugcggcucaccgagcagcacuucaucgagcuggacgagaaccgccagcggcugcuccagaagugcaaggagcugaugaagcgcgcccgccaggugugcaaccugggcgccgagcagacgcucccccaggaguaccagacccagguccccaccauccccaacgggcacaacagcucccugccgaugguguuccaggaccugcccaacacccucgacgagaucgacgcccugcugaccgaggagcggagccgggcguccugcuucacgggccucaaccccaccaucgugcaggaguacaccaagcgcgaggaggagaucgagcagcugaccgaggagcugaagggcaagaaggucgagcucgaccaguaccgggagaacaucagccaggugaaggagcgcuggcugaacccgcugaaggagcucguggagaagaucaacgagaaguucuccaacuucuucagcuccaugcagugcgccggggaggucgaccugcacacggagaacgaggaggacuacgacaaguacggcauccgcauccgggugaaguuccgcagcuccacccagcugcacgagcucacgccccaccaccagagcgggggcgagcgguccgugagcaccaugcuguaccugauggcccuccaggagcugaaccgcugccccuuccgggucguggacgagaucaaccaggggauggaccccaucaacgagcgccggguguucgagauggucgugaacaccgccugcaaggagaacaccagccaguacuucuucaucaccccgaagcugcuccagaaccugcccuacuccgagaagaugaccgugcuguucgucuacaacggcccccacaugcucgagcccaacacguggaaccugaaggccuuccagcgccggcgccggcgcaucaccuucacccagccgagcuga

SEQ ID NO: 36799 - RNA, 3276 nt, Artificial Sequence
  derived and/or modified sequence opt1 from SMC6__Homo_sapiens__NP_001135758
auggccaagcgcaaggaggagaacuucagcucccccaagaacgccaagcggccgcgccaggaggagcuggaggacuucgacaaggacggcgacgaggacgagugcaaggggaccacccucacggcggccgaggugggcaucaucgagagcauccaccugaagaacuucaugugccacuccaugcuggggcccuucaaguucggcagcaacgucaacuucgugguggggaacaacggcuccggcaagagcgccguccucaccgcccugaucguggggcugggcgggcgggccguggcgaccaaccgcggcuccagccucaagggguucgucaaggacggccagaacuccgccgacaucagcaucacccugcggaaccgcggcgacgacgccuucaaggccuccguguacgggaacagcauccugauccagcagcacaucuccaucgacggcagccgguccuacaagcucaagagcgcgacgggguccguggucagcacccgcaaggaggagcugaucgccauccuggaccacuucaacauccagguggacaaccccguguccguccucacccaggagaugagcaagcaguuccugcagagcaagaacgagggcgacaaguacaaguucuucaugaaggccacccagcuggagcagaugaaggaggacuacuccuacaucauggagacgaaggagcggaccaaggagcagauccaccagggcgaggagcgccucaccgagcugaagcggcagugcguggagaaggaggagcgcuuccagagcaucgccgggcuguccaccaugaagacgaaccucgagagccugaagcacgagauggccugggcgguggucaacgagaucgagaagcagcugaacgccauccgggacaacaucaagaucggcgaggaccgcgccgcccggcucgaccgcaagauggaggagcagcagguccggcugaacgaggccgagcagaaguacaaggacauccaggacaagcuggagaagaucuccgaggagaccaacgcgcgcgcccccgagugcauggcccucaaggccgacgugguggccaagaagcgggcguacaacgaggccgaggugcuguacaaccgcagccugaacgaguacaaggcccucaagaaggacgacgagcagcugugcaagcggaucgaggagcugaagaaguccaccgaccagagccucgagccggagcgccuggagcgccagaagaagaucuccuggcugaaggagcgggugaaggccuuccagaaccaggagaacagcgucaaccaggagaucgagcaguuccagcaggccaucgagaaggacaaggaggagcacgggaagaucaagcgcgaggagcucgacgugaagcacgcgcuguccuacaaccagcggcagcugaaggagcucaaggacagcaagaccgaccgccugaagcgguucggccccaacgugcccgcccugcucgaggccaucgacgacgccuaccgccaggggcacuucacguacaagcccgucggcccgcugggcgcgugcauccaccuccgggaccccgagcuggcccuggccaucgaguccugccugaaggggcuccugcaggccuacugcugccacaaccacgccgacgagcgcgugcugcaggcgcucaugaagcgguucuaccugcccggcaccagccggcccccgaucaucgucuccgaguuccgcaacgagaucuacgacgugcgccaccgggccgccuaccaccccgacuuccccaccgugcugaccgcccuggagaucgacaacgccgucguggcgaacagccucaucgacaugcgcgggaucgagacggugcugcugaucaagaacaacuccgucgcccgggccgugaugcagagccagaagcccccgaagaacugccgcgaggccuucaccgccgacggcgaccagguguucgcggggcgguacuacuccagcgagaacacccgccccaaguuccucagccgggacgucgacuccgagaucagcgaccuggagaacgagguggagaacaagaccgcccagauccugaaccuccagcagcaccuguccgcccuggagaaggacaucaagcacaacgaggagcuccugaagcgcugccagcugcacuacaaggagcucaagaugaagauccgcaagaacaucagcgagauccgggagcuggagaacaucgaggagcaccaguccguggacaucgccacgcuggaggacgaggcgcaggagaacaagagcaagaugaagauggucgaggagcacauggagcagcagaaggagaacauggagcaccucaagucccugaagaucgaggccgagaacaaguacgacgccaucaaguucaagaucaaccagcugagcgagcucgccgacccccugaaggacgagcugaaccucgccgacuccgagguggacaaccagaagcgcggcaagcggcacuacgaggagaagcagaaggagcaccuggacacccugaacaagaagaagcgcgagcucgacaugaaggagaaggagcuggaggagaagaugagccaggcgcggcagaucugccccgagcgcaucgagguggagaaguccgccagcauccuggacaaggagaucaaccggcuccgccagaagauccaggccgagcacgccucccacggcgaccgggaggagaucaugcgccaguaccaggaggcccgggagaccuaccuggaccuggacagcaagguccgcacccucaagaaguucaucaagcugcugggggagaucauggagcaccgguucaagacguaccagcaguuccgccggugccucacccugcgcugcaagcuguacuucgacaaccuccugucccagcgggcguacugcggcaagaugaacuucgaccacaagaacgagacccugagcaucuccgugcagccgggggagggcaacaaggccgccuucaacgacaugcgcgcccucagcgggggcgagcggagcuucuccaccgugugcuucauccugagccugugguccaucgccgagagccccuuccgcugccucgacgaguucgacgucuacauggacauggugaaccggcgcaucgcgauggaccugauccugaagauggccgacucccagcgcuuccggcaguucauccuccugacgccccagagcauguccagccugcccuccagcaagcucauccgcauccugcggauguccgacccggagcgcggccagaccacccugcccuuccggcccgugacccaggaggaggacgacgaccagcgcuga

SEQ ID NO: 36800 - RNA, 6018 nt, Artificial Sequence
  derived and/or modified sequence opt1 from SMCHD1__Homo_sapiens__NP_056110
auggccgccgccgacggcgggggccccgggggcgccagcguggggaccgaggaggacggcggcggggugggccaccgcaccguguaccuguucgaccggcgcgagaaggaguccgagcugggggaccggccccuccaggugggcgagcgcagcgacuacgccggguuccgggccugcgugugccagacccugggcaucucccccgaggagaaguucgugaucaccaccaccagccgcaaggagaucacgugcgacaacuucgacgagaccgugaaggacggcgugacccuguaccugcugcaguccgugaaccagcuccugcugaccgccaccaaggagcggaucgacuuccucccccacuacgacacccuggucaagagcgggauguacgaguacuacgcguccgagggccagaacccccugcccuucgcccucgccgagcugaucgacaacagccuguccgccaccagccgcaacaucgggguccggcgcauccagaucaagcuccuguucgacgagacccagggcaagcccgcgguggccgugaucgacaacggccgggggaugacguccaagcagcugaacaacugggccgucuaccgccucagcaaguucacccggcagggcgacuucgaguccgaccacagcggguacgugcgccccgugcccgucccgcggucccugaacagcgacaucuccuacuucggcgucgggggcaagcaggccguguucuucgucggccagagcgcccgcaugaucuccaagcccgcggacagccaggacgugcacgagcuggugcucagcaaggaggacuucgagaagaaggagaagaacaaggaggccaucuacuccggguacauccggaaccgcaagcccagcgacuccguccacaucaccaacgacgacgagcgguuccugcaccaccugaucaucgaggagaaggagaaggacagcuucaccgccguggugaucacgggcguccagcccgagcacauccaguaccucaagaacuacuuccaccuguggacccgccagcuggcccacaucuaccacuacuacauccacgggccgaagggcaacgagauccggaccuccaaggagguggagcccuucaacaacaucgacaucgagaucagcauguucgagaaggggaagguccccaagaucgugaaccuccgcgagauccaggacgacaugcagacccuguacgugaacacggccgcggacuccuucgaguucaaggcccacgucgagggcgacggcgugguggaggggaucauccgcuaccaccccuuccuguacgaccgggagaccuacccggacgaccccugcuuccccagcaagcucaaggacgaggacgacgaggacgacugcuucauccuggagaaggccgcccgcggcaagcggcccaucuucgagugcuucuggaacgggcgccugaucccguacaccuccgucgaggacuucgacuggugcacgccgcccaagaagcggggccucgcccccaucgagugcuacaaccgcaucagcggggcgcuguucacgaacgacaaguuccagguguccaccaacaagcugaccuucauggaccucgagcugaagcugaaggacaagaacacccucuucacgcggauccugaacggccaggagcagcgcaugaagaucgaccgggaguucgcccuguggcucaaggacugccacgagaaguacgacaagcagaucaaguucacccuguucaagggcgugaucacccgcccggaccugcccagcaagaagcaggggcccugggccaccuacgccgccaucgagugggacggcaagaucuacaaggcggggcagcucgucaagacgaucaagacccugccccuguucuacggcuccaucgugcgguucuuccucuacggcgaccacgacggggagguguacgccaccggcggggagguccagaucgccauggagccgcaggcccuguacgacgaggugcgcaccgugcccaucgcgaagcuggaccggacggucgccgagaaggccgugaagaaguacguggaggacgagauggcccgccugcccgaccggcucagcgucaccuggccggagggcgacgagcugcugcccaacgaggugcgccccgccgggacccccaucggcgcgcuccggaucgagauccugaacaagaagggcgaggccaugcagaagcugccggggaccucccacggcgggagcaagaagcuccugguggagcugaaggucauccuccacuccagcuccggcaacaaggagaucaucagccacaucagccagcacgggggcaaguggcccuacugguucaagaagauggagaacauccagaagcugggcaacuacacccugaagcuccagguggugcugaacgaguccaacgccgacacguacgccgggcgcccccugcccagcaaggccaucaaguucuccgucaaggagggcaagccggagaaguucagcuucgggcuccuggaccugcccuuccgggugggcgugcccuucaacaucccccucgaguuccaggacgaguucgggcacaccucccagcuggucaccgacauccagccggugcuggaggcgagcggccucucccugcacuacgaggagaucaccaagggccccaacugcgugauccgcggggucacggccaagggccccgugaacagcugccaggggaagaacuacaaccugaaggugacccuccccggccugaaggaggacucccagauccugaagauccgccuccugccggggcacccccggcgccugaaggucaagcccgacagcgagauccucgugaucgagaacggcaccgccuuccccuuccagguggagguccuggacgaguccgacaacaucaccgcccagccgaagcugaucgugcacugcaaguucagcggcgcccccaaccuccccguguacgucguggacugcuccagcuccgggacgagcauccugaccggcuccgcgauccaggugcagaacaucaagaaggaccagacccugaaggcccggaucgagauccccagcugcaaggacgucgccccgguggagaagaccaucaagcuccugcccagcucccacguggcccgccugcagaucuucagcgucgaggggcagaaggcgauccagaucaagcaccaggacgaggugaacuggaucgccggcgacaucaugcacaaccucaucuuccagauguacgacgagggcgagcgggagaucaacaucacguccgcccuggccgagaagaucaaggugaacuggacccccgagaucaacaaggagcaccuccugcaggggcugcugccggacguccaggugcccaccagcgugaaggacaugcgcuacugccaggucuccuuccaggacgaccacgugagccucgaguccgccuucaccguccggccccugcccgacgagccgaagcaccugaagugcgagaugaagggcgggaagacggugcagaugggccaggagcuccagggggagguggucaucaucaucaccgaccaguacggcaaccagauccaggcguucagccccuccagccuguccagccuguccaucgccggcguggggcucgacagcuccaaccugaagaccaccuuccaggagaacacgcagagcaucuccgugcgcggcaucaaguucauccccgggcccccgggcaacaaggaccugugcuucaccuggcgggaguucagcgacuucauccgcguccagcucaucuccgggccgcccgccaagcugcugcucaucgacuggcccgagcugaaggagagcaucccggugaucaacggccgggaccugcagaaccccaucaucgugcagcucugcgaccagugggacaaccccgcccccguccagcacgugaagaucagccugaccaaggccuccaaccugaagcucaugccgagcaaccagcagcacaagaccgacgagaagggccgcgcgaaccuggggguguucuccgucuucgcgccccggggcgagcacacgcuccaggugaaggccaucuacaacaagagcaucaucgaggggcccaucaucaagcucaugauccugcccgacccggagaagcccgugcgccugaacgucaaguacgacaaggacgccuccuuccucgccggcgggcuguucaccgacuucaugaucagcgugaucuccgaggacgacagcaucaucaagaacaucaaccccgcgcggaucuccaugaagauguggaagcugagcaccuccggcaaccgcccgcccgccaacgccgagaccuucagcugcaacaagaucaaggacaacgacaaggaggacggcugcuucuacuuccgggacaaggugauccccaacaaggucgggacguacugcauccaguucggcuucaugauggacaagaccaacauccucaacuccgagcaggucaucguggaggugcugcccaaccagcccgugaagcuggugcccaagaucaagccgcccaccccggccgucagcaacgugcgcuccguggcgagccggacccucguccgcgaccugcaccuguccaucacggacgacuacgacaaccacaccgggaucgaccucgugggcaccaucaucgccaccaucaagggcagcaacgaggaggacacggacacgccccuguucaucgggaaggugcggacccuggaguuccccuucgucaacggcuccgccgagaucaugagccucgugcuggccgagagcucccccgggcgcgacagcaccgaguacuucaucguguucgagccgcgccugccccuccugucccggacccuggagcccuacauccuccccuucauguucuacaacgacgucaagaagcagcagcagauggccgcgcugacgaaggagaaggaccagcugagccaguccaucgugauguacaagagccucuucgaggccucccagcagcugcugaacgagaugaagugccagguggaggaggcccgccucaaggaggcccagcugcggaacgagcugaagauccacaacaucgacaucccgaccacccagcaggucccccacaucgaggcccugcucaagcgcaagcugagcgagcaggaggagcugaagaagaagccccggcgcuccugcacccuccccaacuacacgaagggcagcggggacgugcugggcaagaucgcgcaccuggcccagaucgaggacgaccgggccgccauggugaucuccuggcaccucgccagcgacauggacugcgucgugacccugaccaccgacgcggcccgccggaucuacgacgagacgcagggccgccagcagguccugccgcucgacuccaucuacaagaagacccugcccgacuggaagcggagccugccccacuuccgcaacgggaagcucuacuucaagcccaucggcgacccggucuucgcccgggaccugcugaccuuccccgacaacguggagcacugcgagaccguguucgggaugcuccugggcgacacgaucauccuggacaaccucgacgccgccaaccacuaccgcaaggaggucgugaagaucacccacugccccacccugcugacccgggacggggaccgcauccgguccaacggcaaguucggcgggcuccagaacaaggcgcccccgauggacaagcugcgcggcaugguguucggggcccccguccccaagcagugccugauccucggcgagcagaucgaccugcugcagcaguaccggagcgccgugugcaagcucgacuccgugaacaaggaccugaacagccagcuggaguaccuccgcacgcccgacaugcgcaagaagaagcaggagcuggacgagcacgagaagaaccugaagcucaucgaggagaagcuggggaugaccccgauccggaagugcaacgacucccugcgccacagccccaaggucgagaccaccgacugccccgugcccccgaagcggaugcgccgggaggccacgcgccagaaccggaucaucaccaagaccgacgucuga

SEQ ID NO: 36801 - RNA, 180 nt, Artificial Sequence
  derived and/or modified sequence opt1 from SMCO4__Homo_sapiens__NP_064564
augcgccagcugaagggcaagcccaagaaggagaccagcaaggacaagaaggagcggaagcaggccaugcaggaggcccgccagcagaucaccacggugguccucccgacccuggcgguggugguccugcucaucgugguguucgucuacguggccacccggcccaccaucacggaguga

SEQ ID NO: 36802 - RNA, 351 nt, Artificial Sequence
  derived and/or modified sequence opt1 from SMCP__Homo_sapiens__NP_109588
augugcgaccagaccaagcacagcaagugcugccccgccaagggcaaccagugcugcccgccccagcagaaccagugcugccaguccaaggggaaccagugcugcccgcccaagcagaaccagugcugccagcccaagggcagccagugcugcccgcccaagcacaaccacugcugccagcccaagccgcccugcugcauccaggcccgcugcugcgggcuggagaccaagcccgaggugagcccccucaacauggaguccgagcccaacuccccgcagacgcaggacaagggcugccagacccagcagcagccccacagcccccagaacgagucccggcccagcaaguga

SEQ ID NO: 36803 - RNA, 2463 nt, Artificial Sequence
  derived and/or modified sequence opt1 from SMEK1__Homo_sapiens__NP_001271209
augaccgacacccgccggcgcgugaaggucuacacgcugaacgaggaccggcagugggacgaccgcggcaccgggcacgugagcuccggcuacguggagcggcucaaggggaugagccugcugguccgcgccgaguccgacggcagccuccugcuggaguccaagaucaaccccaacaccgccuaccagaagcagcaggacacccucaucguguggagcgaggcggagaacuacgaccuggcccuguccuuccaggagaaggccgggugcgacgagaucugggagaagaucugccaggugcagggcaaggacccgagcgucgacaucacgcaggaccucguggacgaguccgaggaggagcgguucgacgacaugagcucccccggccuggagcugcccagcugcgagcucucccgccuggaggagaucgccgagcugguggccagcucccuccccagcccgcugcggcgcgagaagcuggcgcucgcccuggagaacgagggguacaucaagaagcugcucgagcuguuccacgucugcgaggaccuggagaacaucgagggccuccaccaccuguacgagaucaucaaggggaucuuccugcucaaccggaccgcccuguucgaggugauguucuccgaggagugcaucauggacgugaucggcugccuggaguacgaccccgcccucagccagccccgcaagcaccgggaguuccugaccaagaccgcgaaguucaaggaggucauccccaucuccgacccggagcugaagcagaagauccaccagacguaccgcgugcaguacauccaggacauggugcuccccacccccagcgucuucgaggagaacaugcugagcacccugcacuccuucaucuucuucaacaagguggagaucguggggaugcuccaggaggacgagaaguuccugaccgaccuguucgcccagcucacggacgaggccaccgacgaggagaagcggcaggagcuggucaacuuccugaaggaguucugcgccuucagccagacccuccagccccagaaccgcgacgccuucuucaagacccuguccaacaugggcauccugccggcgcucgaggugauccugggcauggacgacacccaggugcggagcgccgccacggacaucuucuccuaccuggucgaguacaaccccagcauggugcgcgaguucgugaugcaggaggcccagcagaacgacgacgacauccuccugaucaaccugaucaucgagcacaugaucugcgacaccgaccccgagcucgggggcgccguccagcugauggggcugcugcggacccucguggaccccgagaacaugcuggcgacggccaacaagaccgagaagaccgaguuccugggcuucuucuacaagcacugcaugcacguccucaccgccccgcugcuggccaacacgaccgaggacaagcccuccaaggacgacuuccagaccgcccagcuccuggcgcuggugcucgagcugcugaccuucugcguggagcaccacacguaccacaucaagaacuacaucaucaacaaggacauccuccgccggguccuggugcugauggccagcaagcacgccuuccucgcccugugcgcccugcgcuucaagcgcaagaucaucggccucaaggacgaguucuacaaccgguacaucaugaaguccuuccuguucgagcccguggucaaggcguuccugaacaacgggagccgcuacaaccucaugaacuccgccaucaucgagauguucgaguucauccggguggaggacaucaagagccugaccgcccacgugaucgagaacuacuggaaggcccuggaggacgucgacuacgugcagaccuucaagggccucaagcugcgcuucgagcagcagcgggagcgccaggacaaccccaagcuggacuccaugcggagcauccuccgcaaccaccgguaccgccgggacgcgcgcacccuggaggacgaggaggagaugugguucaacacggacgaggacgacauggaggacggggaggccguggucuccccgagcgacaagaccaagaacgacgacgacaucauggaccccaucuccaaguucauggagcggaagaagcugaaggagagcgaggagaaggaggugcuccugaagaccaaccuguccggccgccagagccccagcuucaagcucucccugagcuccgggaccaagacgaaccugaccagccaguccagcaccaccaaccuccccggcuccccgggcagccccgggucccccggcagccccggguccccgggcagcgugcccaagaacaccucccagacggccgccaucaccaccaagggcgggcuggucggccugguggacuaccccgacgacgacgaggacgacgacgaggacgaggacaaggaggacacccucccgcugagcaagaaggccaaguucgacuccuga

SEQ ID NO: 36804 - RNA, 2550 nt, Artificial Sequence
  derived and/or modified sequence opt1 from SMEK2__Homo_sapiens__NP_001116436
augagcgacacccgccggcgcgugaaggucuacacccugaacgaggaccggcagugggacgaccgcggcacggggcacguguccagcaccuacguggaggagcucaagggcaugucccugcugguccgggccgagagcgacgggucccuccugcuggagagcaagaucaaccccaacaccgccuaccagaagcagcaggacacccucaucgugugguccgaggcggagaacuacgaccuggcccugagcuuccaggagaaggccggcugcgacgagaucugggagaagaucugccaggugcaggggaaggacccguccgucgaggugacgcaggaccucaucgacgagagcgaggaggagcgcuucgaggagaugcccgagaccucccaccugaucgaccugccgaccugcgagcucaacaagcuggaggagaucgccgaccuggugaccagcguccucuccagccccauccggcgcgagaagcuggcccuggcgcucgagaacgagggcuacaucaagaagcugcugcagcuguuccaggccugcgagaaccucgagaacacggagggccugcaccaccucuacgagaucauccgggggauccuguuccugaacaaggccacccucuucgaggugauguucuccgacgagugcaucauggacguggucggcugccuggaguacgaccccgcccuggcgcagcccaagcgccaccgggaguuccucaccaagaccgccaaguucaaggaggugauccccaucacggacagcgagcugcgccagaagauccaccagaccuaccgggugcaguacauccaggacaucauccugcccaccccguccgucuucgaggagaacuuccucagcacccugacguccuucaucuucuucaacaagguggagaucgugagcaugcugcaggaggacgagaaguuccucagcgaggucuucgcccagcugaccgacgaggccaccgacgacgacaagcgccgggagcuggugaacuucuucaaggaguucugcgccuucucccagacccuccagccccagaaccgcgacgcguucuucaagacgcuggccaagcuggggauccuccccgcccuggagaucgugaugggcauggacgaccugcagguccggagcgccgccaccgacaucuucuccuaccucguggaguucagccccuccauggugcgcgaguucgucaugcaggaggcgcagcagagcgacgacgacauccugcugaucaacguggucaucgagcagaugaucugcgacaccgacccggagcucgggggcgccgugcagcugaugggccugcugcggacccucaucgaccccgagaacaugcuggccacgaccaacaagaccgagaaguccgaguuccugaacuucuucuacaaccacugcaugcacgugcucaccgcgccccugcugacgaacaccagcgaggacaagugcgagaaggacuucuuccucaagcacuaccgcuacuccuggagcuucgucugcacccccucccacagccacucccacagcaccccguccagcuccaucagccaggacaacaucgugggguccaacaagaacaacacgaucugccccgacaacuaccagaccgcccagcugcuggcccucauccuggagcugcucaccuucugcguggagcaccacaccuaccacaucaagaacuacaucaugaacaaggaccugcugcggcgcguccucgugcugaugaacagcaagcacacguuccuggcccucugcgcccugcgcuucaugcggcgcaucaucggccugaaggacgaguucuacaaccgguacaucaccaaggggaaccucuucgagcccgugaucaacgcccugcuggacaacggcacccgcuacaaccuccugaacagcgccgucaucgagcuguucgaguucauccggguggaggacaucaagucccucaccgcgcacaucguggagaacuucuacaaggcccuggagagcaucgaguacguccagaccuucaagggccugaagacgaaguacgagcaggagaaggaccgccagaaccagaagcucaacuccgugcccagcauccugcgguccaaccgcuuccggcgcgacgccaaggcccuggaggaggacgaggagaugugguucaacgaggacgaggaggaggaggggaaggcgguggucgccccgguggagaagcccaagcccgaggacgacuuccccgacaacuacgagaaguucauggagaccaagaaggccaaggagagcgaggacaaggagaaccucccgaagcggaccucccccggcggguucaaguucaccuucagccacuccgccagcgccgcgaacggcacgaacuccaagagcguggucgcccagaucccgcccgccaccuccaacgggagcuccagcaagaccaccaaccugcccacguccgugaccgccaccaagggcagccuggugggccucgucgacuaccccgacgacgaggaggaggacgaggaggaggagagcagcccccgcaagcggccgcgccugggguccuga

SEQ ID NO: 36805 - RNA, 10986 nt, Artificial Sequence
  derived and/or modified sequence opt1 from SMG1__Homo_sapiens__NP_055907
augucccggcgggcccccggcucccgccugagcuccgggggcgggggcgggggcaccaaguacccgcggagcuggaacgacuggcagccccgcaccgacuccgccagcgccgaccccgacaaccucaaguacuccagcucccgggaccgcggcgggagcuccagcuacggccugcagcccuccaacagcgccguggugucccggcagcgccacgacgacacccgggugcacgccgacauccagaacgacgagaagggcggguacagcgugaacgggggcuccggcgagaacaccuacgggcgcaagagccugggccaggagcuccgggugaacaacgugaccuccccggaguucaccagcgugcagcacgggagccgcgcccuggccaccaaggacaugcggaagucccaggagcgcagcauguccuacagcgacgagucccggcugagcaaccuccugcgccggaucacccgcgaggacgaccgggaccgccggcuggccaccgucaagcagcucaaggaguucauccagcagcccgagaacaagcuggugcuggugaagcagcucgacaacauccuggccgccguccacgacgugcugaacgaguccagcaagcuccugcaggagcugcgccaggagggcgccugcugccucggccugcugugcgcgucccucagcuacgaggccgagaagaucuucaaguggaucuucuccaaguucagcuccagcgccaaggacgaggugaagcugcuguaccucugcgccaccuacaaggcccuggagaccgucggggagaagaaggcguucuccagcgugaugcagcuggugaugaccucccuccagagcauccuggagaacgucgacacccccgagcugcucugcaagugcgugaagugcauccugcugguggcccgcugcuacccccacaucuucuccaccaacuuccgggacaccgucgacauccucgugggcuggcacaucgaccacacccagaagccgagccugacccagcaggucagcggguggcugcagucccucgagcccuucugggucgccgaccuggccuucagcaccacgcugcucggccaguuccuggaggacauggaggccuacgcggaggaccugucccacguggccagcggggaguccguggacgaggacgugccgccgcccagcgugucccuccccaagcuggccgcccugcuccgcgucuucagcaccguggugcgguccaucggcgagcgcuucagccccauccgggggccgcccaucaccgaggccuacgucaccgacgugcuguaccgcgugaugcggugcgucaccgcggccaaccagguguucuucuccgaggccgugcugaccgccgccaacgagugcgucggggugcuccugggcagccuggaccccuccaugaccauccacugcgacauggugaucaccuacgggcuggaccagcucgagaacugccagacgugcggcaccgacuacaucaucagcguccugaaccugcucacccugaucguggagcagaucaacaccaagcugcccuccagcuucguggagaagcuguucauccccuccagcaagcugcuguuccuccgcuaccacaaggagaaggaggucguggcgguggcccacgccgucuaccaggccgugcugagccugaagaacauccccgugcucgagacggcguacaagcugauccugggggagaugaccugcgcccucaacaaccugcugcacucccuccagcugcccgaggccugcagcgagaucaagcacgaggccuucaagaaccacgucuucaacguggacaacgccaaguucguggucaucuucgaccuguccgcgcucaccaccaucggcaacgccaagaacagccugaucggcaugugggcccugucccccacgguguucgcccuccugagcaagaaccugaugaucgugcacuccgaccucgccguccacuuccccgcgauccaguacgccgugcuguacacccuguacagccacugcacccggcacgaccacuucaucuccagcucccucagcuccagcucccccagccuguucgacggggccgugaucuccaccgucacgaccgccaccaagaagcacuucagcaucauccugaaccuccugggcauccugcucaagaaggacaaccugaaccaggacacccgcaagcugcucaugaccugggcccuggaggcggccgugcugaugaagaaguccgagacguacgcgccccucuucagccugcccagcuuccacaaguucugcaaggggcugcucgccaacacccugguggaggacgucaacaucugccugcaggcgugcuccagccuccacgcccuguccagcucccugcccgacgaccuccugcagcggugcguggacgugugccgcguccagcuggugcacagcggcacccggauccgccaggccuucgggaagcuccugaaguccaucccgcuggacgugguccucagcaacaacaaccacaccgagauccaggagaucucccuggcccugcggagccacauguccaaggcccccagcaacacguuccacccccaggacuucuccgacgugaucagcuucauccucuacggcaacucccaccgcaccggcaaggacaacuggcuggagcggcuguucuacagcugccagcgccucgacaagcgggaccaguccaccaucccgcgcaaccugcugaagaccgacgcggugcucuggcagugggccaucugggaggccgcccaguucacgguccugagcaagcugcgcacgccccucgggcgggcccaggacaccuuccagaccaucgagggcaucauccgcucccuggcggcccacacgcugaaccccgaccaggacgugagccaguggaccaccgccgacaacgacgaggggcacggcaacaaccagcuccggcuggugcugcuccugcaguaccuggagaaccucgagaagcugauguacaacgccuacgagggcugcgccaacgcgcugaccagcccgcccaaggucauccgcacguucuucuacaccaaccggcagaccugccaggacuggcucacccgcauccggcuguccaucaugcgcguggggcugcucgccggccagcccgccgugacgguccggcacggguucgaccugcugaccgagaugaagaccaccagccucucccagggcaacgagcuggaggugacgaucaugaugguggucgaggcccugugcgagcuccacugccccgaggcgauccaggggaucgccguguggagcuccagcaucgucggcaagaaccugcuguggaucaacuccguggcccagcaggccgagggccgcuucgagaaggccagcguggaguaccaggagcaccucugcgcgaugaccggggucgacugcugcaucuccagcuucgacaaguccgugcugacccuggccaacgccggccggaacagcgccucccccaagcacagccugaacggggagucccgcaagaccgugcucagcaagccgacggacuccagccccgaggucaucaacuaccugggcaacaaggccugcgagugcuacaucuccaucgcggacugggccgccgugcaggaguggcagaacgccauccacgaccugaagaaguccaccagcuccaccagccucaaccugaaggccgacuucaacuacaucaagucccugagcuccuucgagagcgggaaguucguggagugcaccgagcagcucgagcugcugcccggcgagaacaucaaccuccuggcgggcggguccaaggagaagaucgacaugaagaagcugcuccccaacaugcugagcccggacccccgggagcugcagaaguccaucgagguccagcuccugcgcagcuccgugugccuggccacggcccucaaccccaucgagcaggaccagaaguggcagagcaucaccgagaacguggucaaguaccugaagcagaccucccggaucgccaucggcccccugcgccucagcacccugacggugucccagagccugccggugcucuccacccugcagcuguacugcagcuccgcccucgagaacaccgucagcaaccggcugagcaccgaggacugccugaucccccucuucuccgaggcgcugcgcagcugcaagcagcacgacgugcggcccuggaugcaggcccugcgcuacaccauguaccagaaccagcuccuggagaagaucaaggagcagacggugcccauccggucccaccugauggagcucgggcugaccgccgccaaguucgcgcgcaagcgcggcaacgucagccuggccacccggcuccuggcccagugcuccgaggugcagcuggggaagaccacgaccgcccaggaccucgugcagcacuucaagaagcugagcacccagggccaggucgacgagaaguggggcccggagcuggacaucgagaagaccaagcuccuguacacggccgggcaguccacccacgcgauggagaugcugagcuccugcgccaucagcuucugcaaguccgugaaggccgaguacgccguggccaagagcauccucacccuggcgaaguggauccaggccgaguggaaggagaucuccggccagcugaagcaggucuaccgcgcccagcaccagcagaacuucaccgggcucagcacgcuguccaagaacauccugacccucaucgagcugcccagcgugaacaccauggaggaggaguacccccggaucgaguccgagagcaccgugcacaucggcgucggggagcccgacuucauccugggccagcucuaccaccuguccagcgugcaggccccggagguggccaagagcugggcggcccuggccuccugggccuaccgcuggggccggaaggucguggacaacgcgagccagggggagggcgugcgccuccugccccgggagaaguccgagguccagaaccugcuccccgacacgaucaccgaggaggagaaggagcgcaucuacgggauccugggccaggccgugugccggccggccggcauccaggacgaggacaucacccugcagaucaccgagagcgaggacaacgaggaggacgacaugguggacgucaucuggcgccagcucaucuccagcugccccuggcuguccgagcuggacgagagcgccacggagggggugaucaagguguggcggaaggucguggaccgcaucuucucccucuacaagcugagcugcuccgccuacuucaccuuccugaagcucaacgcgggccagaucccccuggacgaggacgacccccggcugcaccucagccaccgcguggagcaguccaccgacgacaugaucgucauggccacccugcggcugcuccgccugcuggugaagcacgccggggagcuccggcaguaccuggagcacggccuggagacgaccccgaccgcccccuggcgcgggaucaucccccagcuguucagccggcugaaccaccccgagguguacguccgccaguccaucugcaaccugcucugccgcguggcccaggacagcccgcaccugauccuguaccccgcgaucgugggcaccaucucccucagcagcgagucccaggccagcggcaacaaguucuccacggccauccccacccugcuggggaacauccagggcgaggagcuccuggucagcgagugcgagggcggcagcccgcccgccagccaggacuccaacaaggacgagcccaagagcgggcugaacgaggaccaggccaugaugcaggacugcuacuccaagaucguggacaagcucagcuccgcgaaccccaccauggugcugcagguccagaugcugguggccgagcuccggcgcgucaccgugcugugggacgagcuguggcugggcgugcuccugcagcagcacauguacguccugcggcgcauccagcagcucgaggacgaggugaagcgggugcagaacaacaacacgcugcgcaaggaggagaagaucgccaucaugcgggagaagcacaccgcccugaugaagcccaucgucuucgcgcucgagcacgugcgcagcaucaccgccgcccccgccgagacgccccacgagaagugguuccaggacaacuacggcgacgccaucgagaacgcgcuggagaagcugaagacgccccucaaccccgccaagccgggguccagcuggauccccuucaaggagaucaugcugucccugcagcagcgggcccagaagcgcgccagcuacauccuccggcuggaggagaucucccccuggcuggccgcgaugaccaacaccgagaucgcccuccccggcgaggugagcgcccgcgacaccgucaccauccacuccgucgggggcacgaucaccauccugccgaccaagaccaagcccaagaagcuccucuuccuggggagcgacggcaagagcuaccccuaccuguucaagggccucgaggaccugcaccuggacgagcggaucaugcaguuccucuccaucgugaacacgauguucgccaccaucaaccgccaggagacgccccgguuccacgcccgccacuacagcgucaccccgcuggggacgcgguccggccugauccaguggguggacggggcgacgccccucuucggccuguacaagcgcuggcagcagcgggaggccgcccugcaggcccagaaggcccaggacagcuaccagacgccccagaacccgggcaucgugccccgccccuccgagcucuacuacagcaagaucgggcccgcgcugaagaccgucggccugucccucgacgugagccggcgcgacuggccgcugcacgugaugaaggccguccuggaggagcucauggaggccaccccgcccaaccugcuggccaaggagcucugguccagcugcaccacccccgacgagugguggcgcgugacccaguccuacgcgcggagcacggccgugauguccauggucggguacaucaucggccugggggaccgccaccuggacaacgugcucaucgacaugaccaccggcgaggugguccacaucgacuacaacgugugcuucgagaagggcaagagccugcgggugccggagaagguccccuuccgcaugacccagaacaucgagacggcccugggggugaccggcguggagggggucuuccggcucuccugcgagcagguccugcacaucaugcgccggggccgcgagacccugcucacccugcuggaggccuucguguacgacccccucgucgacuggacggccgggggcgaggcgggcuucgccggggccguguacggcgggggcgggcagcaggccgagagcaagcaguccaagcgggagauggagcgcgagaucacccggagccuguucuccagccgcguggccgagaucaaggucaacugguucaagaaccgggacgagaugcugguggugcuccccaagcuggacggcagccuggacgaguaccucucccugcaggagcagcugaccgacgucgagaagcuccagggcaagcugcuggaggagaucgaguuccucgagggggcggagggcguggaccacccgagccacacccugcagcaccgcuacuccgagcacacgcagcugcagacccagcagcgggccgugcaggaggccauccaggucaagcucaacgaguucgagcaguggaucacccacuaccaggccgccuucaacaaccuggaggcgacccagcuggccagccuccugcaggagaucuccacgcagauggaccuggggccgcccagcuacgugcccgccaccgccuuccuccagaacgcgggccaggcccaccugaucucccagugcgagcagcuggagggggaggugggcgcccuccugcagcagcgccggagcguccugcgcggcugccucgagcagcugcaccacuacgccaccguggcccugcaguacccgaaggcgaucuuccagaagcaccggaucgagcaguggaagaccuggauggaggagcucaucugcaacacgaccguggagcgcugccaggagcuguaccgcaaguacgagaugcaguacgcgccccagccgcccccgaccgucugccaguucaucaccgccacggagaugacccugcagcgguacgccgccgacaucaacucccgccucauccgccagguggagcgccugaagcaggaggcggugaccguccccgugugcgaggaccagcugaaggagaucgagcggugcaucaaggucuuccuccacgagaacggggaggagggcagccugucccuggccagcgugaucaucuccgcccucugcacccugacccgccggaaccugaugauggagggggccgccagcuccgcgggcgagcagcucguggaccugacgagccgcgacggcgccugguuccuggaggagcucugcuccaugagcgggaacgugaccugccuggugcagcugcugaagcagugccaccucgugccccaggaccuggacauccccaacccgauggaggccuccgagaccguccaccuggccaacggcguguacaccagccuccaggagcugaacagcaacuuccggcagaucaucuuccccgaggcgcugcgcugccucaugaagggggaguacacgcuggaguccaugcugcacgagcucgacggccugaucgagcagaccaccgacggggugccccugcagacccucgucgagagccugcaggccuaccugcggaacgccgccaugggccucgaggaggagacgcacgcccacuacaucgacguggcgcgccugcugcacgcccaguacggcgagcucauccagccccggaacggguccguggacgagaccccgaagaugagcgccggccagaugcugcuggucgccuucgacgggauguucgcccagguggagaccgcguucucccuccugguggagaagcugaacaagauggagauccccaucgccuggcgcaagaucgacaucauccgggaggcccgcagcacccaggucaacuucuucgacgacgacaaccaccgccaggugcucgaggagaucuucuuccugaagcggcugcagacgaucaaggaguucuuccggcucugcggcaccuucuccaagacccugagcggguccagcucccuggaggaccagaacaccgugaacggccccguccagaucgugaacgugaagacccucuuccgcaacagcugcuucuccgaggaccagauggccaagccgaucaaggccuucaccgcggacuucguccggcagcugcugaucggccuccccaaccaggcccuggggcugacccucugcagcuucaucuccgcccugggcguggacaucaucgcccagguggaggccaaggacuucggggcggagagcaaggucuccguggacgaccugugcaagaaggccguggagcacaacauccagaucggcaaguucagccagcucgucaugaaccgcgccaccgugcuggccuccagcuacgacacggcguggaagaagcacgaccuggugcgccggcucgagaccagcaucuccagcugcaagaccucccugcagcgcguccagcugcacaucgccauguuccaguggcagcacgaggaccuccugaucaaccggccccaggccaugagcgugacgcccccgccccgcuccgccauccugacgagcaugaagaagaagcuccacacccugucccagaucgagaccagcaucgccaccgugcaggagaagcuggcggcccucgaguccagcaucgagcagcggcugaagugggccgggggcgccaaccccgcccuggcgcccguccuccaggacuucgaggccacgaucgccgagcgccggaaccuggugcugaaggagucccagcgcgccagccaggugaccuuccucugcuccaacaucauccacuucgagagccugcggacccgcaccgccgaggcgcugaaccucgacgccgcccuguucgagcugaucaagcggugccagcagaugugcuccuucgccagccaguucaacuccagcgucuccgagcucgagcugcgccugcuccagcggguggacacgggccuggagcaccccaucgggagcagcgaguggcugcucuccgcgcacaagcagcugacccaggacaugagcacccagcgcgccauccagaccgagaaggagcagcagaucgagacggugugcgagaccauccagaaccuggucgacaacaucaagaccgugcucaccggccacaaccggcagcugggggacgugaagcaccuccucaaggccauggccaaggacgaggaggccgcgcuggccgacggcgaggacguccccuacgagaacuccgugcgccaguuccugggggaguacaagagcuggcaggacaacauccagaccguccucuucacgcugguccaggccaugggccaggugcggucccaggagcacguggagaugcugcaggagaucacccccacccucaaggagcugaagacccagagccaguccaucuacaacaaccuggucagcuucgccagcccccucgugacggacgccaccaacgagugcagcuccccgaccagcuccgcgaccuaccagcccagcuucgccgccgccgugcgcuccaacacgggccagaagacccagcccgacgucaugagccagaacgcccggaagcugauccagaagaaccuggcgaccuccgccgacacgcccccgagcacggugcccgggaccggcaagagcgucgccugcucccccaagaaggccgugcgcgaccccaagaccgggaaggccgugcaggagcgcaacagcuacgcggucuccguguggaagcgggugaaggccaagcucgagggccgcgacgucgacccgaaccggcgcaugagcguggccgagcaggucgacuacgugaucaaggaggccaccaaccuggacaaccuggcgcagcucuacgagggcuggacggccuggguguga

SEQ ID NO: 36806 - RNA, 993 nt, Artificial Sequence
  derived and/or modified sequence opt1 from SMG6__Homo_sapiens__NP_001269255
augcgcuuccggcugugccaccagcgcggcugcugcccccacgagcgggagaacacgugcacgugcaagaugaucaucagcucccuccaggugaucgccgccgacugcaagcgcgucaccgugcugaaguacuuccuggaggcgcucugcgggcaggaggagccgcugcuggccuucaagggcgggaaguacgugagcgucgcccccgugcccgacaccaugggcaaggagauggggucccaggagggcacccggcucgaggacgaggaggaggacguggucaucgaggacuucgaggaggacagcgaggccgagggcuccgggggcgaggacgacauccgcgagcugcgggccaagaagcuggcgcucgcccgcaagaucgccgagcagcagcggcgccaggagaagauccaggccgugcuggaggaccacagccagaugcggcagauggagcuggagauccgcccccucuuccuggugccggacaccaacggguucaucgaccaccuggcgucccucgcccggcugcuggagagccgcaaguacauccucgucgugccccugaucgugaucaacgagcuggacggccucgccaaggggcaggagaccgaccaccgggccggcggcuacgcccgcgucgugcaggagaaggcgcggaaguccaucgaguuccuggagcagcgcuucgagagccgggacuccugccugcgcgcccucaccagccgggggaacgagcuggaguccaucgccuuccgcagcgaggacaucaccggccagcuggggaacaacgacgaccucauccuguccugcugccugcacuacugcaaggacaaggccaaggacuucaugcccgccagcaaggaggagcccauccgccuccugcgggaggugguccugcucaccgacgaccgcaaccugcgggugaaggcgcugacgcgcaacgugccgguccgggacauccccgccuuccucaccugggcccaggugggcuga

SEQ ID NO: 36807 - RNA, 2976 nt, Artificial Sequence
  derived and/or modified sequence opt1 from SMG8__Homo_sapiens__NP_060619
auggccggccccgugagccugcgcgaccuccugaugggggccuccgcguggaugggcagcgagucccccgggggcagccccaccgagggcggcggcuccgccgccgggggccccgagcccccguggcgggaggacgagaucugcgucguggggaucuucggcaagaccgcccugcgccucaacagcgagaaguucucccuggugaacacggucugcgaccgccagguguucccccuguuccggcaccaggaccccggggaccccggcccgggcauccggaccgaggccggggcggugggcgaggccgggggcgccgaggaccccggcgccgcggccgggggcagcguccgcggguccggcgccguggccgaggggaaccggaccgaggccggcagccaggacuacucccuccugcaggcguacuacagccaggaguccaaggugcuguaccuccugcugaccagcaucugcgacaacucccagcuccugcgcgccugccgggcccugcagagcggcgaggccgggggcgggcucucccugccccacgccgaggcgcacgaguucuggaagcaccaggagaagcugcagugccucagccugcuguaccucuucuccgucugccacauccugcugcucgugcaccccacgugcagcuucgacaucaccuacgaccgcguguuccgggcccuggacggccugcgccagaagguccucccgcugcugaagaccgccaucaaggacugccccguggggaaggacuggaagcucaacugccggcccugcccgccgcgccugcuguuccucuuccagcugaacggcgcccugaagguggagccgccccggaaccaggaccccgcccaccccgacaagcccaagaagcacagccccaagcgccggcuccagcacgcgcuggaggaccagaucuaccgcaucuuccggaagucccgcguccugaccaaccagagcaucaacugccucuucacggugcccgccaaccaggccuucguguacaucgucccgggcucccaggaggaggaccccguggggaugcugcuggaccagcuccggagccacugcaccgugaaggaccccgagucccugcugguccccgccccgcucagcggcccccgccgcuaccaggugaugcggcagcacucccgccagcagcugagcuuccacaucgacuccagcuccagcuccagcuccgggcagcugguggacuucacccuccgggaguuccuguggcagcacgucgagcuggugcugagcaagaagggcuucgacgacuccgucgggcgcaacccccagccgagccacuucgagcuccccaccuaccagaaguggaucuccgccgcgagcaagcuguacgagguggccaucgacggcaaggaggaggaccugggcagccccacgggggagcucaccuccaagauccugagcuccaucaaggugcuggagggcuuccucgacaucgacaccaaguucagcgagaaccggugccagaaggcccugcccauggcccacuccgcguaccagagcaaccugccgcacaacuacaccaugacgguccacaagaaccagcucgcccaggcccugcgcguguacucccagcacgcccgggggcccgccuuccacaaguacgcgaugcagcugcacgaggacugcuacaaguucuggagcaacggccaccagcucugcgaggagcgcucccugaccgaccagcacugcgugcacaaguuccacagccugcccaaguccggcgagaagcccgaggccgaccggaacccgcccguccucuaccacaacagccgcgcccgguccaccggggccugcaacugcggccgcaagcaggcgccccgggacgaccccuucgacaucaaggccgccaacuacgacuucuaccagcugcuggaggagaagugcugcgggaagcucgaccacaucaacuucccgguguucgagcccagcacccccgaccccgccccggccaagaacgaguccagccccgccccgcccgacuccgacgcggacaagcugaaggagaaggagccccagacgcagggcgagagcaccagccugucccucgcccugagccuggggcaguccaccgacagccucggcaccuaccccgccgacccccaggccggcggggacaaccccgaggugcacggccaggucgaggugaagacggagaagcgcccgaacuucguggaccggcaggcguccaccgucgaguaccugcccgggaugcugcacagcaacugccccaagggccuccugccgaaguucuccagcuggucccuggugaagcucgggcccgccaagagcuacaacuuccacaccggccuggaccagcagggcuucauccccgggaccaacuaccugaugcccugggacaucgugauccgcacgcgggccgaggacgagggcgaccucgacaccaacuccuggccggcccccaacaaggccauccccgggaagcgcagcgcggucgugaugggccgggggcgccgccgggacgacaucgcccgcgccuucgugggcuucgaguacgaggacucccggggccgccgguucaugugcagcgggcccgacaaggucaugaaggugaugggcuccgggccgaaggagagcgcccugaaggcccugaacuccgacaugccccucuacauccugagcuccagccagggccgcgggcugaagccccacuacgcgcagcucaugcggcuguucguggucgugcccgacgccccgcugcagaucauccucaugccccaggugcagcccgggcccccgcccugccccgucuucuaccccgagaagcaggagaucacccugccgcccgacggccugugggugcuccgcuuccccuacgccuacgugaccgagcgggggcccugcuucccgcccaaggagaacguccagcugaugagcuacaaggugcugcgcggcgugcucaaggccgucacgcaguga

SEQ ID NO: 36808 - RNA, 225 nt, Artificial Sequence
  derived and/or modified sequence opt1 from SMIM15__Homo_sapiens__NP_001041714
auguucgacaucaaggccugggccgaguacguggucgagugggcggccaaggaccccuacggcuuccugaccaccgugauccucgcccugacgccgcuguuccucgccagcgccgugcuguccuggaagcuggcgaagaugaucgaggcccgcgagaaggagcagaagaagaagcagaagcggcaggagaacaucgccaaggccaagcgccucaagaaggacuga

SEQ ID NO: 36809 - RNA, 324 nt, Artificial Sequence
  derived and/or modified sequence opt1 from SMIM19__Homo_sapiens__NP_001129148
auggccggcggguacggcgugaugggggacgacggcagcaucgacuacaccguccacgaggccuggaacgaggcgaccaacguguaccugaucgugauccucgucuccuucgggcuguucauguacgccaagcgcaacaagcggcgcaucaugcggaucuucagcgugcccccgacggaggagacccuguccgagcccaacuucuacgacaccaucagcaagauccgccuccggcagcagcuggagauguacuccaucagccgcaaguacgacuaccagcagccccagaaccaggccgacuccgugcagcugagccucgaguga

SEQ ID NO: 36810 - RNA, 204 nt, Artificial Sequence
  derived and/or modified sequence opt1 from SMIM20__Homo_sapiens__NP_001138904
augagccgcaaccugcggaccgcccucaucuucggcggguucaucucccugaucggcgccgcguucuaccccaucuacuuccgcccccugaugcggcucgaggaguacaagaaggagcaggccaucaaccgcgccgggaucgugcaggaggacguccagccgcccggccugaagguguggagcgaccccuucgggcggaaguga

SEQ ID NO: 36811 - RNA, 306 nt, Artificial Sequence
  derived and/or modified sequence opt1 from SMIM21__Homo_sapiens__NP_001032408
auggaccaguacgugagcaccgcgcccccgcgcuuccccaucgcccagcugggcaccuucaagcaggacuccgccgggaugggccggaucuucaaggggaaccuccugcagaagaaggcccugacgaccuucgagaacgagcaccacauccgcuucuucacccuccugguccuguuccacgugauggugcuccugcggaaccacagccgcauccagggcgucuccgaggacuggaagcgggccaacagcaucuuccgcaacuuccugcggcucaaguccagccgcaacaccgccgaggccgaguga

SEQ ID NO: 36812 - RNA, 519 nt, Artificial Sequence
  derived and/or modified sequence opt1 from SMIM23__Homo_sapiens__NP_001276899
auggccacccagcaggucgacagccgccgccagguggccgcggagcaggucgccgcccagcugcucgagcggcggcgcggcucccacugcgacgacgagaagcagacccugcuggcccuccugauccuggugcucuaccugagcacggagaucuggggguccagcugggagguguccgagcggauccgcgagugcaacuacuaccagaaccuggccgugccccagggccucgaguaccagaccaacgagccgagcgaggagcccaucaagaccauccggaacuggcugaaggagaagcugcacguguucuccgagaagcucgaggaggagguccagcagcuggagcagcuggcgugggaccucgagcuguggcuggacgcccuccugggggagccccaccaggaggagcacugcagcaccuacaagucccaccugugggagugggccugggcccucggccgcgagcacaagggcggggagggccugcuggagaucagccucuccggggcggagcuguga

SEQ ID NO: 36813 - RNA, 720 nt, Artificial Sequence
  derived and/or modified sequence opt1 from SMIM5__Homo_sapiens__XP_011523418
augcgccggcuggccggccgcgccgggcacagccaggugacccaggacuccaaguucagccccaagaccccguccgacgcggagcggcacaagggccucccccgcgacuggcugcagagccugcuccugucccugcgggggccgcccgcgccccacugccuccugcuguuccuccgcgaggcccggggccgcgaccagcccgggagcggccagcgggaccgccggggcgggcugcccgagggccgcgucggggcccccgaccugcgggcccuccaggacuccccgccccaggcccagguggagccgccccagggcccgcccgggcaggagggccgcgagcccacgagcuucuucuccagccagccccggcccagcccccgccggggcagccgcggggagggcgaggaggaggagggcgggggcgagcgggagcuggugcugucccucagcuccgcccugcgcgccgaggacgaccagcagcagaagucccaggccgagaccgccgccgggugccagcagcgguccugggccgaggcgccccgcggcgccgcggcccccaccaaggagguccgcgggcagcacguggaggccccgcgguggggcaccgccgcccagccgcccacgcccgagcugcccggggcguggcccacccacugcuggugcagccagcucaccgcccagcccggcuccagcagccugggccccucccgcaccccguga

SEQ ID NO: 36814 - RNA, 885 nt, Artificial Sequence
  derived and/or modified sequence opt1 from SMN2__Homo_sapiens__NP_059107
auggccaugagcuccggcgggagcggcgggggcgugcccgagcaggaggacuccguccuguuccgccgggggaccggccagagcgacgacuccgacaucugggacgacaccgcccucaucaaggcguacgacaaggccguggccagcuucaagcacgcccugaagaacggcgacaucugcgagacguccgggaagccgaagaccacccccaagcgcaagcccgccaagaagaacaagagccagaagaagaacaccgcggccucccugcagcaguggaaggugggcgacaagugcagcgccaucugguccgaggacgggugcaucuaccccgccacgaucgcgagcaucgacuucaagcgggagaccugcgucgugguguacaccggcuacgggaaccgcgaggagcagaaccucuccgaccugcugagcccgaucugcgaggucgccaacaacaucgagcagaacgcccaggagaacgagaacgagucccaggugagcaccgacgaguccgagaacagccggucccccggcaacaagagcgacaacaucaagcccaagagcgcccccuggaacuccuuccucccgcccccccccccgaugcccggcccccgccuggggcccggcaagccggggcugaaguucaacggccccccccccccgcccccccccccgcccccccaccuccugagcugcuggcugcccccguuccccuccggccccccgaucauccccccccccccgcccaucugccccgacagccucgacgacgccgacgcgcugggguccaugcugaucagcugguacauguccggcuaccacacgggguacuacaugggcuuccggcagaaccagaaggaggggcgcugcagccacucccucaacuga

SEQ ID NO: 36815 - RNA, 1308 nt, Artificial Sequence
  derived and/or modified sequence opt1 from SMOC1__Homo_sapiens__NP_001030024
augcugcccgcccgcugcgcccggcuccugaccccgcaccuccugcuggugcugguccagcucagccccgcgcgcggccaccggaccacggggccccgcuuccugaucuccgaccgggacccccagugcaaccugcacugcagccgcacccagccgaagcccaucugcgccuccgacggccggagcuacgaguccaugugcgaguaccagcgcgccaagugccgggaccccacccucgggguggugcaccgcggccggugcaaggacgccgggcagagcaagugccgccuggagcgggcccaggcgcuggagcaggccaagaagccccaggaggccgucuucgugccggagugcggcgaggacggcuccuucacccaggugcagugccacacguacaccggguacugcuggugcgucacccccgacggcaagcccaucagcggguccagcgugcagaacaagacccccgugugcuccggcagcgucacggacaagccgcucucccaggggaacagcggccgcaaggacgacggcuccaagcccacccccaccauggagacccagcccguguucgacggggacgagaucacggccccgacccuguggaucaagcaccuggugaucaaggacagcaagcucaacaacaccaacauccggaacuccgagaaggucuacagcugcgaccaggagcgccaguccgcgcuggaggaggcccagcagaacccccgggagggcaucgugauccccgagugcgcccccgggggccuguacaagccggugcagugccaccagagcaccggcuacugcuggugcguccucguggacacggggcgcccccugcccggcaccagcacccgguacgugaugcccuccugcgagagcgacgcccgcgccaagaccacggaggcggacgacccguucaaggaccgggagcugcccgggugccccgagggcaagaagauggaguucaucaccucccuccuggacgcccugaccaccgacaugguccaggccaucaacagcgccgcccccaccgggggcggccgcuucuccgagccggaccccagccacacgcucgaggagcgcguggugcacugguacuucucccagcuggacagcaacuccagcaacgacaucaacaagcgggagaugaagcccuucaagcgcuacgucaagaagaaggcgaagccgaagaagugcgcccggcgcuucaccgacuacugcgaccugaacaaggacaaggugaucucccuccccgagcugaaggggugccugggcgugagcaaggaggucgggcggcucguguga

SEQ ID NO: 36816 - RNA, 1341 nt, Artificial Sequence
  derived and/or modified sequence opt1 from SMOC2__Homo_sapiens__NP_001159884
augcugcucccccagcugugcuggcugccgcuccuggccggccugcucccgcccgugcccgcccagaaguucagcgcgcugaccuuccugcgcgucgaccaggacaaggacaaggacugcucccucgacugcgccgggagcccccagaagccccugugcgccuccgacggccggaccuuccugagccgcugcgaguuccagcgggccaagugcaaggacccccagcucgagaucgccuaccgcgggaacugcaaggacgugucccggugcguggcggagcgcaaguacacccaggagcaggcccggaaggaguuccagcaggucuucauccccgagugcaacgacgacggcaccuacagccaggugcagugccacuccuacaccggguacugcuggugcgugaccccgaacggccgccccaucagcggcacggccgucgcccacaagacgccccggugccccggguccgugaacgagaagcugccgcagcgcgagggcaccgggaagaccgacgacgcggccgcccccgcccuggagacccagccccagggcgacgaggaggacaucgccagccgguaccccacccucuggaccgagcaggucaagucccgccagaacaagaccaacaagaacagcguguccagcugcgaccaggagcaccaguccgcgcuggaggaggccaagcagccgaagaacgacaacguggugauccccgagugcgcccacgggggccuguacaagcccguccagugccaccccagcacgggcuacugcuggugcgugcucguggacaccgggcggccgauccccggcaccuccacccgcuacgagcagcccaagugcgacaacacggcccgggcccaccccgcgaaggcccgcgaccuguacaaggggcggcagcugcagggcugcccgggcgccaagaagcacgaguuccucaccagcguccuggacgcccuguccaccgacauggugcacgccgcgagcgaccccagcuccagcuccgggcgccucagcgagcccgaccccucccacacccuggaggagcgggugguccacugguacuucaagcugcucgacaagaacagcuccggcgacaucgggaagaaggagaucaagccguucaagcgcuuccugcggaagaaguccaagcccaagaagugcgugaagaaguucguggaguacugcgacgucaacaacgacaagagcaucagcgugcaggagcugaugggcugccucgggguggccaaggaggacggcaaggccgacacgaagaagcgccacacgccccgcggccacgccgaguccaccagcaaccggcagccgcgcaagcagggguga

SEQ ID NO: 36817 - RNA, 2364 nt, Artificial Sequence
  derived and/or modified sequence opt1 from SMO__Homo_sapiens__NP_005622
auggccgccgcgcgccccgcccggggcccggagcugccccuccuggggcugcuccugcugcuccugcugggcgaccccgggcgcggcgccgccagcuccgggaacgccaccggccccggcccgcggagcgccgggggcuccgcgcgccggagcgccgccgugaccgggcccccgccgccccucucccacugcggccgcgcggcccccugcgagccccugcgguacaacgucugccuggggagcgugcuccccuacggcgccacguccacccugcuggccggcgacagcgacucccaggaggaggcccacgggaagcucgugcuguggagcggccugcgcaacgcgccccggugcugggccgucauccagccccuccugugcgccguguacaugcccaagugcgagaacgaccgcguggagcugcccucccggacccucugccaggccacccgcgggccgugcgccaucgucgagcgggagcgcggcuggcccgacuuccugcggugcacgcccgaccgcuuccccgagggcugcaccaacgaggugcagaacaucaaguucaacagcuccgggcagugcgaggugccgcugguccggaccgacaaccccaagagcugguacgaggacguggagggcugcgggauccagugccagaacccccucuucaccgaggcggagcaccaggacaugcacuccuacaucgccgccuucggcgccgugacggggcugugcacccuguucacccucgccaccuucgucgcggacuggcgcaacagcaaccgguaccccgccgugauccuguucuacgugaacgccugcuucuucgucggcuccaucggcuggcuggcccaguucauggacggggcccgccgggagaucgugugccgcgcggacggcacgaugcgccucggggagccgaccagcaacgagacccuguccugcgugaucaucuucgucaucguguacuacgcccugauggccggcguggucugguucguggugcucaccuacgccuggcacacgagcuucaaggcgcuggggaccaccuaccagccccugagcggcaagaccuccuacuuccaccuccugacguggagccugcccuucguccucaccguggccauccuggccgucgcccagguggacggcgacuccgugagcgggaucugcuucgucggcuacaagaacuaccgguaccgcgccggguucgugcuggcgcccaucggccucgugcugaucgucgggggcuacuuccugauccggggcgugaugacccucuucuccaucaagagcaaccacccggggcugcuguccgagaaggccgccagcaagaucaacgagaccaugcuccgccugggcaucuucggguuccuggccuucggcuucgugcugaucacguucuccugccacuucuacgacuucuucaaccaggccgagugggagcggagcuuccgcgacuacguccucugccaggcgaacgugaccaucggccugcccaccaagcagcccaucccggacugcgagaucaagaaccggcccucccugcucguggagaagaucaaccuguucgccauguucgggaccggcaucgccaugagcacgugggucuggaccaaggccacccugcucaucuggcgccggaccuggugccgccugacggggcaguccgacgacgagcccaagcggaucaagaaguccaagaugaucgccaaggcguucagcaagcgccacgagcugcuccagaaccccggccaggagcugagcuucuccaugcacaccgugagccacgacgggccgguggccggccuggccuucgaccucaacgagcccuccgccgacgucagcagcgcgugggcccagcacgugaccaagaugguggcccggcgcggcgccauccugccccaggacaucuccgucacccccguggccacgccggugccgcccgaggagcaggcgaaccuguggcucgucgaggccgagaucagccccgagcugcagaagcggcuggggcgcaagaagaagcggcgcaagcggaagaaggaggugugcccccucgccccgccgcccgagcugcacccgcccgcccccgcccccuccaccaucccccgccugccccagcucccccgccagaagugccugguggcggccggcgccuggggcgccggggacagcugccggcagggggccuggacccuggucuccaaccccuucugccccgagcccuccccgccccaggaccccuuccuccccagcgcgcccgccccgguggccugggcccacggccgccggcagggccuggggcccauccacagccgcaccaaccugauggacaccgagcucauggacgcggacuccgacuucuga

SEQ ID NO: 36818 - RNA, 1668 nt, Artificial Sequence
  derived and/or modified sequence opt1 from SMOX__Homo_sapiens__NP_787033
augcagagcugcgaguccagcggcgacuccgccgacgacccccugagccgcgggcuccggcgccggggccagccgcgcgugguggugaucggggccggccuggcggggcuggccgccgccaaggcccuccuggagcagggcuucaccgacgugaccguccuggaggcguccagccacaucggcgggcgggugcaguccgugaagcucggccacgccacguucgagcugggggccaccuggauccacggcagccacgggaaccccaucuaccaccuggccgaggcgaacggccuccuggaggagaccaccgacggcgagcgcuccgucgggcggaucagccuguacuccaagaacggcguggccugcuaccucacgaaccacgggcgccggauccccaaggacguggucgaggaguucagcgaccuguacaacgagguguacaaccugacccaggaguucuuccgccacgacaagcccgugaacgccgagucccagaacagcgucggcguguucacccgggaggaggugcgcaaccggauccgcaacgacccggacgaccccgaggccaccaagcggcucaagcuggccaugauccagcaguaccugaaggucgaguccugcgagagcuccagccacuccauggacgaggugagccucagcgcguucggcgaguggacggagauccccggggcccaccacaucauccccuccggcuucaugcgcguggucgagcugcuggccgaggggaucccggcccacgugauccagcucggcaagcccgugcggugcauccacugggaccaggccagcgcgcgcccccgggggcccgagaucgagccgcgcggcgagggcgaccacaaccacgacaccggggagggcgggcagggcggggaggagccccggggcggccgcugggacgaggacgagcagugguccgucgugguggagugcgaggacugcgagcugauccccgccgaccacgucaucgugaccgucagccugggggugcucaagcgccaguacaccuccuucuuccggcccggccugccgacggagaagguggccgccauccaccgccuggggaucggcaccaccgacaagaucuuccucgaguucgaggagcccuucugggggcccgagugcaacagccugcaguucgucugggaggacgaggccgagucccacacccugacguacccgcccgagcucugguaccggaagaucugcggcuucgacgugcuguacccgcccgagcgcuacggccacgugcugagcggguggaucugcggcgaggaggcgcucgucauggagaagugcgacgacgaggccguggccgagaucugcaccgagaugcugcggcaguucaccgggaaccccaacauccccaagccccgccggauccugcgcuccgccuggggcagcaaccccuacuuccggggcuccuacagcuacacccaggugggguccagcggcgccgacgucgagaagcucgcgaagccccugccguacacggaguccagcaagaccgcccccaugcagguccuguucuccggggaggccacccaccgcaaguacuacagcaccacgcacggcgcccuccuguccgggcagcgggaggcggcccgccugaucgagauguaccgggaccucuuccagcagggcaccuga

SEQ ID NO: 36819 - RNA, 1896 nt, Artificial Sequence
  derived and/or modified sequence opt1 from SMPD1__Homo_sapiens__NP_000534
augccccgcuacggcgccagccugcggcaguccugcccgcgcagcgggcgggagcagggccaggacgggaccgccggcgcgcccgggcuccuguggaugggccuggugcucgcccuggcccuggcccucgcccuggcgcuggcccucuccgacagccgcguccugugggcccccgccgaggcgcacccccuguccccgcagggccaccccgcccggcuccaccgcaucgugccccggcugcgcgacguguucggguggggcaaccugaccugccccaucugcaaggggcucuucacggccaucaaccugggccugaagaaggagccgaacgucgcccggguggggagcguggccaucaagcucugcaaccugcugaagaucgcgccccccgccgucugccaguccaucgugcaccucuucgaggacgacaugguggaggucuggcgccggagcgugcugucccccagcgaggccugcggccugcuccugggcuccaccugcgggcacugggacaucuucagcuccuggaacaucagccugccgaccgugcccaagccccccccgaagccccccucccccccggcccccggcgcccccgucagccgcauccucuuccugaccgaccugcacugggaccacgacuaccucgaggggacggaccccgacugcgcggacccgcugugcugccggcgcggcuccggccugccccccgccagccggcccggggccggcuacuggggggaguacuccaagugcgaccucccgcugcgcacccuggagagccuccugagcggccuggggcccgccggccccuucgacaugguguacuggaccggcgacaucccggcccacgacguguggcaccagacccggcaggaccagcuccgcgcgcugacgaccgucaccgcccuggugcggaaguuccucgggcccgugcccgucuaccccgccgugggcaaccacgaguccaccccggugaacagcuuccccccccccuucaucgaggggaaccacuccagccgcuggcuguacgaggccauggccaaggcgugggagccguggcugcccgccgaggcccuccggacgcugcgcaucggcggguucuacgcccugucccccuaccccggccuccgccugaucagccugaacaugaacuucugcucccgggagaacuucuggcugcucaucaacagcaccgacccggcgggccagcugcaguggcuggucggggagcuccaggccgccgaggaccgcggcgacaaggugcacaucaucgggcacaucccccccggccacugccugaaguccuggagcuggaacuacuaccggaucguggcccgcuacgagaacacccuggccgcgcaguucuucgggcacacccacgucgacgaguucgagguguucuacgacgaggagacgcucucccggccccuggccgucgccuuccuggccccgagcgccaccaccuacaucggccucaaccccggcuaccgcguguaccagaucgacgggaacuacuccggcagcucccacgugguccuggaccacgagaccuacauccugaaccucacgcaggcgaacauccccggggccaucccccacuggcagcugcuguaccgggcccgcgagaccuacggccucccgaacacccugcccaccgccuggcacaaccugguguaccggaugcgcggcgacaugcagcucuuccagacguucugguuccuguaccacaaggggcacccccccagcgagccgugcggcacccccugccggcuggccacccucugcgcgcagcuguccgcccgcgccgacagccccgcccugugccggcaccucaugccggacgggucccugcccgaggcgcagagccuguggccccgcccccucuucugcuga

SEQ ID NO: 36820 - RNA, 1272 nt, Artificial Sequence
  derived and/or modified sequence opt1 from SMPD2__Homo_sapiens__NP_003071
augaagcccaacuucagccugcgccuccggaucuucaaccugaacugcuggggcaucccguaccuguccaagcaccgcgccgaccggaugcgccggcucggggacuuccugaaccaggagagcuucgaccuggcccuccuggaggaggugugguccgagcaggacuuccaguaccugcgccagaagcucagccccaccuaccccgcggcccaccacuuccgguccggcaucaucgggagcggccugugcgucuucuccaagcaccccauccaggagcugacccagcacaucuacacgcucaacggguacccguacaugauccaccacggcgacugguucagcggcaaggccguggggcugcuggugcuccaccuguccggcaugguccugaacgccuacgugacccaccuccacgccgaguacaaccgccagaaggacaucuaccuggcgcaccggguggcccaggccugggagcuggcccaguucauccaccacaccagcaagaaggcggacgucgugcuccugugcggggaccugaacaugcaccccgaggaccucggcugcugccugcugaaggaguggaccgggcuccacgacgccuaccuggagacgcgcgacuucaagggcuccgaggagggcaacaccauggugcccaagaacugcuacgucagccagcaggagcugaagcccuucccguucggggugcggaucgacuacgugcucuacaaggccgucuccggcuucuacaucagcugcaaguccuucgagaccaccacgggguucgacccccaccgcggcacgccccugagcgaccacgaggcccugauggccacccucuucgugcggcacuccccgccccagcagaaccccagcuccacccacggccccgcggagcgcagcccccugaugugcgugcugaaggaggccuggaccgagcucgggcugggcauggcccaggcccgguggugggccaccuucgcgagcuacgucaucgggcugggccuccugcugcucgcccugcugugcgugcucgccgccgggggcggcgccggggaggcggccauccugcuguggaccccguccgugggccucguccugugggccggggccuucuaccuguuccacgugcaggaggugaacggccuguaccgcgcccaggcggagcuccagcacguccuggggcgggcccgcgaggcccaggaccugggccccgagccccagcccgcccuccugcugggccagcaggagggggaccggaccaaggagcaguga

SEQ ID NO: 36821 - RNA, 1968 nt, Artificial Sequence
  derived and/or modified sequence opt1 from SMPD3__Homo_sapiens__NP_061137
auggugcuguacaccacccccuucccgaacagcugccuguccgcccugcacugcgucagcugggcccugaucuuccccugcuacuggcucguggaccgccuggcggccuccuucauccccacgaccuacgagaagcggcagcgcgccgacgaccccugcugccugcagcuccugugcaccgcccuguucaccccgaucuaccucgcccugcugguggcgagccuccccuucgccuuccugggcuuccuguucuggagcccccuccagagcgcccggcgccccuacaucuacucccggcuggaggacaaggggcuggccggcggggcggcccuccugagcgaguggaagggcacggggccgggcaaguccuucugcuucgccaccgccaacgucugccugcuccccgacagccuggcccgcgugaacaaccuguucaacacccaggcgcgggccaaggagaucggccagcgcauccggaacggggccgcccgcccccagaucaagaucuacaucgacucccccaccaacacgagcaucuccgccgcgagcuucuccagccucguguccccgcagggcggggacggcgucgcccgggccgugcccgggagcaucaagcgcaccgccuccguggaguacaagggcgacggcgggcggcaccccggcgacgaggccgcgaacgggcccgccagcggcgacccggucgacagcuccagccccgaggacgccugcaucgugcgcaucggcggggaggagggcgggcggccgcccgaggccgacgaccccgugcccggcgggcaggcccgcaacggcgcgggcgggggcccccgggggcagacccccaaccacaaccagcaggacggcgacuccgggagccugggcuccccgagcgccucccgcgagagccuggucaagggccgggccgggcccgacaccuccgccagcggcgagcccggggcgaacuccaagcuccuguacaaggccagcguggugaagaaggccgccgcccgccggcgccgccaccccgacgaggcguucgaccacgaggucuccgccuucuucccggccaaccuggacuuccucugccugcaggagguguucgacaagcgggccgccacgaagcugaaggagcagcuccacggcuacuucgaguacauccuguacgacgugggggucuacggcugccagggcugcugcagcuucaagugccugaacuccgggcuccuguucgcgagccgcuaccccaucauggacguggccuaccacugcuaccccaacaagugcaacgacgacgcccuggccuccaagggcgcccucuuccugaaggugcaggucgggagcaccccgcaggaccagcggaucgugggcuacaucgcgugcacccaccuccacgcgccccaggaggacuccgccauccgcugcggccagcuggaccugcugcaggacuggcucgccgacuuccggaaguccaccagcuccagcuccgccgccaaccccgaggagcugguggccuucgacgucgugugcggggacuucaacuucgacaacugcagcuccgacgacaagcuggagcagcagcacagccucuucacgcacuaccgcgaccccugccggcugggcccgggggaggagaagcccugggccaucggcacccugcuggacaccaacgggcucuacgacgaggacgucugcacccccgacaaccugcagaaggugcuggaguccgaggagggccgccgggaguaccucgccuuccccacgagcaaguccagcggccagaaggggcgcaaggagcugcugaagggcaacgggcggcgcaucgacuacaugcuccacgcggaggagggccugugcccggacuggaaggccgagguggaggaguucuccuucaucacccagcugagcgggcucaccgaccaccuccccgucgccaugcggcugaugguguccagcggcgaggaggaggccuga

SEQ ID NO: 36822 - RNA, 969 nt, Artificial Sequence
  derived and/or modified sequence opt1 from SMPDL3A__Homo_sapiens__NP_001273067
augaccaccacgauccagagccuguuccccaaccuccagguguucccggcccugggcaaccacgacuacuggccccaggaccagcugcccgucgugaccuccaagguguacaacgccgucgcgaaccucuggaagcccuggcuggacgaggaggccaucagcacccugcgcaagggcggguucuacucccagaaggugaccacgaacccgaaccuccggaucaucagccugaacaccaaccuguacuacgggcccaacaucaugacccucaacaagaccgaccccgccaaccaguucgaguggcuggaguccacgcugaacaacagccagcagaacaaggagaagguguacaucaucgcccacguccccgugggcuaccucccguccagccagaacaucaccgccaugcgcgaguacuacaacgagaagcugaucgacaucuuccagaaguacuccgacgugaucgcggggcaguucuacggccacacccaccgggacagcaucaugguccuguccgacaagaagggcagccccgugaacucccucuucguggcccccgccgucacccccgucaagagcgugcuggagaagcagacgaacaacccggggauccgccuguuccaguacgacccccgggacuacaagcuccuggacaugcugcaguacuaccucaaccugaccgaggccaaccugaagggcgaguccaucuggaagcucgaguacauccugacccagaccuacgacaucgaggaccugcagcccgagagccucuacgggcuggcgaagcaguucacgauccuggacuccaagcaguucaucaaguacuacaacuacuucuucgugagcuacgacuccagcgugaccugcgacaagaccugcaaggccuuccagaucugcgccaucaugaaccucgacaacaucagcuacgccgacugccugaagcagcuguacaucaagcacaacuacuga

SEQ ID NO: 36823 - RNA, 1458 nt, Artificial Sequence
  derived and/or modified sequence opt1 from SMPDL3B__Homo_sapiens__XP_011539561
augcgccugcucgccuggcugaucuuccuggccaacuggggcggggcgcgggccgagcccgaggaggcccagggcccgugcgcccaggagaaggggaagggcccgccgcccaccagcauccucgccucccuggcgcccgggcuggaggccggcaaguucuggcacaucgccgaccuccaccuggaccccgacuacaaggugagcaaggaccccuuccaggucugccccuccgccggcagccagcccgugcccgacgcggggcccuggggcgacuaccugugcgacucccccugggcccucaucaacagcuccaucuacgccaugaaggagaucgagccggagcccgacuucauccuguggaccggggacgacacgccccacgugcccgacgagaagcugggcgaggccgccguccucgagaucguggagcgccugaccaagcugauccgggagguguucccggacaccaaggucuacgcggcccucgggaaccacgacuuccaccccaagaaccaguuccccgccggcagcaacaacaucuacaaccagaucgccgagcuguggaagcccuggcuguccaacgagagcaucgcccucuucaagaagggcgcguucuacugcgagaagcugccggggcccuccggcgccgggcgcaucguggugcugaacaccaaccucuacuacacgagcaacgcccugaccgccgacauggccgaccccggccagcaguuccaguggcuggaggacguccucaccgacgcguccaaggccggcgacaugguguacaucguggggcacgugcccccgggcuucuucgagaagacccagaacaaggccugguuccgggagggguucaacgagaaguaccugaaggucgugcgcaagcaccaccgggucaucgccggccaguucuucgggcaccaccacacggacagcuuccgcaugcuguacgacgacgccggcgugcccaucuccgcgauguucaucacccccggcgugacccccuggaagaccacgcucccgggggucgugaacggcgccaacaaccccgccauccggguguucgaguacgaccgcgccacccugagccugaaggacauggucaccuacuucaugaaccucucccaggcgaacgcccaggggacgccccggugggagcuggaguaccagcugaccgaggccuacggcgugccggacgccagcgcccacuccaugcacaccgugcucgaccgcaucgcgggggaccagagcacccugcagcgguacuacgucuacaacagcguguccuacagcgccggcgucugcgacgaggccugcuccaugcagcacgugugcgccaugcgccagguggacaucgacgccuacaccacgugccuguacgcgagcggcaccacccccgucccccagcucccccugcugcucauggcccugcuggggcucugcacccuggugcuguga

SEQ ID NO: 36824 - RNA, 267 nt, Artificial Sequence
  derived and/or modified sequence opt1 from SMPX__Homo_sapiens__NP_055147
augaacaugagcaagcagcccguguccaacguccgcgccauccaggccaacaucaacaucccgaugggcgcguuccggcccggggccggccagccgccccgccggaaggagugcacccccgagguggaggagggggugccgcccaccagcgacgaggagaagaagcccauccccggcgccaagaagcugcccgggcccgccgucaaccucuccgagauccagaacaucaagagcgagcugaaguacgugcccaaggccgagcaguga

SEQ ID NO: 36825 - RNA, 240 nt, Artificial Sequence
  derived and/or modified sequence opt1 from SMR3B__Homo_sapiens__NP_006676
augaagagccugaccuggauccucggccugugggcccuggccgcgugcuucacccccggggagucccagcgcggcccgcgggggcccuacccccccggcccgcucgcccccccccagcccuucgggccgggcuucgugcccccccccccgcccccccccuacggcccggggcgcauccccccccccccgcccgcccccuacggccccgggaucuucccgcccccccccccgcagcccuga

SEQ ID NO: 36826 - RNA, 942 nt, Artificial Sequence
  derived and/or modified sequence opt1 from SMS__Homo_sapiens__NP_001245352
auggccgccgcgcgccacagcacccuggacuucaugcucggcgccaaggccgacggggagaccauccugaagggccugcaguccaucuuccaggagcaggggauggccgagagcgugcacacguggcaggaccacggcuaccucgccaccuacaccaacaagaacgggcggcugcccccgaucguccgcggcggcgcgaucgaccgguacuggcccaccgccgacgggcgccugguggaguacgacaucgacgagguggucuacgacgaggacucccccuaccagaacaucaagauccuccacagcaagcaguucggcaacauccugauccuguccggggacgugaaccucgccgagagcgaccuggccuacacgcgggcgaucaugggcuccgggaaggaggacuacaccggcaaggacgugcugauccucggcgggggcgacgggggcauccugugcgagaucgucaagcugaagcccaagauggugaccaugguggagaucgaccagauggucaucgacggcugcaagaaguacaugcgcaagaccugcggggacgugcucgacaaccugaagggcgacugcuaccaggugcugaucgaggacugcaucccgguccucaagcgguacgccaaggaggggcgcgaguucgacuacgugaucaacgaccugacggccgugcccaucagcaccucccccgaggaggacagcaccugggaguuccugcggcucauccuggaccuguccaugaagguccucaagcaggacggcaaguacuucacccaggggaacugcgugaaccugacggaggcccugagccucuacgaggagcagcugggccgccuguacugccccguggaguucuccaaggagaucgucugcgugccgagcuaccucgagcuguggguguucuacaccgucuggaagaaggccaagcccuga

SEQ ID NO: 36827 - RNA, 2754 nt, Artificial Sequence
  derived and/or modified sequence opt1 from SMTN__Homo_sapiens__NP_008863
auggccgacgaggcccuggcgggccucgacgagggggcccugcgcaagcugcucgaggugaccgccgaccuggccgagcggcgccggauccgcagcgccauccgggagcugcagcgccaggagcucgagcgggaggaggaggcgcuggccuccaagcgcuuccgggccgagcgccaggacaacaaggagaacuggcugcacagccagcagcgggaggccgagcagcgcgcggcccucgcccggcuggccggccagcuggaguccaugaacgacgucgaggagcucaccgcccugcugcgcagcgcgggggaguacgaggagcggaagcucauccgcgccgccauccggcgcgugcgggcccaggagaucgaggccgcgacgcuggccggccgccuguacuccgggcggcccaacagcggcucccgcgaggacagcaagggccucgccgcccaccgccuggagcagugcgaggugccggagcgggaggagcaggagcagcaggccgaggucuccaagcccacccccacccccgaggggaccagccaggacgugacgaccgugacccugcuccugcgcgcgccgcccggcuccaccagcuccagccccgccucccccagcuccagcccgacgcccgccucccccgagcccccgcuggagcccgccgaggcccagugccucaccgcggagguccccgggagccccgagccgccgcccagcccgcccaagaccaccucccccgagccccaggagagccccacgcugcccuccaccgagggccagguggugaacaagcugcucagcgggcccaaggagacccccgccgcccagucccccacccggggcccgagcgacacgaagcgcgccgacgucgcgggcccccggcccugccagcgcucccugagcgugcuguccccgcggcagcccgcccagaaccgcgagagcacgccccucgccuccgggcccagcuccuuccagcgggccggcagcgugcgcgaccggguccacaaguucaccuccgacagcccgauggccgcgcgccugcaggacgggacgccccaggccgcccugagcccccucacccccgcccggcugcugggcccgucccucaccuccaccacccccgccagcagcuccagcggcuccagcucccgcgggcccagcgacaccuccagccgguucuccaaggagcagcgcggcguggcgcagccccuggcccagcugcggagcugcccgcaggaggaggggccccgcggccgggggcucgccgcccgcccccuggagaaccgcgccggcggccccguggcgcgguccgaggagccgggggcgccccugcccgucgccgugggcaccgccgagcccgggggcagcaugaagaccaccuucacgaucgagaucaaggacgggcgcggccaggccuccaccggccgggugcuccugccgaccgggaaccagcgcgccgagcugacccucggccugcgggccccgcccacgcugcucagcaccuccagcgggggcaaguccaccaucacccgcgucaacagccccgggacgcuggcccggcugggcagcgugacccacgugaccuccuucagccacgccccgcccuccagccgcggcgggugcuccaucaagauggaggcggagcccgccgagccccuggccgccgccgucgaggcggccaacggcgccgagcagacccgggugaacaaggcccccgaggggcgcagcccccucuccgccgaggagcugaugaccaucgaggacgagggcgugcuggacaagaugcucgaccagagcacggacuucgaggagcggaagcugauccgcgcggcccugcgggagcuccgccagcggaagcgcgaccagcgggacaaggagcgcgagcggcgccugcaggaggcccggggccgccccggggagggccgcgggaacaccgccaccgagaccacgacccggcacucccagcgcgcggccgacggcagcgccgucuccaccgugaccaagacggagcggcugguccacagcaacgacgggacccgcaccgcccggaccacgaccguggaguccagcuucgugcgccgguccgagaacggcagcggcuccaccaugaugcagaccaagacguucagcuccagcagcuccagcaagaagaugggguccaucuucgaccgcgaggaccaggccagcccgcgggcgggcucccucgccgcccuggagaagcgccaggccgagaagaagaaggagcugaugaaggcccagagccuccccaagaccuccgcgagccaggcccggaaggccaugaucgagaagcuggagaaggagggggccgccggcucccccgggggcccccgcgcggccguccagcggagcaccuccuucggcgugccgaacgccaacagcaucaagcagaugcugcucgacuggugccgcgccaagacccggggguacgagcacguggacauccagaacuucuccagcuccuggagcgacggcauggccuucugcgcgcugguccacaacuucuuccccgaggccuucgacuacgggcagcugagcccccagaaccgccggcagaacuucgagguggccuucuccuccgccgagaugcucguggacugcgucccccugguggagguggacgacaugaugaucaugggcaagaagccggaccccaagugcgucuucacguacgugcagagccuguacaaccaccuccgccggcacgagcugcgccugcgcgggaagaacguguga

SEQ ID NO: 36828 - RNA, 1485 nt, Artificial Sequence
  derived and/or modified sequence opt1 from SMTNL1__Homo_sapiens__NP_001099035
auggagcagaaggagggcaagcugagcgaggacgggaccaccgugucccccgccgccgacaacccggagaugagcggcgggggcgcgcccgccgaggagacgaaggggaccgccggcaaggccaucaacgagggcccgcccaccgaguccgggaagcaggagaaggcccccgcggaggacggcaugagcgccgagcuccagggggaggccaacggccuggacgaggucaagguggagucccagcgcgaggccgggggcaaggaggacgcggaggccgagcugaagaaggaggacggcgagaaggaggagaccacgguggggagccaggagaugaccggccggaaggaggagaccaaguccgagcccaaggaggccgaggagaaggagagcacccucgccuccgagaagcagaaggccgaggagaaggaggcgaagcccgagagcgggcagaaggccgacgccaacgaccgcgacaagcccgagccgaaggccacggucgaggaggaggacgccaagaccgcgucccaggaggagaccggccagcggaaggagugcagcaccgagcccaaggagaaggccacggacgaggaggccaaggccgagucccagaaggccgugguggaggacgaggcgaaggccgagcccaaggagcccgacggcaaggaggaggccaagcacggggccaaggaggaggccgacgcgaaggaggaggccgaggacgccgaggaggccgagccgggcagccccuccgaggagcaggagcaggacgucgagaaggagcccgagggcggggcgggggugauccccagcuccccggaggaguggcccgagagccccaccggcgagggccacaaccuguccaccgacgggcugggccccgacugcguggccagcgggcagaccagcccguccgccagcgaguccagccccuccgacgucccccagagcccgcccgagucccccagcuccggcgagaagaaggagaaggcccccgagcgccgggugagcgcccccgcgcgcccgcgggggccccgcgcccagaaccggaaggccaucguggacaaguucggcggcgccgccuccgggcccacggcccucuuccgcaacaccaaggcggccggcgccgccaucgggggcgucaagaacaugcugcuggaguggugccgggcgaugaccaagaaguacgagcacguggacauccagaacuucagcuccagcugguccagcgggauggccuucugcgcccucauccacaaguucuucccggacgccuucgacuacgcggagcuggaccccgccaagcgccggcacaacuucacccuggccuucuccacggccgagaagcucgccgacugcgcgcagcugcuggacguggacgacaugguccgccucgccgugcccgacagcaagugcguguacaccuacauccaggagcuguaccggucccugguccagaagggccucgugaagaccaagaagaaguga

SEQ ID NO: 36829 - RNA, 1542 nt, Artificial Sequence
  derived and/or modified sequence opt1 from SMU1__Homo_sapiens__NP_060695
augagcaucgagaucgaguccagcgacgugauccgccugaucaugcaguaccucaaggagaacucccugcaccgggcccuggccacccuccaggaggagaccacggucagccugaacaccguggacuccaucgagagcuucguggcggacaucaacuccggccacugggacaccguccugcaggccauccagagccucaagcugcccgacaagacccugaucgaccucuacgagcaggucgugcuggagcugaucgagcuccgcgagcugggggccgcccggucccugcuccgccagacggacccgaugaucaugcugaagcagacccagcccgagcgguacauccaccuggagaaccuccuggcccgcagcuacuucgacccccgggaggcguaccccgacggcuccagcaaggagaagcgccgggccgccaucgcccaggcgcuggccggggagguguccguggugccgcccagccgccucauggcccugcugggccaggcccucaaguggcagcagcaccaggggcugcugccgcccggcaugaccaucgaccucuuccggggcaaggccgcggucaaggacguggaggaggagaaguuccccacccagcugucccgccacaucaaguucgggcagaagucccacguggagugcgcccgguucagccccgacggccaguaccuggucacggggagcguggacggcuucaucgagguguggaacuucaccaccgggaagauccgcaaggaccucaaguaccaggcccaggacaacuucaugaugauggacgacgccguccugugcaugugcuucucccgggacaccgagaugcuggccacgggcgcgcaggacggcaagaucaagguguggaagauccagagcgggcagugccuccgccgguucgagcgcgcccacagcaagggcgugaccugccuguccuucagcaaggacuccagccagauccuguccgccagcuucgaccagaccauccggauccacgggcucaaguccggcaagacccugaaggaguuccgcggccacagcuccuucgucaacgaggccacguucacccaggacgggcacuacaucaucagcgccuccagcgacggcaccgugaagaucuggaacaugaagaccacggagugcuccaacaccuucaagagccugggguccaccgcgggcaccgacaucacggugaacagcgucauccuccugcccaagaaccccgagcacuucguggugugcaaccgguccaacaccgucgugaucaugaacaugcaggggcagaucguccgcagcuucuccagcggcaagcgcgagggcggggacuucgugugcugcgcccugagcccgcggggcgaguggaucuacugcgugggggaggacuucguccucuacugcuucuccaccgugaccggcaagcuggagcgcacgcugaccgugcacgagaaggacgucaucgggaucgcccaccacccccaccagaaccucaucgccaccuacagcgaggacggccugcugaagcucuggaagcccuga

SEQ ID NO: 36830 - RNA, 534 nt, Artificial Sequence
  derived and/or modified sequence opt1 from SMUG1__Homo_sapiens__XP_006719385
augccccaggccuuccugcucggcagcauccacgagccggccggggcgcugauggagccccagcccugccccggcucccuggccgagagcuuccucgaggaggagcugcgccugaacgccgagcucucccagcugcaguucagcgagccgguggggaucaucuacaaccccgucgaguacgccugggagccccaccggaacuacgugacccgcuacugccagggccccaaggaggugcuguuccucgggaugaacccgggccccuucggcauggcccagaccgggguccccuucggcgagguguccauggugcgggacuggcuggggaucgucggccccgugcugacgccgccccaggagcaccccaagcgccccgugcucgggcuggagugcccgcagagcgagggcccccggcaguccaugggccacgagaucaagagcgagcugcucaugggcgggugcuccuggauccgcgggaagauccagugcgaccggguccaggugcgccggcccggcuucagcucccagcuguga

SEQ ID NO: 36831 - RNA, 2274 nt, Artificial Sequence
  derived and/or modified sequence opt1 from SMURF1__Homo_sapiens__NP_065162
augagcaaccccggcacccgccggaacggguccagcaucaagauccgccugaccgugcucugcgccaagaaccuggccaagaaggacuucuuccggcugcccgaccccuucgcgaagaucgucguggacggcuccgggcagugccacagcacggacaccgugaagaacacccucgaccccaaguggaaccagcacuacgaccuguacgucggcaagaccgacuccaucacgaucagcguguggaaccacaagaagauccacaagaagcagggggccggcuuccugggcugcgugcgccuccuguccaacgccaucagccggcugaaggacaccggguaccagcgccucgaccugugcaagcugaaccccuccgacaccgacgccguccggggccagaucguggugagccuccagacccgcgaccggaucgggacgggcggguccgucguggacugccgcggccugcuggagaacgagggcaccguguacgaggacagcgggccgggccggccccucuccugcuucauggaggagcccgcccccuacaccgacagcaccggggcggccgccggcggcgggaacugccgcuucgucgaguccccgagccaggaccagcggcugcaggcccagcgccugcggaaccccgacgugcgcggcucccuccagacgccccagaaccggccccacgggcaccagagcccggagcugcccgagggcuacgagcagcgcaccaccgugcaggggcaggucuacuuccugcacacccagacgggcguguccaccuggcacgacccccggauccccagcccgagcggcaccauccccgggggcgacgcggccuuccucuacgaguuccugcugcaggggcacaccuccgagccccgcgaccucaacagcgugaacugcgacgagcugggcccccugccgcccgggugggagguccgguccacggugagcggccgcaucuacuucguggaccacaacaaccgcaccacccaguucaccgacccccggcuccaccacaucaugaaccaccagugccagcugaaggagcccucccagccgcugccccuccccagcgagggcucccuggaggacgaggagcugcccgcccagcgcuacgagcgggaccucguccagaagcugaaggugcugcgccacgagcucagccugcagcagccgcaggccgggcacugccggaucgaggugucccgcgaggagaucuucgaggagagcuaccggcagaucaugaagaugcgccccaaggaccugaagaagcggcucauggucaaguuccgcggcgaggaggggcuggacuacggcgggguggcccgggaguggcuguaccuccugugccacgagaugcugaaccccuacuacggccucuuccaguacuccacggacaacaucuacaugcugcagaucaacccggacagcuccaucaaccccgaccaccugagcuacuuccacuucgucggccgcaucauggggcucgcgguguuccacggccacuacaucaacgggggcuucaccgugcccuucuacaagcagcugcugggcaagcccauccagcuguccgaccucgagagcgucgacccggagcugcacaagucccugguguggauccucgagaacgacaucacccccgugcuggaccacaccuucugcgucgagcacaacgccuucgggcggauccugcagcacgagcucaagcccaacggccgcaacgugcccgugacggaggagaacaagaaggaguacguccggcuguacgugaacuggcgcuucaugcgggggaucgaggcccaguuccuggcccuccagaagggcuucaacgagcugaucccgcagcaccuccugaagcccuucgaccagaaggagcuggagcugaucaucgggggccucgacaagaucgaccugaacgacuggaaguccaacacccgccugaagcacugcguggccgacagcaacaucguccggugguucuggcaggcgguggagaccuucgacgaggagcgccgcgcccggcuccugcaguucgugaccggcagcacgcgcgucccccugcagggguucaaggcccuccagggcagcaccggggccgccggcccccggcuguucaccauccaccugaucgacgcgaacaccgacaaccucccgaaggcccacacgugcuucaaccgcaucgacaucccgcccuacgaguccuacgagaagcuguacgagaagcugcucaccgccguggaggagaccugcggguucgccguggaguga

SEQ ID NO: 36832 - RNA, 2247 nt, Artificial Sequence
  derived and/or modified sequence opt1 from SMURF2__Homo_sapiens__NP_073576
augagcaaccccggcgggcgccggaacggccccgugaagcugcgccucaccguccugugcgccaagaaccuggugaagaaggacuucuuccggcuccccgaccccuucgccaagguggucguggacggguccggccagugccacagcaccgacacggugaagaacacccuggaccccaaguggaaccagcacuacgaccuguacaucgggaaguccgacagcgucaccaucuccguguggaaccacaagaagauccacaagaagcagggcgcgggcuuccucgggugcgugcgccugcugagcaacgccaucaaccggcucaaggacaccggcuaccagcgccuggaccugugcaagcucgggccgaacgacaacgacacgguccggggccagaucguggugucccugcagagccgcgaccggaucgggaccggcggccaggucguggacugcucccgccuguucgacaacgaccuccccgacgggugggaggagcggcgcaccgccagcggccggauccaguaccugaaccacaucacccgcacgacccagugggagcggcccacccgccccgccuccgaguacagcuccccggggcggccccugagcugcuucguggacgagaacacccccaucuccggcacgaacggcgcgaccugcgggcagagcuccgacccccgccucgccgagcggcgcguccggagccagcgccaccgcaacuacaugucccggacccaccuccacaccccgcccgaccugcccgagggcuacgagcagcgcacgacccagcagggccagguguacuuccuccacacccagaccggggugagcacguggcacgacccccgggucccgcgcgaccugagcaacaucaacugcgaggagcuggggccccucccgcccggcugggagauccggaacaccgccaccggccgcguguacuucguggaccacaacaaccggaccacgcaguucaccgacccccgccuguccgccaaccugcaccucguccugaaccggcagaaccagcugaaggaccagcagcagcagcaggucgugagccucugccccgacgacaccgagugccugaccgugccccgcuacaagcgggaccuggugcagaagcucaagauccugcgccaggagcugucccagcagcagccccaggccgggcacugccggaucgaggucagccgcgaggagaucuucgaggaguccuaccgccaggugaugaagaugcggccgaaggaccucuggaagcggcugaugaucaaguuccgcggcgaggaggggcuggacuacggcgggguggcgcgggaguggcucuaccugcugagccacgagaugcucaaccccuacuacggccuguuccaguacucccgcgacgacaucuacacgcugcagaucaaccccgacagcgccgucaaccccgagcaccucuccuacuuccacuucgugggccgcaucauggggauggccguguuccacggccacuacaucgacgggggcuucacccugccguucuacaagcagcugcucggcaagagcaucacccuggacgacauggagcuggucgaccccgaccugcacaacucccucguguggauccuggagaacgacaucaccggggugcuggaccacacguucugcgucgagcacaacgccuacggcgagaucauccagcacgagcucaagcccaacggcaagagcaucccggugaacgaggagaacaagaaggaguacgugcggcuguacgucaacuggcgcuuccugcgggggaucgaggcccaguuccucgcgcugcagaagggguucaacgaggugaucccccagcaccuccugaagaccuucgacgagaaggagcuggagcugaucaucugcggccucggcaagaucgacgugaacgacuggaaggucaacacccgccugaagcacugcacccccgacuccaacaucgugaagugguucuggaaggccguggaguucuucgacgaggagcggcgcgcccggcugcuccaguucgucacggggagcucccgcgugccccugcagggcuucaaggcccugcagggggccgcgggcccgcggcuguucaccauccaccagaucgacgccugcaccaacaaccugcccaaggcccacacgugcuucaaccgcaucgacaucccgcccuacgagagcuacgagaagcuguacgagaagcuccugaccgccaucgaggagaccugcggguucgccguggaguga

SEQ ID NO: 36833 - RNA, 1473 nt, Artificial Sequence
  derived and/or modified sequence opt1 from SMYD1__Homo_sapiens__NP_938015
augaccaucggccgcauggagaacguggagguguucaccgccgaggggaagggccgggggcugaaggccacgaaggaguucugggcggccgacaucaucuucgccgagcgcgccuacagcgccgugguguucgacucccucgucaacuucgugugccacacgugcuucaagcggcaggagaagcugcaccgcugcggccagugcaaguucgcgcacuacugcgaccggaccugccagaaggacgccuggcugaaccacaagaacgagugcagcgccaucaagcgcuacgggaaggugcccaacgagaacauccggcucgccgcgcgcaucauguggcgggucgagcgcgagggcaccggccugaccgaggggugccugguguccguggacgaccuccagaaccacgucgagcacuucggcgaggaggagcagaaggaccugcggguggacguggacaccuuccugcaguacuggccgccccagagccagcaguucuccaugcaguacaucagccacaucuucggggucaucaacugcaacggcuucacccucuccgaccagcgcgggcugcaggccgugggcgugggcaucuuccccaaccuggggcucgucaaccacgacugcuggcccaacugcaccgugaucuucaacaacggcaaccacgaggccgucaagagcauguuccacacgcagaugcggaucgagcugcgcgcccuggggaagaucuccgagggcgaggagcucaccgugagcuacaucgacuuccugaacguguccgaggagcggaagcgccagcugaagaagcaguacuacuucgacugcacgugcgagcacugccagaagaagcucaaggacgaccuguuccugggcgugaaggacaacccgaagcccagccaggaggucgugaaggagaugauccaguucuccaaggacacccucgagaagaucgacaaggcccggagcgaggggcuguaccacgagguggucaagcugugccgcgagugccucgagaagcaggagcccguguucgcggacaccaacaucuacaugcugcggaugcuguccaucgucagcgaggugcucuccuaccugcaggccuucgaggaggccagcuucuacgcccgccggaugguggacggcuacaugaagcuguaccaccccaacaacgcccagcucgggauggcggucaugcgcgccggccugaccaacuggcacgccgggaacaucgaggugggccacggcaugaucugcaaggccuacgccauccugcucgugacccacgggccgucccaccccaucaccaaggaccuggaggcgaugcgcguccagacggagauggagcugcggauguuccgccagaacgaguucauguacuacaagaugcgggaggccgcccucaacaaccagcccaugcaggucauggccgagcccagcaacgagccgagccccgcccuguuccacaagaagcaguga

SEQ ID NO: 36834 - RNA, 1302 nt, Artificial Sequence
  derived and/or modified sequence opt1 from SMYD2__Homo_sapiens__NP_064582
augcgcgccgagggccucgggggccucgagcgguucugcagccccgggaagggccgcgggcugcgggcccugcagccguuccaggugggcgaccuccuguucuccugccccgcguacgccuacguccugaccgugaacgagcgcggcaaccacugcgaguacugcuucacccggaaggaggggcucagcaagugcggccgcugcaagcaggccuucuacugcaacguggagugccagaaggaggacuggcccaugcacaagcuggagugcucccccauggucguguucggggagaacuggaacccgagcgagacggugcggcugaccgcccgcauccucgccaagcagaagauccaccccgagcggacccccuccgagaagcugcuggcggucaaggaguucgagagccaccucgacaagcuggacaacgagaagaaggaccugauccaguccgacaucgccgcccuccaccacuucuacagcaagcaccugggcuuccccgacaacgacucccugguggugcuguucgcccaggucaacugcaacggguucaccaucgaggacgaggagcugagccaccugggcuccgcgaucuucccggacguggcccucaugaaccacagcugcugccccaacgugaucgucacguacaagggcacccuggccgaggugcgcgccgugcaggagaucaagcccggggaggaggucuucaccuccuacaucgaccugcucuaccccaccgaggaccggaacgaccgccugcgggacagcuacuucuucacgugcgagugccaggagugcaccaccaaggacaaggacaaggccaagguggagauccgcaagcuguccgacccgcccaaggcggaggccauccgggacauggugcgcuacgcccggaacgucaucgaggaguuccgccgggccaagcacuacaagagccccuccgagcuccuggagaucugcgagcugagccaggagaagauguccagcguguucgaggacagcaacguguacaugcuccacaugauguaccaggccaugggcgucugccuguacaugcaggacugggagggggcgcugcaguacggccagaagaucaucaagcccuacuccaagcacuacccgcucuacagccugaacguggccuccauguggcugaagcucggccgccuguacauggggcuggagcacaaggccgccggcgagaaggcccucaagaaggcgaucgccaucauggagguggcccacgggaaggaccaccccuacaucagcgagaucaagcaggagaucgagucccacuga

SEQ ID NO: 36835 - RNA, 1287 nt, Artificial Sequence
  derived and/or modified sequence opt1 from SMYD3__Homo_sapiens__NP_001161212
auggagccccugaagguggagaaguucgccaccgccaagcgcggcaacgggcuccgggcggucaccccgcugcgccccggcgagcuccuguuccggagcgacccccuggccuacacggugugcaaggggucccgcggcguggucugcgaccggugccugcucgggaaggagaagcugaugcgcugcagccagugccggguggccaaguacugcuccgccaagugccagaagaaggccuggcccgaccacaagcgcgagugcaagugccucaagagcugcaagccgcgguacccgcccgacuccgugcgccugcugggccgggucguguucaagcugauggacggcgcgcccagcgaguccgagaagcucuacagcuucuacgaccuggaguccaacaucaacaagcugaccgaggacaagaaggaggggcuccgccagcuggugaugaccuuccagcacuucaugcgggaggagauccaggacgccagccagcugccgcccgccuucgaccucuucgaggccuucgcgaaggucaucugcaacuccuucaccaucugcaacgccgagaugcaggaggugggcguggggcuguaccccagcaucucccugcucaaccacagcugcgaccccaacugcuccaucgucuucaacggcccccaccuccugcugcgcgccgugcgggacaucgaggugggggaggagcugacgaucugcuaccuggacaugcucaugaccagcgaggagcgccggaagcagcugcgcgaccaguacugcuucgagugcgacugcuuccggugccagacccaggacaaggacgccgacaugcugaccggcgacgagcaggucuggaaggaggugcaggagucccucaagaagaucgaggagcugaaggcccacuggaagugggagcagguccuggcgaugugccaggccaucaucagcuccaacagcgagcgccuccccgacaucaacaucuaccagcugaaggugcuggacugcgccauggacgccugcaucaaccucggccugcuggaggaggcccucuucuacgggacgcggaccauggagcccuaccgcaucuucuuccccggcagccacccggugcgcggggugcaggucaugaaggugggcaagcugcagcugcaccagggcauguucccccaggcgaugaagaaccuccggcuggccuucgacaucaugcgcgugacccacgggcgggagcacucccugaucgaggaccucauccugcugcucgaggagugcgacgccaacauccgcgccagcuga

SEQ ID NO: 36836 - RNA, 2415 nt, Artificial Sequence
  derived and/or modified sequence opt1 from SMYD4__Homo_sapiens__NP_443160
auggaccugcccguggacgaguggaaguccuaccuccugcagaagugggccagccugccgaccagcguccaggugaccaucuccacggccgagacccuccgcgacaucuuccugcacagcuccagccugcuccagcccgaggacgagcuguuccugaagcggcucuccaagggcuaccugguggggaaggacagcgacgcgccccuguucuaccgcgaggagggcaacaagaaguuccaggagaaggacuacaccggggccgccguccucuacuccaagggcgugagccacucccggcccaacaccgaggacaugagccugugccacgccaaccgcuccgccgcgcuguuccaccucgggcaguacgagacgugccugaaggacaucaaccgggcccagacccacggcuacccggagcgccugcagcccaagaucaugcuccggaaggccgagugccugguggcccugggccgccuccaggaggcgagccagaccaucuccgaccuggagcggaacuucaccgccacgcccgcccuggccgacguccucccccagacccugcagcgcaaccugcaccggcucaagaugaagaugcaggagaaggacagccugaccgaguccuucccggccgcgcuggccaagacccucgaggacgccgcccugcgcgaggagaacgagcagcugagcaacgccuccagcagcaucgggcucugcguggacccccugaagggccggugccugguggcgacgaaggacauccuccccggggagcugcugguccaggaggacgccuucguguccgugcucaaccccggcgagcugccgccgccccaccacgggcuggacagcaagugggacacccgcgucaccaacggcgaccucuacugccaccggugccugaagcacacccuggccacggugcccugcgacggcugcuccuacgccaaguacugcagccaggagugccuccagcaggccugggagcuguaccaccgcaccgagugcccccucgggggccugcugcugacccuggggguguucugccacaucgcgcuccggcugacccugcucgucggcuucgaggacgugcgcaagaucaucacgaagcugugcgacaagaucuccaacaaggacaucugccugcccgagagcaacaaccaggugaagacccucaacuacggccugggggaguccgagaagaacggcaacaucgucgagacccccauccccgggugcgacaucaacggcaaguacgagaacaacuacaacgccguguucaaccugcucccgcacaccgagaaccacagccccgagcacaaguuccugugcgcccugugcguguccgcccucugccggcagcuggaggccgcgagccugcaggccauccccacggagcgcaucgucaacuccagccagcucaaggccgccgugacccccgagcugugcccggacgugaccaucuggggcgucgcgaugcugcggcacaugcuccagcugcagugcaacgcccaggccaugaccacgauccagcacaccgggcccaagggcuccaucgugaccgacagccgccagguccgccuggccaccgggaucuuccccgugaucucccuccugaaccacagcugcucccccaacacgagcguguccuucaucagcaccgucgccaccauccgggcgagccagcgcauccggaagggccaggagauccugcacugcuacgggccgcacaagucccgcaugggcguggccgagcggcagcagaagcuccgcagccaguacuucuucgacugcgccugccccgccugccagaccgaggcccaccggauggcggccgggccccgcugggaggccuucugcugcaacuccugcggcgccccgaugcagggcgacgacgugcugcggugcgggagccgcuccugcgccgagagcgcggucucccgggaccaccuggugagccgccuccaggaccugcagcagcagguccggguggcccagaagcugcuccgcgacggcgagcuggagcgggccgugcagcgccuguccgggugccagcgggacgccgagagcuuccucugggcggagcacgccguggucggcgagaucgccgacgggcuggcccgcgccugcgcggcccugggcgacuggcagaaguccgccacgcaccuccagcggagccuguacgugguggagguccgccacggccccuccagcguggagauggggcacgagcuguucaagcucgcccagaucuucuucaacggcuucgccgugcccgaggcgcuguccaccauccagaaggccgaggagguccugagccuccacugcgggcccugggacgacgagauccaggagcugcagaagaugaaguccugccugcucgaccugccgcccacccccgugggccccgcccuguga

SEQ ID NO: 36837 - RNA, 1257 nt, Artificial Sequence
  derived and/or modified sequence opt1 from SMYD5__Homo_sapiens__NP_006053
auggccgccagcaugugcgacguguucuccuucugcgucggcguggcggggcgcgcccgggugagcgucgaggugcgcuucguguccagcgccaagggcaaggggcuguucgccacccagcucauccggaagggcgagaccaucuucgucgagcgcccccugguggccgcgcaguuccuguggaacgcccucuaccgguaccgcgccugcgaccacugccugcgggcccuggagaaggcggaggagaacgcccagcgccucacggggaagccgggccaggugcugccccaccccgagcugugcaccguccggaaggaccuccaccagaacugcccccacugccaggugauguacugcuccgccgagugccgccuggccgccaccgagcaguaccaccaggugcugugcccgggccccagccaggacgacccccuccacccccugaacaagcugcaggaggcguggcgguccauccacuacccgcccgagaccgccagcaucaugcucauggcccgcauggucgccacggugaagcaggccaaggacaaggaccgguggauccgccuguucucccaguucugcaacaagaccgcgaacgaggaggaggagaucgugcacaagcugcucggggacaaguucaagggccagcuggagcugcuccggcgccuguucaccgaggcccuguacgaggaggccgucagccagugguucacccccgacggguuccggucccucuucgcccuggugggcacgaacgggcagggcaucggcaccagcucccugagccagugggugcacgccugcgacacccucgagcugaagccccaggaccgcgagcagcuggacgcguucaucgaccagcucuacaaggacaucgaggccgccaccggggaguuccugaacugcgagggcuccgggcuguucguccuccagagcugcugcaaccacuccugcgugccgaacgccgagacgagcuuccccgagaacaacuuccugcugcacgugaccgcccucgaggacaucaagcccggcgaggagaucugcaucuccuaccuggacugcugccagcgggagcgcagccggcacagccgccacaagauccugcgcgagaacuaccucuucgucugcuccugccccaagugccuggcggaggccgacgagccgaacgugaccagcgaggaggaggaggaggaggaggaggaggaggagggcgagcccgaggacgccgagcugggggacgagaugaccgacguguga

SEQ ID NO: 36838 - RNA, 795 nt, Artificial Sequence
  derived and/or modified sequence opt1 from SNAI1__Homo_sapiens__NP_005976
augccccgcagcuuccuggugcggaagccguccgaccccaaccgcaagcccaacuacagcgagcuccaggacuccaaccccgaguucaccuuccagcagccguacgaccaggcccaccuccuggccgcgaucccgccgcccgagauccugaaccccaccgccagccugcccaugcugaucugggacuccguccucgcgccccaggcccagcccaucgccugggccagccugcggcugcaggagagcccccgcguggccgagcucacgucccuguccgacgaggacagcggcaaggggucccagccgcccagcccgcccucccccgcccccagcuccuucagcuccaccagcguguccagccuggaggccgaggcguacgccgccuuccccggccucgggcagguccccaagcagcuggcccagcugagcgaggccaaggaccuccaggcgcggaaggccuucaacugcaaguacugcaacaaggaguaccugucccugggcgcccucaagaugcacauccgcagccacacccugcccugcgugugcgggaccugcggcaaggccuucucccggcccuggcugcuccagggccacgugcgcacgcacaccggggagaagcccuucagcugcccgcacugcucccgggccuucgcggaccgcagcaaccugcgggcccaccuccagacccacuccgacgucaagaaguaccagugccaggccugcgcccgcaccuucagccggaugucccugcugcacaagcaccaggagagcggcugcuccgggugcccccgcuga

SEQ ID NO: 36839 - RNA, 807 nt, Artificial Sequence
  derived and/or modified sequence opt1 from SNAI2__Homo_sapiens__NP_003059
augccccgcagcuuccuggugaagaagcacuucaacgccuccaagaagccgaacuacagcgagcucgacacccacaccgucaucaucucccccuaccuguacgagagcuacuccaugcccgugaucccccagccggagauccugagcuccggcgccuacagccccaucacgguguggaccaccgcggcccccuuccacgcccagcuccccaacgggcuguccccgcugagcggcuacuccagcucccucgggcgggucagcccgcccccgcccuccgacaccagcuccaaggaccacagcggcuccgagagccccaucagcgacgaggaggagcgccugcaguccaagcugagcgacccccacgccaucgaggccgagaaguuccagugcaaccucugcaacaagacguacuccaccuucagcgggcuggcgaagcacaagcagcugcacugcgacgcccagucccgcaagagcuucuccugcaaguacugcgacaaggaguacgugagccucggcgcccugaagaugcacauccggacccacacccugcccugcgugugcaagaucugcggcaaggccuucucccggcccuggcuccugcaggggcacauccgcacgcacaccggcgagaagcccuucagcugcccccacugcaaccgggcguucgccgaccgcuccaaccugcgggcccaccuccagacccacagcgacgucaagaaguaccagugcaagaacugcuccaagaccuucagccgcaugucccugcugcacaagcacgaggagagcgggugcugcguggcccacuga

SEQ ID NO: 36840 - RNA, 879 nt, Artificial Sequence
  derived and/or modified sequence opt1 from SNAI3__Homo_sapiens__NP_840101
augccccgcagcuuccuggugaagacccacuccagccaccgggucccgaacuaccgccggcucgagacccagcgcgagaucaacggcgccugcuccgccugcgggggccugguggugccccugcucccccgggacaaggaggcgcccagcgucccgggggaccugccccagcccugggaccgcuccagcgccguggccugcaucucccugccccuccugccgcggaucgaggaggcccugggcgccagcgggcucgacgcgcuggagguguccgaggucgacccccgcgccagccgggccgccaucgugccccugaaggacucccucaaccaccugaaccugcccccgcuccuggugcugcccacgcgcuggagccccacccucggccccgaccggcacggcgcgccggagaagcugcugggggccgagcgcaugccccgggcccccggcggguucgagugcuuccacugccacaagcccuaccacacccucgccggccuggcccgccaccggcagcugcacugccaccuccaggucgggcgcguguucacgugcaaguacugcgacaaggaguacaccucccugggcgcgcugaagaugcacauccggacccacacccucccgugcacgugcaagaucugcggcaaggccuucagccgccccuggcugcugcaggggcacgugcggacccacaccggcgagaagcccuacgccugcucccacugcagccgcgccuucgccgaccgguccaaccuccgcgcgcaccuccagacccacagcgacgccaagaaguaccgcugccggcgcugcaccaagacguucucccggaugagccugcuggcccgccacgaggagagcgggugcugccccggcccguga

SEQ ID NO: 36841 - RNA, 636 nt, Artificial Sequence
  derived and/or modified sequence opt1 from SNAP23__Homo_sapiens__NP_003816
auggacaaccugagcuccgaggagauccagcagcgcgcccaccagaucaccgacgagagccucgaguccacccggcgcauccugggccuggccaucgagagccaggacgcggggaucaagacgaucaccaugcucgacgagcagaaggagcagcugaaccggaucgaggagggccuggaccagaucaacaaggacaugcgcgagaccgagaagacccucacggagcugaacaagugcugcgggcugugcgugugccccugcaaccggaccaagaacuucgaguccggcaaggccuacaagaccaccuggggcgacgggggcgagaacagcccgugcaacgucguguccaagcagcccgggcccgugacgaacggccagcuccagcagcccaccaccggggccgccagcggcggguacaucaagcgcaucaccaacgacgcccgggaggacgagauggaggagaaccugacgcaggucggcuccauccugggcaaccucaaggacauggcgcugaacaucgggaacgagaucgacgcccagaacccgcagaucaagcgcaucaccgacaaggccgacaccaaccgggaccgcaucgacaucgccaacgcgcgggccaagaagcugaucgacagcuga

SEQ ID NO: 36842 - RNA, 621 nt, Artificial Sequence
  derived and/or modified sequence opt1 from SNAP25__Homo_sapiens__NP_003072
auggccgaggacgccgacaugcgcaacgagcuggaggagaugcagcggcgcgcggaccagcucgccgacgagagccuggaguccacccggcgcaugcugcagcucguggaggagagcaaggacgccggcauccggacccuggugaugcuggacgagcagggggagcagcucgaccgcguggaggagggcaugaaccacaucaaccaggacaugaaggaggccgagaagaaccugaaggaccuggggaagugcugcggccucuucaucugccccugcaacaagcugaaguccagcgacgccuacaagaaggcgugggggaacaaccaggacggcguggucgccucccagccggcccgggugguggacgagcgcgagcagauggccaucagcggcggguucauccggcgcgucacgaacgacgcgcgggagaacgagauggacgagaaccuggagcaggucuccggcaucaucgggaaccuccgccacauggcccuggacaugggcaacgagaucgacacccagaaccggcagaucgaccgcaucauggagaaggccgacagcaacaagacccggaucgacgaggccaaccagcgcgccaccaagaugcugggguccggcuga

SEQ ID NO: 36843 - RNA, 777 nt, Artificial Sequence
  derived and/or modified sequence opt1 from SNAP29__Homo_sapiens__NP_004773
augagcgccuaccccaaguccuacaacccguucgacgacgacggcgaggacgagggggcccgccccgcgcccuggcgggacgcccgcgaccugcccgacggcccggacgcccccgccgaccggcagcaguaccuccgccaggaggugcugcggcgcgccgaggcgaccgccgccagcaccucccggagccuggcccucauguacgaguccgagaaggucgggguggcgagcuccgaggagcuggcccgccagcggggcgugcuggagcgcacggagaagauggucgacaagauggaccaggaccucaagaucagccagaagcacaucaacuccaucaagagcguguucgggggccuggugaacuacuucaaguccaagcccgucgagacgcccccggagcagaacggcacccugaccagccagcccaacaaccggcucaaggaggccaucuccaccagcaaggagcaggaggccaaguaccaggccucccaccccaaccugcgcaagcuggacgacaccgaccccgugccgcgcggggcgggcagcgccauguccaccgacgccuaccccaagaacccccaccuccgggccuaccaccagaagaucgacagcaaccuggacgagcuguccauggggcucggccggcugaaggacaucgcccuggggaugcagaccgagaucgaggagcaggacgacauccucgaccgccugacgaccaagguggacaagcuggacgucaacaucaagagcaccgagcggaaggugcgccagcucuga

SEQ ID NO: 36844 - RNA, 1395 nt, Artificial Sequence
  derived and/or modified sequence opt1 from SNAP47__Homo_sapiens__NP_444280
augcgcgccgcccggcgcggccugcacugcgcgggggccgagcggccccgccggcgcggccggcucugggacagcuccggggugccgcagcgccagaagcggcccggccccuggcgcacccagacccaggagcagaugagccgggacgucugcauccacacguggcccugcaccuacuaccuggagccgaagcgccggugggugaccgggcagcugucccucaccagccugucccugcgcuucaugacggacagcaccggcgagauccucguguccuucccccugagcuccaucgucgagaucaagaaggaggccagccacuucaucuucuccagcaucaccauccuggagaagggccacgccaagcacugguucuccagccuccggcccucccgcaacgugguguucagcaucaucgagcacuucuggcgggagcugcugcucucccagcccggggccgucgcggacgccagcgugccgcgcacccggggcgaggagcugacggggcugauggccggcucccagaagcgccucgaggacaccgcccgggugcugcaccaccaggggcagcagcuggacagcgucaugcgcggccucgacaagauggagagcgaccuggagguggcggaccgccugcucaccgagcuggagucccccgccugguggcccuucagcuccaagcuguggaagacgcccccggagaccaagccccgggaggacgugagcaugaccuccugcgagcccuucggcaaggaggggauccucaucaagauccccgccgucaucagccaccgcaccgagucccacgugaagccgggccggcugaccgugcuggucagcgggcucgagauccacgacuccagcucccugcugaugcaccgcuucgagcgggaggacguggacgacaucaaggugcacagccccuacgagaucuccauccgccagcgguucaucggcaagcccgacauggccuaccgccucaucagcgccaagaugcccgaggucaucccgauccuggaggugcaguucuccaagaagauggagcugcucgaggacgcgcuggugcugcggagcgcccgcacguccagccccgccgagaaguccugcagcgucuggcacgccgccagcggccucauggggcggacccugcaccgcgagccgcccgcgggcgaccaggaggggaccgcccugcaccuccagaccucccugcccgcccugagcgaggccgacacgcaggagcucacccagauccugcggcgcaugaagggccuggcccucgaggcggaguccgagcuggagcggcaggacgaggcccuggacgggguggccgccgccguggaccgcgcgacccucaccaucgacaagcacaaccggcgcaugaagcggcugacguga

SEQ ID NO: 36845 - RNA, 2724 nt, Artificial Sequence
  derived and/or modified sequence opt1 from SNAP91__Homo_sapiens__NP_001229721
augagcggccagacccugaccgaccgcaucgccgccgcgcaguacuccgugacggggagcgccgucgcccgggccgugugcaaggccaccacccacgaggugaugggccccaagaagaagcaccucgacuaccugauccaggcgaccaacgagacgaacgucaacaucccgcagauggccgacacccuguucgagcgcgccaccaacuccagcugggugguggucuucaaggcccucgugaccacgcaccaccugauggugcacgggaacgagcgguucauccaguaccuggcgucccgcaacacccucuucaaccugagcaacuuccuggacaaguccggcagccacggguacgacauguccaccuucauccggcgcuacagccgguaccucaacgagaaggccuucuccuaccgccagauggccuucgacuucgcccgggucaagaagggcgccgacggcgugaugcgcaccauggcgcccgagaagcugcugaagagcaugcccauccuccaggggcagaucgacgcccugcuggaguucgacgugcaccccaacgagcucacgaacggcgucaucaacgccgccuucaugcugcuguucaaggaccucaucaagcuguucgccugcuacaacgacggggugaucaaccugcucgagaaguucuucgagaugaagaagggccagugcaaggacgcgcuggagaucuacaagcgguuccugacccgcaugacccggguguccgaguuccucaaggucgccgagcagguggggaucgacaagggcgacaucccggaccugacccaggcccccagcucccugauggagacgcucgagcagcaccugaacacccuggagggcaagaagcccgggaacaacgagggcagcggggcccccuccccgcucagcaaguccagccccgccaccaccgugacgagccccaacuccacccccgcgaagaccaucgacaccagcccgcccgucgaccuguucgccacggccuccgccgccgugcccgugagcaccuccaagcccagcuccgaccugcucgaccugcagccggacuucagcuccggcggcgcggccgccgccgcggcccccgccccccccccgcccgccgggggcgccaccgcguggggggaccugcucggcgaggacagccuggccgcccuguccagcguccccuccgaggcccagaucagcgaccccuucgccccggagcccaccccccccacgaccaccgcggagaucgccaccgccuccgccagcgccuccacgaccaccaccgugacggcggugaccgccgaggucgaccucuucggggacgccuucgccgcgagcccgggcgaggcccccgccgccuccgagggcgccgcggcccccgccaccccgacccccguggccgccgcgcuggacgccugcagcgggaacgaccccuucgcccccagcgagggcuccgccgaggccgcgccggagcuggaccucuucgccaugaagccccccgagaccagcguccccguggugacgccgaccgccuccaccgccccccccguccccgcgaccgccccgagccccgcccccgccguggccgcggccgccgccgccacgaccgcggccaccgccgccgccaccacgaccaccaccacguccgcggccaccgccaccaccgcccccccggcccuggacaucuucggggaccuguucgagagcacgcccgagguggcggccgcccccaagcccgacgccgcgccguccaucgaccucuucagcaccgacgccuucuccagccccccccagggcgccucccccgucccggagagcucccugaccgccgaccugcucagcguggacgccuucgcggcccccucccccgccaccacggccagcccggccaagguggacuccagcggggucaucgaccuguucggcgacgcguucggcagcuccgccagcgagccccagcccgccucccaggccgccagcuccagcuccgcgagcgccgaccugcuggccggguucggcggguccuucauggcccccagcccgucccccgugacccccgcgcagaacaaccuccugcagcccaacuucgaggccgccuucggcaccaccccgagcacguccagcuccagcuccuucgaccccagcguguucgacgggcugggcgaccuccugaugcccaccauggcccccgccggccagccggcgcccgucuccauggugccccccagcccggccauggccgccagcaaggcccugggguccgaccucgacagcucccuggcgagccuggugggcaaccucgggaucuccggcaccaccacgaagaagggcgaccugcaguggaacgccggggagaagaagcugaccggcggggccaacuggcagcccaaggucgcccccgccaccuggagcgcgggcgugcccccguccgccccccuccagggggccgugccccccaccagcuccgucccgcccguggccggcgcgcccagcgugggccagcccggggccggcuucgggaugccgcccgccggcacggggaugcccaugaugccgcagcagcccgucauguucgcccagcccaugaugcgccccccguucggcgccgcggccgugcccggcacccagcugucccccagccccaccccggccucccagagccccaagaagccccccgccaaggacccgcuggccgaccucaacaucaaggacuuccuguga

SEQ ID NO: 36846 - RNA, 1107 nt, Artificial Sequence
  derived and/or modified sequence opt1 from SNAPC1__Homo_sapiens__NP_003073
augggcacgcccccggggcugcagaccgacugcgaggcccuccugagccgcuuccaggagaccgacuccgugcgguucgaggacuucaccgagcuguggcgcaacaugaaguucggcaccaucuucugcgggcggaugcgcaaccucgagaagaacauguucaccaaggaggcccuggcgcuggccuggcgguacuuccucccgcccuacacguuccagauccgcgucggcgcccuguaccugcucuacgggcuguacaacacccagcugugccagcccaagcagaagauccggguggcccucaaggacugggacgaggugcugaaguuccagcaggaccuggucaacgcccagcacuucgacgcggccuacaucuuccgcaagcuccggcuggaccgcgccuuccacuucaccgccaugcccaagcugcucagcuaccggaugaagaagaagauccaccgcgcggaggugaccgaggaguucaaggaccccuccgaccgggugaugaagcugaucacgagcgacguccuggaggagaugcucaacgugcacgaccacuaccagaacaugaagcacgugaucuccgucgacaagagcaagcccgacaaggcccugucccugaucaaggacgacuucuucgacaacaucaagaacaucgugcucgagcaccagcaguggcacaaggaccgcaagaaccccagccugaaguccaagaccaacgacggcgaggagaagauggagggcaacagccaggagaccgagcggugcgagcgcgccgagucccuggccaagaucaagagcaaggccuucuccguggucauccaggcgagcaagucccggcgccaccgccaggugaagcucgacagcuccgacagcgacuccgccagcgggcagggccaggugaaggccacccggaagaaggagaagaaggagcggcugaagccggccgggcgcaagaugagccugcgcaacaagggcaacguccagaacauccacaaggaggacaagccccucucccugagcaugcccgugaucacggaggaggaggagaacgagucccugagcgggaccgaguucaccgccuccaagaagcggcgcaagcacuga

SEQ ID NO: 36847 - RNA, 4410 nt, Artificial Sequence
  derived and/or modified sequence opt1 from SNAPC4__Homo_sapiens__NP_003077
auggacguggacgccgagcgcgagaagaucacccaggagaucaaggagcuggagcggauccucgaccccggcagcuccgggagccacgucgagaucuccgagagcucccuggagagcgacuccgaggccgacagccugccguccgaggaccucgaccccgccgacccgcccaucagcgaggaggagcgcuggggcgaggccuccaacgacgaggacgaccccaaggacaagacccugcccgaggaccccgagacgugccugcagcucaacaugguguaccaggaggugauccaggagaagcuggccgaggccaaccugcuccuggcccagaaccgggagcagcaggaggagcugaugcgcgaccucgcggggagcaagggcaccaaggucaaggacgggaagucccugcccccgagcaccuacaugggccacuucaugaagcccuacuucaaggacaaggugaccggcguggggccgcccgccaacgaggacacgcgggagaaggccgcccagggcaucaaggcguucgaggagcugcucgucaccaaguggaagaacugggagaaggcccugcugcgcaaguccguggugagcgaccggcuccagcgccugcugcagcccaagcuccugaagcuggaguaccuccaccagaagcaguccaaggucagcuccgagcuggagcggcaggcccuggagaagcaggggcgcgaggccgagaaggagauccaggacaucaaccagcuccccgaggaggcccugcugggcaaccggcucgacagccacgacugggagaagaucagcaacaucaacuucgaggggucccgcagcgcggaggagauccggaaguucuggcagaacuccgagcaccccagcaucaacaagcaggaguggucccgcgaggaggaggagcggcugcaggccaucgccgccgcccacggccaccuggaguggcagaagaucgcggaggagcucggcaccagccgcuccgccuuccagugccugcagaaguuccagcagcacaacaaggcccugaagcggaaggaguggaccgaggaggaggaccgcaugcucacgcagcuggugcaggagaugcggguggggagccacauccccuaccgccggaucgucuacuacauggagggccgcgacuccaugcagcugaucuaccgcuggaccaagagccucgacccggggcugaagaagggcuacugggcccccgaggaggacgccaagcugcuccaggcgguggccaaguacggcgagcaggacugguucaagauccgggaggaggugcccgggcgcuccgacgcccagugccgggaccgcuaccugcggcgccugcacuucagccucaagaagggccgguggaaccugaaggaggaggagcagcugaucgagcucaucgagaaguacggggucggccacugggccaagaucgccuccgagcugccccaccgcagcgggucccagugccugagcaaguggaagaucaugaugggcaagaagcagggccugcggcgccggcgccggcgcgcgcggcacuccgugcgcuggagcuccaccagcagcuccgggagcuccagcggcuccagcgggggcuccagcuccagcuccagcuccagcuccgaggaggacgagccggagcaggcccaggccggggagggcgaccgggcccuccugagcccccaguacauggugcccgacauggaccuguggguccccgcgcgccaguccaccagccagccguggcggggcggggccggcgccuggcucgggggccccgccgccagccuguccccgcccaaggggagcuccgcgagccagggcggcuccaaggaggccagcacgaccgccgccgcccccggggaggagaccucccccguccaggugcccgcgcgcgcccacggcccggugccccgcagcgcccaggccucccacagcgccgacacccggcccgcgggggccgagaagcaggcccuggagggcggccgccggcuccugacggugcccguggagaccguccugcgcgugcuccgggccaacaccgcggcccgcuccugcacccagaaggagcagcugcggcagccgccccugcccacgagcucccccggggucagcuccggcgacagcguggcccgcucccacgugcaguggcuccggcaccgcgccacccagagcgggcagcggcgcuggcggcacgcccugcaccgccggcugcucaaccgccggcugcugcucgcggucaccccgugggugggcgacguggucgugcccugcacccaggccucccagcgccccgccgugguccagacgcaggccgacgggcugcgggagcagcugcagcaggcccgccucgcgagcacccccguguucacccuguucacccagcuguuccacaucgacacggccggcugccucgaggugguccgggagcgcaaggcccugccgccccgccugccccaggccggcgcccgggacccgcccgugcaccuccugcaggcgagcuccagcgcccaguccacccccgggcaccuguuccccaacgugcccgcccaggaggccagcaaguccgcgagccacaagggcucccgccggcucgccagcucccgcgucgagcggacccugccgcaggccagccugcucgccuccaccgggccccgccccaagcccaagacggugagcgagcugcugcaggagaagcggcuccaggaggcccgcgcgcgggaggccacccgcggcccggugguccugcccucccagcugcucgugagcuccagcgugauccugcagcccccgcugccccacacgccccacgggcggcccgccccgggccccaccguccucaacgugccccuguccggccccggggccccggccgcggccaagcccggcaccagcggguccuggcaggaggccggcaccagcgccaaggacaagcgccugagcaccaugcaggcccucccccuggcgcccguguucuccgaggccgaggggaccgccccggccgccagccaggcgcccgcccugggccccggccagaucuccgucagcugccccgaguccgggcucggccagagccaggccccggccgcgucccggaagcaggggcugcccgaggccccgcccuuccugcccgccgcccccagccccacgccccucccggugcagccccugucccugacccacaucggcgggccccacguggccaccagcgucccccucccggugaccugggugcugaccgcgcagggccugcuccccguccccgugccggccguggucucccugccccgccccgccggcacgcccgggccggccggccugcucgccacccugcugccgccccucaccgagacccgggcggcccaggggccccgcgcccccgcccugagcuccagcuggcagccgcccgccaacaugaaccgggagcccgagcccuccugccgcacggacacccccgcgccgcccacccacgcccugagccagucccccgccgaggccgacggcagcguggcguucgugcccggcgaggcccaggucgcccgggagauccccgagccccgcaccuccagccacgccgacccgcccgaggccgagccgcccuggagcgggcgccuccccgcguucggcggggugauccccgccacggagccccggggcacccccggguccccgagcggcacccaggagccccgcggcccccuggggcuggagaagcucccgcugcggcagcccggccccgagaagggggcccuggaccucgagaagcccccgcugccccagcccggccccgagaagggggcccuggaccucggccugcugucccaggagggcgaggccgcgacccagcaguggcucgggggccagcgcggggugcgggucccgcugcugggcagccgccuccccuaccagccgcccgcccugugcucccugcgggcccucagcgggcugcugcuccacaagaaggcccuggagcacaaggccacgucccugguggugggcggcgaggcggagcgccccgccggggcccuccaggccagccugggccugguccgggggcagcuccaggacaaccccgcguaccugcugcugcgcgcccgguuccucgccgccuucacccugcccgcccugcucgcgacccuggcgccccagggcgugcgcaccacgcuguccgugccgagccgggucggcuccgagagcgaggacgaggaccuccuguccgagcuggagcucgccgaccgcgacgggcagcccggcugcaccaccgcgaccugccccauccagggggcccccgacagcggcaagugcuccgccagcuccugccuggacacgagcaacgacccggacgaccuggacgugcuccggacccgccacgcccggcacacccgcaagcggcgccggcugguguga

SEQ ID NO: 36848 - RNA, 297 nt, Artificial Sequence
  derived and/or modified sequence opt1 from SNAPC5__Homo_sapiens__NP_006040
augcugagccgccuccaggagcugcggaaggaggaggagacccugcuccgccugaaggccgcccugcacgaccagcucaaccggcugaagguggaggagcuggcgcuccaguccaugaucagcucccgccggggcgacgagaugcugagcucccacaccguccccgagcagagccacgacaugcuggugcacguggacaacgaggccuccaucaaccagacgacccucgagcugagcaccaagucccacgucaccgaggaggaggaggaggaggaggaggaggagagcgacuccuga

SEQ ID NO: 36849 - RNA, 339 nt, Artificial Sequence
  derived and/or modified sequence opt1 from SNCA__Homo_sapiens__NP_009292
auggacguguucaugaagggccugagcaaggccaaggagggggucguggccgcggccgagaagaccaagcagggcguggccgaggccgccgggaagaccaaggagggcguccucuacgugggguccaagacgaaggagggcgugguccacggcguggcgaccguggccgagaagaccaaggagcaggucaccaacgucgggggcgccguggugacgggggugaccgccguggcgcagaagaccgucgagggcgccgggagcaucgccgccgccaccggcuucgugaagaaggaccagcugggcaaggagggguaccaggacuacgagcccgaggcguga

SEQ ID NO: 36850 - RNA, 1812 nt, Artificial Sequence
  derived and/or modified sequence opt1 from SNCAIP__Homo_sapiens__NP_001229864
augaccuaccugauccagagccaccacucccgccggagccagaacugcgccgaggacgugauccgcaagaccaagacggaccagaacggccagcucgagugcguccgguggaugguguccgagaccgaggccaucgcggagcugagcugcuccaaggacuuccccagccugauccacuacgccgggugcuacggccaggagaagauccuccuguggcugcuccaguucaugcaggagcaggggaucucccuggacgagguggaccaggacggcaacagcgccguccacguggccucccagcacggguaccugggcugcauccagacccucguggaguacggcgccaacgucaccaugcagaaccacgcgggggagaagccgagccaguccgccgagcgccagggccacacgcugugcagccgguaccuggugguggucgagaccugcaugucccucgccagccagguggugaagcugaccaagcagcugaaggagcagaccgucgagcgcgugacgcuccagaaccagcugcagcaguuccuggaggcccagaaguccgagggcaagagccuccccuccagccccuccagccccagcuccccggcgagccggaagucccaguggaagucccccgacgccgacgacgacagcguggccaagagcaagcccgggguccaggaggggauccaggugcugggcucccugagcgccuccagccgcgcccggcccaaggcgaaggacgaggacuccgacaagauccuccgccagcugcugggcaaggagaucagcgagaacgugugcacccaggagaagcucucccuggaguuccaggacgcccaggccagcucccggaacagcaagaagaucccgcuggagaagcgcgagcucaagcuggcccggcugcgccagcucaugcagcggucccugagcgaguccgacaccgacagcaacaacagcgaggaccccaagaccacgcccguccgcaaggccgaccggccccgcccgcagcccaucguggaguccguggagagcauggacuccgcggagagccugcaccucaugaucaagaagcacacccuggccuccgggggccggcgcuuccccuucagcaucaaggccuccaagagccuggacgggcacucccccagcccgaccuccgagagcuccgagcccgaccucgagagccaguaccccggcuccggcagcaucccgcccaaccagcccuccggggacccccagcagcccagcccggacagcaccgccgcccagaaggucgcgacgucccccaagagcgcccugaagucccccagcuccaagcggcgcaccagccagaaccugaagcuccgcgugaccuucgaggagcccgugguccagauggagcagccgucccuggagcugaacggcgagaaggacaaggacaaggggcggacccuccagcgcacgagcaccuccaacgagagcggcgaccagcugaagcggcccuucggggccuuccgcuccaucauggagacccugagcggcaaccagaacaacaacaacaacuaccaggccgccaaccagcucaagaccuccacgcugccccugaccagccucggccggaagaccgacgcgaaggggaacccggccuccagcgccuccaagggcaagaacaaggccgagauguacagcuccugcaucaaccugagcagcaacaugcugaucgaggagcaccugugcaacgacacccgccacaacgacaucaaccggaagaugaagaaguccuacagcaucaagcacaucgcggagcccgaguccaaggagcuguuccucuga

SEQ ID NO: 36851 - RNA, 405 nt, Artificial Sequence
  derived and/or modified sequence opt1 from SNCB__Homo_sapiens__NP_003076
auggacguguucaugaagggccugagcauggccaaggagggggucguggccgcggccgagaagaccaagcagggcgugaccgaggccgccgagaagacgaaggaggggguccucuacgugggcuccaagacccgcgagggggugguccagggcguggccagcguggcggagaagaccaaggagcaggccucccaccugggcggggccgucuucagcggcgccgggaacaucgcggccgccaccggccuggugaagcgggaggaguuccccacggaccucaagccggaggagguggcccaggaggccgcggaggagccccugaucgagccccugauggagcccgagggggaguccuacgaggacccgccccaggaggaguaccaggaguacgagcccgaggccuga

SEQ ID NO: 36852 - RNA, 384 nt, Artificial Sequence
  derived and/or modified sequence opt1 from SNCG__Homo_sapiens__NP_003078
auggacguguucaagaagggcuucagcaucgccaaggagggggucgugggcgccguggagaagaccaagcagggggucaccgaggcggccgagaagacgaaggagggcgugauguacgugggggccaagaccaaggagaacgucgugcaguccgugaccagcgucgccgagaagaccaaggagcaggccaacgcgguguccgaggccguggucagcuccgugaacacgguggccaccaagaccgucgaggaggccgagaacaucgcggugaccagcggcgugguccgcaaggaggaccugcggcccuccgccccgcagcaggagggcgaggccagcaaggagaaggaggagguggccgaggaggcccaguccgggggcgacuga

SEQ ID NO: 36853 - RNA, 2733 nt, Artificial Sequence
  derived and/or modified sequence opt1 from SND1__Homo_sapiens__NP_055205
auggccagcuccgcccagagcggcggguccagcggcgggcccgcggugccgaccguccagcgcggcaucaucaagauggugcuguccgggugcgccaucaucgugcggggccagccccgcggcgggcccccgcccgagcggcagaucaaccucagcaacauccgcgccggcaaccuggcccggcgcgccgcggccacccagcccgacgccaaggacacgcccgacgagcccugggccuucccggcgcgggaguuccugcgcaagaagcucaucgggaaggaggucugcuucaccaucgagaacaagacgccccagggccgggaguacgggaugaucuaccugggcaaggacaccaacggcgagaacaucgccgagucccugguggccgaggggcucgccacccgccgggagggcaugcgcgccaacaaccccgagcagaaccggcugagcgagugcgaggagcaggcgaaggccgccaagaaggggaugugguccgagggcaacggcagccacaccauccgcgaccugaaguacaccaucgagaacccccggcacuucguggacucccaccaccagaagccggucaacgccaucaucgagcacgugcgcgacgggagcgugguccgggcccuccugcugcccgacuacuaccucgugaccgugaugcuguccggcaucaagugccccacguuccgccgggaggcggacgggagcgagacccccgagccguucgccgccgaggccaaguucuucaccgagucccgccugcuccagcgggacguccagaucauccuggagagcugccacaaccagaacauccugggcaccauccuccaccccaacgggaacaucacggagcugcugcucaaggagggcuucgcccgcugcguggacugguccaucgcgguguacacccgcggcgccgagaagcugcgggccgccgagcgcuucgccaaggagcggcgccugcggaucuggcgcgacuacgucgcgcccaccgccaaccucgaccagaaggacaagcaguucguggccaaggugaugcagguccugaacgccgacgcgaucguggugaagcugaacagcggggacuacaagaccauccaccucuccagcauccggcccccgcgccuggagggcgagaacacgcaggacaagaacaagaagcugcggccccucuacgacauccccuacauguucgaggcccgcgaguuccugcggaagaagcugaucgggaagaaggucaacgugaccguggacuacauccgccccgccagcccggccaccgagaccguccccgccuucuccgagcggacgugcgcgaccgugaccaucggcgggaucaacaucgccgaggcccucgucagcaagggccuggccaccgugauccgcuaccggcaggacgacgaccagcgcuccagccacuacgacgagcugcucgccgcggaggcccgggccaucaagaacggcaaggggcugcacuccaagaaggaggugcccauccaccgcgucgccgacaucagcggcgacacgcagaaggccaagcaguuccugcccuuccuccagcgggcggggcgcuccgaggccgugguggaguacgucuucagcggcucccgccugaagcuguaccucccgaaggagaccugccugaucaccuuccugcucgccgggaucgagugcccccggggcgcccgcaaccugcccggccuggugcaggagggggagccguucagcgaggaggcgacccucuucacgaaggagcuggugcugcagcgggaggucgagguggagguggaguccauggacaaggccggcaacuucaucggguggcugcacaucgacggcgccaaccucagcguccugcugguggagcacgcccucuccaaggugcacuucaccgccgagcgcagcuccuacuacaagagccugcuguccgcggaggaggccgccaagcagaagaaggagaaggucugggcccacuacgaggagcagcccguggaggaggugaugcccguccucgaggagaaggagcggagcgccuccuacaagcccguguucgugaccgagaucaccgacgaccugcacuucuacguccaggacguggagacgggcacccagcuggagaagcucauggagaacaugcgcaacgacaucgcgagccacccgcccguggaggggagcuacgcgccccggcgcggcgaguucugcaucgccaaguucgucgacggggagugguaccgggcccgcguggagaagguggagucccccgccaagauccacgucuucuacaucgacuacggcaaccgggaggugcugccgagcacccgccuggggacccucucccccgccuucagcacgcgggugcugcccgcccaggccaccgaguacgccuucgcguucauccaggucccccaggacgacgacgcccgcaccgacgccguggacuccgugguccgggacauccagaacacccagugccugcucaacguggagcaccugagcgccggcugcccgcacgugacccugcaguucgccgacuccaagggcgacgucgggcucggccuggugaaggaggggcuggugauggucgaggugcgcaaggagaagcaguuccagaaggugaucacggaguaccucaacgcgcaggagagcgccaaguccgcccggcugaaccuguggcgcuacggcgacuuccgggccgacgacgccgacgaguucggguacagccgcuga

SEQ ID NO: 36854 - RNA, 4242 nt, Artificial Sequence
  derived and/or modified sequence opt1 from SNED1__Homo_sapiens__NP_001073906
augcgccacggcguggccugggcccugcucgucgcggccgcccuggggcugggcgcccgcggggugcgcggcgccguggcgcucgccgacuucuaccccuucggggccgagcggggcgacgccgucaccccgaagcaggacgacggcgggagcggccugcgcccccuguccgugcccuuccccuucuucggggcggagcacagcggccucuacgugaacaacaacgggaucaucuccuuccugaaggaggucagccaguucaccccgguggccuuccccaucgccaaggaccggugcguggucgccgccuucugggcggacguggacaaccgccgggccggcgacguguacuaccgcgaggccacggaccccgccaugcugcggcgcgccaccgaggacguccggcacuacuuccccgagcuccuggacuucaacgcgaccuggguguucguggccaccugguaccgcgucacguucuucggcggguccagcuccagcccggugaacaccuuccagaccgugcugaucaccgacggcaagcucuccuucacgaucuucaacuacgagagcaucgucuggaccaccgggacccacgccuccagcggcggcaacgccacggggcugggcgggaucgccgcgcaggccggcuucaacgccggggacggccagcgguacuucuccauccccggcagccgcaccgccgacauggccgagguggagaccaccacgaacguggggguccccggccggugggcguuccgcaucgacgacgcccaggugcgggucgggggcugcgggcacaccaccuccgugugccuggcccuccgccccugccugaacggcggcaagugcaucgacgacugcgugaccgggaacccgagcuacacgugcuccugccugagcggcuucaccgggcggcgcugccaccucgacgucaacgagugcgccucccagcccugccagaacggcgggaccugcacccacggcaucaacagcuuccggugccagugccccgcgggcuucgggggccccacgugcgagaccgcccagagcccgugcgacaccaaggagugccagcacgggggccagugccagguggagaacggcuccgccgugugcgucugccaggccggguacaccggcgccgcgugcgagauggacguggacgacugcagccccgaccccugccugaacgggggcuccugcguggaccuggucgggaacuacacgugccucugcgccgagcccuucaagggccugcgcugcgagaccggcgaccacccggugcccgacgccugccugagcgcccccugccacaacggcgggaccugcguggacgccgaccagggguacgucugcgagugccccgagggguucauggggcucgacugccgcgagcgggugccggacgacugcgagugccgcaacggcggccggugccugggcgcgaacaccacgcugugccagugcccccucggcuucuucgggcugcugugcgaguucgagaucaccgccaugcccugcaacaugaacacccagugccccgacggcggguacugcauggagcacggcggcuccuaccucugcgugugccacaccgaccacaacgccagccacucccugccgagccccugcgacuccgaccccugcuucaacgggggcagcugcgacgcccacgacgacuccuacacgugcgagugcccgcgcggguuccacggcaagcacugcgagaaggcccggccccaccugugcagcuccgggcccugccgcaacggcgggaccugcaaggaggcgggcggcgaguaccacugcagcugccccuaccgguucaccgggcgccacugcgagaucggcaagccggacuccugcgccagcggccccugccacaacggcgggaccugcuuccacuacaucgggaaguacaagugcgacugcccgcccggcuucuccgggcggcacugcgagaucgcccccagccccugcuuccgcucccccugcgucaacggcgggaccugcgaggaccgggacacggacuucuucugccacugccaggccggcuacaugggccgccggugccaggcggagguggacugcgggcccccggaggaggugaagcacgccacccuccgcuucaacggcacccggcugggggccgucgcccuguacgccugcgaccgcggcuacagccucagcgcgcccucccggauccgcgugugccagccccacggcguguggagcgagcccccgcagugccuggagaucgacgagugccggucccagcccugccugcacgggggcagcugccaggaccgcgucgccggguaccucugccugugcuccaccggcuacgagggggcccacugcgagcuggagcgcgacgagugccgggcccaccccugccgcaacggcggcagcugccggaaccuccccggggccuacgugugccgcugcccggcgggcuucguggggguccacugcgagacggagguggacgccugcgacuccagccccugccagcacggcggccggugcgaguccgggggcggggccuaccugugcgugugccccgagagcuucuucggcuaccacugcgagaccgucuccgaccccugcuucagcuccccgugcgggggccgcggcuacugccuggccagcaacgggucccacagcugcacgugcaaggugggcuacaccggggaggacugcgccaaggagcuguucccgcccacggcgcucaagauggagcggguggaggaguccggcgucagcaucagcuggaacccgcccaacgggcccgccgcccgccagaugcuggacggcuacgccgugaccuacguguccagcgacggcuccuaccggcgcaccgacuucgucgaccggacccgcagcucccaccagcuccaggcgcuggccgccgggcgggccuacaacaucagcguguucuccgugaagcgcaacagcaacaacaagaacgacaucucccggcccgccguccugcuggcgcgcacgcggccccgccccguggagggcuucgaggugaccaacgucaccgccagcaccaucuccgugcagugggcccuccaccggauccgccacgccacggugagcgggguccggguguccauccgccaccccgaggcccugcgcgaccaggcgaccgacguggaccggagcgucgaccgcuucaccuuccgggcccugcuccccggcaagcgcuacaccauccagcugacgacccuguccgggcuccggggcgaggagcacccgaccgagagccuggccaccgcccccacgcacguguggacccgcccccugcccccggccaaccucaccgcggcccgggugaccgccacguccgcccacgucgugugggacgcccccacccccggcagccugcuggaggcguacgugaucaacgucaccaccucccagagcaccaagagccgcuacgugcccaacgggaagcucgccuccuacaccgugcgggaccugcugccgggccgccgguaccagcucagcgucaucgccgugcaguccaccgagcuggggccccagcacagcgagcccgcccaccuguacaucaucaccagcccccgcgacggcgcggaccggcgcuggcaccagggcgggcaccacccgcggguccucaagaaccggcccccgcccgcccggcugcccgagcugcgccuccugaacgaccacuccgcccccgagacgcccacccagcccccgcgguucuccgagcugguggacggccgcgggcgcgugagcgcccgguucggcgggucccccagcaaggccgcgaccguccgcucccagcccaccgccagcgcccagcucgagaacauggaggaggccccgaagcgggugucccuggcccugcagcuccccgagcacggcagcaaggacaucggcaacgugcccgggaacugcuccgagaaccccugccagaacggcgggaccugcgucccgggcgcggacgcccacagcugcgacugcgggcccggcuucaagggccgccggugcgagcuggccugcaucaaggugucccgccccugcacgcggcuguucagcgagaccaaggccuuccccgugugggagggcggggucugccaccacguguacaagcgcguguaccggguccaccaggacaucugcuucaaggaguccugcgagagcaccagccucaagaagaccccgaaccgcaagcaguccaagagccagacgcuggagaaguccuga

SEQ ID NO: 36855 - RNA, 777 nt, Artificial Sequence
  derived and/or modified sequence opt1 from SNF8__Homo_sapiens__NP_009172
augcaccgccggggcgugggggccggcgccaucgcgaagaagaagcuggccgaggccaaguacaaggagcgcgggaccguccucgccgaggaccagcuggcccagaugagcaagcagcuggacauguucaagaccaaccucgaggaguucgcguccaagcacaagcaggagauccggaagaaccccgaguuccgcgugcaguuccaggacaugugcgccacgaucggcguggacccgcuggccagcgggaagggcuucugguccgagaugcugggcgucggggacuucuacuacgagcucggcgugcagaucaucgaggugugccuggcccugaagcaccggaacgggggccucaucacccuggaggagcugcaccagcagguccucaaggggcgcggcaaguucgcgcaggacgugagccaggacgaccugauccgggccaucaagaagcugaaggcccucggcaccggguucggcaucauccccgucgggggcaccuaccugauccaguccgugcccgccgagcugaacauggaccacacgguggugcuccagcuggccgagaagaacggcuacgucaccgugagcgagaucaaggcgucccugaagugggagaccgagcgcgcccgccaggugcucgagcaccuccugaaggaggggcuggccuggcuggaccugcaggcccccggcgaggcccacuacuggcucccggcgcuguucaccgaccuguacagccaggagaucacggccgaggaggcccgggaggcccuccccuga

SEQ ID NO: 36856 - RNA, 948 nt, Artificial Sequence
  derived and/or modified sequence opt1 from SNIP1__Homo_sapiens__XP_011540462
auggaccugcaguuccacauggccggcgaggccagccaguccuggugggaggcgcgccggagcaagucccacggguggcgccaggagcgggaggaccacccccgccggggccgcgaggaccggcagcaccgcgagccgagcgagcaggagcaccggcgcgcccggaacuccgaccgcgaccggcaccgcgggcacagccaccagcggcgcaccuccaacgagcggcccggcagcgggcagggccagggccgcgaccgggacacccagaaccuccaggcccaggaggaggagcgcgaguucuacaacgcccggcgccgcgagcaccggcagcgcaacgacgucgggggcgggggcuccgagagccaggagcuggugccccggcccgggggcaacaacaaggagaaggaggugccggccaaggagaagcccuccuucgagcugagcggcgcgcuccuggaggacacgaacaccuuccgcgggguggucaucaaguacuccgagccgcccgaggcccggauccccaagaagcgcuggcggcuguaccccuucaagaacgacgaggugcuccccgugauguacauccaccgccagagcgccuaccugcugggccggcaccgccggaucgccgacauccccaucgaccacccguccugcagcaagcagcacgcggucuuccaguaccgccucguggaguacacccgggccgacgggaccgugggccgccgggucaagcccuacaucaucgaccugggcuccgggaacggcacguuccugaacaacaagcgcaucgagccccagcgguacuacgagcucaaggagaaggacgugcugaaguucggguucagcucccgcgaguacgugcugcuccacgagagcagcgacaccuccgagaucgaccggaaggacgacgaggacgaggaggaggaggaggaggucagcgacuccuga

SEQ ID NO: 36857 - RNA, 2298 nt, Artificial Sequence
  derived and/or modified sequence opt1 from SNRK__Homo_sapiens__NP_001094064
auggccggcuucaagcgcggguacgacggcaagaucgccgggcuguacgaccucgacaagacccugggccgggggcacuucgcgguggucaagcuggcccgccacguguucaccggcgagaagguggccgucaaggugaucgacaagacgaagcucgacacccuggccaccggccaccuguuccaggaggugcggugcaugaagcucguccagcaccccaacaucgugcgccuguacgaggugaucgacacccagacgaagcuguaccucauccuggagcugggggacggcggggacauguucgacuacaucaugaagcacgaggagggccucaacgaggaccuggccaagaaguacuucgcgcagaucguccacgccaucagcuacugccacaagcugcacguggugcaccgggaccucaagccggagaacgucguguucuucgagaagcaggggcuggugaagcugaccgacuucggcuucuccaacaaguuccagcccggcaagaagcucaccaccagcugcgggucccuggccuacagcgcccccgagauccugcucggcgacgaguacgacgcgcccgccgucgacaucuggucccugggggugauccuguucaugcucgugugcggccagccgcccuuccaggaggccaacgacagcgagacgcugaccaugaucauggacugcaaguacaccguccccucccacgugagcaaggagugcaaggaccugaucacccgcaugcuccagcgggaccccaagcgccgggccucccuggaggagaucgagaaccacccguggcugcagggcguggaccccagccccgccacgaaguacaacaucccccucgucuccuacaagaaccugagcgaggaggagcacaacuccaucauccagcgcauggugcugggggacaucgcggaccgggacgccaucguggaggcccucgagaccaaccgcuacaaccacaucaccgccaccuacuuccugcuggccgagcggauccuccgcgagaagcaggagaaggagauccagacgcggagcgcguccccgagcaacaucaaggcccaguuccgccaguccuggcccaccaagaucgacgucccccaggaccuggaggacgaccugaccgccacgccccucagccacgccaccgugccgcagucccccgcccgggcggccgacagcguccugaacggccaccgcagcaaggggcugugcgacuccgccaagaaggacgaccuccccgagcuggccggccccgcccugagcaccgugccgcccgcgucccucaagcccaccgccagcgggcggaagugccuguuccgcguggaggaggacgaggaggaggacgaggaggacaagaagcccaugucccugagcacccaggucgugcuccggcgcaagccguccgugacgaaccgccugaccagccggaaguccgcccccguccugaaccagaucuucgaggagggcgagagcgacgacgaguucgacauggacgagaaccugccgcccaagcucucccgccugaagaugaacaucgccagccccggcaccgugcacaagcgguaccaccgccggaagucccaggggcgcggcagcuccugcagcuccagcgagaccuccgacgacgacagcgagagccggcgccggcuggacaaggacuccggguucacguacagcuggcaccgccgggacuccagcgagggcccgcccggguccgagggcgacggcgggggccagagcaagcccuccaacgcgagcgggggcguggacaaggccucccccagcgagaacaacgccgggggcggcucccccagcuccgggagcggcgggaaccccaccaacaccuccggcaccacgcgccggugcgccggcccgagcaacuccaugcagcucgccagccgcagcgcgggggagcuggucgagucccugaagcucaugagccugugccugggcucccagcuccacgggagcaccaaguacaucaucgacccccagaacggccuguccuucagcuccgugaaggugcaggagaaguccaccuggaagaugugcaucagcagcaccgggaacgccggccagguccccgccgugggcgggaucaaguucuucuccgaccacauggccgacacgaccaccgagcuggagcggaucaagagcaagaaccucaagaacaacgugcugcagcugccccucugcgagaagaccaucuccgucaacauccagcgcaacccgaaggagggccugcugugcgccagcucccccgcgagcugcugccacgugaucuga

SEQ ID NO: 36858 - RNA, 6411 nt, Artificial Sequence
  derived and/or modified sequence opt1 from SNRNP200__Homo_sapiens__NP_054733
auggccgacgugaccgcccgcagccugcaguacgaguacaaggccaacuccaaccucguccugcaggccgaccggagccugaucgaccgcacccggcgcgacgagcccaccggggaggugcucucccugguggggaagcuggagggcacccggaugggggacaaggcccagcgcaccaagccccagaugcaggaggagcggcgcgccaagcggcgcaagcgggacgaggaccgccacgacaucaacaagaugaagggcuacacccuccugagcgaggggaucgacgagauggucggcaucaucuacaagcccaagacgaaggagacccgggagaccuacgaggugcugcucuccuucauccaggccgcccugggcgaccagccccgcgacauccugugcggggccgccgacgaggugcucgccguccugaagaacgagaagcugcgggacaaggagcgccggaaggagaucgaccuccugcugggccagaccgacgacacgcgcuaccacgugcucgugaaccuggggaagaagaucaccgacuacggcggggacaaggagauccagaacauggacgacaacaucgacgagaccuacggcgucaacgugcaguucgagagcgacgaggaggagggcgacgaggacguguacggggagguccgggaggaggccuccgacgacgacauggagggcgacgaggccguggugcgcugcacccugagcgccaaccucgucgccuccggggagcugaugagcuccaagaagaaggaccugcacccccgggacaucgacgccuucuggcuccagcgccagcugagccgcuucuacgacgacgcgaucgugucccagaagaaggccgacgaggugcuggagauccucaagacggccagcgacgaccgggagugcgagaaccagcugguccugcuccugggcuucaacaccuucgacuucaucaaggugcugcgccagcaccggaugaugauccucuacugcacccugcuggccuccgcccagagcgaggcggagaaggagcgcaucaugggcaagauggaggccgacccggagcucuccaaguuccuguaccagcugcacgagaccgagaaggaggaccucauccgggaggagcgcagccggcgcgagcgggugcgccagucccggauggacacggaccuggagaccauggaccuggaccagggcggggaggcccucgcgccccgccagguccuggaccuggaggaccucguguucacccaggggagccacuucauggccaacaagcggugccagcugcccgacggcagcuuccgccggcagcgcaagggguacgaggaggugcacguccccgcgcugaagccgaagcccuucggcuccgaggagcagcuccugcccguggagaagcugcccaaguacgcccaggccggcuucgagggguucaagacccugaaccggauccagagcaagcucuaccgcgccgcccuggagacggacgagaaccugcuccugugcgcgccgaccggcgccgggaagaccaacgucgcccugaugugcaugcuccgggagaucggcaagcacaucaacauggacgggaccaucaacguggacgacuucaagaucaucuacaucgcccccaugcgcucccuggugcaggagauggucggcagcuucggcaagcgccuggcgacguacgggaucaccguggccgagcucaccggcgaccaccagcugugcaaggaggagaucuccgccacccagaucaucgugugcacgcccgagaagugggacaucaucacccggaagggcggggagcgcaccuacacccagcugguccggcucaucauccuggacgagauccaccuccuccacgacgaccgcgggcccgugcuggaggcccugguggcccgggcgauccgcaacaucgagaugacgcaggaggacguccggcucaucggccugagcgccacccugccgaacuacgaggacguggccaccuuccuccgcguggaccccgccaagggccuguucuacuucgacaacuccuuccggcccgucccccuggagcagaccuacguggggaucacggagaagaaggccaucaagcgcuuccagaucaugaacgagaucguguacgagaagaucauggagcacgcgggcaagaaccagguccucguguucgugcacagccggaaggagaccgggaagaccgcccgcgccauccgggacaugugccuggagaaggacacccugggccucuuccugcgcgagggcuccgccagcaccgagguccugcggacggaggccgagcagugcaagaaccucgagcugaaggaccugcucccguacggguucgcgauccaccacgccggcaugacccgcguggaccggacccugguggaggaccuguucgccgacaagcacauccagguccucguguccaccgccacgcuggcguggggcgugaaccugcccgcccacaccgucaucaucaagggcacccagguguacagccccgagaaggggcgcuggaccgagcucggcgcccuggacauccugcagaugcucggccgggccgggcgcccccaguacgacacgaagggcgaggggauccugaucaccucccacggcgagcugcaguacuaccucagccugcugaaccagcagcucccgaucgagucccagauggugagcaagcugcccgacaugcugaacgccgagaucguccucgggaacgugcagaacgcgaaggacgccgugaacuggcugggcuacgccuaccuguacauccggaugcuccgcucccccacccuguacggcaucagccacgacgaccugaagggggacccccuccuggaccagcgccggcuggaccucguccacaccgccgcccugaugcuggacaagaacaaccucgugaaguacgacaagaagacgggcaacuuccaggugaccgagcuggggcgcaucgcgucccacuacuacaucaccaacgacaccguccagacguacaaccagcugcucaagccgacccugagcgagaucgagcuguuccggguguucagccucuccagcgaguucaagaacaucaccgugcgcgaggaggagaagcuggagcugcagaagcuccuggagcggguccccauccccgugaaggaguccaucgaggagccgagcgccaagaucaacgugcugcuccaggccuucaucucccagcugaagcuggagggcuucgcccucauggccgacauggucuacgugacccagagcgcggggcgccugaugcgggccaucuucgagaucgugcugaaccgcggcugggcccagcucacggacaagacccugaaccugugcaagaugaucgacaagcggauguggcaguccaugugcccccuccgccaguuccggaagcugcccgaggaggucgugaagaagaucgagaagaagaacuuccccuucgagcgccuguacgaccucaaccacaacgagaucggcgagcugauccggaugccgaagauggggaagaccauccacaaguacgugcaccuguuccccaagcucgagcugagcguccaccuccagcccaucacccgcuccacgcugaagguggagcugaccaucacccccgacuuccagugggacgagaaggugcacggcagcuccgaggccuucuggauccuggucgaggacguggacagcgaggugauccugcaccacgaguacuuccuccugaaggcgaaguacgcccaggacgagcaccugaucaccuucuucgucccgguguucgagccccugccgccccaguacuucauccgggucguguccgaccgcuggcugagcugcgagacgcagcugccgguguccuuccggcaccucauccugcccgagaaguacccgccgcccaccgagcugcucgaccugcagccccugcccgucagcgcccuccgcaacuccgccuucgagagccuguaccaggacaaguuccccuucuucaaccccauccagacccagguguucaacaccguguacaacagcgacgacaacgucuucgugggggcccccacgggcuccgggaagaccaucugcgcggaguucgccauccugcggaugcuccugcagagcuccgagggccgcugcguguacaucacccccauggaggcccuggccgagcaggucuacauggacugguacgagaaguuccaggaccgccucaacaagaagguggugcugcugaccggcgagacgagcaccgaccucaagcugcuggggaagggcaacaucaucaucuccacccccgagaagugggacauccucagccggcgcuggaagcagcggaagaacguccagaacaucaaccuguucgugguggacgagguccaccugaucgggggcgagaacggcccggugcucgaggugaucugcucccgcaugcgguacaucagcucccagaucgagcgccccauccggaucgucgcccugagcuccagccuguccaacgcgaaggacguggcccacuggcucgggugcagcgccaccuccaccuucaacuuccaccccaacgugcgcccggucccccuggagcugcacauccagggcuucaacaucagccacacgcagacccggcuccuguccauggccaagcccguguaccacgccaucaccaagcacagccccaagaagccggugaucgucuucgugcccucccgcaagcagacccggcugacggcgaucgacauccucacgaccugcgccgccgacauccagcgccagcgguuccugcacugcaccgagaaggaccugauccccuaccucgagaagcugagcgacagcacgcugaaggagacccuccugaacggggugggcuaccugcacgaggggcucucccccauggagcgccggcuggucgagcagcuguucagcuccggcgccauccaggugguggucgccagccgcucccucugcuggggcaugaacguggcggcccaccuggugaucaucauggacacccaguacuacaacgggaagauccacgccuacgucgacuacccgaucuacgacgugcugcagauggugggccacgccaaccggccccuccaggacgacgaggggcgcugcgucaucaugugccagggcagcaagaaggacuucuucaagaaguuccuguacgagccccugcccguggagucccaccucgaccacugcaugcacgaccacuucaacgcggagaucgugaccaagacgaucgagaacaagcaggacgccgucgacuaccugaccuggaccuuccuguaccggcgcaugacccagaacccgaacuacuacaaccuccaggggaucagccaccggcaccuguccgaccaccugagcgagcucguggagcagacgcuguccgaccuggagcagagcaagugcaucuccaucgaggacgagauggacguggcgccccucaaccugggcaugaucgccgccuacuacuacaucaacuacaccaccaucgagcuguucagcaugucccucaacgcgaagaccaagguccgcggccugaucgagaucaucagcaacgccgccgaguacgagaacauccccauccgccaccacgaggacaaccugcuccggcagcuggcccagaaggugccccacaagcugaacaacccgaaguucaacgacccccacgugaagacgaaccuccugcugcaggcccaccucucccgcaugcagcugagcgcggagcugcaguccgacaccgaggagauccucagcaaggccauccggcugauccaggccugcgucgacgugcugagcuccaacggguggcucagccccgcccuggccgcgauggagcuggcccagauggugacccaggccaugugguccaaggacagcuaccucaagcagcugccccacuucaccuccgagcacaucaagcgcugcacggacaagggcgucgagagcguguucgacaucauggagauggaggacgaggagcggaacgcccugcuccagcugaccgacucccagaucgcggacguggcccgcuucugcaaccgguacccgaacaucgagcugagcuacgaggucguggacaaggacuccauccgcagcgggggccccgucguggugcucguccagcuggagcgggaggaggaggugaccgggcccgugaucgcgccccuguucccgcagaagcgcgaggagggcuggugggucgugaucggcgacgccaaguccaacagccucaucuccaucaagcggcugacccugcagcagaaggccaaggugaagcucgacuucgucgcgcccgccacgggggcccacaacuacacccuguacuucaugagcgacgccuacaugggcugcgaccaggaguacaaguucuccguggacgugaaggaggccgagaccgacagcgacuccgacuga

SEQ ID NO: 36859 - RNA, 468 nt, Artificial Sequence
  derived and/or modified sequence opt1 from SNRNP27__Homo_sapiens__NP_006848
augggccgcagccggucccgcagcccccggcgcgagcggcgccggucccgcagcaccucccgggagcgcgagcggcgccggcgcgagcggagccgcucccgggagcgcgaccggcgccggagccgcucccgcagcccgcaccggcgccggucccgcagcccccggcgccaccgguccaccagccccucccccagccgccugaaggagcggcgcgacgaggagaagaaggagacgaaggagaccaaguccaaggagcggcagaucaccgaggaggaccucgaggggaagaccgaggaggagaucgagaugaugaagcugaugggcuucgccagcuucgacuccacgaaggggaagaagguggacggcagcgucaacgccuacgcgaucaacgugagccagaagcgcaaguaccggcaguacaugaaccgcaagggcggguucaaccggccgcuggacuucaucgccuga

SEQ ID NO: 36860 - RNA, 1287 nt, Artificial Sequence
  derived and/or modified sequence opt1 from SNRNP70__Homo_sapiens__NP_001287998
augacccaguuccugcccccgaaccuccuggcccuguucgcgccccgcgaccccauccccuaccucccgccccuggagaagcugccccacgagaagcaccacaaccagcccuacugcggcaucgccccguacauccgggaguucgaggacccccgcgacgccccgccgcccacccgggccgagacgcgcgaggagcggauggagcgcaagcggcgcgagaagaucgagcggcgccagcaggagguggagaccgagcucaagaugugggacccccacaacgaccccaacgcccagggggacgccuucaagacccuguucgucgcgcgggugaacuacgacaccacggagagcaagcugcgccgggaguucgagguguacggccccaucaagcgcauccacauggucuacuccaagcggagcgggaagccccgcggcuacgccuucaucgaguacgagcacgagcgggacaugcacuccgccuacaagcacgccgacgggaagaagaucgacggccgccgggugcucguggacgucgagcgcggccggaccgugaagggguggcgcccccgccggcugggcgggggccucgggggcacccgccggggcggggcggacgugaacauccgccacagcggccgggacgacaccucccgcuacgacgagcgggaccgcgaccgggaccgcgagcgggagcgccgggagcgcagccgggagcgcgacaaggagcgggagcgccggcgcucccgcagccgggaccgccggcgccggucccgcagccgggacaaggaggagcgccggcgcucccgggagcgcagcaaggacaaggaccgggaccgcaagcggcgcuccagccggucccgcgagcgggcccgccgggagcgcgagcgcaaggaggagcugcgcgggggcggcggggacauggccgagcccagcgaggccggcgacgcgcccccggacgacgggccgcccggcgagcuggggcccgacggccccgacggccccgaggagaaggggcgggaccgggaccgcgagcggcgccggucccaccgcagcgagcgggagcgccggcgcgaccgggaccgcgaccgggaccgcgaccgggagcacaagcgcggcgagcggggguccgagcgcggccgcgacgaggcccgcgggggcggcgggggccaggacaacgggcuggagggccucgggaacgacagccgggacauguacauggagagcgagggcggcgacggguaccuggcccccgagaacggcuaccugauggaggccgcccccgaguga

SEQ ID NO: 36861 - RNA, 849 nt, Artificial Sequence
  derived and/or modified sequence opt1 from SNRPA__Homo_sapiens__NP_004587
auggccgugcccgagacccgccccaaccacaccaucuacaucaacaaccugaacgagaagaucaagaaggacgagcucaagaagucccuguacgccaucuucagccaguucggccagauccuggacauccucgucagccggucccugaagaugcgcgggcaggcguucgugaucuucaaggaggugagcuccgccacgaacgcccugcggagcaugcagggcuuccccuucuacgacaagcccaugcgcauccaguacgccaagaccgacuccgacaucaucgccaagaugaaggggaccuucgucgagcgggaccgcaagcgggagaagcgcaagcccaagagccaggagacccccgcgacgaagaaggccgugcagggcgggggcgccacccccguggucggcgccgugcaggggcccgugcccggcaugccgcccaugacccaggcgccccggaucaugcaccacaugcccgggcagccgcccuacaugcccccgcccggcaugaucccgccgcccgggcucgcccccggccagaucccgcccggcgccaugccgccccagcagcugaugcccgggcagaugccgcccgcccagccccuguccgagaacccgcccaaccacauccucuuccugaccaaccugcccgaggagacgaacgagcucaugcugagcaugcuguucaaccaguuccccggcuucaaggagguccgccucgugcccgggcggcacgacaucgccuucguggaguucgacaacgagguccaggcgggcgccgcccgcgacgcccugcagggcuucaagaucacccagaacaacgccaugaagaucuccuucgcgaagaaguga

SEQ ID NO: 36862 - RNA, 696 nt, Artificial Sequence
  derived and/or modified sequence opt1 from SNRPB__Homo_sapiens__NP_003082
augaccgugggcaagagcuccaagaugcugcagcacaucgacuaccgcaugcggugcauccuccaggacgggcgcaucuucaucggcaccuucaaggccuucgacaagcacaugaaccugauccugugcgacugcgacgaguuccggaagaucaagcccaagaacagcaagcaggccgagcgcgaggagaagcggguccucgggcuggugcugcuccgcggcgagaaccugguguccaugacggucgaggggccgccccccaaggacaccggcaucgcgcgggugccccuggccggcgccgccgggggcccggggaucggccgcgccgcggggcggggcauccccgccggcgugcccaugccccaggccccggccgggcucgcgggccccguccgcggggugggcggccccagccagcaggugaugaccccccaggggcggggcaccgucgccgccgccgccgcggccgccacggccuccaucgccggggcgccgacccaguacccccccggccgcgggggccccccgccccccaugggccggggggcccccccgcccggcaugauggggccccccccgggcaugcgcccccccauggggcccccgaugggcaucccccccggccgggggaccccgaugggcaugcccccccccgggaugcgcccgcccccccccggcaugcgggggcugcuguga

SEQ ID NO: 36863 - RNA, 480 nt, Artificial Sequence
  derived and/or modified sequence opt1 from SNRPC__Homo_sapiens__NP_003084
augcccaaguucuacugcgacuacugcgacaccuaccugacccacgacagcccguccgugcgcaagacgcacugcagcggccggaagcacaaggagaacgucaaggacuacuaccagaaguggauggaggagcaggcccagucccucaucgacaagaccaccgccgcguuccagcaggggaagaucccccccacccccuucagcgccccgccccccgccggcgccaugauccccccgccccccucccugcccgggccgccccgccccggcaugaugcccgccccgcacauggggggcccccccaugaugcccaugaugggcccgcccccccccgggaugaugccggugggccccgcgcccgggaugcggcccccgaugggcgggcacaugcccaugaugcccggcccgcccaugaugcgcccccccgcccggccgaugauggugcccacgcgccccggcaugacccggcccgaccgcuga

SEQ ID NO: 36864 - RNA, 360 nt, Artificial Sequence
  derived and/or modified sequence opt1 from SNRPD1__Homo_sapiens__NP_008869
augaagcuggugcgcuuccucaugaagcugagccacgagaccgucaccaucgagcugaagaacggcacccaggugcacgggacgaucaccggcguggacgucuccaugaacacccaccucaaggccgugaagaugacgcugaagaaccgggagcccgugcagcuggagacccucagcauccgcgggaacaacauccgguacuucauccugccggacucccugccccucgacacccugcuggucgacguggagcccaaggucaagagcaagaagcgcgaggccguggcgggccgggggcgcggccggggccgcgggcggggccgcgggcggggccgcgggcggggcggcccccgccgguga

SEQ ID NO: 36865 - RNA, 381 nt, Artificial Sequence
  derived and/or modified sequence opt1 from SNRPD3__Homo_sapiens__NP_004166
augagcaucggcgugcccaucaagguccugcacgaggccgaggggcacaucgugaccugcgagaccaacacgggcgagguguaccgcgggaagcucaucgaggccgaggacaacaugaacugccagauguccaacaucaccgucaccuaccgggacggccgcguggcgcagcuggagcaggucuacauccgggggagcaagauccgcuuccugauccucccggacaugcugaagaacgcccccaugcugaaguccaugaagaacaagaaccagggcagcggcgccgggcggggcaaggccgccauccucaaggcccagguggcggcccgcgggcggggccgcgggaugggccggggcaacaucuuccagaagcgccgguga

SEQ ID NO: 36866 - RNA, 255 nt, Artificial Sequence
  derived and/or modified sequence opt1 from SNRPE__Homo_sapiens__NP_001291393
augagcggccugggggccaccgugguccagaaccucaucuuccgcuaccugcagaaccggucccgcauccagguguggcuguacgagcaggucaacaugcggaucgagggcugcaucaucggguucgacgaguacaugaaccucgugcuggacgacgccgaggagauccacagcaagaccaagucccgcaagcagcugggccggaucaugcucaagggggacaacaucacgcugcugcagagcguguccaacuga

SEQ ID NO: 36867 - RNA, 261 nt, Artificial Sequence
  derived and/or modified sequence opt1 from SNRPF__Homo_sapiens__NP_003086
augagccugccccucaacccgaagcccuuccugaacggccugaccgggaagcccgugauggucaagcucaaguggggcauggaguacaagggguaccugguguccguggacggcuacaugaacaugcagcuggccaacaccgaggaguacaucgacggggcccucagcggccaccugggcgagguccugauccgcugcaacaacgugcucuacauccgcgggguggaggaggaggaggaggacggcgagaugcgggaguga

SEQ ID NO: 36868 - RNA, 723 nt, Artificial Sequence
  derived and/or modified sequence opt1 from SNRPN__Homo_sapiens__NP_073719
augaccgugggcaagagcuccaagaugcugcagcacaucgacuaccgcaugcggugcauccuccaggacgggcgcaucuucaucggcaccuucaaggccuucgacaagcacaugaaccugauccugugcgacugcgacgaguuccggaagaucaagcccaagaacgccaagcagccggagcgcgaggagaagcggguccucgggcuggugcugcuccgcggcgagaaccuggugagcaugacggucgaggggcccccccccaaggacaccggcaucgcgcgggugccgcuggccggcgccgccgggggccccggggugggccgcgccgcggggcggggcguccccgccggcgugcccaucccgcaggcccccgccgggcucgcgggccccgugcgcggggucggcggccccucccagcaggugaugaccccgcaggggcggggcaccguggccgccgccgccgucgcggccacggccagcaucgccggggcccccacccaguacccccccggccgcgggaccccgcccccccccgugggccgggcgaccccgccccccggcaucauggcccccccgcccgggaugcgcccccccaugggcccgcccaucgggcugcccccggcccggggcacgcccaucgggaugccccccccgggcaugcgccccccccccccgggcauccgggggcccccccccccgggcaugcgccccccccggcccuga

SEQ ID NO: 36869 - RNA, 1518 nt, Artificial Sequence
  derived and/or modified sequence opt1 from SNTA1__Homo_sapiens__NP_003089
auggccagcggccgccgggcgccccgcaccgggcugcucgagcugcgggccggcgccggguccggcgccgggggcgagcgcuggcagcgggugcugcucagccuggccgaggacguccugaccguguccccggccgacggcgaccccgggcccgagcccggcgcgccgcgcgagcaggagcccgcccagcucaacggggccgccgagcccggcgcggggcccccgcagcugcccgaggcccugcuccugcagcggcgccgggugacgguccgcaaggccgacgccggcggccuggggaucagcaucaagggcgggcgggagaacaagaugcccauccucaucuccaagaucuucaagggccuggccgcggaccagaccgaggcccuguucgugggcgacgccauccucagcgugaacggggaggaccuguccagcgccacccacgacgaggccguccaggugcugaagaagaccggcaaggaggugguccucgaggugaaguacaugaaggacgugucccccuacuucaagaacagcaccgggggcaccuccgucgggugggacagcccgcccgcgagcccccugcagcgccagcccuccuccccgggccccacgccccggaacuucagcgaggccaagcacaugucccugaagauggccuacgugagcaagcgcugcacccccaacgacccggagccccgguaccucgagaucugcuccgccgacggccaggacacgcuguuccugcgcgccaaggacgaggcgagcgcccggagcugggccaccgccauccaggcccaggugaacacccucacgccccgcgucaaggacgagcugcaggcgcugcucgccgccaccuccaccgccgggagccaggacaucaagcagaucggcuggcugaccgagcagcugcccuccgggggcaccgcgccgacgcucgcccugcugaccgagaaggagcuccugcuguaccucagccugcccgagacccgggaggcccugucccgccccgcccggaccgcgccccucaucgccacgcgccuggugcacagcgggccguccaagggcagcgugcccuacgacgccgagcuguccuucgcccuccgcaccggcacccggcacggggucgacacccaccuguucagcguggagagcccccaggagcuggccgccuggacgcgccagcucguggacggcugccaccgggcggccgaggggguccaggagguguccaccgccugcaccuggaacggccgcccgugcucccugagcgugcacaucgacaagggguucacccugugggccgccgagcccggcgcggcccgggccguccuccugcgccagcccuucgagaagcugcagauguccagcgacgacggcgccucccuccuguuccuggacuucgggggcgcggagggggagauccagcuggaccuccacagcugccccaagacgaucguguucaucauccacuccuuccugagcgccaaggucacccggcugggccuccuggccuga

SEQ ID NO: 36870 - RNA, 1617 nt, Artificial Sequence
  derived and/or modified sequence opt1 from SNTB1__Homo_sapiens__NP_066301
auggccguggccgcggccgccgccgccgcgggccccgccggggccggcgggggccgcgcccagcggagcgggcugcucgagguccuggugcgcgaccgguggcacaaggugcuggucaaccucuccgaggacgcgcuggugcugagcuccgaggagggcgccgccgccuacaacggcaucgggaccgccaccaacggcagcuucugccgcggggcgggcgccgggcacccgggcgccggcggggcccagccgcccgacucccccgccggcgugcggacggcguucaccgaccuccccgagcagguccccgagagcaucuccaaccagaagcgcggggugaaggugcugaagcaggagcugggcggccucgggaucagcaucaagggcgggaaggagaacaagaugcccauccugaucuccaagaucuucaagggccuggccgccgaccagacccaggcccucuacgucggggacgccauccugagcgugaacggcgcggaccugcgggacgccacccacgacgaggccgugcaggcccucaagcgcgccggcaaggagguccugcuggaggugaaguacaugcgggaggcgacgcccuacgugaagaagggguccccggucagcgagaucggcugggagaccccgccgcccgagagcccccgccucgggggcuccaccuccgacccgcccagcucccagagcuucuccuuccaccgggaccgcaagagcaucccccugaagaugugcuacgugacccggagcauggcccuggccgaccccgagaaccgccagcucgagauccacucccccgacgccaagcacacggugauccugcggagcaaggacuccgcgaccgcccaggccugguucagcgccauccacuccaacgucaacgaccugcucacccgcgugaucgccgaggugcgggagcagcuggggaagaccggcaucgcgggcagccgcgagauccggcaccugggguggcucgccgagaagguccccggcgaguccaagaagcaguggaagcccgcccugguggugcugacggagaaggaccuccugaucuacgacagcaugccccgccggaaggaggccugguucucccccguccacaccuacccccugcucgccacccgccuggugcacagcgggcccggcaagggguccccgcaggcgggcgucgaccugagcuucgccacccgcacgggcacccggcaggggaucgagacccaccucuuccgcgccgagaccucccgggaccugagccacuggacgcgcuccaucgugcagggcugccacaacagcgccgagcugaucgccgagaucuccaccgcgugcaccuacaagaaccaggagugccggcucaccauccacuacgagaacggguucagcaucacgaccgagccccaggagggcgccuuccccaagaccaucauccagucccccuacgagaagcugaagaugagcagcgacgacggcauccgcaugcuguaccucgacuucgggggcaaggacggggagauccagcuggaccugcacuccugcccgaagcccaucguguucaucauccacagcuuccucuccgccaagaucacccggcugggccuggucgccuga

SEQ ID NO: 36871 - RNA, 1443 nt, Artificial Sequence
  derived and/or modified sequence opt1 from SNTG1__Homo_sapiens__NP_001274743
auggacuuccgcaccgccugcgaggagaccaagacgggcaucugccugcuccaggacgggaaccaggagcccuucaaggugcggcugcaccuggccaaggacauccucaugauccaggagcaggacgucaucugcgugagcggcgagccguucuacuccggggagcgcaccgugaccauccggcgccagaccgucggcggguucggccugagcaucaagggcggggcggagcacaacauccccgugguggucuccaagaucagcaaggagcagcgggccgagcuguccggccuccuguucaucggggacgccauccugcagaucaacggcaucaacgugcgcaagugccggcacgaggaggugguccaggugcuccgcaacgccggggaggaggugacgcugaccgucagcuuccugaagcgggcccccgcguuccucaagcugccccugaacgaggacugcgccugcgccccguccgaccagagcuccggcaccagcagcccccucugcgacuccggccugcaccugaacuaccaccccaacaacaccgacacgcucuccugcagcuccuggcccaccagcccggggcugcgcugggagaagcgguggugcgaccugcgccucaucccccugcugcacucccgguucagccaguacgugcccggcaccgaccucucccgccagaacgccuuccaggugaucgcggucgacggggugugcaccggcaucauccagugccugagcgccgaggacugcguggacuggcugcaggccaucgccacgaacaucagcaaccucaccaagcacaacaucaagaagaucaaccggaacuuccccgucaaccagcagaucguguacaugggcuggugcgaggcccgcgagcaggacccgcugcaggaccggguguacucccccaccuuccuggcgcuccgcgggagcugccuguacaaguuccuggccccgcccgucaccacgugggacuggacccgggccgagaagaccuucuccguguacgagaucaugugcaagauccucaaggacagcgaccugcuggaccgccggaagcagugcuucaccgugcaguccgagagcggcgaggaccucuacuucuccgucgagcuggagagcgaccuggcccagugggagcgcgccuuccagacggcgaccuuccucgagguggagcgcauccagugcaagaccuacgccugcguccuggagucccaccugauggggcucaccaucgacuucagcacgggcuucaucugcuucgacgccgccaccaaggagcuggaguucuccaaccuguucgccgugcuccacugcauccacagcuucuucgcggccaagguggccugccuggacccccuguuccucgggaaccaggccaccgccuccaccgcggccagcuccgccacgaccagcaaggccaaguacaccaccuga

SEQ ID NO: 36872 - RNA, 1620 nt, Artificial Sequence
  derived and/or modified sequence opt1 from SNTG2__Homo_sapiens__NP_061841
augggcaccgaggggcccccgccgcccgccgccagccgcggccggcaggggugccugcucgugcccgcgcgcaccaagacgaccaucgcccugcuguacgacgaggaguccgagaacgccuacgacauccggcucaagcugaccaaggagguccugaccauccagaagcaggacguggugugcgucggcgggagccaccagggccgcaaccggcgcacggugacccuccggcgccagcccgugggcgggcugggccuguccaucaagggcgggagcgagcacaacguccccguggugaucuccaagaucuucgaggaccaggccgccgaccagaccgggaugcuguucgucggcgacgcggugcuccaggugaacggcauccacgucgagaacgccacccacgaggagguggugcaccuccugcggaacgccggggacgaggucacgaucaccguggaguaccugcgcgaggcccccgcguuccugaagcucccccugggcagcccggggcccuccagcgaccacuccagcggcgccuccagcccccuguucgacuccggccuccaccugaacgggaacagcuccaccaccgcccccagcuccccgagcucccccaucgccaaggacccccgguacgagaagcgcuggcuggacacgcucagcgugccccugagcauggcccggaucucccgcuacaaggcgggcaccgagaagcugcgguggaacgccuucgagguccucgcccuggacggggugagcuccggcauccugcgcuucuacaccgcccaggacgggaccgacuggcuccgggccgugagcgcgaacauccgcgagcugacgcugcagaacaugaagauggccaacaagugcugcuccccgagcgaccaggucgugcacaugggcugggugaacgagaagcuccagggcgccgacuccagccagaccuuccggcccaaguuccuggcccugaaggggcccuccuucuacgucuucagcacgcccccgguguccaccuucgacuggguccgcgccgagcggaccuaccaccucugcgaggugcuguucaaggugcacaaguucuggcugaccgaggacugcuggcuccaggcgaaccuguaccugggccuccaggacuucgacuucgaggaccagcgccccuacugcuucagcaucgucgccgggcacggcaagucccacguguucaacguggagcuggggagcgagcuggccaugugggagaaguccuuccagcgcgccaccuucauggagguccagcggaccggcagccgcacguacaugugcuccuggcagggcgagaugcucugcuucaccguggacuucgcccugggguucacgugcuucgagagcaagaccaagaacgugcuguggcgguucaaguucucccagcucaagggcagcagcgacgacgggaagacccgcgucaagcugcuguuccagaaccucgacaccaagcagaucgagaccaaggagcuggaguuccaggaccugcgggcggugcugcacugcauccacuccuucaucgccgccaagguggccagcgucgaccccggcuucauggacucccagagccucgcgcgcaaguacauguacuccagcuga

SEQ ID NO: 36873 - RNA, 1083 nt, Artificial Sequence
  derived and/or modified sequence opt1 from SNUPN__Homo_sapiens__NP_005692
auggaggagcugagccaggcccucgccuccagcuucuccgugagccaggaccugaacuccaccgcggccccgcacccgcgccugagccaguacaaguccaaguacagcucccucgagcagagcgagcggcgccggcgccugcuggagcuccagaaguccaagcggcuggacuacgucaaccacgcccgccggcuggccgaggacgacuggaccggcauggagagcgaggaggagaacaagaaggacgacgaggagauggacaucgacacggugaagaagcuccccaagcacuacgccaaccagcugaugcuguccgaguggcucaucgacgugcccagcgaccuggggcaggaguggaucgucguggugugccccgucggcaagcgcgcgcugaucguggccucccgggggagcaccuccgccuacaccaagagcggcuacugcgugaaccgcuucuccagccuccugcccgggggcaaccggcgcaacagcaccgccaaggacuacacgauccuggacugcaucuacaacgaggucaaccagaccuacuacgugcucgacgugaugugcuggcggggccaccccuucuacgacugccagaccgacuuccgcuucuacuggaugcacuccaagcugcccgaggaggaggggcugggcgagaagaccaagcucaaccccuucaaguucgucgggcugaagaacuucccgugcacgcccgagagccugugcgacgugcucuccauggacuuccccuucgagguggacggccugcuguucuaccacaagcagacccacuacagccccggguccaccccgcucgucggcuggcugcggcccuacauggugagcgacgugcugggcgucgcggugcccgccgggccccucaccacgaagccggacuacgccggccaccagcugcagcagaucauggagcacaagaagucccagaaggaggggaugaaggagaagcugacccacaaggccagcgagaacggccacuacgagcucgagcaccuguccacccccaagcugaagggcagcucccacagccccgaccaccccgggugccucauggagaacuga

SEQ ID NO: 36874 - RNA, 216 nt, Artificial Sequence
  derived and/or modified sequence opt1 from SNURF__Homo_sapiens__NP_005669
auggagcgcgcccgggaccgccugcaccuccggcgcaccaccgagcagcacgugcccgagguggagguccaggugaagcggcgccggaccgccagccuguccaaccaggagugccagcuguacccgcgccggagccagcagcagcagguccccgugguggacuuccaggcggagcuccgccaggccuuccuggccgagacgccccggggcggguga

SEQ ID NO: 36875 - RNA, 1611 nt, Artificial Sequence
  derived and/or modified sequence opt1 from SNW1__Homo_sapiens__NP_036377
auggcccugaccagcuuccuccccgccccgacccagcugucccaggaccagcuggaggcggaggagaaggcccgcagccagcggucccgccagacgagccucguguccagccggcgcgagcccccgcccuacggcuaccggaagggguggaucccccgccugcuggaggacuucggcgacgggggcgccuuccccgagauccacgucgcccaguacccccucgacauggggcggaagaagaagauguccaacgcccuggcgauccagguggacagcgagggcaagaucaaguacgacgccaucgcccgccagggccaguccaaggacaaggugaucuacagcaaguacaccgaccugguccccaaggaggugaugaacgccgacgacccggaccuccagcggcccgacgaggaggcgaucaaggagaucaccgagaagacccgcguggcccuggagaaguccgucagccagaagguggccgccgccaugcccgugcgggcggccgacaagcuggcccccgcccaguacauccgcuacacgccgucccagcagggggucgccuucaacagcggcgcgaagcagcgggugauccgcaugguggagaugcagaaggaccccauggagccgccccgguucaagaucaacaagaagaucccccgcgggccgcccuccccgcccgcccccgucaugcacagccccucccggaagaugaccgugaaggagcagcaggaguggaagaucccgcccugcaucagcaacuggaagaacgccaagggcuacaccaucccccucgacaagcgccuggccgccgacgggcggggccugcagaccgugcacaucaacgagaacuucgcgaagcucgccgaggcccuguacaucgccgaccgcaaggcccgggaggcggucgagaugcgcgcccagguggagcgcaagauggcccagaaggagaaggagaagcacgaggagaagcugcgggagauggcccagaaggcgcgcgagcggcgcgccggcaucaagacgcacguggagaaggaggacggggaggcccgggagcgcgacgagauccggcacgaccgccggaaggagcgccagcacgaccggaaccucucccgcgccgcccccgacaagcggagcaagcugcagcgcaacgagaaccgggacaucagcgaggucaucgcgcugggcgugcccaacccccgcaccuccaacgaggugcaguacgaccagcgccucuucaaccagagcaaggggauggacuccggcuucgccggcggggaggacgagaucuacaacgucuacgaccaggccuggcggggcgggaaggacauggcccagagcaucuaccggcccuccaagaaccuggacaaggacauguacggcgacgaccuggaggcccgcaucaagaccaaccgcuucgugcccgacaaggaguucagcggguccgaccggcgccagcggggccgcgagggcccggugcaguucgaggaggaccccuucgggcucgacaaguuccuggaggaggcgaagcagcacggcgggagcaagcggcccuccgacagcucccgccccaaggagcacgagcacgagggcaagaagcggcgcaaggaguga

SEQ ID NO: 36876 - RNA, 606 nt, Artificial Sequence
  derived and/or modified sequence opt1 from SNX10__Homo_sapiens__NP_001186764
auguuccccgagcagcagaaggaggaguucgugagcgucugggugcgcgacccgcggauccagaaggaggacuucuggcacuccuacaucgacuacgagaucugcauccacaccaacagcaugugcuucaccaugaagacguccugcgugcgccggcgcuaccgggaguucgucuggcugcgccagcggcuccagagcaacgcccugcuggugcagcuccccgagcugcccuccaagaaccuguucuucaacaugaacaaccgccagcacguggaccagcggcgccagggccucgaggacuuccugcggaagguccugcagaacgcccuccugcugagcgacuccagccuccaccuguuccugcagucccaccucaacagcgaggacaucgaggcgugcguguccgggcagaccaaguacagcguggaggaggccauccacaaguucgcccugaugaaccgccgguuccccgaggaggacgaggagggcaagaaggagaacgacaucgacuacgacuccgagagcuccagcuccgggcugggccacagcuccgacgacagcagcucccacgggugcaaggucaacaccgccccgcaggagagcuga

SEQ ID NO: 36877 - RNA, 477 nt, Artificial Sequence
  derived and/or modified sequence opt1 from SNX12__Homo_sapiens__NP_001243117
augagcgacaccgccguggccgacacccgccggcugaacuccaagccccaggaccucacggacgcguacggcccgcccagcaacuuccuggagaucgacaucuucaacccccagaccgucggggugggccgcgcccgguucaccaccuacgagacgaaccugcccaucuucaagcucaaggaguccugcgugcgccggcgcuacagcgacuucgaguggcugaagaacgagcuggagcgggacuccaagaucgucgugccgccccuccccgggaaggcccugaagcgccagcugcccuuccggggcgacgaggggaucuucgaggagagcuucaucgaggagcgccggcagggccucgagcaguucaucaacaagaucgccggccacccgcuggcccagaacgagcgcugccugcacauguuccuccaggaggaggcgaucgaccggaacuacgugcccgggaagguccgccaguga

SEQ ID NO: 36878 - RNA, 2814 nt, Artificial Sequence
  derived and/or modified sequence opt1 from SNX14__Homo_sapiens__NP_001284543
auggugcccuggguccgcaccaugggccagaagcugaagcagcggcuccgccuggacguggggcgggagaucugccgccaguacccgcuguucugcuuccuccugcugugccucagcgccgccucccugcugcucaaccgguacauccacauccugaugaucuucuggagcuucguggcgggcgucgugaccuucuacugcucccuggggcccgacagccuccugcccaacaucuucuucacgaucaaguacaagcccaagcagcugggccuccaggagcuguucccgcaggggcacuccugcgccgugugcggcaaggucaagugcaagcgccaccggcccagccugcuccuggagaacuaccagcccuggcuggaccucaagaucuccagcaagguggacgccucccugagcgaggugcuggagcucguccuggagaacuucguguaccccugguaccgcgacgugaccgacgacgaguccuucgucgacgagcugcggaucacccuccgcuucuucgccagcgugcugauccggcgcauccacaagguggacaucccguccaucaucaccaagaagcugcucaaggccgcgaugaagcacaucgaggucaucgugaaggcccggcagaaggugaagaacacggaguuccugcagcaggccgcccuggaggaguacggccccgagcuccacgucgcgcugcgcagccggcgcgacgagcugcacuaccuccggaagcugaccgagcugcuguuccccuacauccugcccccgaaggccaccgacugccgcucccugacccuccugauccgggagauccugagcggguccguguuccuccccagccuggacuuccuggccgaccccgacacggugaaccaccuccugaucaucuucaucgacgacuccccgcccgagaaggccaccgagcccgccagcccccugguccccuuccugcagaaguucgcggagccgcgcaacaagaagcccagcgugcucaagcuggagcugaagcagauccgggagcagcaggaccuccuguuccgcuucaugaacuuccugaagcaggagggcgccgugcacguccuccaguucugccugaccguggaggaguucaacgaccgcauccugcggcccgagcucuccaacgacgagaugcugagccugcacgaggagcuccagaagaucuacaagaccuacugccuggacgaguccaucgacaagauccgcuucgaccccuucaucgucgaggagauccagcggaucgccgaggggccguacaucgacguggugaagcugcagacgaugcgcugccucuucgaggccuacgagcacguccugagccugcucgagaacguguucacccccauguucugccacuccgacgaguacuuccggcagcugcugcgcggcgccgagagccccacccggaacuccaagcucaaccgcaacacccagaagcgcggggagagcuucggcaucucccggaucggcagcaagaucaaggggguguucaaguccacgaccauggagggcgcgaugcugcccaacuacggggucgccgagggcgaggacgacuucaucgaggagggcaucguggugauggaggacgacagcccggucgaggccguguccacccccaacacgccccggaaccuggccgccuggaagaucagcaucccguacguggacuucuucgaggaccccuccagcgagcgcaaggagaagaaggagcggauccccgucuucugcaucgacguggagcgcaacgaccggcgcgcgguggggcacgagcccgagcacugguccgucuaccggcgcuaccucgaguucuacgugcuggagagcaagcugaccgaguuccacggcgccuucccggacgcccagcuccccuccaagcggaucaucgggcccaagaacuacgaguuccucaagagcaagcgcgaggaguuccaggaguaccugcagaagcuccugcagcaccccgagcugagcaacucccagcuccuggccgacuuccugagcccgaacggcggggagacccaguuccucgacaagauccugcccgacgugaaccugggcaagaucaucaaguccguccccggcaagcucaugaaggagaaggggcagcaccuggagcccuucaucaugaacuucaucaacagcugcgaguccccgaagcccaagcccagccgccccgagcugaccauccucuccccgaccagcgagaacaacaagaagcuguucaacgaccuguucaagaacaacgccaaccgggcggagaacacggagcgcaagcagaaccagaacuacuucauggaggugaugaccguggagggcgucuacgacuaccucauguacguggggcggguggucuuccaggugcccgacuggcugcaccaccuccugaugggcacccgcauccuguucaagaacacccuggagauguacacggacuacuaccuccagugcaagcuggagcagcuguuccaggagcaccggcucgugucccugaucacccugcuccgcgacgccaucuucugcgagaacaccgagccccggagccugcaggacaagcagaagggggccaagcagaccuucgaggagaugaugaacuacauccccgaccugcucgucaagugcaucggcgaggagacgaaguacgaguccauccgccugcuguucgacggccuccagcagccggugcugaacaagcagcugaccuacgugcuccuggacaucgucauccaggagcuguuccccgagcucaacaaggugcagaaggaggugaccagcgucaccuccuggauguga

SEQ ID NO: 36879 - RNA, 1035 nt, Artificial Sequence
  derived and/or modified sequence opt1 from SNX16__Homo_sapiens__NP_690049
auggccacccccuacgugccgguccccaugcccaucggcaacagcgccuccagcuucaccacgaaccgcaaccagcgguccagcuccuucgggagcguguccaccagcuccaacagcuccaagggccagcuggaggacagcaacauggggaacuucaagcagaccuccgugcccgaccagauggacaacaccagcuccgucugcagcuccccgcucauccgcacgaaguucaccggcaccgcgagcuccaucgaguacagcacccggccccgcgacacggaggagcagaaccccgagaccgugaacugggaggaccggcccagcaccccgaccauccugggguacgaggugauggaggagcgcgccaaguucacggucuacaagauccuggugaagaagacccccgaggaguccuggguggucuuccggcgcuacaccgacuucagccggcucaacgacaagcugaaggagauguuccccggcuuccgccuggcccugcccccgaagcggugguucaaggacaacuacaacgccgacuuccucgaggaccgccagcugggccuccaggccuuccugcagaaccugguggcgcacaaggacaucgccaacugccucgccgugcgggaguuccugugccuggacgacccgcccgggcccuucgacucccucgaggagagccgcgccuucugcgagacccuggaggagacgaacuaccggcugcagaaggagcuccuggagaagcagaaggagauggagucccugaagaagcuccugagcgagaagcagcugcacaucgacacccucgagaaccgcauccggacccugucccuggagcccgaggagagccucgacgucuccgagaccgagggcgagcagauccugaagguggagagcuccgcgcuggagguggaccaggacguccucgacgaggagagccgcgccgacaacaagcccugccuguccuucagcgagcccgagaacgccguguccgagaucgagguggccgaggucgccuacgacgcggaggaggacuga

SEQ ID NO: 36880 - RNA, 1875 nt, Artificial Sequence
  derived and/or modified sequence opt1 from SNX18__Homo_sapiens__NP_001096045
auggcccugcgcgcccgggcgcucuacgacuuccgcagcgagaaccccggcgagaucucccugcgggagcacgaggugcugagccucugcuccgagcaggacaucgagggguggcuggagggcgucaacagccgcggggaccggggccuguucccggccuccuacguccaggugauccgcgcccccgagcccgggcccgccggcgacggcgggccgggcgcccccgcgcgguacgccaacgugccgcccgggggcuucgagccccuccccguggccccgcccgccagcuucaagcccccgcccgacgcguuccaggcccugcugcagccccagcaggcgcccccgcccuccaccuuccagccgcccggggccggcuuccccuacggcgggggcgcccuccagcccagcccccagcagcuguacgggggcuaccaggccucccagggcagcgacgacgacugggacgacgagugggacgacuccagcaccguggccgacgagcccggggcccugggcuccggggccuaccccgaccucgacggcagcuccagcgccggggucggcgcggccggccgcuaccggcuguccacgcgcagcgaccugucccucgggagccggggcgggagcgugccgccccagcaccaccccuccggccccaagagcuccgccaccgugagccgcaaccugaaccgguucuccaccuucgucaagagcgggggcgaggccuucgugcugggcgaggccuccggguucgugaaggacggcgacaagcucugcgucgugcuggggcccuacggcccggaguggcaggagaaccccuaccccuuccagugcaccaucgacgaccccacgaagcagaccaaguucaaggggaugaaguccuacaucagcuacaagcuggugccgacccacacccagguccccgugcaccgccgguacaagcacuucgacuggcucuacgcgcgccuggccgagaaguuccccgugaucagcgucccccaccucccggagaagcaggccacgggccgguucgaggaggacuucaucuccaagcgccggaagggccucaucugguggaugaaccacauggccagccaccccgugcuggcccagugcgacguguuccagcacuuccugaccugccccuccagcaccgacgagaaggcguggaagcaggggaagcgcaaggccgagaaggacgagauggucggcgccaacuucuuccucacccuguccacgcccccggccgcggcccuggaccuccaggagguggagagcaagaucgacggguucaagugcuucaccaagaagauggacgacuccgcccugcagcugaaccacaccgccaacgaguucgcccggaagcaggucaccggcuucaagaaggaguaccagaaggugggccagagcuuccgcgggcucucccaggcguucgagcuggaccagcaggccuucagcgugggccugaaccaggccaucgccuucacgggggacgccuacgacgcgaucggcgagcuguucgccgagcagccccgccaggaccuggaccccgucauggaccugcucgcccuguaccaggggcaccuggccaacuuccccgacaucauccacgugcagaagggcgcccucaccaaggugaaggagagccggcgccacgucgaggagggcaagauggaggugcagaaggcggacgggauccaggaccggugcaacaccaucuccuucgccacccuggccgagauccaccacuuccaccagauccgcgugcgggacuucaagagccagaugcagcacuuccugcagcagcagaucaucuucuuccagaaggucacgcagaagcucgaggaggcccugcacaaguacgacuccguguga

SEQ ID NO: 36881 - RNA, 1119 nt, Artificial Sequence
  derived and/or modified sequence opt1 from SNX19__Homo_sapiens__NP_001288018
auggacagcgaccgcguggaggcccggaagucccugcucgagagcuuccugaagcagcugugcgccauccccgagaucgcgaacuccgaggagguccaggaguuccucgcccugaacaccgacgcccgcaucgccuucgugaagaagccguucauggugagccggaucgacaagauggucguguccgccaucguggacacccugaagacggcguucccccgcagcgagccccagucccccaccgaggagcucagcgaggccgagaccgaguccaagccgcagaccgagggcaagaaggccagcaagucccggcugcgcuucagcuccagcaagaucucccccgcccugagcgucacggaggcgcaggacaagauccucuacugccugcaggaggggaacguggaguccgagacccugagcauguccgccauggagagcuucaucgagaagcagaccaagcuccuggagaugcagcccaccaaggcccccgagaaggacccggagcagccgcccaagggccggguggacagcugcgucuccgacgccgccgugcccgcgcaggaccccagcaacuccgaccccgggacggagaccgagcuggccgacaccgcccucgaccugcugcuccugcugcucaccgagcaguggaaguggcugugcacggagaacaugcagaaguuccugcgccucaucuucggcacccuggugcagcgguggcuggagguccagguggccaaccucaccagcccccagcgcugggugcaguaccugcugcuccugcaggaguccaucuggcccgggggcguccugccgaaguucccccggcccgugcgcacccaggagcagaagcucgccgcggagaagcaggcccugcagagccugaugggcgugcuccccgaccuggucguggagauccugggggugaacaagugccggcucuccuggggccugguccuggagagccuccagcagccgcugaucaaccgccaccugaucuacugccucggggacaucauccuggaguuccuggaccucuccgccagcguggaggaguccgccgccacgaccagcgcguccgacacccccggcaacagcaagcggauggggguguccagcuga

SEQ ID NO: 36882 - RNA, 1569 nt, Artificial Sequence
  derived and/or modified sequence opt1 from SNX1__Homo_sapiens__NP_003090
auggccagcggcgggggcgggugcuccgccagcgagcgccugcccccgcccuuccccggccucgagcccgaguccgagggggcggccggcggcagcgagccggaggccggggacuccgacaccgagggcgaggacaucuucaccggggccgccguggucagcaagcaccagucccccaagaucacgaccagccugcugcccaucaacaacggcuccaaggagaacgggauccacgaggagcaggaccaggagccccaggaccucuucgcggacgccaccguggagcugagccuggacuccacccagaacaaccagaagaaggugcucgccaagacgcugaucagccugccgccccaggaggccaccaacuccagcaagccccagcccaccuacgaggagcucgaggaggaggagcaggaggaccaguucgaccugaccgucggcaucacggacccggagaagaucggcgacgggaugaacgcguacguggccuacaaggugaccacccagaccucccugccccucuuccggagcaagcaguucgccgucaagcgccgguucuccgacuuccugggccuguacgagaagcucagcgagaagcacucccagaacggguucaucgugcccccgccgcccgagaagucccugaucggcaugacgaaggugaaggucggcaaggaggacagcagcagcgccgaguuccuggagaagcgccgggccgcgcucgagcgcuaccugcagcggaucgugaaccaccccaccaugcugcaggaccccgacgugcgcgaguuccucgagaaggaggagcugccccgggccgucgggacccagacccuguccggcgccgggcuccugaagauguucaacaaggccacggacgccgugagcaagaugaccaucaagaugaacgaguccgacaucugguucgaggagaagcugcaggagguggagugcgaggagcagcgccuccggaagcugcacgcggucguggagacccuggugaaccaccgcaaggagcucgcccugaacaccgcccaguucgccaagagccuggccaugcucggcuccagcgaggacaacacggcgcugucccgggcccugagccagcucgccgaggucgaggagaagaucgagcagcugcaccaggagcaggccaacaacgacuucuuccugcucgccgagcugcuguccgacuacauccgccuccuggcgaucgugcgggccgccuucgaccagcgcaugaagaccuggcagcgguggcaggacgcccaggcgacccugcagaagaagcgcgaggccgaggcccggcuccugugggccaacaagcccgacaagcugcagcaggccaaggacgagauccucgagugggagagccgcgugacccaguacgagcgggacuucgagcgcaucuccacggucgugcgcaaggaggugauccgguucgagaaggagaaguccaaggacuucaagaaccacgucaucaaguaccuggagacccugcuguacagccagcagcagcucgcgaaguacugggaggccuuccugcccgaggccaaggccaucagcuga

SEQ ID NO: 36883 - RNA, 309 nt, Artificial Sequence
  derived and/or modified sequence opt1 from SNX20__Homo_sapiens__NP_001138444
auggccagccccgagcacccgggcucccccgggugcaugggccccaucacccagugcaccgcccgcacgcagcaggaggcgcccgccaccgggccggaccugccccaccccggccccgacgggcaccucgacacccacagcggccuguccagcaacuccagcaugaccacgcgggagcugcagcaguacuggcagaaccagaagugccgcuggaagcacgugaagcuccuguucgagaucgccuccgcccggaucgaggagcgcaaggucagcaaguucguggccccggcgcccgacgccacccccuga

SEQ ID NO: 36884 - RNA, 510 nt, Artificial Sequence
  derived and/or modified sequence opt1 from SNX24__Homo_sapiens__NP_054754
auggagguguacauccccagcuuccgcuacgaggaguccgaccuggagcggggcuacaccgucuucaagaucgaggugcugaugaacgggcgcaagcacuucguggagaagcgguacagcgaguuccacgcccugcacaagaagcugaagaagugcaucaagaccccggagauccccuccaagcacguccgcaacugggugcccaaggugcucgagcagcggcgccagggccuggagacguaccugcaggccgucauccucgagaacgaggagcugcccaagcuguuccucgacuuccugaacgugcggcaccucccgagccuccccaaggcggaguccugcgggagcuucgacgagaccgaguccgaggagagcuccaagcugagccaccagcccgugcugcuguuccugcgcgaccccuacguccugccggccgccuccgacuuccccaacguggugaucgagggcguccuccacgggaucuucuacccccaccuccagccccgguga

SEQ ID NO: 36885 - RNA, 3015 nt, Artificial Sequence
  derived and/or modified sequence opt1 from SNX25__Homo_sapiens__XP_005263324
augcaccccgacgccaccgacagcggcggggccggcccgucccccgcgcgcgccgccggggccggcgggcggcccgugagcggcuuccgcggcgagcggcgccccgaguccccgggggacgccgaggcggccgccgccgcggcccccggcgcccccgggggccggagcugguggaagcccgucgccguggccgcgcuggccgccguggcccucuccuuccuggggccgggcagcggcgaggccgcgggggccgccggccuguccagcguccucuuccgccugucccuguaccucagcugcgccgccgcggccuuccugcuggggauccucuucgcccuggugugccggagcccccgcgcccagccgcccgacuucgccgcggccuggagccggcuggccgccaccuccgcggcccgccggccgcccggcagccccguguacggcaacucccacgagagcgcccagucccgccgggucgugaucagccacaacauggacaaggcccucaaggagguguucgacuacuccuaccgcgacuacauccugagcugguacgggaaccugagccgggacgagggccagcucuaccaccuccugcuggaggacuucugggagaucgcccgccagcugcaccaccggcugucccacgucgacguggugaaggucgugugcaacgacgugguccgcacgcuccugacccacuucugcgaccugaaggcggccaacgcccggcacgaggagcagccccgccccuucgugcuccacgccugccugcggaacagcgacgacgaggugcgcuuccugcagaccugcucccgcguccucguguucugccugcugcccagcaaggacgugcagucccucagccugcggaucaugcuggccgagauccucaccacgaagguccugaagcccgugguggagcugcucuccaaccccgacuacaucaaccagaugcugcuggcgcagcucgccuaccgcgagcagaugaacgagcaccacaagcgggccuacaccuacgccccgagcuacgaggacuucaucaagcugaucaacuccaacagcgacgucgaguuccugaagcagcuccgcuaccagaucguggucgagaucauccaggccaccaccaucuccagcuucccccagcugaagcggcacaaggggaaggagacggcggccaugaaggccgaccugcuccgcgcccggaacaugaagcgcuacaucaaccagcugaccguggcgaagaagcagugcgagaagcggauccgcauccugggcgggcccgccuacgaccagcaggaggacggcgcccucgacgagggcgaggggccccagucccagaagauccugcaguucgaggacauccuggccaacaccuucuaccgggagcacuucggcauguacauggagcgcauggacaagcgggcccugaucagcuucugggaguccguggagcaccucaagaacgcgaacaagaacgagaucccgcagcuggucggggagaucuaccagaacuucuucguggagagcaaggagaucuccguggagaagucccuguacaaggagauccagcagugccucgucggcaacaaggggaucgagguguucuacaagauccaggaggacguguacgagacccugaaggaccgcuacuaccccuccuucaucgucagcgaccuguacgagaagcuccugaucaaggaggaggagaagcacgccagccagaugaucuccaacaaggacgagaugggcccccgggacgaggccggcgaggaggccguggacgacgggacgaaccagaucaacgagcaggccagcuucgcggugaacaagcugcgcgagcucaacgagaagcuggaguacaagcggcaggcccugaacuccauccagaacgcccccaagccggacaagaagaucgucagcaagcucaaggacgagaucauccugaucgagaaggagcgcaccgaccugcagcuccacauggcccggaccgacugguggugcgagaaccugggcauguggaaggccuccaucaccagcggggaggugacggaggagaacggcgagcagcugcccugcuacuucgugauggucucccuccaggaggucgggggcguggagaccaagaacuggaccgugccccgccgccugagcgaguuccagaaccugcaccggaagcucuccgagugcgugccgagccugaagaaggugcagcugcccucccucagcaagcugcccuucaaguccaucgaccagaaguucauggagaaguccaagaaccagcugaacaaguuccuccagaaccugcugagcgacgagcgccucugccagagcgaggcgcuguacgccuuccugucccccagcccggacuaccucaaggucaucgacgugcagggcaagaagaacagcuucucccugagcuccuuccuggagcggcucccccgcgacuucuucagccaccaggaggaggagaccgaggaggacuccgaccugagcgacuacggggacgacguggacggccggaaggacgcccuggccgagcccugcuucaugcucaucggggagaucuucgagcugcgcggcauguucaaguggguccggcgcacgcugaucgcgcucguccaggugaccuucggccggaccaucaacaagcagauccgcgacaccguguccuggaucuucagcgagcagaugcugguguacuacaucaacaucuuccgggacgccuucuggcccaacgggaagcuggccccgcccacgaccauccgcuccaaggagcagagccaggagaccaagcagcgggcccagcagaagcuccuggagaacauccccgacaugcugcagucccucgugggccagcagaacgcccgccacgggaucaucaagaucuucaacgcgcugcaggagacccgggccaacaagcaccuccuguacgcccugauggagcugcuccugaucgagcugugccccgagcuccgcguccaccuggaccagcugaaggccggccagguguga

SEQ ID NO: 36886 - RNA, 2442 nt, Artificial Sequence
  derived and/or modified sequence opt1 from SNX29__Homo_sapiens__NP_115543
augagcggcucccagaacaacgacaagcgccaguuccugcucgagcggcugcuggacgccgugaagcagugccagauccgcuucgggggccggaaggagaucgccagcgacuccgacagccgcgugaccugccucugcgcgcaguucgaggccguccugcagcacgggcugaagcggucccgcggccucgcccugaccgccgccgcgaucaagcaggccgccggguucgccagcaagacggagaccgagcccguguucugguacuacgucaaggaggugcugaacaagcacgagcuccagcgguucuacucccugcgccacaucgcgagcgacgugggccggggccgcgccuggcugcggugcgcccucaacgagcacucccuggagcgcuaccugcacaugcuccuggccgaccggugccgccugagcaccuucuacgaggacugguccuucgucauggacgaggagcggagcuccaugcucccgaccauggccgcggggcugaacagcauccuguucgccaucaacaucgacaacaaggaccucaacggccaguccaaguucgcccccacggugagcgaccugcugaaggaguccacccagaacgugaccagccuccugaaggaguccacccagggggucagcagccuguuccgcgagaucacggccuccagcgccguguccauccucaucaagcccgagcaggagaccgacccccugccgguggucagccggaacguguccgcggacgccaagugcaagaaggagcgcaagaagaagaagaaggugaccaacaucaucagcuucgacgacgaggaggacgagcagaacuccggcgacgucuucaagaagacccccggggccggcgagagcuccgaggacaacagcgaccgguccagcgugaacaucauguccgccuucgagagccccuucggccccaacuccaacgggagccaguccagcaacuccuggaagaucgacagccugagccucaacggcgaguucggguaccagaagcuggacgugaaguccaucgacgacgaggacgucgacgagaacgaggacgacguguacggcaacagcuccggccgcaagcaccgggggcacagcgaguccccggagaagccccuggagggcaacacgugccucagccagaugcacuccugggcgccccugaaggugcugcacaacgacagcgacauccucuuccccgucuccggggugggcagcuacuccccggccgacgcgccccuggggagccuggagaacggcaccggccccgaggaccacgugcuccccgacccggggcugcgcuacuccgucgaggccagcucccccggccacgggagcccccuguccagccuccugcccagcgccuccgugccggagagcaugaccaucuccgagcugcgccaggccaccgucgccaugaugaaccggaaggacgagcucgaggaggagaaccgcagccugcggaaccugcucgacggcgagauggagcacuccgccgcccugcgccaggagguggacacgcugaagcggaagguggccgagcaggaggagcgccaggggaugaagguccaggcgcuggcccgggagaacgaggugcucaaggugcagcugaagaaguacgucggcgccgugcagaugcugaagcgcgagggccagaccgccgaggugcccaaccucuggagcgucgacggggaggugaccguggccgagcagaagcccggcgagaucgcggaggagcuggccuccagcuacgagcggaagcugaucgaggucgccgagaugcacggggagcucaucgaguucaacgagcgccugcaccgggcccugguggccaaggaggcgcucgugucccagaugcgccaggagcugaucgaccugcggggccccgucccgggggaccucagccagaccuccgaggaccagagccuguccgacuucgagaucagcaaccgcgcccugaucaacguguggauccccuccguguuccuccggggcaaggccgccaacgccuuccacgucuaccagguguacauccgcaucaaggacgacgaguggaacaucuaccggcgcuacacggaguuccggagccugcaccacaagcugcagaacaaguacccccaggugcgcgcguacaacuucccgcccaagaaggccaucggcaacaaggacgccaaguucgucgaggagcgccggaagcagcuccagaacuaccugcgcuccgugaugaacaaggugauccagaugguccccgaguucgccgcgagccccaagaaggagacccugauccagcucaugccguucuucguggacaucaccccgcccggggagcccgugaacucccggcccaaggccgccagccgcuuccccaagcugagccggggccagccccgcgagacccggaacgucgagccccaguccggggaccuguga

SEQ ID NO: 36887 - RNA, 1560 nt, Artificial Sequence
  derived and/or modified sequence opt1 from SNX2__Homo_sapiens__NP_003091
auggccgccgagcgcgagcccccgccccugggcgacgggaagcccaccgacuucgaggaccucgaggacggcgaggaccuguucaccagcacgguguccacccuggagagcucccccagcuccccggagcccgcgagccuccccgccgaggacaucuccgccaacagcaacgggcccaagccgaccgaggucgugcuggacgacgaccgggaggaccuguucgccgaggccaccgaggaggugucccucgacagccccgagcgcgagcccauccuguccagcgagcccuccccggcggucacgcccgugacccccaccacccugaucgcgccccggaucgagagcaaguccaugagcgccccggugaucuucgaccgcucccgggaggagaucgaggaggaggccaacggcgacaucuucgacaucgagaucggggucagcgaccccgagaaggugggcgacggcaugaacgccuacauggccuaccgcgugacgaccaagaccucccucagcauguucagcaaguccgaguucagcgucaagcggcgcuucuccgacuuccuggggcugcacagcaagcucgccuccaaguaccugcacgugggcuacaucgugccgcccgcccccgagaaguccaucgucgggaugaccaaggugaaggugggcaaggaggacagcagcuccacggaguucgucgagaagcggcgcgccgcgcuggagcgguaccuccagcgcaccgugaagcaccccacccugcugcaggaccccgaccuccggcaguuccuggagagcuccgagcugccccgcgccgugaacacccaggcccucagcggggccggcauccugcggauggucaacaaggccgcggacgccgugaacaagaugacgaucaagaugaacgaguccgacgccugguucgaggagaagcagcagcaguucgagaaccuggaccagcagcuccgcaagcugcacgugagcgucgaggcccuggugugccaccggaaggagcucuccgccaacaccgcggccuucgccaagagcgccgccaugcugggcaacuccgaggaccacaccgcgcugagccgcgcccucucccagcuggccgagguggaggagaagaucgaccagcugcaccaggagcaggccuucgcggacuucuacauguucagcgagcuccugagcgacuacauccggcugaucgccgccgucaaggggguguucgaccaccgcaugaagugcuggcagaagugggaggacgcccagaucacccuccugaagaagcgggaggccgaggcgaagaugauggucgccaacaagccggacaagauccagcaggccaagaacgagauccgcgagugggaggccaaggugcagcagggcgagcgcgacuucgagcagaucuccaagacgauccggaaggagguggggcgcuucgagaaggagcgggucaaggacuucaagaccgugaucaucaaguaccuggagagccucgugcagacccagcagcagcugaucaaguacugggaggccuuccugcccgaggcgaaggccaucgccuga

SEQ ID NO: 36888 - RNA, 1314 nt, Artificial Sequence
  derived and/or modified sequence opt1 from SNX30__Homo_sapiens__NP_001013012
auggccggcgggcccccgaaggcccugcccagcaccggcccccacucccuccgcgacaugccccacccgcuggcggggagcuccagcgaggaggccgugggcggggacuccacccccagccccgaccugcucauggcccgguccuucggcgacaaggaccugauccugcccaacggcgggacgccggccggcaccagcucccccgccagcuccagcucccuccugaaccgccugcagcucgacgacgacaucgacggggagacccgggaccuguucgucaucguggacgaccccaagaagcacgugugcaccauggagacguacaucaccuaccgcaucaccaccaagagcacgcgggucgaguucgaccugcccgaguacuccgugcgccggcgcuaccaggacuucgacuggcuccggagcaagcuggaggagucccagccgacccaccugaucccgccccuccccgagaaguucguggucaagggcgugguggaccgcuucagcgaggaguucgucgagacccggcgcaaggcgcuggacaaguuccugaagcggaucaccgaccaccccgugcucuccuucaacgagcacuucaacaucuuccugacggccaaggaccugaacgccuacaagaagcaggggaucgcccuccugacccgcaugggcgagagcgugaagcacgucaccggcggguacaagcugcggacccgcccccucgaguucgcggccaucggcgacuaccuggacacguucgcccugaagcucgggaccaucgaccggaucgcccagcgcaucaucaaggaggagaucgaguaccugguggagcugcgggaguacggccccguguacagcaccugguccgcccucgagggcgagcuggcggagccccuggagggggucagcgccugcaucggcaacugcuccaccgcccucgaggagcugacggacgacaugaccgaggacuuccugccggugcuccgcgaguacauccuguacagcgacuccaugaaguccgugcugaagaagcgggaccagguccaggccgaguacgaggccaagcucgaggcgguggcccugcgcaaggaggaccgccccaaggugcccgccgacgucgagaagugccaggaccggauggagugcuucaacgccgaccugaaggccgacauggagcgcuggcagaacaacaagcggcaggacuuccgccagcuccugauggggauggcggacaagaacauccaguacuacgagaagugccugauggccugggagagcaucaucccccuccugcaggagaagcaggaggccaaguga

SEQ ID NO: 36889 - RNA, 318 nt, Artificial Sequence
  derived and/or modified sequence opt1 from SNX3__Homo_sapiens__NP_001287857
auggccgagaccguggccgacacccgccggcugaucacgaagccccagaaccucaacgacgcguacggcccgcccagcaacuuccuggagaucgacgucuccaacccccagaccgugggggugggccgcgggcgguucaccaccuacgagauccgcgucaagacgaaccugcccaucuucaagcucaaggagagcaccgugcggcgccgguacuccgacuucgaguggcugcgcagcgagcuggagcgggaguccaagggccgcuggagcuccagcgggaccgagcggacccucuccagccacguguucacgcgcuga

SEQ ID NO: 36890 - RNA, 1215 nt, Artificial Sequence
  derived and/or modified sequence opt1 from SNX5__Homo_sapiens__NP_689413
auggccgccgugcccgagcugcuccagcagcaggaggaggaccgcagcaagcugcgguccgucagcguggaccugaacguggacccgucccuccagaucgacauccccgacgcgcugagcgagcgcgacaaggucaaguucaccgugcacaccaagacgacccugcccaccuuccagucccccgaguucagcgugacccggcagcacgaggacuucgucuggcuccacgacacgcugaucgagaccaccgacuacgccggccugaucaucccgcccgcccccaccaagcccgacuucgacgggccgcgcgagaagaugcagaagcucggcgagggggagggcuccaugacgaaggaggaguucgccaagaugaagcaggagcuggaggccgaguaccuggcgguguucaagaagaccgugagcucccacgaggucuuccuccagcggcugagcucccaccccgugcugagcaaggaccgcaacuuccacguguuccucgaguacgaccaggaccuguccguccggcgcaagaacaccaaggagauguucgggggcuucuucaagagcguggugaaguccgccgacgagguccuguucaccggcgugaaggagguggacgacuucuucgagcaggagaagaacuuccucaucaacuacuacaaccggaucaaggacagcugcgucaaggccgacaagaugacgcgcucccacaagaacguggccgacgacuacauccacaccgcggccugccugcacagccuggcccucgaggagcccaccgugaucaagaaguaccugcugaaggucgccgagcuguucgagaagcuccggaagguggaggggcgcguguccagcgacgaggaccugaagcucaccgagcugcugcgguacuacaugcucaacaucgaggccgcgaaggaccugcuguaccgccggacgaaggcccucaucgacuacgagaacagcaacaaggcccuggacaaggcccgccugaaguccaaggacgucaagcucgccgaggcgcaccagcaggagugcugccagaaguucgagcagcugagcgaguccgccaaggaggagcugaucaacuucaagcggaagcgcguggccgccuuccggaagaaccucaucgagaugagcgagcuggagaucaagcacgcccgcaacaacgucucccugcuccagagcugcaucgaccuguucaagaacaacuga

SEQ ID NO: 36891 - RNA, 1788 nt, Artificial Sequence
  derived and/or modified sequence opt1 from SNX9__Homo_sapiens__NP_057308
auggccaccaaggcccgcgugauguacgacuucgcggccgagcccggcaacaacgagcugaccgugaacgagggggagaucaucacgaucaccaacccggacgugggcgggggcuggcucgaggggcggaacaucaagggcgagcgcggccuggugcccaccgacuacgucgagauccugcccagcgacgggaaggaccaguucuccugcggcaacagcguggccgaccaggccuuccucgacucccugagcgccuccaccgcgcaggccagcuccagcgccgccuccaacaaccaccagguggggagcggcaacgaccccugguccgcguggagcgccuccaagagcgggaacugggaguccagcgagggcuggggcgcccagccggagggggccggcgcccagcggaacacgaacacccccaacaacugggacaccgcguucgggcacccccaggccuaccagggccccgccaccggcgacgacgacgacugggacgaggacugggacgggccgaaguccagcuccuacuucaaggacagcgagagcgccgacgccggcggggcgcagcgcggcaacucccgggccagcuccagcuccaugaagaucccccugaacaaguuccccggguucgccaagcccggcacggagcaguaccuccuggccaagcagcuggccaagccgaaggagaagauccccaucaucgucggcgacuacgggcccauguggguguaccccaccagcaccuucgacugcguggucgcggacccgcgcaagggcuccaagauguacgggcucaagagcuacaucgaguaccagcugacccccacgaacaccaaccgguccgugaaccaccgcuacaagcacuucgacuggcuguacgagcggcuccuggugaaguucggcagcgccauccccauccccucccugccggacaagcaggucaccgggcgcuucgaggaggaguucaucaagaugcggauggagcgccuccaggccuggaugacccggaugugccgccaccccgugaucagcgaguccgagguguuccagcaguuccugaacuuccgggacgagaaggaguggaagacgggcaagcgcaaggccgagcgggacgagcuggccggcgucaugaucuucagcaccauggagcccgaggcgcccgaccucgaccugguggagaucgagcagaagugcgaggccguggggaaguucaccaaggccauggacgacggcgucaaggagcugcucaccguggggcaggagcacuggaagcgcugcacgggcccgcugcccaaggaguaccagaagaucgggaaggcccugcagucccucgcgaccguguucagcuccagcggcuaccagggcgagaccgaccugaacgacgccaucaccgaggccgggaagacguacgaggagaucgccucccuggucgccgagcagcccaagaaggaccuccacuuccugauggagugcaaccacgaguacaagggcuuccuggggugcuuccccgacaucaucggcacccacaagggcgcgaucgagaaggugaaggagagcgacaagcucguggccaccagcaagaucacccugcaggacaagcagaacauggucaagcggguguccaucaugagcuacgcccugcaggccgagaugaaccacuuccacuccaaccgcaucuacgacuacaacagcgucauccggcucuaccuggagcagcagguccaguucuacgagacgaucgccgagaagcugcgccaggcgcucucccgcuucccggugauguga

SEQ ID NO: 36892 - RNA, 1479 nt, Artificial Sequence
  derived and/or modified sequence opt1 from SOAT1__Homo_sapiens__NP_001239440
auggagcugaagcccuucuucaugaaggaggugggcagccacuucgacgacuucgucaccaaccucaucgagaaguccgccagccuggacaacgggggcugcgcccugaccacguucuccgugcucgagggggagaagaacaaccaccgcgcgaaggaccugcgggccccgcccgagcagggcaagaucuucaucgcccgccggagccugcucgacgagcugcuggagguggaccacauccgcaccaucuaccacauguucaucgcccuccugauccuguucauccucuccacccuggucguggacuacaucgacgaggggcggcuggugcucgaguucagccugcuguccuacgccuucggcaaguuccccaccgucguguggacgugguggaucauguuccucagcaccuucuccgugcccuacuuccuguuccagcacugggcgaccggcuacagcaaguccagccacccgcugauccgcucccucuuccacggguuccuguucaugaucuuccagaucggcguccugggguucggccccaccuacguggugcucgccuacacgcugccgcccgccagccgguucaucaucaucuucgagcagauccgcuucgucaugaaggcccacuccuucgugcgggagaacgugccccgcguccugaacagcgcgaaggagaaguccagcaccgugcccauccccaccgugaaccaguaccucuacuuccuguucgcccccacccugaucuaccgggacuccuacccgcgcaaccccacgguccgguggggguacguggccaugaaguucgcccagguguucggcugcuucuucuacgucuacuacaucuucgagcgccucugcgcgccccuguuccggaacaucaagcaggagcccuucagcgcccgcgugcuggugcucugcgucuucaacagcauccugccgggcgugcugauccucuuccugaccuucuucgccuuccugcacugcuggcucaacgccuucgccgagaugcugcgguucggggaccgcauguucuacaaggacugguggaacuccaccagcuacuccaacuacuaccggaccuggaacgucguggugcacgacuggcuguacuacuacgccuacaaggacuuccucugguucuucagcaagcgcuucaaguccgcggccaugcuggccgucuucgccgugagcgccgugguccacgaguacgcgcuggccgugugccucuccuucuucuaccccgugcuguucguccuguucauguucuucggcauggccuucaacuucaucgugaacgacagccggaagaagcccaucuggaacgugcucauguggacgucccuguuccuggggaacggcguccugcucugcuucuacagccaggagugguacgcccgccagcacugcccccugaagaacccgaccuuccuggacuacgugcgcccccgguccuggaccugccgcuacguguucuga

SEQ ID NO: 36893 - RNA, 1569 nt, Artificial Sequence
  derived and/or modified sequence opt1 from SOAT2__Homo_sapiens__NP_003569
auggagcccggcggggcccgccugcggcuccagcgcaccgagggccucgggggcgagcgggagcgccagccgugcggggacggcaacaccgagacgcaccgggcccccgaccuggugcaguggacccgccacauggaggcggucaaggcccagcugcuggagcaggcccagggccagcugcgggagcuccuggaccgcgccaugcgggaggccauccagagcuaccccucccaggacaagccccugccgcccccgccgcccgggagccucucccgcacccaggagcccagccugggcaagcagaagguguucaucauccggaagucccugcucgacgagcugauggaggugcagcacuuccgcaccaucuaccacauguucaucgcggggcugugcgucuucaucaucagcacgcucgccaucgacuucaucgacgagggccggcugcugcucgaguucgaccugcugaucuucuccuucgggcagcucccccuggcccuggugaccugggugcccauguuccucagcacccugcuggcccccuaccaggcgcuccgccugugggcccggggcaccuggacgcaggccaccggccuggggugcgcccuccuggccgcgcacgccgucgugcugugcgcccuccccgugcacgucgccguggagcaccagcugccgcccgccucccgcugcgugcuggucuucgagcagguccgguuccucaugaaguccuacagcuuccugcgcgaggcggugcccggcacccugcgggcccgccgcggggagggcauccaggcccccagcuucuccagcuaccucuacuuccuguucugccccacccugaucuaccgggagacguacccccgcaccccguacgugcgguggaacuacguggccaagaacuucgcccaggcgcucggcugcgugcuguacgccugcuucauccuggggcgccucugcguccccguguucgccaacaugucccgggagcccuucagcacccgcgcccuggugcuguccauccuccacgccacccugcccggcaucuucaugcugcugcucaucuucuucgcguuccugcacugcuggcugaacgccuucgccgagaugcuccgguucggggaccgcauguucuaccgggacugguggaacagcacguccuucagcaacuacuaccgcaccuggaacgucguggugcacgacuggcuguacagcuacgucuaccaggacggccugcggcuccugggggcccgcgcgcggggcguggccaugcugggcgucuuccucguguccgccguggcccacgaguacaucuucugcuucguccugggguucuucuacccggugaugcugauccucuuccuggugaucggcgggaugcugaacuucaugaugcacgaccagcgcaccggccccgccuggaacguccucauguggaccaugcuguuccuggggcagggcauccaggugagccucuacugccaggagugguacgcgcggcgccacugcccccugccccaggccacguucuggggccuggugaccccgcgguccuggagcugccacaccuga

SEQ ID NO: 36894 - RNA, 2622 nt, Artificial Sequence
  derived and/or modified sequence opt1 from SOBP__Homo_sapiens__NP_060483
auggccgagauggagaaggagggccgccccccggagaacaagcggagccgcaagcccgcccaccccgugaagcgggagaucaacgaggagaugaagaacuucgcggagaacaccaugaacgagcugcucgggugguacggcuacgacaaggucgagcugaaggacggggaggacaucgaguuccgcuccuaccccaccgacggcgagagccggcagcacaucuccgugcugaaggagaacagccucccgaagcccaagcugcccgaggacuccgugaucagccccuacaacaucuccacgggguacagcggccuggccaccggcaacgggcucuccgacagcccggccggcuccaaggaccacgggagcguccccaucaucgugccccugauccccccgcccuucaucaagccccccgccgaggacgacguguccaacguccagaucaugugcgccuggugccagaaggugggcaucaagcgcuacagccuguccauggggagcgaggugaaguccuucugcagcgagaagugcuucgcggccugccggcgcgccuacuucaagcggaacaaggcccgcgacgaggacggccacgcggagaacuucccgcagcagcacuacgccaaggagaccccccggcucgccuucaagaacaacugcgagcugcuggucugcgacuggugcaagcacauccgccacaccaaggaguaccucgacuucggcgacggggagcggcgccugcaguucugcuccgccaagugccugaaccaguacaagauggacaucuucuacaaggagacgcaggccaaccuccccgcgggccugugcagcacccugcaccccccgauggagaacaaggccgaggggaccggcgugcagcuccugacccccgacagcuggaacaucccccugacggacgcccggcgcaaggcccccuccccgguggccaccgcgggccagagccaggggcccggccccuccgccagcaccaccgucucccccagcgacacggccaacugcuccgugaccaagaucccgacccccgugcccaagagcaucccgaucuccgagacccccaacaucccccccgucagcgugcagccgcccgccuccaucgggcccccccucggcgugccgccccggagcccccccauggucaugacgaaccgcgggccggugccccugcccaucuucauggagcagcagaucaugcagcagauccggcccccguucauccgcggccccccccaccacgccuccaaccccaacagcccgcuguccaaccccaugcuccccggcaucgggcccccgcccggcgggccccggaaccugggcccgaccagcucccccaugcaccgccccaugcugagcccccacauccacccgcccuccacccccaccaugcccgggaacccgcccggccuccugccccccccgccccccggcgcgccccugccgagccuccccuucccccccgugagcaugaugccgaacgggcccaugcccgucccccagaugaugaacuucggccugccgucccuggccccccucgugccccccccgacgcugcuggugcccuaccccgucaucgugccgcuccccguccccauccccaucccgauccccaucccccacgugagcgacuccaagcccccgaacggguucagcuccaacggcgagaacuucauccccaacgcccccggggacagcgccgccgcgggcggcaagcccuccgggcacagccuguccccgcgcgacagcaagcagggcuccagcaaguccgccgacagcccccccgggugcuccggccaggcccugagccucgcccccaccccggcggagcacggccgguccgagguggucgaccugacccgccgggccgggagcccccccggccccccgggggccggcgggcagcugggcuuccccggcgugcuccaggggccccaggacggcgugaucgaccugaccgucgggcaccgcgcccggcugcacaacgugauccaccgcgcccuccacgcgcacgugaaggccgagcgggagcccagcgccgccgagcgccggacgugcggcgggugccgcgacggccacugcuccccgcccgccgcgggcgaccccgggcccggcgccccggccgggcccgaggccgccgcggccugcaacgucaucgugaacggcacccggggggccgccgcggagggcgccaagagcgccgagcccccgcccgagcagccccccccgcccccccccccggccccccccaagaagcugcugucccccgaggagccggccgugagcgagcucgaguccgucaaggagaacaacugcgcgagcaacugccaccuggacggcgaggccgccaagaagcugaugggggaggaggcccuggccggcggggacaaguccgaccccaaccucaacaaccccgcggacgaggaccacgccuacgcccugcgcaugcugcccaagaccggcugcgugauccagccggugcccaagcccgccgagaaggccgcgauggcccccugcaucaucagcuccccgaugcucagcgccgggcccgaggaccuggagcccccccugaagcggcgcugccuccggauccgcaaccagaacaaguga

SEQ ID NO: 36895 - RNA, 636 nt, Artificial Sequence
  derived and/or modified sequence opt1 from SOCS1__Homo_sapiens__NP_003736
augguggcccacaaccaggucgccgccgacaacgccgugagcaccgccgccgagccccgccggcgcccggagcccuccagcuccagcuccagcucccccgccgcccccgcccggccgcgccccugccccgccgugcccgccccggcgcccggcgacacccacuuccggacguuccgcagccacgccgacuaccggcgcaucacccgggccuccgcccugcucgacgccugcggguucuacuggggcccccugagcguccacggggcgcacgagcgccugcgggccgagcccgugggcaccuuccucgugcgcgacucccggcagcgcaacugcuucuucgcccugagcgucaagauggccuccgggccgaccagcauccgggugcacuuccaggccggccgcuuccaccuggacggcucccgggagagcuucgacugccucuucgagcugcuggagcacuacguggcggcgccccgccggaugcucggggcgccccugcgccagcggcgcguccgcccccugcaggagcucugccggcagcgcaucguggccacggugggccgggagaaccuggcccgcaucccgcugaaccccguccuccgggacuaccuguccagcuuccccuuccagaucuga

SEQ ID NO: 36896 - RNA, 597 nt, Artificial Sequence
  derived and/or modified sequence opt1 from SOCS2__Homo_sapiens__NP_001257400
augacccugcgcugccucgagcccagcggcaacgggggcgaggggacccggucccaguggggcacggccgggagcgccgaggagccgagcccccaggcggcccgccuggccaaggcccugcgggagcucggccagaccggcugguacuggggguccaugaccgugaacgaggccaaggagaagcugaaggaggcgcccgagggcaccuuccugauccgcgacuccagccacuccgacuaccuccugacgaucagcgucaagaccuccgccgggcccaccaaccugcggaucgaguaccaggacggcaaguuccgccucgacagcaucaucugcgugaaguccaagcugaagcaguucgacagcgugguccaccugaucgacuacuacgugcagaugugcaaggacaagcggaccgggccggaggcgccccgcaacggcacggugcaccucuaccugaccaagccccuguacaccuccgcccccagccuccagcaccugugccggcugaccaucaacaagugcacgggcgccaucugggggcucccgcugcccacccgccugaaggacuaccucgaggaguacaaguuccaggucuga

SEQ ID NO: 36897 - RNA, 678 nt, Artificial Sequence
  derived and/or modified sequence opt1 from SOCS3__Homo_sapiens__NP_003946
auggugacccacagcaaguuccccgccgccggcaugucccgcccgcuggacaccagccuccggcugaagacguucuccagcaaguccgaguaccagcuggucgugaacgcggugcgcaagcuccaggagagcggguucuacugguccgccgucaccggcggggaggccaaccugcugcucagcgccgagcccgccggcaccuuccugauccgggacuccagcgaccagcgccacuucuucacccuguccgugaagacgcagagcgggaccaagaaccuccggauccagugcgagggcggcuccuucagccugcaguccgacccccgcagcacccagcccgugccgcgguucgacugcguccugaagcucgugcaccacuacaugcccccgcccggggcgcccuccuuccccagcccgcccaccgagcccuccagcgaggugcccgagcagcccagcgcccagccccugccgggcuccccgccccgccgggccuacuacaucuacagcgggggcgagaagaucccccugguccucucccgcccccugagcuccaacguggccacgcugcagcaccucugccggaagaccgugaacgggcaccuggacagcuacgagaaggucacccagcugcccggccccauccgcgaguuccucgaccaguacgacgcgccccuguga

SEQ ID NO: 36898 - RNA, 1323 nt, Artificial Sequence
  derived and/or modified sequence opt1 from SOCS4__Homo_sapiens__NP_543143
auggccgagaacaacgagaacaucagcaagaacguggacguccgccccaagaccucccggagccgcuccgccgaccggaaggacggcuacguguggagcgggaagaagcuguccuggagcaagaaguccgagagcuacuccgacgcggagaccgugaacggcaucgagaagacggaggucagccuccgcaaccaggagcggaagcacuccugcagcuccaucgagcuggaccuggaccacagcugcgggcaccgcuuccucggccggucccugaagcagaagcugcaggacgccguggggcagugcuucccgaucaagaacugcagcucccgccacagcuccggccuccccagcaagcggaagauccacaucagcgagcugaugcuggacaagugccccuucccgccccgcuccgaccucgccuuccgguggcacuucaucaagcgccacaccgcccccaucaacagcaaguccgacgagugggugagcaccgaccugucccagaccgagcugcgggacggccagcucaagcgccggaacauggaggagaacaucaacugcuucagccacacgaacguccagcccugcgugaucaccaccgacaacgcccugugccgcgaggggcccaugaccggcuccgugaugaaccuggucagcaacaacuccaucgaggacagcgacauggacuccgacgacgagauccucacgcugugcaccagcucccggaagcgcaacaagccgaagugggaccuggacgacgagauccuccagcuggagaccccgcccaaguaccacacccagaucgacuacgugcacugccuggugcccgaccuccugcagaucaacaacaaccccugcuacuggggcgucauggacaaguacgcggccgaggcccugcucgaggggaagcccgaggggacguuccugcugcgggacagcgcccaggaggacuaccucuucuccgugagcuuccgccgguacucccgcagccugcacgcgcgcaucgagcaguggaaccacaacuucuccuucgacgcccacgaccccugcguguuccacagccccgacaucaccggccugcucgagcacuacaaggacccgagcgccugcauguucuucgagccccugcuguccacgccccucauccggaccuuccccuucagccugcagcacaucugccgcaccgucaucugcaacugcaccaccuacgacggcaucgacgcccugccgauccccuccagcaugaagcucuaccugaaggaguaccacuacaaguccaaggugcgggugcugcgcaucgacgcccccgagcagcagugcuga

SEQ ID NO: 36899 - RNA, 1611 nt, Artificial Sequence
  derived and/or modified sequence opt1 from SOCS5__Homo_sapiens__NP_659198
auggacaaggugggcaagauguggaacaacuucaaguaccgcugccagaaccuguucgggcacgagggcgggagccgguccgagaacgucgacaugaacagcaaccgcugccucuccgugaaggagaagaacaucagcaucggcgacuccacgccccagcagcagagcuccccgcugcgggagaacaucgcccugcagcucgggcugagccccuccaagaacagcucccgccggaaccagaacugcgccaccgagaucccccagaucguggagaucagcaucgagaaggacaacgacuccugcgucacccccggcacccgccuggcgcggcgcgacagcuacucccggcacgccccguggggcgggaagaagaagcacagcugcuccaccaagacccagagcucccucgacgccgacaagaaguucggccgcacgcggagcgggcugcagcgccgggagcgccgguacggcgugagcuccgugcacgacauggacagcgucuccagccgcaccguggggucccggagccugcgccagcggcuccaggacaccgugggccugugcuuccccaugcgcaccuacuccaagcagagcaagccccuguucuccaacaagcggaagauccaccucagcgagcugaugcuggagaagugccccuucccggccggcuccgaccucgcccagaaguggcaccugaucaagcagcacacggcgcccgucagcccccacuccaccuucuucgacaccuucgaccccagccugguguccaccgaggacgaggaggaccgccuccgcgagcggcgccggcugagcaucgaggaggggguggacccgccgcccaacgcccagauccacacguucgaggccaccgcccaggucaacccccuguacaagcucggccccaagcuggcgcccgggaugaccgagaucuccggcgacagcuccgccaucccccaggccaacugcgacagcgaggaggacaccacgacccugugccuccagagccgccggcagaagcagcgccagaucuccggcgacagccacacccacgugucccggcagggggccuggaaggugcacacccagaucgacuacauccacugccugguccccgaccugcuccagaucacgggcaacccgugcuacuggggcgugauggaccgcuacgaggccgaggcgcugcuggaggggaagcccgaggggaccuuccuccugcgggacagcgcccaggaggacuaccuguucuccgugagcuuccgccgguacaaccgcucccuccacgcccggaucgagcaguggaaccacaacuucagcuucgacgcccacgaccccugcgucuuccacuccagcaccgugaccggccugcuggagcacuacaaggaccccuccagcugcauguucuucgagccgcuccugacgaucucccugaaccgcaccuuccccuucagccuccaguacaucugccgggccgugaucugccgcugcaccaccuacgacggcaucgacgggcugccccugcccuccaugcuccaggacuuccugaaggaguaccacuacaagcagaagguccgggugcgcuggcuggagcgggagccggugaaggcgaaguga

SEQ ID NO: 36900 - RNA, 1608 nt, Artificial Sequence
  derived and/or modified sequence opt1 from SOCS6__Homo_sapiens__XP_005266840
augaagaagaucagccugaagacccuccgcaaguccuucaaccugaacaagagcaaggaggagaccgacuucaugguggugcagcagcccucccuggccagcgacuucggcaaggacgacucccucuucgggagcugcuacggcaaggacauggccuccugcgacaucaacggggaggacgagaagggcgggaagaaccggagcaaguccgagagccugaugggcacgcugaagcgccggcucuccgcgaagcagaaguccaagggcaaggccgggaccccguccggcagcuccgccgacgaggacaccuucagcuccagcuccgcccccaucguguucaaggacgugcgcgcccagcggcccauccgcagcaccagccugcggucccaccacuacagccccgcgccguggccccugcgccccacgaacuccgaggagaccugcaucaagauggagguccgggugaaggcccucgugcacagcuccagccccuccccggcccugaacgggguccgcaaggacuuccacgaccugcagagcgagacgaccugccaggagcaggccaacucccucaagagcuccgcgagccacaacggcgaccugcaccuccaccuggacgagcacgugcccguggucaucgggcugaugccccaggacuacauccaguacaccgugccccuggacgagggcauguacccgcucgagggcucccggagcuacugccuggacuccagcucccccauggaggugagcgccgucccgccccaggucgggggccgcgccuuccccgaggacgagucccagguggaccaggaccuggugguggcccccgagaucuucguggaccagagcgucaacgggcuccugaucggcaccaccggcgugaugcugcagagcccccgggccgggcacgacgacgugcccccgcucagcccccugcugccgcccaugcagaacaaccagauccagcgcaacuucagcggccucaccgggacggaggcgcacgucgccgaguccaugcggugccaccugaacuucgaccccaacagcgcccccggcguggcccgcguguacgacuccguccagagcuccgggcccaugguggucaccagccugaccgaggagcucaagaagcuggccaagcagggcugguacuggggccccaucacccggugggaggcggaggggaagcuggccaacgugccggacggcuccuuccucgugcgcgacagcuccgacgaccgguaccugcugagccucuccuuccgcagccacgggaagacgcugcacacccggaucgagcacuccaacggccgcuucagcuucuacgagcagcccgacgucgaggggcacaccuccaucguggaccugaucgagcacagcauccgcgacagcgagaacggcgccuucugcuacucccggagccgccuccccggcuccgccaccuacccggugcggcugacgaaccccgucagccgcuucaugcagguccggucccugcaguaccucugccgcuucgugauccggcaguacacccgcaucgaccugauccagaagcugccccuccccaacaagaugaaggacuaccugcaggagaagcacuacuga

SEQ ID NO: 36901 - RNA, 1746 nt, Artificial Sequence
  derived and/or modified sequence opt1 from SOCS7__Homo_sapiens__NP_055413
augguguuccgcaacgucggccggcccccggaggaggaggacguggaggccgcccccgagcccgggcccagcgagcugcucugcccgcgccaccggugcgcgcuggaccccaaggcccugccccccggccucgcccuggagcgcaccugggggccggccgccggccuggaggcgcagcucgccgcccuggggcugggccagcccgccggccccggggugaagaccgucggcgggggcugcugccccugcccgugccccccccagcccccgcccccccagccccagccgcccgcggccgccccccaggccggggaggaccccacggagaccuccgacgcccuccuggugcuggagggccucgagagcgaggcggagucccuggagaccaacagcugcuccgaggaggagcugagcuccccgggccgggggggcgggggcggcgggcgccuccugcugcagccccccggccccgagcucccgcccgugcccuucccgcugcaggaccuggucccccucgggcggcugagccgcggcgagcagcagcagcagcagcagcagcagccccccccgcccccccccccgcccgggccccugcggccccucgccggcccgucccgcaagggcagcuucaagauccggcugucccgccuguuccggaccaagagcugcaacgggggcuccgggggcggggacggcacgggcaagcgccccagcggggagcucgccgccuccgccgcgagccugaccgacaugggcggguccgccggccgggagcuggacgccgggcgcaagcccaagcucacccggacccagagcgccuucucccccgugagcuucagcccgcuguucacgggcgagaccgugucccuggucgacguggacaucagccagcgcggccucaccuccccccacccccccaccccgcccccccccccgcggcgcagccugucccugcucgacgacaucagcgggacgcugcccaccuccgugcuggucgcccccaugggcagcucccuccagagcuucccgcugcccccccccccgcccccccacgcgcccgacgccuucccgcggaucgcccccauccgcgccgccgagucccugcacagccagcccccccagcaccuccagugcccgcuguaccgccccgacuccagcuccuucgcggccagccugcgggagcucgagaagugcgggugguacuggggccccaugaacugggaggacgccgagaugaagcugaagggcaagcccgacggguccuuccuggugcgcgacagcuccgacccgcgguacauccucagccugagcuuccgcucccagggcaucacccaccacacccggauggagcacuaccgcgggacguucagccuguggugccaccccaaguucgaggaccggugccaguccguggucgaguucaucaagcgcgccaucaugcacagcaagaacggcaaguuccuguacuuccuccggucccgcgugcccgggcugcccccgacccccgugcagcugcucuaccccgucagccgguucuccaacgugaagagccugcagcaccugugccgcuuccggauccgccagcucgugcggaucgaccacauccccgaccugccgcugcccaagccccucaucuccuacauccgcaaguucuacuacuacgacccccaggaggaggucuaccugagccugaaggaggcgcagcucaucuccaagcagaagcaggagguggagccgagcaccuga

SEQ ID NO: 36902 - RNA, 465 nt, Artificial Sequence
  derived and/or modified sequence opt1 from SOD1__Homo_sapiens__NP_000445
auggccaccaaggccgugugcguccugaagggcgacgggcccgugcagggcaucaucaacuucgagcagaaggagagcaacgggccggugaaggucuggggcuccaucaaggggcucaccgagggccugcacggcuuccacgugcacgaguucggggacaacacggcgggcugcaccagcgccgggccccacuucaacccccugucccgcaagcacggcgggcccaaggacgaggagcggcacgugggcgaccucggcaacgucaccgccgacaaggacgggguggccgacgugagcaucgaggacuccgucaucagccuguccggcgaccacugcaucaucgggcgcacccugguggugcacgagaaggccgacgaccucggcaagggcgggaacgaggagagcacgaagaccggcaacgcggggucccggcuggccugcggcgucaucgggaucgcccaguga

SEQ ID NO: 36903 - RNA, 669 nt, Artificial Sequence
  derived and/or modified sequence opt1 from SOD2__Homo_sapiens__NP_001019636
augcugagccgcgccgugugcggcaccucccggcagcucgcccccguccugggguaccugggcagccgccagaagcacucccucccggaccugcccuacgacuacggggcgcuggagccccacaucaacgcccagaucaugcagcuccaccacagcaagcaccacgccgccuacgugaacaaccugaacgugaccgaggagaaguaccaggaggcccuggcgaagggcgacgucacggcccagaucgcccuccagcccgcccugaaguucaacgggggcggccacaucaaccacuccaucuucuggaccaaccugagcccgaacgggggcggggagcccaagggcgagcuccuggaggcgaucaagcgggacuucggguccuucgacaaguucaaggagaagcugaccgccgccagcgugggcgugcagggcuccggguggggcuggcucggguucaacaaggagcgcggccaccuccagaucgccgccugccccaaccaggacccccugcagggcaccacggggcugaucccgcugcugggcaucgacgucugggagcacgcguacuaccuccaguacaagaacgugcggcccgacuaccugaaggccaucuggaacgugaucaacugggagaacgucaccgagcgcuacauggccugcaagaaguga

SEQ ID NO: 36904 - RNA, 723 nt, Artificial Sequence
  derived and/or modified sequence opt1 from SOD3__Homo_sapiens__NP_003093
augcuggcccuccugugcagcugccugcuccuggccgcgggcgccuccgacgccuggaccggggaggacagcgccgagcccaacuccgacagcgccgaguggauccgcgacauguacgcgaaggugaccgagaucuggcaggaggucaugcagcggcgcgacgacgacggcgcccugcacgccgccugccaggugcagccguccgcgacgcucgacgccgcccagccccgggugaccggggucgugcuguuccgccagcuggcgccccgggccaagcucgacgccuucuucgcccuggagggcuuccccaccgagccgaacagcuccagccgcgccauccacgugcaccaguucggggaccugucccagggcugcgagagcaccggcccccacuacaacccccucgccgucccccacccgcagcaccccggggacuucggcaacuucgccgugcgggacgggucccuguggcgcuaccgggcgggccuggccgccagccucgccgggccccacuccaucgugggccgcgccgucguggugcacgcgggcgaggacgaccuggggcggggcgggaaccaggccagcgucgagaacggcaacgccggccgccggcuggccugcugcguggugggggucugcggccccgggcucugggagcgccaggcccgggagcacuccgagcgcaagaagcggcgccgggagagcgagugcaaggcggccuga

SEQ ID NO: 36905 - RNA, 987 nt, Artificial Sequence
  derived and/or modified sequence opt1 from SOHLH1__Homo_sapiens__NP_001012415
auggccagccgcugcuccgagcccuaccccgaggugagccggauccccaccguccgcggcugcaacgggucccugagcggcgcccucuccugcugcgaggacagcgcgcagggguccggcccgcccaaggcccccaccguggccgaggggcccagcuccugccugcggcgcaacgugaucagcgagcgggagcgccggaagcgcaugucccugagcugcgagcggcuccgcgcccugcugccccaguucgacggccggcgcgaggacauggccuccguccucgagaugagcgugcaguuccugcggcuggcguccgcccucggccccagccaggagcagcacgccauccuggccuccagcaaggagauguggcacucccugcaggaggacgugcuccagcugacgcugagcagccagauccaggcgggggucccggaccccggcaccggggccuccagcggcacccgcacccccgacgugaaggccuuccucgagucccccuggagccuggacccggccuccgccagccccgagcccgugccccacauccuggcguccagccggcagugggacccggccuccugcacgagccucgggaccgacaagugcgaggcccugcugggccucugccagguccgcggcgggcugccgcccuucuccgagcccagcucccuggugcccuggccgcccggccggagccuccccaaggccgugcgcccgccccuguccuggccgcccuucagccagcagcagacccugcccgucauguccggggaggcccucggcuggcugggccaggcggggccccuggccaugggcgccgcgccccucggggagcccgccaaggaggaccccaugcuggcccaggaggccggcagcgcccugggguccgacguggacgacggcaccagcuuccuccugacggccggccccagcuccuggcccggggaguggggcccgggguuccgggccggcccgcccgcguga

SEQ ID NO: 36906 - RNA, 1278 nt, Artificial Sequence
  derived and/or modified sequence opt1 from SOHLH2__Homo_sapiens__NP_060296
auggccagcuccaucaucugccaggagcacugccagaucagcggccaggccaagaucgacauccugcucgugggggacgucaccgugggcuaccuggcggacaccgugcagaagcuguucgccaacaucgccgaggucacgaucaccaucuccgacaccaaggaggccgccgcgcuccuggacgacugcaucuucaacauggugcugcucaaggugcccagcucccugagcgccgaggagcuggaggccaucaagcucauccgcuucgggaagaagaagaacacccacucccuguucgucuucaucaucccggagaacuucaagggcugcaucagcgggcacggcauggacaucgcccugacggagccccucaccauggagaagauguccaacguggugaaguacuggacgaccugccccagcaacaccgucaagaccgagaacgcgaccggccccgaggagcuggggcugccgcuccagcgguccuacagcgagcaccugggcuacuuccccaccgaccuguucgccugcuccgagagccuccgcaacgggaacggccuggagcugaacgccucccucagcgaguucgagaagaacaagaagaucucccugcugcacagcuccaaggagaagcuccggcgcgagcggaucaaguacugcugcgagcagcugcgcacgcugcuccccuacgugaaggggcggaagaacgacgccgccagcgugcuggaggcgaccgucgacuacgugaaguacauccgcgagaagaucagccccgccgugauggcccagaucaccgaggcccugcaguccaacaugcgguucugcaagaagcagcagaccccgaucgagcucagccugcccggcacggucauggcccagcgcgagaacuccgugaugagcaccuacucccccgagcggggccugcaguuccucaccaacacgugcuggaacgggugcagcacccccgacgcggaguccagccuggacgaggccgugcgcgucccguccagcuccgccagcgagaacgccaucggcgaccccuacaagacccacaucuccagcgccgcgcugucccucaacagccugcacaccgugcgguacuacuccaaggugacccccagcuacgacgccacggccgucaccaaccagaacaucuccauccaccuccccagcgccaugccgcccgugagcaagcugcugccccgccacugcaccuccgggcugggccagaccugcacgacccaccccaacugccuccagcaguucugggccuacuga

SEQ ID NO: 36907 - RNA, 6327 nt, Artificial Sequence
  derived and/or modified sequence opt1 from SON__Homo_sapiens__NP_001278340
auggccaccaacaucgagcagaucuuccgcagcuucgucgucagcaaguuccgggagauccagcaggagcugagcagcggccgcaacgagggccagcucaacggcgagaccaacacccccaucgaggggaaccaggccggcgacgccgccgccagcgcccggagccugcccaacgaggagaucgugcagaagaucgaggaggugcugagcgggguccucgacaccgagcugcgcuacaagcccgaccugaaggagggcagccggaagucccgcugcguguccgugcagaccgaccccaccgacgagauccccacgaagaaguccaagaagcacaagaagcacaagaacaagaagaagaagaagaagaaggagaaggagaagaaguacaagcggcagcccgaggaguccgagagcaagaccaagucccacgacgacggcaacaucgaccucgagagcgacuccuuccugaaguucgacagcgagcccuccgccgucgcccuggagcuccccacccgcgccuucgggcccagcgagaccaacgagucccccgccguggugcuggagccgcccgucgugagcauggaggugagcgagccccacauccuggagacgcucaagcccgccaccaagaccgcggagcuguccgucgugagcaccuccgugaucagcgagcaguccgagcagagcgucgccgugaugcccgagcccuccaugacgaagauccuggacagcuucgccgccgcccccgugcccaccaccacccucguccugaaguccagcgagcccguggugacgauguccgucgaguaccagaugaaguccgugcugaaguccguggagagcaccucccccgagcccagcaagaucaugcucgucgagccgcccguggccaagguccuggagcccuccgagacccugguggugagcuccgagacccccacggaggucuaccccgagcccagcaccagcaccaccauggacuuccccgaguccagcgccaucgaggcccuccggcugcccgagcagccgguggacgugcccuccgagaucgccgacagcuccaugacgcgcccccaggagcugccggagcuccccaagaccaccgcccuggagcugcaggagagcuccgucgcgagcgccauggagcuccccggcccgcccgccaccuccaugcccgagcugcaggggccgcccgugacgcccgugcuggagcuccccggccccagcgccacccccgucccggagcugcccgggccccuguccacccccgugccggagcuccccgggccgcccgccaccgcggugccggagcugcccggccccagcgucacgcccgugccgcagcugucccaggagcuccccgggcugcccgccccgagcaugggccuggagccgccccaggaggugcccgagccgcccgucauggcccaggagcuccccgggcugccccuggugaccgccgccguggagcucccggagcagcccgcggucaccguggccauggagcugaccgagcagcccgugacgaccaccgagcuggagcagcccgucggcaugaccaccguggagcacccgggccaccccgaggugacgaccgccaccgggcuccugggccagcccgaggccaccaugguccuggagcuccccgggcagccgguggcgacgaccgcccuggagcugcccggccagcccuccgugaccgggguccccgagcugccgggccuccccagcgccacccgggcccuggagcuguccggccagcccguggccacgggggcgcucgagcugcccggcccgcugauggccgccggggcccucgaguucagcggccagagcggggccgcgggcgcccuggagcugcucggccagccccuggccaccggggugcuggagcuccccggccagcccggggccccggagcugcccggccagcccgucgccaccguggcgcuggagaucuccgugcagagcgucgugaccacguccgagcucagcaccaugaccgugucccagagccuggaggucccguccaccacggcccuggagagcuacaacaccguggcccaggagcuccccaccacccuggugggggagacguccgucaccgugggcguggacccccugauggcccccgagagccacauccucgcguccaacaccauggagacccacauccuggccagcaacacgauggacucccagaugcuggccagcaacaccauggacucccagaugcucgccagcaacaccauggacucccagaugcuggccagcuccaccauggacagccagaugcuggcgacgagcuccauggacagccagaugcucgccaccuccagcauggacucccagaugcuggccaccagcaccauggacucccagaugcuggccacgagcuccauggacagccagaugcucgccaccuccagcauggacucccagaugcuggcgaccagcuccauggacagccagaugcuggccaccuccagcauggacucccagaugcucgccacgagcaccauggacagccagaugcuggccaccuccaccauggacagccagaugcuggccaccuccagcauggacucccagaugcucgcgagcggcacgauggacucccagaugcuggccagcgggaccauggacgcccagaugcuggccuccggcaccauggacgcgcagaugcucgccagcuccacccaggacagcgccaugcugggguccaagagcccggaccccuaccgccuggcccaggaccccuaccggcucgcccaggaccccuaccgccugggccacgacccguaccggcugggccacgacgcguaccgccucgggcaggaccccuaccggcugggccacgaccccuaccgccugacgcccgacccguaccggaugagcccccgccccuaccggaucgcgccccgcagcuaccgcaucgccccgcggcccuaccgccucgcgccccggccccugaugcuggccucccgccggagcaugaugauguccuacgcggccgagcgcagcaugaugagcuccuacgagcggagcaugauguccuacgagcgcagcaugauguccccgauggccgagcggagcaugauguccgccuacgagcgcagcaugauguccgccuacgagcggagcaugaugucccccauggcggagcgcagcaugauguccgccuacgagcggagcaugauguccgccuacgagcgcagcaugaugucccccauggccgaccggagcaugauguccaugggggccgaccgcagcaugaugagcuccuacagcgcggccgaccgguccaugaugagcuccuacagcgccgccgaccgcuccaugaugagcuccuacaccgcggaccggagcaugauguccauggccgccgacagcuacaccgacuccuacaccgacacguacaccgaggccuacauggugcccccgcucccgcccgaggagccgcccaccaugccgccccugccgcccgaggagccgcccaugaccccgccccugccgcccgaggagccgcccgagggccccgcccuccccacggagcagagcgcgcugaccgccgagaacaccuggcccaccgaggugcccucccugcccagcgaggaguccgugagccagcccgagccgcccgucucccagagcgagaucagcgagcccuccgccgugcccacggacuacagcguguccgccagcgaccccuccguccucgugagcgaggccgcggugaccguccccgagccgccgcccgagcccgaguccagcaucacccugacccccguggaguccgccgucguggccgaggagcacgaggugguccccgagcgccccgugacgugcauggugagcgagacccccgccauguccgccgagcccaccguccuggcgagcgagccgcccgugauguccgagaccgccgagacguucgacagcaugcgcgccuccgggcacguggccagcgaggucuccaccagccuccuggugcccgcggugaccacccccguccuggccgagagcauccucgagccgcccgccauggccgcccccgaguccagcgcgauggccgugcuggaguccagcgccgugacgguccuggaguccagcaccgugaccgugcucgaguccagcaccgucacggugcuggagcccuccguggucaccgugccggagccgcccguggucgccgagcccgacuacgugaccauccccgugcccgucgugagcgcccuggagcccuccgugcccguccucgagccggcggugagcgugcugcagcccuccaugaucgucagcgagcccuccgugagcgugcaggaguccaccgucacggugagcgagcccgccgugaccgucuccgagcagacccaggugaucccgaccgagguggccaucgagagcacccccaugauccuggagagcuccaucaugagcucccacgucaugaagggcaucaaccucagcuccggcgaccagaaccuggcccccgagaucgggaugcaggagaucgcccugcacagcggcgaggagccccacgcggaggagcaccucaagggggacuucuacgaguccgagcacggcaucaacaucgaccugaacaucaacaaccaccugaucgccaaggagauggagcacaacacggugugcgccgccgggaccagcccggugggcgagaucggcgaggagaagauccuccccaccuccgagaccaagcagcggacgguccuggacaccuaccccggggugagcgaggcggacgccggcgagacccuguccagcaccgggccguucgcccucgagcccgacgccacgggcaccuccaaggggaucgaguucaccaccgccagcacgcugucccuggugaacaaguacgacgucgaccucagccugaccacccaggacaccgagcacgacauggugaucuccacgagccccuccggcggcagcgaggcggacaucgaggggccccugccggccaaggacauccaccucgaccugcccagcaacaacaaccugguguccaaggacaccgaggagccccuccccgucaaggagagcgaccagacccuggccgcccugcucuccccgaaggagagcuccggcggggagaaggaggugccgccgccgcccaaggagacccugcccgacagcggcuucuccgccaacaucgaggacaucaacgaggcggaccugguccgcccccugcuccccaaggacauggagcggcugacgagccugcgcgccgggaucgagggcccccuccuggccuccgacgugggccgggaccgcagcgccgccucccccguggucagcuccaugcccgagcgggcgagcgaguccagcuccgaggagaaggacgacuacgagaucuucgugaaggugaaggacacccacgagaaguccaagaagaacaagaaccgcgacaagggggagaaggagaagaagcgggacuccagccugcgcagccgguccaagcgcagcaaguccagcgagcacaagucccggaagcgcaccagcgagucccggagccgcgcccggaagcgcuccagcaaguccaagagccaccggucccagacccgcagccggucccgcagccgccggcgccggcgcuccagccggucccgcagcaagagccggggccgccgguccgucagcaaggagaagcgcaagcggucccccaagcaccgcagcaagucccgggagcgcaagcggaagcgcagcuccagccgggacaaccgcaagacggugcgggcccgcucccgcaccccgagccggcgcucccggagccacacccccucccgccggcgccggagccgcuccguggggcggcgccggagcuucuccaucagccccucccgccggagccgcacccccagccggcgcucccggacgccgagccgccggucccgcacccccagccggcgcucccgcacccccagccggcgcucccggacccccagccgccggucccgcacgccgagccggcgccggcgcucccggagcgucgugcgccggcgcuccuucagcaucucccccgugcggcuccgccggagccgcacgccccugcggcgccgcuucucccggagcccgauccgccggaagcgcagccgguccagcgagcgcggccggucccccaagcgccugaccgaccucgacaaggcccagcugcuggagaucgccaaggcgaacgccgccgccaugugcgcgaaggccggcgucccccucccgcccaaccugaagcccgcgcccccgcccaccaucgaggagaagguggccaagaaguccgggggcgccacgaucgaggagcugaccgaguucuga

SEQ ID NO: 36908 - RNA, 3456 nt, Artificial Sequence
  derived and/or modified sequence opt1 from SORBS1__Homo_sapiens__NP_001030127
augagcuccgagugcgacggcgggagcaaggccgugaugaacggccuggcccccggguccaacggccaggacaaggcgaccgccgacccgcuccgcgcccggagcaucuccgccgucaagaucauccccgugaagaccgugaagaacgccagcgggcugguccugcccacggacauggaccccaccaagaucugcaccggcaagggcgcggugacccuccgcgccuccagcuccuaccgggagacgccgagcuccagccccgccagcccccaggagacccgccagcacgaguccaagcccgggcuggagccggagcccuccagcgccgacgaguggcggcuguccagcuccgcggacgccaacggcaacgcccagcccagcagccucgccgccaagggguaccgcuccgugcaccccaaccugccgagcgacaagucccaggacgcgaccagcuccagcgccgcccagcccgaggucaucguggugccccuguaccucgucaacaccgaccggggccaggaggggacggcccggcccccgacgccccugggcccccugggcugcgugcccaccaucccggccaccgcguccgccgccagcccccucaccuuccccacccuggacgacuucaucccgccccaccuccagcgguggccccaccacucccagcccgcccgcgccagcggguccuucgcgcccaucagccagaccccgcccuccuucagcccgcccccgccccucgugccgcccgcccccgaggaccugcggcgcgucuccgagcccgaccugaccggcgccgugagcuccacggacagcagcccccuccugaacgagguguccagcucccugaucgggaccgacagccaggccuuccccuccgucagcaagcccuccagcgccuaccccuccaccaccaucgugaaccccacgaucgugcuccugcagcacaaccgggagcagcagaagcgccugagcucccucagcgacccggucuccgagcggcgcgugggcgagcaggacagcgcgcccacccaggagaagcccaccucccccggcaaggccaucgagaagcgggccaaggacgacagccgccggguggucaaguccacccaggaccugagcgacguguccauggacgagguggggaucccgcugcgcaacacggagcggagcaaggacugguacaagaccauguucaagcagauccacaagcugaaccgcgacacccccgaggagaaccccuacuuccccaccuacaaguucccggagcugcccgagauccagcagacgagcgaggagaccaaguccugcagcgucaugagcccccgccuggagugcuccggcaccgugaucgcccacugcucccucaagcugcuggacagcuccaacccgcccaccagcgcgucccaggucgccgggacggccgacgacgacagcgaccucuacagcccccgguacuccuucuccgaggacaccaagagcccccuguccgugccgcgcagcaaguccgagaugagcuacaucgacggcgagaagguggucaagcgguccgccacccugccccuccccgcccgcagcagcucccucaagagcuccagcgagcggaacgacugggagcccccggacaagaagguggacacccgcaaguaccgggcggagcccaaguccaucuacgaguaccagcccggcaagagcuccgugcugacgaacgagaagaugagccgcgacaucucccccgaggagaucgaccugaagaacgagccgugguacaaguucuucagcgagcuggaguucgggaagcccccgcccaagaagaucugggacuacacccccggcgacugcuccauccugccccgggaggaccgcaagaccaaccucgacaaggaccugagccugugccagaccgagcucgaggccgaccuggagaagauggagacccugaacaaggcccccuccgccaacgucccccagagcuccgccaucagcccgacgcccgagaucuccagcgagacccccggguacaucuacuccagcaacuuccacgcggugaagcgggagagcgacggcgcccccggggaccucaccucccuggagaacgagcgccagaucuacaagagcgugcuggagggcggggacaucccgcugcagggccucuccggccugaagcggcccagcuccagcgccuccaccaaggacagcgagagcccccgccacuucauccccgccgacuaccuggaguccacggaggaguucauccggcgccggcacgacgacaaggagaagcuccuggccgaccagcgccggcugaagcgcgagcaggaggaggcggacaucgccgcccgccggcacaccggggucaucccgacccaccaccaguucaucaccaacgagcgcuucggcgaccuccugaacaucgacgacacggccaagcggaaguccgggagcgagaugcgccccgcgcgggccaaguucgacuucaaggcccagacccugaaggagcucccccugcagaagggcgacaucguguacaucuacaagcagaucgaccagaacugguacgagggggagcaccacggccgcgugggcaucuucccccggaccuacaucgagcugcucccgcccgccgagaaggcccagcccaagaagcugaccccgguccaggugcuggaguacggggaggcgaucgccaaguucaacuucaacggcgacacccagguggagauguccuuccgcaagggggagcggaucacgcuccugcgccaggucgacgagaacugguacgagggccggauccccggcaccagccgccaggggaucuuccccaucaccuacguggacgugaucaagcggccccuggucaagaacccgguggacuacauggaccuccccuucuccagcucccccagccgcuccgccacggccagcccccagccguggcgggaggagagcggccaguacgagcgcaaggccgagcgcggggcgggcgagcgcgggcccggcggccccaagaucuccaagaaguccugccugaagcccagcgacgugguccggugccugagcaccgagcagcgccucuccgaccugaacaccccggaggagagccggcccgggaagccccugggcuccgccuuccccgggagcgaggccgagcagaccgagcgccaccgcggcggggagcaggccggccggaaggccgcgcgccggggcgggucccagcagccgcaggcccagcagcgccgggugacgcccgaccgcagccagaccucccaggaccucuucagcuaccaggcccuguacuccuacaucccccagaacgacgacgagcuggagcuccgggacggcgacaucguggacgucauggagaagugcgacgacgggugguucgugggcaccagccgccggaccaagcaguucgggacguuccccggcaacuacgugaagccgcuguaccuguga

SEQ ID NO: 36909 - RNA, 1935 nt, Artificial Sequence
  derived and/or modified sequence opt1 from SORBS2__Homo_sapiens__NP_001139142
augagcgugacccugaccuccgucaagcgcgugcagagcucccccaaccuccuggccgccggccgggacagccaguccccggacagcgcguggcgcuccuacaacgacgggaaccaggagacgcugaacggcgacgccaccuacagcucccucgccgccaagggguuccggagcgugcgccccaaccugcaggacaagcggucccccacccagagccagaucaccgucaacggcaacuccgggggcgccgugagccccauguccuacuaccagcgcccguucagccccuccgcguacagccugcccgccucccucaacagcagcaucgugaugcagcacggcacgucccuggacagcaccgacaccuacccccagcacgcccagucccuggacgggaccacgagcuccagcaucccgcucuaccgguccagcgaggaggagaagcgcgucaccgugaucaaggcgccccacuaccccggcaucgggcccguggacgaguccggcaucccgaccgccauccggaccacggucgaccgccccaaggacugguacaagaccauguucaagcagauccacauggugcacaagcccgggcuguacaacccgcccuacagcgcccagucccaccccgccgccaagacccagaccuaccggccccugagcaagucccacagcgacaacucccccaacgccuucaaggacgcgagcuccccggugcccccgccccacgugcccccgcccgucccgccccuccgcccccgggaccgcagcuccacggagaagcacgacugggacccgcccgaccggaagguggacacccgcaaguuccggagcgagccccgcagcaucuucgaguacgagcccggcaaguccagcauccugcagcacgagcggcccgccucccuguaccagagcuccaucgaccgcagccucgagcggcccauguccagcgccuccauggccagcgacuuccgcaagcgccggaaguccgagcccgccgucggcccgccccgcgggcugggcgaccagagcgcgucccggaccagccccgggcgcguggaccugcccggcuccagcaccacgcucaccaaguccuucaccagcagcucccccagcucccccagccgggccaaggaccgcgaguccccgcggagcuacuccagcacccugacggacaugggccgcuccgcgccccgggagcgccgggggacccccgagaaggagaagcugcccgccaaggccguguacgacuucaaggcccagaccagcaaggagcucuccuucaagaagggcgacaccgucuacauccugcgcaagaucgaccagaacugguacgagggggagcaccacggccggguggggaucuucccgaucagcuacguggagaagcugacgccgcccgagaaggcccagcccgcccggcccccgccgcccgcccagcccggcgagaucggcgaggccaucgcgaaguacaacuucaacgccgacaccaacgucgagcucucccugcgcaagggggaccgcgugauccugcucaagcggguggaccagaacugguacgagggcaagauccccgggaccaaccgccagggcaucuuccccgucagcuacguggaggucgugaagaagaacaccaagggggccgaggacuaccccgacccgcccaucccccacuccuacagcuccgaccggauccacagccuguccagcaacaagccccagcgccccguguucacgcacgagaacauccagggcggcggggagcccuuccaggcccuguacaacuacacgccccgcaacgaggacgagcucgagcugcgggagagcgacgucaucgacgugauggagaagugcgacgacggcugguucguggggaccucccgccggaccaaguucuucggcaccuucccggggaacuacgucaagcgccuguga

SEQ ID NO: 36910 - RNA, 2016 nt, Artificial Sequence
  derived and/or modified sequence opt1 from SORBS3__Homo_sapiens__NP_005766
augcaggggcccccgcgcagccugcgggccggccucucccuggacgacuucauccccggccaccuccagagccacaucggguccagcucccgcggcacccgggugcccgucauccgcaacgggggcagcaacacccugaacuuccaguuccacgaccccgccccgcggacggugugcaacggcggguacacgccccgccgggacgcgucccagcaccccgaccccgccugguaccagaccuggccgggccccgggagcaagcccuccgccagcaccaagauccccgccucccagcacacccagaacuggagcgccaccuggaccaaggacuccaagcgccgggacaagcgcugggugaaguacgagggcaucgggccggucgacgagagcggcaugcccaucgcgccccgguccagcguggaccgcccccgggacugguaccgccggauguuccagcagauccaccgcaagaugccggaccugcagcuggacuggaccuucgaggagccgccccgggacccccgccaccucggcgcccagcagcggcccgcccaccgccccgggcccgccacguccagcuccggccggagcugggaccacagcgaggagcugccccgcuccaccuucaacuaccgcccgggggcguucagcaccgugcugcagcccuccaaccagguccuccggcgccgggagaagguggacaacguguggaccgaggagagcuggaaccaguuccugcaggagcuggagacgggccagcgccccaagaagccccucgucgacgacccgggcgagaagcccucccagcccaucgaggugcugcuggagcgggagcucgccgagcugagcgccgagcuggacaaggaccuccgcgccaucgagacccggcugccgucccccaagagcucccccgcgccccgccgggccccggagcagcgcccgcccgccgggcccgccagcgccugguccagcuccuacccccacgcccccuaccugggcagcgcgcggucccucagcccccacaagauggccgacgggggcucccccuuccuggggcgccgggacuucguguacccgagcuccacccgcgaccccagcgccagcaacggcggcgggucccccgcccggcgcgaggagaagaagcggaaggccgcgcgccugaaguucgacuuccaggcccagagccccaaggagcucacccugcagaagggcgacaucgucuacauccacaaggagguggacaagaacuggcuggagggggagcaccacggccggcucgggaucuucccggccaacuacguggagguccugcccgccgacgagauccccaagcccaucaagccgcccacguaccaggugcuggaguacggcgaggccguggcgcaguacaccuucaagggcgaccucgaggucgagcuguccuuccgcaagggggagcacaucugccugauccgcaaggugaacgagaacugguacgagggccggaucaccgggaccggccgccaggggaucuuccccgccagcuacgugcaggucucccgggagccccgccuccggcugugcgacgacggcccgcagcugcccacgagcccccgccucaccgccgccgcgcgguccgcccgccacccgagcucccccagcgcccugcggucccccgccgaccccaucgaccugggcgggcagaccagcccgcgccggaccggcuucuccuuccccacgcaggagccccgcccccagacccagaaccucgggaccccgggccccgcccugagccacucccggggccccagccacccccuggaccucgggaccuccagcccgaacacgagccagauccacuggacccccuaccgcgcgauguaccaguaccggccccagaacgaggacgagcuggagcugcgcgagggcgaccggguggacgugaugcagcagugcgacgacgggugguucgucggcgugucccgccggacccagaaguucgggaccuuccccggcaacuacgucgccccgguguga

SEQ ID NO: 36911 - RNA, 3597 nt, Artificial Sequence
  derived and/or modified sequence opt1 from SORCS1__Homo_sapiens__NP_001013049
augggcaaggugggggccggcgggggcagccaggcccgccuguccgcgcuccuggccggggccggccugcucauccugugcgcccccggcgucugcgggggcgggagcugcugcccgagcccccaccccuccuccgcgccccggagcgccuccaccccgcgcggcuucagccaccaggggcggcccggccgcgcccccgccacgccccugccgcucguggugcggccccuguucuccgucgcccccggcgaccgcgcgcugagccucgagcgggcccgcgggaccggcgccuccauggccguggccgcgcggagcgggcgccggcgccgguccggcgccgaccaggagaaggccgagcgcggcgagggggccagccggagcccccgcggcgugcugcgggacgggggccagcaggagccggggacccgcgagcgggaccccgacaaggccacccgcuuccggauggaggagcugcgccucaccuccacgaccuucgcgcugaccggcgacuccgcccacaaccaggccaugguccacuggagcggccacaacuccagcgugauccugauccucaccaagcuguacgacuacaaccuggggagcaucacggaguccagccucuggcgcuccaccgacuacggcaccaccuacgagaagcugaacgacaagguggggcugaagacgauccucagcuaccuguacgucugccccaccaacaagcggaagaucaugcugcucaccgaccccgagaucgaguccagccugcugaucuccagcgacgagggcgccaccuaccagaaguaccgccucaacuucuacauccagucccugcuguuccacccgaagcaggaggacuggauccucgccuacagccaggaccagaagcuguacuccagcgcggaguucgggcggcgcuggcagcugauccaggagggcguggugcccaaccgguucuacugguccgucaugggcagcaacaaggagcccgaccucgugcaccuggaggcccgcacgguggacgggcacucccacuaccugaccugccggaugcagaacugcaccgaggccaaccgcaaccagcccuucccgggcuacaucgaccccgacagccucaucguccaggaccacuacguguucgugcagcugaccuccgggggccggccccacuacuacgucagcuaccgccggaacgccuucgcccagaugaagcugcccaaguacgcgcucccgaaggacaugcacgugaucuccacggacgagaaccagguguucgccgccguccaggaguggaaccagaacgacaccuacaaccuguacaucagcgacacccgcgggguguacuucacccuggcccucgagaacgugcagagcucccggggccccgagggcaacaucaugaucgaccuguacgaggucgcggggaucaagggcauguuccuggccaacaagaagaucgacaaccaggugaagacguucaucaccuacaacaaggggcgcgacuggcggcuccugcaggcccccgacaccgaccugcgcggcgaccccguccacugccuccugccguacugcagccugcaccuccaccugaagguguccgagaaccccuacaccagcggcaucaucgccuccaaggacacggcccccagcaucaucguggcguccgggaacaucggcagcgagcuguccgacaccgacaucagcauguucgucuccagcgacgccgggaacaccuggcggcagaucuucgaggaggagcacuccgugcuguaccucgaccagggcggggugcuggucgccaugaagcacaccagccugccgauccgccaccucuggcuguccuucgacgagggccggagcugguccaaguacagcuucacgagcaucccccuguucguggacggcgugcucggggagcccggcgaggagacccugaucaugaccgucuucgggcacuucucccaccgcagcgaguggcagcuggugaagguggacuacaaguccaucuucgaccgccggugcgccgaggaggacuaccgccccuggcagcuccacagccagggcgaggccugcaucaugggggcgaagcggaucuacaagaagcgcaaguccgagcggaagugcaugcagggcaaguacgccggcgccauggagagcgagccgugcgucugcaccgaggccgacuucgacugcgacuacggguacgagcgccacuccaacggccagugccugcccgccuucugguucaaccccagcucccugagcaaggacugcucccucgggcagagcuaccugaacuccacgggcuaccggaagguggugagcaacaacugcaccgacgggguccgcgagcaguacaccgcgaagccccagaagugcccgggcaaggcgccccggggccugcgcaucgugaccgccgacgggaagcucaccgccgagcagggccacaacgugacgcugaugguccagcuggaggagggggacgugcagcggacccucauccagguggacuucggcgacgggaucgccgucuccuacgugaaccugagcuccauggaggacggcaucaagcacguguaccagaacgucggcaucuuccgcgugaccgugcaggucgacaacagccugggguccgacagcgccgugcucuaccugcacgugaccugcccccuggagcacguccaccucagccugcccuucgugacgaccaagaacaaggaggugaacgccaccgccguccuguggccgucccaggugggcacccucacguacguguggugguacgggaacaacaccgagccccugaucacccuggagggcagcaucuccuuccgguucaccagcgagggcaugaacacgaucaccguccagguguccgccgggaacgcgauccuccaggacaccaagaccaucgccguguacgaggaguuccgcagccugcggcuguccuucagccccaaccucgacgacuacaaccccgacaucccggaguggcgccgggacaucggccgcgucaucaagaagucccugguggaggccacgggggugcccggccagcacauccuggucgccgugcuccccgggcugcccaccaccgccgagcuguucgugcucccguaccaggaccccgcgggcgagaacaagcggagcaccgacgaccuggagcagaucuccgagcugcucauccacacgcugaaccagaacagcguccacuucgagcugaagcccggcgugcgcgugcucguccacgccgcccaccugaccgccgcgccccugguggaccucaccccgacccacuccgggagcgccaugcugaugcugcucuccguggucuucgugggccuggccgucuucgugaucuacaaguucaagcggaagauccccgggaucaacguguacgcccagaugcagaacgagaaggagcaggagaugaucagccccgucucccacagcgagucccgcccgaacgugccccagacggagcugcgccggcccggccagcucaucgacgagaagguggagagccagcugaucgggagcaucuccaucgucgccgagaaccagagcaccaaggagauccccaccuacgugaacguguga

SEQ ID NO: 36912 - RNA, 3480 nt, Artificial Sequence
  derived and/or modified sequence opt1 from SORCS2__Homo_sapiens__NP_065828
auggcccaccgcggccccagccgggccuccaaggggccgggccccaccgcgcgcgcccccagccccggggccccgcccccgccccgguccccgcgcagccggccccugcuccugcugcuccugcugcucggcgccugcggggccgcgggccgcucccccgagcccggccggcuggggccgcacgcccagcugacccgcgugccccggagcccgcccgccggccgcgccgagcccgggggcggggaggaccggcaggcgcgcggcacggagcccggcgcccccgggcccucccccggccccgcccccgggcccggcgaggacggcgccccggccgcgggguaccggcgcugggagcgggccgcgccccucgccggcgucgccagccgcgcccaggugucccugaucagcaccuccuucgugcugaagggggacgccacccacaaccaggccaugguccacuggaccggcgagaacagcuccgugauccucauccugacgaaguacuaccacgccgacauggggaaggugcuggagagcucccucuggcggagcuccgacuucggcaccagcuacaccaagcugacccugcagcccggcgucacgaccgugaucgacaacuucuacaucugccccaccaacaagcgcaaggugauccucgucuccagcagccuguccgaccgggaccagagccuguuccucuccgccgacgagggggccaccuuccagaagcagccgauccccuucuucguggagacgcugaucuuccaccccaaggaggaggacaaggugcuggccuacaccaaggagagcaagcucuacgucuccagcgaccugggcaagaaguggacccugcuccaggagcgcgugaccaaggaccacguguucugguccgucagcgggguggacgccgacccggaccuggugcacgucgaggcccaggaccugggcggggacuuccgguacgugacgugcgccauccacaacugcuccgagaagaugcucaccgcgcccuucgccggccccaucgaccacggcagccugaccgugcaggacgacuacaucuucuucaaggccaccuccgccaaccagacgaaguacuacgucagcuaccgccgcaacgaguucgugcugaugaagcuccccaaguacgcgcugccgaaggaccugcagaucaucuccaccgacgagagccagguguucgucgcggugcaggagugguaccagauggacaccuacaaccucuaccaguccgacccccgcgggguccgguacgcccuggugcugcaggacgugcggagcucccgccaggccgaggagagcguccucaucgacauccuggaggugcggggcgugaagggggucuuccuggccaaccagaagaucgacggcaaggugaugacccucaucacguacaacaaggggcgcgacugggacuaccugcggccgcccuccauggacaugaacggcaagcccaccaacugcaagccgcccgacugccaccuccaccuccaccuccgcugggcggacaaccccuacgugagcggcaccguccacaccaaggacacggcccccgggcugaucaugggcgccgggaaccugggcagccagcugguggaguacaaggaggagauguacaucaccuccgacugcggccacaccuggcgccagguguucgaggaggagcaccacauccuguaccuggaccacgggggcgucaucguggccaucaaggacaccagcaucccccugaagauccugaaguucuccguggacgaggggcugacguggagcacccacaacuucaccuccaccagcgucuucguggacggccuccuguccgagcccggggacgagacgcuggugaugaccgucuucggccacaucagcuuccgguccgacugggagcucgugaagguggacuuccggcccagcuucucccgccagugcggcgaggaggacuacagcuccugggagcugagcaaccugcagggggaccggugcaucaugggccagcagcgcuccuuccggaagcgcaagagcaccuccuggugcaucaaggggcggagcuucaccagcgcccucaccucccgcgucugcgagugccgggacagcgacuuccugugcgacuacggcuucgagcgcuccagcuccagcgaguccagcacgaacaagugcuccgcgaacuucugguucaacccgcugagcccgcccgacgacugcgcccucgggcagaccuacaccuccagccugggcuaccgcaaggugguguccaacgucugcgagggcgggguggacaugcagcagagccaggugcagcugcagugcccccucaccccgccccggggccugcaggucuccauccagggggaggccguggccgugcgccccggcgaggacguccuguucguggugcggcaggagcagggggacguccucacgaccaaguaccagguggaccugggcgacggcuucaaggccauguacgugaaccugacccucaccggggagcccauccgccaccgguacgagagccccggcaucuaccgcgucuccgugcgggcggagaacacggccgggcacgacgaggccgugcuguucguccaggugaacagcccccugcaggcccucuaccuggaggugguccccgugaucggccugaaccaggaggugaaccucaccgcgguccugcugccgcucaaccccaaccugaccguguucuacugguggaucgggcacucccugcagccccuccugagccuggacaacagcgugaccacgcgcuucuccgacaccggcgacguccgggugaccgugcaggccgccugcggcaacagcguccuccaggacucccgcgugcugcggguccuggaccaguuccaggugaugccccuccaguucagcaaggagcuggacgccuacaacccgaacacccccgaguggcgcgaggacguggggcuggucgugacgcggcuccuguccaaggagaccagcgugccccaggagcugcucgucaccguggugaagcccggccugccgacccuggccgaccucuacguccugcugcccccgccccgccccacgcggaagcgcucccucagcuccgacaagcggcuggcggccauccagcagguccugaacgcccagaagaucagcuuccuccugcgcgggggcgugcgggugcugguggcccuccgcgacaccggcaccggggccgagcagcugggcgggggcgggggcuacugggcgguggucgugcuguucgugaucggccucuucgccgccggggccuucauccuguacaaguucaagcggaagcgccccggccgcaccgucuacgcccagaugcacaacgagaaggagcaggagaugacgucccccgugagccacuccgaggacgugcagggggcgguccagggcaaccacagcgggguggugcuguccaucaacagccgggagaugcacuccuaccucgucagcuga

SEQ ID NO: 36913 - RNA, 3669 nt, Artificial Sequence
  derived and/or modified sequence opt1 from SORCS3__Homo_sapiens__NP_055793
auggaggccgcccgcaccgagcggcccgcgggccgcccgggggcgccccuggugcggaccggccuccugcugcucagcacguggguccuggccggggccgagaucaccugggacgccaccggcgggcccggccgccccgccgccccggccucccggccgcccgcccugagcccccucagcccccgcgcgguggccucccaguggcccgaggagcuggccuccgcccggcgcgccgcggugcugggccggcgcgccgggcccgagcuccugccccagcagggcgggggccgcgggggcgagaugcaggucgaggccggcgggaccagcccggccggcgagcggcgggggcgcggcauccccgcccccgcgaagcugggcggggcccggcgcucccggcgcgcccagcccccgaucacgcaggagcggggcgacgccugggccaccgcgcccgccgacgggagccgcggcucccggccccucgccaaggggagccgcgaggaggugaaggcgccccgcgccggcggcuccgccgccgaggaccugcggcugccgagcaccuccuucgcccucaccggggacagcgcccacaaccaggcgauggugcacugguccggccacaacagcuccgucauccugauccugacgaagcucuacgacuucaaccuggggagcgugaccgaguccagccuguggcgcagcaccgacuacggcaccacguacgagaagcucaacgacaagguggggcugaagaccguccuguccuaccucuacgugaaccccaccaacaagcggaagaucaugcugcugagcgaccccgagauggaguccagcauccucaucuccagcgacgagggcgccaccuaccagaaguaccgccugacguucuacauccagucccuccuguuccaccccaagcaggaggacugggugcuggccuacagccuggaccagaagcucuacuccagcauggacuucggccggcgcuggcagcugaugcacgagcggaucaccccgaaccgcuucuacugguccgucgccgggcuggacaaggaggccgaccucgugcacauggaggugcggaccaccgacggcuacgcgcacuaccugacgugccgcauccaggagugcgccgagaccacccggagcgggcccuucgcccgcuccaucgacaucagcucccuggucgugcaggacgaguacaucuucauccaggugaccacgagcggccgggccuccuacuacgucagcuaccgccgggaggccuucgcgcagaucaagcuccccaaguacucccugcccaaggacaugcacaucaucagcaccgacgagaaccagguguucgccgccgugcaggaguggaaccagaacgacaccuacaaccuguacaucagcgacacccgcgggaucuacuucacgcucgccauggagaacaucaaguccagccggggccugaugggcaacaucaucaucgagcuguacgaggucgccgggaucaagggcaucuuccucgcgaacaagaagguggacgaccaggugaagaccuacaucaccuacaacaaggggcgcgacuggcggcugcugcaggccccggacgucgaccuccgcggcucccccgugcacugccugcugcccuucugcagccugcaccuccaccuccagcuguccgagaacccguacagcuccggccgcaucagcuccaaggagaccgcccccgggcuggucguggccacgggcaacaucgggcccgagcugagcuacaccgacaucggcguguucaucuccagcgacgggggcaacaccuggcggcagaucuucgacgaggaguacaacgucugguuccuggacuggggcggggcgcucguggccaugaagcacacgccccugccggugcgccaccugugggucuccuucgacgagggccacagcugggacaaguacggguucaccuccgugccccucuucguggacggcgcccuggucgaggccgggauggagacccacaucaugaccguguucggccacuucagccugcgguccgaguggcagcucgugaaggucgacuacaagagcaucuucagccgccacugcaccaaggaggacuaccagaccuggcaccuccugaaccagggcgagcccugcgugaugggggagcggaagaucuucaagaagcgcaagcccggcgcccagugcgcgcuggggcgggaccacuccggcagcguggucuccgagccgugcgugugcgccaacugggacuucgagugcgacuacggguacgagcgccacggcgagagccagugcgugcccgccuucugguacaaccccgccucccccagcaaggacugcucccugggccagagcuaccugaacuccacgggguaccggcgcaucgucagcaacaacugcaccgacggccuccgggagaaguacaccgccaaggcgcagaugugcccggggaaggcgccccgcggccugcacguggugaccacggacgggcggcuggucgccgagcagggccacaacgccaccuucaucauccucauggaggagggcgaccugcagcgcaccaacauccagcuggacuucggggacggcaucgccguguccuacgccaacuucagccccaucgaggacgggaucaagcacguguacaaguccgccggcaucuuccaggucaccgccuacgccgagaacaaccucggcagcgacacggcggugcuguuccugcacguggucugccccguggagcacgugcaccuccgggucccguucguggccauccgcaacaaggaggugaacaucuccgccgucguguggcccagccagcuggggacccugaccuacuucuggugguucggcaacuccaccaagccccucaucacgcuggacagcuccaucagcuucaccuuccuggccgaggggaccgacaccaucacggugcaggucgccgcgggcaacgcccucauccaggacaccaaggagaucgccgugcacgaguacuuccagagccagcugcuguccuucagccccaaccucgacuaccacaacccggacauccccgaguggcggaaggacaucgggaacgugaucaagcgcgcccuggucaaggugaccuccgugcccgaggaccagauccugaucgccgucuuccccggccucccgaccagcgcggagcuguucauccugccgcccaagaaccucacggagcggcgcaagggcaacgagggggaccuggagcagaucguggagacccuguucaacgcccucaaccagaaccuggugcaguucgagcugaagcccggcguccaggugaucguguacgucacccagcucacccuggcgccccugguggacuccagcgccgggcacuccagcuccgccaugcucaugcugcugagcguggucuucgugggccucgccgucuuccugaucuacaaguucaagcggaagauccccuggaucaacaucuacgcccaggugcagcacgacaaggagcaggagaugaucggguccgugagccaguccgagaacgcccccaagaucacgcugagcgacuucaccgagccggaggagcuccuggacaaggagcuggacacccgcgucaucggcggcaucgccaccaucgccaacuccgagagcacgaaggagauccccaacugcaccuccguguga

SEQ ID NO: 36914 - RNA, 1074 nt, Artificial Sequence
  derived and/or modified sequence opt1 from SORD__Homo_sapiens__NP_003095
auggccgccgcggccaagcccaacaaccugagccucgugguccacggcccgggggaccugcgccuggagaacuaccccauccccgagcccggcccgaacgaggugcuccugcggaugcacuccguggggaucugcggcagcgacguccacuacugggaguacgggcgcaucggcaacuucaucgugaagaagcccauggugcugggccacgaggccuccgggaccgucgagaaggugggcagcuccgugaagcaccucaagcccggggaccgggucgccaucgagcccggcgccccgcgcgagaacgacgaguucugcaagauggggcgguacaaccugagccccuccaucuucuucugcgcgaccccgcccgacgacggcaaccugugccgcuucuacaagcacaacgccgccuucugcuacaagcuccccgacaacgugacguucgaggagggcgcccugaucgagccccugagcguggggauccacgcgugccggcgcggcggggucacccucggccacaaggugcuggugugcggcgccgggcccaucggcauggucacccugcucguggccaaggccaugggggccgcccagguggucgugaccgaccuguccgcgacgcggcugagcaaggccaaggagaucggcgccgaccucgugcugcagaucuccaaggagagcccccaggagaucgcccgcaaggucgaggggcagcugggcugcaagccggaggugaccaucgagugcaccggcgcggaggccuccauccaggccgggaucuacgccacccggagcggcgggaaccucgugcuggucggccugggguccgagaugacgaccgugccccuccugcacgccgcgauccgcgaggucgacaucaagggcguguuccgguacugcaacaccuggcccguggccaucagcaugcuggccuccaagagcgucaacgugaagccccucgugacccaccgcuucccgcuggagaaggcccuggaggccuucgagacguucaagaagggccucgggcugaagaucaugcugaagugcgaccccuccgaccagaaccccuga

SEQ ID NO: 36915 - RNA, 6645 nt, Artificial Sequence
  derived and/or modified sequence opt1 from SORL1__Homo_sapiens__NP_003096
auggccacccggagcagccggcgcgagagccggcugcccuuccucuucacccugguggcccugcucccgcccggcgcccugugcgaggucuggacccagcgccugcacggcggcagcgcgccccugccccaggaccggggguuccugguggugcagggcgacccccgcgagcugcggcucugggcccgcggggacgcccggggcgccagccgcgccgacgagaagccccugcggcgcaagcggagcgccgcccugcagcccgagcccaucaaggucuacggccaggugagccucaacgacagccacaaccagauggugguccacugggccggggagaaguccaacgugaucguggcgcuggcccgcgacagccuggcccucgcccggcccaagagcuccgacgucuacgugagcuacgacuacggcaaguccuucaagaagaucagcgacaagcugaacuucgggcugggcaaccgcuccgaggccgugaucgcgcaguucuaccacagccccgccgacaacaagcgguacaucuucgccgacgccuacgcccaguaccucuggaucaccuucgacuucugcaacacccugcagggguucuccauccccuuccgcgcggccgaccugcuccugcacagcaaggccuccaaccugcuccugggcuucgaccggagccaccccaacaagcagcuguggaaguccgacgacuucggccagaccuggaucaugauccaggagcacgucaaguccuucagcugggggaucgaccccuacgacaagcccaacaccaucuacaucgagcgccacgagcccuccggcuacagcaccguguuccgguccaccgacuucuuccagagccgcgagaaccaggaggugauccucgaggagguccgcgacuuccagcugcgggacaaguacauguucgccaccaagguggugcaccuccucggguccgagcagcagagcuccguccagcugugggugagcuucggccgcaagcccaugcgggccgcgcaguucgugacgcgccaccccaucaacgaguacuacaucgccgacgccuccgaggaccaggucuucgugugcgugagccacuccaacaaccggaccaaccuguacaucagcgaggccgagggccucaaguucucccugagccuggagaacguccucuacuacucccccgggggcgccgggagcgacacccuggugcgcuacuucgcgaacgagcccuucgccgacuuccaccgggucgagggccugcaggggguguacaucgccacccucaucaacggcuccaugaacgaggagaacaugcgcagcgugaucaccuucgacaagggcgggaccugggaguuccugcaggcccccgcguucaccggcuacggggagaagaucaacugcgagcugagccagggcugcucccuccaccuggcccagcggcugagccagcuccugaaccugcagcuccgccggaugccgauccuguccaaggagagcgcccccgggcugaucaucgccaccggcuccgucggcaagaaccuggccagcaagacgaacguguacaucuccagcuccgcgggggcccgcuggcgggaggcccuccccggcccccacuacuacaccuggggcgaccacggcgggaucaucaccgccaucgcccagggcauggagaccaacgagcugaaguacagcacgaacgagggcgagaccuggaagaccuucaucuucuccgagaagccgguguucgucuacgggcugcucaccgagcccggcgagaaguccacgguguucaccaucuucggguccaacaaggagaacgugcacagcuggcugauccugcaggucaacgcgaccgacgcccucggcgugcccugcaccgagaacgacuacaagcuguggucccccagcgacgagcgcggcaacgagugccugcucgggcacaagacgguguucaagcggcgcaccccgcacgcgaccugcuucaacggcgaggacuucgaccggcccgucgugguguccaacugcagcugcacccgcgaggacuacgagugcgacuucggguucaagaugagcgaggaccugucccuggaggucugcgugcccgacccggaguucagcggcaaguccuacuccccgcccgugcccugcccggucggguccacguaccggcgcacccgcggcuaccggaagaucagcggcgacacgugcuccgggggcgacguggaggcccgccucgagggggagcuggugcccugcccccuggccgaggagaacgaguucauccucuacgcgguccgcaagagcaucuaccgcuacgaccuggccuccggcgccaccgagcagcugccccucacggggcugcgggccgcgguggcccuggacuucgacuacgagcacaacugccucuacuggagcgaccuggcccuggacgugauccagcgccucugccugaacggcuccaccggccaggaggucaucaucaacagcgggcuggagaccguggaggcccucgccuucgagccgcugucccagcugcucuacuggguggacgcgggcuucaagaagaucgaggucgccaaccccgacggggacuuccggcugaccaucgugaacagcuccgugcuggaccgcccccgggcccucguccuggugccccaggagggcgugauguucuggaccgacuggggcgaccugaagccgggcaucuaccgcagcaacauggacggcuccgccgccuaccaccucgucagcgaggacgugaaguggcccaacgggaucuccguggacgaccaguggaucuacuggacggacgcguaccuggagugcaucgagcggaucaccuucagcggccagcagcgcagcgucauccuggacaaccucccccaccccuacgccaucgccguguucaagaacgagaucuacugggacgacuggucccagcugagcaucuuccgggccuccaaguacagcgggucccagauggagauccuggccaaccagcucaccggccugauggacaugaagaucuucuacaaggggaagaacaccggcagcaacgcgugcgugccgcgccccugcucccugcucugccugcccaaggccaacaacagccgguccugccgcugccccgaggacgucagcuccagcgugcugccguccggcgaccucaugugcgacugcccccagggguaccagcugaagaacaacacgugcgugaaggaggagaacacgugccugcggaaccaguaccgcugcagcaacggcaacugcaucaacuccaucugguggugcgacuucgacaacgacugcggggacaugagcgacgagcggaacugccccaccaccaucugcgaccucgacacgcaguuccgcugccaggaguccgggaccugcaucccccugagcuacaagugcgaccuggaggacgacugcggcgacaacuccgacgagagccacugcgagaugcaccagugccggagcgacgaguacaacugcuccagcgggaugugcauccgcuccagcugggucugcgacggcgacaacgacugccgcgacugguccgacgaggccaacugcaccgccaucuaccacacgugcgaggcgagcaacuuccagugccggaacgggcacugcaucccgcagcgcugggccugcgacggcgacacggacugccaggacggguccgacgaggaccccgugaacugcgagaagaagugcaacggcuuccggugccccaacgggaccugcaucccgagcuccaagcacugcgacgggcuccgcgacugcagcgacggcuccgacgagcagcacugcgagccccugugcacccacuucauggacuucgugugcaagaaccggcagcagugccuguuccacagcauggucugcgacgggaucauccagugccgcgacggcuccgacgaggacgccgccuucgccgggugcagccaggaccccgaguuccacaaggugugcgacgaguucggcuuccagugccagaacggcgugugcaucucccucaucuggaagugcgacgggauggacgacugcggcgacuacagcgacgaggcgaacugcgagaaccccaccgaggccccgaacugcucccgguacuuccaguuccgcugcgagaacgggcacugcauccccaaccgguggaagugcgaccgcgagaacgacugcggcgacuggagcgacgagaaggacugcggggacucccacauccugcccuucagcacgcccggcccguccacgugccugcccaacuacuaccggugcuccagcgggaccugcgucauggacaccugggugugcgacggguaccgcgacugcgccgacggcuccgacgaggaggccugcccccuccuggccaacgugaccgcggccagcacccccacccagcuggggcggugcgaccgcuucgaguucgagugccaccagccgaagaccugcauccccaacuggaagcggugcgacggccaccaggacugccaggacggccgcgacgaggccaacugccccacgcacuccacccugaccugcaugagccgggaguuccagugcgaggacggggaggccugcaucguccuguccgagcgcugcgacggcuuccuggacugcagcgacgaguccgacgagaaggccugcagcgacgagcucaccguguacaagguccagaaccugcaguggacggcggacuucuccggggacgugacccugaccuggaugcggcccaagaagaugccgagcgccuccugcguguacaacgucuacuaccgcguggugggcgagagcaucuggaagacccucgagacgcacuccaacaagaccaacaccguccugaaggugcugaagcccgacaccacguaccaggugaagguccaggugcagugccucagcaaggcccacaacaccaacgacuucgugacccugcgcacccccgaggggcugcccgacgccccgcggaaccuccagcugucccugccccgcgaggccgagggcgucaucgugggccacugggcgccgcccauccacacccacgggcucauccgggaguacaucguggaguacagccgcuccggcagcaagaugugggccagccagcgggccgccuccaacuucacggagaucaagaaccugcuggucaacacccucuacaccgugcgcguggcggccgucaccagccgggggaucggcaacugguccgacagcaaguccaucacgaccaucaaggggaaggugaucccgccgcccgacauccacaucgacagcuacggcgagaacuaccuguccuucacccugaccauggagagcgacaucaaggugaacggcuacgucgugaaccucuucugggccuucgacacgcacaagcaggagcgccggacccugaacuuccgcggguccauccugagccacaaggugggcaaccucaccgcccacaccuccuacgagaucagcgccugggcgaagacggaccugggggacagcccccucgccuucgagcacgucaugacccggggcgugcgcccgcccgcccccagccucaaggccaaggccaucaaccagaccgcgguggagugcaccuggacggggccgcggaacgucguguacggcaucuucuacgccaccuccuuccuggaccuguaccgcaaccccaagagccucaccaccucccugcacaacaagacggugaucgucagcaaggacgagcaguaccuguuccuggugcggguggucgugcccuaccagggccccuccagcgacuacguggucgugaagaugaucccggacagccgccugccgccccggcaccuccacgugguccacaccgggaagaccuccguggugaucaagugggagagccccuacgacuccccggaccaggaccugcucuacgccaucgccgucaaggaccugauccgcaagaccgaccggagcuacaaggugaagucccgcaacagcacgguggaguacacccugaacaagcucgagcccggcgggaaguaccacaucaucguccagcugggcaacauguccaaggacagcuccaucaagaucaccaccgugagccuguccgcccccgacgcgcucaagaucaucacggagaacgaccacgugcugcuguucuggaagucccucgcccugaaggagaagcacuucaacgagucccggggguacgagauccacauguucgacagcgccaugaacaucaccgccuaccugggcaacaccaccgacaacuucuucaagaucuccaaccucaagaugggccacaacuacacguucaccguccaggcgcgcugccuguucgggaaccagaucugcggcgagcccgccauccugcucuacgacgagcuggggagcggcgccgacgccuccgccacccaggcggcccgcagcaccgacguggccgccguggucgugccgauccuguuccucauccugcugagccucggcgucggguucgccauccuguacacgaagcaccggcgccugcaguccagcuucaccgcguucgccaacucccacuacagcucccggcucggcagcgccaucuucuccagcggggacgaccugggcgaggacgacgaggacgcccccaugaucaccggguucuccgacgacgugcccauggugaucgccuga

SEQ ID NO: 36916 - RNA, 4002 nt, Artificial Sequence
  derived and/or modified sequence opt1 from SOS1__Homo_sapiens__NP_005624
augcaggcccagcagcugcccuacgaguucuucagcgaggagaacgccccgaaguggcgcggccuccuggugcccgcgcugaagaagguccaggggcaggugcaccccacccucgaguccaacgacgacgcccugcaguacguggaggagcugauccuccagcugcugaacaugcucugccaggcccagccccggagcgccuccgacgucgaggagcgcgugcagaagagcuucccgcaccccaucgacaagugggccaucgcggacgcccaguccgccaucgagaagcggaagcgccggaacccccugagccugcccguggagaagauccacccgcuccugaaggagguccugggcuacaagaucgaccaccagguguccguguacaucgucgccgugcucgaguacaucagcgcggacauccugaagcugguggggaacuacguccgcaacauccggcacuacgagaucaccaagcaggacaucaagguggccaugugcgccgacaaggugcucauggacauguuccaccaggacgucgaggacaucaacauccugucccugacggacgaggagcccagcaccuccggcgagcagaccuacuacgaccucgugaaggccuucauggccgagauccgccaguacauccgggagcugaaccugaucaucaagguguuccgcgagcccuucgucagcaacuccaagcucuucagcgcgaacgacguggagaacaucuucucccggaucguggacauccacgagcugagcgucaagcugcucgggcacaucgaggacaccguggagaugacggacgagggcuccccccacccgcuggugggcagcugcuucgaggaccuggccgaggagcucgccuucgaccccuacgaguccuacgcccgcgacauccugcggcccggguuccacgaccgcuuccugagccagcucagcaagcccggcgccgcgcuguaccugcaguccaucggggagggcuucaaggaggccguccaguacgugcucccgcggcugcugcucgcccccgucuaccacugccugcacuacuucgagcugcucaagcagcuggaggagaagagcgaggaccaggaggacaaggagugccugaagcaggccaucaccgcccuccugaacgugcaguccgggauggagaagaucugcagcaagucccuggcgaagcgccggcucagcgaguccgccugccgcuucuacagccagcagaugaagggcaagcagcuggccaucaagaagaugaacgagauccagaagaacaucgacggcugggaggggaaggacaucggccagugcugcaacgaguucaucauggaggggacccugacccgggugggcgccaagcacgagcgccacaucuuccuguucgacggccucaugaucugcugcaaguccaaccacgggcagccccggcugcccggcgccagcaacgcggaguaccgccugaaggagaaguucuucaugcgcaagguccagaucaacgacaaggacgacacgaacgaguacaagcacgccuucgagaucauccucaaggacgagaacuccgugaucuucagcgccaaguccgccgaggagaagaacaacuggauggcggcccugaucagccugcaguaccgguccacccucgagcgcaugcuggacgugaccaugcugcaggaggagaaggaggagcagaugcggcucccgagcgccgacgucuaccgcuucgccgagcccgacuccgaggagaacaucaucuucgaggagaacaugcagcccaaggccgggauccccaucaucaaggcgggcaccgugaucaagcugaucgagcggcugacguaccacauguacgccgacccgaacuucgugcgcaccuuccucaccaccuaccggagcuucugcaagccccaggagcugcugucccucaucaucgagcgcuucgagauccccgagcccgagccgacggaggccgaccggaucgccaucgagaacggggaccagccccugagcgccgagcugaagcgcuuccggaaggaguacauccagcccguccagcuccgcgugcugaacgugugccggcacugggucgagcaccacuucuacgacuucgagcgcgacgcguaccugcuccagcggauggaggaguucaucggcaccgugcgcggcaaggccaugaagaaguggguggagagcaucaccaagaucauccagcggaagaagaucgcccgcgacaacgggccgggccacaacaucaccuuccaguccagcccccccacggucgaguggcacaucucccggcccgggcacaucgagaccuucgaccugcugacccuccacccgaucgagaucgcccgccagcugacccugcucgagagcgaccuguaccgcgccgugcagcccuccgagcuggugggcagcgucuggacgaaggaggacaaggagaucaacucccccaaccuccugaagaugauccggcacaccaccaaccugacccucugguucgagaagugcaucguggagacggagaaccuggaggagcgcguggcggucgugagccggaucaucgagauccugcagguguuccaggagcucaacaacuucaacgggguccuggaggugguguccgccaugaacagcucccccgucuaccgccuggaccacaccuucgagcagaucccgagccggcagaagaagauccucgaggaggcccacgagcuguccgaggaccacuacaagaaguaccuggccaagcuccgcagcaucaacccccccugcgugcccuucuucggcaucuaccugaccaacauccugaagaccgaggagggcaacccggaggugcucaagcggcacgggaaggagcugaucaacuucuccaagcgccggaaggucgcggagaucacgggcgagauccagcaguaccagaaccagcccuacugccugcgcguggagagcgacaucaagcgguucuucgagaaccucaaccccauggggaacuccauggagaaggaguucaccgacuaccuguucaacaagagccuggagaucgagccccgcaacccgaagccccucccccgguuccccaagaaguacagcuacccgcugaagucccccggcgugcgccccagcaacccccggccggggaccaugcgccaccccaccccccugcagcaggagccgcggaagaucuccuacagccgcauccccgaguccgagacggagagcaccgccuccgcccccaacagcccccggaccccgcucacccccccccccgccuccggcgccagcuccaccacggacgucugcagcguguucgacuccgaccacagcuccccguuccacagcuccaacgacaccguguucauccaggucacccugccccacggcccccgcagcgcguccgugagcagcaucucccugaccaaggggacggacgaggugcccgucccgccccccgugcccccgcggcgccgccccgagagcgcccccgccgaguccagccccuccaagaucaugagcaagcaccucgacuccccgcccgccauccccccccggcagccgaccagcaaggccuacuccccccgcuacagcaucuccgaccggaccagcaucuccgacccccccgagagcccgccccugcugcccccgcgcgagcccgugcggacccccgacgucuucuccagcuccccccuccaccugcagccgcccccccugggcaagaagagcgaccacgggaacgcguucuuccccaacuccccgagccccuucacgccccccccgccccagacccccagcccccacggcacccgccggcaccucccgucccccccccugacccaggagguggaccugcacagcaucgccggccccccggugcccccccgccaguccacgagccagcacauccccaagcucccgcccaagaccuacaagcgggagcacacccaccccuccaugcaccgcgacgggcccccgcugcuggagaacgcccacagcuccuga

SEQ ID NO: 36917 - RNA, 3999 nt, Artificial Sequence
  derived and/or modified sequence opt1 from SOS2__Homo_sapiens__NP_008870
augcagcaggcgccccagcccuacgaguucuucagcgaggagaacucccccaaguggcgcggccugcugguguccgcccugcggaaggugcaggagcagguccaccccacccuguccgccaacgaggagucccucuacuacaucgaggagcugaucuuccagcugcucaacaagcugugcauggcccagccccgcaccgugcaggacgucgaggagcgggugcagaagaccuucccccaccccaucgacaagugggccaucgccgacgcccaguccgcgaucgagaagcgcaagcggcgcaacccccugcuccugcccguggacaagauccaccccucccugaaggagguccucggguacaagguggacuaccacgugucccuguacaucgucgccgugcuggaguacaucuccgccgacauccucaagcuggccggcaacuacguguucaacauccggcacuacgagaucucccagcaggacaucaaggucagcaugugcgccgacaaggugcugauggacauguucgaccaggacgacaucgggcucgugucccugugcgaggacgagcccagcuccagcggcgagcugaacuacuacgaccucguccgcaccgagaucgccgaggagcggcaguaccugcgcgagcugaacaugaucaucaagguguuccgggaggccuuccucuccgaccgcaagcuguucaagcccagcgacaucgagaagaucuucuccaacaucagcgacauccacgagcugaccgugaagcuccuggggcugaucgaggacaccgucgagaugaccgacgaguccagcccccacccccucgccggcagcugcuucgaggaccuggccgaggagcaggcguucgaccccuacgagacccugucccaggacauccucagccccgaguuccacgagcacuucaacaagcugauggcccggcccgccguggcccugcacuuccaguccaucgccgacggcuucaaggaggcggugcgcuacguccucccccggcugaugcuggugcccguguaccacugcuggcacuacuucgagcuccugaagcagcugaaggccugcagcgaggagcaggaggaccgcgagugccucaaccaggccaucaccgcccugaugaaccugcagggguccauggaccggaucuacaagcaguacagcccccgccggcgccccggcgaccccgucugccccuucuacucccaccagcuccggagcaagcaccuggccaucaagaagaugaacgagauccagaagaacaucgacgggugggagggcaaggacaucgggcagugcugcaacgaguucaucauggagggcccccugacccgcaucggcgcgaagcacgagcgccacaucuuccucuucgacgggcugaugaucuccugcaagcccaaccacggccagacccggcugcccggguacagcuccgccgaguaccgccugaaggagaaguucgugaugcggaagauccagaucugcgacaaggaggacacgugcgagcacaagcacgccuucgagcucgucagcaaggacgagaacuccaucaucuucgccgccaagagcgcggaggagaagaacaacuggauggccgcccugaucucccugcacuaccgcagcacccucgaccggaugcuggacuccgugcugcucaaggaggagaacgagcagccccugcgccugcccagccccgagguguaccgguucgucgugaaggacuccgaggagaacaucguguucgaggacaaccuccagagccgcagcggcaucccgaucaucaagggcgggaccgucgugaagcugaucgagcggcugaccuaccacauguacgccgaccccaacuucgugcgcaccuuccucaccaccuaccgguccuucugcaagccccaggagcugcugagccuccugaucgagcgcuucgagaucccggagcccgagcccacggacgcggacaagcuggccaucgagaagggcgagcagcccaucuccgccgaccucaagcgguuccgcaaggaguacguccagccggugcagcugcggauccugaacguguuccgccacugggucgagcaccacuucuacgacuucgagcgggaccucgagcugcuggagcgccucgagagcuucaucuccagcgugcgggggaaggccaugaagaaguggguggaguccaucgccaagaucauccgccgcaagaagcaggcgcaggccaacggcgucagccacaacaucaccuucgagagcccgccgccgcccaucgaguggcacaucagcaagcccgggcaguucgagaccuucgaccugaugacccugcaccccaucgagaucgcccggcagcucacgcugcuggaguccgaccucuaccgcaaggugcagcccagcgagcuggugggcuccgucuggaccaaggaggacaaggagaucaacagccccaaccugcucaagaugauccggcacaccaccaaccugacgcugugguucgagaagugcaucguggaggccgagaacuucgaggagcgcguggccguccucucccggaucaucgagauccuccagguguuccaggaccugaacaacuucaacggcgugcucgagaucgucagcgcggugaacuccgugagcgucuaccgccuggaccacaccuucgaggcccugcaggagcggaagcgcaagauccucgacgaggccguggagcugagccaggaccacuucaagaaguaccuggugaagcucaaguccaucaacccgcccugcguccccuucuucgggaucuaccugaccaacauccugaagaccgaggagggcaacaacgacuuccucaagaagaaggggaaggaccugaucaacuucagcaagcggcgcaagguggccgagaucacgggcgagauccagcaguaccagaaccagccguacugccugcggaucgagcccgacaugcgccgguucuucgagaaccucaaccccaugggguccgccagcgagaaggaguucaccgacuaccuguucaacaagucccuggagaucgagccccgcaacugcaagcagccgccccgguucccccgcaagagcaccuucucccucaagagccccggcauccggccgaacaccggccgccacggguccacgagcggcacccugcgggggcaccccacgccccuggagcgcgagccgugcaagaucuccuucagccggaucgcggagaccgagcucgaguccacggugagcgcccccaccucccccaacacccccagcaccccgcccgucuccgccagcuccgaccugagcguguuccuggacguggaccucaacagcuccugcggcagcaacuccaucuucgcccccguccugcugccccacagcaaguccuucuucagcuccugcgggagccuccacaagcuguccgaggagccgcugaucccgccgccccugccgccccgcaagaaguucgaccacgacgcgagcaacuccaagggcaacaugaaguccgacgacgacccgcccgccaucccgccccgccagccgcccccgcccaaggugaagccccgggugcccguccccaccggcgccuucgacgggccccugcacagcccgcccccgcccccgccccgcgacccccugcccgacacgcccccgcccgugccccuccggccgcccgagcacuucaucaacugccccuucaaccugcagcccccgccccugggccaccuccaccgcgacagcgacuggcugcgggacaucuccacgugccccaacagccccagcaccccgcccagcacccccagcccccgcgugccccggcgcugcuacguccugagcagcucccagaacaaccucgcccacccgcccgcgccgcccgugccgccccggcagaacagcagcccccaccuccccaagcugccgcccaagacguacaagcgcgagcucagccacccgccccuguaccggcugccccuccuggagaacgcggagacgccccaguga

SEQ ID NO: 36918 - RNA, 621 nt, Artificial Sequence
  derived and/or modified sequence opt1 from SOSTDC1__Homo_sapiens__NP_056279
augcugcccccggccauccacuucuaccuccugccccuggccugcauccucaugaaguccugccuggcguucaagaacgacgccaccgagauccuguacucccacguggucaagcccgugcccgcccacccgagcuccaacagcacccucaaccaggcccgcaacggcgggcggcacuucuccaacacgggccuggaccgcaacacccgggugcaggucgggugccgcgagcugcggagcaccaaguacaucuccgacggccagugcaccagcaucagcccccucaaggagcuggugugcgccggggagugccugccccuccccgugcugccgaacuggaucggcggcggguacggcacgaaguacuggagccgccgguccagccaggaguggcgcugcgucaacgacaagacccggacccagcgcauccagcugcagugccaggacggguccacccggacguacaagaucaccguggugaccgcgugcaagugcaagcgcuacacccggcagcacaacgagagcucccacaacuucgagagcaugucccccgccaagcccguccagcaccaccgcgagcggaagcgcgccagcaaguccagcaagcacagcauguccuga

SEQ ID NO: 36919 - RNA, 642 nt, Artificial Sequence
  derived and/or modified sequence opt1 from SOST__Homo_sapiens__NP_079513
augcagcugccccucgcccugugccuggugugccuccugguccacaccgccuuccgcgugguggagggccagggguggcaggcguucaagaacgacgccaccgagaucaucccggagcugggcgaguaccccgagcccccgcccgagcucgagaacaacaagacgaugaaccgggccgagaacgggggccgcccgccccaccaccccuucgagaccaaggacgucagcgaguacuccugccgggagcugcacuucacccgcuacgugaccgacgggcccugccggagcgccaagcccgugacggagcuggucugcuccggccagugcggccccgcccgccuccugcccaacgcgaucgggcggggcaagugguggcgcccgagcgggcccgacuuccggugcauccccgaccgcuaccgggcccagcgcgugcagcugcucugccccggcggggaggccccgcgggcccgcaaggugcggcuggucgcguccugcaagugcaagcgccugacccgguuccacaaccagagcgagcucaaggacuucggcaccgaggccgcccgcccccagaagggccggaagccccgcccccgggcccgcuccgccaaggcgaaccaggccgagcuggagaacgccuacuga

SEQ ID NO: 36920 - RNA, 1401 nt, Artificial Sequence
  derived and/or modified sequence opt1 from SOX10__Homo_sapiens__NP_008872
auggccgaggagcaggaccugagcgagguggagcucucccccgucggcagcgaggagccgcgcugccugucccccgggagcgcccccucccugggccccgacgggggcgggggcggcagcgggcuccgggcguccccgggccccggggagcugggcaaggugaagaaggagcagcaggacggggaggccgacgacgacaaguuccccgugugcauccgcgaggccgucagccaggugcuguccggcuacgacuggacccucgugcccaugccgguccgggugaacggcgccagcaaguccaagccccacgugaagcgccccaugaacgccuucauggucugggcgcaggccgcccggcgcaagcuggccgaccaguacccccaccuccacaacgcggagcucagcaagacccuggggaagcuguggcggcuccugaacgaguccgacaagcgcccguucaucgaggaggccgagcggcugcgcaugcagcacaagaaggaccaccccgacuacaaguaccagccccggcgccggaagaacggcaaggccgcccagggggaggccgagugccccggcggcgaggcggagcagggcgggacggccgccauccaggcccacuacaagagcgcccaccucgaccaccgccacccgggggagggcucccccaugagcgacgggaaccccgagcaccccuccggccagagccacggcccgcccaccccgcccaccacccccaagacggagcugcaguccgggaaggcggaccccaagcgggacggccgcagcaugggggagggcgggaagccccacaucgacuucggcaacguggacaucggcgagaucagccacgaggugauguccaacauggagaccuucgacgucgccgagcuggaccaguaccugcccccgaacgggcaccccggccacgugagcuccuacagcgccgccggguacggccugggguccgcccuggcgguggccagcggccacuccgccuggaucagcaagcccccgggcgucgcccuccccaccguguccccgcccgggguggacgccaaggcgcaggucaagaccgagacggccggcccccaggggccgccccacuacaccgaccagcccagcaccucccagaucgccuacaccagccugucccugccccacuacggcagcgccuuccccuccaucagccggccccaguucgacuacuccgaccaccagcccagcggcccguacuacgggcacuccggccaggcgagcgggcucuacagcgccuucuccuacaugggccccagccagcgcccccuguacacggccaucuccgaccccagcccguccgggccccagagccacucccccacccacugggagcagcccguguacaccacccugagccggccguga

SEQ ID NO: 36921 - RNA, 1326 nt, Artificial Sequence
  derived and/or modified sequence opt1 from SOX11__Homo_sapiens__NP_003099
auggugcagcaggccgagagccuggaggccgaguccaaccucccccgcgaggcgcuggacaccgaggagggcgaguucauggccugcagccccgucgcccuggacgaguccgaccccgacuggugcaagaccgccagcgggcacaucaagcggcccaugaacgccuucauggugugguccaagaucgagcgccggaagaucauggagcagagccccgacaugcacaacgcggagaucuccaagcgccucggcaagcgguggaagaugcugaaggacagcgagaagaucccguucauccgcgaggccgagcggcugcgccucaagcacauggccgacuaccccgacuacaaguaccggccccgcaagaagcccaagauggacccguccgccaagcccagcgcgucccagagccccgagaaguccgccgccgggggcgggggcggcagcgccgggggcggggccggcggggcgaagacguccaagggcagcuccaagaagugcggcaagcugaaggcccccgccgccgccggggcgaaggccggcgccgggaaggccgcccagagcggcgacuacggcggggcgggcgacgacuacgugcuggggucccuccgggucagcggcagcgggggcggcggggccggcaagaccgugaagugcguguuccuggacgaggacgacgacgacgacgacgacgacgacgagcugcagcuccagaucaagcaggagccggacgaggaggacgaggagccgccccaccagcagcugcugcagccgcccgggcagcagcccucccagcuccugcgccgguacaacgucgccaaggugcccgccagccccacccuguccagcuccgccgagagccccgagggcgcgucccucuacgacgaggugcgcgccggggccaccagcggcgccggcgggggcucccggcuguacuacagcuucaagaacaucacgaagcagcacccgccgccccuggcgcagcccgcccucucccccgccagcucccgcagcgucuccaccagcuccagcuccagcagcggguccagcuccggcagcuccggggaggacgccgacgaccugauguucgaccugagccucaacuucucccagagcgcccacuccgcgagcgagcagcagcugggcggcggggccgccgccggcaaccugucccucagccugguggacaaggaccuggacuccuucagcgaggggucccucggcagccacuucgaguuccccgacuacugcacccccgagcuguccgagaugaucgccggcgacuggcuggaggcgaacuucagcgaccucguguucaccuacuga

SEQ ID NO: 36922 - RNA, 948 nt, Artificial Sequence
  derived and/or modified sequence opt1 from SOX12__Homo_sapiens__NP_008874
auggugcagcagcgcggcgcccgggccaagcgcgacgggggcccgcccccgcccgggcccggccccgcggaggagggggcccgggagcccggcuggugcaagacccccagcggccacaucaagcgccccaugaacgccuucauggucuggucccagcacgagcggcgcaagaucauggaccaguggccggacaugcacaacgccgagaucagcaagcggcuggggcgccgguggcagcuccugcaggacuccgagaagauccccuucgugcgcgaggccgagcggcugcgccucaagcacauggcggacuaccccgacuacaaguaccggccccgcaagaaguccaagggcgccccggccaaggcccggccccgcccgcccgggggcagcgggggcggcagccggcugaagcccgggccccagcugcccggccgcgggggccggcgcgcggccggcgggccccucggcgggggcgccgccgccccggaggacgacgacgaggacgacgacgaggagcugcuggaggugcggcucgucgagacccccgggcgcgagcuguggcgcauggugcccgcgggccgggccgcccgcggccaggccgagcgggcccaggggcccuccggcgagggggcggccgccgccgccgcggccagcccgacgcccuccgaggacgaggagcccgaggaggaggaggaggaggccgccgccgcggaggagggcgaggaggagaccguggccagcggggaggagucccugggcuuccucagccgccugcccccgggccccgccgggcuggacugcuccgcccucgaccgggaccccgaccugcagccgcccagcggcaccucccacuucgaguuccccgacuacugcacccccgaggucacggagaugaucgcgggggacuggcgcccgagcuccaucgccgaccugguguucaccuacuga

SEQ ID NO: 36923 - RNA, 1869 nt, Artificial Sequence
  derived and/or modified sequence opt1 from SOX13__Homo_sapiens__NP_005677
augagcaugcgcagccccaucagcgcccagcuggcccucgacggcguggggaccauggucaacugcaccaucaaguccgaggagaagaaggagccgugccacgaggcgccccagggcagcgccacggccgccgagccccagcccggggacccggcccgggcgucccaggacagcgccgacccccaggcccccgcccagggcaacuuccgcggguccugggacugcagcucccccgagggcaacggcagcccggagcccaagcggcccgggguguccgaggcggccagcggcucccaggagaagcuggacuucaaccgcaaccugaaggaggugguccccgccaucgagaagcuccugagcuccgacuggaaggagcgguuccuggggcgcaacagcauggaggccaaggacgugaagggcacccaggagucccucgccgagaaggagcugcagcugcucgugaugauccaccagcugagcacccugcgggaccagcuccugaccgcgcacuccgagcagaagaacauggccgccaugcuguucgagaagcagcagcagcagauggagcucgcccgccagcagcaggagcagaucgccaagcagcagcagcagcugauccagcagcagcacaagaucaaccugcuccagcagcagauccagcaggucaacaugccguacgugaugauccccgcguucccgcccagccaccagccccugcccgugacgcccgacagccagcuggcccuccccauccagccgauccccugcaagcccgucgaguacccccugcagcugcuccacuccccgcccgcccccguggugaagcggcccggggccauggccacccaccacccgcugcaggagcccagccagccccugaaccucaccgcgaagccgaaggcccccgagcugcccaacaccuccagcucccccagccugaagauguccagcugcgucccgcgcccgcccucccacggcggccccacgcgggaccuccagagcuccccgcccagccugccccugggguuccucggcgagggggacgccgugaccaaggccauccaggacgcccgccagcugcugcacucccacagcggcgcgcucgacggcucccccaacacccccuuccggaaggaccugaucagccuggacuccagccccgccaaggagcgccucgaggacgggugcgugcacccccuggaggaggccaugcuguccugcgacauggacggcagccggcacuuccccgagagccgcaacuccagccacaucaagcggccgaugaacgccuucauggucugggcgaaggacgagcgccggaagauccuccaggccuuccccgacaugcacaacuccagcaucuccaagauccuggggagccgcuggaaguccaugaccaaccaggagaagcagcccuacuacgaggagcaggcccggcugagccgccagcaccucgagaaguaccccgacuacaaguacaagccgcgccccaagcggacgugcaucguggagggcaagcgccugcgggugggggaguacaaggcccugaugcgcacccggcgccaggacgcccggcaguccuacgucaucccgccccaggcgggccaggugcagaugagcuccagcgacgugcucuacccccgcgccgccggcaugccccuggcccagccccuggucgagcacuacgugccgcggucccuggaccccaacaugcccgugaucgucaacacgugcagccuccgcgaggagggggagggcaccgacgaccggcacuccguggccgacggggagauguaccgcuacagcgaggacgaggacuccgagggcgaggagaaguccgacggggagcuggucgugcugaccgacuga

SEQ ID NO: 36924 - RNA, 723 nt, Artificial Sequence
  derived and/or modified sequence opt1 from SOX14__Homo_sapiens__NP_004180
augagcaagcccuccgaccacaucaagcgcccgaugaacgccuucaugguguggagccggggccagcgccggaagauggcccaggagaaccccaagaugcacaacuccgagaucagcaagcgccugggggcggaguggaagcuccuguccgaggccgagaagcggcccuacaucgacgaggccaagcgccugcgggcccagcacaugaaggagcaccccgacuacaaguaccgcccgcggcgcaagcccaagaaccuccugaagaaggaccgguacgucuucccccugcccuaccucggcgacaccgacccgcugaaggccgcggggcugcccgugggcgccagcgacgggcuccuguccgcccccgagaaggcccgcgcguuccugcccccggccagcgcccccuacucccuccuggaccccgcccaguucagcuccagcgccauccagaagaugggcgaggugccccacacccuggcgacgggcgcccucccguacgccuccacccugggguaccagaacggcgccuucgggagccuguccugccccagccagcacacccacacccaccccucccccacgaacccgggcuacgucgugcccugcaacugcaccgccuggagcgcguccacccuccagccgcccguggccuacauccuguuccccgggaugaccaagacgggcaucgaccccuacagcagcgcccacgccaccgccauguga

SEQ ID NO: 36925 - RNA, 702 nt, Artificial Sequence
  derived and/or modified sequence opt1 from SOX15__Homo_sapiens__NP_008873
auggcccugcccggcagcucccaggaccaggccuggagccucgagccgcccgcggccaccgccgccgccuccagcuccagcgggccccaggagcgcgagggcgcggggucccccgccgccccgggcacccugccccuggagaaggugaagcggcccaugaacgccuucauggucuggagcuccgcgcagcgccggcagauggcccagcagaaccccaagaugcacaacagcgagaucuccaagcgccucggggcccaguggaagcugcuggacgaggacgagaagcggccguucguggaggaggccaagcgccuccgggcccgccaccuccgggacuaccccgacuacaaguaccgcccccggcgcaaggccaagagcuccggcgcgggccccagccggugcgggcagggccgcgggaaccuggccuccggcgggccgcuguggggccccggcuacgccacgacccagcccagccggggguucggcuaccggcccccguccuacagcaccgccuaccugcccggguccuacggcagcagccacugcaagcuggaggcgcccucccccugcagccucccgcaguccgacccccgccugcagggcgagcugcuccccaccuacacgcacuaccugcccccggggagccccacccccuacaacccgccccuggccggcgcccccaugccccucacccaccuguga

SEQ ID NO: 36926 - RNA, 1245 nt, Artificial Sequence
  derived and/or modified sequence opt1 from SOX17__Homo_sapiens__NP_071899
augagcucccccgacgccggcuacgccagcgacgaccagucccagacccagagcgcgcugccggccgugauggccgggcucggccccugccccugggccgagucccugagccccaucggggacaugaaggucaagggcgaggccccggcgaacuccggggcccccgccggcgccgcgggccgcgccaagggggagagccggauccgccggcccaugaacgccuucauggugugggccaaggacgagcgcaagcggcuggcccagcagaaccccgaccuccacaacgcggagcuguccaagaugcugggcaagagcuggaaggcccucacccuggccgagaagcgcccguucguggaggaggccgagcggcugcgcguccagcacaugcaggaccaccccaacuacaaguaccggccccgccggcgcaagcaggucaagcggcucaagcgcguggagggcggcuuccugcacgggcuggccgagccccaggcggccgcccucggcccggagggcgggcggguggccauggacggccuggggcugcaguuccccgagcagggcuuccccgccgggcccccgcuccugccgccccacaugggcgggcacuaccgcgacugccagucccugggggcgccgccccucgacggcuacccccugcccacgcccgacaccagcccccuggacgggguggaccccgaccccgccuucuucgccgcccccaugccgggcgacugccccgccgcgggcaccuacuccuacgcccaggugagcgacuacgccgggcccccggagccgcccgccggccccaugcacccccggcucgggcccgagcccgcgggccccuccaucccggggcugcuggccccgcccagcgcccuccacgucuacuacggcgccaugggcucccccggggccggcgggggccgcggguuccagaugcagccccagcaccagcaccagcaccagcaccagcaccacccgcccggccccggccagcccagcccgccgcccgaggcgcugcccugccgggacgggaccgaccccucccagcccgccgagcugcucggcgagguggaccgcacggaguucgagcaguaccugcacuucgugugcaagcccgagauggggcugcccuaccagggccacgacagcggcgucaaccuccccgacagccacggggccaucuccagcgugguguccgacgccagcuccgccgucuacuacugcaacuaccccgacguguga

SEQ ID NO: 36927 - RNA, 1155 nt, Artificial Sequence
  derived and/or modified sequence opt1 from SOX18__Homo_sapiens__NP_060889
augcagcgcagcccgcccggcuacggggcccaggacgacccgcccgcccggcgcgacugcgcgugggcccccggccacggggccgccgccgacacccggggccuggcggccgggcccgccgcccucgcggcccccgccgcccccgccuccccgcccagcccccagcgcuccccgccccggagccccgagcccggccgcuacggccugucccccgcggggcggggcgagcgccaggccgccgacgagagccggauccgccggcccaugaacgccuucauggugugggccaaggacgagcgcaagcggcuggcgcagcagaacccggaccuccacaacgccguccuguccaagaugcuggggaaggccuggaaggagcucaacgccgccgagaagcgccccuucguggaggaggcggagcggcugcgcgugcagcaccuccgggaccaccccaacuacaaguaccgcccccggcgcaagaagcaggcccggaaggcccgccgccuggagccgggccugcugcuccccgggcuggccccgccccagcccccgcccgagcccuuccccgccgcgagcggcuccgcccgggccuuccgcgagcugccgccccucggcgccgaguucgacgggcugggccugcccacccccgagcggagcccccucgacgggcuggagcccggcgaggcggccuucuucccgccgcccgccgcccccgaggacugcgcccugcgccccuuccgggcgcccuacgcccccacggagcucucccgcgaccccggcgggugcuacggcgccccgcuggccgaggcccugcggaccgcgccgcccgccgcgccccucgccgggcuguacuacggcacccuggggacccccggccccuaccccggcccccucagcccgccgcccgaggcgccgccccuggaguccgccgagccccuggggcccgccgccgaccucugggccgacgucgaccugacggaguucgaccaguaccugaacugcagccgcacccggcccgacgcccccggccuccccuaccacguggcccuggccaagcuggggccccgcgccauguccugcccggaggagagcucccucaucagcgcccuguccgacgcgagcagcgccguguacuacuccgccugcaucagcggcuga

SEQ ID NO: 36928 - RNA, 1176 nt, Artificial Sequence
  derived and/or modified sequence opt1 from SOX1__Homo_sapiens__NP_005977
auguacagcaugaugauggagaccgaccugcacucccccggcggggcccaggccccgaccaaccucagcggccccgcgggggccggcgggggcggcgggggcgggggcgggggcggcgggggcgggggcgccaaggccaaccaggaccgcgugaagcggcccaugaacgccuucauggucuggucccgcggccagcggcgcaagauggcgcaggagaaccccaagaugcacaacagcgagaucuccaagcggcugggggccgaguggaaggugaugagcgaggccgagaagcgcccguucaucgacgaggccaagcggcugcgcgcgcuccacaugaaggagcaccccgacuacaaguaccggccccgccggaagacgaagacccugcugaagaaggacaaguacucccucgccggcgggcugcuggccgccggcgccgggggcggcggggcggccguggccaugggcgucggggugggcgugggggccgccgcggucggccagcgccucgagagccccggcggggccgccggcgggggcuacgcccacgugaacgggugggccaacggcgcguacccgggcuccguggccgccgccgccgcggccgccgccaugaugcaggaggcgcagcuggccuacgggcagcaccccggcgccgggggcgcccacccccacgcccaccccgcgcacccgcacccccaccacccccacgcccacccccacaacccgcagcccaugcaccgguacgacaugggcgcccugcaguacagccccaucuccaacagccagggguacauguccgccagccccuccggcuacgggggccucccguacggggccgcggccgccgccgccgcggccgccggcggcgcccaccagaacagcgcggucgccgccgccgccgcggccgccgccgccuccagcggggcgcugggcgcccuggggucccucgucaagagcgagcccagcggcuccccgcccgcccccgcccacagccgcgcccccugccccggggaccugcgggagaugaucuccauguaccugcccgcgggcgagggcggggacccggccgccgccgcggccgccgccgcccagagccgccuccacucccugccccagcacuaccagggcgcgggggccggcgugaacgggaccgugccccugacccacaucuga

SEQ ID NO: 36929 - RNA, 831 nt, Artificial Sequence
  derived and/or modified sequence opt1 from SOX21__Homo_sapiens__NP_009015
augagcaagcccguggaccacgucaagcgcccgaugaacgccuucaugguguggucccgggcccagcgccggaagauggcgcaggagaaccccaagaugcacaacagcgagaucuccaagcgccugggcgccgaguggaagcuccugaccgagagcgagaagcggcccuucaucgacgaggccaagcgccugcgggccaugcacaugaaggagcaccccgacuacaaguaccgcccgcggcgcaagcccaagacccuccugaagaaggacaaguucgccuuccccgugcccuacgggcugggcggggucgcggacgccgagcacccggcccucaaggccggcgcggggcugcacgccggcgccggcgggggccuggugcccgagucccuccuggccaaccccgagaaggccgcggccgccgccgccgcggccgccgcccggguguucuucccccagagcgccgcggccgccgccgccgcggccgccgccgcggccgccggguccccguacagccugcucgaccugggcuccaagauggccgagaucagcuccagcuccagcgggcugcccuacgccuccagccucggcuaccccacggcgggcgccggggccuuccacggcgccgccgcggccgccgccgccgcggccgccgccgccgggggccacacccacucccaccccagcccgggcaaccccggguacaugauccccugcaacugcuccgcguggcccagcccgggccugcagccgccccuggccuacauccuccugcccgggaugggcaagccccagcuggaccccuaccccgccgccuacgcggccgcccucuga

SEQ ID NO: 36930 - RNA, 954 nt, Artificial Sequence
  derived and/or modified sequence opt1 from SOX2__Homo_sapiens__NP_003097
auguacaacaugauggagaccgagcugaagcccccgggcccccagcagaccagcgggggcgggggcgggaacuccacggccgccgcggccggcggcaaccagaagaacagccccgaccgcgugaagcggcccaugaacgccuucauggucuggucccgcgggcagcggcgcaagauggcccaggagaacccgaagaugcacaacagcgagaucuccaagcggcucggcgccgaguggaagcugcugagcgagaccgagaagcgccccuucaucgacgaggcgaagcggcuccgcgcccugcacaugaaggagcaccccgacuacaaguaccggccccgccggaagaccaagacccugaugaagaaggacaaguacacgcuccccgggggccugcuggcccccgggggcaacuccauggccagcggcgugggggugggcgcggggcucggcgccggcgucaaccagcgcauggacuccuacgcccacaugaacggguggagcaacggcuccuacagcaugaugcaggaccagcugggguacccccagcaccccggccugaacgcccacggggccgcgcagaugcagccgaugcaccgguacgacguguccgcccuccaguacaacagcaugaccuccagccagaccuacaugaacggcucccccaccuacagcauguccuacagccagcagggcacgcccgggauggcccugggcagcaugggguccguggucaagagcgaggccuccagcuccccgccgguggugaccagcuccagccacucccgcgcccccugccaggcgggcgaccugcgggacaugaucagcauguaccuccccggggccgagguccccgagccggccgcccccucccgccugcacaugagccagcacuaccaguccggccccgugcccggcaccgccaucaacgggacccugccgcucagccacauguga

SEQ ID NO: 36931 - RNA, 1341 nt, Artificial Sequence
  derived and/or modified sequence opt1 from SOX3__Homo_sapiens__NP_005625
augcgccccgugcgggagaacagcuccggcgcccgcagcccgcggguccccgccgaccuggcgcgcuccauccucaucagccugcccuuccccccggacucccuggcccaccggccccccagcuccgcccccaccgagagccaggggcucuucaccguggccgccccggcgcccggcgcccccucccccccggccacgcuggcccaccugcuccccgcgcccgccauguacagccugcuggagaccgagcucaagaaccccguggggaccccgacccaggccgccggcacggggggccccgccgcgcccggcggggccggcaaguccagcgccaacgccgccgggggcgcgaacuccgggggcggcagcuccgggggcgccagcgggggcggcgggggcaccgaccaggaccgcgucaagcggcccaugaacgccuucaugguguggucccgcgggcagcggcgcaagauggcccuggagaacccgaagaugcacaacagcgagaucuccaagcggcugggcgccgacuggaagcuccugaccgacgcggagaagcgccccuucaucgacgaggccaagcggcugcgcgccgugcacaugaaggaguaccccgacuacaaguaccggccccgccggaagaccaagacgcuccugaagaaggacaaguacagccugccgagcgggcuccugccccccggcgccgccgcggccgccgccgcggccgccgccgccgcggccgccgccuccagccccgucggcguggggcagcgccuggacaccuacacccacgugaacggcugggccaacggggcguacucccucguccaggagcagcugggcuacgcccagccgcccagcauguccagccccccgcccccccccgcccugccgcccaugcaccgguacgacauggccgggcuccaguacucccccaugaugcccccgggcgcccagagcuacaugaacguggcggccgccgccgcggccgccuccggcuacgggggcauggcccccagcgccaccgcggccgccgccgccgcguacgggcagcagcccgccacggccgccgccgcggccgccgccgcggccgccaugucccugggccccauggggagcguggucaaguccgagccgagcucccccccccccgccaucgccagccacucccagcgcgcgugccugggcgaccuccgggacaugaucagcauguaccugccgcccggcggggacgccgccgacgccgccuccccccugcccggcgggcgccuccacggcgugcaccagcacuaccagggcgcggggaccgccgugaacggcaccgucccgcugacccacaucuga

SEQ ID NO: 36932 - RNA, 1425 nt, Artificial Sequence
  derived and/or modified sequence opt1 from SOX4__Homo_sapiens__NP_003098
auggugcagcagaccaacaacgccgagaacaccgaggcccugcucgcgggcgagagcuccgacagcggggccggccuggagcuggggaucgccuccagccccacgccgggcuccaccgccagcaccgggggcaaggccgacgaccccuccuggugcaagacccccagcggccacaucaagcgccccaugaacgcguucauggucuggucccagaucgagcggcgcaagaucauggagcagagcccggacaugcacaacgccgagaucuccaagcggcucgggaagcgcuggaagcugcugaaggacagcgacaagauccccuucauccgggaggccgagcgccuccggcugaagcacauggccgacuaccccgacuacaaguaccgcccccggaagaaggugaaguccggcaacgcgaacagcuccagcuccgccgccgccagcuccaagccgggggagaagggcgacaaggucgggggcagcggcgggggcgggcacggcggcgggggcgggggcgggagcuccaacgccggcggcgggggcgggggcgcgagcgggggcggcgccaacuccaagcccgcccagaagaaguccugcgggagcaagguggccggcggggccggcgggggcgugagcaagccccacgcgaagcugauccucgccggcgggggcgggggcggcaaggccgccgccgcggccgccgccuccuucgccgcggagcaggccggggccgccgcgcugcugccccucggcgccgccgccgaccaccacagccuguacaaggcccgcacgccguccgcgagcgccuccgccagcuccgccgccagcgcguccgccgcccuggccgcccccgggaagcaccucgcggagaagaaggugaagcgggucuaccuguucggcgggcugggcaccagcuccagccccgugggcggggugggcgccggggccgaccccuccgacccgcucggccuguacgaggaggagggggccggcugcagccccgacgcgcccagccuguccggccgcagcuccgccgccagcucccccgccgccgggcggagcccggcggaccaccgcggcuacgccucccuccgggccgccagccccgcccccuccagcgcgcccucccacgccagcuccagcgccuccagccacuccagcagcuccagcuccagcggguccagcuccagcgacgacgaguucgaggacgaccugcuggaccucaacccguccagcaacuucgaguccaugagccugggcuccuucagcuccagcuccgcccuggaccgcgaccucgacuucaacuucgagcccgggagcggcucccacuucgaguuccccgacuacugcacccccgaggucagcgagaugaucagcggcgacuggcuggaguccagcaucuccaaccugguguucaccuacuga

SEQ ID NO: 36933 - RNA, 1929 nt, Artificial Sequence
  derived and/or modified sequence opt1 from SOX5__Homo_sapiens__NP_001248343
augagcuccaagcgccccgccagcccguacggcgaggccgacggggagguggcgauggucaccucccggcagaagguggaggaggaggagagcgacggccugcccgccuuccaccucccccugcacguguccuuccccaacaagccgcacagcgaggaguuccagcccgucucccugcugacccaggagacgugcgggcaccgcacccccaccagccagcacaacaccauggagguggacggcaacaaggugauguccagcuucgcgccccacaacuccagcacguccccgcagaaggccgaggagggcgggcggcagagcggcgagucccugagcuccaccgcccuggggacccccgagcgccggaagggcagccucgccgacgucguggacacccugaagcagcgcaagauggaggagcugaucaagaacgagcccgaggagacgcccuccaucgagaagcuccugagcaaggacuggaaggacaagcugcucgccauggggagcggcaacuucggggagaucaagggcaccccggagucccuggccgagaaggagcggcagcugaugggcaugaucaaccagcucaccagccugcgcgagcagcugcucgccgcgcacgacgagcagaagaagcuggccgccucccagaucgagaagcagcggcagcagauggagcuggccaagcagcagcaggagcagaucgcccgccagcagcagcagcuccugcagcagcagcacaagaucaaccugcuccagcagcagauccaggugcaggggcagcugccgccccugaugauccccgucuucccgcccgaccagcggacccucgcggccgccgcccagcagggcuuccugcugccgcccggguucagcuacaaggccggcugcuccgaccccuaccccgugcagcucauccccacgaccauggcggccgccgccgccgcgacccccggccuggggccgcugcagcuccagcagcuguacgccgcccagcuggccgccaugcaggucagccccggcgggaagcuccccggcaucccccaggggaaccugggcgcggccguguccccgaccagcauccacacggacaaguccaccaacagcccgccgcccaaguccaaggagaagaccacccuggagagccucacgcagcagcuggccgugaagcagaacgaggagggcaaguucucccacgccaugauggacuucaaccugagcggggacuccgacggcagcgcggggguguccgagagccgcaucuaccgggagucccgcggccgggggagcaacgagccccacaucaagcgccccaugaacgccuucauggucugggccaaggacgagcggcgcaagauccuccaggccuuccccgacaugcacaacagcaacaucuccaagauccugggcagccgguggaaggccaugaccaaccuggagaagcagcccuacuacgaggagcaggcgcgccucuccaagcagcaccuggagaaguaccccgacuacaaguacaagccccggcccaagcggaccugccugguggacggcaagaagcuccgcaucggggaguacaaggccaucaugcgcaaccgccggcaggagaugcgccaguacuucaacgugggccagcaggcccagauccccaucgccaccgccggggucguguaccccggcgcgaucgccauggccgggaugcccagcccccaccucccguccgagcacagcuccgugagcuccagccccgagcccggcaugcccgucauccaguccacguacggcgugaagggggaggagccgcacaucaaggaggagauccaggccgaggacaucaacggcgagaucuacgacgaguacgacgaggaggaggacgaccccgacguggacuacgggagcgacuccgagaaccacaucgccggccaggcgaacuga

SEQ ID NO: 36934 - RNA, 2406 nt, Artificial Sequence
  derived and/or modified sequence opt1 from SOX6__Homo_sapiens__NP_001139283
augagcuccaagcaggccaccagccccuucgccugcgcggccgacggcgaggacgccaugacccaggaccugacgucccgcgagaaggaggaggggagcgaccagcacguggccucccaccucccgcugcaccccaucaugcacaacaagccccacagcgaggagcugcccacccucgucuccaccauccagcaggacgccgacugggacagcgugcuguccagccagcagcggauggaguccgagaacaacaagcugugcagccucuacuccuuccgcaacaccagcacguccccgcacaagcccgacgagggcagccgggaccgcgagaucaugaccuccgugaccuucgggacccccgagcggcgcaagggcagccuggcggacgucguggacacgcugaagcagaagaagcucgaggagaugacccggaccgagcaggaggacuccagcugcauggagaagcugcugagcaaggacuggaaggagaagauggagcgccucaacaccuccgagcugcugggggagaucaagggcacgcccgagagccucgccgagaaggagcggcagcuguccaccaugaucacccagcugaucagccuccgcgagcagcugcuggccgcccacgacgagcagaagaagcucgcggccucccagaucgagaagcagcggcagcagauggaccuggcccgccagcagcaggagcagaucgcccggcagcagcagcagcugcuccagcagcagcacaagaucaaccugcugcagcagcagauccaggugcagggccacaugccgccccucaugauccccaucuucccccacgaccagcgcacccuggccgcggccgccgccgcccagcagggguuccuguucccgcccggcaucacguacaagcccggggacaacuaccccguccaguucaucccgagcaccauggcggccgccgccgccuccggccucagcccccugcagcugcagcagcucuacgcggcccagcuggccuccaugcaggucagccccggggccaagaugcccuccaccccgcagccgcccaacaccgccggcacggugagccccaccggcaucaagaacgagaagcgggggaccucccccgugacccaggugaaggacgaggcggccgcccagccccugaaccucagcucccgccccaagacggccgagcccgugaaguccccgaccucccccacccagaaccuguuccccgcgagcaagaccuccccggucaaccugcccaacaagagcagcauccccucccccaucggcgggagccucggccggggcuccagccuggggaaguggaagucccagcaccaggaggagacguacgagcuggacauccucagcucccugaacagcccggcccuguucggcgaccaggacaccgugaugaaggccauccaggaggcccgcaagaugcgggagcagauccagcgcgagcagcagcagcagcagccccacgggguggacggcaagcucuccagcaucaacaacauggggcugaacuccugccggaacgagaaggagcgcacccgcuucgagaaccugggcccccagcucaccggcaagagcaacgaggacgggaagcugggccccggggucaucgaccugacgcggccggaggacgccgagggcuccaaggcgaugaacgggagcgccgccaagcugcagcaguacuacugcuggcccaccggcggcgccaccguggccgaggcgcgcguguaccgggacgcccgcgggcgggccuccagcgagccccacaucaagcgccccaugaacgccuucauggucugggccaaggacgagcggcgcaagauccuccaggcguucccggacaugcacaacuccaacaucagcaagauccugggcagccgguggaaguccaugagcaaccaggagaagcagcccuacuacgaggagcaggcccgccuguccaagauccaccucgagaaguaccccaacuacaaguacaagccccggccgaagcggaccugcaucguggacgggaagaagcugcgcaucggcgaguacaagcagcugaugcgcagccggcgccaggagaugcggcaguucuucacgguggggcagcagccccagauccccaucaccaccggcaccggcgucguguaccccggggccaucaccauggccacgaccaccccgagcccccagaugaccagcgacugcuccagcacguccgcgagccccgagcccucccucccggugauccagagcaccuacggcaugaagaccgacgggggcucccuggccggcaacgagaugaucaacggggaggacgagauggagauguacgacgacuacgaggacgaccccaagagcgacuacuccagcgagaacgaggcccccgaggccgucuccgccaacuga

SEQ ID NO: 36935 - RNA, 1167 nt, Artificial Sequence
  derived and/or modified sequence opt1 from SOX7__Homo_sapiens__NP_113627
auggccagccugcucggcgccuaccccuggccggaggggcuggagugccccgcgcuggacgccgagcucuccgacggccagagcccgcccgccgugccccgcccgcccggggacaagggcuccgagagccggauccgccggcccaugaacgccuucauggucugggccaaggacgagcgcaagcggcuggcggugcagaaccccgaccugcacaacgccgagcucuccaagaugcugggcaagagcuggaaggcccugacccucucccagaagcgccccuacguggacgaggccgagcggcugcgccugcagcacaugcaggacuaccccaacuacaaguaccggccccgccggaagaagcaggcgaagcgccucugcaagcgggucgacccgggguuccugcugagcucccucagccgcgaccagaacgcccugcccgagaagcgguccggcagccgcggggcccugggcgagaaggaggaccgcggggaguacucccccggcaccgcccuccccagccugcgggggugcuaccacgagggcccggccggcgggggcgggggcggcacgcccuccagcguggacaccuaccccuacgggcugcccaccccgcccgagaugagcccccucgacgugcuggagcccgagcagaccuucuucuccuccccgugccaggaggagcacggccacccccggcgcaucccccaccuccccgggcacccguacagccccgaguacgcgcccagcccgcugcacugcucccacccccugggcagccuggcccucgggcagucccccggcgucagcaugaugucccccgugccgggcugcccgcccagccccgccuacuacucccccgccacguaccacccccugcacagcaaccugcaggcccaccucgggcagcuguccccgccgcccgagcaccccggcuucgacgcgcuggaccagcucagccagguggagcugcugggggacauggaccggaacgaguucgaccaguaccucaacacccccggccaccccgacuccgccaccggggccauggcccugagcggccacguccccgugucccaggugacccccacgggccccaccgagaccagccugaucuccguccucgccgacgcgaccgccacguacuacaacagcuacuccgugagcuga

SEQ ID NO: 36936 - RNA, 1341 nt, Artificial Sequence
  derived and/or modified sequence opt1 from SOX8__Homo_sapiens__NP_055402
augcuggacaugagcgaggcccgcucccagcccccgugcagccccuccggcaccgccagcuccaugagccacguggaggacuccgacagcgacgcgccgcccucccccgccgggagcgagggccucgggcgggccggcgucgccgucgggggcgcccgcggcgaccccgcggaggccgccgacgagcgguuccccgccugcauccgcgacgcggugucccaggugcugaagggguacgacuggagccuggugcccaugccggugcggggcgggggcgggggcgcccucaaggccaagccccacgucaagcgccccaugaacgccuucauggugugggcccaggcggcccggcgcaagcuggccgaccaguacccccaccuccacaacgccgagcuguccaagacccugggcaagcuguggcggcuccugagcgaguccgagaagcgcccguucguggaggaggccgagcggcugcgcguccagcacaagaaggaccaccccgacuacaaguaccagccccggcgccgcaagagcgcgaaggccgggcacuccgacagcgacuccggcgccgagcucgggccccacccgggcggcggggccguguacaaggccgaggcgggccugggggacggccaccaccacggggaccacacgggccagacccacggcccgcccaccccgcccaccacgcccaagaccgagcugcagcaggccggggccaagcccgagcucaagcuggagggccggcggcccguggacagcgggcgccagaacaucgacuucagcaacgucgacaucuccgagcugagcuccgaggugaugggcaccauggacgccuucgacgugcacgaguucgaccaguaccucccccucgggggccccgccccgcccgagcccggccaggcguacgggggcgccuacuuccacgccggggccagccccgucugggcgcacaaguccgcccccagcgccuccgccagcccgaccgagacgggcccgccccggccccacaucaagaccgagcagcccucccccgggcacuacggcgaccagccccgcggcagccccgacuacggguccugcagcggccaguccagcgccaccccggcggcccccgccgggcccuucgccggcucccagggcgacuacggggaccugcaggccagcuccuacuacggcgcguaccccggguacgccccgggccuguaccaguaccccugcuuccacagcccccggcgccccuacgccuccccgcugcugaacgggcucgcccugccgcccgcccacagccccaccagccacugggaccagcccguguacacgacccugacccgccccuga

SEQ ID NO: 36937 - RNA, 1530 nt, Artificial Sequence
  derived and/or modified sequence opt1 from SOX9__Homo_sapiens__NP_000337
augaaccugcucgaccccuucaugaagaugaccgacgagcaggagaagggccugagcggggccccgucccccaccaugagcgaggacuccgccggcagccccugccccuccgggagcggcuccgacacggagaacacccgcccgcaggagaacaccuuccccaagggggagcccgaccugaagaaggagagcgaggaggacaaguuccccgugugcauccgggaggcggucucccaggugcucaagggcuacgacuggacccuggugccgaugcccguccgcgugaacggcagcuccaagaacaagccccacgugaagcggcccaugaacgccuucauggucugggcccaggccgcccgccggaagcuggcggaccaguacccgcaccuccacaacgccgagcugagcaagacgcuggggaagcucuggcgccugcugaacgaguccgagaagcggcccuucguggaggaggccgagcgccuccgggugcagcacaagaaggaccaccccgacuacaaguaccagccccgccggcgcaagagcgucaagaacggccaggccgaggcggaggaggccaccgagcagacccacaucuccccgaacgccaucuucaaggcccugcaggccgacagcccccacuccagcuccgggaugagcgaggugcacagccccggcgagcacuccgggcagagccaggggcccccgaccccgcccacgacccccaagaccgacgugcagcccggcaaggcggaccugaagcgggagggccgcccccuccccgagggcgggcggcagcccccgaucgacuuccgcgacgucgacaucggcgagcuguccagcgacgugaucuccaacaucgagaccuucgacgugaacgaguucgaccaguaccugccgcccaacggccaccccgggguccccgccacgcacggccaggugaccuacaccgggagcuacggcaucuccagcaccgccgccacgcccgccuccgcggggcacguguggaugagcaagcagcaggcgcccccgcccccgccccagcagccgccccaggccccgcccgcgccccaggccccgccccagccccaggccgccccgccccagcagcccgccgccccgccccagcagccccaggcccacacccucaccacccuguccagcgagcccggccagucccagcggacgcacaucaagaccgagcagcugagccccucccacuacagcgagcagcagcagcacagcccccagcagaucgccuacucccccuucaaccucccccacuacucccccagcuacccgcccaucacccgcagccaguacgacuacaccgaccaccagaacuccagcuccuacuacagccacgccgccggccaggggacgggccuguacuccaccuucaccuacaugaaccccgcccagcggcccauguacacccccaucgcggacacgagcgggguccccuccaucccccagacccacagcccgcagcacugggagcagcccguguacacccagcugacccgccccuga

SEQ ID NO: 36938 - RNA, 2658 nt, Artificial Sequence
  derived and/or modified sequence opt1 from SP100__Homo_sapiens__NP_001073860
auggccggcgggggcggggaccugagcacccgccggcucaacgagugcaucucccccguggccaacgagaugaaccaccucccggcgcacagccacgaccugcagcgcauguucaccgaggaccagggcgucgacgaccggcugcuguacgacaucguguucaagcacuucaagcgcaacaagguggagaucuccaacgccaucaagaagacguuccccuuccuggaggggcuccgggaccgcgaccugaucaccaacaagauguucgaggacagccaggacuccugccggaaccugguccccgugcagcgcguggucuacaacgugcucagcgagcuggagaagaccuucaaccugcccgugcucgaggcccuguucuccgacgucaacaugcaggaguacccggaccugauccacaucuacaagggcuucgagaacgugauccacgacaagcucccccugcaggagagcgaggaggaggagcgggaggagcgcuccggccugcagcucagccuggagcaggggaccggcgagaacuccuuccggagccugacguggccgcccuccgggagccccucccacgccggcaccaccccgcccgagaacgggcucagcgagcaccccugcgagaccgagcagaucaacgccaagcgcaaggacacgaccuccgacaaggacgacagccugggcucccagcagaccaacgagcagugcgcgcagaaggccgagcccaccgagagcugcgagcagaucgccgugcaggucaacaacggcgacgccgggcgggagaugcccugcccccugcccugcgacgaggagagcccggaggcggagcuccacaaccacggcauccagaucaacuccugcagcgugcgccugguggacaucaagaaggagaagcccuucuccaacagcaaggucgagugccaggcccaggcccggacgcaccacaaccaggccuccgacaucaucgugaucagcuccgaggacagcgagggguccaccgacguggacgagccccuggaggucuucaucagcgccccgcgcuccgagcccgugaucaacaacgacaacccccucgagagcaacgacgagaaggagggccaggaggcgaccugcucccggccccagaucgugcccgagccgauggacuuccgcaagcugagcaccuuccgggaguccuucaagaagcgcgucaucggccaggaccacgacuucagcgaguccagcgaggaggaggcccccgccgaggccuccagcggggcccugcggagcaagcacggcgagaaggcgcccaugacgucccgcagcaccuccaccuggcgcauccccagccggaagcgccgguucuccagcuccgacuucagcgaccucuccaacggggaggagcugcaggagaccugcagcuccagccugcgccggggcuccgggagccagccgcaggagcccgagaacaagaagugcuccugcgugaugugcuuccccaagggcgugccgcgcagccaggaggcccggacggaguccagccaggccagcgacaugauggacaccauggacgucgagaacaacuccacccucgagaagcacagcggcaagcgccggaagaagcgccggcaccgcuccaaggugaacgggcugcagcggggccgcaagaaggaccggccccgcaagcaccugacccucaacaacaagguccagaagaagcgguggcagcagcgcgggcggaaggccaacacgcgcccccugaagcgccggcgcaagcggggcccccgcaucccgaaggacgagaacaucaacuucaagcagagcgagcugcccgugaccugcggggaggugaagggcacccucuacaaggagcgguucaagcagggcaccuccaagaagugcauccagagcgaggacaagaagugguucacgccccgcgaguucgagaucgagggggaccggggcgccuccaagaacuggaagcugagcauccgcugcgggggcuacacccugaagguccucauggagaacaaguuccugcccgagccgcccuccacccggaagaagcgcauccuggagagccacaacaacacccucguggaccccugccccgagaacuccaacaucugcgaggugugcaacaagugggggcggcuguucugcugcgacacgugcccgcgcagcuuccacgagcacugccacauccccuccgucgaggcgaacaagaaccccuggagcugcaucuucugccggaucaagaccauccaggagcgcugccccgagucccagagcggccaccaggaguccgaggugcugaugcggcagaugcucccggaggagcagcugaagugcgaguuccugcugcucaagguguacugcgacagcaaguccugcuucuucgccagcgagcccuacuacaaccgcgagggcagccaggggccccagaagcccauguggcugaacaaggucaagaccucccugaacgagcagauguacacccggguggagggcuucgugcaggacaugcgccucaucuuccacaaccacaaggaguucuaccgggaggacaaguucacgcgccuggggauccagguccaggacaucuucgagaagaacuuccggaacaucuucgccauccaggagaccagcaagaacaucaucauguucaucuga

SEQ ID NO: 36939 - RNA, 1668 nt, Artificial Sequence
  derived and/or modified sequence opt1 from SP110__Homo_sapiens__NP_001171944
augggccgcggguuccggauguucaccaugacccgcgccauggaggaggcccuguuccagcacuucaugcaccagaagcucggcaucgcguacgccauccacaagcccuuccccuucuucgaggggcugcuggacaacagcaucaucacgaagcggauguacauggagucccucgaggccugccgcaaccugauccccgugagccgggucgugcacaacauccugacccagcucgagcgcaccuucaaccugucccugcucgugacccuguucagccagaucaaccugcgggaguaccccaaccucgucacgaucuaccgcuccuucaagcgggugggcgccagcuacgaguggcagucccgcgacacccccauccugcuggaggccccgaccgggcucgcggagggcagcucccugcacacgccccuggcccucccgccgccccagccgccccagcccagcugcucccccugcgcgccccgggugagcgagcccggcaccuccagccagcaguccgacgagauccugagcgagucccccagccccuccgaccccguccugccccuccccgcccugauccaggaggggcgcagcaccagcgugaccaacgacaagcugaccuccaagaugaacgccgaggaggacagcgaggagaugccgucccuccugacgagcaccgugcaggucgccuccgacaaccugaucccccagauccgggacaaggaggacccccaggagaugccccacagcccgcucggcuccaugcccgagauccgcgacaacagccccgagcccaacgacccggaggagccccaggagguguccagcacccccuccgacaagaaggggaagaagcggaagcgcugcaucuggagcaccccgaagcggcgccacaagaagaagucccugcccggcgggacggccagcucccggcacggcauccagaagaagcugaagcgcguggaccaggucccccagaagaaggacgacagcacgugcaacuccaccguggagacccgggcccagaaggcccgcaccgagugcgcgcgcaagagccgguccgaggagaucaucgacggcaccagcgagaugaacgaggggaagcgcagccagaagacccccuccaccccgcggcgcgugacgcagggcgccgccagccccgggcacggcauccaggagaagcuccaggucguggacaaggugacccagcggaaggacgacuccaccuggaacagcgaggucaugaugcgcgugcagaaggcccggaccaagugcgcccgcaagucccggcugaaggagaagaagaaggagaaggacaucugcagcuccagcaagcgccgguuccagaagaacauccaccgccggggcaagcccaaguccgacacgguggacuuccacugcagcaagcugcccgugaccugcggggaggcgaagggcauccucuacaagaagaagaugaagcacggguccagcgucaagugcauccgcaacgaggacggcaccuggcugaccccgaacgaguucgagguggaggggaagggccggaacgccaagaacuggaagcgcaacauccggugcgagggcaugacgcugggggagcuccugaaguccggccugcuccugugcccgccccgcaucaaccugaagcgggagcucaacagcaaguga

SEQ ID NO: 36940 - RNA, 519 nt, Artificial Sequence
  derived and/or modified sequence opt1 from SP140__Homo_sapiens__NP_001005176
auggcccagcagggccagcaggggcagauggccagcggcgacuccaaccugaacuuccgcaugguggcggagauccagaacgucgaggggcagaaccuccaggagcaggucugccccgagccgaucuuccgguucuuccgcgagaacaagguggagaucgccagcgccaucacccggcccuuccccuuccugaugggccugcgcgaccgguccuucaucagcgagcagauguacgagcacuuccaggaggccuuccgcaaccucgugcccgugacccgggugauguacugcguccuguccgagcuggagaagacguucggguggagccaccucgaggcccuguucucccgcaucaaccugauggcguacccggaccucaacgagaucuaccggagcuuccagaacgagaaccuguccagcuccgccgugcugugccagcucgugagccccaacaaggacuggcgcucccacgaggagagccuggcccacaccggcacccugcggcgcuccugcauguga

SEQ ID NO: 36941 - RNA, 2358 nt, Artificial Sequence
  derived and/or modified sequence opt1 from SP1__Homo_sapiens__NP_612482
augagcgaccaggaccacuccauggacgagaugaccgccguggucaagaucgagaagggcgucgggggcaacaacgggggcaacgggaacggcggcggggccuucagccaggcgcgcuccagcuccaccggcagcuccagcuccaccgggggcgggggccaggagagccagcccuccccgcuggcccuccuggccgcgaccugcagccggaucgagucccccaacgagaacagcaacaacucccagggccccagccaguccgggggcaccggggagcuggaccucaccgccacgcagcugagccagggcgccaacggcuggcagaucaucuccagcagcuccggggccacccccaccagcaaggagcaguccggcagcuccaccaacgggagcaacggcuccgagagcuccaagaaccgcacggugagcgggggccaguacgugguggccgccgcgccgaaccugcagaaccagcagguccucaccggccugcccggggugaugcccaacauccaguaccaggugaucccccaguuccagaccguggacggccagcagcugcaguucgccgccaccggggcccagguccagcaggacggcuccgggcagauccagaucaucccgggcgccaaccagcagaucaucacgaaccggggcagcgggggcaacaucaucgcggccaugcccaaccuccugcagcaggccgugccccugcaggggcucgccaacaacgugcuguccggccagacccaguacgucaccaacgugcccguggcccugaacgggaacaucacccuccugccggucaacagcguguccgcggccacgcugacccccagcucccaggccgugaccaucagcuccagcggcagccaggaguccggcagccagcccgucaccuccgggacgaccaucagcuccgccagccucguguccagccaggccuccagcuccagcuucuucaccaacgcgaacuccuacagcaccacgaccaccaccuccaacaugggcaucaugaacuucacgaccagcggguccagcggcaccaacagccagggccagacgccccagcgcguguccgggcugcagggcagcgacgcccugaacauccagcagaaccagacguccgggggcagccuccaggccgggcagcagaaggagggcgagcagaaccagcagacccagcagcagcagauccugauccagccgcagcugguccagggcgggcaggcccuccaggcccugcaggcggcgccccuguccggccagaccuucaccacgcaggccaucagccaggagacccuccagaaccugcagcugcaggccgugcccaacuccgggcccaucaucauccggaccccgaccgugggccccaacgggcaggucagcuggcagacccuccagcugcagaaccuccaggugcagaacccccaggcccagacgaucacccuggcccccaugcagggcgucucccugggccagaccagcuccagcaacaccacgcugaccccgaucgccuccgccgccagcauccccgcggggaccgugaccgugaacgccgcccagcucuccagcaugcccggccugcagacgaucaaccuguccgcccucgggaccagcggcauccagguccaccccauccaggggcugccgcuggccaucgcgaacgcccccggcgaccacggcgcccagcucgggcugcacggcgccgggggcgacgggauccacgacgacaccgccggcggcgaggagggggagaacucccccgacgcgcagccgcaggccggccgccggacccgccgggaggccugcacgugccccuacugcaaggacagcgaggggcgcggcagcggcgaccccgggaagaagaagcagcacaucugccacauccagggcugcgggaagguguacggcaagaccucccaccuccgggcccaccuccgcuggcacaccggggagcggcccuucaugugcaccuggagcuacugcggcaagcgcuucacgcgguccgacgagcugcagcgccacaagcggacccacaccggcgagaagaaguucgcgugcccggagugccccaagcgcuucaugcggagcgaccaccuguccaagcacaucaagacccaccagaacaagaagggcgggcccgggguggcccugagcgucggcacgcugccccuggacuccggggccggcagcgagggcuccgggaccgccaccccgagcgcccugaucaccacgaacaugguggcgauggaggccaucugccccgagggcaucgcccgccucgccaacuccgggaucaacgugaugcaggucgccgaccugcagagcaucaacaucuccggcaacggguucuga

SEQ ID NO: 36942 - RNA, 1842 nt, Artificial Sequence
  derived and/or modified sequence opt1 from SP2__Homo_sapiens__NP_003101
augagcgacccccagaccuccauggccgccaccgcggccgugagcccguccgacuaccugcagcccgccgccagcacgacccaggacucccagcccagcccccucgcccugcuggcggcgaccugcuccaagaucggcccgcccgccgucgaggccgccgugaccccgcccgccccgccccagcccacgccccgcaagcucgugcccaucaagcccgcgccccugccccugagcccggggaagaacuccuucggcauccucagcuccaaggggaacauccugcagauccagggcagccagcuguccgccagcuaccccgggggccagcucgucuucgccauccagaaccccaccaugaucaacaagggcacccgguccaacgccaacauccaguaccaggccgugccccagauccaggccagcaacucccagaccauccaggugcagccgaaccugacgaaccagauccagaucauccccgggaccaaccaggccaucaucacccccagccccuccagccacaagccgguccccaucaagcccgcccccauccagaaguccagcaccacgaccaccccggugcagagcggcgcgaacguggucaagcugaccgggggcgggggcaacgugacgcucacccugcccgugaacaaccuggucaacgccuccgacaccggcgcccccacccagcuccugacggagagcccgcccacgccccuguccaagaccaacaagaaggcccgcaagaagucccuccccgccagccagccgcccguggcgguggccgagcaggucgagaccgugcugaucgagaccaccgccgacaacaucauccaggccgggaacaaccugcucaucgugcagagccccggcgggggccagcccgccgucgugcagcagguccagguggugccgcccaaggcggagcagcagcaggucgugcagaucccccagcaggcccugcgggugguccaggccgccuccgcgacccugcccaccgugccgcagaagcccagccagaacuuccagauccaggccgccgagcccacgcccacccagguguacauccgcaccccguccggcgagguccagaccgugcucgugcaggacagcccgcccgccacggccgcggccaccuccaacacgaccugcagcucccccgccagccgggcgccccaccuguccgggaccagcaagaagcacuccgccgccauccugcgcaaggagcggccccuccccaagaucgcccccgccggcagcaucaucagccugaacgccgcccagcuggcggccgccgcccaggcgaugcagaccaucaacaucaacgggguccaggugcagggcgugccggucaccaucaccaacaccgggggccagcagcagcucacggugcagaacguguccggcaacaaccugaccaucagcgggcugucccccacccagauccagcuccagauggagcaggcccuggccggcgagacccagcccggggagaagcgccggcgcauggccugcacgugcccgaacugcaaggacggcgagaagcggagcggggagcagggcaagaagaagcacgucugccacauccccgacugcggcaagaccuuccgcaagaccucccugcuccgggcccacgugcgccugcacaccggggagcggcccuucgugugcaacugguucuucugcggcaagcgcuucacgcggagcgacgagcugcagcgccacgcgcggacccacaccggggacaagcgcuucgagugcgcccagugccagaagcgguucaugcgcuccgaccaccucaccaagcacuacaagacgcaccuggucaccaagaaccuguga

SEQ ID NO: 36943 - RNA, 2142 nt, Artificial Sequence
  derived and/or modified sequence opt1 from SP3__Homo_sapiens__NP_001017371
auggggcccccgagccccggggacgacgaggaggaggccgccgcggccgccggcgcccccgccgcggccggggccaccggcgaccuggccuccgcgcagcucgggggcgcccccaaccgcugggaggugcugagcgccaccccgacgaccaucaaggacgaggccggcaaccugguccagauccccuccgccgcgaccagcuccgggcaguacgugcucccccugcagaaccugcagaaccagcagaucuucagcguggcccccggcuccgacagcuccaacgggaccgucagcuccgugcaguaccaggugaucccgcagauccagagcgccgacggccagcagguccagaucggguucacgggcuccagcgacaacggcgggaucaaccaggaguccagccagauccagaucauccccggcuccaaccagacccuccuggccagcgggacccccuccgccaacauccagaaccugaucccccagaccggccagguccaggugcagggcguggcgaucgggggcagcagcuucccggggcagacccaggugguggccaacgucccccucggccugcccgggaacaucaccuucgugcccaucaacuccguggaccuggacagccucggccuguccggcagcucccagaccaugaccgccgggaucaacgccgacggccaccugaucaacacggggcaggccauggacagcuccgacaacagcgagcggaccggcgagcgcgucuccccggacaucaacgagaccaacaccgacacggaccucuucgugcccaccagcuccagcucccagcugcccgugaccaucgacagcaccgggauccugcagcagaacacgaacucccucaccaccagcuccggccagguccacagcuccgaccugcagggcaacuacauccagagccccgugagcgaggagacccaggcgcagaacauccagguguccacggcccagccggucgugcagcaccuccagcugcaggagagccagcagcccaccucccaggcccagaucgugcaggggaucacgccccagaccauccacggcguccaggccagcgggcagaacaucucccagcaggcccugcagaaccugcagcuccagcugaaccccggcacguuccugauccaggcgcagaccgugaccccgagcgggcaggucaccuggcagacguuccaggugcagggcgugcagaaccuccagaaccugcagauccagaacaccgccgcccagcagaucacccugacccccguccagacgcucacccugggccagguggccgcgggcggcgccuucaccuccacccccgugagccuguccaccgggcagcuccccaaccugcagacggucaccgugaacagcaucgacuccgccggcauccagcugcacccgggcgagaacgccgacagccccgccgacauccggaucaaggaggaggagcccgacccggaggaguggcagcucuccggggacagcacccugaacaccaacgaccugacgcaccuccgcgugcaggucguggacgaggagggcgaccagcagcaccaggaggggaagcggcugcgccggguggcgugcacgugccccaacugcaaggagggcgggggccgcggcaccaaccuggggaagaagaagcagcacaucugccacauccccggcugcgggaaggucuacggcaagaccucccaccuccgggcccaccuccgcuggcacagcggggagcggcccuucgugugcaacuggauguacugcggcaagcgcuucacccgguccgacgagcugcagcgccaccggcgcacccacaccggcgagaagaaguucgugugcccggagugcagcaagcgguucaugcgcagcgaccaccuggccaagcacaucaagacccaccagaacaagaaggggauccacuccagcuccacgguccuggccagcguggaggccgcgcgggacgacacccugaucaccgccggcgggaccacgcucauccuggccaacauccagcagggcuccgugagcgggaucggcaccgucaacaccuccgccaccagcaaccaggacauccugacgaacaccgagaucccccugcagcucgugaccguguccggcaacgagaccauggaguga

SEQ ID NO: 36944 - RNA, 2355 nt, Artificial Sequence
  derived and/or modified sequence opt1 from SP4__Homo_sapiens__NP_003103
augagcgaccagaagaaggaggaggaggaggaggccgccgcggccgccgccauggccaccgagggcgggaagaccuccgagcccgagaacaacaacaagaagccgaagacgagcggcucccaggacagccagcccagcccccuggcgcuccuggccgcgaccugcuccaagaucgggacccccggcgagaaccaggccaccgggcagcagcagaucaucaucgacccgucccagggccuggugcagcuccagaaccagccccagcagcuggagcuggucacgacccagcucgccggcaacgccuggcagcugguggccagcaccccgcccgccuccaaggagaacaacgugagccagcccgccuccagcuccagcuccagcuccagcuccaacaacgggagcgcgagccccaccaagacgaaguccggcaacagcuccacccccgggcaguuccaggucauccaggugcagaaccccagcggcuccgugcaguaccaggucaucccgcagcugcagaccguggaggggcagcagauccagaucaaccccaccagcuccagcucccuccaggaccugcagggccagauccagcugaucagcgccggcaacaaccaggccauccucacggccgccaaccgcaccgcguccgggaacauccuggcccagaaccuggccaaccagaccgugcccguccagauccggcccggcgugagcaucccgcuccagcugcagacccugcccgggacgcaggcccagguggucaccacccuccccaucaacaucggcggcgugacccuggcccugcccgugaucaacaacgucgcggccgggggcgggacgggccagguggggcagccggccgccaccgccgacuccggcaccagcaacggcaaccagcucguguccacccccacgaacaccaccaccagcgcguccacgaugcccgagagccccuccagcagcacgaccugcaccaccaccgccuccaccagccugaccuccagcgacacgcuggucuccagcgccgacaccgggcaguacgccuccaccagcgcguccagcuccgagcgcaccaucgaggagagccagaccccggccgccacggaguccgaggcccagagcuccagccagcuccagcccaacggcaugcagaacgcccaggaccaguccaacagccugcagcagguccagaucguggggcagcccauccugcagcagauccagauccagcagccccagcagcagaucauccaggcgaucccgccccagagcuuccagcuccaguccggccagaccauccagaccauccagcagcagccccugcagaacgugcagcugcaggccgugaacccgacccaggugcucauccgggcccccacgcugacccccagcgggcagaucuccuggcagaccguccaggugcagaacauccagagccuguccaaccuccagguccagaacgccggccugagccagcagcugaccaucacgcccguguccagcuccggcgggaccacccucgcccagaucgcgccgguggccgucgccggcgcccccaucacccugaacacggcccagcuggcgagcgugcccaaccuccagaccguguccgucgccaaccugggggccgccggcguccaggugcagggggugcccgugaccaucaccagcguggcgggccagcagcagggccaggacggggucaaggugcagcaggccacgaucgccccggugaccgucgccgugggcgggaucgccaacgcgaccaucggcgccgugucccccgaccagcugacccagguccaccuccagcagggccagcagacgagcgaccaggaggugcagcccgggaagcgccugcggcgcguggccugcuccugccccaacugccgggagggcgaggggcgcggcagcaacgagccggggaagaagaagcagcacaucugccacaucgagggcugcggcaaggucuacgggaagaccucccaccuccgggcccaccuccgcuggcacaccggcgagcggcccuucaucugcaacuggauguucugcgggaagcgcuucacccggagcgacgagcugcagcgccaccggcgcacgcacaccggcgagaagcgguucgagugccccgagugcuccaagcgcuucaugcggagcgaccaccugagcaagcacgugaagacccaccagaacaagaagggcgggggcaccgcccuggcgaucgugacguccggggagcuggacagcuccgucaccgaggugcugggcagcccccgcaucgugaccgucgccgccaucucccaggacagcaacccggccacccccaacguguccacgaacauggaggaguucuga

SEQ ID NO: 36945 - RNA, 1197 nt, Artificial Sequence
  derived and/or modified sequence opt1 from SP5__Homo_sapiens__NP_001003845
auggccgccguggcgguccugcgcaacgacagccuccaggccuuccugcaggaccggacccccuccgccagccccgaccugggcaagcacagcccccucgcccugcuggccgcgaccugcucccgcaucgggcagcccggcgccgccgcgcccccggacuuccuccaggugcccuacgaccccgcccuggggucccccagccggcuguuccacccguggacggccgacaugcccgcccacucccccggcgcccugcccccgccccaccccagccucgggcugaccccgcagaagacccaccuccagcccuccuucggcgccgcgcacgagcugccccugaccccgcccgccgaccccagcuaccccuacgaguucucccccgugaagaugcuccccagcuccauggccgcccugccggccagcugcgcgcccgccuacguccccuacgccgcccaggccgcgcugcccccgggcuacuccaaccuccugccgccgcccccgccgccgccgccgccgcccacgugccgccagcugagccccaaccccgcccccgacgaccuccccuggugguccaucccccaggccggggccggccccggggccagcggcgugcccggguccggccugagcggcgcgugcgccggggcgccccacgcgccccgguuccccgccagcgccgccgccgccgccgccgccgccgccgcgcugcagcgcggccucgugcuggggcccuccgacuucgcccaguaccagagccagaucgccgcccugcuccagaccaaggcgccccuggccgccaccgcccggcgcugccggcgcugccggugccccaacugccaggccgcgggcggcgcccccgaggccgagcccgggaagaagaagcagcacgucugccacgugcccggcugcgggaagguguacggcaagaccucccaccugaaggcccaccuccgcuggcacacgggggagcggcccuucgucugcaacuggcuguucugcggcaagagcuucacccgcuccgacgagcugcagcggcaccuccgcacccacaccggcgagaagcgguucgccugccccgagugcgggaagcgcuucaugcggagcgaccaccuggcgaagcacgugaagacgcaccagaacaagaagcugaagguggccgaggccggcgucaagcgcgaggacgcccgggaccucuga

SEQ ID NO: 36946 - RNA, 1131 nt, Artificial Sequence
  derived and/or modified sequence opt1 from SP6__Homo_sapiens__NP_954871
augcugaccgccgugugcggcagccuggggucccagcacaccgaggcgccccacgccagcccgccccgccuggaccugcagccccuccagacguaccagggccacaccucccccgaggccggggacuaccccagcccccugcagcccggcgagcugcagucccucccccuggggccggaggucgacuucagccagggcuacgagcugcccggcgccuccagccgggugaccugcgaggaccucgaguccgacagcccccuggcccccgggccguucuccaagcugcuccagcccgacaugagccaccacuacgaguccugguuccgccccacccaccccggcgccgaggacgggagcuggugggaccugcacccgggcacguccuggauggaccugccccacacccagggggcgcucaccagccccggccaccccggcgcccugcaggccgggcugggcggguacgugggcgaccaccagcucugcgccccgccgccccacccccacgcgcaccaccuccugcccgccgccggcgggcagcaccuccugggcccgcccgacggggccaaggcccuggaggucgcggcccccgagucccagggccuggacagcucccuggacggggccgcccggcccaagggcagccgccggagcgugccccgcuccagcggccagaccgugugccggugccccaacugccuggaggccgagcgccucggggcgccgugcggccccgacgggggcaagaagaagcaccuccacaacugccacauccccgggugcggcaaggccuacgccaagacgucccaccugaaggcccaccuccgguggcacagcggcgaccgccccuucgucugcaacuggcuguucugcgggaagcgguucacccgcuccgacgagcugcagcggcaccuccagacccacaccggcacgaagaaguucccgugcgccgugugcagccgcguguucaugcgguccgaccaccuggcgaagcacaugaagacccacgagggggccaaggaggaggccgccggcgccgcgagcggggagggcaaggccggcggggccgucgagccgcccggcgggaagggcaagcgcgaggccgagggcuccguggcgcccagcaacuga

SEQ ID NO: 36947 - RNA, 1296 nt, Artificial Sequence
  derived and/or modified sequence opt1 from SP7__Homo_sapiens__NP_690599
auggccagcucccugcucgaggaggaggugcacuacggcagcagcccccuggccaugcugaccgcggccugcuccaaguucgggggcuccagcccgcuccgcgacuccaccacgcuggggaaggccggcaccaagaagcccuacagcgucggguccgaccugagcgccuccaagaccaugggcgacgccuaccccgcgcccuucaccagcacgaacggccuccuguccccggccgggagcccgcccgcccccaccuccggcuacgccaacgacuacccgcccuucagccacuccuuccccgggcccaccggcacccaggacccggggcugcucgugcccaagggccacagcuccagcgacugccugcccagcguguacacgucccuggacaugacccaccccuacggcagcugguacaaggcggggauccacgccggcaucuccccggggcccggcaacacccccacccccuggugggacaugcacccgggcgggaacuggcucggcgggggccaggggcagggcgacggccugcaggggacgcugcccaccggccccgcccagcccccgcucaacccccagcugcccaccuaccccagcgacuucgccccgcugaaccccgcccccuacccggcgccccaccuccugcagcccgggccccagcacguccugccgcaggacguguacaagcccaaggccgugggcaacuccgggcagcucgagggcagcggcggggccaagccgccccggggcgccuccaccgggggcagcgggggcuacggcggguccggcgccgggcgcagcuccugcgacugccccaacugccaggagcuggagcggcugggcgcggccgccgccggccuccgcaagaagcccauccacagcugccacauccccgggugcggcaaggucuacgggaaggccucccaccugaaggcgcaccuccgguggcacacgggcgagcgccccuucgugugcaacuggcuguucugcgggaagcgguucacccgcagcgacgagcuggagcggcacgugcgcacccacacccgggagaagaaguucacgugccugcucugcuccaagcgcuucacccggagcgaccaccuguccaagcaccagcgcacccacggcgagccgggccccgggcccccgcccagcggccccaaggagcugggggagggccgguccaccggggaggaggaggccagccagacgccccgccccagcgccucccccgccacccccgagaaggcccccggcggcagccccgagcaguccaaccuccuggagaucuga

SEQ ID NO: 36948 - RNA, 1527 nt, Artificial Sequence
  derived and/or modified sequence opt1 from SP8__Homo_sapiens__NP_874359
auggccaccagccugcucggcgaggagccccgccugggguccaccccgcuggccaugcucgcggccacgugcaacaagaucggcagccccucccccagccccuccagccuguccgacagcuccagcuccuucgggaagggcuuccacccguggaagcggagcuccagcuccagcuccgccagcugcaacguggucggguccagccugagcuccuucggcgugagcggcgccucccgcaacgggggcagcuccagcgccgcggccgccgccgcggccgccgccgccgcggccgccgcccucguguccgacagcuucuccugcgggggcagccccggguccagcgccuucucccugaccagcuccagcgcggccgccgccgccgcggccgccgccgccgcggccuccagcucccccuucgccaacgacuacagcgucuuccaggcccccggcgugagcggcggguccggcgggggcggcgggggcgggggcgggggcagcuccgcgcacagccaggacggcucccaccagccgguguucaucagcaagguccacaccuccguggacgggcugcagggcaucuacccccggguggggauggcccaccccuacgagagcugguucaagcccucccacccgggccucggggccgccggcgaggucggcagcgccggggcguccagcuggugggacgugggcgccggguggaucgacgugcagaaccccaacuccgccgccgcccugcccggcagccugcaccccgcggccgggggccuccagaccucccugcacagcccgcugggcggguacaacuccgacuacagcggccucagccacuccgccuucagcuccggggccagcucccaccuccugagccccgccggccagcaccugauggacggcuucaagcccguccugcccggguccuacccggacagcgcgcccagcccccuggccggcgccgggggcuccaugcucuccgccgggcccagcgcgccgcugggcggcagcccccgcuccuccgcccggcgcuacagcgggcgggccacgugcgacugccccaacugccaggaggccgagcgccugggccccgccggggcgucccuccggcgcaagggccugcacagcugccacaucccggggugcggcaagguguacggcaagaccucccaccugaaggcccaccuccgguggcacaccggggagcgccccuucgugugcaacuggcuguucugcggcaagcgguucacccgcagcgacgagcugcagcggcaccuccgcacgcacaccggggagaagcgguucgccugccccgucugcaacaagcgcuucaugcggagcgaccaccuguccaagcacgugaagacccacagcggcgggggcggcgggggcggguccgccggcagcggguccggcggcaagaaggggagcgacaccgacuccgagcacagcgccgcgggcuccccgcccugccacagccccgagcugcuccagcccccggagcccgggcaccgcaacggccuggaguga

SEQ ID NO: 36949 - RNA, 456 nt, Artificial Sequence
  derived and/or modified sequence opt1 from SPA17__Homo_sapiens__XP_011541172
augagcauccccuucuccaacacccacuaccgcaucccgcagggcuucgggaaccugcucgagggccugacccgggagauccugcgcgagcagcccgacaacauccccgccuucgccgcggccuacuucgagagccuccuggagaagcgggagaagacgaacuucgaccccgccgaguggggguccaagguggaggaccgcuucuacaacaaccacgccuucgaggagcaggagccgcccgagaaguccgaccccaagcaggaggagagccagaucagcggcaaggaggaggagaccuccgucaccauccuggacagcuccgaggaggacaaggagaaggaggagguggccgcggugaagauccaggccgccuuccgggggcacaucgcccgcgaggaggcgaagaagaugaagaccaacagccuccagaacgaggagaaggaggagaacaaguga

SEQ ID NO: 36950 - RNA, 885 nt, Artificial Sequence
  derived and/or modified sequence opt1 from SPACA1__Homo_sapiens__NP_112222
augagcccccgcggcaccgggugcuccgccggccugcucaugaccgugggguggcugcugcucgccggccugcagagcgcgcgggggacgaacgucaccgccgccgugcaggacgccggccuggcccacgagggcgagggggaggaggagaccgagaacaacgacuccgagaccgcggagaacuacgccccgcccgagacggaggacgugagcaaccgcaacgucgugaaggagguggaguucggcaugugcaccgugaccugcgggaucggcguccgggaggugauccucaccaacgggugccccggcggcgaguccaagugcgucgugcgcguggaggagugccgggggcccacggacugcggcugggggaagccgaucagcgagucccuggagagcguccgccuggccugcauccacaccagcccccucaaccgguucaaguacauguggaagcugcugcgccaggaccagcaguccaucauccucgugaacgacuccgccauccuggaggugcggaaggagagccacccccuggcguucgagugcgacacccucgacaacaacgagaucgucgccaccaucaaguucacgguguacaccuccagcgagcugcagaugcgccgguccagccugcccgccaccgacgccgcccucaucuucgugcugaccaucggcgucaucaucugcguguucaucaucuuccugcucaucuucaucaucaucaacugggcggccgugaaggccuucuggggcgccaaggccuccacgccggagguccagagcgagcaguccagcgugcgcuacaaggacagcaccucccuggaccagcugcccaccgagaugcccggggaggacgacgcgcucagcgaguggaacgaguga

SEQ ID NO: 36951 - RNA, 648 nt, Artificial Sequence
  derived and/or modified sequence opt1 from SPACA3__Homo_sapiens__NP_776246
auggugagcgcccugcgcggcgcgccccucauccggguccacuccagcccgguguccagccccuccgugagcgggccccgccggcuggucuccugccugagcucccagagcuccgcccucagccaguccggcgggggcagcaccuccgccgccgggaucgaggcccgcagccgggcccugcgccggcgcuggugccccgcgggcaucaugcugcucgcccuggugugccugcucuccugccugcugccgagcuccgaggccaagcucuacggccggugcgagcuggcccgcgugcugcacgacuucgggcucgacggcuaccggggguacagccuggcggacugggucugccuggccuacuucaccagcggcuucaacgccgccgcccucgacuacgaggcggacggguccacgaacaacggcaucuuccagaucaacagccgccgguggugcuccaaccugacccccaacgugcccaacgugugccgcauguacugcagcgaccugcucaaccccaaccugaaggacaccgucaucugcgccaugaagaucacccaggagccgcagggccugggguacugggaggccuggcggcaccacugccagggcaaggaccucacggaguggguggacgggugcgacuucuga

SEQ ID NO: 36952 - RNA, 327 nt, Artificial Sequence
  derived and/or modified sequence opt1 from SPAG11A__Homo_sapiens__NP_001075021
augcgccagcggcugcuccccagcgugaccucccugcugcucgucgcccugcuguuccccggcagcucccaggcccgccacgugaaccacagcgcgaccgaggcccucggggagcugcgggagcgcgcccccggccaggggacgaacggcuuccagcugcuccggcacgccgugaagcgcgaccugcugccgccccggaccccgcccuaccagggggacgucccccucggcauccgcaacaccaucugccggaugcagcagggcaucugccgccuguucuucugccacuccgggaccggccagcagcaccggcagcgcugcggguga

SEQ ID NO: 36953 - RNA, 312 nt, Artificial Sequence
  derived and/or modified sequence opt1 from SPAG11B__Homo_sapiens__NP_057596
augcgccagcggcugcuccccagcgugaccucccugcugcucgucgcccugcuguuccccggcagcucccaggcccgccacgugaaccacagcgcgaccgaggcccucggggagcugcgggagcgcgcccccggccaggggacgaacggcuuccagcugcuccggcacgccgugaagcgcgaccugcugccgccccggaccccgcccuaccagguccacaucucccaccgcgaggcccgggggcccagcuuccgcaucugcguggacuuccucggcccccggugggcgcgcggcugcuccaccgggaacuga

SEQ ID NO: 36954 - RNA, 552 nt, Artificial Sequence
  derived and/or modified sequence opt1 from SPAG16__Homo_sapiens__NP_001020607
auggccgcccagcgcggcaugcccagcuccgcggugcggguccuggaggaggcccucgggaugggccugaccgccgccggggacgcccgcgacaccgcggacgccguggccgccgagggcgcguacuaccuggagcaggucacgaucaccgaggccagcgaggacgacuacgaguacgaggagaucccggacgacaacuucuccauccccgagggggaggaggaccucgccaaggccauccagauggcccaggagcaggcgaccgacaccgagauccuggagcggaagacggugcugcccagcaagcacgccgugcccgaggugaucgaggacuuccucugcaacuuccugaucaagaugggcaugacccgcacccuggacugcuuccaguccgagugguacgagcucauccagaagggcgucaccgagcugcggacgguggggaacgugccggacgucuacacccagaucaugcugcucgagaacgagaacaagaaccugaagaaggaccugaagcacuacaagcaggccgccgaguacgugaucuucuga

SEQ ID NO: 36955 - RNA, 2781 nt, Artificial Sequence
  derived and/or modified sequence opt1 from SPAG1__Homo_sapiens__NP_757367
augaccaccaaggacuaccccagccuguggggcuucgggacgaccaagaccuucaagaucccgaucgagcaccucgacuucaaguacaucgagaagugcuccgacgugaagcaccuggagaagauccugugcguccuccgcagcggcgaggagggguacuaccccgagcugaccgaguucugcgagaagcaccuccaggcccucgcccccgagucccgggcgcugcgcaaggacaagcccgccgccacggccgccagcuucaccgcggaggagugggagaagaucgacggcgacaucaaguccugggugagcgagaucaagaaggaggaggacaagaugcacuuccacgagaccgagaccuucccggccaugaaggacaaccugccgcccgugcggggguccaacagcugccuccacgucggcaaggagaaguacuccaagcgccccacgaagaagaagacgccccgggacuacgccgagugggacaaguucgacguggagaaggagugccugaagaucgacgaggacuacaaggagaagaccgugaucgacaagagccaccuguccaagaucgagacccgcaucgacaccgccggccucaccgagaaggagaaggacuuccuggcgacccgggagaaggagaaggggaacgaggccuucaacagcggcgacuacgaggaggccgucauguacuacacccgcuccaucagcgcccugcccacggugguggccuacaacaaccgggcgcaggccgagaucaagcuccagaacuggaacuccgccuuccaggacugcgagaagguccuggagcuggagcccgggaacgugaaggcccuccugcgccgggccaccaccuacaagcaccagaacaagcugcgcgaggcgaccgaggaccucagcaaggugcuggacgucgagcccgacaacgaccuggccaagaagacgcucuccgagguggagcgggaccugaagaacagcgaggccgccuccgagacccagaccaagggcaagcgcauggugauccaggagaucgagaacagcgaggacgaggagggcaagagcgggcggaagcacgaggacggcgggggcgacaagaagccggccgagcccgcgggggccgcccgcgccgcccagcccugcgucaugggcaacauccagaagaagcugaccggcaaggcggagggcgggaagcggcccgcccgcggggccccgcagcggggccagacgcccgaggccggggcggacaagcgcagcccccggcgcgccagcgccgccgccgcggccggcggcggggccaccggccaccccgggggcgggcagggcgccgagaacccggccggccucaagucccaggggaacgagcuguuccgcagcggccaguucgcggaggccgccgggaaguacuccgccgccaucgcgcugcucgagcccgccggcagcgagaucgccgacgaccuguccauccuguacagcaaccgggccgcgugcuaccucaaggaggggaacugcuccggcugcauccaggacugcaaccgcgcccuggagcugcaccccuucagcaugaagccccuccugcggcgcgccauggccuacgagacccuggagcaguacggcaaggccuacguggacuacaagaccgugcuccagaucgacugcgggcugcagcuggcgaacgacuccgucaaccggcucagccgcauccugauggagcuggacggcccgaacuggcgggagaagcucucccccauccccgccgugcccgccagcgugccgcugcaggccuggcaccccgccaaggagaugaucuccaagcaggcgggggacagcuccagccaccgccagcagggcaucacggacgagaagaccuucaaggcccugaaggaggagggcaaccagugcgucaacgacaagaacuacaaggacgcccucuccaaguacagcgagugccugaagaucaacaacaaggagugcgccaucuacaccaaccgggcccugugcuaccugaagcucugccaguucgaggaggcgaagcaggacugcgaccaggcccugcagcuggccgacgggaacgugaaggccuucuaccgccgggcgcucgcccacaagggccugaagaacuaccagaagucccugaucgaccucaacaaggugauccugcuggaccccuccaucaucgaggccaagauggagcucgaggaggucacccgccugcugaaccucaaggacaagacggccccguucaacaaggagaaggagcggcgcaagaucgagauccaggaggugaacgaggggaaggaggagcccggccggcccgccggggaggucagcaugggcugccuggcguccgagaagggcggcaagagcucccgcagccccgaggacccggagaagcugcccaucgccaagcccaacaacgccuacgaguucgggcagaucaucaacgcccucuccacccggaaggacaaggaggccugcgcgcaccuccuggccaucaccgcccccaaggaccugccgauguuccugagcaacaagcuggagggggacaccuuccuccugcugauccagucccucaagaacaaccugaucgagaaggaccccagccugguguaccagcaccuccuguaccuguccaaggccgagcgcuucaagaugaugcucacgcugaucagcaagggccagaaggagcugaucgagcagcuguucgaggaccuguccgacacccccaacaaccacuucacccuggaggacauccaggcccucaagcggcaguacgagcuguga

SEQ ID NO: 36956 - RNA, 1314 nt, Artificial Sequence
  derived and/or modified sequence opt1 from SPAG4__Homo_sapiens__NP_003107
augcgccggagcucccgccccggcagcgccuccagcucccggaagcacaccccgaacuucuucagcgagaacuccagcauguccaucaccagcgaggacuccaaggggcugcgcagcgccgagcccggccccggggagcccgagggccggcgcgcgcgggggccguccugcggcgagcccgcccucagcgccggcgugcccgggggcaccaccugggccggguccagccagcagaagcccgccccgcgcucccacaacuggcagaccgcgugcggcgccgccaccguccgcgggggcgccagcgagcccacgggcucccccguggugagcgaggagccccuggaccugcucccgacccuggaccugcgccaggagaugcccccgccccgggucuucaagagcuuccucucccugcuguuccaggggcucagcgugcugcugucccucgcgggcgacgugcuggucagcauguaccgcgaggugugcuccauccgguuccuguucaccgccgugagccuccugucccuguuccucagcgccuucuggcuggggcugcucuaccuggucagcccccuggagaacgagcccaaggagaugcucacccuguccgaguaccacgagcgcgugcggucccagggccagcagcugcagcagcuccaggccgagcuggacaagcugcacaaggaggugagcacgguccgcgccgcgaacuccgagcggguggccaagcucguguuccagcgccugaacgaggacuucguccggaagcccgacuacgcccugagcuccgugggcgccagcaucgaccuccagaagaccucccacgacuacgccgaccgcaacaccgcguacuucuggaaccgguucagcuucuggaacuacgcccggcccccgaccgugauccuggagccccacgucuuccccgggaacugcugggccuucgagggcgaccagggccagguggugauccagcugcccgggcgcguccagcucuccgacaucacgcugcagcacccgccgcccagcguggagcacaccgggggcgccaacagcgcgccccgggacuucgccguguucggccugcaggucuacgacgagaccgaggugucccucgggaaguucaccuucgacgucgagaaguccgagauccagacguuccaccuccagaacgacccgcccgccgccuuccccaaggugaagauccagauccugagcaacuggggccacccccgcuucacgugccuguaccgggugcgcgcccacgggguccggaccagcgagggcgccgagggguccgcgcagggcccccacuga

SEQ ID NO: 36957 - RNA, 3582 nt, Artificial Sequence
  derived and/or modified sequence opt1 from SPAG5__Homo_sapiens__NP_006452
auguggcgcgugaagaagcugagccucucccugagccccuccccgcagaccggcaagcccagcaugcggacgccccugcgcgagcucacccugcagcccggggcccugaccaacuccggcaagcggagcccggccugcuccagccucacccccucccugugcaagcuggggcuccaggagggcagcaacaacuccagccccgucgacuucgugaacaacaagcgcaccgaccuguccagcgagcacuucucccacagcuccaaguggcuggagacgugccagcacgagagcgacgagcagccccucgacccgaucccccagaucuccagcacccccaagaccagcgaggaggcgguggacccccuggggaacuacauggucaagaccaucgugcuggugccgagcccccucggccagcagcaggacaugaucuucgaggcccggcuggacacgauggccgagaccaacagcaucucccugaacggcccccuccgcaccgacgaccugguccgggaggagguggcccccugcaugggggaccgcuucagcgagguggccgcggucuccgagaagccgaucuuccaggagagccccucccaccuccuggaggagagcccgcccaaccccugcuccgagcagcugcacugcagcaaggagucccugagcucccggaccgaggccgugcgcgaggaccucgugcccagcgaguccaacgccuuccugcccagcuccguccuguggcucagccccuccacggcccuggcggccgacuuccgggugaaccacguggacccggaggaggagaucgucgagcacggcgccauggaggagcgcgagaugcgguuccccacccaccccaaggagagcgagaccgaggaccaggcccuggugagcuccguggaggacauccucagcacgugccugacccccaaccuggucgagauggagucccaggaggccccggggcccgcgguggaggacgugggccgcauccucgggagcgacaccgaguccuggaugagcccccuggccuggcuggagaagggcgucaacaccuccgugaugcucgagaaccugcggcagagccugucccucccgagcaugcugcgcgacgccgccaucggcaccacgcccuucuccacgugcagcguggggaccugguucacccccuccgcgccccaggagaaguccaccaacaccucccagaccggccuggucgggaccaagcacagcacguccgagaccgagcagcuccugugcggccggccgcccgaccugaccgcccucagccgccacgaccuggaggacaaccugcucagcucccuggugauccuggagguccugagccggcagcuccgcgacuggaagucccagcuggccgugccccaccccgagacccaggacagcuccacgcagaccgacaccagccacuccggcaucaccaacaagcugcagcaccucaaggagagccacgagauggggcaggcccugcagcaggcccggaacgugaugcaguccuggguccugaucagcaaggagcucaucucccugcugcaccucagccugcugcaccucgaggaggacaagacgaccgugucccaggagagccgccgcgccgagacccuggugugcugcugcuucgaccugcucaagaagcugcgggcgaagcugcagucccucaaggccgagcgcgaggaggcccggcaccgcgaggagauggcccugcggggcaaggacgccgcggagaucguccuggaggccuucugcgcccacgccagccagcgcaucucccagcucgagcaggaccuggcgagcaugcgggaguuccgcgggcugcucaaggacgcccagacccagcuggugggccugcacgccaagcaggaggagcucgugcagcagaccgucucccugacgagcacccugcagcaggacuggcggagcaugcagcucgacuacaccaccuggacggcccugcugucccgcagccggcagcucaccgagaagcugaccgugaagucccagcaggcccugcaggagcgcgacguggcgaucgaggagaagcaggaggucagccgggugcucgagcaggucuccgcccagcuggaggagugcaaggggcagaccgagcagcuggagcucgagaacagccgccuggccacggaccugcgggcccagcuccagauccuggccaacauggacucccagcugaaggagcuccagagccagcacacccacugcgcgcaggaccuggccaugaaggacgagcugcucugccagcugacccaguccaacgaggagcaggccgcccaguggcagaaggaggagauggcccugaagcacaugcaggcggagcuccagcagcagcaggccgugcuggccaaggaggugcgcgaccugaaggagacccucgaguucgccgaccaggagaaccagguggcgcaccuggagcugggccaggucgagugccagcucaagacgacccuggaggugcugcgggagcgcagccuccagugcgagaaccugaaggacaccguggagaaccugaccgccaagcucgccuccacgaucgccgacaaccaggagcaggaccuggagaagacccggcaguacagccagaagcugggccuccugaccgagcagcugcagucccucacccuguuccugcagacgaagcucaaggagaagaccgagcaggagacccugcugcucagcaccgccugcccgcccacgcaggagcacccccugcccaacgaccgcaccuuccugggguccauccucaccgcggucgccgacgaggagccggagagcacccccgugccccugcugggcuccgacaagagcgccuucacgcgcguggccuccauggucagccuccagcccgccgagaccccggggauggaggagagccuggcggagauguccaucaugaccaccgagcugcagagccucugcucccugcugcaggagagcaaggaggaggccauccggacgcuccagcgcaagaucugcgagcugcaggcccggcugcaggcccaggaggagcagcaccaggaggugcagaaggccaaggaggcggacaucgagaagcucaaccaggcccugugccugcgcuacaagaacgagaaggagcuccaggaggugauccagcagcagaacgagaagauccuggagcagaucgacaaguccggcgagcugaucagccugcgggaggaggucacccaccucacccgcucccugcggcgcgccgagaccgagacgaaggugcugcaggaggcccucgcggggcagcuggacagcaacugccagcccauggccaccaacuggauccaggagaagguguggcugucccaggaggucgacaagcuccgggugauguuccuggagaugaagaacgagaaggagaagcugaugaucaaguuccagagccaccgcaacauccucgaggagaaccugcggcgcuccgacaaggagcuggagaagcucgacgacaucgugcagcacaucuacaagacccugcugagcauccccgaggucgugcggggcugcaaggagcuccagggccugcuggaguuccucuccuga

SEQ ID NO: 36958 - RNA, 1455 nt, Artificial Sequence
  derived and/or modified sequence opt1 from SPAG6__Homo_sapiens__NP_001240783
augcacagccugaccauggaccucuggauccccaacggccaggccggggugaugucccugcugcgcacccuccugcuggacgucgugccgacgauccagcagaccgccgcgcucgcccugggccggcuggccaacuacaacgacgaccucgccgaggccguggucaagugcgacauccugccccagcugguguacagccucgcggagcagaaccgcuucuacaagaaggccgccgccuucgugcugcgggcggucgggaagcacagcccccagcuggcccaggccaucguggacugcggcgcccucgacacccuggugaucugccuggaggacuucgaccccggggucaaggaggccgcggccugggcccuccgcuacaucgcccggcacaacgccgagcugucccaggcggugguggacgccggcgccgucccgcugcucgugcugugcauccaggagcccgagaucgcccugaagcgcaucgccgcguccgcccucagcgacaucgccaagcacucccccgagcuggcccagaccguggucgacgccggcgcgguggcccaccuggcccagaugauccucaaccccgacgccaagcugaagcaccagauccugagcgcgcucucccaggugagcaagcacuccgucgaccuggccgagauggugguggaggccgagaucuucccggucgugcugacgugccucaaggacaaggacgaguacgugaagaagaacgccagcacccugauccgggagaucgccaagcacacccccgagcugucccagcucgucgugaacgccgggggcgucgcggccgugaucgacugcaucgggagcugcaagggcaacacccgccugcccgggaucaugaugcugggcuacguggccgcccacuccgagaaccucgcgauggccgucaucaucagcaagggcgugccccagcuguccgugugccugagcgaggagccggaggaccacaucaaggccgccgccgcgugggcccucgggcagaucggccggcacacgcccgagcacgcccgcgccgucgcggugaccaacacccugcccgugcugcucucccuguacaugagcaccgagagcuccgaggaccugcaggucaagagcaagaaggccaucaagaacauccuccagaagugcacguaccugcccgcccuggagccguuccuguacgacgccccgcccaacauccucaagcacgugguggggcaguucuccaagguccugccccacgacagcaaggcccggcgccuguucgugaccuccggcggccucaagaaggugcaggagaucaaggcggagcccgggagccugcugcaggaguacaucaacuccaucaacagcugcuaccccgaggagaucguccgguacuacucccccggcuacagcgacacccuccugcagcgcguggacuccuaccagccccugaacaacuga

SEQ ID NO: 36959 - RNA, 684 nt, Artificial Sequence
  derived and/or modified sequence opt1 from SPAG7__Homo_sapiens__NP_004881
auggccgaccugcucggcagcauccuguccagcauggagaagcccccgucccugggggaccaggagacccgccggaaggcccgcgagcaggcggcccggcucaagaagcugcaggagcaggagaagcagcagaagguggaguuccgcaagcggauggagaaggaggucagcgacuucauccaggacuccggccagaucaagaagaaguuccagcccaugaacaagaucgagcgcagcauccugcacgacgugguggaggucgccgggcucaccuccuucagcuucggcgaggacgacgacugccgguacgugaugaucuucaagaaggaguucgcccccuccgacgaggagcuggacagcuaccgccgcggggaggagugggacccccagaaggccgaggagaagcggaagcugaaggagcucgcgcagcggcaggaggaggaggccgcccagcagggcccgguggucgugucccccgccagcgacuacaaggacaaguacucccaccugaucggcaagggggcggccaaggacgccgcccacaugcugcaggccaacaagacguacggcugcgugcccgucgcgaacaagcgcgacacccggagcaucgaggaggccaugaacgagauccgcgccaagaagcggcuccgccaguccggggaggagcugcccccgaccagcuga

SEQ ID NO: 36960 - RNA, 1458 nt, Artificial Sequence
  derived and/or modified sequence opt1 from SPAG8__Homo_sapiens__NP_001034681
auggagaccaacgagagcaccgagggcucccgcagccggucccgcagccuggacauccagcccuccagcgaggggcucggcccgacguccgagcccuuccccagcuccgacgacagcccccgguccgcccuggccgcggccaccgccgccgccgcggccgccgccagcgcggccgccgccaccgccgcguucaccacggccaaggccgccgcccuguccaccaagaccccggcgcccugcagcgaguucauggagcccuccagcgaccccucccuccugggggagccgugcgccggccccggguucacccacaacaucgcccacggcagccugggcuucgagcccguguacgucuccugcaucgcccaggacacgugcaccaccaccgaccacagcagcaaccccgggccggugcccggcuccagcuccgggcccgugcucggcagcuccagcggggccggccacggcuccgggagcggcuccgggcccggcugcggcagcgucccgggguccggcagcgggcccggccccggguccggccccggcagcgggccgggccacggguccggcagccaccccgggcccgcguccggccccggcccggacacggggcccgacagcgagcugucccccugcaucccgcccggcuuccgcaaccugguggccgaccgggugcccaacuacaccagcuggagccagcacugccccugggagccgcagaagcagccgcccugggaguuccuccagguccuggagcccggggcccgcggccuguggaagccgcccgacaucaaggggaagcucauggugugcuacgagacccugccccggggccagugccugcucuacaacugggaggaggagcgcgccaccaaccaccuggaccaggugcccuccaugcaggacggcagcgaguccuucuucuuccggcacgggcaccgcggccugcucacgaugcagcucaagagccccaugcccuccagcaccacccagaaggacuccuaccagccgcccgggaacgucuacuggccccugcggggcaagcgcgaggccaugcucgagaugcugcugcagcaccagaucugcaaggaggugcaggcggagcaggagcccacccggaagcuguucgagguggagagcgucacgcaccacgacuaccgcauggagcuggcccaggccggcacccccgcccccaccaagccgcacgacuaccggcaggagcagcccgagaccuucuggauccagcgcgcgccccagcugcccgggguguccaacauccggacgcucgacaccccguuccgcaagaacugcagcuucuccacccccgugccccugagccugggcaagcuccugcccuacgagccggagaacuaccccuaccagcugggggagaucuccagccuccccugcccgggcgggcggcugggcggcgggggcgggcgcaugacccccuucuga

SEQ ID NO: 36961 - RNA, 3936 nt, Artificial Sequence
  derived and/or modified sequence opt1 from SPAG9__Homo_sapiens__NP_001123999
auggagcuggaggacggcguggucuaccaggaggagcccgggggcagcggggccgugauguccgagcgcgugagcggccucgccggguccaucuaccgggaguucgagcgccugaucggccgguacgacgaggaggucgugaaggagcugaugccgcucguggucgcggugcuggagaaccuggacagcguguucgcccaggaccaggagcaccaggucgagcucgagcugcugcgcgacgacaacgagcagcucaucacccaguacgagcgggagaaggcccugcgcaagcacgccgaggagaaguucaucgaguucgaggacucccaggagcaggagaagaaggaccugcagacccggguggagagccucgagucccagacccgccagcuggagcugaaggccaagaacuacgcggaccagaucagccggcucgaggagcgcgaggccgagcugaagaaggaguacaacgcccugcaccagcggcacaccgagaugauccacaacuacauggagcaccucgagcgcaccaagcugcaccagcuguccggcagcgaccagcucgaguccaccgcccacagccggauccgcaaggagcggcccaucucccuggggaucuucccccugcccgcgggcgacgggcuccugacgccggacgcccagaagggcggggagacccccggcagcgagcaguggaaguuccaggagcugucccagccccgcagccacaccucccucaaggacgagcugagcgacgugucccagggcgggagcaaggccaccacgcccgccagcaccgccaacuccgacgucgcgaccaucccgaccgacacgccccugaaggaggagaacgagggcuucgugaaggugaccgacgcccccaacaagagcgagaucuccaagcacaucgagguccagguggcccaggagacccggaacgugagcaccggguccgccgagaacgaggagaaguccgagguccaggccaucaucgaguccacgcccgagcucgacauggacaaggaccugagcggcuacaagggcuccagcaccccgaccaaggggaucgagaacaaggcguucgaccgcaacaccgagucccuguucgaggagcucagcuccgccggcagcgggcugaucggcgacguggacgagggggccgaccugcucggcaugggccgggagguggagaaccugauccuggagaacacgcagcuccuggagaccaagaacgcccugaacaucgucaagaacgaccucaucgccaagguggacgagcugaccugcgagaaggacgugcugcagggggagcucgaggcggucaagcaggccaagcugaagcuggaggagaagaaccgcgagcucgaggaggagcugcggaaggcccgcgccgaggccgaggacgcgcgccagaaggccaaggacgacgacgacuccgacauccccaccgcccagcggaagcgcuucacgcggguggagauggcccgcguccugauggagcggaaccaguacaaggagcgccugauggagcuccaggaggcggugcgguggaccgagaugauccgcgccagccgggagaaccccgccaugcaggagaagaagcgcuccagcaucuggcaguucgugcccacccgguucucccgccuguucagcagcuccagcaacaccacgaagaagccggagccgcccgucaaccugaaguacaacgcccccaccucccacgugacccccagcgugaagaagcgguccagcacccucucccagcugcccggcgacaagagcaaggccuucgacuuccuguccgaggagacggaggcgagccucgccucccgccgggagcagaagcgcgagcaguaccggcaggucaaggcccacgugcagaaggaggacgggcgcgugcaggccuucggcuggagccugccccagaaguacaagcaggucaccaacgggcagggcgagaacaagaugaagaaccugcccgugccgguguaccuccggccccuggacgagaaggacaccuccaugaagcuguggugcgccgucggcgugaaccucagcgggggcaagacccgcgacgggggcuccguggucggggcgagcguguucuacaaggacguggccggccuggacacggagggcuccaagcagcgcagcgccagccaguccagccuggacaagcucgaccaggagcugaaggagcagcagaaggagcugaagaaccaggaggagcucuccagccuggucuggaucugcaccuccacccacagcgccaccaaggugcugaucaucgacgccgugcagcccgggaacauccucgacuccuucaccgucugcaacagccacgugcugugcaucgcguccgugcccggcgcccgggagacggacuacccggccggggaggaccugagcgaguccggccaggucgacaaggccagccucugcggcuccaugaccagcaacuccagcgcggagaccgacucccugcucgggggcaucaccgugguggggugcagcgccgagggcgucacgggggccgccaccucccccagcaccaacggcgccagccccgugauggacaagccgcccgagauggaggcggagaacuccgagguggacgagaacguccccaccgccgaggaggccacggaggccaccgagggcaacgccgggagcgcggaggacaccguggacaucucccagaccggcguguacacggagcacgucuucaccgacccccugggggugcagaucccggaggaccugagccccguguaccaguccagcaacgacuccgacgccuacaaggaccagaucagcguccugcccaacgagcaggaccucgugcgcgaggaggcccagaagauguccagccugcugcccaccauguggcucggcgcccagaacgggugccuguacgugcacuccagcgucgcccaguggcggaagugccugcacuccaucaagcucaaggacagcauccuguccaucgugcacgugaagggcaucguccugguggcgcucgccgacggcacccuggccaucuuccaccgcgggguggacggccagugggaccugagcaacuaccaccuccuggaccuggggcggccgcaccacuccauccgcugcaugacggucgugcacgacaagguguggugcggcuaccggaacaagaucuacgucgugcagcccaaggccaugaagaucgagaaguccuucgacgcgcacccccgcaaggagagccaggugcggcagcucgccugggucggggacggcgugugggucagcauccgccuggacagcacccugcggcucuaccacgcccacaccuaccagcaccuccaggacguggacaucgagcccuacguguccaagaugcugggcaccgggaagcugggcuucagcuucguccgcaucacggcccugaugguguccugcaaccggcuguggguggggaccggcaacggggucaucaucagcaucccgcucaccgagaccaacaagacguccggcgugcccggcaaccgccccgggagcgugauccgggucuacggcgacgagaacuccgacaaggugacccccgggaccuucaucccguacugcagcauggcccacgcgcagcugugcuuccacggccaccgcgacgccgugaaguucuucgucgccgugcccggccaggugaucagcccccagagcuccagcuccgggaccgaccugacgggcgacaaggccgggcccagcgcccaggagccgggcucccagacgccccucaagagcaugcuggucaucuccgggggcgagggcuacaucgacuuccggaugggggacgagggcggggagagcgagcugcucggcgaggaccugccccuggagcccuccgugaccaaggcggagcgcagccaccucaucguguggcaggucauguacgggaacgaguga

SEQ ID NO: 36962 - RNA, 1536 nt, Artificial Sequence
  derived and/or modified sequence opt1 from SPAM1__Homo_sapiens__XP_011514825
augggcgugcugaaguucaagcacaucuucuuccgcagcuucgucaaguccagcggggugucccagaucguguucaccuuccuccugauccccugcugccugacccucaacuuccgggccccgcccgucauccccaacgugcccuuccugugggccuggaacgcgccgagcgaguucugccugggcaaguucgacgagccccucgacaugucccuguucagcuucaucgggagcccccgcaucaacgccacgggccagggggugaccaucuucuacgucgaccggcugggcuacuaccccuacaucgacagcaucaccggcgugaccgugaacgggggcaucccgcagaagaucucccuccaggaccaccuggacaaggccaagaaggacaucacguucuacaugcccgucgacaaccuggggauggccgugaucgacugggaggaguggcgccccaccugggcccggaacuggaagcccaaggacguguacaagaaccgcagcaucgagcucguccagcagcagaacgugcagcugucccugaccgaggcgaccgagaaggccaagcaggaguucgagaaggccggcaaggacuuccucguggagacgaucaagcuggggaagcugcuccggccgaaccaccuguggggcuacuaccuguuccccgacugcuacaaccaccacuacaagaagcccggcuacaacgggagcugcuucaacgucgagaucaagcgcaacgacgaccucuccuggcuguggaacgagagcaccgcccuguaccccuccaucuaccucaacacccagcagagcccgguggcggccacccuguacgugcggaaccgcguccgggaggccauccgcguguccaagauccccgacgccaagagcccccugcccguguucgccuacacgcggaucgucuucaccgaccaggugcucaaguuccugucccaggacgagcugguguacaccuucggcgagaccgucgcgcucggggccagcggcaucgugaucuggggcacgcugagcaucaugcgcuccaugaaguccugccugcuccuggacaacuacauggagaccauccugaacccguacaucaucaacgucacccucgccgccaagaugugcucccaggugcugugccaggagcagggggugugcauccggaagaacuggaacagcuccgacuaccugcaccucaaccccgacaacuucgccauccagcuggagaagggcgggaaguucaccguccgcggcaagcccacgcuggaggaccucgagcaguucagcgagaaguucuacugcuccugcuacagcacccuguccugcaaggagaaggcggacgugaaggacaccgacgccguggacgucugcaucgccgacggggugugcaucgacgccuuccugaagcccccgauggagaccgaggagccccagaucuucuacaacgccagccccuccacgcucagcgcgaccauguucaucuggcggcuggaggugugggaccagggcaucucccgcaucggcuucuucuga

SEQ ID NO: 36963 - RNA, 294 nt, Artificial Sequence
  derived and/or modified sequence opt1 from SPANXA2__Homo_sapiens__NP_663695
auggacaagcagagcuccgccggcggggugaagcgcagcguccccugcgacuccaacgaggccaacgagaugaugccggagacccccaccggcgacagcgacccccagcccgcgccgaagaagaugaagacguccgagagcuccaccauccugguggugcgguaccgccggaacuucaagcgcaccagccccgaggagcuccugaacgaccacgcccgggagaaccgcaucaacccccugcagauggaggaggaggaguucauggagaucauggucgagauccccgccaaguga

SEQ ID NO: 36964 - RNA, 312 nt, Artificial Sequence
  derived and/or modified sequence opt1 from SPANXB1__Homo_sapiens__NP_115850
augggccagcagagcuccgugcgccggcugaagcgcagcguccccugcgaguccaacgaggccaacgaggccaacgaggcgaacaagaccaugccggagacccccacgggggacagcgacccccagcccgccccgaagaagaugaagaccuccgagagcuccaccauccucguggugcgguaccgccggaacgucaagcgcaccagccccgaggagcugcugaacgaccacgcccgggagaaccgcaucaaccccgaccagauggaggaggaggaguucaucgagaucacgaccgagcggcccaagaaguga

SEQ ID NO: 36965 - RNA, 294 nt, Artificial Sequence
  derived and/or modified sequence opt1 from SPANXD__Homo_sapiens__NP_115793
auggacaagcagagcuccgccggcggggugaagcgcagcguccccugcgacuccaacgaggccaacgagaugaugccggagaccagcuccggcuacagcgacccccagcccgcgcccaagaagcugaagaccuccgagagcuccacgauccucguggugcgguaccgccggaacuucaagcgcaccagcccggaggagcuggucaacgaccacgcccggaagaaccgcaucaacccccugcagauggaggaggaggaguucauggagaucaugguggagauccccgccaaguga

SEQ ID NO: 36966 - RNA, 300 nt, Artificial Sequence
  derived and/or modified sequence opt1 from SPANXN4__Homo_sapiens__NP_001009613
auggaggagcccaccagcuccaccaacgagaacaagaugaaguccccgugcgagagcaacaagcgcaagguggacaagaagaagaagaaccugcaccgggccagcgcccccgagcagucccucaaggagacggagaaggcgaaguaccccacccuggucuucuacugccgcaagaacaagaagcggaacagcaaccagcuggagaacaaccagcccaccgaguccagcaccgacccgaucaaggagaagggcgaccucgacaucuccgccgggagcccccaggacggcgggcagaacuga

SEQ ID NO: 36967 - RNA, 912 nt, Artificial Sequence
  derived and/or modified sequence opt1 from SPARC__Homo_sapiens__NP_003109
augcgcgccuggaucuucuuccugcucugccuggccggccgggcccuggccgcgccccagcaggaggcccucccggacgagaccgagguggucgaggagaccguggccgaggugacggaggucagcgugggggccaaccccgugcaggucgaggugggcgaguucgacgacggggccgaggagaccgaggaggagguggucgccgagaaccccugccagaaccaccacugcaagcacggcaaggugugcgagcuggacgagaacaacacccccaugugcgugugccaggacccgaccuccugccccgcccccaucggggaguucgagaaggucugcagcaacgacaacaagacguucgacuccagcugccacuucuucgcgaccaagugcacccuggagggcaccaagaagggccacaagcuccaccuggacuacaucgggcccugcaaguacaucccgcccugccuggacuccgagcucacggaguucccccugcgcaugcgggacuggcugaagaacgugcucgugacccuguacgagcgcgacgaggacaacaaccugcucaccgagaagcagaagcugcgggucaagaagauccacgagaacgagaagcgccuggaggccggcgaccaccccguggagcuccuggcccgggacuucgagaagaacuacaacauguacaucuucccggugcacuggcaguucgggcagcuggaccagcaccccaucgacggcuaccucagccacaccgagcuggcgccccugcgcgcgccccucaucccgauggagcacugcacgacccgguucuucgagaccugcgaccuggacaacgacaaguacaucgcccuggacgagugggccgggugcuucggcaucaagcagaaggacaucgacaaggaccucgucaucuga

SEQ ID NO: 36968 - RNA, 1995 nt, Artificial Sequence
  derived and/or modified sequence opt1 from SPARCL1__Homo_sapiens__NP_001121782
augaagaccggccuguucuuccucugccugcuggggaccgccgccgcgauccccacgaacgcccgccuccugagcgaccacuccaagccgaccgccgagaccguggcccccgacaacaccgccauccccagccugcgggcggaggccgaggagaacgagaaggagacggccgucuccaccgaggacgacagccaccacaaggccgagaaguccagcgugcucaaguccaaggaggagagccacgagcaguccgcggagcagggcaagagcuccagccaggagcuggggcugaaggaccaggaggacuccgacggccaccucagcgugaaccuggaguacgcccccaccgaggggacccuggacaucaaggaggacauguccgagccgcaggagaagaagcucagcgagaacacggacuuccuggcccccggcgucuccagcuucaccgacuccaaccagcaggagagcaucaccaagcgcgaggagaaccaggagcagccccggaacuacagccaccaccagcugaaccgcuccagcaagcacucccagggccuccgggaccaggggaaccaggagcaggaccccaacaucagcaacggcgaggaggaggaggagaaggagccgggggaggugggcacccacaacgacaaccaggagcgcaagacggagcugccccgggagcacgccaacuccaagcaggaggaggacaacacccagagcgacgacauccuggaggaguccgaccagcccacccaggugagcaagaugcaggaggacgaguucgaccaggggaaccaggagcaggaggacaacuccaacgccgagauggaggaggagaacgcgagcaacgucaacaagcacauccaggagaccgaguggcagucccaggagggcaagacgggccucgaggccaucagcaaccacaaggagaccgaggagaagaccguguccgaggcccugcugauggagcccaccgacgacgggaacacgaccccgcgcaaccacggcguggacgacgacggggacgacgacggcgacgacggcgggaccgacggcccccggcacagcgccuccgacgacuacuucauccccagccaggccuuccucgaggcggagcgcgcccaguccaucgccuaccaccugaagaucgaggagcagcgggagaagguccacgagaacgagaacaucgggaccacggagcccggcgagcaccaggaggccaagaaggccgagaacagcuccaacgaggaggagaccagcagcgaggggaacaugcgcgugcacgcgguggacuccugcaugagcuuccagugcaagcggggccacaucugcaaggccgaccagcagggcaagccgcacugcgucugccaggaccccgugaccugcccgcccaccaagccccuggaccaggugugcgggacggacaaccagaccuacgccuccagcugccaccucuucgccaccaagugccgccuggagggcaccaagaaggggcaccagcugcagcucgacuacuucggcgccugcaaguccauccccacgugcaccgacuucgaggucauccaguucccccugcggaugcgcgacuggcugaagaacauccucaugcagcuguacgaggcgaacagcgagcacgccggguaccugaacgagaagcagcggaacaaggugaagaagaucuaccucgacgagaagcgccugcuggccggcgaccaccccaucgaccuccugcugcgggacuucaagaagaacuaccacauguacguguacccgguccacuggcaguucuccgagcucgaccagcaccccauggaccgcgugcugacccacagcgagcuggcgccccuccgggccucccuggugcccauggagcacugcaucacccgcuucuucgaggagugcgacccgaacaaggacaagcacaucacgcugaaggaguggggccacugcuucgggaucaaggaggaggacaucgacgagaaccuccuguucuga

SEQ ID NO: 36969 - RNA, 1851 nt, Artificial Sequence
  derived and/or modified sequence opt1 from SPAST__Homo_sapiens__NP_055761
augaacagccccggcgggcgcggcaagaagaagggguccggcggggccagcaacccggugccgccccggcccccgccgcccugccuggcccccgcgccgcccgccgccggccccgcgcccccgcccgagagcccccacaagcgcaaccucuacuacuucuccuacccccuguucgucggcuucgcccugcuccggcugguggccuuccaccuggggcuccuguucguguggcugugccagcgcuucucccgggcccucauggccgccaagcgcagcuccggcgcggccccggcccccgccagcgccuccgcgcccgcccccguccccgggggcgaggccgagcgggugcgcguguuccacaagcaggccuucgaguacaucagcaucgcccugcggaucgacgaggacgagaaggcggggcagaaggagcaggccgucgagugguacaagaagggcaucgaggagcuggagaagggcaucgccgugaucgugaccgggcagggcgagcagugcgagcgcgcccggcgccuccaggccaagaugaugaccaaccuggucauggcgaaggaccggcugcagcuccuggagaagaugcagcccgugcugcccuucuccaagagccagacggacguguacaacgacuccaccaaccucgccugccgcaacgggcaccuccagagcgaguccggcgccguccccaagcggaaggacccccugacccacaccagcaacucccugccccgcagcaagacggugaugaagaccggcuccgccgggcugagcggccaccaccgggcccccagcuacuccgggcugagcaugguguccggcgucaagcaggggagcggccccgcgccgaccacccacaagggcacgcccaagaccaaccgcaccaacaagcccuccaccccgacgaccgccacccggaagaagaaggaccucaagaacuuccgcaacguggacagcaaccuggccaaccugaucaugaacgagaucguggacaacgggaccgccgucaaguucgacgacaucgcgggccaggaccucgccaagcaggcccugcaggagaucgugauccugcccucccuccggcccgagcuguucacggggcugcgcgcccccgcccgcggccuccugcuguucgggccgcccggcaacggcaagaccaugcucgcgaaggccguggccgccgagagcaacgccaccuucuucaacaucuccgcggccagccugaccuccaaguacgucggggagggcgagaagcuggugcgggcccucuucgccguggcccgcgagcugcagcccagcaucaucuucaucgacgaggucgacucccugcucugcgagcggcgcgagggggagcacgacgcgagccggcgccugaagacggaguuccugaucgaguucgacggcgugcaguccgccggggacgaccggguccucgugaugggcgccaccaaccgcccccaggagcuggacgaggccgugcugcggcgcuucaucaagcgggucuacgugagccucccgaacgaggagacccgccugcugcugcucaagaaccugcugugcaagcagggcagcccccucacccagaaggagcuggcgcagcuggcccggaugacggacggguacuccggcuccgaccucaccgcccuggccaaggacgccgcgcuggggcccauccgcgagcucaagcccgagcaggucaagaacaugagcgccagcgagaugcggaacauccgccuguccgacuucaccgagagccugaagaagaucaagcgguccgugagcccgcagacccucgaggccuacauccgcuggaacaaggacuucggcgacacgaccguguga

SEQ ID NO: 36970 - RNA, 3834 nt, Artificial Sequence
  derived and/or modified sequence opt1 from SPATA13__Homo_sapiens__NP_001159743
augacccaggccgccgugcgccccugggcgccgugccuggagaacaugaccacggcccccaacggccucgggcccggccccgccgccccgugcgccgggagcgaccugaaggacgcgaagauggucaccucccuggccugcggcaacggggugugcggcugcagccccggcggggacaccgacacccaggaggccaagcucucccccgccaagcuggugcggcuguucagcacgucccgcaagcggaccggcgcgcaccccgagcgcccgcacagcaugguccucguggggaacuccagcaccuggaacacccuggccuccuuccggaagaugggcagcuucaagaagcugaaguccagcgugcucaaggggauccagucccgcgagggcagcaacgccugcuccaagggcgaggccagcgagcacgggcugggcaaguccauccccaacggggccguccccggcgcgcaggccagccggggcagcccccuggccccggggcccgccugcggcgcccuccgccccgcggagugggggacgcuggacggcuccgaccuggaggacaccgacgacgccuuccagcggagcacccaccgcucccggagccuccgccgggccuacgggcugggccgcaucugccugcucgacgcgccccagaaccacgccaccccgacgaucgccaccggccaggugcccgccgugugcgagauccugguccgggaccccgagaacaacuccaugggguaccgccggagcaaguccaccgacaaccuggccuuccucaagaaguccuccuucaagcgcaagagcaccuccaaccuggccgaccugcggacggcccacgacgcgcgcgugccccagcggacccucagcuccagcuccaccgacagccagaagcugggcuccgggcgcaccaagcgcuggcggagcccgauccgcgccaaggacuucgaccggguguucaagcuggucuccaacgugacggaggccgccuggcgccgggagagcccccgcuccggcgcgcccagccccggggaggccagccuccggcugcaggcccacucccgccugcacgacgacuacagccggcgcgugucccggagcaccgagcaggacucccgccggggcggcgccgucaugcacgggaccaccgccacgugcaccguggcgccgggcuucgggagcgccaccuccaagggcccccaccucgacgccgacaccgccguguucccccuggagaccaagagcuccugggccgucgagagcgacuccagcugcacgugcagcagccugcccuccccgaucgugcaggacgugcucagcaaggacuccugcgaccccaacgcggggagccagcugacguucgaccccgagcagccgcccacgccccugcgccccaccaccccgaagccccagagcccccagagcccccaguccccgggcgccggcuccgccagcugccacuccaaccacagcgcccucuccgccaacagcgaggaguccgaggggcgggcggaggagcccgcccagcgcgagcccggccccgugagccugcaggacccgcuggaggccacccacggggacgagggcuccaaggaccuccuggugaacaucggcguggccgcggggcccgaggagaaggagaaggaggaggucgugcccgacggccccuggcggcgcagcuccagccaggacgaggagcggaccgaggcccagcgcaccccgaagcgccgguggggguccggccgccggccccgcccccggcccuucagcgacuacgggcagcuggccucccgcagccucuccaucccggaggacagcgucgccgccgacccccagaaggaggaccggguggacgaggacccccaggcgagcaugaccuccgccagccccgaggaccagaacgccccggugggcugccccaagggcgcccgccggcgccggcccaucuccgucaucgggggcgugagccuguacgggaccaaccagaccgaggagcuggacaaccuccugacccagccggccucccgcccgcccaugcccgcgcaccaggugccgcccuacaaggccgucagcgcccgguuccgccccuucacguucucccagagcacccccaucggccuggaccggguggggcgccggcgccagaugcgggccuccaacgugagcuccgacggcggcaccgagcccagcgcccucgucgacgacaacggguccgaggaggacuucagcuacgaggaccugugccaggcgagcccccgcuaccugcagcccggcggggagcagcuggccaucaacgagcucaucuccgacggcaacguggugugcgccgaggcccugugggaccacgucaccauggacgaccaggagcugggguucaaggcgggcgacgugauccaggugcucgaggccuccaacaaggacuggugguggggccggagcgaggacaaggaggccugguuccccgccuccuucguccgccugcgcgugaaccaggaggagcugagcgagaacagcuccagcacgccguccgaggagcaggacgaggaggccagccagucccggcaccgccacugcgagaacaagcagcagaugcggaccaacgugauccgcgagaucauggacaccgagcgggucuacaucaagcaccuccgcgacaucugcgagggguacauccggcagugccgcaagcacaccggcauguucacgguggcgcagcuggccaccaucuucgggaacaucgaggacaucuacaaguuccagcggaaguuccugaaggaccucgagaagcaguacaacaaggaggagccccaccugagcgagaucggcuccugcuuccugcagaaccaggagggguucgccaucuacagcgaguacugcaacaaccaccccggcgccugccucgagcuggccaaccugaugaagcagggcaaguaccgccacuucuucgaggcgugccggcuccugcagcagaugaucgacaucgccaucgacggguuccugcucacccccgugcagaagaucugcaaguacccgcugcagcuggccgagcuccugaaguacaccacgcaggagcacggcgacuacuccaacaucaaggccgccuacgaggcgaugaagaacgucgccugccugaucaacgagcgcaagcggaagcucgagagcaucgacaagaucgcccgcuggcaggucuccaucguggggugggagggccuggacauccuggaccggagcuccgagcucauccacagcggcgagcugaccaagaucaccaagcaggggaagucccagcagcgcaccuucuuccuguucgaccaccagcucgugagcugcaagaaggaccugcugcggcgcgacaugcucuacuacaagggccggcuggacauggacgagauggagcugguggaccucggggacggccgcgacaaggacugcaaccuguccgugaagaacgccuucaagcuggucagccgcacgaccgacgagguguaccucuucugcgccaagaagcaggaggacaaggcgcgguggcugcaggccugcgccgacgagcgccggcgcgugcaggaggacaaggagauggggauggagaucuccgagaaccagaagaagcuggccaugcucaacgcgcagaaggccggccacggcaagagcaagggguacaaccggugccccgucgccccgccccaccagggccugcaccccauccaccagcgccacaucaccaugcccaccagcgugccccagcagcaggucuucgggcuggccgagcccaagcggaaguccagccucuucuggcacacguucaaccgccugaccccguuccggaaguga

SEQ ID NO: 36971 - RNA, 1710 nt, Artificial Sequence
  derived and/or modified sequence opt1 from SPATA16__Homo_sapiens__NP_114161
auggacgccggcagcucccgcagccuggagaacgccgugaaccggaucuaccacgaccagcucguccccaagaucaacaccuccaagaagaugagcacccuggcgcacccgcccaacauccuggagaugucccaggagaucaagaagaacugcgggggcaagcaggucgagaucacgcucgagcgcaccaagaugaccaaggggaucaaggagaagcagagcaacgaccuggagaaggccgccuucaagcggaaggccgagggcgaggagaagcccacccgcaagaagcaggccaagaucacggagcuggacaaccagcucaucaccaugccccugccgcacaucccccugaagaacaucauggacguggagaugaagcucguguacaucgacgagaugggggugcgguacgaguucguggaguccuucaugagcaccggcucccagccgaccugccaggcggccgagaucgucgacccccugagcgugcacaacuucuccuuccugccccagaucgacaaguggcuccagguggcccugaaggacgccagcuccugcuaccgccagaagaaguacgcgcuggccgccggccaguuccggacggcccucgagcugugcagcaagggggccguccugggcgagcccuucgacgcgcccgccgaggacaucgccuccguggccagcuucaucgagaccaagcucgugaccugcuaccugcgcaugcggaagcccgaccuggcccucaaccacgcgcaccgcuccaucguccugaacccggccuacuuccggaaccaccuccgccaggccaccguguuccggugccuggagcgcuacagcgaggccgcccgguccgcgaugaucgccgacuacauguucuggcucgggggcgggcgcgaggagagcaucagcaagcugaucaagcuguacuggcaggccaugaucgaggaggccaucacgcgggccgaguccuucagcgugauguacacccccuucgcgaccaagauccgcgccgacaagaucgagaaggucaaggacgccuucaccaagacgcaccccgccuacgcggaguacauguacaccgaccugcaggcccugcacaugcucccccagaccguggacugguccagcuucccgccccagcaguaccugcugacccucggcuucaagaacaaggacgacggcaaguuccuggagaagaucuccagccggaagcugcccaucuucacggagcacaagacccccuucgggcucacccgcgaggacaccgugcggcagauggagacgaugggcaagcgcauccugccgauccuggacuucauccgcuccacccagcucaacgggagcuuccccgccuccagcggcgucauggagaagcugcaguacgccucccugcucagccagcugcagcgggugaaggagcagucccaggugaucaaccaggccauggcggagcuggccaccauccccuaccuccaggacaucagccagcaggaggccgagcugcugcagucccucauggccgacgccauggacacccuggagggccgccggaacaacaacgagcgcgucuggaacaugauccagaagguggggcagaucgaggacuuccuguaccagcuggaggacagcuuccucaagacgaagaagcugcggaccgcgcgccggcagaagaccaagaugaagcgccugcagaccgugcagcagcgguga

SEQ ID NO: 36972 - RNA, 1086 nt, Artificial Sequence
  derived and/or modified sequence opt1 from SPATA17__Homo_sapiens__XP_005273109
auggccacccuggcccgccuccaggcgcggagcuccaccgugggcaaccaguacuacuuccgcaacagcgucguggaccccuuccggaagaaggagaacgacgccgccgugaagauccaguccugguuccgcgggugccagguccgggccuacauccgccaccugaaccggaucgugacgaucauccagaagugguggcgcagcuuccugggccggaagcaguaccagcucaccgugcaggucgccuacuacaccaugaugaugaaccuguacaacgcgauggccgugcgcauccagcggcgcuggcggggguaccgcgugcggaaguaccuguucaacuacuacuaccucaaggaguaccugaaggucguguccgagaccaacgacgccauccgcaaggcccuggaggaguucgcggagaugaaggagcgggaggagaagaaggccaaccucgagcgcgaggagaagaagcgggacuaccaggcccgcaagaugcacuaccugcugagcacgaagcagaucccgggcaucuacaacucccccuuccggaaggagcccgaccccugggagcuccagcugcagaaggccaagccgcugacccaccgccgccccaaggugaagcagaaggacagcaccucccucaccgacuggcuggccugcacgagcgcgcgguccuucccccgcagcgagauccugcccccgaucaaccggaagcagugccaggggcccuuccgcgacaucaccgagguccucgagcagcgguaccgcccccuggagcccacccugcggguggccgagccgaucgacgagcucaagcuggcccgcgaggagcugcggcgcgaggaguggcuccagaacgugaacgacaacauguuccugcccuucuccagcuaccacaagaacgagaaguacauccccuccaugcaccugagcuccaaguacggccccaucagcuacaaggagcaguuccgguccgagaacccgaagaaguggaucugcgacaaggacuuccagaccguccuccccagcuucgagcuguucagcaaguacggcaagcuguacuccaaggccgggcagaucguguga

SEQ ID NO: 36973 - RNA, 1617 nt, Artificial Sequence
  derived and/or modified sequence opt1 from SPATA18__Homo_sapiens__NP_660306
auggccgagaaccugaagcgccucgugagcaacgagacccugcggacccugcaggagaagcucgacuucuggcugaaggaguacaacacgaacacgugcgaccagaaccugaaccacugccucgagcugaucgagcaggucgccaaggugcagggccagcuguucgggauccucaccgcggccgcccaggagggcgggcgcaacgacggcguggagaccaucaagucccggcugcugcccuggcucgaggccagcuucaccgccgcgucccugggcaagagcgucgacuccaaggugccgagccugcaggacaccuucgaccgcgagcggcacaaggaccccagcccccgcgaccgggacaugcagcagcucgacuccaaccugaacuccacccgcagccagugcaaccaggugcaggacgaccuggucgagaccgagaagaaccucgaggaguccaagaaccggagcgccaucucccugcuggccgccgaggaggagaucaaccagcucaagaagcagcucaagagccugcaggcgcaggaggacgcccgccaccggaacacggaccagcgcuccagcgagaaccggcgcuccgagcccuggagccuggaggagcggaagcgcgagcaguggaacucccugaagcagaacgccgaccagcaggacaccgaggccaugagcgacuacaagaagcagcugcggaaccucaaggaggagaucgccgugcugagcgcggagaaguccgcccugcaggggcgcagcucccggagccgcuccccgagccccgcgccccggucccgcagcugcucccgcagccgguccgccagccccuccaccgccgugaagguccgccggccgagccccaaccgcuccaagcucagcaacguggcccggaaggccgcccugcugucccgcuucagcgacuccuacagccaggcccggcucgacgcccagugccugcugcgccggugcaucgacaaggcggagaccgugcagcgcaucaucuacaucgccacggucgaggccuuccacguggccaagauggccuuccggcacuucaagauccacgugcgcaagagccucacccccuccuacgucggcagcaacgacuucgagaacgcggugcuggacuacgugaucugccaccuggaccucuacgacucccagagcuccgucaacgacgugauccgggccaugaacgugaaccccaagaucagcuucccgcccgucguggacuucugccugcuguccgacuucauccaggagaucugcugcaucgccuucgccaugcaggcgcucgagccgccccuggacaucgccuacggggccgacggcgagguguucaacgacugcaaguaccgccggagcuacgacuccgacuucaccgcgccccugguccucuaccacguguggcccgcccugauggagaacgacugcgucaucaugaagggggaggccgugacccgccggggcgccuucuggaacagcgugcgcuccgucagccggugccgcucccgcagccugucccccaucugcccccggagccagaucgggcucaacacgaugucccgcagccggagcccgucccccauccgcugcggccugccccgguucuga

SEQ ID NO: 36974 - RNA, 504 nt, Artificial Sequence
  derived and/or modified sequence opt1 from SPATA19__Homo_sapiens__NP_001278921
augaucaucaccaccuggaucguguacauccuggcccgcaagggcgucgggcuccccuuccugccgaucacgagcuccgacaucgacgugguggagagcgaggccgucuccgugcugcaccacuggcucaagaagaccgaggaggaggcgagccggggcaucaaggagaagcuguccaucaaccaccccagccagggggugcgcgagaagauguccaccgacagcccgcccacccacggccaggacauccacgucacgcgggacguggugaagcaccaccuguccaagagcgaccuccuggccaaccagucccaggagguccuggaggagcgcacccggauccaguucauccgcuggagccacacccggaucuuccaggugcccuccgagaugaccgaggacaucaugcgcgaccggaucgagcagguccgccggagcaucucccgccucacggacgugagcgcccaggacuucuccaugcggcccagcuccagcgacugcuga

SEQ ID NO: 36975 - RNA, 2361 nt, Artificial Sequence
  derived and/or modified sequence opt1 from SPATA20__Homo_sapiens__NP_001245301
augcugggcgcccgcgccuggcucgggcgggugcugcugcucccccgcgcgggcgccgggcuggccgccagccggcgcggcuccagcucccgggacaaggaccgcagcgccaccgucuccagcuccgugccgaugcccgccgggggcaagggcagccaccccuccagcacgccccagcgggugccgaaccgccugauccacgagaagucccccuaccuccugcagcacgcguacaaccccgucgacugguaccccugggggcaggaggccuucgacaaggcccggaaggagaacaagccgaucuuccugagcgugggcuacuccacgugccacuggugccacaugauggaggaggagagcuuccagaacgaggagaucgggcgccuccuguccgaggacuucgugagcgucaagguggaccgggaggagcgccccgacguggacaaggucuacaugaccuucgugcaggcgaccuccagcggcgggggcuggcccaugaacguguggcugacccccaaccuccagccguucgucggcgggaccuacuucccgcccgaggacggccugacccgggugggguuccgcaccgugcugcuccggauccgcgagcaguggaagcagaacaagaacacccugcuggagaacucccagcgggucacgaccgcccuccuggcccgcagcgagaucagcgugggcgaccggcagcugcccccguccgccgccaccgugaacaaccgcugcuuccagcagcucgacgagggcuacgacgaggaguacgggggcuucgcggaggcccccaaguuccccacccccgucauccugagcuuccuguucuccuacuggcucagccaccggcugacgcaggacgggucccgcgcccagcagauggcccugcacacccucaagaugauggccaacggcgggauccgcgaccacgugggccagggcuuccaccgguacagcaccgaccgccaguggcacgugccgcacuucgagaagaugcuguacgaccaggcgcagcuggccgucgccuacucccaggccuuccagcucagcggggacgaguucuacuccgacguggccaagggcauccugcaguacguggcgcggagccugucccaccgcagcgggggcuucuacuccgccgaggacgccgacagcccgcccgagcgggggcagcgccccaaggagggcgccuacuacgucuggaccgugaaggagguccagcagcuccugcccgagcccgugcugggcgccacggagccccucaccuccgggcagcugcugaugaagcacuacggccucaccgaggcggggaacaucagccccucccaggacccgaagggcgagcugcaggggcagaacgugcugaccguccgguacagccucgagcugacggccgcccgcuucggccuggacguggaggccgugcggacccuccugaacuccggccuggagaagcuguuccaggcgcgcaagcaccggcccaagccccaccucgacagcaagaugcuggccgccuggaacgggcugauggucagcggcuacgccgugaccggggccgugcucggccaggaccgccugaucaacuacgcgaccaacggcgccaaguuccugaagcggcacauguucgacgucgccuccgggcgccucaugcggacgugcuacaccggccccgggggcaccguggagcacagcaacccgcccugcuggggguuccuggaggacuacgccuucgugguccgcggccugcucgaccuguacgaggccucccaggagagcgcguggcuggagugggcccuccggcugcaggacacccaggacaagcuguucugggacucccagggcgggggcuacuucugcagcgaggccgagcucggggccggccugccccugcgccucaaggacgaccaggacggggccgagcccuccgcgaacagcguguccgcccacaaccugcugcggcuccacggcuucacgggccacaaggacuggauggacaagugcgugugccugcugaccgccuucagcgagcgcaugcgccggguccccguggcccuccccgagauggugcgcgcgcuguccgcccagcagcagacccugaagcagaucgucaucugcggggaccggcaggccaaggacaccaaggcccucgugcagugcgugcacagcgucuacauccccaacaaggugcugauccuggccgacggcgacccguccagcuuccucucccgccagcugcccuuccugagcacgcuccggcgccuggaggaccaggcgaccgccuacgugugcgagaaccaggccugcuccguccccaucaccgaccccugcgagcugcggaagcuccugcacccguga

SEQ ID NO: 36976 - RNA, 2088 nt, Artificial Sequence
  derived and/or modified sequence opt1 from SPATA21__Homo_sapiens__XP_011539714
auggacaaccgcaacacccagauguacaccgagggccggacgaaggcccccgggacccagccgagccccggccugcgcaucaccaucaagcgggccgggguggagcccaucauccccggcgucuccaaggugauguucccggacgcgagcgaggugggguccaagaagcaccucagcuccgccagccgcggccccgagaagggcccccggcugcgcgacgccuucgagaaggggcccuccgagcugcggauccaggagcagggcccgcccgcccgccccgggaagaagcagcccagcugggucccgcaggagggcucccaggagcuccaggccgggcaggaccagagcgagcugggccugcuccccuccugggugcccgaggugcccgagggccugcagcagcuggggagcggcaaggagaucaaggggcagcagggccggcagcgcaaccggggcaucggggaggaccagccgcccgaguccugccagggcagcggguaccaguccacccccagccaccaggcggacaugguccagcccgccgagccgugcugccgccucgccucccacggccagccccucgggggcaagcaccccaaggaggccggcgugccccacauccggccgcaggaggcgccgcccgagcccagccccgggggccacggggacuccagccaggaggccaugccgcccaugagcguggucgcccccgaggagaagacggugaaccccuuccugcccuccacccccggcccgaagaaggccaagggcggcggcgaggccguggagacccaccccgcgcccgggccccugccgccgcccgagguccgcgacaucggcgagcggcgcgagcccgaccgggcccagcagcagccccagaagcccgccguggccgccgggacccagagccugggcaacuuccgccagggguucaugaagugccugcucgagguggagaagauggaggcgucccaccggcgcgccagcaaggcccggucccagacggcccagaaguccccgcgcacccugacccccguccccaccagcgcccccagccugccccagacgcccgcguccgugccggccagcggccccuccugggcccgccuccccgcccccggcccggagcccgcccccaugggggcgccggugcccaccagcaugcccugccccguccugcugggcccggcccucgaccugggguggcggcgcauggagcugcuccaccaguccagcgagcggacccuguccuacgccaaggcccgccaggagcccgaggagcagagccugcagaagcucuaccagaaccgggagaaguccgaggagcagcugacccugaagcaggaggaggcguuccgcagcuacuucgagaucuucaacggccccggcgagguggacgcccagucccucaagaacauccugcugcucaugggguucagcgugacgcuggcccaggucgaggacgcccugaugagcgccgacgugaacggcgacgggcggguggacuucaaggacuuccucgcggucaugaccgacacccgccgguucuucugcuccguggagcagaacgcccugagcgacauggcgccccacaacccgcacacccuccuguucgagauccugucccugcucgucgagaugcuggcccugcccgaggccgugcucgaggagaucacgaacuacuaccagaagaagcugaaggaggggaccugcaaggcccaggagauggaggccgccguggggcgccugcggcuccagaagcugcccuacaacccccagcaggaggagagcuccgaggucccggagcgcaaggugcugagcauccugucccggcucaagcagcagaacuacgcccccaaccugcagagccccuacgcccaggugcccugcauccugcucugcccgcagcuggacaagaagaugguccgccggcagcccuccaaccacuacgcgcuggaccagugcaccccgcccggccucgaccccgacauccgcagccccuucuuccaguccggcagccaggggaaccgggagcacaacuccgacagccgcaaguggcuguccagcgugcccgcccggacccacuga

SEQ ID NO: 36977 - RNA, 1092 nt, Artificial Sequence
  derived and/or modified sequence opt1 from SPATA22__Homo_sapiens__NP_001164166
augaagcgcagccugaacgagaacuccgcccggagcaccgccggcugccuccccgugccgcuguucaaccagaagaagcgcaaccggcagccccugaccuccaacccccucaaggacgacagcgggaucuccacgcccagcgacaacuacgacuucccgccccugcccaccgacugggcgugggaggccgucaaccccgagcuggccccggugaugaagaccguggacaccggccagaucccccacuccgucagccgcccccuccggucccaggacagcguguucaacuccauccagagcaacacggggcgcucccagggcggguggagcuaccgggacggcaacaagaacaccucccugaagaccuggaacaagaacgacuucaagccccagugcaagcgcaccaaccugguggccaacgacggcaagaacagcugcccggucuccagcggggcccagcagcagaagcagcuccggauccccgagccgcccaaccugucccgcaacaaggagacggagcugcuccggcagacccacagcagcaagaucuccggcugcaccaugcgcgggcuggacaagaacagcgcgcugcagacccucaagcccaacuuccagcagaaccaguacaagaagcagaugcuggacgacauccccgaggacaacacgcugaaggagaccucccucuaccagcugcaguucaaggagaaggccagcucccugcggaucaucagcgccgugaucgaguccaugaaguacuggcgcgagcacgcccagaagaccgugcuccuguucgagguccuggcggugcucgacagcgccgugacccccggccccuacuacuccaagacguuccugaugcgggacgggaagaacacccugccgugcgucuucuacgagaucgaccgcgagcucccccggcugauccgcggccgggugcaccgcugcgugggcaacuacgaccagaagaagaacaucuuccagugcgucagcgugcggcccgccuccgugagcgagcagaagaccuuccaggccuucgucaagaucgccgacguggagaugcaguacuacaucaacgugaugaacgagaccuga

SEQ ID NO: 36978 - RNA, 684 nt, Artificial Sequence
  derived and/or modified sequence opt1 from SPATA25__Homo_sapiens__NP_542175
augagcuacuuccgcacgccccagacccaccccggcccccugcccuccgggcagggcggggccgccagccccggccucucccuggggcugugcagcccgguggagcccgucgugguggcguccggcggcaccgggccccucagccagaaggccgagcaggucgcccccgccgcccaggcguggggcccggcccuggccaugccccaggcccgggggugccccggcgggaccuccugggagacccugcgcaaggaguacagccggaacugccacaaguucccccacgugcgccagcucgagucccugggcugggacaacggcuacagccggucccgcgcgccggaccucgggggccccagccggccccgcccccugaugcugugcgggcuguccccgcgggugcuccccguccccagcgaggccgugggcaaggaggccuccagccagcccgacaucugcauccugacccuggccaugaugaucgccggcaucccgacggugcccguccccggggugcgcgaggaggaccucaucugggcggcccaggccuucaugauggcccaccccgagccggagggcgccguggagggggcgcggugggagcaggcccacgcccacaccgccuccggcaagaugccccugguccgcagcaagcgggggcagccgcccggcuccugccuguga

SEQ ID NO: 36979 - RNA, 1563 nt, Artificial Sequence
  derived and/or modified sequence opt1 from SPATA2__Homo_sapiens__NP_001129245
augggcaagcccagcuccauggacaccaaguucaaggacgaccuguuccgcaaguacgugcaguuccacgagagcaaggucgacaccaccaccucccggcagcgcccggggagcgacgagugccuccggguggccgccuccacccugcugagccuccacaagguggaccccuucuaccgcuuccggcugauccaguucuacgaggucguggaguccagccugcgcucccucagcuccagcucccugcgggcgcugcacggcgccuucagcaugcucgagaccguggggaucaaccuguuccuguaccccuggaagaaggaguuccgcuccaucaagacguacaccggccccuucgucuacuacgucaagagcacccuccuggaggaggacauccgggccauccuguccugcaugggguacaccccggagcucggcacggccuacaagcugcgcgagcugguggagacccuccaggugaagauggugagcuucgagcuguuccuggccaagguggagugcgagcagaugcucgagauccacucccaggucaaggacaagggcuacagcgagcuggacaucgugagcgagcggaaguccagcgcggaggacgugcgcgggugcuccgacgcccugcggcgccgggccgagggccgcgagcaccucaccgccagcaugucccgggucgcgcugcagaaguccgccagcgagcgcgccgccaaggacuacuacaagccccgggugaccaagcccagccgcuccguggacgccuacgacagcuacugggagucccggaagcccccgcugaaggcgagccucucccugcgcaaggagcccgucgccacggacgugggggacgaccugaaggacgagaucauccgccccagccccucccuccugaccauggccagcuccccgcacggcagccccgacgugcugccgcccgccucccccagcaacgggcccgcccuccugcggggcaccuacuucagcacccaggacgacgucgaccuguacacggacuccgagccccgcgcgaccuaccggcgccaggacgcccuccggcccgacguguggcugcugcgcaacgacgcccacagccucuaccacaagcgguccccgcccgccaaggagagcgcccuguccaagugccagagcugcggccuguccugcagcuccagccucugccagcgcugcgacucccugcugaccugcccgcccgcgagcaagcccuccgccuuccccagcaaggccuccacccacgacagccucgcccacggggccucccugcgggagaaguaccccggccagacgcaggggcuggaccgccucccccaccuccacagcaagagcaagccguccaccacccccaccagccggugcggcuucugcaaccgccccggcgcgacgaacacgugcacccagugcuccaaggugagcugcgacgccugccuguccgccuaccacuacgacccgugcuacaagaaguccgagcugcacaaguucaugcccaacaaccagcugaacuacaagagcacccagcugagccaccuggucuaccgguga

SEQ ID NO: 36980 - RNA, 2682 nt, Artificial Sequence
  derived and/or modified sequence opt1 from SPATA5__Homo_sapiens__NP_660208
augagcagcaagaagaaccgcaagcggcugaaccagagcgccgagaacggcuccagccuccccuccgccgcgagcuccugcgccgaggcccgcgccccgagcgccggguccgacuucgcggccaccagcggcacccugacggugaccaaccugcucgagaaggucgacgacaagauccccaagaccuuccagaacucccugauccaccuggggcucaacaccaugaaguccgccaacaucugcaucggccggcccgugcugcugacgagccucaacgggaagcaggagguguacaccgccuggcccauggcgggcuucccgggcgggaaggucggccugagcgagauggcccagaagaacgugggggugcgccccggcgacgccauccagguccagccccuggugggggccgugcuccaggccgaggagauggacgucgcgcuguccgacaaggacauggagaucaacgaggaggagcugaccggcugcauccuccggaagcuggacggcaagaucgugcugcccgggaacuuccucuacugcaccuucuacggccgcccguacaagcuccaggugcugcgggucaagggggccgacggcaugauccugggcgggccccagagcgacuccgacacggacgcccagcgcauggccuucgagcagagcuccauggagaccagcagccuggagcugucccuccagcugagccagcuggaccucgaggacacccagauccccaccucccggagcacgcccuacaagccgaucgacgaccgcaucaccaacaaggccuccgacgugcugcuggacgugacccagagccccggcgacggguccggccucaugcuggaggaggucaccgggcugaagugcaacuucgagagcgcgcgggagggcaacgagcagcucacggaggaggagcgccugcugaaguucuccaucggcgccaagugcaacaccgacaccuucuacuucaucagcuccaccacgcgggugaacuucaccgagaucgacaagaacagcaaggagcaggacaaccaguucaaggugaccuacgacaugaucgggggccucuccagccagcugaaggccauccgcgagaucaucgagcugccccucaagcagcccgagcuguucaaguccuacgggaucccggcgccccggggcguccugcucuacgggccgcccggcaccggcaagacgaugaucgcccgcgccguggccaacgaggugggggccuacgucagcgugaucaacggccccgagaucaucuccaaguucuacggggagaccgaggccaagcugcggcagaucuucgccgaggcgacccugcgccaccccagcaucaucuucaucgacgagcucgacgcccugugccccaagcgggagggcgcccagaacgagguggagaagcgcgucguggccucccugcucacccugauggacgggaucggcagcgaggucagcgagggccaggugcuggugcugggggcgacgaaccggccccacgcccucgacgccgcccugcgccgcccgggccgguucgacaaggagaucgagaucgggguccccaacgcccaggaccgccuggacauccuccagaagcugcugcggcgcgugccccaccuccugaccgaggcggagcugcuccagcuggccaacuccgcccacggcuacgugggcgccgaccugaagguccucugcaacgaggccgggcugugcgcgcugcggcgcauccucaagaagcagcccaaccugccggacgugaagguggccggccuggucaagaucacccucaaggacuuccugcaggccaugaacgacauccggcccagcgccaugcgcgagaucgccaucgacgugcccaacguguccuggagcgacaucgggggccuggaguccaucaagcucaagcuggagcaggcggucgaguggccgcugaagcaccccgagagcuucauccggauggggauccagccgcccaagggcgugcuccuguacggcccgcccgggugcuccaagaccaugaucgccaaggcccuggccaacgagagcggccucaacuuccuggcgaucaaggggcccgagcugaugaacaaguacgugggcgaguccgagcgcgccguccgggagacguuccgcaaggcccgggccguggcccccagcaucaucuucuucgacgagcucgacgcgcuggccguggagcgcggguccagccugggcgccggcaacgucgccgaccgggugcucgcccagcugcugaccgagauggacgggaucgagcagcucaaggacgugaccauccuggcggccaccaaccgccccgaccggaucgacaaggcccugaugcgccccggccggaucgaccgcaucaucuacgucccccuccccgacgccgccacgcgccgggagaucuucaagcugcaguuccacuccaugccggugagcaacgagguggaccuggacgagcucauccugcagaccgacgcguacuccggggccgagaucgucgccgugugccgcgaggccgcgcugcucgcccuggaggaggacauccaggccaaccugaucaugaagcggcacuucacccaggcccucagcaccgugacgccccgcauccccgagucccugcggcgcuucuacgaggacuaccaggagaaguccggccugcacacccucuga

SEQ ID NO: 36981 - RNA, 1704 nt, Artificial Sequence
  derived and/or modified sequence opt1 from SPATA7__Homo_sapiens__NP_001035518
auggacggcagccgccgggugcgcgccaccuccguccugccccgguacgggccgcccugccucuucaagggccaccugagcaccaaguccaacgccgcgguggacugcagcgugcccgucuccgugagcacguccaucaaguacgccgaccagcagcgccgggagaagcugaagaaggagcucgcccagugcgagaaggaguucaagcugaccaagaccgccaugcgcgccaacuacaagaacaacagcaagucccuguucaacacccuccagaagcccagcggggagccgcagaucgaggacgacaugcugaaggaggagaugaacggcuucuccagcuucgcgcggucccuggugcccagcuccgagcgccuccaccugagccugcacaaguccagcaaggucaucacgaacgggcccgagaagaacuccagcagcucccccagcuccguggacuacgccgccagcggcccgcggaagcucuccagcggcgcccuguacgggcgccggccccgcuccaccuuccccaacagccaccgguuccagcuggugaucuccaaggcgcccagcggcgaccuccuggacaagcacuccgagcuguucagcaacaagcagcucccguucacgccccgcacccugaagaccgaggccaaguccuuccugagccaguaccgguacuacacccccgccaagcgcaagaaggacuucaccgaccagcggaucgaggccgagacccagacggagcucuccuucaagagcgagcuggggaccgccgagaccaagaacaugaccgacuccgagaugaacaucaagcaggcgagcaacugcgucacguacgacgccaaggagaagaucgcgccccugccgcucgagggccacgacuccaccugggacgagaucaaggacgacgcccugcagcacagcagcccccgcgccaugugccaguacucccugaagccgcccagcacccggaagaucuacuccgacgaggaggagcuccuguaccugagcuucaucgaggacgugaccgacgagauccucaagcuggggcuguucuccaaccgcuuccucgagcggcuguucgagcgccacaucaagcagaacaagcaccuggaggaggagaagaugcgccaccuccugcacgugcugaaggucgaccucggcugcacgagcgaggagaacuccgugaagcagaacgacguggacaugcugaacgucuucgacuucgagaaggccggcaacagcgagcccaacgagcugaagaacgaguccgaggugaccauccagcaggagcggcagcaguaccagaaggcccucgacaugcugcugagcgcccccaaggacgagaacgagaucuuccccucccccaccgaguucuucaugccgaucuacaagagcaagcacuccgagggggugaucauccagcaggucaacgacgagaccaaccucgagacgagcacccuggacgagaaccaccccuccaucagcgacucccugaccgaccgcgagaccagcgugaacgugaucgagggcgacagcgaccccgagaaggucgagaucuccaacgggcucugcggccugaacacgagccccucccagagcgugcaguucuccagcgugaagggcgacaacaaccacgacauggagcuguccacccugaagaucauggagaugagcaucgaggacugcccgcucgacgucuga

SEQ ID NO: 36982 - RNA, 318 nt, Artificial Sequence
  derived and/or modified sequence opt1 from SPATA8__Homo_sapiens__NP_775770
auggcccccgccggcaugagcggggcgcaggacaacuccugccuguaccaggagaucgccccgagcuuccagcgccuccccugcccccggaccuccagccgccacuucuccgaggccaugaccugccccugcggcuggcggccguucaagggcgggcccgggggccugaagggccccguguggcccgccaaggaggagaacagcugcucccacgggcgcauccagcgggugcagcgccggcgcgugccgagcgccagcccccugauccagaagaucaaccggcgcuccguccucuuccaccccuacugcugguccuga

SEQ ID NO: 36983 - RNA, 765 nt, Artificial Sequence
  derived and/or modified sequence opt1 from SPATA9__Homo_sapiens__NP_114158
augcccaucaagccggugggcuggaucugcgggcagguccugaagaacuucagcggccgcaucgaggggauccagaaggccaucauggaccucguggacgaguucaaggacgaguuccccaccauccugcggcugucccagagcaaccagaagcgcgagcccgcccagaagaccuccaagauccggauggcgaucgcccucgccaagaucaaccgcgccacgcugauccggggccugaacagcaucucccgcagcuccaagagcguggccaagcuccugcacccccagcuggcgugccggcuccuggagcugcgcgacaucuccgggcggcuccugcgcgaggucaacgccccgcggcagccccuguacaacauccaggugcgcaagggcagccucuucgagaucaucuccuuccccgccaagaccgcccugaccagcaucaucuacgcguccuacgccgcccugaucuaccucgccgugugcgucaacgccgugcugaagaaggugaagaacaucuuccaggaggaggagagcauccggcagaaccgcgaggaguccgagaacugccggaaggcguucagcgagcccguccuguccgagccgauguucgccgagggcgagaucaaggccaagcccuaccgcagccuccccgagaagcccgacaucuccgacuacccgaagcugcuggccaacaagcagagcaacaacauccaggugcuccacagcguguucgaccaguccgccgagaugaacgagcagaucuga

SEQ ID NO: 36984 - RNA, 1326 nt, Artificial Sequence
  derived and/or modified sequence opt1 from SPATC1__Homo_sapiens__NP_001127846
augagccugcucaccaacuacgagggccugcgccaccagaucgagcggcuggugcgcgagaacgaggagcucaagaagcugguccggcugauccgcgagaaccacgagcucaaguccgccaucaagacccaggccgggggccuggggaucagcggcuucacguccgggcugggcgaggccaccgccggccucagcucccggcagaacaacgggguguuccugcccccgagccccgccguggccaacgagcgcguccuggaggaggugggcaucauggcccucgcgccccuggccgagaugcugaccucccuccagcccagcgccaccccggggucccugaugagcccccugacgggcacccucuccacccugcugagcgggcccgcccccaccucccagagcuccccgcucacgagcuuccugaccucccccaucgcgggcccccugaccggcacccucgccagcucccuggggcugcccagcacgggcacccucaccccgagcucccugguggccgggcccgucgccaugagccaguccagcccccugaucgcccccgugaugggcaccguggcggucucccucagcuccccgcugcugagcuccacggccaccccgcccggcgugagccagaaccuccuggccaaccccauguccaaccuggugcuccccgaggcgccccggcugcgccuggccgagccccuccgcgggggccccaccgggccgcagagccccgccugcgucgugcccaccgccacgaccaaggugccccuguccaccgagccgccccagagcacccaggaccccgagccgcuguccauggccuucgccggcgcgccccuccagacgagcacccccaucggggccaugggcacccccgccccgaagaccgccuucuccuucaacacgagcgacacccaggcccagcccuccgccgcgcaggagcaggucgugcccgccagcgugcccaccagcccgaccacgucccccaccgucaccgugcuggccagcgcccccgcgcuggcgccccagguggccaccuccuacacgccgagcuccaccacccacaucgcccagggcgcgccccacccgcccagccggaugcacaacucccccacccagaaccuccccgucccccacugcccgccccacaacgcccacagcccgccccggaccuccagcucccccgccagcgugaacgacucccgcgggccccggacgaccgagcccagcaccaaguccaugauggagguggagcgcaagcuggcccaccggaagaccagcaaguuccccgagaacccgcgcggcuuccccgagccccaguga

SEQ ID NO: 36985 - RNA, 594 nt, Artificial Sequence
  derived and/or modified sequence opt1 from SPC24__Homo_sapiens__NP_872319
auggccgccuuccgcgacaucgaggaggugagccagggccugcucucccugcugggggcgaaccgggccgaggcccagcagcgccggcuccugggccgccacgagcaggucguggagcggcugcucgagacccaggacggggccgagaagcagcugcgcgagauccugaccauggagaaggagguggcccagagccuccugaacgcgaaggagcagguccaccagggcgggguggagcugcagcagcucgaggccggccugcaggaggccggcgaggaggacacgcggcugaaggccucccuccugcagcugacccgcgagcucgaggagcugaaggagaucgaggcggaccuggagcggcaggagaaggagguggacgaggacaccaccgucacgauccccagcgccguguacguggcccagcucuaccaccaggucuccaagaucgagugggacuacgagugcgagccggggauggugaagggcauccaccacgggcccagcguggcccagcccauccaccuggacuccacccagcugagccgcaaguucaucuccgacuaccucuggagccuggucgacaccgagugguga

SEQ ID NO: 36986 - RNA, 675 nt, Artificial Sequence
  derived and/or modified sequence opt1 from SPC25__Homo_sapiens__NP_065726
augguggaggacgagcuggcccucuucgacaagagcaucaacgaguucuggaacaaguucaaguccaccgacaccagcugccagauggccggccugcgcgacacguacaaggacuccaucaaggcguucgccgagaagcugagcgucaagcucaaggaggaggagcggaugguggagauguuccuggaguaccagaaccagaucucccgccagaacaagcugauccaggagaagaaggacaaccuccugaagcugaucgccgaggugaaggggaagaagcaggagcucgagguccugaccgccaacauccaggaccugaaggaggaguacagccggaagaaggagaccaucuccaccgccaacaaggcgaacgccgagcgccucaagcggcugcagaaguccgccgaccuguacaaggaccgccucggccuggagauccggaagaucuacggggagaagcugcaguucaucuucacgaacaucgaccccaagaacccggagagccccuucauguucagccuccaccugaacgaggcccgcgacuacgagguguccgacagcgcgccccaccuggagggccucgccgaguuccaggagaacgugcggaagaccaacaacuucuccgccuuccuggccaacguccgcaaggccuucaccgcgaccguguacaacuga

SEQ ID NO: 36987 - RNA, 543 nt, Artificial Sequence
  derived and/or modified sequence opt1 from SPCS3__Homo_sapiens__NP_068747
augaacaccgugcugagccgcgccaacucccucuucgccuucagccuguccgucauggcggcccugaccuucggcugcuucaucacgaccgccuucaaggaccggagcgugcccgugcgccuccacgucucccggaucaugcugaagaacguggaggacuucaccgggccgcgcgagcggagcgaccugggcuucaucaccuucgacaucacggccgaccucgagaacaucuucgacuggaacgugaagcagcuguuccuguaccucuccgccgaguacagcaccaagaacaacgcgcugaaccaggucgugcugugggacaagaucgugcuccgcggggacaaccccaagcugcugcucaaggacaugaagaccaaguacuucuucuucgacgacggcaacgggcugaagggcaaccggaacgucacccugacgcucuccuggaacguggugcccaacgccggcauccugccccuggucaccgggagcggccacguguccgugccguuccccgacaccuacgagaucaccaagagcuacuga

SEQ ID NO: 36988 - RNA, 960 nt, Artificial Sequence
  derived and/or modified sequence opt1 from SPDEF__Homo_sapiens__NP_001239223
augggcagcgccucccccgggcugagcuccgugagcccgucccaccuccugcugccgcccgacaccgucagccgcaccggccucgagaaggccgcggccggggccgugggccuggagcggcgcgacuggucccccagcccgcccgccacgcccgagcaggggcuguccgccuucuaccucagcuacuucgacaugcuguaccccgaggacuccagcugggcggccaaggcccccggcgccuccagccgggaggagccgcccgaggagcccgagcagugccccgugaucgacucccaggcgcccgccggcagccuggaccucguccccgggggccugacccuggaggagcacucccucgagcagguccagagcaugguggugggggaggugcugaaggacaucgagaccgccugcaagcugcucaacaucaccgccgaccccauggacugguccccgagcaacgugcagaaguggcugcuguggacggagcaccaguaccgccucccgcccaugggcaaggccuuccaggagcuggcggggaaggagcugugcgccaugagcgaggagcaguuccggcagcgcagcccccucggcggcgacguccugcacgcccaccuggacaucuggaaguccgccuccaccagcgaggaguccuggaccgacagcgagguggacuccagcugcuccgggcagcccauccaccucuggcaguuccugaaggagcugcuccugaagccccacagcuacggccgguucauccgcuggcugaacaaggagaaggggaucuucaagaucgaggacuccgcccagguggcgcggcucuggggcauccgcaagaaccggcccgccaugaacuacgacaagcugagccgcuccauccggcaguacuacaagaagggcaucauccgcaagcccgacaucagccagcggcuggucuaccaguucgugcacccgaucuga

SEQ ID NO: 36989 - RNA, 1818 nt, Artificial Sequence
  derived and/or modified sequence opt1 from SPDL1__Homo_sapiens__NP_060255
auggaggccgacaucaucaccaaccugcgcugccggcucaaggaggccgaggaggagcgccugaaggcggcccaguacggccugcagcucguggagagccagaacgagcugcagaaccagcuggacaagugccggaacgagaugaugaccaugacggaguccuacgagcaggagaaguacacccuccagcgcgaggucgagcucaagagccggaugcuggagucccugagcugcgagugcgaggccaucaagcagcagcagaagaugcaccuggagaagcuggaggagcagcucucccgcagccacgggcaggaggugaacgagcugaagaccaagaucgagaagcugaagguggagcucgacgaggcccggcuguccgagaagcagcugaagcaccaggucgaccaccagaaggagcuccugagcugcaaguccgaggagcugcgcgugaugagcgagcgggugcaggaguccaugagcuccgagaugcucgcccugcagaucgagcugaccgagauggagagcaugaagacgacccucaaggaggaggucaacgagcugcaguaccgccaggagcagcuggagcuccugaucaccaaccugaugcgccagguggaccggcucaaggaggagaaggaggagcgggagaaggaggcgguguccuacuacaacgcccuggagaaggcccgcgucgccaaccaggaccuccaggugcagcuggaccaggcgcugcagcaggcccuggaccccaacagcaagggcaacucccucuucgccgagguggaggaccggcgcgccgccauggagcggcagcugaucagcaugaaggucaaguaccagucccugaagaagcagaacguguucaaccgcgagcagaugcagcggaugaagcuccagaucgcgacccugcugcagaugaaggggagccagacggaguucgagcagcaggagcgccuccuggccaugcuggagcagaagaacggcgagaucaagcaccuccugggggagauccggaaccuggagaaguucaagaaccucuacgacagcauggaguccaagccgagcguggacuccggcacccuggaggacaacaccuacuacaccgaccugcugcagaugaagcucgacaaccugaacaaggagaucgagagcacgaagggcgagcuguccauccagcgcaugaaggcccucuucgagagccagcgcgcccuggacaucgagcggaagcuguucgccaacgagcgcugccuccagcuguccgagagcgagaacaugaagcugcgggcgaagcucgacgagcugaagcugaaguacgagcccgaggagaccgucgaggugcccgugcucaagaagcgccgggagguccugcccguggacaucaccaccgccaaggacgccugcgugaacaacuccgcccucgggggcgaggucuaccgccugccgccccagaaggaggagacgcagagcugccccaacucccuggaggacaacaaccugcagcucgagaaguccgugagcaucuacacccccguggucagccuguccccgcacaagaaccugcccguggacaugcagcucaagaaggagaagaagugcgucaagcugaucggggugcccgccgacgcggaggcccugagcgagcgguccggcaacacccccaacagcccgcgccucgccgccgaguccaagcugcagaccgaggugaaggaggggaaggagacgagcagcaagcuggagaaggagaccugcaagaagcuccaccccauccuguacgucuccagcaaguccacccccgagacccagugcccccagcaguga

SEQ ID NO: 36990 - RNA, 861 nt, Artificial Sequence
  derived and/or modified sequence opt1 from SPDYA__Homo_sapiens__NP_001008779
augcgccacaaccagaugugcugcgagacgcccccgaccgugaccgucuacgucaagagcggcuccaaccggagccaccagcccaagaagcccaucacccugaagcgccccaucugcaaggacaacuggcaggccuucgagaagaacacccacaacaacaacaaguccaagcggccgaaggggcccugccucgugauccagcgccaggacaugaccgccuucuucaagcuguucgacgacgaccugauccaggacuuccucuggauggacugcugcugcaagaucgcggacaaguaccugcuggccaugacguucguguacuucaagcgggccaaguucaccaucagcgagcacacccgcaucaacuucuucaucgcccucuaccuggccaacaccguggaggaggacgaggaggagacgaaguacgagaucuuccccugggcgcugggcaagaacuggcggaagcuguuccccaacuuccucaagcugcgcgaccagcucugggaccggaucgacuaccgcgccaucgugucccggcgcugcugcgaggaggucauggccaucgccccgacccacuacaucuggcagcgggagcgcagcgugcaccacuccggggcggugcggaacuacaaccgcgacgagguccagcugccccggggccccagcgccacccccguggacugcucccugugcgggaagaagcgccgguacgugcgccucggccugagcuccagcuccagccuguccagccacaccgccggcgucacggagaagcacucccaggacagcuacaacucccucagcauggacaucaucggggacccgagccaggccuacaccggcuccgaggggaugaucuga

SEQ ID NO: 36991 - RNA, 2130 nt, Artificial Sequence
  derived and/or modified sequence opt1 from SPECC1__Homo_sapiens__NP_001028726
augggcaaccacagcgggcgccccgaggacccggagcccggcgccuucaccaccacgaagcggaccgggauccccgcgccccgcgaguucuccgugaccgucagccgggagcgcuccgugccgcggggccccagcaacccccgcaaguccgugagcucccccaccagcuccaacacgccgacccccaccaagcaccuccggacccccagcacgaagcccaagcaggagaacgagggcggggagaaggccgcccuggagucccagguccgcgagcugcuggccgaggccaaggccaaggacagcgagaucaaccggcuccgcuccgagcugaagaaguacaaggagaagcggacccugaacgcggagggcaccgacgcccucgggccgaacguggacggcaccagcgugucccccggggacacggagcccaugauccgcgcccuggaggagaagaacaagaacuuccagaaggagcugagcgaccucgaggaggagaaccggguccugaaggagaagcugaucuaccucgagcacucccccaacagcgagggcgccgcgucccacaccggggacagcagcugcccgaccuccaucacccaggagagcuccuucggcagccccacgggcaaccagauguccagcgacaucgacgaguacaagaagaacauccacgggaacgcccugcgcaccuccggcagcuccagcuccgacgugaccaaggccagccugucccccgacgccagcgacuucgagcacaucaccgccgagacgcccucccggccgcucagcuccaccagcaaccccuucaaguccagcaagugcagcaccgcgggguccagccccaacuccgugagcgagcugucccuggccagccucaccgagaagauccagaagauggaggagaaccaccacuccacggccgaggagcugcaggccacccugcaggagcucagcgaccagcagcagaugguccaggagcugaccgccgagaacgagaagcugguggacgagaagaccauccucgagacguccuuccaccagcaccgcgagcgggcggagcagcugagccaggagaacgagaagcugaugaaccuccugcaggagcgcgugaagaacgaggagcccaccacccaggagggcaagaucaucgagcuggagcagaagugcaccggcauccucgagcaggggcgguucgagcgcgagaagcugcugaacauccagcagcagcucacgugcucccugcggaaggucgaggaggagaaccagggcgcccuggagaugaucaagcgccucaaggaggagaacgagaagcugaacgaguuccuggagcucgagcgccacaacaacaacaugauggccaagacccuggaggagugccgggugacccuggaggggcucaagauggagaacggcagccugaagucccaccuccagggggagaagcagaaggccaccgaggccagcgcgguggagcagacggccgaguccugcgagguccaggagaugcugaagguggcccgcgccgagaaggaccugcuggagcucagcugcaacgagcugcggcaggagcugcugaaggccaacggcgagaucaagcacguguccagccuccuggcgaaggucgagaaggacuacagcuaccugaaggagaucugcgaccaccaggccgagcagcucucccgcaccagccugaagcugcaggagaaggccuccgagagcgacgccgagaucaaggacaugaaggagaccaucuucgagcucgaggaccagguggagcagcaccgggcggugaagcugcacaacaaccagcugaucuccgagcucgagagcuccgucaucaagcuggaggagcagaaguccgaccuggagcgccagcucaagacccugaccaagcagaugaaggaggagacggaggaguggcggcgcuuccaggccgaccugcagaccgccgugguggucgccaacgacaucaagugcgaggcccagcaggagcuccggaccgugaagcgcaagcugcuggaggaggaggagaagaacgcgcggcuccagaaggagcugggcgacguccaggggcacggccgcguggugaccagccgggccgccccgcccagccugggguccgucagcuga

SEQ ID NO: 36992 - RNA, 3354 nt, Artificial Sequence
  derived and/or modified sequence opt1 from SPECC1L__Homo_sapiens__NP_001138940
augaagaaggccagccgcuccgugggcagcguccccaagguguccgccaucagcaagacccagaccgcggagaagaucaagccggagaacuccagcuccgccagcaccgggggcaagcuggugaagcccgggaccgccgccucccucagcaagaccaaguccagcgacgaccugcuggccggcauggccgggggcgucaccgugacgaacggcgugaaggggaagaaguccacgugccccagcgcggcccccuccgccagcgcgccggccaugaccaccgucgagaacaaguccaagaucagcacgggcaccgccuccagcaccaagcggagcaccuccacggggaacaaggagagcuccagcacccgcgagcggcuccgcgagcggacccgccugaaccaguccaagaagcugcccagcgccggccagggggccaacgacauggcgcucgccaagcggucccgcagccggaccgccacggagugcgacgugcgcauguccaagagcaaguccgacaaccagaucagcgaccgggccgcccuggaggcgaaggugaaggaccugcucacccuggccaagaccaaggacgucgagauccugcaccuccgcaacgagcugcgggacaugcgcgcccagcugggcaucaacgaggaccacuccgagggcgacgagaaguccgagaaggagaccaucauggcccaccagcccacggacguggaguccacccuccugcagcugcaggagcagaacaccgccauccgggaggagcucaaccagcugaagaacgagaaccgcaugcugaaggaccggcucaacgcgcugggguucagccuggagcagcgccucgacaacuccgagaagcuguucggcuaccagagccugucccccgagaucaccccggggaaccagagcgacggcggcgggacgcucaccagcuccguggagggcagcgcccccggguccgucgaggaccugcugagccaggacgagaacacccucauggaccaccagcacuccaacagcauggacaaccuggacuccgagugcagcgagguguaccagccccugaccuccagcgacgacgcccucgacgcccccuccagcuccgagagcgagggcaucccguccaucgagcggagccgcaagggguccagcggcaacgccagcgagguguccgucgcgugccugacggagcggauccaccagauggaggagaaccagcacagcaccuccgaggagcugcaggccacccuccaggagcuggccgaccugcagcagaucacccaggagcucaacagcgagaacgagcgccugggcgaggagaaggugauccugauggagucccucugccagcagagcgacaagcuggagcacuucucccgccagaucgaguacuuccggagccugcucgacgagcaccacaucuccuacgugaucgacgaggacgucaagagcgggcgcuacauggagcuggagcagcgguacauggaccuggccgagaacgcgcgcuucgagcgggagcagcuccugggcgugcagcagcaccuguccaacacgcugaagauggccgagcaggacaacaaggaggcccaggagaugaucggggcccucaaggagcgcagccaccacauggagcggaucaucgaguccgagcagaagggcaaggccgcgcuggccgccacccuggaggaguacaaggccaccguggccagcgaccagaucgagaugaaccgccucaaggcgcagcuggagaacgagaagcagaaggucgccgagcuguacuccauccacaacagcggggacaaguccgacauccaggaccuccuggagagcgugcggcuggacaaggagaaggccgagacccucgccuccagccugcaggaggaccuggcccacacgcgcaacgacgcgaaccggcuccaggacgccaucgccaagguggaggacgaguaccgcgccuuccaggaggaggcgaagaagcagaucgaggaccugaacaugacccuggagaagcuccggagcgaccuggacgagaaggagaccgagcgcuccgacaugaaggagaccaucuucgagcuggaggacgaggucgagcagcaccgggccgugaagcuccacgacaaccugaucaucagcgaccuggagaacaccgucaagaagcuccaggaccagaagcacgacauggagcgcgagaucaagacgcugcaccggcgccugcgggaggaguccgccgaguggcgccaguuccaggccgaccuccagaccgccguggugaucgcgaacgacaucaagagcgaggcccaggaggagaucggcgaccugaagcgccggcugcacgaggcccaggagaagaacgagaagcucaccaaggagcuggaggagaucaagucccgcaagcaggaggaggagcggggccgcgucuacaacuacaugaacgccguggagcgggaccuggccgcgcuccgccaggggaugggccugagccggcgcuccagcaccuccagcgagcccacgcccaccgugaagacccugaucaaguccuucgacagcgccucccagguccccaacccggccgccgccgcgaucccccggacgccccucagccccuccccgaugaagaccccgcccgccgccgccgugagccccaugcagcgccacuccaucagcgggcccaucuccaccagcaagccccugaccgcgcugagcgacaagcggcccaacuacggcgagauccccgugcaggagcaccuccugcgcaccuccagcgccucccggccggccagccugccccgcguccccgccauggaguccgccaagacgcucagcgugucccggcgcagcuccgaggagaugaagcgggacaucagcgcgcaggagggggccuccccggccagccugauggccaugggcaccaccagcccccagcugagccucuccagcucccccaccgccagcgugacgcccaccacccgcucccggauccgcgaggagcggaaggacccgcugagcgcgcuggcccgcgaguacggcgggagcaagcgcaacgcccuccugaaguggugccagaagaagaccgagggcuaccagaacaucgacaucacgaacuucuccagcuccuggaacgacgggcuggccuucugcgcccuccugcacaccuaccugcccgcgcacauccccuaccaggagcucaacagccaggacaagcggcgcaacuucaugcuggccuuccaggccgccgaguccgucggcaucaagagcacccuggacaucaacgagauggugcggaccgagcgccccgacuggcagaacgugaugcucuacgucacggccaucuacaaguacuucgagaccuga

SEQ ID NO: 36993 - RNA, 5469 nt, Artificial Sequence
  derived and/or modified sequence opt1 from SPEF2__Homo_sapiens__NP_079143
augagcgagauccugugccaguggcugaacaaggagcugaaggugagccgcaccgugagccccaagagcuucgccaaggccuucagcuccggcuaccugcucggggaggugcugcacaaguucgagcugcaggacgacuucagcgaguuccucgacucccgggugagcuccgcgaagcugaacaacuucagccgccuggagcccacccucaaccugcugggcgugcaguucgaccagaacguggcccacgggaucaucaccgagaagcccggcguggccaccaagcuccuguaccagcuguacaucgcccuccagaagaagaagaaguccgggcugaccggcgucgagaugcagaccaugcagcggcugacgaaccuccgccugcagaacaugaaguccgacaccuuccaggagcggcugcgccacaugaucccccggcagaccgacuucaaccucaugcgcaucaccuaccgguuccaggagaaguacaagcacgugaaggaggaccuggcccaccuccacuucgagaagcucgagcgcuuccagaagcugaaggaggagcagcggugcuucgacaucgagaagcaguaccugaaccgccggcgccagaacgagaucauggcgaagauccaggccgccaucauccagauccccaagcccgccuccaaccggacgcucaaggcgcuggaggcccagaagaugaugaagaagaagaaggaggccgaggacguggccgacgagaucaagaaguucgaggcccugaucaagaaggaccuccaggcgaaggagagcgccuccaagaccagccuggacaccgccggccagaccacgaccgaccugcucaacaccuacuccgacgacgaguacaucaagaagauccagaagcgccuggaggaggacgccuucgcccgggagcagcgcgagaagcggcgccggaagcugcucauggaccagcugaucgcgcacgaggcccaggaggaggccuaccgcgaggagcagcugaucaaccgccucaugcggcagagccagcaggagcgccggaucgccguccagcugaugcacgugcgccacgagaaggaggugcuguggcagaaccggaucuuccgcgagaagcagcacgaggagcggcgccucaaggacuuccaggacgcccuggaccgggaggcggcccuggccaagcaggccaagaucgacuucgaggagcaguuccucaaggagaagcgcuuccacgaccagaucgccgucgagcgggcgcaggcccgcuacgagaagcacuacuccgugugcgccgagauccuggaccagaucguggaccugagcaccaaggucgccgacuaccggaugcucacgaacaaccugauccccuacaagcugaugcacgacuggaaggagcuguucuucaacgcgaagcccaucuacgagcaggccagcgugaagacccuccccgccaaccccucccgcgagcagcugaccgagcuggagaagcgggaccuccuggacaccaacgacuacgaggaguacaagaacauggugggggagugggcccugcccgaggagauggucgacaaccugccgcccagcaacaacugcauccugggccacauccugcaccgccucgccgagaagucccugccgccccgggcggagagcacgacccccgagcugcccuccuucgccgugaaggggugccuccugggcaagacccugagcgggaagaccacgauccuccgcucccugcagaaggacuucccgauccagauccugagcaucgacacccucgugcaggaggccauccaggccuuccacgacaacgagaaggucuccgaggugcugcccauccagaagaacgacgaggaggacgcccugcccgugcuccaggaggagaucaaggagagccaggacccccagcacgucuucuccgcgggcccggugagcgacgagguccugcccgagaccgagggcgagaccaugcuguccgccaacgccgacaagacgcccaaggccgaggaggucaagagcuccgacagcuuccucaagcugaccacccgggcccagcugggggcgaaguccgagcagcuccugaagaagggcaagagcauccccgacgugcugcucgucgacaucaucgugaacgccaucaacgagaucccggugaaccaggacugcauccuggacggguuccccaugacccugaaccaggcccagcuccuggaggaggcccugacgggcugcaaccgcaaccucaccgaggucgagcgcaagaaggcgcagaaguccacccuggccaucgaccccgccaccagcaaggagaucccccugccgagccccgccuucgacuucgugauccuccuggacguguccgacacgagcuccaugagccggaugaacgacaucaucgccgaggagcuguccuacaagaccgcgcacgaggacaucagccagcgcgucgccgccgagaaccaggacaaggacggcgaccagaaccuccgggaccagauccagcaccgcaucaucggguuccuggacaacuggccccugcucgagcagugguucuccgagccggagaacauccugaucaagaucaacgccgagaucgacaaggagagccugugcgagaaggugaaggagauccucaccaccgagaucgccaagaagaagaacaagguggagaagaagcuggaggagaaggaggcggagaagaaggccgccgccucccuggccgagcucccccugcccacgcccccgcccgcgcccccgcccgagcccgagaaggagaaggagauccaccagagccacgucgccuccaagacgcccaccgccaagggcaagccccagagcgaggcgccccacgggaagcaggagucccugcaggagggcaaggggaagaagggcgagaccgcccucaagcggaagggcagccccaaggggaaguccagcggcgggaaggugcccgugaagaagucccccgccgacagcaccgacacgagcccggucgccaucgugccccagccgcccaagccgggcuccgaggaguggguguacgucaacgagcccgugcccgaggagaugccccuguuccuggugccguacugggagcucaucgagaacagcuacaucaacaccaucaagaccguccugcgccaccuccgggaggaccagcacaccgugcucgccuaccuguacgagauccgcacguccuuccaggaguuccugaagcggcccgaccacaagcaggacuucguggcccaguggcaggcggacuucaacagccuccccgacgaccugugggacgacgaggagaccaaggccgagcugcaccagcgcgucaacgaccuccgggaccgccugugggacaucugcgacgcccggaaggaggaggccgagcaggagcgccuggacaucaucaacgaguccuggcuccaggacacccuggggaugaccaugaaccacuucuucagccugaugcaggccgagcucaaccgguuccaggacacgaagcgccugcugcaggacuacuacuggggcauggaguccaagaucccgguggaggacaacaagcgguucacccgcaucccccucgugcagcuggacagcaaggacaacuccgagagccagcugcggaucccccucgucccccgcaucuccaucagccuggagaccgugaccccgaagcccaagacgaaguccgugcugaagggcaagauggacaacagccucgagaacgucgaguccaacuucgaggcggacgagaagcuggugauggacaccuggcagcaggccagccuggccgugucccacauggucgccgccgagauccaccagcggcucauggaggaggagaaggagaaccagcccgcggaccccaaggagaaguccccgcagaugggggccaacaagaaggugaagaaggagccgcccaagaagaagcaggaggacaagaagcccaagggcaaguccccgcccauggccgaggccacccccgugaucgucaccacggaggagaucgccgagaucaagcgcaagaacgagcugcgcgugaagaucaaggaggagcaccuggcggcccuccaguucgaggagaucgccacccaguuccggcuggagcugaucaagaccaaggcccucgcgcugcuggaggaccucgugaccaaggucguggacguguacaagcugauggagaaguggcugggggagcgcuaccugaacgagauggccagcacggagaagcucaccgacgucgcccgguaccacaucgagaccagcaccaagauccagaacgagcuguaccugucccaggaggacuucuucaucaacggcaacaucaagguguuccccgacccgccgcccagcauccgcccgccgcccguggagaaggaggaggacgggacgcucaccaucgagcagcuggacucccugcgggaccaguuccucgacauggcccccaagggcaucaucggcaacaaggccuucaccgacauccugaucgaccuggucacccucaaccuggggacgaacaacuuccccagcaacuggaugcaccugacccagcccgagcuccaggagcugaccucccugcucaccgugaacagcgaguucguggacuggcgcaaguuccugcuggucacguccaugcccuggcccaucccccucgaggaggagcugcuggagacccuccagaaguucaaggcgguggacaaggagcagcugggcaccaucaccuucgagcaguacaugcaggccgggcugugguucaccggcgacgaggacaucaagauccccgagaacccccucgagccccugccguucaaccggcaggagcaccugaucgaguucuucuuccgccucuucgccgacuacgagaaggacccgccccagcuggacuacacgcagaugcugcucuacuucgccugccaccccgacaccguggagggcgucuaccgggcccugagcguggcggucgggacccacguguuccagcaggucaaggccuccaucccgagcgccgagaagaccuccagcacggacgccggccccgccgaggaguuccccgagcccgaggagaacgcggcccgcgaggagcggaagcugaaggacgacaccgagaagcgcgagcagaaggacgaggagaucccggagaacgccaacaacgagaagauguccauggagacccuccugaaggucuucaagggcgggagcgaggcccaggacuccaaccgguucgcgagccaccugaagaucgagaacaucuacgccgagggguucaucaagaccuuccaggaccucggcgccaagaaccuggagcccaucgagguggccgugcugcucaagcaccccuucauccaggaccugaucuccaacuacagcgacuacaaguuccccgacaucaagaucauccugcagcgcuccgagcacguccagggcagcgacggggagcggagcccgucccgccacacggaggagaagaaguga

SEQ ID NO: 36994 - RNA, 342 nt, Artificial Sequence
  derived and/or modified sequence opt1 from SPEG__Homo_sapiens__NP_001166947
augaagcccagcccgucccagaaccgccggagcuccgacaccggcagcaaggccccgcccaccuucaaggugucccugauggaccagagcguccgcgaggggcaggacgugaucauguccauccgggugcagggcgagcccaagcccgucgugagcuggcuccgcaaccggcagcccgugcgccccgaccagcggcgcuucgccgaggaggcggagggcgggcugugccggcugcgcauccucgccgccgagcgcggggacgccggcuucuacacgugcaaggccgucaacgaguacggcgcgcggcagugcgaggcccggcuggaggugcgcggggaguga

SEQ ID NO: 36995 - RNA, 1053 nt, Artificial Sequence
  derived and/or modified sequence opt1 from SPESP1__Homo_sapiens__NP_663633
augaagccccuggugcuccuggucgcccugcuccuguggcccagcuccgugcccgccuaccccagcaucaccgugacccccgacgaggagcagaaccugaaccacuacauccagguccucgagaaccuggugcgcuccgugccgagcggcgagcccgggcgggagaagaaguccaacagccccaagcacgucuacuccaucgcgagcaagggcuccaaguucaaggagcuggugacgcacggggacgccagcaccgagaacgacgugcucaccaaccccaucuccgaggagaccacgaccuucccgaccggcggguucacccccgagaucggcaagaagaagcacacggagagcacccccuucugguccaucaagcccaacaacgucagcaucgugcugcacgccgaggagccguacaucgagaacgaggagcccgagcccgagcccgagccggccgccaagcagaccgaggcgccccgcaugcugcccguggucaccgaguccagcacgucccccuacgugaccagcuacaaguccccggugaccacccucgacaagagcacgggcaucgggaucagcaccgaguccgaggacgucccccagcugagcggcgagaccgccaucgagaagcccgaggaguucgggaagcaccccgaguccuggaacaacgacgacauccugaagaagauccucgacaucaacagccaggugcagcaggcccugcuguccgacaccagcaacccggccuaccgggaggacaucgaggcguccaaggaccaccucaagcgcagccuggcccuggccgccgccgcggagcacaagcucaagacgauguacaagucccagcugcugcccgugggccggaccagcaacaagaucgacgacaucgagaccgucaucaacaugcucugcaacucccgcagcaagcuguacgaguaccuggacaucaagugcgugccgcccgagaugcgggagaaggccgccaccguguucaacacgcucaagaacaugugccgcucccggcgcgucaccgcccugcugaagguguacuga

SEQ ID NO: 36996 - RNA, 6993 nt, Artificial Sequence
  derived and/or modified sequence opt1 from SPG11__Homo_sapiens__NP_001153699
auggccgccgaggagggcguggcgagcgccgccuccgccgggggcagcugggggaccgccgcgaugggccgcguccugcccaugcuccuggugccggugcccgccgaggccauggggcagcugggcucccgggcccagcuccgcacccagcccgaggcgcugggcagccugacggccgccgggucccuccagguccugagccugacccccggcucccgggggggcgggcgcugcugccucgagggcccguucuggcacuuccugugggaggacagccggaacuccagcacccccaccgagaagcccaagcugcucgcccugggcgagaacuacgagcugcucaucuacgaguucaaccugaaggacgggcgcugcgacgccacgauccuguacuccugcagccgggaggcgcuccagaagcugaucgacgaccaggacaucuccaucagccugcucucccugcgcauccugagcuuccacaacaacaccucccuccuguucaucaacaagugcgugauccugcacaucaucuuccccgagcgggacgccgccauccgcgugcucaacugcuucacccugccgcugcccgcccaggccgucgacaugaucaucgacacccagcucugccggggcauccuguucgugcugagcucccucggguggaucuacaucuucgacguggucgacggcacguacguggcgcacguggaccuggcccugcacaaggaggacaugugcaacgagcagcagcaggagcccgccaagaucagcagcuucaccucccucaaggucagccaggaccuggacguggccgugaucgucuccagcuccaacagcgccguggcgcugaaccucaaccuguacuuccgccagcaccccggccaccugcucugcgagcggauccuggaggaccugccgauccaggggcccaagggcguggacgaggacgaccccgucaacuccgccuacaacaugaagcucgccaaguucagcuuccagaucgaccgcuccuggaaggcccagcugagcucccugaacgagaccaucaagaacagcaagcucgagguguccugcugcgcccccugguuccaggacauccugcaccuggagagcccggaguccgggaaccacagcaccuccgugcagagcugggcguucaucccccaggacaucaugcacggccaguacaacguccugcagaaggaccacgccaagacguccgaccccgggcggagcuggaagaucaugcacaucagcgagcaggaggagcccaucgagcucaagugcguguccgugaccggcuucaccgcccuguucaccugggaggucgagcgcaugggcuacacgaucacccugugggaccucgagacccaggggaugcagugcuucagccugggcaccaagugcaucccgguggacuccagcggggaccagcagcugugcuucguccucacggagaacggccugucccugauccucuucgggcugacccaggaggaguuccugaaccggcucaugauccacggcagcgccuccaccguggacacccugugccaccugaacggcugggggcgcugcagcauccccauccacgcgcucgaggccggcaucgagaaccggcagcuggacacggugaacuucuuccugaaguccaaggagaaccucuucaaccccagcuccaagagcuccgucagcgaccaguucgaccaccuguccagccaccuguaccuccgcaacguggaggagcugauccccgcccuggaccuccugugcuccgccauccgggagagcuacagcgagccgcaguccaagcacuucagcgagcagcugcucaaccugacccuguccuuccucaacaaccagaucaaggagcuguucauccacaccgaggagcuggacgagcaccuccagaagggggugaacauccugaccagcuacaucaacgagcugcgcacguucaugaucaaguuccccuggaagcucaccgacgccaucgacgaguacgacguccacgagaacgugcccaaggugaaggaguccaacaucuggaagaagcugagcuucgaggaggucaucgcguccgccauccugaacaacaagauccccgaggcccagaccuucuuccgcaucgacagccacuccgcccagaagcucgaggagcugaucggcaucgggcugaaccucguguucgacaaccugaagaagaacaacaucaaggaggccagcgagcugcucaagaacaugggcuucgacgugaagggccagcugcugaagaucugcuucuacaccacgaacaagaacauccgggacuuccucgucgagauccugaaggagaagaacuacuucuccgagaaggagaagcgcaccaucgacuucgugcaccagguggagaagcuguaccucgggcacuuccaggagaacaugcagauccagagcuucccgcgguacuggaucaaggagcaggacuucuucaagcacaaguccguccuggacagcuuccugaaguacgacugcaaggacgaguucaacaagcaggaccaccgcaucgugcucaacugggcgcuguggugggaccagcugacccaggaguccauccuccugccccggaucagccccgaggaguacaaguccuacagcccggaggcccuguggcgcuaccucaccgcccggcacgacuggcugaacaucauccuguggaucggcgaguuccagacgcagcacuccuacgccagccuccagcagaacaaguggccccugcugaccguggacgucaucaaccagaacaccagcugcaacaacuacaugcgcaacgagauccucgacaagcuggcccggaacgggguguuccuggcguccgagcucgaggacuucgagugcuuccugcugcgccucagccggaucggcggcgugauccaggacacccugcccguccagaacuacaagaccaaggaggggugggacuuccacucccaguucauccuguacugccucgagcacagccugcagcaccugcucuacguguaccuggacugcuacaagcugucccccgagaacugcccguuccucgagaagaaggagcugcacgaggcccaccccugguucgaguuccuggugcagugccgccaggucgccagcaaccucacggaccccaagcugaucuuccaggccucccuggcgaacgcccagauccucauccccaccaaccaggccagcguguccagcaugcugcuggagggccacacccuccuggcccuggccaccacgauguacuccccggggggcgugagccaggucgugcagaacgaggagaacgagaacugccucaagaagguggacccccagcugcugaagauggcgcugacccccuaccccaagcucaagaccgcccuguucccgcagugcaccccccccuccguccugcccagcgacaucacgaucuaccaccucauccagucccugagcccguucgaccccucccggcuguucggguggcagagcgccaacacccucgccaucggcgacgccuggucccaccugccccacuucagcagccccgaccuggugaacaaguacgcgaucguggagcgccucaacuucgccuacuaccugcacaacggccggccguccuucgccuucgggaccuuccugguccaggagcucaucaagagcaagacccccaagcagcugauccagcaggugggcaacgaggccuacgugaucgggcuguccagcuuccacauccccuccaucggcgccgcgugcgucugcuuccucgagcugcuggggcucgacagccugaagcugcgcguggacaugaagguggccaacaucauccucuccuacaagugccggaacgaggacgcccaguacagcuucauccgcgaguccgucgccgagaagcugagcaagcuggcggacggcgagaagacgaccaccgaggagcuccuggugcugcucgaggagggcaccuggaacuccauccagcagcaggagaucaagcggcugagcuccgagagcuccagccagugggcccuggugguccaguucugccgccuccacaacaugaagcuguccaucagcuaccugcgcgagugcgccaaggccaacgacuggcuccaguucaucauccacucccagcugcacaacuaccaccccgccgaggugaagagccugauccaguacuucagcccggugauccaggaccaccuccggcuggcguucgagaaccugcccuccguccccacgagcaagauggacuccgaccaggugugcaacaagugcccgcaggagcuccaggggagcaagcaggagaugaccgaccuguucgagauccugcuccagugcuccgaggagcccgacagcuggcacuggcugcugguggaggccgucaagcagcaggcccccauccucuccgugcuggccagcugccugcagggcgccuccgcgaucagcugccucugcguguggaucaucaccuccgucgaggacaacguggccaccgaggccauggggcacauccaggacagcacggaggaccacaccuggaaccuggaggaccuguccgucaucuggcgcacccuccugacccggcagaagagcaagacgcugauccgcggcuuccagcucuucuucaaggacuccccccugcugcucgugauggagauguacgagcugugcauguucuuccggaacuacaaggaggccgaggccaagcugcucgaguuccagaagagccuggagacccugaacaccgcggccaccaaggugcacccggucauccccgccauguggcucgaggaccaggugugcuuccugcugaagcucaugcugcagcagugcaagacgcaguacgagcuggggaagcuccugcagcuguucguggagcgcgagcaccucuucuccgacggccccgacgucaagaagcugugcauccugugccagauccucaaggacaccagcaucgccaucaaccacaccaucaucaccuccuacagcaucgagaaccugcagcacgagugccggagcauccuggagcgccuccagacggacggccaguucgcccuggcgcggcgcguggccgagcuggccgagcuccccguggacaaccuggucaucaaggagaucacccaggagaugcagacccugaagcacaucgagcaguggucccucaagcaggcccggaucgacuucuggaagaagugccacgagaacuucaagaagaacagcaucuccagcaaggcggccuccagcuucuucuccacccaggcccacguggccugcgagcacccgacgggguggagcuccauggaggagcgccaccugcugcucacccuggccggccacuggcuggcgcaggaggacguggucccccucgacaagcuggaggagcuggagaagcagaucuggcucugccggaucacccagcacacccuggggcgcaaccaggaggagaccgagccccgguucagccgccagaucuccacgagcggcgagcuguccuucgacagccucgccuccgaguucagcuucuccaagcuggccgcccugaacaccagcaaguaccucgagcugaacucccugcccagcaaggagaccugcgagaaccggcuggacuggaaggagcaggagagccucaacuuccugaucgggcgccugcucgacgacggcugcgugcacgaggccucccgggugugccgcuacuuccacuucuacaacccggacgucgcgcuggugcugcacugccgggcccucgccagcggcgaggccuccauggaggaccugcaccccgagauccacgcccugcuccagagcgcggagcugcuggaggaggaggcccccgacaucccccuccgccgcgugcacucccggcacaagcagauguucaacccgaccgaggagagccagacguuccugcagcugaccacccucugccaggaccgcacccuggucgggaugaagcugcucgacaagaucuccagcgugccccacggcgagcuguccugcacgaccgagcugcucauccuggcccaccacugcuucacccugaccugccacauggaggggaucauccgggugcuccaggccgcgcacaugcugacggacaaccaccuggcccccagcgaggaguacggccucgucgugcgccugcugaccggcaucgggcgguacaacgagaugaccuacaucuucgaccuccugcacaagaagcacuacuucgaggugcugaugcgcaagaagcucgaccccuccggcacccugaagacggcccugcucgacuacaucaagcggugccgcccgggggacagcgagaagcacaacaugaucgcccugugcuucuccaugugccgggagaucggcgagaaccacgaggccgcggcccgcauccagcugaagcucaucgagagccagcccugggaggacucccugaaggacgggcaccagcugaagcagcuccugcugaaggcccucacccugaugcuggacgccgccgagagcuacgcgaaggacuccugcguccggcaggcccagcacugccagcgccucaccaagcugaucacccugcagauccacuuccucaacacgggccagaacaccaugcugaucaaccugggccggcacaagcucauggacugcauccuggcccugccccgcuucuaccaggccagcaucguggccgaggcguacgacuucgugcccgacugggccgagauccucuaccagcaggucauccugaagggggacuucaacuaccuggaggaguucaagcagcagcggcuccugaagagcuccaucuucgaggagaucagcaagaaguacaagcagcaccagccgaccgacauggugauggagaaccugaagaagcuccugaccuacugcgaggacguguaccuguacuacaagcucgccuacgagcacaaguucuacgagaucgucaacgugcugcugaaggacccccagacgggcugcugccucaaggacaugcuggccggguga

SEQ ID NO: 36997 - RNA, 2001 nt, Artificial Sequence
  derived and/or modified sequence opt1 from SPG20__Homo_sapiens__NP_055902
auggagcaggagccccagaacggcgagccggccgagaucaagaucauccgcgaggccuacaagaaggcguuccuguucgugaacaaggggcucaacaccgacgagcugggccagaaggaggaggccaagaacuacuacaagcaggggaucggccaccuccuccgggggaucagcaucuccagcaaggaguccgagcacaccggccccggcugggagagcgcccgccagaugcagcagaagaugaaggagacgcugcagaacguccggacccgccuggagauccucgagaaggggcuggccaccucccugcagaacgaccuccaggaggugcccaagcuguaccccgaguucccgcccaaggacaugugcgagaagcugcccgagccccagagcuucuccagcgccccgcagcacgcggaggugaacggcaacaccuccacgcccagcgccggggccgucgccgcgcccgccucccucagccugcccucccagagcugcccggccgaggccccgcccgccuacacgccccaggcggccgagggccacuacaccguguccuacgggaccgacagcggcgaguucuccagcgugggcgaggaguucuaccggaaccacucccagcccccgccccuggagacccucgggcuggacgccgacgagcugauccucauccccaacggcguccagaucuucuucgugaaccccgccggggaggugagcgcccccagcuaccccggcuaccugcgcaucguccgguuccuggacaacucccucgacaccgugcugaaccggcccccgggcuuccuccaggugugcgacuggcuguacccccugguccccgaccgcagccccgugcugaagugcaccgcgggggccuacauguucccggacaccaugcuccaggccgccggcugcuucgugggggucgugcuguccagcgagcugcccgaggacgaccgcgagcuguucgaggaccugcugcggcagauguccgaccuccgccugcaggccaacuggaaccgggcggaggaggagaacgaguuccagauccccggccgcacgcggccgagcuccgaccagcugaaggaggccagcgggaccgacgugaagcagcucgaccagggcaacaaggacguccgccacaagggcaagcgggggaagcgcgccaaggacaccuccagcgaggaggugaaccugucccacaucgugcccugcgagcccguccccgaggagaagccgaaggagcugcccgaguggagcgagaagguggcccacaacauccucuccggcgccagcuggguguccugggggcuggucaagggcgcggagaucaccgggaaggccauccagaagggcgccagcaagcugcgggagcgcauccagcccgaggagaagcccguggaggucuccccggccgugacgaagggccucuacaucgcgaagcaggccaccgggggcgccgccaaggugagccaguuccuggucgacggggugugcaccguggccaacugcgucggcaaggagcuggcgccccacgugaagaagcacggguccaagcucgugcccgagagccugaagaaggacaaggacggcaagagcccccuggacggcgccauggucguggccgccuccagcgugcagggguucuccaccgucuggcagggccucgagugcgccgcgaagugcaucgugaacaacgugagcgccgagacgguccagaccgugcgguacaaguacggguacaacgccggcgaggccacccaccacgccguggacuccgcggucaacgugggcgugaccgccuacaacaucaacaacaucgggaucaaggccauggucaagaagacggccacccagaccggccacacccugcuggaggacuaccagaucguggacaacagccagcgcgagaaccaggagggggcggccaacgugaacguccgcggcgagaaggacgagcagacgaaggaggugaaggaggccaagaagaaggacaaguga

SEQ ID NO: 36998 - RNA, 846 nt, Artificial Sequence
  derived and/or modified sequence opt1 from SPG21__Homo_sapiens__NP_001121362
augggcgagaucaaggugagccccgacuacaacugguuccgcgggaccgucccgcugaagaagaucaucguggacgacgacgacuccaagaucuggagccucuacgacgccggcccccgguccauccgcugcccccugaucuuccugcccccggugagcgggaccgccgacgucuucuuccggcagauccucgcgcugacgggcuggggguaccgcgugaucgccgugcaccuguucggcgccucccucggcggguuccuggcccagaaguucgccgaguacacccacaagagcccccggguccacucccugauccucugcaacagcuucuccgacaccagcaucuucaaccagaccuggacggcgaacuccuucuggcugaugcccgccuucaugcugaagaagaucgugcucggcaacuucagcuccgggcccguggacccgaugauggccgacgccaucgacuucauggucgaccgccuggagagccugggccaguccgagcucgcgagccggcugacccugaacugccagaacuccuacguggagccccacaagauccgcgacauccccgugaccaucauggacgucuucgaccagagcgcccucuccaccgaggccaaggaggagauguacaagcuguaccccaacgcccggcgcgcccaccugaagaccgggggcaacuucccguaccucugccggagcgcggaggugaaccuguacgugcagauccaccuccugcaguuccacggcacgaaguacgccgccaucgaccccagcauggucuccgccgaggagcuggaggugcagaaggggagccugggcaucucccaggaggagcaguga

SEQ ID NO: 36999 - RNA, 2388 nt, Artificial Sequence
  derived and/or modified sequence opt1 from SPG7__Homo_sapiens__NP_003110
auggccgugcugcuccugcugcuccgcgcccugcggcgcggccccgggccgggcccccggccccugugggggcccggcccggcguggagccccggguuccccgcccgccccggccggggccgcccguacauggccucccggccgcccggggaccucgccgaggccggcgggcgcgcgcugcagagccugcagcuccggcugcugacccccaccuucgagggcaucaacgggcuccugcugaagcagcaccucguccagaaccccgugcgccuguggcagcugcucggcggcacguucuacuucaacaccucccggcugaagcagaagaacaaggagaaggacaagagcaaggggaaggcccccgaggaggacgaggaggagcgccggcgccgggagcgcgacgaccagauguaccgggagcgccugcggacccuccuggugaucgccgucgugaugucccugcucaacgcccugagcaccuccggcgggagcaucuccuggaacgacuucgugcacgagaugcuggcgaagggcgagguccagcgcguccagguggugcccgagagcgacgugguggaggucuaccuccaccccggcgccgugguguucgggcggccgcgccuggcccugauguaccgcaugcaggucgccaacaucgacaaguucgaggagaagcuccgggccgcggaggacgagcugaacaucgaggccaaggaccgcauccccguguccuacaagcggacgggcuucuucgggaacgcccuguacagcgugggcaugaccgccgucgggcucgccauccugugguacguguuccgccuggcgggcaugaccggccgggagggcggcuucuccgccuucaaccagcucaagauggcccgcuucaccaucguggacgggaagaugggcaagggggucagcuucaaggacguggccggcaugcacgaggccaagcuggaggugcgggaguucgucgacuaccugaagucccccgagcgcuuccuccagcugggcgcgaaggugcccaagggggcccugcuccugggcccgcccgggugcggcaagacgcugcucgccaaggccgucgccaccgaggcccaggugcccuuccuggcgauggccgggcccgaguucguggaggucaucggcggccugggggccgcgcgggugcgcagccucuucaaggaggcccgggcccgcgccccgugcaucguguacaucgacgagaucgacgccgucggcaagaagcgguccaccaccaugagcggguucuccaacacggaggaggagcagacccugaaccagcugcugguggagauggacggcaugggcaccaccgaccacgugaucguccucgcgagcacgaaccgcgccgacauccuggacggggcccugaugcggcccggccgccucgaccggcacguguucaucgaccugcccacccugcaggagcgccgggagaucuucgagcagcaccucaagagccugaagcugacccaguccagcaccuucuacucccagcgccucgccgagcugacgcccggguucagcggcgccgacaucgcgaacaucugcaacgaggccgcccugcacgccgcccgcgaggggcacaccuccgugcacacccucaacuucgaguacgcggucgagcgggugcuggccggcaccgccaagaaguccaagauccugagcaaggaggagcagaagguggucgccuuccacgagagcggccacgcgcucgugggguggaugcuggagcacacggaggccgugaugaaggucuccaucaccccgcgcaccaacgccgcccugggcuucgcccagaugcucccccgggaccagcaccuguucaccaaggagcagcuguucgagcgcaugugcauggcgcucgggggccgggccagcgaggcccuguccuucaacgaggugacgagcggggcccaggacgaccugcgcaaggugacccggaucgccuacuccauggucaagcaguucggcauggcgcccggcaucgggccgaucagcuuccccgaggcccaggagggccucauggggaucggccgccggcccuucucccaggggcugcagcagaugauggaccacgaggcccgccugcucguggccaaggccuaccggcacaccgagaaggugcugcaggacaaccuggacaagcuccaggcgcuggccaacgcccugcucgagaaggaggucaucaacuacgaggacaucgaggcccugaucgggcccccgccccacggccccaagaagaugaucgcgccccagcgcuggaucgacgcccagcgggagaagcaggaccugggggaggaggagaccgaggagacgcagcagccgccccucggcggggaggagcccaccuggcccaaguga

SEQ ID NO: 37000 - RNA, 1197 nt, Artificial Sequence
  derived and/or modified sequence opt1 from SPHK1__Homo_sapiens__NP_068807
auggaccccguggucggcugcgggcgcggccuguucggguucguguucagcgccggcgggccgcggggcgugcucccccgccccugccggguccuggugcugcucaacccccgcggcgggaagggcaaggcccugcagcuguuccggucccacgugcagccgcuccuggcggaggccgagaucagcuucacccugaugcucaccgagcgccggaaccacgcccgcgagcugguccgguccgaggagcuggggcgcugggacgcccucguggugaugagcggcgacgggcugaugcacgaggucgugaacggccugauggagcggcccgacugggagacggccauccagaagccccucugcucccugcccgcgggcagcgggaacgcccuggccgccucccucaaccacuacgcgggcuacgagcaggucaccaacgaggaccugcugaccaacugcacccuccugcugugccgccggcuccugagcccgaugaaccugcucucccugcacacggccagcgggcugcgccucuucuccgugcugagccuggccuggggcuucaucgccgacguggaccucgaguccgagaaguaccggcgccugggcgagaugcgguucacccuggggaccuuccuccgccuggccgcgcugcggaccuaccgcggccggcucgccuaccugcccguggggcgcgucggcagcaagacgcccgccucccccguggugguccagcaggggccgguggacgcccaccuggugccccucgaggagcccguccccagccacuggaccguggugccggacgaggacuucguccuggugcuggcccuccugcacucccaccugggcagcgagauguucgcggcccccaugggccgcugcgccgccggggucaugcaccucuucuacgugcgggccggcgugucccgcgcgaugcugcugcggcuguuccucgccauggagaaggggcgccacauggaguacgagugccccuaccuggucuacgugcccguggucgccuuccggcuggagccgaaggacggcaaggggguguucgccguggacggcgagcucauggucagcgaggccgugcagggccaggugcaccccaacuacuucuggauggucagcgggugcguggagcccccgcccuccuggaagccccagcagaugcccccgcccgaggagccccuguga

SEQ ID NO: 37001 - RNA, 1788 nt, Artificial Sequence
  derived and/or modified sequence opt1 from SPHK2__Homo_sapiens__NP_001191087
augaacggccaccuggaggccgaggagcagcaggaccaggcccuccacauccagcgccugcggcccaagccggaggcgcgcccccgggggggccuggugccccucgccgaggucagcgggugcugcacccugcgcucccggagccccuccgacagcgccgccuacuucugcaucuacaccuacccgcgcggccggcgcggggcccggcgccgggcgacgcgcaccuuccgggccgacggcgccgccaccuacgaggagaaccgcgcggaggcccagcggugggccaccgcccugacgugccuccugcgcggccugccccuccccggggacggcgagaucacccccgaccugcugccgcggcccccccgccuccugcugcucgugaaccccuucgggggccgggggcuggccuggcaguggugcaagaaccacgugcugccgaugaucuccgaggcgggccucagcuucaaccugauccagaccgagcgccagaaccacgcccgggagcugguccagggccucucccugagcgagugggacgggaucgugaccguguccggcgacgggcugcuccacgagguccugaacggccugcucgaccgccccgacugggaggaggccgugaagaugcccgugggcauccugcccugcgggagcggcaacgcccuggccggggcggucaaccagcacggcggguucgagccggcccucggccuggaccugcuccugaacugcucccugcuccugugccgcggcgggggccacccccuggaccuccugagcgugacgcuggccuccgggagccggugcuucuccuuccucagcguggccuggggcuucgucuccgacguggacauccagagcgagcgcuuccgggcccugggguccgcgcgcuucacccugggcaccgugcucggccuggccacccugcacacguaccgggggcgccucagcuaccugcccgccaccgucgagcccgccagcccgacccccgcccacucccugccccgggcgaagagcgagcugacccucacgcccgacccggccccccccauggcccacuccccccugcaccgcagcguguccgaccugccgcucccccugccccagccggcccuggcgagccccggcucccccgagccccucccgauccugagccugaacgggggcgggcccgagcucgccggcgacuggggcggggccggcgacgccccccugucccccgacccgcugcucagcuccccccccgggagccccaaggccgcgcugcacuccccggugagcgagggcgcccccgucaucccccccuccagcggccugccgcuccccacccccgacgcccgggugggggccuccaccugcggccccccggaccaccugcugcccccccucgggaccccccugccgcccgacugggugacgcuggagggcgacuucguccucaugcuggccaucagccccucccaccugggggcggaccucguggccgccccgcacgcccgcuucgacgacggccuggugcaccugugcuggguccggagcggcaucagccgcgccgcgcuccugcggcuguuccucgccauggagcgcgggucccacuucagccugggcugcccccagcugggguacgccgccgcgcgggccuuccgccucgagccccugaccccccggggcgugcugaccgucgacggggagcagguggaguacggcccgcuccaggcccagaugcaccccggcaucgggacccugcugacgggcccccccgggugcccgggccgcgagcccuga

SEQ ID NO: 37002 - RNA, 5103 nt, Artificial Sequence
  derived and/or modified sequence opt1 from SPHKAP__Homo_sapiens__NP_001136116
auggacggcaacagccugcucuccgugcccagcaaccuggaguccagccgcauguacgacguccuggagccccagcaggggcggggcugcggguccagcggcuccgggcccggcaacagcaucaccgccugcaagaaggugcuccgcuccaacagccugcuggaguccaccgacuacuggcuccagaaccagcggaugcccugccagaucggcuucguggaggacaagagcgagaacugcgccuccgucugcuucgugaaccuggacgugaacaaggacgagugcagcaccgagcaccuccagcagaagcucgucaacgugucccccgaccugcccaagcugaucagcuccaugaacgugcagcagcccaaggagaacgagaucgucgugcucagcgggcuggccuccggcaaccugcaggccgacuucgaggugagccagugccccuggcuccccgacaucugccugguccagugcgcccgcgggaaccggccgaacagcaccaacugcaucaucuucgagaucaacaaguuccugaucggccucgagcuggugcaggagcgccagcugcaccucgagaccaacauccugaagcuggaggacgacaccaacugcucccucagcuccaucgaggaggacuuccugacggccagcgagcaccuggaggaggaguccgagguggacgagagccggaacgacuacgagaacaucaacgucuccgccaacgugcucgagagcaagcagcugaagggggccacccagguggaguggaacugcaacaaggagaaguggcuguacgcccucgaggacaaguacaucaacaaguaccccacgccccugaucaagaccgagcgcucccccgagaaccugacgaagaacaccgcccuccagagccuggacccguccgccaagcccagccaguggaagcgggaggcggucggcaacggccgccaggccacccacuacuaccacuccgaggccuucaaggggcagauggagaagucccaggcccuguacauccccaaggacgccuacuucuccaugauggacaaggacgugcccagcgcgugcgccguggccgagcagcgguccaaccucaacccgggcgaccacgaggacacccgcaacgcccugccgccccggcaggacggggaggucacgaccggcaaguacgccaccaaccuggcggagagcgugcuccaggacgccuucauccgccugucccagagccagagcacccugccccaggaguccgccgugagcgucuccgugggcagcucccuccugccgagcugcuacuccacgaaggacaccgucgugagccgguccuggaacgagcugcccaagaucguggucgugcagagccccgacggguccgacgccgcgccccagccgggcaucagcuccuggcccgagauggaggugagcgucgagaccuccagcauccucuccggggagaacagcagccgccagccccaguccgcgcuggagguggcccuggccugcgccgccaccgugaucggcacgaucagcagcccccaggcgaccgagcggcucaagauggagcaggucgugagcaacuucccgcccggguccagcggcgcccugcagacccaggcgccccagggccugaaggagccguccaucaacgaguacagcuuccccuccgcccugugcgggaugacccagguggcgagcgccgucgccgugugcggccucggggagcgcgaggaggugacgugcuccgucgcccccagcggcucccugcccccggccgcggaggccagcgaggccaugccgccccugugcgggcucgccuccauggagcugggcaaggaggccaucgcgaagggccugcucaaggaggccgcccuggugcugacccggcccaacaccuacagcuccaucggggacuuccucgacagcaugaaccgccggaucauggagaccgccuccaagagccagacgcugugcagcgagaacgugguccgcaacgagcuggcccacacccucuccaacgugauccugcgccacagcaucgacgaggugcaccacaagaacaugaucaucgacccgaacgacaaccggcacuccagcgagauccuggacacccucauggaguccaccaaccagcugcugcucgacgucaucugcuucacguucaagaagaugagccacaucgugcgccugggcgagugccccgcggugcuguccaaggagaccauccggcgccgggagaccgagcccagcugccagcccuccgacccgggggccagccaggccuggaccaaggccacggaguccagcuccagcagcccccugagcaacucccacaacaccagccuggucaucaacaaccugguggacggcauguacuccaagcaggacaagggcggcgugcgccccggccucuucaagaaccccacccugcagagccagcugagccggucccaccgcgucccggacagcuccaccgcgaccacgagcuccaaggagaucuaccucaaggggaucgccggcgaggacaccaagagcccccaccacuccgagaacgagugccgggccagcuccgaggggcagcgcagccccaccgugucccagagccgguccggcagccaggaggccgaggaguccauccaccccaacacccaggagaaguacaacugcgccacgagccgcaucaacgaggugcaggucaaccugucccugcucggcgacgaccugcugcucccggcgcagagcacccugcagaccaagcaccccgacaucuacugcaucaccgacuucgccgaggagcuggccgacacggugguguccauggccaccgagaucgccgcgaucugccucgacaacagcagcgggaagcagcccugguucugcgccuggaagcggggcuccgaguuccugaugacccccaacgucccgugccgcagccugaagcggaagaaggagucccaggggagcggcaccgccgugcgcaagcacaagccgccccggcucuccgagaucaagcgcaagacggacgagcaccccgagcugaaggagaagcugaugaaccggguggucgacgagagcaugaaccucgaggacgugcccgacuccgugaaccuguucgccaacgaggucgccgcgaagaucaugaaccugaccgaguucagcaugguggacgggauguggcaggcccagggcuacccccgcaaccgccuccuguccggcgaccgguggagccgccugaaggccuccagcugcgaguccauccccgaggaggacagcgaggcccgggcguacgugaacucccucgggcugaugagcacccugucccagccggucagccgcgccuccagcgugagcaagcaguccagcugcgaguccaucaccgacgaguucagccgguucauggugaaccagauggagaacgagggccgcggguucgagcuccugcuggacuacuacgccggcaagaacgccuccagcauccucaacuccgccaugcagcaggcgugccggaaguccgaccaccuguccguccgccccagcugccccuccaagcagagcuccacggagagcaucaccgaggaguucuaccgguacaugcugcgcgacaucgagcgggacucccgcgagagcgccuccagccggcgcuccagccaggacuggaccgccgggcuccugagccccucccugcggagcccggugugccaccgccaguccagcaugcccgacucccggagccccugcucccgccucaccgugaacguccccaucaaggccaacagccuggacggcuucgcccagaacugcccgcaggacuuccuguccgugcagcccgugagcuccgcgagcuccagcggccucugcaaguccgacagcugccuguaccggcgcgggggcacggaccacaucaccaacaugcugauccacgagaccugggccuccagcaucgaggcccucaugcggaagaacaagaucaucgucgacgacgccgaggaggccgacaccgagcccgugagcgggggcucccccagccaggcggagaagugcgccaaccgccuggccgccucccgcaugugcagcgggccgacgcugcucguccaggagucccuggacugcccccggaaggacagcgugaccgagugcaagcagccgcccguguccagccuguccaagaccgccagccucaccaaccacagcccccuggacuccaagaaggagacguccagcugccaggaccccguccccaucaaccacaagcgccggucccugugcagccgcgaggugccccucauccagaucgagaccgaccagcgggaggcgugcgccggcgagccggagcccuuccuguccaagagcucccugcucgaggaggccgagggccacagcaacgacaagaacauccccgacgugguccgcgggggcgacaccgccgugagcgcgugccagauccacuccgacagccuggacacccgggacgugcccgaggccgaggccuccacggaggcccgcgccccggacgaggcgcccaacccgcccagcuccagcgaggaguccaccgggagcuggacccagcuggccaacgaggaggacaaccccgacgacaccuccagcuuccuccagcuguccgagcggagcauguccaacggcaacagcuccgccacgagcucccuggggaucauggaccucgacaucuaccaggagagcaugcccuccagccccaugaucaacgagcuggucgaggagaagaagauccugaagggccagagcgaguccaccgaggcccccgccagcgggccgcccaccgggaccgcgagcccccagcgcagccuccuggugaucaacuucgaccuggagccggagugccccgacgccgagcuccgggccacccugcaguggaucgccgccuccgagcugggcauccccacgaucuacuucaagaagucccaggagaaccgcaucgagaaguuccucgacgugguccagcuggugcaccggaaguccuggaaggugggggacaucuuccacgcggucgugcaguacugcaagaugcacgaggagcagaaggacggccgccugagccuguucgacuggcuccuggagcugggcuga

SEQ ID NO: 37003 - RNA, 816 nt, Artificial Sequence
  derived and/or modified sequence opt1 from SPI1__Homo_sapiens__NP_001074016
augcugcaggccugcaagauggagggcuucccccucgugccgccccagcccagcgaggaccugguccccuacgacaccgaccuguaccagcgccagacccacgaguacuaccccuaccucuccagcgacggggagucccacagcgaccacuacugggacuuccacccccaccacgugcacuccgaguucgagagcuucgccgagaacaacuucacggagcugcaguccgugcagccgccccagcugcagcagcucuaccggcacauggagcuggagcagaugcacguccuggacacccccauggugccgccccaccccagccucggccaccagguguccuaccugccccgcaugugccugcaguaccccagccucucccccgcgcagcccagcuccgacgaggaggagggggagcggcagagcccgccccuggaggucuccgacggcgaggccgacgggcuggagcccggccccggccuccugccgggggagaccggcagcaagaagaagauccgccuguaccaguuccuccuggaccugcuccgguccggggacaugaaggacagcaucugguggguggacaaggacaagggcaccuuccaguucuccagcaagcacaaggaggcccuggcccaccgcugggggauccagaagggcaaccggaagaagaugacguaccagaagauggcccgcgcgcugcggaacuacggcaagaccggggaggugaagaaggucaagaagaagcucaccuaccaguucagcggcgaggugcuggggcgcggcggccuggccgagcggcgccacccgccccacuga

SEQ ID NO: 37004 - RNA, 516 nt, Artificial Sequence
  derived and/or modified sequence opt1 from SPIB__Homo_sapiens__NP_001230927
auggccagcuccaugaccuggaccgccgcgagcauccccgccacgcugauccagcgcggccuccugacccuggugccgcccgccuacgcccccuaccccuccccgguccucagcgaggaggaggaccugccccuggacucccccgcccucgaggugagcgacuccgagagcgacgaggcgcugguggccgggcccgagggcaagggguccgaggccggcacccggaagaagcugcgccucuaccaguuccugcuggggcuccugacccggggcgacaugcgcgagugcgucugguggguggagccgggcgccgggguguuccaguucagcuccaagcacaaggagcugcucgcgcggcgcuggggccagcagaaggggaaccggaagcgcaugacguaccagaagcuggcccgggcccugcgcaacuacgccaagaccggcgagauccggaaggucaagcgcaagcucaccuaccaguucgacagcgcccugcugcccgcggugcggcgcgccuga

SEQ ID NO: 37005 - RNA, 747 nt, Artificial Sequence
  derived and/or modified sequence opt1 from SPIC__Homo_sapiens__NP_689536
augaccugcguggagcaggacaagcugggccaggccuucgaggacgccuucgagguccuccgccagcacagcaccggggaccugcaguacucccccgacuaccggaacuaccuggcgcucaucaaccaccgcccgcacgugaagggcaacagcuccugcuacggggugcugcccacggaggagcccgucuacaacuggcggaccgugaucaacagcgccgccgacuucuacuucgagggcaacauccaccagucccugcagaacaucaccgagaaccagcucgugcagcccacccugcugcagcagaagggcgggaagggccgcaagaagcuccggcuguucgaguaccugcacgagagccucuacaacccggagauggccuccugcauccagugggucgacaagacgaaggggaucuuccaguucgugagcaagaacaaggagaagcuggccgagcuguggggcaagcgcaaggggaaccggaagaccaugaccuaccagaagauggcgcgcgcccuccggaacuacggccgcuccggggagaucaccaagauccggcgcaagcugacguaccaguucagcgaggccauccugcagcggcucucccccagcuacuuccugggcaaggagaucuucuacucccagugcgugcagcccgaccaggaguaccugagccucaacaacuggaacgccaacuacaacuacaccuacgcgaacuaccacgagcugaaccaccacgacugcuga

SEQ ID NO: 37006 - RNA, 2748 nt, Artificial Sequence
  derived and/or modified sequence opt1 from SPIDR__Homo_sapiens__NP_001073863
augccccgcggcagccgggcccgcggguccaagcggaagcgcagcuggaacaccgagugcccguccuuccccggcgagcggccccuccaggugcgccgggccgggcugcgcaccgcgggcgccgccgccagccuguccgaggccuggcugcggugcggggagggcuuccagaacacgagcggcaaccccucccucaccgcggaggagaagaccaucaccgagaagcaccuggagcugugcccgcgccccaagcaggagacgaccaccagcaaguccaccagcgggcucacggacaucaccugguccagcuccggcagcgaccuguccgacgaggacaagacccugagccagcuccagcgggacgagcugcaguucaucgacugggagaucgacuccgaccgcgccgaggccagcgacugcgacgaguucgaggacgacgagggggccgucgagaucuccgacugcgcgagcugcgccagcaaccagucccugaccagcgacgagaagcucuccgagcugcccaagcccagcuccaucgagauccuggaguacagcuccgacagcgagaaggaggacgaccucgagaacgugcugcugaucgacuccgagagcccgcacaaguaccacgugcaguucgccuccgacgcccggcagaucauggagcgccucaucgacccccggaccaagagcaccgagaccauccugcacacgccccagaagcccacggccaaguucccgcgcacccccgagaacuccgcgaagaagaagcugcuccggggcgggcuggccgagcgccugaacggccuccagaaccgggagcgcagcgccaucucccuguggcggcaccagugcaucagcuaccagaagacccuguccggccgcaagagcgggguccucaccgugaagauccuggagcugcacgaggagugcgccaugcaggucgccaugugcgagcagcuccugggcucccccgcgacgagcagcucccagagcguggcgccccgcccgggggccggccugaagguccucuucaccaaggagaccgccggcuaccugcgggggcgcccccaggacaccgugcggaucuucccgcccuggcagaagcugaucauccccuccggcagcugccccgugauccucaacacguacuucugcgagaaggugguggccaaggaggacuccgagaagaccugcgaggucuacugccccgacaucccccugccgcgccggagcaucucccuggcccagauguucgugaucaaggggcucaccaacaacagccccgagauccagguggucugcuccggcguggccaccacggggaccgccuggacccacggccacaaggaggccaagcagcgcauccccaccagcacgccccugcgggacucccugcucgacguggucgagagccagggcgccgcguccuggccgggggccggcgugcgcguggucgugcagcggguguacagccugcccucccgcgacagcacccgggggcagcagggcgccuccagcgggcacaccgaccccgccggcacccgcgcgugccugcucguccaggacgccugcggcauguucggggaggugcaccuggaguucacgaugagcaaggcccggcagcuggagggcaaguccugcagccucgucgggaugaaggugcugcagaaggugacccgcggccggaccgccgggaucuucucccugaucgacacccuguggccgcccgccaucccccucaagacccccggccgcgaccagccgugcgaggagaucaagacgcaccucccgccgcccgcgcugugcuacauccugaccgcccaccccaaccugggccagaucgacaucaucgacgaggaccccaucuacaagcuguaccagccgcccgucacccggugccuccgcgacauccugcagaugaacgaccuggggacccggugcagcuucuacgccacggugaucuaccagaagccccagcucaagucccugcugcuccuggagcagcgcgagaucuggcugcucgugaccgacgucacccugcagaccaaggaggagcgcgacccccggcugcccaagacgcuccugguguacguggcgccccugugcguccucggcagcgaggugcuggaggcccuggccggggccgcgccccacucccucuucuucaaggacgcccugcgcgaccagggccggaucgugugcgccgagcgcaccguccugcuccugcagaagccccugcucagcgugguguccggcgccagcuccugcgagcugcccgggcccgucaugcuggacagccucgacuccgccaccccggugaacagcaucugcuccgugcagggcaccgucguggggguggacgagagcacggccuucuccuggcccgucugcgacaugugcggcaacgggcggcuggagcagcgccccgaggaccggggcgccuucagcugcggcgacugcucccgcguggugaccagccccguccugaagcggcaccuccagguguuccuggacugccgcagccggccgcagugccgcgugaaggucaagcugcuccagcgguccaucagcucccugcugcgcuucgcggccggggaggacggcagcuacgaggugaaguccgugcucgggaaggaggucggccugcugaacugcuucgugcagagcgugaccgcccaccccaccuccugcaucgggcucgaggagaucgagcugcugagcgccggcggcgccuccgcggagcacuga

SEQ ID NO: 37007 - RNA, 789 nt, Artificial Sequence
  derived and/or modified sequence opt1 from SPIN1__Homo_sapiens__NP_006708
augaagacccccuucggcaagaccccggggcagcgcagccgggccgacgccggccacgcggggguguccgccaacaugaugaagaagcgcacgagccacaagaagcaccgguccagcgucggccccuccaagcccgugagccagccccgccggaacaucguggggugccgcauccagcacggcuggaaggagggcaacgggccggucacccaguggaagggcaccgugcuggaccaggugcccgucaaccccucccucuaccugaucaaguacgacggguucgacugcguguacggccuggagcucaacaaggacgagcgggugagcgcccuggagguccugcccgaccgcguggccaccucccggaucagcgacgcccaccucgcggacacgaugaucgggaaggccguggagcacauguucgagaccgaggacggcuccaaggacgaguggcgcggcaugguccuggcccgggccccggugaugaacaccugguucuacaucaccuacgagaaggaccccgugcuguacauguaccagcuccuggacgacuacaaggagggggaccugcgcaucaugcccgacagcaacgacuccccgcccgcggagcgggagcccggcgaggucguggacagccucguggggaagcaggucgaguacgccaaggaggacggcuccaagcgcacgggcauggugauccaccagguggaggccaagcccagcgucuacuucaucaaguucgacgacgacuuccacaucuacguguacgaccuggugaagaccuccuga

SEQ ID NO: 37008 - RNA, 777 nt, Artificial Sequence
  derived and/or modified sequence opt1 from SPIN2A__Homo_sapiens__NP_061876
augaagacccccaacgcccaggaggccgagggccagcagacccgcgcggccgccgggcgggccacgggcagcgccaacaugaccaagaagaaggugucccagaagaagcagcgcgggcggccgagcucccagccccgccggaacaucgucggcugccgcaucagccacggguggaaggagggcgacgagcccaucacccaguggaagggcaccgugcuggaccaggugcccaucaacccgucccucuaccuggucaaguacgacgggaucgacugcguguacggccuggagcuccaccgggacgagcgcgugcugagccugaagauccucuccgaccgggucgcgagcucccacaucagcgacgccaaccuggccaacacgaucaucgggaaggccguggagcacauguucgagggcgagcacggguccaaggacgaguggcgcggcauggugcuggcgcaggcccccaucaugaaggccugguucuacaucaccuacgagaaggaccccguccucuacauguaccagcugcuggacgacuacaaggagggcgaccuccggaucaugcccgagagcuccgagagcccgcccaccgagcgcgagcccgggggcgugguggacgggcugaucggcaagcacgucgaguacaccaaggaggacggcuccaagcggaucgggauggugauccaccagguggagacgaagcccagcgucuacuucaucaaguucgacgacgacuuccacaucuacguguacgaccuggugaagaaguccuga

SEQ ID NO: 37009 - RNA, 240 nt, Artificial Sequence
  derived and/or modified sequence opt1 from SPINK1__Homo_sapiens__NP_003113
augaaggugaccggcaucuuccugcucagcgcccuggcccugcucucccugagcgggaacaccggcgcggacucccuggggcgcgaggccaagugcuacaacgagcucaacggcugcacgaagaucuacgaccccgucugcgggaccgacggcaacaccuacccgaacgagugcgugcugugcuucgagaaccggaagcgccagaccagcauccugauccagaaguccggccccugcuga

SEQ ID NO: 37010 - RNA, 405 nt, Artificial Sequence
  derived and/or modified sequence opt1 from SPINK2__Homo_sapiens__NP_001258647
auggcccugagcgugcuccgccuggcccugcuccugcuggcggucaccuucgccggcuccgcccggagcgggcccggcgagcgcgggccgcccgagaaguccggcuucgggagccagaccggcggcgggcccugccccgccccgggcgggcucggcgacgggacgcgggcccccgugaccggcggcucccccgaggaccugcccgcgagccugaucccgcaguucggccucuucuccaaguaccgcacccccaacugcagccaguaccggcugcccgggugcccccgccacuucaacccggugugcggguccgacaugagcaccuacgccaacgagugcacgcugugcaugaagauccgggagggcggccacaacaucaagaucauccgcaacgggcccugcuga

SEQ ID NO: 37011 - RNA, 261 nt, Artificial Sequence
  derived and/or modified sequence opt1 from SPINK4__Homo_sapiens__NP_055286
auggccgugcgccagugggucaucgcccuggcgcucgccgcccugcuggugguggaccgggagguccccguggccgccggcaagcuccccuucagccgcaugcccaucugcgagcacaugguggaguccccgaccugcagccagauguccaaccuggucugcgggaccgacggccugacguacaccaacgagugccagcucugccuggcgcggaucaagaccaagcaggacauccagaucaugaaggacgggaagugcuga

SEQ ID NO: 37012 - RNA, 3285 nt, Artificial Sequence
  derived and/or modified sequence opt1 from SPINK5__Homo_sapiens__NP_001121170
augaagaucgccaccgugagcguccugcucccccuggcccugugccucauccaggacgcggccuccaagaacgaggaccaggagaugugccacgaguuccaggccuucaugaagaacggcaagcuguucugcccgcaggacaagaaguucuuccagagccuggacgggaucauguucaucaacaagugcgcgaccugcaagaugauccucgagaaggaggccaagucccagaagcgcgcccggcaccuggcccgcgcccccaaggccacggcgcccaccgagcugaacugcgacgacuucaagaagggcgagcgggacggggacuucaucugccccgacuacuacgaggccgugugcggcaccgacgggaagaccuacgacaaccgcugcgcccucugcgccgagaacgccaagacgggcagccagaucggcgugaaguccgagggggagugcaagagcuccaacccggagcaggacgucugcagcgcguuccggcccuucgugcgcgacggccggcuggggugcacccgcgagaacgaccccgugcugggccccgacgggaagacccacggcaacaagugcgccaugugcgccgagcuguuccucaaggaggccgagaacgccaagcgggagggcgagacccgcauccggcgcaacgcggagaaggacuucugcaaggaguacgagaagcagguccggaacgggcgccuguucugcacgcgggaguccgacccggugcgcggccccgacgggcggaugcacggcaacaagugcgcccucugcgccgagaucuucaagcagcgcuucagcgaggagaacuccaagaccgaccagaaccugggcaaggccgaggagaagaccaaggugaagcgggagaucgucaagcugugcagccaguaccagaaccaggccaagaacgggauccucuucugcacccgcgagaacgaccccauccggggccccgacgggaagaugcacggcaaccugugcuccaugugccaggcguacuuccaggccgagaacgaggagaagaagaaggccgaggcccgcgcccgcaacaagcgggagagcgggaaggcgacguccuacgccgagcugugcagcgaguaccgcaagcucgugcggaacggcaagcuggccugcacccgcgagaacgacccgauccagggccccgacgggaaggugcacggcaacacgugcuccaugugcgaggucuucuuccaggccgaggaggaggagaagaagaagaaggagggcaagagccggaacaagcgccaguccaagagcaccgcgagcuucgaggagcugugcuccgaguaccgcaagagccggaagaacgggcgccucuucugcacccgggagaacgaccccauccaggggcccgacggcaagaugcacggcaacacgugcuccaugugcgaggccuucuuccagcaggaggagcgggcccgcgccaaggccaagcgggaggcggccaaggagaucugcagcgaguuccgcgaccaggugcggaacgggacccugaucugcacccgcgagcacaacccggugcggggccccgacgggaagaugcacggcaacaagugcgccaugugcgccuccgucuucaagcuggaggaggaggagaagaagaacgacaaggaggagaaggggaagguggaggccgagaaggugaagcgcgaggcgguccaggagcucugcagcgaguaccggcacuacgugcgcaacggccgccugcccugcacccgggagaacgaccccaucgagggccuggacgggaagauccacggcaacacgugcuccaugugcgaggccuucuuccagcaggaggccaaggagaaggagcgcgccgagccgcgggccaaggugaagcgcgaggcggagaaggagaccugcgacgaguuccggcgccuccugcagaacgggaagcuguucugcacccgggagaacgaccccguccgcggccccgacggcaagacccacgggaacaagugcgccaugugcaaggccguguuccagaaggagaacgaggagcggaagcgcaaggaggaggaggaccagcggaacgccgcgggccacgggagcuccggcgggggcggcgggaacacccaggacgagugcgccgaguaccgcgagcagaugaagaacggccggcucagcugcacccgcgaguccgaccccgugcgggacgccgacggcaagagcuacaacaaccagugcaccaugugcaaggccaagcuggagcgcgaggccgagcggaagaacgaguacucccgcagccgguccaacgggacggggagcgaguccggcaaggacacgugcgacgaguuccgcagccagaugaagaacggcaagcugaucugcacccgggaguccgacccgguccgcgggcccgacggcaagacccacgggaacaagugcaccaugugcaaggagaagcucgagcgcgaggcggccgagaagaagaagaaggaggacgaggaccggagcaacaccggcgagcgcagcaacaccggggagcgguccaacgacaaggaggaccugugccgcgaguuccggagcaugcagcgcaacggcaagcugaucugcacccgggagaacaaccccgugcgcggccccuacgggaagaugcacaucaacaagugcgccaugugccaguccaucuucgaccgggaggccaacgagcgcaagaagaaggacgaggagaaguccagcagcaagccguccaacaacgccaaggaccagugccggcagguccagaacgaggcggaggacgccaaguuccgccagcccggccggagccucgccuccguggcccgcaugagcacggacgagugcuccgaguuccggaacuacauccgcaacaacgagcugaucugcccccgggagaacgacccggugcacggggccgacggcaaguucuacaccaacaagugcuacaugugccgcgcggucuuccugaccgaggcccucgagcgggccaagcugcaggagaagcccagccacgugcgcgccucccaggaggaggacagccccgacuccuucagcucccuggacagcgagaugugcaaggacuaccgcgugcucccccggaucggguaccugugcccgaaggaccugaagcccgucugcggcgacgacggccagaccuacaacaaccccugcaugcucugccacgagaaccugauccgccagaccaacacgcacauccggagcaccgggaagugcgaggaguccagcacccccggcaccacggcggccuccaugccgcccagcgacgaguga

SEQ ID NO: 37013 - RNA, 243 nt, Artificial Sequence
  derived and/or modified sequence opt1 from SPINK6__Homo_sapiens__NP_001182219
augaagcugagcggcauguuccuccugcugucccucgcccuguucugcuuccugaccgggguguucagccagggcgggcaggucgacugcggcgaguuccaggaccccaagguguacugcacccgcgaguccaacccgcacugcgggagcgacggccagacguacggcaacaagugcgccuucugcaaggcgaucgugaaguccgggggcaagaucagccucaagcaccccgggaagugcuga

SEQ ID NO: 37014 - RNA, 258 nt, Artificial Sequence
  derived and/or modified sequence opt1 from SPINK7__Homo_sapiens__NP_115955
augaagaucaccggcgggcugcuccugcugugcaccguggucuacuucugcagcuccagcgaggccgccucccucagccccaagaagguggacugcuccaucuacaagaaguacccgguggucgcgauccccugccccaucacguaccugcccgugugcggcagcgacuacaucaccuacgggaacgagugccaccugugcaccgagucccucaagagcaacggccgcgugcaguuccugcacgacggguccugcuga

SEQ ID NO: 37015 - RNA, 1542 nt, Artificial Sequence
  derived and/or modified sequence opt1 from SPINT1__Homo_sapiens__NP_001027539
auggcccccgcccgcaccauggcgcgggcccgccuggcccccgccggcauccccgccguggcgcucuggcugcugugcacccucgggcugcagggcacgcaggccgggccgccgcccgccccgcccggccugcccgccggggcggacugccucaacagcuucaccgccggcguccccggcuucgugcuggacaccaacgccuccgugagcaacggggccaccuuccuggagucccccacgguccggcgcggcugggacugcgugcgggccugcugcaccacccagaacugcaaccucgcgcugguggagcugcagcccgaccgcggggaggacgccaucgccgccugcuuccucaucaacugccuguacgagcagaacuucgucugcaaguucgcgccccgggagggcuucaucaacuaccugacccgcgagguguaccggagcuaccgccagcuccggacgcagggguucggcggcuccgggauccccaaggccugggccggcaucgaccugaaggugcagccccaggagccccugguccucaaggacguggagaacaccgacuggcgccugcugcgcggggacaccgacgugcgggucgagcggaaggaccccaaccagguggagcucuggggccugaaggagggcaccuaccuguuccagcucacggugaccagcuccgaccacccggaggacaccgccaacgucaccgugacggugcugagcaccaagcagaccgaggacuacugccuggccuccaacaaggucgggcgcugccggggcagcuucccccgcugguacuacgaccccaccgagcagaucugcaaguccuucguguacgggggcugccucgggaacaagaacaacuaccugcgggaggaggagugcauccuggccugccgcggcgugcagggccccagcauggagcggcgccacccggucugcuccgggacgugccagcccacccaguuccgcugcagcaacggcugcugcaucgacuccuuccucgagugcgacgacacccccaacugccccgacgcgagcgacgaggccgccugcgagaaguacaccuccggguucgacgagcugcagcggauccacuucccgagcgacaagggccacugcguggaccugcccgacacggggcucugcaaggaguccaucccccgcugguacuacaaccccuucagcgagcacugcgcccgguucaccuacggcggcugcuacgggaacaagaacaacuucgaggaggagcagcagugccuggagagcugccgcggcaucuccaagaaggacguguucgggcugcggcgcgagaucccgauccccagcaccggcuccgucgagauggccguggcggucuuccucgugaucugcaucguggucgugguggccauccugggguacugcuucuucaagaaccagcggaaggacuuccacggccaccaccaccacccgccgcccacccccgccagcuccacggucagcaccaccgaggacaccgagcaccugguguacaaccacacgacccgcccccucuga

SEQ ID NO: 37016 - RNA, 588 nt, Artificial Sequence
  derived and/or modified sequence opt1 from SPINT2__Homo_sapiens__NP_001159575
auggcccagcugugcggccuccgccggagccgcgccuuccuggcgcugcucgggucccugcugcucagcggcgugcuggccgccgaccgggagcgcuccauccacgagaacgccaccggggaccuggccaccagccggaacgcggccgacuccagcguccccuccgccccgcgccggcaggacagcgaggaccacuccagcgacauguucaacuacgaggaguacugcacggccaacgcggugaccggccccugccgcgccuccuucccccggugguacuucgacguggagcgcaacagcugcaacaacuucaucuacgggggcugccggggcaacaagaacuccuaccgcagcgaggaggccugcaugcuccggugcuuccgccagcaggagaacccgccccugccccugggguccaaggucguggugcucgccggccuguucgucauggugcugauccucuuccugggggccagcaugguguaccugauccgggucgcgcgccggaaccaggagcgcgcccuccggaccgugugguccagcggcgacgacaaggagcagcuggugaagaacaccuacguccuguga

SEQ ID NO: 37017 - RNA, 1365 nt, Artificial Sequence
  derived and/or modified sequence opt1 from SPNS1__Homo_sapiens__NP_001135921
auggccggcagcgacaccgcccccuuccugucccaggcggacgacccggacgacgggcccgugcccggcacccccgggcucccgggcagcacggggaaccccaaguccgaggagcccgagguccccgaccaggagggccugcagcgcaucaccggccugagcccggggcgguccgcccucaucguggccgugcugugcuacaucaaccugcucaacuacauggaccgcuucaccgucgccguguucaucagcuccuacauggugcuggcccccgucuucggcuaccugggggaccgguacaaccgcaaguaccucaugugcggcgggaucgcguucuggagccuggugacccugggcuccagcuucauccccggcgagcacuucuggcuccugcugcucacgcgggggcuggugggcgucggggaggccuccuacagcaccaucgcccccacccugaucgccgaccucuucguggcggaccagcgcucccggaugcugagcaucuucuacuucgccaucccggugggcuccggccugggguacaucgccggcagcaaggucaaggacauggccggggacuggcacugggcccuccgcgugacccccggccuggggguggucgcggugcugcuccuguuccuggugguccgggagccgccccgcggcgccguggagcggcacuccgaccucccgccccugaaccccacgagcuggugggccgaccugcgcgcccucgcccggaaccugaucuucggccugaucacgugccucaccggggugcugggcgucgggcugggcguggagaucucccgccggcuccgccacagcaacccccgggcggacccccuggugugcgccaccgggcugcucggcagcgcccccuuccuguuccugucccucgccugcgcccgcggcagcaucgucgcgaccuacaucuucaucuucaucggggagacccugcuguccaugaacugggccaucguggccgacauccuccuguacgucgugauccccacccggcgcagcaccgccgaggccuuccagaucgugcugucccaccuccugggcgacgcggggagccccuaccugaucggccugaucuccgaccggcuccgccgcaacuggccgcccagcuuccuguccgaguuccgggcccugcaguucagccucaugcugugcgccuucgucggggcccugggcggcgcggccuuccucgggacggccaucuucaucgaggccgaccgccggcgcgcccagcugcacgugcagggccugcuccacgaggcgggguccaccgacgaccggaucguggucccccagcgcggccggagcacccgcgugcccguggccuccguccugaucuga

SEQ ID NO: 37018 - RNA, 1650 nt, Artificial Sequence
  derived and/or modified sequence opt1 from SPNS2__Homo_sapiens__NP_001118230
augaugugccuggagugcgccagcgccgcggccggcggggccgaggaggaggaggccgacgccgagcgccggcgccggcgccggggcgcgcagcgcggggccggcggguccggcugcugcggcgcccgcggggccggcggggcgggcgugagcgccgccggggacgagguccagacccucuccggcagcgugcggcgggcccccaccggcccgcccgggacgcccggcacccccgggugcgccgcgaccgccaagggccccggcgcccagcagcccaagcccgccucccuggggcgcggccgcggggccgcggccgccauccugagccucggcaacgugcugaacuaccuggaccgguacaccgucgccggggugcuccuggacauccagcagcacuucggcgugaaggaccggggcgccgggcugcuccaguccgucuucaucugcagcuucaugguggcggcccccaucuucggcuaccugggggaccgcuucaaccggaaggugauccuguccugcggcaucuucuucuggagcgccgucacguucuccagcuccuucaucccgcagcaguacuucuggcuccuggugcugagccgcgggcucgugggcaucggcgaggccuccuacagcaccaucgcccccaccaucaucggggaccuguucaccaagaacacgcggacccugaugcucuccgucuucuacuucgcgaucccccugggcagcgggcugggcuacaucaccggguccagcgugaagcaggccgccggcgacuggcacugggcccuccgcgugagccccguccugggcaugaucaccgggacgcugauccucauccuggugccggcgaccaagcggggccacgccgaccagcugggggaccagcucaaggcccgcaccuccuggcugcgggacaugaaggcccugauccgcaaccgcagcuacguguucuccagccucgccaccuccgcggucagcuucgccacgggcgcccugggcauguggaucccccuguaccuccaccgggcccagguggugcagaagaccgccgagaccugcaacuccccgcccugcggggcgaaggacagccugaucuucggcgccaucacgugcuucaccggguuccugggcgucgugaccggggccggcgccacccgcuggugccggcucaagacccagcgcgccgacccccuggugugcgcggucggcaugcugggguccgccaucuucaucugccucaucuucguggccgccaagagcuccaucgucggcgcguacaucugcaucuucgugggggagacgcugcuguucagcaacugggccaucaccgccgacauccucauguacguggucauccccacccggcgcgccaccgccguggcgcugcaguccuucacgagccaccuccugggcgacgccgggucccccuaccugaucggcuucaucagcgaccugauccggcaguccaccaaggacagcccccucugggaguuccugucccugggcuacgcccugaugcucugcccguucguggucgugcucgggggcauguucuuccuggccaccgcccuguucuucgugagcgaccgcgcgcgggccgagcagcaggucaaccagcuggccaugccgcccgccagcgugaagguguga

SEQ ID NO: 37019 - RNA, 1191 nt, Artificial Sequence
  derived and/or modified sequence opt1 from SPO11__Homo_sapiens__NP_036576
auggccuucgcccccaugggcccggaggcgagcuucuucgacgugcuggaccgccaccgggagucccuccuggccgcccugcgccgcgggggccgggagccgcccaccgggggcagccggcucgccuccagcuccgagguccuggccagcaucgagaacaucauccaggacaucaucaccucccuggcgcgcaacgaggcccccgccuucacgaucgacaaccggagcuccugggagaacaucaaguucgaggacagcguggggcuccagauggugucccacugcaccacccgcaagaucaagagcgacucccccaagagcgcccagaaguucucccugauccugaagauccucagcaugaucuacaagcugguccaguccaacaccuacgcgacgaagcgggacaucuacuacaccgacagccagcuguucggcaaccagaccgugguggacaacaucaucaacgacaucuccugcaugcucaaggucagccgccggagccugcacauccuguccaccagcaagggccucaucgccgggaaccugcgcuacaucgaggaggacggcacgaaggugaacugcacgugcggggccaccgccguggccguccccuccaacauccagggcauccggaaccuggugaccgacgcgaaguucgugcucaucgucgagaaggacgccaccuuccagcgccugcuggacgacaacuucugcaacaagcucagccccugcaucaugaucaccgggaagggcgugcccgaccugaacacccggcugcucgugaagaagcugugggacaccuuccacgucccgguguucacgcugguggacgccgacccccacggcaucgagaucaugugcaucuacaaguacggguccaugagcauguccuucgaggcccaccaccucaccguccccgccauccgcuggcugggccugcuccccagcgaccugaagcggcugaacgugccgaaggacucccucaucccccugaccaagcgcgaccagaugaagcuggacagcauccuccggcgccccuacgugaccugccagcccuucuggcggaaggagauggagaucauggcggacuccaagaugaaggccgagauccaggcccugacguuccugagcuccgacuaccucagccgcgucuaccugccgaacaagcugaaguucgggggcuggaucuga

SEQ ID NO: 37020 - RNA, 1320 nt, Artificial Sequence
  derived and/or modified sequence opt1 from SPOCK1__Homo_sapiens__NP_004589
augcccgccaucgccgugcuggcggccgccgccgccgcguggugcuuccuccaggucgagagccgccaccuggacgcccuggccggcggggccggcccgaaccacgggaacuuccucgacaacgaccaguggcuguccaccgugagccaguacgaccgggacaaguacuggaaccgcuuccgggacgacgacuacuuccgcaacuggaaccccaacaagcccuucgaccaggcgcuggaccccuccaaggacccgugccucaaggugaagugcagcccccacaaggucugcgugacccaggacuaccagacggcccugugcgugucccggaagcaccuccugccccgccagaagaagggcaacgucgcccagaagcacuggguggggcccagcaaccuggugaagugcaagccgugccccgucgcccaguccgccauggugugcggcagcgacggccacuccuacaccagcaagugcaagcuggaguuccacgcgugcuccaccggcaagagccucgccacccugugcgacgggcccugccccugccugccggagcccgagccgcccaagcacaaggccgagcgguccgccugcacggacaaggagcuccgcaaccuggccagccggcugaaggacugguucggggcgcuccacgaggacgccaaccgcgugaucaagcccaccuccagcaacaccgcccagggccgguucgacaccuccauccugcccaucugcaaggacagccugggguggauguucaacaagcucgacaugaacuacgaccugcugcucgaccccuccgagaucaacgccaucuaccuggacaaguacgagcccugcaucaagccgcuguucaacagcugcgacagcuucaaggacggcaagcucuccaacaacgaguggugcuacugcuuccagaagcccggcgggcugcccugccagaacgagaugaaccgcauccagaagcugagcaagggcaagucccuccugggggccuucaucccccggugcaacgaggagggcuacuacaaggcgacgcagugccacggcagcaccgggcagugcuggugcgucgacaaguacggcaacgagcuggccgggucccgcaagcagggcgccgugagcugcgaggaggagcaggagaccuccggggacuucggcagcggcggguccgugguccuccuggacgaccuggaguacgagcgggagcucggcccgaaggacaaggaggggaagcugcgcgugcacacccgggccgugacggaggacgacgaggacgaggacgacgacaaggaggacgaggucggcuacaucugguga

SEQ ID NO: 37021 - RNA, 234 nt, Artificial Sequence
  derived and/or modified sequence opt1 from SPOCK2__Homo_sapiens__NP_001127906
augcgcgcccccggcugcgggcggcuggugcucccgcugcugcuccuggccgcggccgcccuggccgagggcgacgccaaggggcucaaggagggcgagacccccgggaacuucauggaggacgagcaguggcugagcuccaucagccaguacuccggcaagaucaagcacuggaaccgcuuccgggacguccccagcuccgacccgcccagcaccacgcaggcgacccccuga

SEQ ID NO: 37022 - RNA, 1302 nt, Artificial Sequence
  derived and/or modified sequence opt1 from SPOCK3__Homo_sapiens__NP_001035249
augcugaaggugagcgccguccucugcgugugcgccgcggccuggugcucccagagccuggccgccgccgcggccguggccgccgcgggcgggcgcuccgacggcgggaacuuccuggacgacaagcaguggcucaccaccaucagccaguacgacaaggaggucggccaguggaacaaguuccgggacgacgacuacuuccgcacguggucccccgggaagccguucgaccaggcccuggaccccgccaaggaccccugccugaagaugaagugcagccggcacaaggugugcaucgcccaggacucccagaccgccgugugcaucagccaccgccggcucacccaccgcaugaaggaggcgggcgucgaccaccggcaguggcgcggccccauccuguccacgugcaagcagugcccggugguguaccccagccccgucugcggguccgacggccacaccuacagcuuccagugcaagcuggaguaccaggccugcgugcucgggaagcagaucuccgugaagugcgagggccacugccccugcccgagcgacaagcccaccuccaccagccggaacgucaagcgcgccugcuccgaccuggaguuccgggagguggccaaccgccugcgggacugguucaaggcccuccacgagagcgggucccagaacaagaagaccaagacgcugcugcgccccgagcggagccgcuucgacaccagcauccuccccaucugcaaggacucccugggcuggauguucaaccggcuggacaccaacuacgaccuccugcuggaccagagcgagcuccgcuccaucuaccuggacaagaacgagcagugcaccaaggcguucuucaacagcugcgacacguacaaggacucccugaucagcaacaacgaguggugcuacugcuuccagcggcagcaggacccgcccugccagaccgagcucuccaacauccagaagcgccagggcgugaagaagcugcuggggcaguacaucccccucugcgacgaggacggcuacuacaagcccacccagugccacgggagcgucggccagugcuggugcguggaccgguacggcaacgaggugauggggucccgcaucaacggcgucgccgacugcgccaucgacuucgagaucagcggggacuucgccuccggcgacuuccacgaguggaccgacgacgaggacgacgaggacgacaucaugaacgacgaggacgagaucgaggacgacgacgaggacgagggggacgacgacgacggcggcgacgaccacgacguguacaucuga

SEQ ID NO: 37023 - RNA, 2424 nt, Artificial Sequence
  derived and/or modified sequence opt1 from SPON1__Homo_sapiens__NP_006099
augcgccugagccccgccccgcucaagcugucccggacccccgcccugcucgcgcuggcccugccccucgccgccgcccuggcguucagcgacgagacccuggacaaggugcccaaguccgagggcuacugcagccgcauccuccgggcccaggggacgcgccgggagggcuacaccgaguucucccugcgcgucgagggggacccggacuucuacaagcccggcaccagcuaccgggugacccuguccgccgccccgcccagcuacuuccgcggguucacgcucaucgcgcugcgggagaaccgcgagggcgacaaggaggaggaccacgccggcaccuuccagaucaucgacgaggaggagacccaguucauguccaacugccccguggccgucaccgagagcacgccccggcgccggacccgcauccagguguucuggaucgccccgcccgccgggaccggcugcgugauccugaaggcguccaucguccagaagcggaucaucuacuuccaggacgaggggagccucaccaagaagcugugcgagcaggacuccacguucgacggcgugaccgacaagcccauccuggacugcugcgccugcgggaccgccaaguaccgccucaccuucuacggcaacuggagcgagaagacgcaccccaaggacuacccccggcgcgccaaccacugguccgccaucaucggcgggagccacuccaagaacuacgugcugugggaguacggcggguacgcgagcgagggcgucaagcaggucgccgagcugggcucccccgugaagauggaggaggagauccggcagcagagcgacgaggugcucaccgugaucaaggccaaggcccaguggccggccuggcagccccugaacgugcgcgcggcccccagcgccgaguucuccgucgaccggacccgccaccugaugagcuuccucaccaugauggggcccuccccggacuggaacgugggccugagcgccgaggaccugugcacgaaggagugcgggugggugcagaaggucgugcaggaccucauccccugggacgccggcaccgacuccggggugaccuacgagagccccaacaagcccaccaucccgcaggagaagauccgcccccugacgucccuggaccacccccagagccccuucuacgacccggagggcggcuccaucacccaggucgcgcggguggugaucgagcgcaucgcccggaagggggagcagugcaacaucguccccgacaacguggacgacaucgucgccgaccucgcccccgaggagaaggacgaggacgacaccccggagaccugcaucuacagcaacuggucccccuggagcgcgugcuccagcuccacgugcgacaagggcaagcgcaugcggcagcgcaugcugaaggcccagcuggaccucagcgugcccugccccgacacccaggacuuccagccgugcauggggcccggcugcuccgacgaggacgggagcacgugcaccauguccgaguggaucaccuggagccccugcagcaucuccugcggcaugggcaugcggagccgcgagcgguacgugaagcaguuccccgaggacggguccgucugcacccugccgaccgaggagaccgagaagugcacggugaacgaggagugcagccccuccagcugccugaugaccgaguggggcgagugggacgagugcuccgcgaccugcgggaugggcaugaagaagcgccaccggaugaucaagaugaaccccgccgacgggagcaugugcaaggccgagaccucccaggccgagaagugcaugaugcccgagugccacaccaucccgugccuccugagccccugguccgaguggagcgacugcuccgugacgugcggcaagggcaugcgcacccggcagcgcaugcucaagagccuggccgagcugggggacugcaacgaggaccuggagcaggucgagaagugcaugcuccccgagugccccaucgacugcgagcugaccgaguggucccaguggagcgagugcaacaaguccugcggcaaggggcacgugauccggacccgcaugauccagauggagccgcaguucggcggcgcccccugccccgagacggugcagcggaagaagugccgcauccggaagugccugcgcaaccccagcauccagaagcuccgcuggcgggaggcccgcgagagccggcgcuccgagcagcugaaggaggagagcgagggggagcaguucccgggcugccggaugcgccccuggaccgccugguccgagugcaccaagcugugcgggggcgggauccaggagcgguacaugaccgucaagaagcgcuucaagagcucccaguucacgagcugcaaggacaagaaggagauccgggcgugcaacgugcaccccugcuga

SEQ ID NO: 37024 - RNA, 996 nt, Artificial Sequence
  derived and/or modified sequence opt1 from SPON2__Homo_sapiens__NP_001185950
auggagaaccccagcccggccgccgcgcugggcaaggcccucugcgcccugcugcucgccacccugggggccgcgggccagccccucgggggcgaguccaucugcagcgcccgcgcccccgccaaguacuccaucaccuucacggggaaguggagccagaccgcguuccccaagcaguacccccuguuccggccgcccgcccagugguccagccugcugggcgccgcccacuccagcgacuacuccauguggcgcaagaaccaguacgugagcaacggccuccgggacuucgccgagcgcggggaggcgugggcccugaugaaggagaucgaggccgccggcgaggcccugcaguccguccacgcgguguucagcgcccccgccgugccguccgggaccggccagaccagcgccgagcucgagguccagcggcgccacucccuggugagcuucgugguccggaucgugcccucccccgacugguucgugggggucgacagccuggaccucugcgacggcgaccgcuggcgggagcaggccgcgcuggaccuguaccccuacgacgccggcacggacuccggguucaccuucagcagcccgaacuucgccaccaucccccaggacaccgugacggagaucaccuccagcucccccagccaccccgccaacuccuucuacuacccgcgccucaaggcccugccgcccaucgcgcgggugacccugguccgccuccggcagagcccccgcgccuucaucccgcccgcccccgugcugcccucccgggacaacgagaucguggacagcgccuccguccccgagacgccccuggacugcgaggugagccucugguccagcuggggccugugcgggggccacugcggccgccuggggaccaagucccggacccgcuacgugcggguccagcccgcgaacaacggcagccccugcccggagcucgaggaggaggccgagugcgugcccgacaacugcguguga

SEQ ID NO: 37025 - RNA, 1125 nt, Artificial Sequence
  derived and/or modified sequence opt1 from SPOP__Homo_sapiens__NP_003554
augagccgcgugcccuccccgcccccgcccgccgagaugagcuccggccccgucgccgagagcuggugcuacacccagaucaagguggugaaguucuccuacauguggaccaucaacaacuucagcuucugccgggaggagaugggggaggucaucaaguccagcacguucuccagcggcgcgaacgacaagcugaaguggugccuccgcgugaaccccaaggggcuggacgaggaguccaaggacuaccugagccucuaccugcugcucguguccugccccaagagcgagguccgggccaaguucaaguucuccauccugaacgccaagggcgaggagaccaaggccauggagagccagcgcgccuaccgguucgugcaggggaaggacuggggcuucaagaaguucauccgccgggacuuccugcucgacgaggcgaacggccugcugcccgacgacaagcucacccuguucugcgagguguccgucgugcaggacagcgugaacaucuccgggcagaacaccaugaacauggucaaggugcccgagugccgccuggccgacgagcucggcgggcugugggagaacagccgguucacggacugcugccugugcguggccggccaggaguuccaggcccacaaggcgauccucgccgcccgcagccccgucuucuccgccauguucgagcacgagauggaggagagcaagaagaaccggguggagaucaacgacguggagcccgaggucuucaaggagaugaugugcuucaucuacaccgggaaggcccccaaccuggacaagauggcggacgaccugcucgccgccgccgacaaguacgcccuggagcgccugaaggugaugugcgaggacgcgcucugcuccaaccugagcguggagaacgccgccgagauccugauccucgccgaccugcacuccgccgaccagcugaagacccaggcggucgacuucaucaacuaccacgccagcgacgugcucgagaccuccggcuggaaguccaugguggucagccacccgcaccugguggccgaggccuaccggagccuggccuccgcgcagugccccuuccucggcccgccccgcaagcggcugaagcagagcuga

SEQ ID NO: 37026 - RNA, 903 nt, Artificial Sequence
  derived and/or modified sequence opt1 from SPP1__Homo_sapiens__NP_000573
augcgcaucgccgugaucugcuucugccugcucggcaucacgugcgccauccccgucaagcaggcggacagcggguccagcgaggagaagcagcuguacaacaaguacccggacgccguggccaccuggcugaaccccgaccccucccagaagcagaaccuccuggcgccccagacccugccgagcaaguccaacgagagccacgaccacauggacgacauggacgacgaggacgacgacgaccacguggacucccaggacagcaucgacuccaacgacagcgacgacgucgacgacaccgacgacucccaccagagcgacgagucccaccacagcgacgaguccgacgagcucgugaccgacuuccccaccgaccugcccgccacggagguguucacccccgucgugccgaccguggacaccuacgacggccgcggggacagcgucguguacggccugcgguccaagagcaagaaguuccggcgccccgacauccaguaccccgacgccacggacgaggacaucaccucccacauggagagcgaggagcucaacggggccuacaaggccauccccguggcccaggaccugaacgcgccgagcgacugggacucccggggcaaggacagcuacgagaccucccagcuggacgaccagagcgccgagacccacucccacaagcagagccgccucuacaagcggaaggccaacgacgaguccaacgagcacagcgacgucaucgacucccaggagcugagcaaggugucccgcgaguuccacagccacgaguuccacucccacgaggacaugcugguggucgaccccaagagcaaggaggaggacaagcaccucaaguuccggaucucccacgagcuggacagcgccuccagcgaggugaacuga

SEQ ID NO: 37027 - RNA, 636 nt, Artificial Sequence
  derived and/or modified sequence opt1 from SPP2__Homo_sapiens__NP_008875
augaucagccgcauggagaagaugaccaugaugaugaagauccugaucauguucgcccucggcaugaacuacugguccugcagcggguuccccguguacgacuacgacccguccagccugcgggacgcccuguccgcgagcgucgugaaggugaacucccagagccucucccccuaccuguuccgcgccuuccggagcucccugaagcgcgucgaggugcucgacgagaacaaccuggugaugaaccuggaguucagcauccgggagaccacgugccgcaaggacuccggcgaggaccccgcgaccugcgccuuccagcgggacuacuacgucagcaccgccgugugccgcuccaccgugaaggucagcgcccagcagguccagggggugcacgcccggugcuccuggagcuccagcacgagcgaguccuacagcuccgaggagaugaucuucggcgacaugcucgggagccacaaguggcgcaacaacuaccuguucggccugaucuccgacgagagcaucuccgagcaguucuacgaccggagccucggcaucaugcgccgggugcugcccccggggaaccgccgguaccccaaccaccgccaccgggcccgcaucaacaccgacuucgaguga

SEQ ID NO: 37028 - RNA, 1563 nt, Artificial Sequence
  derived and/or modified sequence opt1 from SPPL2A__Homo_sapiens__NP_116191
augggcccccagcgccggcugagcccggccggggccgcgcuccuguggggcuuccugcuccagcugaccgccgcccaggaggccauccugcacgccuccgggaacggcaccacgaaggacuacugcaugcucuacaaccccuacuggaccgcgcugcccagcacccuggagaacgccaccuccaucagccucaugaaccugacguccacgccccugugcaaccucagcgacaucccgcccguggggaucaaguccaaggccgucguggugcccuggggcagcugccacuuccuggagaaggcccgcaucgcgcagaagggcggggccgaggccaugcuggucgugaacaacuccguccucuucccgcccagcggcaaccgguccgaguuccccgacgugaagauccugaucgccuucaucagcuacaaggacuuccgcgacaugaaccagacccugggggacaacaucaccgugaagauguacucccccagcuggcccaacuucgacuacaccaugguggucaucuucgugaucgccguguucaccgucgcgcucggcggguacugguccggccugguggagcuggagaaccucaaggccgugaccaccgaggaccgggagaugcgcaagaagaaggaggaguaccugacguucagcccgcugaccgucgugaucuucguggucaucugcugcgugaugauggugcuccuguacuucuucuacaaguggcuggucuacgugaugaucgccaucuucugcaucgccuccgccaugagccucuacaacugccuggcggcccugauccacaagauccccuacggccagugcaccaucgccugccgggggaagaacauggaggugcgccucaucuuccuguccggccugugcaucgccgucgccguggucugggcgguguuccggaacgaggaccgcugggccuggauccuccaggacauccuggggaucgccuucugccugaaccucaucaagacccugaagcugcccaacuucaagagcugcgugauccuccugggccugcuccugcuguacgacgucuucuucguguucaucacgcccuucaucaccaagaacggcgagagcaucaugguggagcucgccgccgggccguucggcaacaacgagaagcugcccgucgugauccgggugcccaagcugaucuacuucuccgucaugagcgugugccucaugcccguguccauccugggguucggcgacaucaucgucccggggcugcugaucgcguacugccgccgguucgacgugcagaccggcagcuccuacaucuacuacgugagcuccaccgucgccuacgccaucggcaugauccucacguucguggugcugguccugaugaagaaggggcagcccgcccuccuguaccuggugcccugcacccucaucaccgcgagcguggucgccuggcgccggaaggagaugaagaaguucuggaagggcaacuccuaccagaugauggaccaccuggacugcgccaccaacgaggagaaccccgugaucagcggggagcagaucgugcagcaguga

SEQ ID NO: 37029 - RNA, 1536 nt, Artificial Sequence
  derived and/or modified sequence opt1 from SPPL2B__Homo_sapiens__NP_001070706
auggccgccgcgguggccgccgcccuggcccgccuccuggcggccuuccugcuccuggccgcccaggucgcgugcgaguacggcauggugcacguggucagccaggccgggggccccgaggggaaggacuacugcauccuguacaacccgcagugggcccaccucccccacgaccuguccaaggccagcuuccugcagcuccggaacuggaccgccucccugcugugcagcgcggccgaccuccccgcccgcggcuucuccaaccagaucccccugguggcccgggggaacugcaccuucuacgagaaggugcgccuggcccagggcagcggcgcgcgggggcuccugaucgucucccgcgagcggcuggugccgcccggcgggaacaagacgcaguacgacgagaucggcauccccguggcccuccugagcuacaaggacaugcuggacaucuucacccgcuucgggcggaccguccgcgccgcccucuacgcccccaaggagccggugcuggacuacaacauggugaucaucuucaucauggcggucggcaccguggccaucggcggguacugggccggcucccgggacgugaagaagcgcuacaugaagcacaagcgggacgacgggcccgagaagcaggaggacgaggccgucgacgugacgcccgugaugaccugcgucuucguggugaugugcugcagcaugcugguccuccuguacuacuucuacgaccugcucguguacguggucaucggcaucuucugccuggccuccgcgaccggccuguacagcugccucgcccccugcgugcgccggcugccguucgggaagugccgcauccccaacaacucccugcccuacuuccacaagcggccccaggcccgcaugcuccugcuggcccucuucugcgucgcggugagcguggucuggggcguguuccggaacgaggaccagugggccugggugcugcaggacgcccuggggaucgccuucugccucuacaugcugaagaccauccgccugccgacguucaaggccugcacccuccugcugcucguccuguuccuguacgacaucuucuucguguucaucacccccuuccucaccaaguccggcagcuccaucaugguggaggucgcgacggggcccagcgacuccgccacccgggagaagcugcccauggugcugaaggugccgcgccugaacagcagcccccucgcccugugcgaccgccccuucucccugcucggcuucggcgacauccugguccccgggcugcucguggccuacugccaccgguucgacauccaggugcagagcucccgcgucuacuucguggccugcaccaucgcguacggcguggggcugcuggucaccuucguggcccucgcccugaugcagcggggccagccggcccugcucuaccuggugcccugcacgcuggucaccagcugcgccguggcgcucuggcgccgggagcuggggguguucuggaccggcuccggcuucgccgucaacaccagccugcucuga

SEQ ID NO: 37030 - RNA, 2055 nt, Artificial Sequence
  derived and/or modified sequence opt1 from SPPL2C__Homo_sapiens__NP_787078
auggccugccugggcuuccuccugcccgugggguuccugcuccugaucagcaccgucgccggcgggaaguacggcguggcccacguggucuccgagaacuggagcaaggacuacugcauccuguucuccagcgacuacaucacccucccgcgcgaccugcaccacgcgccccugcucccccuguacgacgggacgaaggcccccuggugcccgggcgaggacagcccccaccaggcccagcugcggucccccucccagcgcccccuccggcagaccaccgccauggugaugcgcggcaacugcagcuuccacaccaagggguggcuggcccagggccagggggcccacggccugcucaucgugucccgggucagcgaccagcagugcuccgacacgacccuggccccgcaggacccccgccagccccuggccgaccucaccauccccguggcgaugcugcacuacgccgacaugcuggacauccucagccacacccgcggggaggccgugguccggguggccauguacgccccgcccgagcccaucaucgacuacaacaugcuggugaucuucauccuggcggucggcacgguggccgccggcggguacugggccggccucaccgaggccaaccggcugcagcgccggcgcgcgcggcgcgggggcggcuccgggggccaccaccagcugcaggaggccgccgccgccgagggggcgcagaaggaggacaacgaggacauccccguggacuucaccccggccaugaccggcgucguggugacgcucagcugcucccugaugcugcuccuguacuucuucuacgaccacuucgucuacgugaccaucgggaucuucggccugggcgccgggaucggccucuacagcugccugagcccccuggugugccggcucucccugcgccaguaccagcggccgccccacucccugugggccagccucccccugccccugcuccugcuggccagccucugcgcgaccgucaucaucuucuggguggccuaccgcaacgaggaccggugggccuggcugcugcaggacacccucgggaucuccuacugccuguucgugcugcaccgcguccggcugcccacgcucaagaacugcagcuccuuccugcuggcccuccuggcguucgacguguucuucgucuucgugacccccuucuucaccaagaccggcgagagcaucauggcccagguggcccuggggccggccgaguccagcucccacgagcgccuccccaugguccugaaggugccccgccugcgggugagcgcccucacgcugugcucccagcccuucagcauccugggcuucggcgacaucgucgugccgggguuccucguggcguacugcugccgcuucgacguccaggugugcucccggcagaucuacuucguggccugcaccgucgccuacgccgugggccugcuggugaccuucauggccaugguccucaugcagauggggcagcccgcgcugcuguaccucgugagcuccacccugcugacgagccucgccguggccgccugccgccaggagcugucccuguucuggaccggccaggggcgggccaagaugugcggccucggcugcgcgcccagcgccgggucccgccagaagcaggagggcgccgccgacgcgcacaccgccagcacccuggagcgggggacgucccgcggcgccggcgaccuggacagcaacccgggggaggacaccaccgagaucgucaccaucagcgagaacgaggccacgaaccccgaggaccgguccgacagcuccgagggcuggagcgacgcccaccucgaccccaacgagcugcccuucaucccgcccggggcguccgaggagcugaugccccucaugcccauggccaugcugaucccgcugaugccccucaugcccccgcccagcgagcugggccacgugcacgcccaggcccaggcccacgagaccgggcugcccugggcgggccuccacaagcgcaagggccugaaggugcggaaguccaugagcacccaggcgccccuguga

SEQ ID NO: 37031 - RNA, 1155 nt, Artificial Sequence
  derived and/or modified sequence opt1 from SPPL3__Homo_sapiens__NP_620584
auggccgagcagaccuacagcugggccuacucccugguggacagcucccaggucagcaccuuccucaucuccauccugcugaucguguacggcagcuuccgcucccucaacauggacuucgagaaccaggacaaggagaaggacagcaacuccagcuccgggagcuucaacggcaacuccacgaacaacagcauccagaccaucgacuccacccaggcgcuguuccugcccaucggggccagcgugucccuccuggucauguucuucuucuucgacagcguccaggugguguucaccaucugcacggccgugcuggccaccaucgccuucgcguuccuccugcugccgaugugccaguaccucacccggcccugcagcccccagaacaagaucuccuucggcugcugcgggcgcuucaccgccgccgagcugcugagcuucucccucagcgugaugcugguccugaucugggugcucacgggccacuggcugcugauggacgcccucgcgaugggccugugcguggccaugaucgccuucguccggcugcccucccucaaggugagcugccugcugcucuccgggcugcugaucuacgacguguucugggucuucuucagcgccuacaucuucaacuccaacgugauggugaaggucgccacccagccggcggacaacccccucgacgugcugagccgcaagcugcaccucggccccaacguggggcgggacgucccccgccugucccugccgggcaagcucguguuccccagcuccaccgggagccacuucuccaugcugggcaucggcgacaucgugaugcccgggcugcuccugugcuucguccugcgguacgacaacuacaagaagcaggccagcggcgacuccugcggggcccccggcccggccaacaucagcggccgcaugcagaagguguccuacuuccacugcacccucaucggguacuucgucggccugcugacggccaccguggcgagccggauccaccgcgccgcccagcccgcccuccuguaccuggugcccuucacccuccugccccugcugaccauggccuaccucaagggggaccugcggcgcaugugguccgagccguuccacagcaagagcuccagcucccgguuccuggaggucuga

SEQ ID NO: 37032 - RNA, 1335 nt, Artificial Sequence
  derived and/or modified sequence opt1 from SPRED1__Homo_sapiens__NP_689807
augagcgaggagaccgccaccuccgacaacgacaacagcuacgcccgcgugcgggcggucgugaugacgcgcgacgacuccagcggcggguggcugccccucggcggguccggccugagcuccgugaccgucuucaaggugccgcaccaggaggagaacgggugcgccgacuucuucauccggggcgagcgccugcgggacaagauggugguccucgagugcaugcugaagaaggaccugaucuacaacaaggugacccccaccuuccaccacuggaagaucgacgacaagaaguucggccucacguuccagagccccgccgacgcccgcgccuucgaccgggggauccgccgggcgaucgaggacaucucccagggcugccccgagagcaagaacgaggccgagggggccgacgaccugcaggccaacgaggaggacuccagcuccagccuggugaaggaccaccucuuccagcaggagaccgucgugaccuccgagccguaccgcagcuccaacauccggcccagccccuucgaggaccugaacgcgcgccggguguacaugcagucccaggccaaccagaucaccuucggccagcccgggcuggacauccagagccgcagcauggaguacguccagcggcagaucuccaaggagugcggcagccucaagucccagaaccgcgugccgcucaagagcauccggcacguguccuuccaggacgaggacgagaucguccgcaucaacccccgggacauccugauccgccgguacgccgacuaccgccaccccgacauguggaagaacgaccuggagcgcgacgacgccgacagcuccauccaguucagcaagcccgacuccaagaaguccgacuaccuguacagcugcggcgacgagacgaagcugagcuccccgaaggacagcgugguguucaagacccagcccuccagccucaagaucaagaaguccaagcggcgcaaggaggacggggagcggagccgcugcgucuacugccaggagcgguucaaccacgaggagaacgugcgcggcaagugccaggacgcccccgaccccaucaagcggugcaucuaccagguguccugcaugcugugcgcggagagcaugcuguaccacugcaugagcgacuccgagggggacuucagcgacccgugcuccugcgacaccagcgacgacaaguucugccuccgcuggcuggcccuggucgcccucuccuucaucgugcccugcaugugcugcuacgugccccugcggaugugccaccgcugcggcgaggccugcggcugcugcgggggcaagcacaaggccgcgggguga

SEQ ID NO: 37033 - RNA, 1248 nt, Artificial Sequence
  derived and/or modified sequence opt1 from SPRED2__Homo_sapiens__NP_001121682
auggccagccccggcuccgacagcuacaucgugcgcgucaaggccguggugaugacccgggacgacuccagcgggggcugguucccgcaggagggcggcgggaucucccgcgucggcgugugcaaggugaugcaccccgagggcaacgggcggagcggcuuccugauccacggggagcgccagaaggacaagcucgucgugcuggagugcuacgugcggaaggaccuggucuacaccaaggcgaaccccacguuccaccacuggaagguggacaaccgcaaguucggccucaccuuccagucccccgccgacgcccgggccuucgaccgcggggugcggaaggccaucgaggaccugaucgagggcagcaccaccuccagcuccacgauccacaacgaggcggagcugggcgacgacgacgucuucaccaccgccaccgacagcuccagcaacuccagccagaagcgcgagcagccgacgcggaccaucuccagccccaccuccugcgagcaccgccggaucuacacccucgggcaccuccacgacagcuaccccacggaccacuaccaccuggaccagcccaugccgcgccccuaccgccaggugagcuuccccgacgacgacgaggagaucgugcgcaucaacccccgggagaagaucuggaugaccggcuacgaggacuaccgccacgccccgguccgggggaaguaccccgaccccuccgaggacgccgacagcuccuacgugcgcuucgcgaagggcgaggugcccaagcacgacuacaacuacccguacgucgacagcuccgacuucggccugggggaggaccccaagggccggggcgggagcgugaucaagacccagcccucccgcggcaagagccgccggcgcaaggaggacggggagcggucccgcugcguguacugccgggacauguucaaccacgaggagaaccgccgggggcacugccaggacgcccccgacagcguccggaccugcauccggcgcguguccugcauguggugcgccgacagcaugcuguaccacugcauguccgacccggagggggacuacacggaccccugcagcugcgacaccuccgacgagaaguucugccugcgguggauggcccucaucgcccugagcuuccuggcgcccugcaugugcugcuaccucccccugcgcgccugcuaccacugcggcgugaugugccggugcugcgggggcaagcacaaggccgccgccuga

SEQ ID NO: 37034 - RNA, 1233 nt, Artificial Sequence
  derived and/or modified sequence opt1 from SPRED3__Homo_sapiens__XP_011525279
auggugcgcguccgggccguggugauggcccgcgacgacagcuccggcggguggcugcccgucggcgggggcgggcucagccagguguccgugugccggguccgcggcgcgcggccggagggcggggcccgccagggccacuacgugauccacggggagcggcugcgcgaccagaagaccacccuggagugcacgcucaagcccggccugguguacaacaaggucaaccccaucuuccaccacuggagccugggggacugcaaguucggccucaccuuccagucccccgccgaggccgacgaguuccagaagucccugcuggccgcgcucgccgcccugggccgggggagccugaccccgagcuccagcuccagcuccagcucccccagccaggacaccgccgagacgcccugcccccucaccucccacguggacagcgacuccagcagcucccacagccgccaggagaccccgcccuccgcggccgccgcccccaucaucaccauggagagcgccuccggcuucgggcccacgaccccgccccagcggcgccggagcuccgcgcagagcuacccgccccugcugcccuucaccggcauccccgagcccuccgagccccucgccggcgccgggggccugggguggggcgggcgcggcuacgaggacuaccggcgcagcggcccgcccgcgccccuggcccucuccacgugcgugguccgguucgccaagaccggggcccugcgcggcgccgcccuggggcccccggccgcgcuccccgcgccccugaccgaggccgcgcccccggccccgcccgcccggcccccgcccggccccgggcccagcuccgcccccgccaaggccagccccgaggccgaggaggccgcccgcugcgugcacugccgggcccuguuccgccgccgggccgacggccgcggcgggcggugcgcggaggcccccgacccgggccgccuccuggugcggcgccuguccugccucuggugcgccgagagccugcuguaccacugccucuccgacgccgagggggacuucagcgaccccugcgccugcgagcccggccacccccggccggcggcccgcugggccgcccuggccgcgcugucccucgccguccccugccugugcugcuacgcgccccugcgggccugccacuggguggccgcccgcugcgggugcgccggcugcggcgggcggcacgaggaggccgcccgcuga

SEQ ID NO: 37035 - RNA, 786 nt, Artificial Sequence
  derived and/or modified sequence opt1 from SPR__Homo_sapiens__NP_003115
auggagggcgggcugggccgcgccgugugccuccugaccggggccagccggggcuucgggcgcacccuggcgccccuccuggccucccugcucagcccgggcuccguccuggugcugagcgcccggaacgacgaggcccuccgccagcuggaggccgagcugggcgcggagcgguccgggcuccgcgugguccgggugcccgccgaccugggcgccgaggccgggcugcagcagcuccugggcgcgcugcgcgagcucccccggcccaaggggcugcagcgccugcuccugaucaacaacgccggcagccugggcgacguguccaagggguucgucgaccucagcgacuccacccaggugaacaacuacugggcccugaaccugacgagcaugcucugccugaccuccagcgugcugaaggccuucccggacucccccggccucaaccggaccgucgugaacaucagcucccugugcgcccugcagcccuucaaggggugggcgcucuacugcgccggcaaggccgcccgcgacaugcuguuccaggugcuggcccucgaggagcccaacguccgggugcugaacuacgcgccgggcccccuggacacggacaugcagcagcucgcccgcgagaccagcguggaccccgacaugcggaaggggcugcaggagcugaaggccaagggcaagcucgucgacugcaagguguccgcccagaagcugcugagccuccuggagaaggacgaguucaaguccggggcccacguggacuucuacgacaaguga

SEQ ID NO: 37036 - RNA, 456 nt, Artificial Sequence
  derived and/or modified sequence opt1 from SPRN__Homo_sapiens__NP_001012526
augaacugggcccccgcgaccugcugggcccugcuccuggccgccgccuuccugugcgacagcggcgccgcgaagggcgggcgcgggggcgcccggggguccgcccgcggcggcgugcggggcggggcccgcggggcgagccggguccgcgugcggccggcccagcgcuacggcgcccccggguccagccuccggguggccgccgcgggcgccgccgccggcgccgcggccggggccgccgccggccuggcggccggguccggcuggcgccgggccgccggccccggggagcgcggccuggaggacgaggaggacgggguccccggcgggaacggcaccggcccggggaucuacagcuaccgggccuggacguccggcgcggggcccacccgcggcccccggcucugccuggugcucgggggcgcccugggcgcccuggggcugcuccgccccuga

SEQ ID NO: 37037 - RNA, 270 nt, Artificial Sequence
  derived and/or modified sequence opt1 from SPRR1A__Homo_sapiens__NP_001186757
augaacagccagcagcagaagcagcccugcaccccgccgccccagccccagcagcagcaggucaagcagcccugccagcccccgccccaggagcccugcauccccaagaccaaggagcccugccaccccaaggugccggagcccugccaccccaaggugcccgagccgugccagcccaaggugcccgagcccugccagccgaagguccccgagcccugccccuccacggugaccccggcccccgcccagcagaagaccaagcagaaguga

SEQ ID NO: 37038 - RNA, 270 nt, Artificial Sequence
  derived and/or modified sequence opt1 from SPRR1B__Homo_sapiens__NP_003116
augagcucccagcagcagaagcagcccugcaccccgccgccccagcugcagcagcagcaggucaagcagcccugccagcccccgccccaggagcccugcauccccaagaccaaggagcccugccaccccaaggugcccgagccgugccaccccaaggugcccgagcccugccagccgaaggugcccgagcccugccaccccaaggucccggagcccugccccagcaucgugacgcccgccccggcccagcagaagaccaagcagaaguga

SEQ ID NO: 37039 - RNA, 219 nt, Artificial Sequence
  derived and/or modified sequence opt1 from SPRR2A__Homo_sapiens__NP_005979
augagcuaccagcagcagcagugcaagcagcccugccagccgccccccgugugccccaccccgaagugccccgagcccugccccccgcccaagugccccgagcccugcccgccccccaagugcccccagccgugccccccccagcagugccagcagaaguaccccccggucacccccuccccccccugccagagcaaguacccgcccaaguccaaguga

SEQ ID NO: 37040 - RNA, 219 nt, Artificial Sequence
  derived and/or modified sequence opt1 from SPRR2B__Homo_sapiens__NP_001017418
augagcuaccagcagcagcagugcaagcagcccugccagccgccccccgugugccccaccccgaagugccccgagcccugccccccgcccaagugccccgagcccugcccgccccccaagugcccccagccgugccccccccagcagugccagcagaaguaccccccggucacccccuccccccccugccagccgaaguacccccccaagagcaaguga

SEQ ID NO: 37041 - RNA, 510 nt, Artificial Sequence
  derived and/or modified sequence opt1 from SPRR3__Homo_sapiens__NP_001091058
augagcuccuaccagcagaagcagaccuucacgcccccgccccagcugcagcagcagcaggucaagcagcccagccagcccccgccccaggagaucuucgugcccaccaccaaggagcccugccacuccaaggugccgcagcccggcaacaccaagauccccgagcccgggugcaccaaggugccggagcccggcugcacgaagguccccgagcccgggugcaccaaggugccggagcccggcugcaccaaggugcccgagcccgggugcaccaaggucccggagcccggcugcacgaaggugcccgagcccggcuacaccaaggugccggagcccgggagcaucaagguccccgaccagggcuucaucaaguuccccgagccgggggccaucaaggugcccgagcagggcuacaccaaggugcccgucccgggguacaccaagcuccccgagcccugccccuccacggugaccccgggccccgcccagcagaagaccaagcagaaguga

SEQ ID NO: 37042 - RNA, 753 nt, Artificial Sequence
  derived and/or modified sequence opt1 from SPRTN__Homo_sapiens__NP_001010984
auggacgacgaccugaugcucgcccugcgccugcaggaggaguggaaccuccaggaggccgagcgggaccacgcgcaggagagccugucccugguggacgccagcugggagcucgucgaccccaccccggaccugcaggcccuguucgugcaguucaacgaccaguucuucuggggccagcucgaggccguggaggucaagugguccgugcgcaugacccugugcgccgggaucugcagcuacgagggcaagggcgggaugugcuccauccggcugagcgagccccuccugaagcugcgcccccggaaggaccucguggagacgcugcugcacgagaugauccacgcguaccucuucgucaccaacaacgacaaggaccgcgaggggcacggccccgaguucugcaagcacaugcaccggaucaacucccugaccggcgccaacaucaccguguaccacacguuccacgacgagguggacgaguaccgccggcacugguggcgcugcaacgggccgugccagcaccggccgcccuacuacggcuacgucaagcgcgccaccaaccgggagcccagcgcccacgacuacuggugggcggagcaccagaagaccugcgggggcaccuacaucaagaucaaggagcccgagaacuacuccaagaaggggaagggcaaggccaagcugggcaaggagcccgugcucgccgccgagaacaaggggacguucguguacauccugcugaucuucauguga

SEQ ID NO: 37043 - RNA, 960 nt, Artificial Sequence
  derived and/or modified sequence opt1 from SPRY1__Homo_sapiens__NP_001244968
auggacccccagaaccagcacggcagcggguccagccugguggucauccagcagccgucccucgacagccgccagcggcuggacuacgagcgcgagauccagcccaccgccauccugucccucgaccagaucaaggccauccggggcagcaacgaguacaccgaggggcccuccguggugaagcgccccgcgccgcggacggcgccccgccaggagaagcacgagcggacccacgagaucauccccaucaacgucaacaacaacuacgagcaccgccacaccagccaccugggccacgccgugcugcccuccaacgcccgggggccgauccucagccgcuccaccagcacgggcuccgccgccagcuccggcagcaacuccagcgccuccagcgagcaggggcugcugggccggagcccgcccacccgccccgugcccgggcaccgguccgagcgcgccauccggacccagcccaagcagcucaucgucgacgaccugaagggcagccugaaggaggaccucacccagcacaaguucaucugcgagcagugcgggaagugcaagugcggcgagugcacggcgccccgcacccugcccuccugccuggccugcaaccggcagugccucugcagcgccgaguccaugguggaguacgggaccugcaugugccuggugaagggcaucuucuaccacugcagcaacgacgacgagggcgacuccuacagcgacaacccgugcuccugcagccagucccacugcugcagccgcuaccugugcaugggggccaugucccucuuccugcccugccugcucugcuacccgcccgccaagggcugccugaagcugugccggcgcugcuacgacuggauccaccggcccggcugccgcugcaagaacagcaacaccgucuacugcaagcucgaguccugccccagccgcgggcagggcaagcccuccuga

SEQ ID NO: 37044 - RNA, 948 nt, Artificial Sequence
  derived and/or modified sequence opt1 from SPRY2__Homo_sapiens__NP_005833
auggaggcccgcgcccagagcggcaacgggucccagccccugcuccagacgccccgggacggcgggcgccagcggggcgagcccgacccccgcgacgcgcugacccagcagguccacgugcugagccucgaccagauccgggccauccgcaacaccaacgaguacaccgaggggcccaccguggugccgcggcccggccugaagcccgcgccccgcccguccacccagcacaagcacgagcggcugcacggccuccccgagcaccgccagccgccccggcugcagcacagccagguccacuccagcgcccgcgcgccccugucccggagcaucuccacggugagcuccgggagccgcuccagcacccggaccuccaccagcuccagcuccagcgagcagcgccuccugggcagcuccuucagcuccgggcccguggccgacggcaucauccggguccagcccaagagcgagcugaagcccggggagcucaagccgcuguccaaggaggaccugggccuccacgccuaccgcugcgaggacugcggcaagugcaagugcaaggagugcacguacccccggccccugcccagcgacuggaucugcgacaagcagugccugugcuccgcccagaacgugaucgacuacgggaccugcgugugcugcgucaagggccucuucuaccacugcagcaacgacgacgaggacaacugcgccgacaacccgugcuccugcagccagucccacugcugcacccgcuggagcgccaugggggugaugucccuguuccugcccugccucuggugcuaccugcccgccaagggcugccugaagcucugccagggcugcuacgaccgggugaaccgccccgggugccgcugcaagaacagcaacaccgucugcugcaaggugccgacggugccgccccggaacuucgagaagcccaccuga

SEQ ID NO: 37045 - RNA, 867 nt, Artificial Sequence
  derived and/or modified sequence opt1 from SPRY3__Homo_sapiens__NP_005831
auggacgccgccgugaccgacgacuuccagcagauccugcccaucgagcagcuccgcagcacccacgcgagcaacgacuacgucgagcggccgcccgcccccugcaagcaggcccugagcucccccagccugaucgugcagacgcacaaguccgacuggagccucgccaccaugccgaccucccugccccgcagccugucccagugccaccagcuccagccccugccccagcaccugagccaguccagcaucgccuccagcaugucccacagcaccacggcguccgaccagcggcuccuggccagcaucaccccgucccccagcggccagagcaucauccgcacccagcccggggccggcgugcaccccaaggccgacggggcgcugaagggcgaggccgagcaguccgccgggcacccgagcgagcaccucuucaucugcgaggagugcggccggugcaagugcguccccugcaccgccgcccgcccccugcccuccugcuggcugugcaaccagcggugccucugcagcgcggagucccugcuggacuacggcacgugccucugcugcgugaaggggcuguucuaccacugcagcaccgacgacgaggacaacugcgccgacgagccgugcuccugcggccccagcuccugcuucgugcgcugggccgccaugagccugaucucccucuuccugcccugccugugcugcuaccuccccacccgggggugccugcaccugugccagcagggcuacgacagccuccgccggccggggugccgcugcaagcggcacaccaacacggucugccgcaagaucuccagcggcuccgcccccuuccccaaggcgcaggagaaguccguguga

SEQ ID NO: 37046 - RNA, 900 nt, Artificial Sequence
  derived and/or modified sequence opt1 from SPRY4__Homo_sapiens__NP_001280218
auggagcccccgaucccccagagcgcgccccugacccccaacuccgugaugguccagccgcuccuggacagccgcaugucccacagccggcugcagcacccccucaccauccugcccaucgaccaggugaagacgucccacguggagaacgacuacaucgacaaccccagccuggcccucaccaccggcccgaagcgcacccggggcggcgcccccgagcuggcccccacgcccgcccgcugcgaccaggacgucacccaccacuggaucuccuucagcgggcggccguccagcguguccagcuccagcuccaccagcuccgaccagcgccugcucgaccacauggcgcccccgcccguggccgaccaggccagcccccgggccguccgcauccagcccaagguggugcacugccagccccuggaccugaagggccccgccgucccgcccgagcucgacaagcacuuccugcugugcgaggccugcgggaagugcaagugcaaggagugcgcgagcccccggacccuccccuccugcugggugugcaaccaggagugccugugcagcgcccagacgcuggugaacuacgggaccugcaugugccucguccagggcaucuucuaccacugcaccaacgaggacgacgagggguccugcgccgaccacccgugcagcugcucccgcagcaacugcugcgcccggugguccuucaugggcgcccugagcguggugcugcccugccuccugugcuaccugcccgcgaccgggugcgucaagcucgcccagcgcggcuacgaccggcugcgccggcccgggugccgcugcaagcacacgaacuccgugaucugcaaggccgccagcggcgacgccaagaccucccggccggacaagcccuucuga

SEQ ID NO: 37047 - RNA, 474 nt, Artificial Sequence
  derived and/or modified sequence opt1 from SPRYD7__Homo_sapiens__NP_001120954
auggccaccagcgugcugugcugccuccgcugcugccgggacggcgggaccggccacaucccccugaaggagaugccggccguccagcuggacacgcagcacauggggaucuggggcaucgggguggcgacccagaaggugaaccucaaccagaucccccugggccgcgacaugcacucccuggucaugcggaacgacggcgcccucuaccacaacaacgaggagaagaaccgccugcccgccaacagccugccccaggagggggacguggugggcaucaccuacgaccacgucgagcucaacguguaccugaacgggaagaacaugcacugcccggccuccggcauccgggggaccguguaccccgucguguacguggacgacagcgccauccuggacugccaguucuccgaguucuaccacacgcccccgcccggcuucgagaagauccucuucgagcagcagaucuucuga

SEQ ID NO: 37048 - RNA, 1068 nt, Artificial Sequence
  derived and/or modified sequence opt1 from SPSB3__Homo_sapiens__NP_543137
auggcccgccggccccgcaacagccgggccuggcacuucgugcuguccgcggcccgccgggacgccgacgcccgcgccgucgcgcucgccggcagcaccaacuggggguacgacuccgacggccagcacagcgacuccgacagcgacccggaguacuccacccugccgcccagcauccccuccgccgugcccgugacgggggagagcuucugcgacugcgccggccaguccgaggcgagcuucugcuccagccugcacuccgcccaccgggggcgcgacugccggugcggcgaggaggacgaguacuucgacugggucugggacgaccucaacaagagcuccgccacccugcugagcugcgacaaccgcaagguguccuuccacauggaguacagcugcggcaccgccgccauccgggggaccaaggagcucggcgaggggcagcacuucugggagaucaagaugacgagccccguguacggcaccgacaugauggucgggaucggcaccuccgacguggaccuggacaaguaccgccacaccuucugcagccugcucggccgggacgaggacuccugggggcugagcuacacgggccugcuccaccacaagggggacaagaccuccuucagcucccgcuucggccagggcagcaucaucggggugcaccuggacaccuggcacggcacccugacguucuucaagaaccggaagugcaucggggucgcggccaccaagcuccagaacaagcgcuucuaccccauggugugcuccaccgccgcccggagcuccaugaaggugacccgcagcugcgccuccgcgacgagccugcaguaccugugcugccaccggcuccgccagcugcggcccgacuccggcgacacccuggaggggcucccgcugccgcccggccugaagcagguccuccacaacaagcugggcugggugcugagcauguccugcagccgccgcaaggcccccguguccgacccccaggccgccaccagcgcccaccccagcucccgggagccccgccccugccagcggaagcgcugccggcgcaccuga

SEQ ID NO: 37049 - RNA, 822 nt, Artificial Sequence
  derived and/or modified sequence opt1 from SPSB4__Homo_sapiens__NP_543138
augggccagaagcugagcgggucccucaagagcguggagguccgcgagcccgcccugcggccggccaagcgcgagcugcggggcgcggagcccgggcgccccgcccggcucgaccagcugcuggacaugcccgccgccggccucgccgugcagcugcgccacgcguggaacccggaggaccggucccugaacguguucgucaaggacgacgaccgccucaccuuccaccggcaccccguggcccagagcaccgacgggauccgcggcaaggugggccacgcccgggggcugcacgccuggcagaucaacuggcccgcgcgccagcggggcacgcacgccgucguggggguggccaccgcccgcgcgccccugcacuccgucggcuacaccgcccucguggggagcgacgccgaguccuggggcugggaccugggccggagccgccuguaccacgacgggaagaaccagccgggcguggccuaccccgccuuccucgggcccgacgaggccuucgcgcugcccgacucccugcucgucgugcuggacauggacgagggcacccugagcuucaucguggacggccaguaccucggggucgccuuccggggccugaaggggaagaagcuguacccggugguguccgccgucuggggccacugcgaggugacgaugcgcuacaucaacgggcucgaccccgagccccugccccugauggaccucugccggcgcagcauccgguccgcccugggccgccagcgccugcaggacaucagcucccucccgcugccccagagccugaagaacuaccuccaguaccaguga

SEQ ID NO: 37050 - RNA, 7260 nt, Artificial Sequence
  derived and/or modified sequence opt1 from SPTA1__Homo_sapiens__XP_011508218
auggagcaguuccccaaggagaccguggucgagagcuccggcccgaaggugcuggagaccgccgaggagauccaggagcgccggcaggaggugcucacgcgcuaccagagcuucaaggagcgggucgccgagcgcgggcagaagcuggaggacuccuaccaccugcagguguucaagcgggacgcggacgaccucggcaaguggaucauggagaaggugaacauccugaccgacaagagcuacgaggaccccaccaacauccaggggaaguaccagaagcaccagucccuggaggccgagguccagaccaagagccgccucauguccgagcuggagaagacgcgggaggagcgcuucaccaugggccacagcgcccacgaggagaccaaggcccacaucgaggagcugcggcaccucugggaccugcugcucgagcugacccuggagaagggggaccagcuccugcgcgcccugaaguuccagcaguacgugcaggagugcgcggacauccucgaguggaucggcgacaaggaggccaucgccacguccguggagcugggcgaggacugggagcggaccgagguccugcacaagaaguucgaggacuuccagguggagcucguggccaaggaggggcgcgucguggaggugaaccaguacgcgaacgagugcgccgaggagaaccaccccgaccugccccugauccagagcaagcagaacgaggucaacgccgccugggagcggcuccgcggccuggcccugcagcggcagaaggcgcucuccaacgccgccaaccugcagcgcuucaagcgggacgugaccgaggccauccaguggaucaaggagaaggagccggugcugaccagcgaggacuacgggaaggaccucgucgccuccgagggccuguuccacagccacaaggggcuggagcgcaaccucgcggugauguccgacaaggugaaggagcugugcgccaaggccgagaagcugacgcucagccaccccuccgacgccccccagauccaggagaugaaggaggaccuggucagcuccugggagcacauccgggcccuggcgaccagccgcuacgagaagcuccaggccaccuacugguaccaccgguucagcuccgacuucgacgagcugagcggcuggaugaacgagaagaccgccgccaucaacgccgacgagcugcccacggacguggcgggcggggaggugcuccuggaccgccaccagcagcacaagcacgagaucgacuccuacgacgaccgcuuccagagcgccgacgagaccggccaggaccuggucaacgccaaccacgaggccuccgacgaggugcgggagaagauggagauccucgacaacaacuggaccgcgcugcuggagcucugggacgagcgccaccggcaguacgagcagugccuggacuuccaccuguucuaccgcgacagcgagcaggucgacuccuggaugagccggcaggaggccuuccuggagaacgaggaccucgggaacucccugggcagcgccgaggcccugcuccagaagcacgaggacuucgaggaggccuucaccgcgcaggaggagaagaucaucacgguggacaagaccgccaccaagcugaucggcgacgaccacuacgacuccgagaacaucaaggccauccgcgacgggcugcucgcccggcgcgacgcccugcgggagaaggcggccacccgccggcgccugcucaaggagagccugcugcuccagaagcuguacgaggacuccgacgaccugaagaacuggaucaacaagaagaagaagcucgccgacgacgaggacuacaaggacauccagaaccugaagagccgggugcagaagcagcaggucuucgagaaggagcuggccgugaacaagacgcagcucgagaacauccagaagaccggccaggagaugaucgaggggggccacuacgccuccgacaacgugaccacccgccugagcgaggucgcgucccugugggaggagcuccuggaggccacgaagcagaaggggacccagcugcacgaggccaaccagcagcuccaguucgagaacaacgccgaggaccugcagcgguggcuggaggacguggaguggcaggugaccagcgaggacuacggcaagggccucgcggagguccagaaccgccugcggaagcacgggcugcucgaguccgccguggccgcccgccaggaccagguggacauccugaccgaccuggccgcguacuucgaggagaucggccacccggacagcaaggacauccgggcccgccaggagagccucgucugccgcuucgaggcccugaaggagccccuggccacgcggaagaagaagcuccuggaccugcuccaccugcagcugaucugccgcgacaccgaggacgaggaggccuggauccaggagaccgagcccuccgcgaccagcacguaccucgggaaggaccugaucgccuccaagaagcugcucaaccggcaccgcgugauccuggagaacaucgccagccacgagccccggauccaggagaucaccgagcgcggcaacaagaugguggaggaggggcacuucgccgccgaggacgucgcgucccgggugaagagccugaaccagaacauggagucccuccgcgcccgggccgcccgccggcagaacgaccuggaggcgaacgugcaguuccagcaguaccuggccgaccuccacgaggccgagaccuggauccgcgagaaggagccgaucgucgacaacaccaacuacggcgccgacgaggaggccgcgggcgcccugcugaagaagcacgaggccuuccuccuggaccugaacagcuucggggacuccaugaaggcccuccggaaccaggccaacgcgugccagcagcagcaggccgcccccguggagggcguggccggggagcagcgcgucauggcccuguacgacuuccaggcgcggagcccccgcgaggugaccaugaagaagggcgacgugcugacgcuccuguccagcaucaacaaggacugguggaaggucgaggccgccgaccaccaggggaucgugcccgccguguacguccggcgccuggcccacgacgaguucccgaugcucccccagcggcgccgggaggagcccggcaacaucacccagcgccaggagcagaucgagaaccaguaccgcucccugcuggaccgggcggaggagcgccggcgccggcuccugcagcgcuacaacgaguuccugcucgccuacgaggccggcgacaugcuggaguggauccaggagaagaaggccgagaacaccgggguggagcuggacgacgugugggagcuccagaagaaguucgacgaguuccagaaggaccugaacaccaacgagccccggcugcgcgacaucaacaaggucgcggacgaccuccuguucgagggccugcucacgccggagggggcccagauccggcaggagcugaacagccgcuggggcucccugcagcggcucgccgacgagcagcgccagcugcugggcagcgcccacgccguggagguguuccaccgggaggcggacgacaccaaggagcagaucgagaagaagugccaggcccucuccgccgccgaccccgggagcgaccuguucagcguccaggcccugcagcgccggcacgagggcuucgagcgcgaccucgugccccugggggacaaggugaccauccugggcgagaccgcggagcggcucuccgagagccaccccgacgccacggaggaccugcagcgccagaagauggagcugaacgaggccugggaggaccuccaggggcggaccaaggaccgcaaggagucccugaacgaggcccagaaguucuaccuguuccugagcaaggcccgcgaccuccagaacuggaucuccagcaucggcggcauggucuccagccaggagcuggcggaggaccugaccgggaucgagauccuccuggagcggcaccaggagcaccgcgccgacauggaggccgaggccccgaccuuccaggcgcuggaggacuucuccgccgagcucaucgacagcggccaccacgccucccccgagaucgagaagaagcugcaggccgugaagcuggagcgggacgaccucgagaaggccugggagaagcgcaagaagauccuggaccagugccuggagcuccagauguuccaggggaacugcgaccagguggagagcuggauggucgcgcgggagaacucccugcgcagcgacgacaaguccagccuggacucccucgaggcccugaugaagaagcgggacgaccuggacaaggccaucacggcccaggagggcaagaucaccgaccucgagcacuucgccgagagccugaucgcggacgagcacuacgccaaggaggagaucgccacccgccugcagcgggugcucgaccgcuggaaggcccugaaggcccagcugaucgacgagcggaccaagcucggggacuacgcgaaccugaagcaguucuaccgcgaccuggaggagcucgaggaguggaucuccgagaugcugcccacggccugcgacgagagcuacaaggacgccaccaacauccagcggaaguaccugaagcaccagaccuucgcccacgagguggacggccgcagcgagcagguccacggcgugaucaaccucgggaacucccugaucgagugcagcgcgugcgacggcaacgaggaggccaugaaggagcagcuggagcagcucaaggagcacugggaccaccugcuggagcggaccaacgacaaggggaagaagcucaacgaggccucccgccagcagcgguucaacacgagcauccgcgacuucgaguucuggcuguccgaggccgagacccugcucgccaugaaggaccaggcgcgggaccuggccagcgccggcaaccugcucaagaagcaccagcugcuggagcgcgagaugcucgcccgggaggacgcccugaaggaccugaacacccucgcggaggaccugcuguccagcgggaccuucaacguggaccagaucgucaagaagaaggacaacgugaacaagcgcuuccucaacgugcaggagcuggccgccgcccaccacgagaagcugaaggaggccuacgcgcucuuccaguucuuccaggaccuggacgacgaggaguccuggaucgaggagaagcugauccgcgucagcucccaggacuacggccgggaccuccagggcgugcagaaccugcugaagaagcacaagcgccucgagggggagcugguggcccacgagcccgccauccagaacguccuggacauggccgagaagcucaaggacaaggccgcggugggccaggaggagauccagcugcggcuggcccaguucgucgagcacugggagaagcucaaggagcuggccaaggcccgcgggcugaagcucgaggagagccuggaguaccugcaguucaugcagaacgcggaggaggaggaggccuggaucaacgagaagaacgcccucgccgugcggggcgacugcggggacacgcuggccgcgacccagucccugcucaugaagcacgaggcccuggagaacgacuucgccgugcacgagacccgcguccagaacgugugcgcccagggcgaggacauccugaacaaggugcuccaggaggagagccagaacaaggagaucuccagcaagaucgaggcccugaacgagaagaccccgucccuggcgaaggccaucgccgccuggaagcuccagcuggaggacgacuacgccuuccaggaguucaacuggaaggcggacgucguggaggccuggaucgccgacaaggagacgagccugaagaccaacggcaacggggccgaccucggcgacuuccugacccugcucgcgaagcaggacacccuggacgccucccugcagagcuuccagcaggagcggcuccccgagaucacggaccugaaggacaagcugaucagcgcccagcacaaccaguccaaggccaucgaggagcgcuacgccgcgcuccugaagcggugggagcagcugcucgaggccagcgccgugcaccgccagaagcugcuggagaagcagcucccccugcagaaggccgaggaccuguucgucgaguucgcccacaaggcguccgcccugaacaacuggugcgagaagauggaggagaaccucagcgagccggugcacugcgugucccugaacgagauccggcagcugcagaaggaccacgaggacuuccucgccagccuggcccgcgcccaggcggacuucaagugccugcucgagcuggaccagcagaucaaggcccuggggguccccuccagccccuacaccuggcucaccguggaggugcuggagcggaccuggaagcaccuguccgacaucaucgaggagcgcgagcaggagcuccagaaggaggaggcccggcaggucaagaacuucgagaugugccaggaguucgagcagaacgccagcacguuccugcaguggauccuggagacccgcgcguacuuccucgacggcucccugcugaaggagaccggcacccucgagagccagcuggaggccaacaagcggaagcagaaggagauccaggccaugaagcgccagcugaccaagaucguggaccucggggacaaccuggaggacgcccugauccucgacaucaaguacuccacgaucggccuggcccagcagugggaccagcuguaccagcucgggcugcggaugcagcacaaccuggagcagcagauccaggcgaaggacaucaagggcgugagcgaggagacccucaaggaguucuccaccaucuacaagcacuucgacgagaaccugaccgggcgccugacgcacaaggaguuccgcagcugccuccggggccugaacuacuaccugcccauggucgaggaggacgagcacgagccgaaguucgagaaguuccucgacgccguggaccccggccgcaagggguacgugucccuggaggacuacaccgccuuccugaucgacaaggagagcgagaacaucaaguccagcgacgagaucgagaacgccuuccaggcccucgcggagggcaagagcuacaucaccaaggaggacaugaagcaggcccugacccccgagcaggucuccuucugcgccacgcacaugcagcaguacauggacccccgggggcgcagccaccuguccggcuacgacuacgugggguucaccaacagcuacuucggcaacuga

SEQ ID NO: 37051 - RNA, 7434 nt, Artificial Sequence
  derived and/or modified sequence opt1 from SPTAN1__Homo_sapiens__NP_001123910
auggaccccagcggcgugaaggugcuggagaccgccgaggacauccaggagcgccggcagcagguccucgaccgcuaccaccgguucaaggagcugagcacccugcgccggcagaagcucgaggacagcuaccgcuuccaguucuuccagcgggacgccgaggagcuggagaaguggauccaggagaagcugcagaucgcgagcgacgagaacuacaaggacccgacgaaccuccaggggaagcugcagaagcaccaggccuucgaggccgaggugcaggccaacagcggcgccaucgugaagcuggacgagaccgggaaccucaugaucuccgagggccacuucgcgagcgagaccauccgcacccggcugauggagcugcaccgccagugggagcuccugcuggagaagaugcgggagaaggggaucaagcuccugcaggcccagaagcuggugcaguaccuccgcgagugcgaggacgugauggacuggaucaacgacaaggaggccaucgugacguccgaggagcugggccaggaccuggagcacguggaggugcuccagaagaaguucgaggaguuccagaccgacauggccgcgcacgaggagcgggugaacgaggugaaccaguucgccgccaagcugauccaggagcagcaccccgaggaggagcugaucaagaccaagcaggacgaggugaacgccgccuggcagcgccucaagggccuggcgcugcagcggcaggggaagcuguucggcgccgccgagguccagcgcuucaaccgggacguggacgagaccaucagcuggaucaaggagaaggagcagcugauggccuccgacgacuucgggcgcgaccuggccagcgugcaggcgcuccugcggaagcacgagggccuggagcgcgaccucgccgcccuggaggacaaggucaaggcccugugcgccgaggcggaccggcuccagcagucccacccccugagcgccacgcagauccaggugaagcgcgaggagcugaucaccaacugggagcagauccgcacccucgccgccgagcggcacgcccgccugaacgacuccuaccggcugcagcgcuuccucgcggacuuccgggaccugaccagcugggugacggagaugaaggcccugaucaacgccgacgagcucgccuccgacgucgcgggggccgaggcccugcuggaccgccaccaggagcacaagggcgagaucgacgcccacgaggacagcuucaaguccgccgacgagagcggccaggcgcuccuggccgccgggcacuacgccuccgacgaggugcgggagaagcugaccgugcugagcgaggagcgcgccgcgcuccuggagcugugggagcuccggcgccagcaguacgagcagugcauggaccugcagcuguucuaccgggacaccgagcaggucgacaacuggaugagcaagcaggaggccuuccuccugaacgaggaccugggcgacucccucgacagcguggaggcccugcugaagaagcacgaggacuucgagaagucccucagcgcccaggaggagaagaucaccgcccuggacgaguucgcgacgaagcugauccagaacaaccacuacgccauggaggacguggccacccgccgggacgcccuccugucccgccggaacgcgcugcacgagcgcgccaugcggcgccgggcccagcucgccgacagcuuccaccuccagcaguucuuccgcgacuccgacgagcucaaguccugggucaacgagaagaugaagaccgccaccgacgaggcguacaaggaccccuccaaccuccaggggaaggugcagaagcaccaggccuucgaggccgagcugagcgccaaccagucccgcaucgacgcccuggagaaggcgggccagaagcucaucgacgucaaccacuacgccaaggacgagguggccgcccggaugaacgaggugaucagccuguggaagaagcugcucgaggccacggagcugaagggcaucaagcugcgcgaggcgaaccagcagcagcaguucaaccggaacgucgaggacaucgagcucuggcuguacgagguggaggggcaccuggccuccgacgacuacggcaaggaccucaccaacgugcagaaccugcagaagaagcacgcccugcucgaggccgacgucgcggcccaccaggaccgcaucgacgggaucaccauccaggcccggcaguuccaggacgccggccacuucgacgccgagaacaucaagaagaagcaggaggcgcugguggcccgcuacgaggcccugaaggagccgaugguggcccggaagcagaagcucgccgacagccugcgccugcagcagcuguuccgggacgucgaggacgaggagaccuggauccgcgagaaggagcccaucgcggccuccacgaaccgggggaaggaccugaucggcgugcagaaccugcucaagaagcaccaggcccugcaggccgagaucgccggccacgagccccgcaucaaggcggugacccagaaggggaacgccauggucgaggagggccacuucgccgccgaggacgugaaggccaagcugcacgagcucaaccagaagugggaggcgcugaaggccaaggccagccagcggcgccaggaccuggaggacucccuccaggcccagcaguacuucgcggacgccaacgaggccgagagcuggaugcgggagaaggagcccaucgugggguccaccgacuacggcaaggacgaggacagcgccgaggcccugcugaagaagcacgaggcgcucaugagcgaccuguccgccuacgggagcuccauccaggcccugcgcgagcaggcccagagcugccggcagcaggucgccccgaccgacgacgagacgggcaaggagcucgugcuggcgcuguacgacuaccaggagaaguccccgcgcgaggugaccaugaagaagggcgacauccucacccugcugaacagcaccaacaaggacugguggaaggucgaggugaacgaccggcagggguucgugcccgccgccuacgucaagaagcucgaccccgcccagagcgccagccgcgagaaccugcuggaggagcagggcuccaucgcgcuccggcaggagcagaucgacaaccagacgcgcaucaccaaggaggccgggagcgugucccugcgcaugaagcaggucgaggagcuguaccacagccuccuggagcugggcgagaagcggaaggggaugcucgagaaguccugcaagaaguucaugcuguuccgcgaggccaacgagcugcagcaguggaucaacgagaaggaggccgcgcucaccagcgaggaggucggcgccgaccuggagcaggucgaggugcugcagaagaaguucgacgacuuccagaaggaccucaaggccaacgagucccggcugaaggacaucaacaaggucgccgaggaccuggagagcgagggccucauggccgaggaggugcaggcggugcagcagcaggaggucuacgggaugaugccccgcgacgagaccgacuccaagacggccagccccuggaaguccgcccggcugauggugcacaccguggccaccuucaacuccaucaaggagcugaacgagcgcuggcggagccuccagcagcuggccgaggagcgcucccagcugcucggcagcgcgcacgagguccagcgguuccaccgcgacgccgacgagaccaaggaguggaucgaggagaagaaccaggcccugaacaccgacaacuacgggcacgaccuggccuccgugcaggcccuccagcggaagcacgagggcuucgagcgcgaccuggcggcccugggcgacaaggugaacagccucggggagacggccgagcggcugauccagucccaccccgagagcgccgaggaccugcaggagaagugcaccgagcugaaccaggcgugguccagccucggcaagcgcgccgaccagcggaaggccaagcugggggacucccacgaccugcagcgcuuccucagcgacuuccgggaccugauguccuggaucaacggcauccgcgggcuggucagcuccgacgagcucgccaaggacgugaccggcgccgaggcgcugcuggagcggcaccaggagcaccgcaccgagaucgacgcccgcgccggcacguuccaggccuucgagcaguucgggcagcagcuccuggcccacggccacuacgcgagccccgagaucaagcagaagcuggacauccucgaccaggagcgggccgaccuggagaaggccugggugcagcgccggaugaugcuggaccagugccucgagcugcagcuguuccaccgcgacugcgagcaggccgagaacuggauggccgcgcgggaggccuuccucaacaccgaggacaagggggacucccuggacagcgucgaggcccugaucaagaagcacgaggacuucgacaaggccaucaacgugcaggaggagaagaucgccgcgcuccaggccuucgccgaccagcugaucgccgcgggccacuacgccaagggggacaucuccagccgccggaacgaggugcuggaccgcuggcggcgccucaaggcccagaugaucgagaagcggagcaagcugggcgagucccagacccugcagcaguucagccgcgacgucgacgagaucgaggccuggaucuccgagaagcuccagaccgccagcgacgaguccuacaaggacccgacgaacauccagcugagcaagcugcucuccaagcaccagaagcaccaggcguucgaggccgagcugcacgccaacgccgaccggauccgcggcgugaucgacauggggaacagccugaucgagcggggcgccugcgcgggguccgaggacgccgugaaggcccgccucgccgcccuggcggaccaguggcaguuccugguccagaaguccgccgagaagucccagaagcucaaggaggccaacaagcagcagaacuucaacaccggcaucaaggacuucgacuucuggcugagcgagguggaggcccugcucgcguccgaggacuacgggaaggaccuggccagcgugaacaaccugcucaagaagcaccagcugcuggaggccgacaucuccgcccacgaggaccggcucaaggaccugaacagccaggccgacucccugaugaccagcuccgcguucgacaccagccaggucaaggacaagcgcgacacgaucaacggccgguuccagaagaucaagagcauggccgccucccgccgggccaagcucaacgagagccaccgccugcaccaguucuuccgcgacauggacgacgaggaguccuggaucaaggagaagaagcugcucgugggcagcgaggacuacgggcgggaccugaccggcgugcagaaccugcgcaagaagcacaagcggcucgaggccgagcuggcggcccacgagcccgccauccaggggguccuggacaccggcaagaagcucuccgacgacaacaccaucgggaaggaggagauccagcagcgccuggcccaguucguggagcacuggaaggagcugaagcagcucgccgcggcccggggccagcgccuggaggagagccuggaguaccagcaguucgucgccaacguggaggaggaggaggccuggaucaacgagaagaugacgcucguggcguccgaggacuacggcgacacccuggccgccauccaggggcugcucaagaagcacgaggccuucgagaccgacuucaccguccacaaggaccgggugaacgacgugugcacgaacggccaggaccugaucaagaagaacaaccaccacgaggagaacaucagcuccaagaugaaggggcugaacggcaaggucagcgaccucgagaaggccgcggcccagcgcaaggccaagcuggacgagaacuccgccuuccugcaguucaacuggaaggccgacgugguggagagcuggaucggcgagaaggagaacucccucaagaccgacgacuacgggcgggaccugagcuccguccagacccugcucaccaagcaggagacguucgacgcgggccugcaggccuuccagcaggaggggaucgccaacaucaccgcccugaaggaccagcuccuggccgcgaagcacgugcagagcaaggccaucgaggcccgccacgccucccugaugaagcgguggagccagcuccuggccaacuccgcggcccgcaagaagaagcugcucgaggcccagagccacuuccggaagguggaggaccuguuccugaccuucgccaagaaggcgagcgccuucaacuccugguucgagaacgccgaggaggaccucaccgaccccguccgcugcaacagccuggaggagaucaaggcccugcgggaggcccacgacgcguuccgcuccagccucuccagcgcccaggccgacuucaaccagcuggccgagcuggaccggcagaucaaguccuuccgcguggccagcaaccccuacacgugguucaccauggaggcgcucgaggagaccuggcggaaccugcagaagaucaucaaggagcgcgagcuggagcuccagaaggagcagcgccggcaggaggagaacgacaagcugcgccaggaguucgcccagcacgccaacgccuuccaccaguggauccaggagacccggacguaccugcucgacggcuccugcaugguggaggagagcgggacccuggagucccagcuggaggccaccaagcgcaagcaccaggagauccgggcgaugcgcagccagcugaagaagaucgaggaccucggcgccgccauggaggaggcccugauccuggacaacaaguacaccgagcacuccacggucggccucgcgcagcagugggaccagcuggaccagcuggggaugcggaugcagcacaaccucgagcagcagauccaggcccgcaacaccaccggcgugaccgaggaggcccugaaggaguucagcaugauguucaagcacuucgacaaggacaaguccgggcggcugaaccaccaggaguucaagagcugccuccgcucccugggcuacgaccugccgaugguggaggagggggagcccgaccccgaguucgaggccauccucgacaccgucgaccccaaccgggacggccacgugagccugcaggaguacauggccuucaugaucucccgcgagacggagaacgucaagagcagcgaggagaucgaguccgcguuccgggcccugagcuccgagggcaagccguacgucaccaaggaggagcucuaccagaaccugacccgcgagcaggccgacuacugcgugagccacaugaagcccuacguggacgggaagggccgggagcugcccaccgccuucgacuacgucgaguucacgcgcucccucuucgugaacuga

SEQ ID NO: 37052 - RNA, 6414 nt, Artificial Sequence
  derived and/or modified sequence opt1 from SPTB__Homo_sapiens__NP_000338
augaccagcgccaccgaguucgagaacgugggcaaccagccgcccuacucccgcaucaacgcccggugggacgcgcccgacgacgagcuggacaacgacaacagcuccgcccgccuguucgagcggagccgcaucaaggcccuggccgacgagcgggagguggugcagaagaagacguucaccaagugggugaacucccaccuggcccgcgugagcugccggaucaccgaccuguacaaggaccugcgcgacgggcggaugcugaucaagcuccuggaggugcuguccggcgagaugcuccccaagcccaccaaggggaagaugcgcauccacugccuggagaacguggacaaggcgcugcaguuccucaaggagcagcggguccaccuggagaacaugggcagccacgacaucguggacgggaaccaccgccuggugcucggccugaucuggacgaucauccugcgguuccagauccaggacaucgucgugcagacccaggagggccgcgagacccgguccgccaaggacgcccuccugcuguggugccagaugaagaccgccggguacccccacgugaacgucacgaacuucaccagcuccuggaaggacggccucgcguucaacgcccugauccacaagcaccgccccgaccugaucgacuucgacaagcucaaggacagcaacgcccggcacaaccuggagcacgccuucaacguggccgagcgccagcuggggaucaucccccuccuggaccccgaggacguguucaccgagaacccggacgagaaguccaucaucaccuacgucguggcguucuaccacuacuucagcaagaugaaggugcuggccgucgagggcaagcggguggggaaggugaucgaccacgccaucgagacggagaagaugaucgagaaguacuccggccucgccagcgaccugcugaccuggaucgagcagaccaucaccguccucaacucccgcaaguucgccaacagccugacgggcgugcagcagcagcugcaggcguucuccaccuaccggaccguggagaagccgcccaaguuccaggagaaggggaaccucgagguccugcuguucaccauccagagccgcaugcgcgccaacaaccagaagguguacacgccccacgacggcaagcucgucagcgacaucaaccgggccugggagucccuggaggaggccgaguaccgccgggagcuggcccuccgcaacgagcugauccggcaggagaagcuggagcagcucgcgcgccgguucgaccgcaaggccgccaugcgggagaccuggcugagcgagaaccagcgccugguggcccaggacaacuucggguacgaccucgccgcgguggaggccgccaagaagaagcacgaggccaucgagaccgacaccgcggccuacgaggagcggguccgcgcccuggaggaccuggcccaggagcuggagaaggagaacuaccacgaccagaagcggaucacggcccgcaaggacaacauccuccggcugugguccuaccugcaggagcuccugcagagccgccggcagcgccuggagaccacccucgcgcugcagaagcuguuccaggacaugcuccacuccaucgacuggauggacgagaucaaggcccaccuccugagcgccgaguucggcaagcaccuccuggagguggaggaccugcuccagaagcacaagcugauggaggccgacaucgccauccagggcgacaaggugaaggcgaucaccgccgccacgcugaaguucaccgaggggaagggcuaccagccgugcgacccccaggucauccaggaccggaucucccaccucgagcagugcuucgaggagcugagcaacauggccgccgggcgcaaggcgcagcuggagcaguccaagcgccucuggaaguucuucugggagauggacgaggccgagagcuggaucaaggagaaggagcagaucuacuccagccuggacuacggcaaggaccugaccuccgugcucauccugcagcggaagcacaaggccuucgaggacgagcugcgcgggcucgacgcccaccuggagcagaucuuccaggaggcgcacggcaugguggcccggaagcaguucggccacccccagaucgaggcccgcaucaaggaggucagcgcccagugggaccagcugaaggaccucgccgcguucugcaagaagaaccugcaggacgccgagaacuucuuccaguuccagggggacgccgacgaccugaaggccuggcuccaggacgcccaccggcugcuguccggcgaggacguggggcaggacgagggcgcgacccgcgcccucgggaagaagcacaaggacuuccuggaggagcuggaggagagccggggcgugauggagcaccucgagcagcaggcccagggcuuccccgaggaguuccgcgacuccccggacgucacgcaccggcugcaggcccugcgcgagcucuaccagcaggucguggcccaggcggaccugcggcagcagcgccugcaggaggcccucgaccuguacaccgucuucggggagaccgacgccugcgagcuguggaugggcgagaaggagaaguggcucgccgagauggagaugcccgacacccuggaggaccuggagguggugcagcaccgguucgacauccucgaccaggagaugaagacgcugaugacccagaucgacggggucaaccuggcggccaacagccucguggaguccggccacccccgcagccgggaggugaagcaguaccaggaccaccugaacacccgcuggcaggccuuccagacccuggucagcgagcggcgcgaggccguggacuccgcccuccgggugcacaacuacugcgucgacugcgaggagaccagcaaguggaucacggacaagaccaaggugguggaguccaccaaggaccuggggcgcgaccuggcgggcaucaucgccauccagcggaagcucagcggccuggagcgcgacgucgccgccauccaggcccgcguggacgcgcuggagcgggagucccagcagcucauggacagccaccccgagcagaaggaggacaucgggcagcgccagaagcaccuggaggagcuguggcagggccuccagcagucccugcaggggcaggaggaccugcucggcgaggugagccagcugcaggccuuccugcaggaccucgacgacuuccaggccuggcuguccaucacccagaaggccgucgccagcgaggacaugccggagucccugcccgaggcggagcagcuccugcagcagcacgccggcaucaaggacgagaucgacgggcaccaggacagcuaccagcgggugaaggaguccggcgagaaggugauccaggggcagacggaccccgaguaccugcuccugggccagcgccuggaggggcucgacaccggcuggaacgcccugggccggaugugggagagccgcucccacacccuggcccagugccucggguuccaggaguuccagaaggacgccaagcaggcggaggccauccugagcaaccaggaguacacccuggcccaccucgagcccccggacucccuggaggccgcggaggccggcauccggaaguucgaggacuuccuggggagcauggagaacaaccgcgacaagguccucagccccguggacuccggcaacaagcugguggccgaggggaaccuguacagcgacaagaucaaggagaagguccagcucaucgaggaccggcaccgcaagaacaacgagaaggcccaggaggccuccgugcugcugcgggacaaccuggagcuccagaacuuccugcagaacugccaggagcugacgcucuggaucaacgacaagcugcugaccagccaggacguguccuacgacgaggcgcgcaaccuccacaacaaguggcugaagcaccaggccuucgucgccgagcuggccagccacgagggcuggcucgagaacaucgacgccgagggcaagcagcugauggacgagaagccccaguucaccgcgcuggugucccagaagcucgaggcccugcaccggcugugggacgagcuccaggccaccacgaaggagaagacccagcaccugagcgccgcccgcuccagcgaccugcggcuccagacccacgcggaccugaacaaguggaucuccgccauggaggaccagcugcgcagcgacgaccccgggaaggaccucaccuccgugaaccggaugcuggccaagcugaagcgcgucgaggaccaggugaacgugcggaaggaggagcucggcgagcuguucgcccaggucccgagcaugggggaggagggcggggacgcggaccuguccaucgagaagcgcuuccucgaccugcuggagccccucggccgccggaagaagcagcuggagagcucccgcgccaagcugcagaucagccgggaccucgaggacgagacgcuguggguggaggagcgccugccccucgcccaguccgccgacuacggcaccaaccugcagaccgugcagcuguucaugaagaagaaccagacccuccagaacgagauccuggggcacacgccgcgggucgaggacgugcugcagcgcggccagcagcucguggaggccgcggagaucgacugccaggaccuggaggagcggcuggggcaccuccagagcagcugggaccgccugcgggaggccgccgccggccgccugcagcggcuccgcgacgccaacgaggcgcagcaguacuaccuggacgccgacgaggccgaggccuggaucggggagcaggagcuguacgucaucuccgacgagauccccaaggacgaggagggcgccaucgugaugcucaagcggcaccuccgccagcagcgggcggucgaggacuacggccgcaacaucaagcagcuggccagccgggcccaggggcuccuguccgccggccaccccgagggggagcagaucauccgccugcagggccagguggacaagcacuacgcgggccucaaggacguggccgaggagcggaagcgcaagcuggagaacauguaccaccuguuccagcucaagcgggagaccgacgaccuggagcaguggaucagcgagaaggagcuggucgccuccagccccgagauggggcaggacuucgaccacgugacccuccugcgcgacaaguuccgcgacuucgcccgggagaccggcgccaucgggcaggagcgcguggacaacgucaacgcguucaucgagcggcugaucgacgccggccacuccgaggccgccacgaucgccgaguggaaggacgggcucaacgagaugugggcggaccugcuggagcucaucgacacccgcaugcagcugcuggccgccagcuacgaccuccaccgguacuucuacaccggcgccgagauccugggccugaucgacgagaagcaccgcgagcucccggaggacguggggcuggacgccuccaccgcggagagcuuccaccgggugcacacggccuucgagcgcgagcugcaccuccugggcguccaggugcagcaguuccaggacguggccacccggcugcagaccgccuacgccggggagaaggcggaggccauccagaacaaggagcaggaggucuccgccgccuggcaggcgcuccuggacgccugcgccggccgccggacccagcugguggacacggccgacaaguuccgcuucuucagcauggcccgggaccuccuguccuggauggagagcaucauccgccagaucgagacccaggagcggccccgcgacguguccagcgucgagcugcucaugaaguaccaccaggggaucaacgcggagaucgagacccgguccaagaacuucagcgccugccuggagcugggcgagucccuccugcagcgccagcaccaggccagcgaggagauccgggagaagcugcagcaggucaugagccgccgcaaggagaugaacgagaagugggaggcccggugggagcgccuccggaugcugcuggaggugugccaguucucccgcgacgccagcgucgcggaggccuggcucaucgcccaggagcccuaccuggccuccggcgacuucgggcacaccguggacagcguggagaagcugaucaagcggcacgaggccuucgagaaguccacggcgagcugggccgagcgcuucgccgcccucgagaagcccaccacccuggagcugaaggagcggcagaucgcggagcgcccggccgaggagaccggcccccaggaggaggagggggagaccgccggcgaggcccccgucucccaccacgccgcgacggagcggaccagccccgugucccuguggagccgccucuccagcuccugggagagccugcagccggagcccucccaccccuacuga

SEQ ID NO: 37053 - RNA, 6468 nt, Artificial Sequence
  derived and/or modified sequence opt1 from SPTBN1__Homo_sapiens__NP_842565
auggagcugcagcgcaccagcuccaucagcggcccccucuccccggccuacaccgggcaggugcccuacaacuacaaccagcuggagggccgguucaagcagcugcaggacgagcgcgaggccguccagaagaagacguucaccaagugggugaacagccaccucgcgcggguguccugccgcaucaccgaccuguacaccgaccugcgggacgggcgcaugcucaucaagcugcuggagguccucagcggcgagcggcugcccaagcccacgaaggggcgcaugcggauccacugccuggagaacguggacaaggcccuccaguuccugaaggagcagcgcgugcaccuggagaacaugggcucccacgacaucgucgacggcaaccaccggcucacccuggggcugaucuggaccaucauccuccgcuuccagauccaggacaucagcguggagaccgaggacaacaaggagaagaaguccgccaaggacgcccugcugcucuggugccagaugaagacggccggcuacccgaacgugaacauccacaacuucaccaccagcuggcgggacgggauggcguucaacgcccugauccacaagcaccgccccgaccugaucgacuucgacaagcucaagaaguccaacgcccacuacaaccugcagaacgccuucaaccuggcggagcagcaccucggccugaccaagcugcucgaccccgaggacaucagcgucgaccaccccgacgagaaguccaucaucacguacguggugaccuacuaccacuacuucagcaagaugaaggcccuggccgucgaggggaagcggaucggcaaggugcuggacaacgccaucgagaccgagaagaugaucgagaaguacgagucccucgccagcgaccugcuggaguggaucgagcagaccaucaucauccucaacaaccgcaaguucgcgaacucccuggugggcguccagcagcagcugcaggccuucaacacguaccggaccguggagaagccgcccaaguucaccgagaaggggaaccucgaggugcugcuguucaccauccagagcaagaugcgcgccaacaaccagaaggucuacaugccccgggagggcaagcucaucuccgacaucaacaaggccugggagcgccuggagaaggccgagcacgagcgggagcuggcgcuccgcaacgagcugauccgccaggagaagcuggagcagcucgcccggcgcuucgaccggaaggccgccaugcgcgagacguggcugagcgagaaccagcggcuggugagccaggacaacuucggguucgaccugcccgccguggaggcggccaccaagaagcacgaggccaucgagaccgacaucgccgccuacgaggagcgcguccaggcggugguggccgucgcccgggagcucgaggccgagaacuaccacgacaucaagcgcaucaccgcgcggaaggacaacgugauccgccugugggaguaccugcucgagcugcugcgggcccgccggcagcgccucgagaugaaccugggccugcagaagaucuuccaggagaugcucuacaucauggacuggauggacgagaugaagguccuggugcugucccaggacuacggcaagcaccuccuggggguggaggaccugcuccagaagcacacgcuggucgaggccgacaucggcauccaggccgagcgggugcgcggggugaacgccagcgcgcagaaguucgccaccgacggcgagggguacaagccgugcgacccccaggucauccgggaccgcguggcccacauggaguucugcuaccaggagcugugccagcucgccgccgagcggcgcgcgcgccuggaggagucccggcgccuguggaaguucuucugggagauggccgaggaggagggcuggauccgggagaaggagaagauccucagcuccgacgacuacggcaaggaccugaccagcgugaugcgccugcucuccaagcaccgggccuucgaggacgagaugagcgggcgcuccggccacuucgagcaggccaucaaggagggggaggacaugaucgccgaggagcacuucggcagcgagaagauccgggagcgcaucaucuacauccgggagcagugggcgaaccuggagcagcuguccgccauccgcaagaagcggcucgaggaggccagccugcugcaccaguuccaggccgacgcggacgacaucgacgccuggaugcucgacauccugaagaucgucuccagcuccgacguggggcacgacgaguacagcacccagucccuggugaagaagcacaaggacgucgccgaggagaucgccaacuaccgccccacgcucgacacccugcacgagcaggccagcgcgcugccccaggagcacgccgaguccccggacgugcggggccgccucagcggcaucgaggagcgguacaaggagguggccgagcugacccgccugcggaagcaggcccuccaggacacccuggcccuguacaagauguucagcgaggcggacgccugcgagcucuggaucgacgagaaggagcaguggcugaacaacaugcagauccccgagaagcuggaggaccucgaggucauccagcaccgcuucgagucccuggagcccgagaugaacaaccaggccagccggguggccguggucaaccagaucgcccgccagcugaugcacuccgggcaccccagcgagaaggagaucaaggcgcagcaggacaagcucaacacgcgguggucccaguuccgcgagcugguggaccgcaagaaggacgcccugcucagcgcccuguccauccagaacuaccaccuggagugcaacgagaccaagagcuggauccgggagaagaccaaggugaucgaguccacccaggaccucggcaacgaccuggccggggucauggcgcugcagcgcaagcucacgggcauggagcgggaccugguggccaucgaggccaagcugagcgaccuccagaaggaggccgagaagcuggaguccgagcacccggaccaggcccaggcgauccugagccgccucgccgagaucuccgacgugugggaggagaugaagaccacccugaagaaccgggaggccagccugggggaggccuccaagcuccagcaguuccugcgcgaccuggacgacuuccagagcuggcucucccggacccagaccgccaucgcgagcgaggacaugcccaacacgcugaccgaggccgagaagcugcucacccagcacgagaacaucaagaacgagaucgacaacuacgaggaggacuaccagaagaugcgcgacaugggcgagauggucacccagggccagacggacgcccaguacauguuccugcggcagcgccugcaggcccucgacaccggguggaacgagcugcacaagaugugggagaaccggcagaaccugcucagccagucccacgccuaccagcaguuccugcgcgacaccaagcaggcggaggccuuccugaacaaccaggaguacgugcucgcccacaccgagaugcccacgacccuggagggcgccgaggccgcgaucaagaagcaggaggacuucaugaccaccauggacgccaacgaggagaagaucaacgccguggucgagacggggcggcgccuggugagcgacggcaacaucaacuccgaccggauccaggagaagguggacagcaucgacgaccgccaccggaagaaccgcgagaccgccuccgagcuccugaugcggcugaaggacaaccgcgaccuccagaaguuccugcaggacugccaggagcugagccucuggaucaacgagaagaugcugaccgcgcaggacauguccuacgacgaggcccgcaaccugcacagcaaguggcucaagcaccaggccuucauggccgagcuggccuccaacaaggaguggcuggacaagaucgagaaggagggcaugcagcugaucagcgagaagcccgagaccgaggcggucgugaaggagaagcucacggggcugcacaagaugugggaggugcuggaguccaccacccagaccaaggcccagcggcucuucgacgccaacaaggccgagcuguucacgcagagcugcgccgaccuggacaaguggcuccacggccuggagucccagauccagagcgacgacuacgggaaggaccugaccuccgucaacauccuccugaagaagcagcagaugcuggagaaccagauggaggugcgcaagaaggagaucgaggagcuccagagccaggcgcaggcccugucccaggagggcaagagcaccgacgagguggacuccaagcggcugaccguccagacgaaguucauggagcuccuggagccgcugaacgagcgcaagcacaaccuccuggccagcaaggagauccaccaguucaaccgggacguggaggacgagauccugugggugggggagcgcaugccccucgccaccagcaccgaccacggccacaaccugcagaccguccagcugcucaucaagaagaaccagacgcugcagaaggagauccagggccaccagccccggaucgacgacaucuucgagcgcucccagaacaucgugaccgacagcuccagccuguccgccgaggcgauccggcagcgccucgccgaccugaagcagcugugggggcuccugaucgaggagaccgagaagcggcaccgccggcuggaggaggcccaccgcgcccagcaguacuacuucgacgcggccgaggccgaggccuggaugagcgagcaggagcucuacaugauguccgaggagaaggccaaggacgagcagagcgcgguguccaugcugaagaagcaccagauccuggagcaggccgucgaggacuacgccgagaccgugcaccagcucagcaagacgucccgggcccugguggccgacagccaccccgaguccgagcgcaucagcaugcggcaguccaaggucgacaagcuguacgcgggccucaaggaccuggccgaggagcgccgggggaagcuggacgagcgccaccggcucuuccagcugaaccgcgagguggacgaccuggagcaguggaucgccgagcgcgagguggucgccggcagccacgagcucgggcaggacuacgagcacgugaccaugcugcaggagcgguuccgcgaguucgcccgggacaccggcaacaucggccaggagcgcguggacaccgucaaccaccuggcggacgagcucaucaacuccgggcacagcgacgccgccacgaucgccgaguggaaggacggccugaacgaggcgugggccgaccugcucgagcugaucgacacccggacccagauccuggccgccuccuacgagcuccacaaguucuaccacgacgccaaggagaucuucgggcgcauccaggacaagcacaagaagcugccggaggagcugggccgggaccagaacaccguggagacccuccagcgcaugcacacgaccuucgagcacgacauccaggcgcuggggacccagguccggcagcugcaggaggacgccgcccgccuccaggccgccuacgcgggcgacaaggccgacgacauccagaagcgggagaacgaggugcuggaggccuggaagagccugcucgacgccugcgagagccgccgggugcgccuggucgacaccggcgacaaguuccgguucuucuccauggugcgcgaccugaugcucuggauggaggacgugauccggcagaucgaggcccaggagaagccccgcgacgucagcuccguggagcugcugaugaacaaccaccaggggaucaaggcggagaucgacgcccggaacgacagcuucacgaccugcaucgagcucggcaagucccugcuggcccgcaagcacuacgccagcgaggagaucaaggagaagcuccugcagcugaccgagaagcgcaaggagaugaucgacaagugggaggaccggugggaguggcuccgccugauccuggaggugcaccaguucucccgggacgccagcgucgcggaggccuggcuccuggggcaggagcccuaccuguccagccgcgagaucggccaguccguggacgagguggagaagcucaucaagcggcacgaggccuucgagaagagcgccgcgaccugggacgagcgcuucuccgcccuggagcggcugacgacccucgagcugcuggagguccgccggcagcaggaggaggaggagcgcaagcggcgcccgcccagccccgagcccuccaccaaggugagcgaggaggccgagucccagcagcagugggacaccagcaagggggagcaggugucccagaacggccucccggccgagcagggcagcccccgggucagcuaccgcucccagacguaccagaacuacaagaacuucaacagccggcgcaccgccuccgaccagcccuggagcgggcuguga

SEQ ID NO: 37054 - RNA, 7173 nt, Artificial Sequence
  derived and/or modified sequence opt1 from SPTBN2__Homo_sapiens__NP_008877
augagcagcacccucagccccaccgacuucgacucccucgagauccagggccaguacagcgacaucaacaaccgcugggaccugcccgacuccgacugggacaacgacagcuccagcgcccggcuguucgagcgcucccggaucaaggcccucgcggacgagcgcgaggccgugcagaagaagaccuucaccaagugggugaacagccaccuggcccgggugaccugccgcgugggggaccuguacuccgaccuccgggacggccgcaaccugcugcggcuccuggagguccugagcggggagauccuccccaagcccaccaagggccgcaugcggauccacugccuggagaacguggacaaggcccugcaguuccucaaggagcagaaggugcaccuggagaacauggggucccacgacaucgucgacggcaaccaccgccugacgcucggccugguguggaccaucauccugcgguuccagauccaggacaucagcguggagaccgaggacaacaaggagaagaaguccgccaaggacgcgcuccugcuguggugccagaugaagaccgccggguaccccaacgucaacgugcacaacuucacgaccagcuggcgcgacggccucgccuucaacgccaucgugcacaagcaccggcccgaccugcuggacuucgagucccucaagaagugcaacgcgcacuacaaccugcagaacgccuucaaccuggccgagaaggagcucgggcugaccaagcugcucgaccccgaggacgucaacguggaccagcccgacgagaaguccaucaucaccuacguggccacguacuaccacuacuucuccaagaugaaggcccuggcggucgagggcaagcgcaucgggaaggugcuggaccacgccauggaggccgagcggcucguggagaaguacgagagccuggccagcgagcugcuccaguggaucgagcagaccaucgucacccugaacgaccgccagcuggccaacucccucagcggcgugcagaaccagcugcaguccuucaacagcuaccggaccguggagaagccgcccaaguucacggagaagggcaaccuggagguccuccuguucaccauccaguccaagcugcgcgcgaacaaccagaagguguacacgccccgggaggggcgccucaucagcgacaucaacaaggccugggagcgccuggagaaggccgagcacgagcgggagcuggcccugcgcaccgagcucauccggcaggagaagcuggagcagcuggccgcgcgcuucgaccggaaggccgccaugcgcgagacguggcucuccgagaaccagcggcuggugagccaggacaacuucggccuggagcucgccgccgucgaggcggccgugcgcaagcacgaggccaucgagaccgacaucgucgccuacuccgggcgggugcaggcgguggacgccgucgccgccgagcuggccgcggagcgcuaccacgacaucaagcggaucgccgcccgccagcacaacguggcccggcugugggacuuccuccgccagaugguggccgcgcggcgcgagcggcugcugcucaaccuggagcugcagaaggucuuccaggaccuccuguaccugauggacuggauggaggagaugaagggccgccuccagagccaggaccugggccggcaccuggccgggguggaggaccuccugcagcugcacgagcucguggaggccgacaucgccguccaggccgagcgcgugcgcgcgguguccgccagcgcccugcgguucugcaaccccggcaaggaguaccgccccugcgacccccagcuggucuccgagcggguggccaagcucgagcagagcuacgaggcgcugugcgagcuggccgccgcccgccgggcccgccucgaggagucccggcgccuguggcgguuccugugggaggugggggaggcggaggccuggguccgcgagcagcagcaccuccuggccagcgccgacaccggccgggaccugaccggggcccuccgccugcugaacaagcacacggcgcuccggggcgagauguccggccgccuggggccccugaagcucacccuggagcagggccagcagcugguggccgaggggcaccccggcgccagccaggccuccgcccgggcggccgagcuccaggcccagugggagcgccuggaggcccuggcggaggagcgggcccagcgccucgcccaggccgccagccuguaccaguuccaggcggacgccaacgacauggaggccuggcugguggacgcccuccggcuggucagcucccccgagcuggggcacgacgaguucagcacccaggcccucgcgcgccagcaccgggcccuggaggaggagauccgcucccaccgccccacccuggacgcccuccgggagcaggccgccgcgcugccgcccacgcugagccgcacccccgaggugcagggccgggugccgacccucgagcgccacuacgaggagcugcaggcccgggccggcgagcgcgcccgggcccuggaggcggcccucgcccuguacaccaugcuguccgaggccggggcgugcggccucugggucgaggagaaggagcaguggcugaacgggcuggcccuccccgagcgccuggaggaccuggagguggugcagcagcgguucgagacgcucgagcccgagaugaacacccuggccgcccagaucaccgccgucaacgacaucgcggagcagcugcucaaggccaacccgcccggcaaggaccgcaucgugaacacccaggagcagcugaaccaccgguggcagcaguuccgccggcuggccgacgggaagaaggccgcccucacgagcgcgcuguccauccagaacuaccaccuggagugcaccgagacccaggccuggaugcgcgagaagaccaaggugaucgagagcacccagggccucggcaacgaccuggccgggguccuggcccuccagcggaagcuggccggcacggagcgcgaccuggaggcgaucgccgcccgggugggggagcucacccgcgaggccaacgcgcuggccgccggccaccccgcccaggccguggcgaucaacgcccggcugcgcgagguccagaccggcugggaggaccuccgcgccaccaugcggcgccgggaggagucccugggggaggcccgccggcugcaggacuuccuccgcagccuggacgacuuccaggccuggcugggccggacgcagaccgcgguggccuccgaggaggggcccgccacccugcccgaggccgaggcccuccuggcgcagcacgccgcccugcgcggcgagguggagcgggcccagagcgaguacucccgccuccgggcgcugggggaggaggucacccgcgaccaggccgacccccagugccuguuccuccggcagcgccuggaggcccugggcacgggcugggaggagcucgggcggaugugggagagccgccagggccggcuggcccaggcccacggguuccagggcuuccugcgcgacgcgcggcaggccgagggggugcucuccagccaggaguacgugcugucccacaccgagaugcccggcacccugcaggccgccgacgccgcgaucaagaagcucgaggacuucaugagcaccauggacgccaacggcgagcgcauccacgggcugcuggaggccggccggcagcucgucagcgaggggaacauccacgccgacaagauccgcgagaaggccgacuccaucgagcgccggcacaagaagaaccaggacgcggcccagcaguuccugggccgccugcgggacaaccgcgagcagcagcacuuccuccaggacugccacgagcugaagcuguggaucgacgagaagaugcucacggcccaggacgugagcuacgacgaggcccggaaccugcacaccaaguggcagaagcaccaggccuucauggcggagcuggccgccaacaaggacuggcucgacaagguggacaaggaggggcgcgagcugacccuggagaagcccgagcucaaggcccuggucuccgagaagcugcgggaccuccaccgccggugggacgagcuggagaccacgacccaggcgaaggcccgcagccuguucgacgccaaccgggccgagcuguucgcccaguccugcugcgcgcuggagagcuggcuggagucccuccaggcccagcugcacagcgacgacuacggcaaggaccugaccuccgugaacauccuccugaagaagcagcagaugcuggagugggagauggccgugcgcgagaaggaggucgaggccauccaggcccaggcgaaggcccucgcccaggaggaccagggcgccggggagguggagcggaccagccgcgccguggaggagaaguuccgggcgcugugccagccgaugcgcgagcggugccgccggcugcaggccucccgcgagcagcaccaguuccaccgcgacgucgaggacgagauccucugggugacggagcggcugcccauggccagcuccauggagcacggcaaggaccugcccagcgugcagcuccugaugaagaagaaccagacccugcagaaggagauccaggggcacgagccccgcaucgccgaccuccgggagcgccagcgggcgcugggcgccgccgccgccgggccggagcuggcggagcuccaggagauguggaagcgccugggccacgagcuggagcuccggggcaagcgccuggaggacgcccugcgggcccagcaguucuaccgcgacgccgccgaggcggaggccuggaugggggagcaggagcuccacaugaugggccaggagaaggccaaggacgagcuguccgcccaggccgaggucaagaagcaccaggugcuggagcaggcgcucgccgacuacgcccagaccauccaccagcuggccgcgagcucccaggacaugaucgaccacgagcaccccgagagcacccggaucuccauccgccaggcccagguggacaagcuguacgccgggcucaaggagcuggccggcgagcggcgcgagcggcugcaggagcaccuccgccugugccagcugcggcgcgagcucgacgaccuggagcaguggauccaggagcgggaggucguggccgcgagccacgagcugggccaggacuacgagcacgucacgaugcuccgcgacaaguuccgggaguucagccgcgacaccuccaccaucgggcaggagcgcguggacagcgccaacgcccuggccaacggccugaucgccgggggccacgcggcccgggccaccguggccgaguggaaggacucccucaacgaggccugggcggaccugcuggagcuccuggacacgcgcgggcagguccuggccgccgccuacgagcuccagcgguuccugcacggcgcccgccaggcgcuggcccgggugcagcacaagcagcagcagcuccccgacggcaccgggcgcgaccugaacgccgccgaggcgcugcagcggcgccacugcgccuacgagcacgacauccaggcccucagcccccaggugcagcagguccaggacgacggccaccggcugcagaaggccuacgccggggacaaggcggaggagaucggccgccacaugcaggccguggccgaggccugggcccagcugcagggguccagcgcggcccggcgccagcuccugcuggacaccaccgacaaguuccgguucuucaaggccgugcgcgagcucaugcuguggauggacgaggucaaccugcagauggacgcccaggagcggccgcgcgacguguccagcgccgaccuggugaucaagaaccagcagggcaucaaggcggagaucgaggcccgggccgaccgcuucuccagcugcaucgacaugggcaaggagcuccuggcccggucccacuacgcggccgaggagaucagcgagaagcugucccagcuccaggcccgccgccaggagacggccgagaaguggcaggagaagauggacuggcugcagcugguccucgaggugcugguguucgggcgggacgccggcauggcggaggccuggcugugcagccaggagccccucguccgcuccgccgagcuggggugcaccguggacgagguggagagccugaucaagcggcacgaggccuuccagaaguccgccgucgcgugggaggagcgcuucugcgcccucgagaagcugaccgcccuggaggagcgggagaaggagcgcaagcggaagcgcgaggaggaggagcggcgcaagcagccgcccgccccggagcccaccgccagcgugccgcccggcgaccucgucgggggccagacggcguccgacaccaccugggacggcacccagccgcggccgccgcccagcacccaggccccgagcgucaacggggugugcacggacggcgagcccucccagccccugcuggggcagcagcgccucgagcacagcuccuuccccgagggcccgggccccgggagcggcgacgaggccaacgggccccggggcgagcgccagacccggacccgcgggccggcccccuccgccaugccccagagccgguccaccgagagcgcgcacgccgccacgcugcccccgcgcggccccgagcccuccgcccaggagcagauggagggcaugcugugccggaagcaggagauggaggcguucgggaagaaggccgccaaccgcagcuggcagaacguguacugcguccuccggcgcggcucccugggguucuacaaggacgccaaggccgcgagcgccggcgugcccuaccacggggaggugccggucucccuggcccgcgcccagggcagcguggccuucgacuaccggaagcgcaagcacguguucaagcucggccugcaggacgggaaggaguaccuguuccaggcgaaggacgaggccgagauguccagcuggcuccgggucgugaacgccgccaucgccaccgcguccagcgccuccggcgagcccgaggagcccgugguccccagcaccacccgcgggaugacgcgggccaugaccaugccgcccgugagccccgugggcgccgaggggcccgucgugcugcgcuccaaggacggccgggagcgcgagcgggagaagcgcuucagcuucuucaagaagaacaaguga

SEQ ID NO: 37055 - RNA, 7695 nt, Artificial Sequence
  derived and/or modified sequence opt1 from SPTBN4__Homo_sapiens__NP_066022
auggcccaggugcccggcgagguggacaacauggaggggcugcccgcccccaacaacaaccccgcggcccgcugggagagccccgaccggggcugggagcgcgagcagcccgccgccagcaccgccgcggccagccuguucgagugcucccggaucaaggcccuggccgacgagcgcgaggcggugcagaagaagaccuucaccaagugggugaacagccaccuggcccggguggggugccacaucggcgaccuguacguggaccugcgcgacggguucgugcugacccggcuccuggagguccuguccggcgagcagcucccccgccccacccggggccgcaugcggauccacagccuggagaacguggacaaggcccugcaguuccucaaggagcagcgcgugcaccuggagaacgucgggucccacgacaucguggacggcaaccaccggcugacccucgggcugguguggacgaucauccugcgcuuccagauccaggucaucaagaucgagaccgaggacaaccgggagacccgcagcgccaaggacgcccuccugcuguggugccagaugaagaccgcgggcuaccccgaggugaacauccagaacuucacgaccuccuggcgggacgggcucgccuucaacgcccugauccaccgccaccggcccgaccugguggacuucagcaagcucaccaaguccaacgccaacuacaaccugcagcgcgccuuccggaccgcggagcagcaccugggccucgcccgccugcuggaccccgaggacgucaacauggaggcccccgacgagaaguccaucaucacguacgugguguccuucuaccacuacuucagcaagaugaaggcccucgccgucgagggcaagcgcaucgggaaggugcuggaccaggugcuggaggucggcaagaucaucgagcgguacgaggagcucgcggccgagcugcuggccuggauccaccgcaccguggggcucaucuccaaccagaaguucgccaacagccuguccggcgugcagcagcagcugcaggccuucaccgcguacugcacccucgagaagcccgucaaguuccaggagaagggcaaccuggaggugcuccuguucagcauccaguccaagcugcgggccugcaaccgccggcuguucgucccgcgcgaggggugcggcaucugggacaucgacaaggccuggggcgagcucgagaaggccgagcacgagcgggaggcggcccugcgcgccgagcugauccggcaggagaagcucgagcugcuggcccagcgcuucgaccacaagguggccaugcgggagagcuggcugaacgagaaccagcgccucgugagccaggacaacuucggcuacgagcugcccgcggucgaggccgccaugaagaagcacgaggccaucgaggccgacaucgcggccuacgaggagcgggugcaggggguggccgagcuggcccaggcccucgcggccgagggcuacuacgacauccgccgggucgccgcccagcgcgacuccgugcugcggcagugggcgcugcucacgggccuggugggggcccgccggacccgccuggagcagaaccucgcccugcagaaggucuuccaggagaugguguacaugguggacuggauggaggagaugcaggcccagcugcucagccgcgagugcggccagcaccuggucgaggccgacgaccugcuccagaagcacgggcugcuggagggcgacaucgcggcccaguccgagcggguggaggcccucaacgccgccgcgcugcgcuucagccagcugcagggguaccagcccugcgacccccaggugaucugcaaccgggucaaccacgugcacggcugccucgccgagcugcaggagcaggccgcccgccggcgcgccgagcuggaggcgucccggagccucugggcccugcugcaggagcucgaggaggccgaguccugggcccgcgacaaggagcggcugcuggaggcggccggcgggggcggggccgccggcgccgcgggggccgccggcaccgccggcggggcccacgaccucagcuccaccgcgcgccugcuggcccagcacaagauccuccagggcgagcucggcgggcggcgcgcccugcuccagcaggcccugcggugcggggaggagcugguggccgccgggggcgccgucgggccgggcgccgacacggugcaccucguggggcuggccgagcgcgccgcgagcgcccggcgccgguggcagcgccuggaggaggccgccgcgcggcgcgagcggcgccuccaggaggcccgcgcccugcaccaguucggcgccgaccuggacggccuccuggacuggcugcgggacgccuaccgccucgcggccgccggggacuucggccacgacgaggccuccagccggcgccuggcccggcagcaccgcgcgcugaccggggaggucgaggcccaccggggccccguguccgggcuccgccggcagcuggccacccugggcggcgccagcggggccggcccccucguggucgcgcuccaggugcgcguggucgaggccgagcagcuguucgccgaggugaccgagguggccgcgcuccggcgccaguggcugcgggacgcccuggccgucuaccgcauguucggggaggugcacgccugcgagcucuggaucggcgagaaggagcaguggcugcuguccaugcgggugcccgacagccucgacgacgucgagguggugcagcaccgcuucgagucccuggaccaggagaugaacagccugauggggcggguccucgacgugaaccacacggugcaggagcuggucgagggcggccacccguccagcgacgaggugcgcagcugccaggaccaccugaacucccgguggaaccgcaucguggagcucgucgagcagcgcaaggaggagaugagcgccgugcugcugguggagaaccacguccucgagguggcggaggugcgggcccagguccgcgagaagcggcgcgccguggaguccgcgccccgggccgggggcgcgcugcaguggcgccugagcgggcucgaggccgcccugcaggcccuggagccccggcaggccgcgcuccuggaggaggccgcccugcucgccgagcgcuuccccgcgcaggccgcccggcugcaccagggcgccgaggagcugggggccgaguggggcgcgcucgccuccgccgcccaggccugcggcgaggcgguggccgccgccgggcgccugcagcgguuccugcacgaccucgacgccuuccuggacuggcugguccgcgcgcaggaggccgccggcgggagcgagggcccgcuccccaacucccuggaggaggccgacgcccugcucgcgcggcacgccgcccugaaggaggagguggaccagcgcgaggaggacuacgcccggaucgucgcggccagcgaggcccugcuggccgccgacggcgcggagcucgggcccggccuggcccuggacgaguggcucccccaccuggagcugggguggcacaagcuccugggccugugggaggcccgccgggaggcccucgugcaggcccacaucuaccagcuguuccugcgcgaccuccggcaggcgcuggugguccugcgcaaccaggagauggcccucuccggggccgagcugccgggcaccguggagagcguggaggaggcccugaagcagcaccgggacuuccucaccaccauggagcugucccagcagaagaugcaggucgccgugcaggcggccgagggccugcuccgccaggggaacaucuacggcgagcaggcccaggaggccgugacgcgccugcuggagaagaaccaggagaaccagcuccgggcgcagcaguggaugcagaagcugcacgaccagcuggagcuccagcacuuccugcgcgacugccacgagcuggacggguggauccacgagaagaugcucauggcccgggacggcacccgcgaggacaaccacaagcugcacaagcgguggcugcgccaccaggccuucauggccgagcucgcccagaacaaggaguggcuggagaagaucgagcgggaggggcagcagcugaugcaggagaagcccgagcucgcggccagcguccgcaagaagcugggcgagauccggcagugcugggccgagcuggaguccaccacccaggccaaggcccgccagcuguucgaggcgagcaaggccgaccagcuggugcaguccuucgccgagcuggacaagaagcuccugcacauggagagccagcugcaggacguggaccccggcggggaccucgccacggucaacucccagcugaagaagcugcagagcauggagagccagguggaggagugguaccgggaggugggcgagcuccaggcccagaccgcggcccugccgcuggagcccgccuccaaggagcucgucggggagcgccagaacgccgugggcgagcggcuggugcgccugcucgagccccugcaggagcggcgccggcugcuccuggcgagcaaggagcugcaccaggucgcccacgaccucgacgacgagcuggccugggugcaggagcgccugccccucgccaugcagaccgagcgggggaacggccugcaggccgugcagcagcacaucaagaagaaccagggccugcgccgcgagauccaggcgcacgggccgcggcucgaggagguccuggagcgcgccggcgcccuggccucccuccggagccccgaggccgaggcggugcgccgggggcuggagcagcugcaguccgccugggccggccuccgcgaggccgccgagcggcgccagcagguccuggacgcggccuuccaggucgagcaguacuacuucgacguggccgagguggaggccuggcugggcgagcaggagcuccugaugaugagcgaggacaaggggaaggacgagcaguccacccugcagcuccugaagaagcaccuccagcucgagcagggcgucgagaacuacgaggagagcaucgcccagcugucccggcagugccgcgcgcugcucgagauggggcaccccgacagcgagcagaucucccggcgccagagccagguggaccggcuguacguggcccugaaggagcucggcgaggagcgccgggucgcccuggagcagcaguacuggcuguaccagcucucccgccaggugagcgagcuggagcacuggaucgccgagaaggagguggucgcggggucccccgagcugggccaggacuucgagcacgugagcgugcuccaggagaaguucuccgaguucgccagcgagacgggcauggccgggcgggagcgccuggccgccgucaaccagaugguggacgagcugaucgagugcggccacaccgcggccgccaccauggccgaguggaaggacgggcucaacgaggccugggcggagcugcuggagcucaugggcacccgggcccagcugcuggccgccucccgcgagcugcacaaguucuucagcgacgcccgggagcuccaggggcagaucgaggagaagcgccgccggcugccgcgccugaccacgccgcccgagccccggccgagcgcguccagcaugcagcgcacccuccgggccuucgagcacgaccugcagcugcucgugucccagguccgccagcugcaggagggcgccgcccagcugcggaccguguacgcgggcgagcacgccgaggccaucgccagccgcgagcaggaggugcuccagggguggaaggagcugcuguccgccugcgaggacgcgcggcuccacgucagcuccaccgccgacgcccugcgcuuccacagccaggugcgggaccugcucuccuggauggacggcaucgccagccagaucggggccgcggacaagccccgcgacguguccagcgucgaggugcugaugaacuaccaccagggccugaagacggagcucgaggcccgggugcccgagcugacgaccugccaggagcuggggcgcucccuccugcugaacaagagcgccauggccgacgagauccaggcccagcucgacaagcugggcacccggaaggaggaggucuccgagaagugggaccgccacugggaguggcugcagcagaugcucgaggugcaccaguucgcgcaggaggccguggucgccgacgccuggcugacggcccaggagccccugcuccagagccgggagcugggcuccagcguggacgaggucgagcagcugauccgccggcacgaggcguuccgcaaggccgccgccgcgugggaggagcgcuucuccagccuccggcgccugaccaccaucgagaagaucaaggccgagcagagcaagcagccgcccacgccccugcucgggcggaaguucuucggcgaccccaccgagcuggccgccaaggccgcgccgcugcuccgccccgggggcuacgagcgggggcuggagccccuggcccgccgggccuccgacacccucagcgccgaggugcgcacccgggugggcuacguccgccaggagcugaagcccgagcggcugcagccgcgcaucgaccggcuccccgagauccccggccgcguggagccggccgcgcugcccgccgcccccgaggacgccgccgagacccccgcgacgccggccgccgccgagcagguccggccccgccccgagcggcaggaguccgcggaccgcgccgaggagcugccccggcgccggcgcccggagcgccaggagagcgucgaccaguccgaggaggccgcccggcgccggcgccccgagcggcaggagagcgccgagcacgaggcggcccacucccucacccuggggcgcuacgagcagauggagcggcgccgggagcgccgggagcgccggcuggagcgccaggagagcuccgagcaggagaugcccauccggggcgaccucgugaaggggaaggccacccuggccgacaucguggagcagcugcaggagaaggaggccggccccggccucccggcggggcccagccugccccagccccgcgagcugccgcccggccggcuccccaacgggcuggagcugcccgagcgcaccccgcggcccgaccgcccccgcgcccgggaccgccccaagccgcggcgccggccccgcccccgggagggcggggagggcggcgggucccgccggagccgcuccgcccccgcccagggcgggagcgccccggcgccgccgccgccgcccacgcacaccguccagcacgagggcuuccuccugcggaagcgcgagcuggacgccaaccggaaguccagcaaccgcuccugggugagccucuacugcgugcuguccaagggggagcugggcuucuacaaggacagcaagggccccgccagcggguccacccacggcggggagccccuccugagccugcacaaggccaccuccgaggucgcgagcgacuacaagaagaagaagcacguguucaagcuccagacgcaggacggcuccgaguuccugcugcaggccaaggacgaggaggagaugaacggguggcucgaggccguggccagcuccgucgccgagcacgcggagaucgcccgguggggccagacccugcccaccaccagcuccacggacgagggcaaccccaagcgcgagggcggggaccggcgcgccagcgggcggcgcaaguga

SEQ ID NO: 37056 - RNA, 11025 nt, Artificial Sequence
  derived and/or modified sequence opt1 from SPTBN5__Homo_sapiens__NP_057726
auggccgggcagccccacagcccccgcgagcugcugggggccgccggccaccggucccgccggcccagcaccgagcugcgcgugccgcccucccccagccugaccauggacucccaguacgagaccgggcacauccggaagcuccaggcccgccacaugcagaugcaggagaagaccuucaccaaguggaucaacaacguguuccagugcggccaggccgggaucaagauccggaaccuguacaccgagcuggccgacggcauccaccuccugcgccugcucgagcugaucagcggcgaggcccugccgccgcccucccgggggcgccuccgggugcacuuccuggagaacagcucccgcgcccuggccuuccuccgggccaaggugcccgugccccugaucggccccgagaacaucguggacggggaccagacgcugauccucggccugaucugggugaucauccugcgcuuccagaucagccacaucucccucgacaaggaggaguucggggccagcgccgcccugcuguccaccaaggaggcccuccugguguggugccagcggaagaccgccagcuacaccaacgugaacaucacggacuucucccgcagcugguccgacggccugggcuucaacgcccucauccacgcccaccggcccgaccugcuggacuacgggagccuccgccccgaccggccccugcacaaccuggccuucgccuuccucguggccgagcaggagcugggcaucgcccagcugcucgaccccgaggacgucgcggccgcccagcccgacgagcgcuccaucaugaccuacgugagccuguacuaccacuacugcagccggcugcaccaggggcagaccgugcagcgccgccucaccaagauccugcugcagcuccaggagacggagcugcugcagacccaguacgagcagcucgucgccgaccugcugcgguggaucgccgagaagcagaugcagcucgaggcgcgcgacuuccccgacucccugcccgccaugcggcagcugcuggccgccuucaccaucuuccgcacccaggagaagccgccccggcuccagcagcgcggcgccgcggaggcccugcuguuccggcuccagacggcccugcaggcccagaaccgccggcccuuccugccccacgagggccucgggcuggcggagcugagccagugcugggccggccucgagugggccgaggccgcccgcucccaggcgcugcagcagcggcugcuccagcugcagcgccuggagacccucgcccggcgcuuccagcacaaggccgcccugcgggagagcuuccugaaggacgccgagcagguccucgaccaggcgcgcgcgccgcccgccucccuggccaccguggaggccgcgguccagcggcuggggaugcucgaggccggcauccugccgcaggaggggcgcuuccaggcccuggccgagaucgcggacauccuccggcaggagcaguaccacagcugggccgacguggcccgccgccaggaggaggugaccguccgguggcagcgccugcugcagcaccuccagggccagcggaagcaggucgccgacaugcaggccgugcugucccugcuccaggaggucgaggcggccagccaccagcuggaggagcugcaggagcccgcccgcuccacggccugcggccagcagcucgccgaggugguggagcugcugcagcggcacgaccuccuggaggcgcaggucagcgcccacggggcccacgugucccaccuggcccagcagaccgccgagcucgacagcucccugggcaccagcgucgaggugcugcaggcgaaggcccgcacccucgcccagcugcagcagucccugguggcccucguccgggcgcgccgggcccugcuggagcagacgcuccagcgcgccgaguuccugcggaacugcgaggaggaggaggccuggcugaaggagugcgggcagcgcgugggcaacgccgcgcucgggcgggaccugagccagaucgccggcgcccugcagaagcacaaggcccucgaggccgaggugcaccgccaccaggcggucugcguggaccuggugcggcgcggccgggaccuguccgcccgccggccgcccacccagccggaccccggggagcgcgccgaggccguccagggcggguggcagcuccugcagacccggguggugggccgcggggcccgccugcagaccgcgcuccugguccugcaguacuucgccgacgccgccgaggccgcgagcuggcuccgggagcgccgguccagccuggagcgcgccagcugcggccaggaccaggccgccgcggagacgcugcuccggcgccacgugcggcuggagcgcgugcugcgggccuucgccgccgagcuccgccggcuggaggagcagggccgcgccgcguccgcccgggccagccuguucaccgucaacuccgcccucagcccgcccggggagucccugcgcaaccccggccccuggagcgaggccuccugccaccccgggcccggcgacgcguggaagauggcccugcccgccgagcccgaccccgacuucgacccgaacaccauccuccagacccaggaccaccugagccaggacuacgagucccugcgggcccucgcccagcugcgccgggcgcgccuggaggaggccauggcccucuucggcuucugcagcuccugcggggagcugcagcuguggcucgagaagcagacggugcugcugcagcgggugcagccccaggccgacacccucgaggucaugcagcugaaguacgagaacuuccugaccgcgcucgccgugggcaaggggcugugggccgaggugagcuccagcgccgagcagcugcgccagcgcuaccccggcaacuccacccagauccagcggcagcaggaggagcucagccagcgcugggggcagcuggaggcccugaagcgggagaaggcgguccagcuggcccacuccguggaggugugcagcuuccuccaggagugcggccccacgcagguccagcugcgcgacgugcugcuccagcuggaggcccugcagccgggcagcuccgaggacacgugccacgcccuccagcuggcccagaagaagacccuggugcucgagcggcgcguccacuuccugcagagcgugguggucaagguggaggagcccggguacgcggagucccagccccugcagggccagguggagacccuccaggggcugcugaagcagguccaggagcaggucgcccagcgggcccgccggcaggccgagacccaggcccgccagagcuuccuccaggagucccagcagcugcugcucugggcggagagcgugcaggcccagcugcgguccaaggaggucagcguggacguggccuccgcccagcgccugcuccgggagcaccaggaccugcuggaggagauccaccucuggcaggagcgccugcagcagcuggacgcgcagagccagcccauggccgcccucgacugcccggacucccaggagguccccaacacgcugcgggugcugggccagcaggggcaggagcucaaggugcugugggagcagcgccagcaguggcugcaggagggccucgagcugcagaaguucggccgggaggucgacggguucaccgcgaccugcgccaaccaccaggcguggcugcaccucgacaaccugggcgaggacgugcgcgaggcccugagccuccugcagcagcaccgggaguucgggcgccugcucuccacccugggcccccgggccgaggcccugcgcgcccacggggagaagcucgugcagagccagcaccccgcggcccacacgguccgcgagcagcugcaguccauccaggcccaguggacccggcugcagggccgcagcgagcagcggcgccggcagcuccuggccucccugcagcuccaggaguggaagcaggacguggccgagcugaugcaguggauggaggagaagggccugauggcggcccacgagccgagcggggcccgccggaacauccuccagacccugaagcgccacgaggccgccgaguccgagcugcucgcgacccggcgccacguggaggcccugcagcaggucggccgggagcugcucagccgccggcccugcgggcaggaggacauccagacgcgccugcagggccugcggagcaagugggaggcccucaaccgcaagaugaccgagcgcggggacgagcugcagcaggccggccagcaggagcagcugcuccgccagcugcaggacgcgaaggagcagcuggagcagcucgagggcgcccugcaguccagcgagaccgggcaggaccugcgguccagccagcgccuccagaagcgccaccagcagcuggaguccgagagccggacccuggccgccaagauggccgcgcucgccuccauggcccacggcauggccgccagccccgcgauccuggaggagacgcagaagcaccuccggcggcuggagcugcugcaggggcaccucgccauccgcggccugcagcugcaggccuccguggagcuccaccaguucugccaccugagcaacauggagcuguccuggguggccgagcacaugccccacggcagcccgaccuccuacaccgagugccucaacggggcccagagccugcaccggaagcacaaggagcugcaggucgaggugaaggcgcaccagggccagguccagcgcgugcucuccagcgggcggucccuggccgccagcggccacccccaggcccagcacaucguggagcagugccaggagcuggaggggcacugggcggagcucgagcgcgccugcgaggcccgggcccagugccugcagcaggccgucaccuuccagcaguacuuccuggacguguccgagcucgagggcuggguggaggagaagcgcccccuggucagcagccgggacuacggccgcgacgaggcggccacgcugcggcucaucaacaagcaccaggcccugcaggaggagcuggccaucuacugguccagcauggaggagcuggaccagaccgcccagacccucaccgggccggaggugcccgagcagcagcgcgugguccaggagcggcugcgcgagcagcugcgggcgcuccaggagcuggccgccacgcgcgaccgggagcuggagggcacccuccgccugcacgaguuccugcgggaggccgaggaccuccagggguggcuggccucccagaagcaggcggccaagggcggggagagccugggcgaggaccccgagcacgcccuccaccugugcaccaaguucgccaaguuccagcaccagguggagaugggcucccagcgcguggcggccugccgccugcucgccgagagccugcuggagcgggggcacuccgccggccccaugguccgccagcggcagcaggaccuccagaccgccuggagcgagcugugggagcugacgcaggcgcgcgggcacgcccuccgggacaccgagaccacccugcgcgugcaccgggaccugcucgaggugcugacgcagguccaggagaaggccaccucccugccgaacaacguggcccgcgaccucugcggccuggaggcccagcugcggagccaccaggggcucgagcgcgagcuggugggcaccgagcggcagcugcaggagcuccuggagaccgcgggccgcguccagaagcugugccccgggccccaggcccacgccgugcagcagcggcagcaggccgugacgcaggccugggcgguccuccagcgccggauggagcagcgccgggcccagcuggagcgcgcccggcugcucgcccgcuuccgcaccgccgugcgggacuacgcguccugggccgcccgcgugcggcaggaccugcaggucgaggagagcucccaggagcccagcuccggcccgcugaagcucagcgcccaccaguggcugcgcgcggagcuggaggcccgggagaagcucuggcagcaggccacccagcuggggcagcaggcccugcucgccgcgggcacccccacgaaggaggugcaggaggagcugcgcgcccugcaggaccagcgggaccagguguaccagaccugggcccgcaagcaggagcggcuccaggccgagcagcaggagcagcuguuccugcgcgagugcggccggcucgaggagauccuggccgcgcaggaggucucccugaagaccagcgcccucggguccagcguggaggagguggagcagcugauccgcaagcacgaggucuuccugaaggugcucaccgcccaggacaagaaggaggccgcccugcgggagcgccugaagacccuccggcgcccccgggugcgcgaccggcugcccauccugcuccagcgccggaugcgcgucaaggagcuggcggagagccgcggccacgcccugcacgccucccuccugauggccagcuucacgcaggcggccacccaggccgaggacuggauccaggccugggcccagcagcugaaggagccggugccgcccggggaccuccgggacaagcugaagccccugcucaagcaccaggcguucgaggccgaggugcaggcccacgaggaggucaugaccuccguggccaagaagggcgaggcccugcuggcgcagagccacccgcgcgccggggaggugucccagcggcuccagggccugcgcaagcacugggaggaccugcggcaggccauggcccuccgcggccaggagcuggaggaccggcgcaacuuccuggaguuccuccagcgggucgaccuggccgaggcguggauccaggagaaggaggugaagaugaacgugggggaccugggccaggaccucgagcacugccugcagcugcgccggcgccuccgggaguuccgcgggaacagcgccggcgacaccgucggggacgccugcauccgguccaucagcgaccugucccugcagcucaagaaccgcgaccccgaggaggugaagaucaucugccagcggcgcagccagcugaacaaccggugggccuccuuccacggcaaccugcuccgcuaccagcagcagcuggagggcgcccuggagauccacgugcugagccgcgagcucgacaacgucacgaagcggauccaggagaaggaggcgcugauccaggcccuggacugcgggaaggaccucgaguccgugcagcgccugcugcggaagcacgaggagcucgagcgcgaggugcaccccauccaggcccaggucgagagccuggagcgggaggugggccgccugugccagcggucccccgaggccgcgcacgggcuccgccaccggcagcaggagguggccgagagcugguggcagcugcgcucccgggcccagaagcgccgggaggcccuggacgcccuccaccaggcgcagaagcugcaggccaugcugcaggagcuccuggucagcgcccagcgccugcgggcccagauggacaccuccccggcgccccgcagccccguggaggcgcggcgcaugcucgaggagcaccaggagugcaaggccgagcuggacagcuggaccgacuccaucagccuggcccgguccaccggccagcagcuccugacggccgggcaccccuucagcuccgacauccgccagguccuggccggccucgagcaggagcugagcucccuggagggcgcguggcaggagcaccagcuccagcugcagcaggcccuggagcuccagcuguuccugagcuccguggagaagauggagcgguggcucugcagcaaggaggacucccuggccagcgaggggcugugggacccgcucgcccccauggagccccugcuguggaagcacaagaugcucgagugggaccuggaggugcaggcgggcaagaucuccgcccuggaggccaccgcccgcgggcuccaccagggcgggcaccccgaggcccagagcgcgcugggccgcugccaggccaugcugcuccggaaggaggcccuguuccgccaggccggcacccggcgccaccggcuggaggagcuccgccagcugcaggccuuccugcaggacucccaggaggucgcggccuggcuccgggagaagaaccugguggcccuggaggaggggcuccuggacaccgccaugcugccggcccagcuccagaagcagcagaacuuccaggcggagcuggacgccagcaugcaccagcagcaggagcugcagcgcgagggccagcggcuccugcagggcgggcaccccgccuccgaggccauccaggagcgccuggaggagcucggcgcgcuguggggcgagcugcaggacaacagccagaagaagguggccaagcuccagaaggccugcgaggcccugcggcugcgccgguccauggaggagcucgagaacuggcuggagcccaucgaggucgagcugcgcgccccgacggugggccaggcgcuccccggggugggcgagcugcuggggacccagcgggagcucgaggccgccgucgacaagaaggcccgccaggccgaggcgcugcugggccaggcccaggccuucgugcgggagggccacugccucgcccaggacguggaggagcaggcccgccggcugcugcagcgcuucaagagccuccgcgagccccugcaggagcggcgcaccgcgcuggaggcccggagccuccugcugaaguucuuccgcgacgccgacgaggagauggccuggguccaggagaagcucccccuggccgcggcccaggacuacgggcagucccugagcgccgugcggcaccuccaggagcagcaccagaaccuggaguccgagaugagcucccacgaggcccugacccgcgugguccucggcacgggguacaagcuggugcaggcgggccacuucgccgcccacgagguggccgcccggguccagcagcuggagaaggcgauggcccaccuccgcgccgaggccgcccggcgccggcuccugcugcagcaggcgcaggaggcccagcaguuccucaccgagcugcuggaggccgggagcuggcucgccgagcgcggccacgugcuggacuccgaggacaugggccacagcgccgaggcgacccaggcccugcuccggcgccuggaggccaccaagcgggaccuggaggccuucuccccgcgcaucgagcggcuccagcagacggcggcccugcuggagagccgcaagaaccccgagucccccaaggugcucgcccagcugcaggccguccgggaggcccacgcggagcugcuccgccgggccgaggcccgcgggcacggccugcaggagcagcugcagcuccaccagcuggagcgcgagacccugcuccuggacgccuggcugaccaccaaggccgcgacggccgagagccaggacuacgggcaggaccucgagggcgugaaggugcuggaggagaaguucgacgccuuccggaaggagguccagucccuggggcaggccaagguguacgcccuccgcaagcuggcgggcacccuggagcggggcgcgccccgccgguacccgcacauccaggcccagcgcagccggaucgaggccgcgugggagcgccucgaccaggccaucaaggcccggaccgagaaccuggccgccgcgcacgaggugcacuccuuccagcaggccgccgccgagcugcaggggcgcaugcaggagaagaccgcccucaugaagggcgaggacgggggccacagccuguccagcguccggacgcugcagcagcagcaccgccggcucgagcgcgagcuggaggcgauggagaaggagguggcccggcugcagaccgaggccugccgccucgggcagcugcaccccgccgcccccggcggccuggcgaaggugcaggaggccugggccacccuccaggccaaggcccaggagcgggggcaguggcuggcgcaggccgcccagggccacgccuuccuggggcgcugccaggagcuccuggcgugggcccaggagcggcaggagcuggccagcuccgaggagcucgccgaggacgucgccggcgcggagcagcugcugggccagcacgaggagcucgggcaggagauccgcgagugccgccugcaggcccaggaccugcggcaggagggccagcagcucguggacaacagccacuucauguccgccgaggugaccgagugccugcaggagcuggaggggcgccuccaggagcuggaggaggccugggcccugcgguggcagcgcugcgcggagagcuggggccuccagaagcugcggcagcgccuggagcaggccgaggccuggcucgccugcugggaggggcugcugcucaagcccgacuacggccacuccgucagcgacguggagcugcugcuccaccggcaccaggaccuggagaagcugcucgccgcgcaggaggagaaguucgcccagaugcagaagacggagauggagcaggagcugcugcuccagccgcaggagcugaagcccggccgcgccggguccagccugaccuccuuccaguggcggcccagcggccaccaggggcucggcgcccagcuggcggagacccgcgacccccaggacgccaaggggaccccgacgauggagggcucccuggaguucaagcagcaccuccugcccggcgggcggcagcccagcuccagcuccugggacagcugccgcggcaaccugcagggguccagccucucccuguuccuggacgagcggauggccgccgagaagguggccagcaucgcgcuccuggaccugaccggcgcccgcugcgagcggcuccgcgggcggcacggccgcaagcacaccuucagccugcggcugaccuccggcgccgagauccucuucgccgcccccagcgaggagcaggcggaguccugguggcgcgcccuggggagcaccgccgcccagucccugagcccgaagcugaaggccaagcccgucuccagccucaacgagugcacgaccaaggacgcgcggcccggcugccugcugcgcuccgaccccuga

SEQ ID NO: 37057 - RNA, 1422 nt, Artificial Sequence
  derived and/or modified sequence opt1 from SPTLC1__Homo_sapiens__NP_006406
auggccaccgccaccgagcagugggugcuggucgagauggugcaggcgcucuacgaggcccccgccuaccaccugauccuggagggcauccucauccuguggaucauccgccuccucuucagcaagacguacaagcugcaggagcgguccgaccugaccgugaaggagaaggaggagcucaucgaggaguggcagccggagccccuggucccgcccgugcccaaggaccaccccgcccugaacuacaacaucgugagcgggccgcccucccacaagaccgucgugaacggcaaggagugcaucaacuucgccagcuucaacuuccucgggcugcuggacaacccccgcgugaaggcggccgcccucgccucccugaagaaguacggcgucgggaccugcggcccccggggcuucuacgggacguucgacgugcaccuggaccucgaggaccgccuggcgaaguucaugaagaccgaggaggccaucaucuacagcuacggcuucgccaccaucgccuccgccauccccgcguacagcaagcgcggggacaucguguucgucgaccgggccgccugcuucgccauccagaagggccugcaggccucccggagcgacaucaagcuguucaagcacaacgacauggcggaccuggagcgccugcucaaggagcaggagaucgaggaccagaagaacccccggaaggcccgcgugacccggcgcuucaucguggucgaggggcuguacaugaacacgggcaccaucugcccgcugcccgagcucgugaagcugaaguacaaguacaaggcccggaucuuccuggaggagucccucagcuucggcgugcugggggagcacggccgcggggucaccgagcacuacggcaucaacaucgacgacaucgaccugaucuccgccaacauggagaacgcccucgcgagcaucggcggguucugcugcggccgguccuucgugaucgaccaccagcgccugagcgggcagggcuacugcuucuccgccagccugccgccccuccuggccgccgccgcgaucgaggcccugaacaucauggaggagaaccccgggaucuucgccgugcucaaggagaagugcggccagauccacaaggcccugcagggcaucuccgggcugaaggucgugggcgagagccucagccccgcguuccaccuccagcuggaggaguccaccgggagccgggagcaggacgugcgccugcugcaggagaucgucgaccagugcaugaaccgguccaucgcccugacgcaggcccgcuaccucgagaaggaggagaagugccugcccccgcccagcauccggguggucgugaccguggagcagaccgaggaggagcuggagcgcgccgccuccaccaucaaggaggucgcgcaggccgugcugcucuga

SEQ ID NO: 37058 - RNA, 1689 nt, Artificial Sequence
  derived and/or modified sequence opt1 from SPTLC2__Homo_sapiens__NP_004854
augcgccccgagccgggcgggugcugcugccggcgcaccgugcgggccaacggcugcgucgccaacggggaggugcgcaacggcuacgugcggagcuccgcggccgccgccgccgcggccgccgccgggcagauccaccacgucacccagaacggcggccuguacaagcgccccuucaacgaggcguucgaggagacgcccaugcucguggccgugcugaccuacgucggguacggcgugcugacccucuucggguaccugcgggacuuccugcgcuacuggcggaucgagaagugccaccacgccaccgagcgcgaggagcagaaggacuucgugagccucuaccaggacuucgagaacuucuacacgcggaaccuguacaugcgcauccgggacaacuggaaccgccccaucugcuccgucccgggcgcccggguggacaucauggagcgccagagccacgacuacaacugguccuucaaguacaccgggaacaucaucaagggcgugaucaacaugggcagcuacaacuaccugggguucgcccggaacaccggcuccugccaggaggcggccgccaagguccucgaggaguacggggccggcgugugcagcacccgccaggagaucggcaaccuggacaagcacgaggagcuggaggagcucguggcccgguuccugggggucgaggcggccauggccuacggcaugggguucgccacgaacuccaugaacauccccgcccuggugggcaaggggugccucauccugagcgacgagcugaaccacgcgucccucgugcugggcgcccgccugagcggcgccaccauccggaucuucaagcacaacaacaugcagucccucgagaagcugcugaaggacgccaucgucuacgggcagccccgcacccgccggcccuggaagaagauccucauccugguggagggcaucuacagcauggagggguccaucgugcgccugccggaggucaucgcccucaagaagaaguacaaggcguaccuguaccuggacgaggcccacagcaucggcgcccucgggcccaccggccggggcgugguggaguacuucgggcuggaccccgaggacgucgacgugaugaugggcacguucaccaaguccuucggggccagcggcggguacaucggcggcaagaaggagcugaucgacuaccuccgcacccacucccacagcgcggucuacgccaccagccuguccccgcccgugguggagcagaucaucacgagcaugaagugcaucauggggcaggacggcaccucccuggggaaggagugcguccagcagcucgccgagaacacccgguacuuccgccggcgccugaaggagaugggcuucaucaucuacggcaacgaggacagccccguggugccccugaugcucuacaugcccgccaagaucggggccuucggccgggagaugcugaagcgcaacaucggggucgugguggucggcuucccggcgacccccaucaucgagucccgggcccgcuucugccugagcgccgcccacacgaaggagauccucgacaccgcccugaaggagaucgacgaggugggggaccugcuccagcugaaguacucccggcaccgccuggugccccuccuggaccggcccuucgacgagaccaccuacgaggagacggaggacuga

SEQ ID NO: 37059 - RNA, 1659 nt, Artificial Sequence
  derived and/or modified sequence opt1 from SPTLC3__Homo_sapiens__NP_060797
auggccaaccccggcgggggcgccgugugcaacgggaagcugcacaaccacaagaagcagagcaacggcucccagagccgcaacugcaccaagaacgggaucgucaaggaggcgcagcagaacggcaagccgcacuucuacgacaagcucaucguggaguccuucgaggaggcgccccugcacgugauggucuucaccuacaugggcuacgggaucggcacgcuguucggguaccuccgggacuuccugcgcaacuggggcaucgagaagugcaacgccgccguggagcggaaggagcagaaggacuucgugccccuguaccaggacuucgagaacuucuacacccgcaaccucuacaugcggauccgcgacaacuggaaccggcccaucugcagcgccccggggccccuguucgaccugauggagcgcgucuccgacgacuacaacuggaccuuccgguucaccggccgcgugaucaaggacgugaucaacaugggcagcuacaacuuccucgggcuggccgccaaguacgacgaguccaugcggacgaucaaggacguccuggagguguacggcaccgggguggccagcacccgccacgagaugggcacccucgacaagcacaaggagcuggaggaccuggucgccaaguuccucaacguggaggcggccaugguguucggcaugggguucgccacgaacuccaugaacauccccgcccuggucggcaaggggugccugauccucagcgacgagcugaaccacaccucccuggugcucggcgcccggcugagcggggcgaccauccgcaucuucaagcacaacaacacccagucccuggagaagcuccugcgggacgccgugaucuacggccagccccgcacgcggcgcgccuggaagaagauccugauccucgucgagggcguguacagcauggagggguccaucgugcaccucccgcagaucaucgcccugaagaagaaguacaaggccuaccuguacaucgacgaggcgcacagcaucggcgccgucgggcccaccggccgcggggugaccgaguucuucggccuggacccccacgagguggacguccugaugggcaccuucacgaaguccuucggggccagcggcggguacaucgccggccggaaggaccucguggacuaccugcggguccacucccacagcgccguguacgcgagcuccaugagcccgcccaucgccgagcagaucauccgcucccugaagcucaucauggggcuggacggcaccacccagggccugcagcgcgugcagcagcucgccaagaacacccgguacuuccgccagcggcugcaggagaugggguucaucaucuacggcaacgagaacgccagcgucgugccccugcuccuguacaugcccgggaagguggccgcguucgcccgccacaugcuggagaagaagaucggcgucgugguggucggcuuccccgccacgccgcucgccgaggcgcgggcccgcuucugcguguccgccgcccacacccgggagaugcuggacaccgugcuggaggcccucgacgagaugggggaccugcugcagcugaaguacagccgccacaagaaguccgcgcggcccgagcucuacgacgagaccagcuucgagcuggaggacuga

SEQ ID NO: 37060 - RNA, 231 nt, Artificial Sequence
  derived and/or modified sequence opt1 from SPTSSB__Homo_sapiens__NP_001035189
auggaccugcgccgggugaaggaguacuucagcuggcucuacuaccaguaccagaucaucuccugcugcgccguccuggagcccugggagcgcagcauguucaacaccauccugcucaccaucaucgccauggugguguacacggcguacgucuucaucccgauccacauccggcuggccugggaguucuucuccaagaucugcggcuaccacagcaccaucuccaacuga

SEQ ID NO: 37061 - RNA, 2058 nt, Artificial Sequence
  derived and/or modified sequence opt1 from SPTY2D1__Homo_sapiens__NP_919261
auggacuuccgcgagauccugaugaucgccagcaagggccagggggugaacaacguccccaagcgguacucccucgccgugggcccgcccaagaaggaccccaaggugaaggggguccagagcgcggccgugcaggccuuccugaagcgcaaggaggaggagcugcggcgcaaggcccucgaggagaagcggcgcaaggaggagcuggugaagaagcggaucgagcugaagcacgacaagaaggcccgcgcgauggccaagcggaccaaggacaacuuccacggcuacaacgggauccccaucgaggagaaguccaagaagcgccaggccaccgagagccacacgucccagggcaccgaccgggaguacgagauggaggaggagaacgaguuccucgaguacaaccacgccgagagcgagcaggaguacgaggaggagcaggagccgcccaaggucgaguccaagcccaaggugccccucaagagcgcgccgccgcccaugaacuucaccgaccugcugcgccuggccgagaagaagcaguucgagcccguggagaucaaggucgugaagaaguccgaggagcggcccaugaccgccgaggagcugcgcgagcgggaguuccucgagcgcaagcaccggcgcaagaagcuggagacggacggcaagcugccgcccaccgugagcaagaaggcccccucccagaaggagagcgucgggaccaagcucuccaagggcagcggggaccggcaccccuccagcaagggcaugccccugccccacgccgagaagaagucccgccccagcauggcgaacgagaagcaccuggcccucuccagcagcaaguccaugccgggggagcggaucaaggccggcagcggcaacuccagccagcccucccugcgcgaggggcacgacaagcccguguucaacggcgccgggaagccccacagcuccaccagcuccccgagcgugcccaagacguccgccagccgcacccagaaguccgcggucgagcacaaggccaagaagucccugagccaccccagccacucccggcccggcccgauggugacgccccacaacaaggccaagagccccggcgugcgccagccgggguccagcagcuccagcgcccccggccagcccuccaccggggucgcccggcccaccgugagcuccggcccggugccccgccggcagaacgggagcuccagcuccggccccgagcgcagcaucuccggcagcaagaagcccaccaacgacuccaacccgagccggcgcaccgucuccgggaccugcggccccgggcagcccgcgagcuccagcggcgggcccggccggccgaucagcggcuccgugagcuccgcccgcccccucgggagcucccggggccccgggcgccccgugagcuccccgcacgagcugcggcgccccgucagcggccuggggccgcccggccgguccgugagcggccccgggcgcuccaucagcggcuccauccccgccgggcggacggucagcaacuccgugcccggccgccccgugagcucccucggcccggggcagaccgucagcuccagcggccccaccaucaagcccaagugcaccguggugagcgagacgaucuccagcaagaacaucaucucccggagcuccaacgggcagaugaacggcaugaagccgccccugagcggguaccgcgccgcccagggcccccagcgccugcccuucccgaccggcuacaagcggcagcgcgaguacgaggaggaggacgacgacgacgacgaguacgacuccgagauggaggacuucaucgaggacgagggggagccccaggaggagaucagcaagcacauccgggagaucuucggcuacgaccgcaagaaguacaaggacgaguccgacuacgcgcuccgguacauggagagcuccuggaaggagcagcagaaggaggaggccaagagccugcgccuggggaugcaggaggaccucgaggagaugcggcgcgaggaggaggagaugcagcggcgccgggccaagaagcugaagcgccgguga

SEQ ID NO: 37062 - RNA, 1293 nt, Artificial Sequence
  derived and/or modified sequence opt1 from SPZ1__Homo_sapiens__NP_115956
auggccagcuccgccaagagcgcggagaugcccaccaucuccaagaccgugaacccgacgcccgacccccaccaggaguaccuggacccccgcaucaccaucgcccucuucgagaucggcagccacuccccgagcuccugggggagccugcccuuccugaagaacuccagccaccaggucaccgagcagcagaccgcccagaaguucaacaaccuccugaaggagaucaaggacauccugaagaacauggccggcuucgaggagaagaucacggaggccaaggagcuguucgaggagaccaacaucaccgaggacguguccgcgcacaaggagaacauccgggggcucgacaagaucaacgagaugcugagcaccaaccuccccgugucccuggcccccgagaaggaggacaacgagaagaagcaggagaugauccuggagacgaacaucaccgaggacgucagcgcccacaaggagaacauccgcggccucgacaagaucaacgagaugcuguccaccaaccugccggugagccucgcccccgagaaggaggacaacgagaagaagcagcagaugaucauggagaaccagaacuccgagaacaccgcccagguguucgcgcgggaccuggucaaccgccuggaggagaagaaggugcucaacgagacgcagcagagccaggagaaggccaagaaccggcugaacgugcaggaggagaccaugaagauccgcaacaacauggagcagcugcuccaggaggccgagcacugguccaagcagcacaccgagcugagcaagcugaucaagagcuaccagaagucccagaaggacaucagcgagacccucgggaacaacggcgucggcuuccagacgcagcccaacaacgagguguccgccaagcacgagcuggaggagcaggucaagaagcugagccacgacaccuacucccuccagcugauggcggcccugcucgagaacgagugccagauccugcagcagcggguggagauccugaaggagcuccaccaccagaagcaggggacccugcaggagaagcccauccagaucaacuacaagcaggacaagaagaaccagaagccgagcgaggccaagaagguggagauguacaagcagaacaagcaggccaugaagggcaccuucuggaagaaggaccgcuccugccggagccuggacgugugccucaacaagaaggccugcaacacgcaguucaacauccacgucgcgcgcaaggcccugcgggggaagaugcgcuccgccagcucccugcgguga

SEQ ID NO: 37063 - RNA, 1725 nt, Artificial Sequence
  derived and/or modified sequence opt1 from SQLE__Homo_sapiens__NP_003120
auguggaccuuccugggcaucgccaccuucacguacuucuacaagaaguucggggacuucaucacccucgccaaccgcgaggugcugcugugcguccucguguuccugagccugggccucgugcuguccuaccggugccgccaccggaacgggggccugcucgggcgccagcagagcggcucccaguucgcgcuguucagcgacauccuguccggccuccccuucaucggguucuucugggccaagagcccgcccgaguccgagaacaaggagcagcuggaggcccggcgccggcgcaagggcaccaacaucagcgagaccucccugaucgggacggccgccugcaccagcaccuccagccagaacgaccccgaggucaucaucgugggcgcgggggugcucggcuccgcccuggccgccguccugagccgggacggccgcaaggugaccgugaucgagcgggaccucaaggagcccgaccgcaucgucggggaguuccugcagccgggcggguaccacgugcugaaggaccucggccugggcgacacgguggaggggcuggacgcgcaggucgugaacggcuacaugauccacgaccaggaguccaagagcgaggugcagauccccuacccccucuccgagaacaaccagguccagagcgggcgggccuuccaccacggccgcuucaucaugucccugcggaaggccgccauggccgagcccaacgcgaaguucaucgaggggguggugcugcagcuccuggaggaggacgacgucgugaugggcgugcaguacaaggacaaggagaccggcgacaucaaggagcugcacgccccgcucaccgucguggccgacgggcuguucagcaaguuccgcaagagccugguguccaacaaggucagcguguccagccacuucgucggcuuccucaugaagaacgcgccccaguucaaggccaaccacgccgagcugauccuggccaaccccucccccgugcucaucuaccagaucagcuccagcgagacccgggugcuggucgacauccgcggggagaugccgcggaaccugcgcgaguacaugguggagaagaucuacccccagauccccgaccaccucaaggagcccuuccuggaggccacggacaacucccaccuccggagcaugccggccuccuuccugccgcccagcuccgugaagaagcgcggcguccugcugcucggggacgccuacaacaugcgccacccccugaccggcggcgggaugaccguggcguucaaggacaucaagcuguggcggaagcuccugaagggcauccccgaccuguacgacgacgccgccaucuucgaggccaagaaguccuucuacugggcccgcaagaccagccacagcuucguggucaacauccuggcgcaggcccucuacgagcuguucuccgccacggacgacagccugcaccagcuccggaaggccugcuuccuguacuucaagcucgggggcgagugcguggcggggcccgugggccugcuguccguccugagccccaacccccucgugcugaucggccacuucuucgccguggccaucuacgccgucuacuucugcuucaagagcgagccguggaucaccaagccccgcgcccugcucuccagcggggcggugcuguacaaggccugcuccgugaucuucccccugaucuacagcgagaugaaguacaugguccacuga

SEQ ID NO: 37064 - RNA, 1353 nt, Artificial Sequence
  derived and/or modified sequence opt1 from SQRDL__Homo_sapiens__NP_067022
auggugccccuggucgccguggugagcggcccgcgcgcccagcuguucgcgugccuccugcggcucgggacccagcaggucggcccccugcagcugcacaccggggccucccacgccgcccgcaaccacuacgaggugcucgugcugggcgggggcagcggcgggaucacgauggccgcgcggaugaagcgcaaggucggcgccgagaacguggccaucguggagcccuccgagcggcacuucuaccagcccaucuggacccuggucggggccggcgcgaagcagcucagcuccagcgggcgcccgaccgccuccgugauccccagcggcguggaguggaucaaggcccgggucaccgagcugaaccccgacaagaacugcauccacacggacgacgacgagaagaucuccuaccgcuaccugaucaucgcccucggcauccagcuggacuacgagaagaucaaggggcugcccgagggcuucgcccacccgaagaucgggagcaacuacuccgugaagaccguggagaagaccuggaaggcgcuccaggacuucaaggagggcaacgccaucuucaccuuccccaacacgcccgucaagugcgccggcgcgccccagaagaucauguaccugagcgaggccuacuuccggaagaccgggaagcgcuccaaggccaacaucaucuucaacaccagccugggcgccaucuucggggugaagaaguacgccgacgcccuccaggagaucauccaggagcggaaccugaccgugaacuacaagaagaaccugaucgagguccgcgccgacaagcaggaggcgguguucgagaaccucgacaagccgggcgagacccaggugaucuccuacgagaugcugcacgucacgccgcccaugagcccgcccgacgugcugaagaccucccccguggccgacgccgccgggugggucgacguggacaaggagacccuccagcaccggcgcuaccccaacgucuucggcaucggcgacugcacgaaccugcccaccagcaagaccgccgcggccguggccgcccaguccgggauccuggaccggaccaucagcgugaucaugaagaaccagacgcccaccaagaaguacgacggcuacaccagcugcccccucgucaccggguacaaccgcgugauccuggcggaguucgacuacaaggccgagccccuggagacguuccccuucgaccaguccaaggagcggcucagcauguaccugaugaaggccgaccugaugccguuccucuacuggaacaugaugcugcgcggcuacuggggcgggcccgccuuccugcggaagcuguuccaccucggcauguccuga

SEQ ID NO: 37065 - RNA, 1071 nt, Artificial Sequence
  derived and/or modified sequence opt1 from SQSTM1__Homo_sapiens__NP_001135771
auggccaugagcuacgugaaggacgacaucuuccgcaucuacaucaaggagaagaaggagugccggcgcgaccaccggccgcccugcgcccaggaggcgccccgcaacaugguccaccccaacgugaucugcgacggcugcaacgggcccguggucggcacccgguacaagugcuccgugugccccgacuacgaccugugcagcgugugcgaggggaagggccuccaccgcgggcacaccaagcuggccuuccccucccccuucggccaccugagcgagggcuucucccacagccgguggcuccgcaaggucaagcacgggcacuucggcuggcccgggugggagaugggcccgcccgggaacuggagcccccggcccccgcgcgccggcgaggcccggcccggccccacggccgaguccgcguccgggcccagcgaggacccguccgugaacuuccugaagaacgugggcgagagcgucgccgccgcccugagcccccucgggaucgagguggacaucgacguggagcacggcggcaagcgcucccggcugacccccgucucccccgagagcuccagcaccgaggagaaguccagcagccagccguccagcugcugcuccgaccccagcaagcccgggggcaacguggagggggcgacccagucccuggccgagcagaugcgcaagaucgcccucgagagcgagggccggcccgaggagcagauggaguccgacaacugcagcgggggcgacgacgacuggacgcaccuguccagcaaggagguggacccguccaccggcgagcugcagagccuccagaugcccgaguccgaggggcccagcucccuggaccccagccaggagggcccgaccgggcugaaggaggccgcccucuacccccaccucccgcccgaggcggacccccgccugaucgagucccugagccagaugcuguccaugggcuucagcgacgagggcggguggcugacccggcuccugcagacgaagaacuacgacaucggcgccgcccuggacaccauccaguacagcaagcacccgccgccccucuga

SEQ ID NO: 37066 - RNA, 711 nt, Artificial Sequence
  derived and/or modified sequence opt1 from SRA1__Homo_sapiens__NP_001030312
augacccgcugccccgccggccaggccgagguggagauggcggagcuguacgucaagcccgggaacaaggagcggggcuggaacgacccgccccaguucagcuacgggcuccagacccaggccggcgggccccgccggagccugcugacgaagcgcguggccgcgccccaggacggcagcccccgggugcccgccuccgagaccagccccggcccgccgcccauggggcccccgccgcccuccagcaaggcgccccgcuccccgcccgucggcagcgggcccgccuccggcguggagcccaccagcuuccccguggaguccgaggccgucauggaggacgugcuccggccccuggagcaggcccuggaggacugccgcgggcacacccggaagcaggucugcgacgacaucagccgccggcucgcccugcugcaggagcagugggccggcggcaagcucuccauccccgugaagaagcgcauggcccugcuggugcaggagcucagcucccaccggugggacgccgccgacgacauccaccgcagccugaugguggaccacgucacggaggugucccaguggauggugggggucaagcggcugaucgcggagaagcgcagccucuucuccgaggaggccgccaacgaggagaaguccgccgccaccgcggagaagaaccacaccauccccggcuuccagcaggccagcuga

SEQ ID NO: 37067 - RNA, 2988 nt, Artificial Sequence
  derived and/or modified sequence opt1 from SRBD1__Homo_sapiens__NP_060549
augagcucccugccccgccgggccaaggugcagguccaggacguggugcucaaggacgaguucagcuccuucagcgagcuguccagcgccuccgaggaggacgacaaggaggacagcgcgugggagccgcagaagaaggucccccgcucccggaagcagcccccgcccaaggagagcaagcccaagcgcaugccccgggugaagaagaacgcgccccagaucuccgacggcagcgagguggucguggugaaggaggagcugaacuccagcgucgccaucgccgacaccgcccucgaggaccgcaagaacaagcuggacaccgugcagacgcugaagaccgccaagaccaagcagaagugcgccgcccagccgcacaccgugcggcgcacgaagaagcucaaggucgaggaggagaccuccaaggccagcaaccuggagggggaguccaacagcuccgagacccccagcaccagcacgguguggggcgggaccugcaagaaggaggagaacgacgacgacuucaccuucggccaguccgcgcugaagaagaucaagaccgagacguacccccaggggcagcccgugaaguucccggccaacgccaacagcaccaaggaggaggucgagaugaacugggacaugguccaggugcucuccgagcggaccaacaucgagcccugggugugcgccaacaucauccgccuguucaacgacgacaacaccauccccuucaucauccgguaccgcaaggagcugaucaacaaccucgacgccgacagccugcgggaggugcagcagacgcuggaggagcuccgcgcgguggccaagaagguccacuccaccauccagaagaucaagaaggagggcaagaugagcgagugccugcugaaggccaugcucaacugcaagaccuucgaggagcuggagcacguguccgcccccuacaagaccggcagcaaggggacgaaggcccagcgggcgcgccagcugggccucgagggggccgcccgggcccugcuggagaagccgggcgagcucucccugcugagcuacauccgccccgacgugaaggggcucuccacccugcaggacaucgagaucggcguccagcacauccuggccgacaugaucgcgaaggacaaggacacccucgacuucauccggaaccugugccagaagcgccacgugugcauccagagcucccuggccaaggucagcuccaagaaggugaacgagaaggacguggacaaguuccuccuguaccagcacuucagcugcaacauccggaacauccaccaccaccagauccuggccaucaaccgcggcgagaaccucaagguccugaccgugaaggugaacaucuccgacggggucaaggacgaguucugccgcuggugcauccagaaccgguggcgcccccggagcuucgcccgccccgagcugaugaagauccucuacaacucccugaacgacagcuucaagcggcugaucuacccgcuccugugccgcgaguuccgggccaagcugacgagcgacgcggagaaggaguccgugaugauguucggccgcaaccuccggcagcugcugcucaccagccccgugcccgggcgcacccugaugggcgucgaccccggcuacaagcacgggugcaagcuggccaucaucuccccgaccagccagauccugcacacggacgugguguaccuccacugcggccagggguuccgggaggccgagaagaucaagacccugcugcucaacuucaacugcuccaccgucgugaucggcaacgggaccgccugccgcgagacggaggcguacuucgccgaccugaucaugaagaacuacuucgcgccccuggacguggucuacugcaucgugagcgaggccggcgccuccaucuacagcgugucccccgaggccaacaaggagaugcccggccucgacccgaaccugcggagcgccgucuccaucgcccgccgggugcaggacccccuggccgagcucgugaagaucgagcccaagcacaucggggucggcauguaccagcacgacgugagccagacccugcugaaggccacccucgacuccguggucgaggagugcgugagcuucgugggggucgacaucaacaucugcuccgaggugcugcugcgccacaucgcgggccucaacgccaaccgggccaagaacaucaucgaguggcgcgagaagaacgggccguucaucaaccgggagcagcugaagaaggugaagggccugggccccaagagcuuccagcagugcgccggguucauccgcaucaaccaggacuacauccgcaccuucugcucccagcagacggagaccagcggccagauccagggggucgccgugaccagcuccgcggacguggaggucaccaacgagaagcagggcaagaagaaguccaagaccgccgugaacgugcuccugaagcccaacccccuggaccagacgugcauccacccggagagcuacgacaucgccaugcgguuccucagcuccaucgggggcacccuguacgaggucggcaagcccgagaugcagcagaagaucaacagcuuccuggagaaggaggggauggagaagaucgccgagcgccuccagaccaccgugcacacgcuccaggugaucaucgacggccugucccagcccgagagcuucgacuuccggaccgacuucgacaagcccgacuucaagcgcuccaucgucugccucgaggaccugcagaucgggaccgugcugaccggcaagguggagaacgcgacgcuguucggcaucuucgucgacaucggggugggcaagagcgggcugaucccgauccggaacgugaccgaggccaagcuguccaagaccaagaagcgccggagccucggccuggggcccggcgagcgcgucgagguccaggugcugaacaucgacaucccccggucccgcaucacccucgaccugauccgggugcuguga

SEQ ID NO: 37068 - RNA, 9693 nt, Artificial Sequence
  derived and/or modified sequence opt1 from SRCAP__Homo_sapiens__NP_006653
augcagagcucccccagcccggcccacccccagcugcccgugcuccagacccagauggucuccgacggcaugaccgggagcaaccccguguccccggccagcuccagcucccccgcgagcuccggcgccgggggcaucagcccccagcacaucgcccaggacuccagccuggacgggcccccgggcccccccgacggcgccacggugccccuggagggguucucccucagccaggccgcggaccuggccaacaagggcccgaagugggagaagucccacgccgagaucgccgagcaggcgaagcacgaggccgagaucgagacccgcaucgccgagcugcggaaggagggguucuggagccucaagcgccugcccaagguccccgagcccccgcggcccaagggccacugggacuaccugugcgaggagaugcaguggcucuccgccgacuucgcccaggagcgccgguggaagcgcgggguggcgcggaaggugguccgcauggugauccggcaccacgaggagcagcgccagaaggaggagcgggcccgccgggaggagcaggccaagcugcgccggaucgccagcaccauggccaaggacgugcgccaguucuggagcaacgucgagaagguggugcaguucaagcagcagucccggcuggaggagaagcgcaagaaggcgcucgaccugcaccuggacuucaucgucggccagaccgagaaguacagcgaccuccugucccagagccugaaccagccccucacguccagcaaggccggcuccagccccugccugggguccagcuccgccgccagcuccccgcccccccccgccagccggcuggacgacgaggacggcgacuuccagccgcaggaggacgaggaggaggacgacgaggagaccaucgagguggaggagcagcaggaggggaacgacgcggaggcccagcgccgggagaucgagcuccugcgccgcgagggcgagcugccccucgaggagcugcugcggucccuccccccccagcugcuggagggcccgagcucccccagccagacccccuccagccacgacagcgacacccgcgacgggccggaggagggcgccgaggaggagcccccccaggugcucgagaucaagcccccgcccuccgccgucacgcagcggaacaagcagcccuggcaccccgacgaggacgacgaggaguucaccgccaacgaggaggaggcggaggacgaggaggacaccaucgccgccgaggagcagcuggagggggagguggaccacgccauggagcugagcgagcucgcgcgcgagggcgagcuguccauggaggagcugcuccagcaguacgccggggccuacgccccgggcagcggcuccagcgaggacgaggacgaggacgagguggacgccaacuccagcgacugcgagcccgaggggcccgucgaggcggaggagcccccgcaggaggacuccagcucccagagcgacuccguggaggaccggagcgaggacgaggaggacgagcacuccgaggaggaggagaccagcggcuccagcgccagcgaggaguccgagagcgaggaguccgaggacgcccagagccagucccaggccgacgaggaggaggaggacgacgacuucgggguggaguaccugcuggcccgcgacgaggagcagagcgaggcggacgccggcuccgggccccccacgcccggcccgaccacccucggccccaagaaggagaucaccgacaucgccgccgccgcggagagccugcagcccaagggguacacgcuggccaccacccaggucaagacccccaucccgcuccugcugcggggccagcuccgcgaguaccagcacaucgggcuggacuggcuggugacgauguacgagaagaagcucaacggcauccuggccgacgagauggggcugggcaagaccauccagaccaucucccugcucgcccaccuggcgugcgagaagggcaacugggggccccaccugaucaucgugcccaccagcgucaugcucaacugggagauggagcugaagcgguggugccccuccuucaagauccugacguacuacggcgcccagaaggagcgcaagcucaagcggcagggguggaccaagccgaacgccuuccacgugugcaucaccagcuacaagcugguccugcaggaccaccaggccuuccgccggaagaacuggcgcuaccucauccuggacgaggcccagaacaucaagaacuucaagucccagcgguggcagagccugcucaacuucaacucccagcgccggcugcugcucaccggcacgccccugcagaacagccugauggagcucuggucccugaugcacuuccugaugccccacguguuccagagccaccgcgaguucaaggagugguucuccaacccgcucaccggcaugaucgaggggagccaggaguacaacgagggccuggugaagcggcugcacaagguccuccgccccuuccugcugcgccgggugaagguggacgucgagaagcagaugcccaagaaguacgagcacgugauccgcugccggcucagcaagcgccagcggugccuguacgacgacuucauggcgcagaccaccacgaaggagacccuggccaccgggcacuucauguccgugaucaacauccucaugcagcugcgcaaggucugcaaccaccccaaccuguucgacccgcggcccgugaccagccccuucaucacgcccggcaucugcuucuccaccgccagccucgugcugcgcgccaccgacguccacccgcugcagcggaucgacauggggcgcuucgaccucaucggccuggagggccgggugucccgcuacgaggccgacaccuuccugccccggcaccgccucagccggcgcgugcugcuggaggucgcgaccgcccccgaccccccgccccggcccaagcccgugaagaugaaggugaaccgcaugcuccagccgguccccaagcaggaggggcggacggugguggucgugaacaacccccgcgccccccugggcccggugcccguccggccccccccggggcccgagcuguccgcccagcccacccccggcccggugccccaggugcuccccgccagccugauggucuccgcgagcccggccgggcccccccugauccccgccucccgcccgcccggccccgugcuccugcccccgcugcagcccaacagcggcucccucccccaggugcugcccagcccgcuggggguccucuccggcaccagccgcccccccacccccacgcugucccugaagccgaccccccccgcccccgugcggcucagcccggcgcccccccccggguccagcagccugcugaagccgcucaccgugccccccggcuacaccuuccccccggccgccgccacgaccaccuccaccacgaccgccaccgcgaccacgaccgccguccccgcccccaccccggccccccagcgccugauccugagccccgacaugcaggcccggcuccccuccggggagguggugagcaucggccagcuggcgucccuggcccagcgcccggucgccaacgccggcgggagcaagccccucaccuuccagauccagggcaacaagcugacgcugaccggggcccaggugcggcagcucgcggugggccagccccgcccccugcagcggaacgucgugcaccugguguccgccgggggccagcaccaccucaucagccagccggcccacgucgcccugauccaggccguggcgcccacccccggccccaccccgguguccguccugcccagcuccacgcccagcaccacccccgccccgaccgggcucucccugccccuggccgccaaccaggugccccccacgauggugaacaacaccggcgucgugaagaucgugguccgccaggcgccgcgggacgggcucacccccgugcccccccuggccccggccccccgccccccgagcuccggccugcccgccguccucaacccccggcccacccugacgccgggccgccugcccacccccacccucgggaccgcccgggcgcccaugccgacgcccacccuggugcgcccccugcucaagcuggugcacagccccuccccggaggucagcgccuccgcccccggcgccgccccccugaccaucagcagcccccuccacgugccguccagccugcccgggcccgcguccagccccaugccgauccccaacuccagcccccuggccucccccgugagcuccaccgucagcgugccgcucuccagcucccugcccaucagcgugcccaccacgcugcccgccccggccuccgccccccugaccauccccaucagcgcgccgcucaccgucuccgccagcggccccgcccugcugaccuccgugacgcccccccucgccccggugguccccgcggcccccgggcccccgagccuggcccccagcggcgccucccccagcgccuccgcgcugacccucggccuggccaccgcccccagccuguccagcucccagaccccggggcacccccuccugcuggcccccacgagcucccacgugcccggccucaacagcaccguggccccggcgugcucccccguccuggugcccgccagcgcccuggccucccccuucccgagcgcccccaaccccgcgcccgcccaggccucccuccuggccccggcgagcuccgccagccaggcccuggccaccccccucgcccccauggcggccccccagaccgccauccuggccccgucccccgcccccccgcuggcgccccuccccgugcuggcccccagcccgggggccgcccccguccuggccagcucccagacgcccgugcccgugauggcgccgagcuccacccccggcaccagccucgccuccgccagccccguccccgccccgacccccgugcuggcccccuccagcacgcagaccaugcugcccgcgccggugcccuccccccuccccagcccggccuccacccagacccuggcccuggcccccgcgcucgcccccacgcuggggggcagcucccccagccagacccugucccucggcaccgggaacccgcagggccccuuccccacccagacgcugagccugacccccgccuccagccucgucccgacccccgcccagacccugagccuggcccccgggccgccccucggccccacgcagacccugucccuggcgcccgccccgccccucgcccccgccagccccguggggccggcccccgcgcacacccugacccuggcccccgccuccagcuccgccagccuccuggcccccgcguccgugcagacgcugacccucagcccggcccccguccccacccugggccccgccgccgcgcagacccuggcccucgccccggccuccacgcagagccccgccucccaggcgagcucccugguggugagcgccuccggcgccgccccccugcccgucaccauggugagccggcucccgguguccaaggacgagcccgacacccugacccugcgcagcgggccccccuccccgcccagcaccgccacgagcuucggcgggccccggccgcgccggcagcccccccccccgccccgcucccccuucuaccucgacagccuggaggagaagcgcaagcggcagcgcuccgagcggcuggagcgcaucuuccagcucagcgaggcgcacggcgcccuggcccccgucuacggcaccgaggugcuggacuucugcacccucccgcagcccguggccucccccaucgggccccggagcccgggccccucccaccccaccuucuggacguacaccgaggccgcgcaccgcgccguccuguucccccagcagcggcuggaccagcucagcgagaucaucgagcgcuucaucuucgugaugccgcccguggaggccccccccccgucccugcacgccugccaccccccccccuggcuggcgccgcggcaggccgccuuccaggagcagcucgccagcgagcuguggccccgcgcccggccccugcaccgcaucgucugcaacaugcggacccaguuccccgaccuccgccugauccaguacgacugcgggaagcugcagacccucgcggugcugcugcggcagcucaaggccgagggccaccgcgugcugaucuucacgcagaugacccggaugcuggacguccucgagcaguuccugaccuaccacgggcaccuguaccuccgccuggacggcuccacccggguggagcagcgccaggcccugauggagcgguucaacgccgacaagcgcaucuucugcuucauccucagcacgcgcuccggcggggugggcgucaaccugaccggggccgacaccgugguguucuacgacagcgacuggaacccgaccauggacgcgcaggcccaggaccggugccaccgcaucggccagacgcgggacguccacaucuaccgccugaucuccgagcggaccguggaggagaacauccucaagaaggccaaccagaagcgcaugcugggggacauggccaucgagggcggcaacuucaccaccgccuacuucaagcagcagacgauccgggagcuguucgacaugccccucgaggagcccagcuccagcuccgugccgagcgcgcccgaggaggaggaggagaccgucgccagcaagcagacccacauccuggagcaggcccugugccgcgccgaggacgaggaggacauccgggccgcgacccaggccaaggccgagcagguggccgagcucgcggaguucaacgagaacgacggguuccccgccggcgagggggaggaggccggccgccccggggccgaggacgaggagaugucccgggccgagcaggagaucgcggcccuggucgagcagcugacgccgaucgagcgcuacgccaugaaguuccucgaggccagccuggaggaggugucccgggaggagcugaagcaggccgaggagcagguggaggcggcccgcaaggaccuggaccaggccaaggaggaggucuuccggcucccccaggaggaggaggagggccccggcgccggggacgagagcuccugcggcaccgggggcgggacccaccgccggagcaagaaggccaaggcgcccgagcgcccgggcacccggguguccgagcgccugcgcggcgcccgggccgagacgcagggggccaaccacacccccgugaucagcgcgcaccagacccgcuccaccacgacccccccccggugcagcccggcccgcgagcgggucccccgccccgccccccggccgcgccccacccccgccuccgcccccgcggccaucccggcccuggugcccgugcccgucagcgcccccgugccgaucuccgcccccaaccccaucaccauccuccccgugcacauccugccgagcccccccccgcccucccagaucccccccugcagcuccccggcgugcacgcccccccccgccugcaccccgccccccgcccacacccccccgcccgcccagaccugccuggucacgcccagcuccccccuccugcugggcccgcccagcgugcccaucagcgccuccgugaccaaccucccccuggggcugcggccggaggcggagcucugcgcccaggcccuggccagccccgagucccuggagcucgccagcgucgcguccagcgagaccuccagccugucccuggugccccccaaggaccuccugccgguggccgucgagauccugcccgugagcgagaagaaccucucccugacccccagcgccccgucccugacccucgaggccggcagcauccccaacggccaggagcaggaggcgcccgacuccgccgaggggacgacccugaccgugcugcccgagggcgaggagcucccgcugugcgucagcgaguccaacgggcuggagcucccccccagcgccgccuccgacgagccccugcaggagccgcuggaggccgaccgcaccagcgaggagcucacggaggcgaagacccccaccagcucccccgagaagccccaggagcuggugaccgccgagguggccgccccgagcacguccagcuccgccaccagcucccccgagggccccagccccgcgcggccgccccgccggcgcaccuccgccgacgucgagauccgggggcagggcaccggccgccccgggcagcccccgggccccaaggugcugcggaagcuccccgggcgccuggugacggucguggaggagaaggagcuggugcggcgccggcgccagcagcgcggcgccgccagcacccucguccccgggguguccgagaccagcgccuccccgggcagccccuccgugcggagcauguccggccccgagagcucccccccgaucgggggccccugcgaggcggcccccagcagcucccugccgacccccccccagcagcccuucaucgcccgccggcacaucgagcugggggucacgggcgggggcagcccggagaacggcgacggggcccuccuggcgaucaccccccccgccgugaagcgccggcgcggccggcccccgaagaagaaccgcucccccgccgacgccgggcggggcguggacgaggcccccagcuccacccugaaggggaagaccaacggcgcggaccccgucccgggccccgagacgcucaucguggccgaccccgugcuggagccccagcugaucccggggccccagccccucggcccccagccgguccaccgccccaacccccugcugagccccguggagaagcggcgccgggggcgcccgcccaaggcccgggaccuccccauccccggcaccaucuccagcgccggcgacgggaacuccgagagccgcacccagccgcccccccacccguccccccugaccccccugcccccgcuccuggugugccccacggccaccgucgcgaacaccgugaccacggugaccaucagcaccuccccccccaagcggaagcgcggccggccgcccaagaacccccccagcccgcgccccucccagcugcccguccucgaccgcgacagcaccuccgugcuggagagcugcgggcugggccggcgccggcagccccaggggcagggcgagagcgagggcuccagcuccgacgaggacgggagccgcccgcucacgcggcuggcccgccugcggcucgaggccgagggcaugcgcgggcggaaguccggcgggagcaugguggucgccgugauccaggacgaccuggaccuggccgacuccggccccggcgggcucgagcugaccccccccguggucagccugaccccgaagcuccgcuccacccggcugcgccccggcagccuggugcccccccucgagacggagaagcugccgcggaagcgcgcgggggcccccgucggcgggucccccggccuggccaagcggggccgccuccagccgcccagcccccuggggcccgagggcuccguggaggagagcgaggccgaggcguccggggaggaggaggagggcgacggcaccccgcggcgccggcccgggccccgccggcuggugggcaccaccaaccagggggaccagcgcauccuccgcagcuccgcccccccgagccuggccggccccgccgucucccaccgggggcgcaaggccaagaccuga

SEQ ID NO: 37069 - RNA, 1611 nt, Artificial Sequence
  derived and/or modified sequence opt1 from SRC__Homo_sapiens__NP_005408
augggcagcaacaaguccaagcccaaggacgccagccagcgccggcgcucccuggagccggccgagaacgugcacggggcgggcgggggcgccuuccccgccagccagacccccuccaagcccgccagcgccgacgggcaccggggcccguccgcggccuucgcccccgccgcggccgagcccaagcuguucggcggguucaacagcuccgacaccgucacgagcccccagcgcgccggcccgcucgccgggggcgugaccaccuucguggcccuguacgacuacgagucccggaccgagacggaccucagcuucaagaagggggagcgccugcagaucgucaacaacaccgagggcgacugguggcuggcgcacucccucagcaccggccagaccggguacauccccuccaacuacguggcccccagcgacuccauccaggccgaggagugguacuucggcaagaucacgcggcgcgagagcgagcggcugcugcucaacgccgagaacccccgcgggaccuuccuggugcgggaguccgagaccaccaagggcgccuacugccugagcgucagcgacuucgacaacgcgaagggccucaacgugaagcacuacaagauccgcaagcuggacuccgggggcuucuacaucacgagccggacccaguucaacucccugcagcagcucguggccuacuacagcaagcacgccgacgggcugugccaccgccugaccaccgucugcccgacguccaagccccagacccagggccucgccaaggacgccugggagaucccccgggagagccugcgccuggaggugaagcucgggcagggcugcuucggcgagguguggauggggaccuggaacggcaccacgcgggucgcgaucaagacccugaagcccgggaccauguccccggaggccuuccugcaggaggcccaggugaugaagaagcuccgccacgagaagcuggugcagcuguacgccgucgugagcgaggagcccaucuacaucgugaccgaguacauguccaagggcagccuccuggacuuccugaagggggagacgggcaaguaccuccggcugccccagcuggucgacauggccgcgcagaucgccuccggcauggccuacguggagcgcaugaacuacgugcaccgggaccuccgcgccgcgaacauccuggucggggagaaccuggugugcaagguggccgacuucggccucgcccgccugaucgaggacaacgaguacaccgcccggcagggggccaaguuccccaucaaguggaccgcgccggaggccgcccuguacggccgcuucaccaucaagagcgacgucugguccuucgggauccuccugacggagcugaccaccaagggccgggugcccuaccccggcauggucaaccgcgaggugcucgaccagguggagcggggguaccgcaugcccugcccgcccgagugccccgagagccugcacgaccugaugugccagugcuggcggaaggagcccgaggagcgcccgaccuucgaguaccuccaggccuuccuggaggacuacuucacguccaccgagccccaguaccagcccggcgagaaccuguga

SEQ ID NO: 37070 - RNA, 3552 nt, Artificial Sequence
  derived and/or modified sequence opt1 from SRCIN1__Homo_sapiens__NP_079524
augggcaacgcccccagccaggacccggagcgcuccagcccccccaugcuguccgccgacgacgcggaguacccccgggaguaccgcacccucgggggcgggggcgggggcggcagcgggggccggcgcuucuccaacguggggcugguccacaccagcgagcggcgccacacggugaucgccgcccagucccuggaggcccucagcggccugcagaaggccgacgcggaccggaagcgcgacgccuucauggaccaccugaaguccaaguacccgcagcacgcccucgcccugcgggggcagcaggaccgcaugcgggagcagcccaacuacuggagcuucaagacccgcuccagccggcacacccagggcgcgcagcccggccuggccgaccaggccgccaagcucuccuacgccagcgcggagucccuggagaccaugagcgaggccgagcugccccucggguucucccgcaugaaccgguuccgccagagccugccgcugucccggagcgccagccagacgaagcuccgcucccccggcgugcuguuccugcaguucggggaggagacccggcgcguccacaucacccacgaggugagcucccucgacacccugcacgcccugaucgcccacauguucccccagaagcucacgaugggcaugcugaagagccccaacaccgcgauccugaucaaggacgaggcccggaacguguucuacgagcucgaggacguccgcgacauccaggaccgcuccaucaucaagaucuaccggaaggagccgcuguacgccgccuuccccggcagccaccugaccaacggggaccuccgccgggagaugguguacgccucccgcgagagcucccccacccggcgccugaacaaccugagccccgcgccgcaccucgccuccggcagccccccccccgggcugccguccggccugcccagcgggcuccaguccggcagccccucccggagccgccuguccuacgccggcgggcggcccccgagcuacgccggcagccccgugcaccacgccgcggagcgccuggggggcgcccccgccgcccagggggucucccccagcccguccgcgauccucgagcggcgcgacgugaagcccgacgaggaccuggccagcaaggccggcggcauggugcuggucaagggggagggccucuacgccgaccccuacgggcugcugcacgagggccggcucucccuggccgcggccgccggggacccguucgccuaccccggcgccggcgggcuguacaagcgcggcagcgugcggucccucagcacguacuccgcggccgcccugcagagcgaccuggaggacucccucuacaaggccgccgggggcggcgggccccuguacggcgacggguacggcuuccgccugcccccgagcuccccccagaagcuggcggacguggccgccccccccgggggcccgccccccccccacagcccguacuccggcccccccagccgggggucccccguccgccagagcuuccggaaggacagcggcuccagcuccguguucgccgagagcccggggggcaagacccgcuccgcggggagcgccuccaccgccggcgccccccccagcgagcucuuccccggcccgggggagcgcucccuggugggcuucgggccccccguccccgccaaggacaccgagacgcgggagcgcauggaggcgauggagaagcagaucgccagccugaccggccucgugcaguccgcccugcugcgggggagcgagccggagacccccuccgagaagaucgagggcagcaacggcgccgccacccccuccgcgccgugcgggagcggcgggcgcuccagcggcgccacgcccguguccgggccccccccgcccagcgccagcuccacccccgccggccagcccaccgccgucagccggcuccagaugcagcugcaccugcgcggccuccagaacuccgcgagcgaccugcgggggcagcugcagcagcuccgcaagcugcagcugcagaaccaggaguccgugcgggcccuccugaagcgcaccgaggccgagcugagcaugcggguguccgaggccgcgcgccggcaggaggacccgcuccagcgccagcggacgcuggucgaggaggagcgccugcgguaccucaacgacgaggagcugaucacccagcagcugaacgaccucgagaagagcguggagaagauccagcgcgacgucucccacaaccaccggcuggugcccggccccgagcuggaggagaaggcccucgugcugaagcagcugggggagacccucaccgagcugaaggcccacuuccccggccugcagagcaagaugcgcgucgugcuccggguggaggucgaggccgugaaguuccugaaggaggagccgcagcgccuggacggccuccugaagcgcugccggggggugacggacacccuggcccagauccgccggcaggucgacgagggcguguggcccccccccaacaaccuccugucccagagcccgaagaaggugaccgcggagaccgacuucaacaaguccgucgacuucgagaugcccccccccagcccgccccugaaccuccacgagcuguccgggcccgccgagggcgccagccugacgcccaaggggggcaacccgaccaagggccucgacacccccgggaagcgcuccguggacaaggccgugagcgucgaggccgcggagcgggacugggaggagaagcgcgccgcccugacccaguacuccgccaaggacaucaaccggcugcucgaggagacgcaggccgagcugcugaaggcgauccccgaccucgacugcgccagcaaggcccaccccggcccggcccccacccccgaccacaagccgcccaaggccccccacgggcagaaggcggccccccgcaccgagccgagcggccggcgcggguccgacgagcugaccgugccccgguaccgcaccgagaagcccagcaagucccccccgcccccccccccgcggcgcagcuuccccuccagccacggccugacgaccacccggaccggcgagguggucgugacguccaagaaggacagcgccuucaucaagaaggccgaguccgaggagcucgaggugcagaagccccaggucaagcugcgccgggcggugagcgagguggcccgccccgccuccaccccgcccaucauggccagcgccaucaaggacgaggacgacgaggaccggaucaucgcggagcuggaguccgggggcgggagcgucccccccaugaagguggugaccccgggcgccucccgccucaaggccgcccaggggcaggccggcagccccgacaaguccaagcacggcaagcagcgcgcggaguacaugcggauccaggcccagcagcaggccaccaagcccagcaaggagauguccgggagcaacgagacgagcucccccgucagcgagaagccguccgccagccgcaccuccauccccgugcugaccagcuucggcgcccggaacuccagcaucuccuucuga

SEQ ID NO: 37071 - RNA, 639 nt, Artificial Sequence
  derived and/or modified sequence opt1 from SRD5A1__Homo_sapiens__XP_011512405
auggagcacgccgcccagcccuggcgcuggcagcggcgccggggcuggcgccggagcgcgugcuggccgcgcucccccacgugcagcgcccccugggccgcccgguccagccgcgccaucgugcggcgcacccagugcaccgcggccacccggugccccgccaccggguccgagugccgccggggcccgcccggguggugccgcagcugcccccgguggcccugccgcuccaccagcacgccggccuccccgccccgggucagcgcggcccgccccaccgccuccagcuggcccugcuccagcuccaccaccggcaucggguucggccuguggcucacgggcaugcugaucaacauccacagcgaccacauccugcggaaccuccgcaagcccggggacaccggcuacaagaucccccgcgggggccuguucgaguacgugaccgccgccaacuacuucggggagaucauggaguggugcggcuacgcgcuggccuccuggagcgugcagggcgccgccuucgccuucuucaccuucugcuuccucuccgggcgggcgaaggagcaccacgagugguaccugcgcaaguucgaggaguaccccaaguuccggaagaucaucaucccguuccuguucuga

SEQ ID NO: 37072 - RNA, 747 nt, Artificial Sequence
  derived and/or modified sequence opt1 from SRD5A2__Homo_sapiens__XP_011531370
augcagguccagugccagcagagccccgugcuggccggcuccgccacccucguggcgcugggggcccuggcccucuacguggccaagccgagcggcuacgggaagcacaccgagucccugaagcccgccgcgacgcgccugcccgcccgggccgccugguuccuccaggagcugcccagcuucgcggucccggccggcauccuggcccgccagccccucucccuguucgggccgcccggcaccgugcugcucggccuguucugccugcacuacuuccaccggaccuucguguacagccuccugaaccgcgggcggcccuaccccgccauccugauccuccgcggcaccgccuucugcacggggaacggcguccugcagggguacuaccugaucuacugcgcggaguaccccgacggcugguacaccgacauccgguucucccucgccugccugcccguggugcuccuguucaucaccagcuggcugcaggacgucgacugcuccagccgccacuacaucuggcagucccggcaggaggagcgccggagccgcggcaccgggcuggccugcacguucuaccagaaguccaagcgguucccgcgcaagagccccaaccaggacuucacccuccaccugaucggcgggaccuccagcugcgacccccugucccagugcaaccucugcagcggcggcuggcagaagaagcggggguggaaccagcugcugcgcuacgagaccuccaucuga

SEQ ID NO: 37073 - RNA, 957 nt, Artificial Sequence
  derived and/or modified sequence opt1 from SRD5A3__Homo_sapiens__NP_078868
auggcccccugggccgaggcggagcacagcgcccugaacccgcuccgcgccguguggcugacccugaccgccgccuuccuccugacgcugcuccugcagcugcucccgcccggccugcugcccgggugcgcgaucuuccaggaccucauccgguacggcaagaccaagugcggggagcccucccgccccgccgccugccgggccuucgacguccccaagcgcuacuucagccacuucuacaucaucuccgugcuguggaacggcuuccugcucuggugccugacccagagccuguuccucggggcgcccuucccguccuggcugcacggccugcuccggauccugggcgccgcccaguuccagggcggggagcuggcccucagcgccuuccuggugcuggucuuccucuggcugcacucccugcgccgccucuucgagugccuguacgugagcguguucuccaacgucaugauccacguggugcaguacugcuucgggcuggucuacuacgugcucgugggccugaccguccugagccaggugcccauggacgggcggaacgcguacaucacgggcaagaaccuccugaugcaggcccggugguuccacauccugggcaugaugauguucaucugguccagcgcccaccaguacaagugccacgugauccucgggaaccugcgcaagaacaaggccggcgucgugauccacugcaaccaccggauccccuucggggacugguucgaguacguguccagccccaacuaccuggccgagcucaugaucuacgucuccauggcggugaccuucggcuuccacaaccugaccugguggcugguggucaccaacguguucuucaaccaggcccucagcgccuuccugucccaccaguucuacaagagcaaguucguguccuacccgaagcaccgcaaggccuuccugcccuuccucuucuga

SEQ ID NO: 37074 - RNA, 3534 nt, Artificial Sequence
  derived and/or modified sequence opt1 from SREBF1__Homo_sapiens__NP_001005291
auggacgagcccccguucagcgaggccgcccuggagcaggcgcucggcgagcccugcgaccuggacgccgcccugcucaccgacaucgagggggaggugggcgccgggcgcggccgggccaacgggcuggacgcgccccgcgccggcgccgaccggggcgccauggacugcaccuucgaggacaugcugcagcucaucaacaaccaggacuccgacuuccccgggcuguucgacccgcccuacgcgggcagcggggccggcgggacggaccccgccucccccgacaccagcuccccgggcagccugucccccccccccgccacccucagcuccagccuggaggccuuccuguccggcccgcaggcggcccccagcccccucucccccccgcagcccgcccccaccccccugaagauguacccgagcaugcccgccuucucccccgggcccggcaucaaggaggagagcgucccgcuguccauccuccagacgcccaccccccagccccugccgggggcccugcucccccagagcuuccccgcgccggcccccccccaguucuccagcacccccgugcugggcuacccgagcccccccggcggguucuccaccggcagccccccggggaacacgcagcagccccugcccggccucccccuggccuccccgcccggggugccccccgucagccugcacacccaggugcaguccguggucccgcagcagcuccugaccgugaccgccgcccccacggcggcccccgugaccaccaccgucacgagccagauccagcaggugcccgugcugcuccagccgcacuucaucaaggccgacucccugcugcucaccgccaugaagaccgacggcgccaccgucaaggcggccggccugagcccccugguguccgggacgaccgugcagaccggcccccuccccacccuggucagcgggggcacgauccuggccaccgugccgcucguggucgacgccgagaagcugcccaucaaccgccuggcggccggguccaaggcccccgccagcgcccagucccggggcgagaagcgcaccgcgcacaacgccaucgagaagcgguaccgcagcuccaucaacgacaagaucaucgagcucaaggaccugguggugggcaccgaggccaagcugaacaagagcgccguccuccggaaggccaucgacuacauccgcuuccugcagcacuccaaccagaagcugaagcaggagaaccucagccugcggacggcggugcacaaguccaagagccugaaggaccucgugagcgccugcggguccggcgggaacaccgacguccugauggagggcgugaagaccgaggucgaggacacccugacgccgccccccagcgacgccgggucccccuuccagagcuccccgcugagccucggcucccgcggcagcggguccggcgggagcggcuccgacagcgagcccgacucccccguguucgaggacagcaaggccaagcccgagcagcggccgucccugcacagccgcggcaugcuggaccggucccgccucgcccugugcacccugguguuccucugccugagcugcaacccccuggcgagccuccugggggcccggggccugcccucccccagcgacaccaccuccgucuaccacagcccggggcgcaacgugcucggcacggagucccgggacgggcccggcugggcccaguggcugcugccccccguggucuggcuccugaacggccugcucgugcuggugagccugguccuccuguucguguacggggagccggugacccgcccccacuccggccccgccgucuacuucuggcggcaccgcaagcaggcggaccuggaccucgcccgcggggacuucgcccaggccgcccagcagcuguggcuggcgcuccgggcccugggccgcccccugccgaccagccaccucgaccuggccugcucccugcucuggaaccugauccggcaccugcuccagcgccuguggguggggcgguggcuggccggccgcgccggcgggcuccagcaggacugcgcgcugcggguggacgccagcgccuccgcccgcgacgccgcgcuggucuaccacaagcuccaccagcugcacaccaugggcaagcacaccgggggccaccugacggccaccaaccucgcccugagcgcccugaaccucgcggagugcgccggggacgccguguccguggccacccuggccgagaucuacgucgcggccgcccugcgggugaagaccagccucccccgcgcccugcacuuccugacgcgguucuuccucuccagcgcccgccaggcgugccuggcccaguccggcagcgugccccccgccaugcaguggcugugccacccggucggccaccgguucuucguggacggggacugguccgugcucagcacccccugggagagccuguacucccuggccggcaaccccgucgacccccucgcccaggugacccagcuguuccgcgagcaccugcucgagcgggcgcugaacugcgugacccagccgaaccccagccccggguccgccgacggcgacaaggaguucagcgacgcccugggguaccuccagcugcugaacuccugcagcgacgccgccggcgcgccggccuacuccuucagcaucuccagcuccauggccacgaccaccggcgucgaccccguggccaaguggugggcgagccucaccgccguggucauccacuggcugcgccgggacgaggaggccgccgagcgccugugcccccucguggagcaccugccccgggugcugcaggaguccgagcgcccgcucccccgcgccgcgcugcacagcuucaaggccgcccgggcccugcucgggugcgccaaggcggaguccggccccgccagccugacgaucugcgagaaggccuccggguaccugcaggacagccucgccaccacccccgccuccagcagcaucgacaaggcgguccagcuguuccugugcgaccuccugcugguggugcgcaccucccucuggcggcagcagcagccgcccgcccccgcccccgccgcgcagggcacgagcucccgcccgcaggccagcgcccuggagcugcggggcuuccagcgcgaccucuccagccugcggcgccuggcccaguccuuccggcccgccaugcgccgggucuuccuccacgaggcgaccgcccgccugauggccggggccagccccacccggacccaccagcugcuggaccgcucccuccggcgccgggccggccccgggggcaaggggggcgcgguggccgagcuggagccgcgccccacgcggcgcgagcacgccgaggcccugcuccuggccagcugcuaccugccccccggcuuccucuccgcgccggggcagcgggugggcaugcuggccgaggccgcccgcacccuggagaagcucggggaccgccggcugcugcacgacugccagcagaugcucaugcgccugggcgggggcaccaccgucacgagcuccuga

SEQ ID NO: 37075 - RNA, 3426 nt, Artificial Sequence
  derived and/or modified sequence opt1 from SREBF2__Homo_sapiens__NP_004590
auggacgacagcggcgagcucgggggccuggagaccauggagacccugacggagcugggggacgagcucacccugggcgacaucgacgagaugcugcaguucguguccaaccaggucggggaguuccccgaccucuucagcgagcagcugugcuccagcuucccgggcuccggcgggagcggcuccagcuccgggagcuccggcagcuccagcuccagcuccaacgggcgcggcagcuccagcggcgccguggaccccagcgugcagcgguccuucacccaggucacccugcccagcuucucccccagcgccgcguccccgcaggcccccacgcuccaggugaaggugagccccaccuccguccccaccaccccgcgcgccacgcccauccugcagccccggccccagccgcagccccagccccagacccagcugcagcagcagaccgugaugaucacccccacguucagcaccaccccgcagacccgcaucauccagcagccccucaucuaccagaacgccgccacguccuuccaggugcugcagccccagguccagagccuggugaccuccagccaggugcagcccgucaccauccagcagcagguccagaccgugcaggcgcagcgggugcucacgcagaccgccaacgggacccugcagacccuggccccggccacggugcagaccguggcggcgccccagguccagcagguccccgugcucgugcagccccagaucaucaagaccgacucccuggugcugaccacgcucaagaccgacggcagcccggugauggccgccguccagaaccccgcccugaccgcgcugaccacgcccauccagaccgccgcccuccaggugcccacccuggucggguccagcggcaccauccugacgaccaugccggugaugaugggccaggagaaggugcccaucaagcagguccccgggggcgugaagcagcucgagccgcccaaggagggggagcgccggaccacccacaacaucaucgagaagcgcuaccgguccagcaucaacgacaagaucaucgagcugaaggaccuggugaugggcaccgacgccaagaugcacaaguccgggguccuccgcaaggccaucgacuacaucaaguaccugcagcaggucaaccacaagcugcggcaggagaacauggugcucaagcuggcgaaccagaagaacaagcugcucaagggcaucgaccugggcagccugguggacaacgagguggaccucaagaucgaggacuucaaccagaacgugcugcugaugagcccgcccgccuccgacagcgggucccaggccggcuucagccccuacuccaucgacagcgagcccgggagcccccuccuggacgacgccaaggucaaggacgagcccgacuccccgcccguggcccugggcaugguggaccgcucccggauccuccugugcguccugacguuccucugccugagcuucaacccccugaccucccugcuccaguggggcggggcgcacgacagcgaccagcacccccacuccggcagcgggcgcuccgugcugagcuucgaguccggcagcgggggcugguucgacuggaugaugccgacccugcuccuguggcuggugaacggggucaucgugcucagcguguucgucaagcugcuggugcacggcgagcccgugauccggccccacucccgcagcuccgucaccuucuggcggcaccgcaagcaggccgaccucgaccuggcccggggcgacuucgccgccgcggccgggaaccugcagacgugccucgccgugcugggccgcgcccugcccaccagccggcucgaccuggcgugcucccugagcuggaacgugauccgcuacucccuccagaagcugcgccugguccgguggcuccugaagaagguguuccagugccgccgggccaccccggccaccgaggccggguucgaggacgaggccaagacgagcgcgcgcgacgccgcccuggccuaccaccggcuccaccagcugcacaucaccggcaagcugcccgccggcuccgcgugcagcgacgugcacauggcccucugcgccgucaaccuggccgagugcgccgaggagaagaucccgcccuccacccugguggagauccaccucaccgcggccauggggcugaagacgcgcugcggcgggaagcugggcuuccucgccagcuacuuccugucccgggcccagagccugugcgggcccgagcacuccgcggugcccgacagccuccgcuggcugugccacccccugggccagaaguucuucauggagcgguccuggagcgucaaguccgccgccaaggagagccucuacugcgcccagcgcaaccccgccgacccgaucgcccaggugcaccaggccuucugcaagaaccugcuggagcgggccaucgagagccucgugaagccccaggccaagaagaaggccggcgaccaggaggaggaguccugcgaguucagcuccgcgcuggaguaccugaagcuccugcacagcuucgucgacuccgugggggugaugagcccgccccugucccgcagcuccguccucaagagcgcccugggccccgacaucaucugccggugguggaccuccgccaucaccguggccaucagcuggcugcagggggacgacgccgcggugcgcucccacuucaccaaggucgagcggauccccaaggcccucgaggugacggagagcccccuggugaaggccaucuuccacgccugccgcgcgaugcacgccucccugccgggcaaggccgacgggcagcagagcuccuucugccacugcgagcgggccagcggccaccucugguccagccugaacgucagcggcgccaccuccgaccccgcgcugaaccacguggugcagcuccugaccugcgaccugcuccugagccugcgcaccgcccucuggcagaagcaggccuccgccagccaggccgucggggagacguaccacgcguccggcgccgagcuggccggguuccagcgggaccugggcagccuccgccgccuggcccacuccuuccggcccgccuaccgcaagguguuccugcacgaggcgaccgugcggcucauggccggggccagccccacccgcacccaccagcugcuggagcacucccuccggcgccggacgacccagagcaccaagcacggcgaggucgacgccuggccgggccagcgcgagcgggccaccgcgauccugcuggccugccgccaccucccccuguccuuccugagcucccccgggcagcgggccgugcuccuggccgaggcggcccgcacgcuggagaaggucggcgaccggcgcagcugcaacgacugccagcagaugaucgugaagcucgggggcgggaccgccaucgccgccuccuga

SEQ ID NO: 37076 - RNA, 1875 nt, Artificial Sequence
  derived and/or modified sequence opt1 from SREK1__Homo_sapiens__NP_001070667
augaacagcggcgggggcuucgggcugggccucggguucggccugacccccaccuccgugauccaggucacgaaccugagcuccgccgugaccagcgagcagaugcgcacccucuucuccuuccugggcgagaucgaggagcugcggcucuacccgcccgacaacgcgccccuggccuucagcuccaaggugugcuacgucaaguuccgcgaccccagcuccguggggguggcccagcaccugaccaacacggucuucaucgaccgggcccucaucguggugccgugcgccgagggcaagauccccgaggagagcaaggcccugucccugcucgcccccgcccccaccaugaccagccugaugccgggggccggccugcuccccauccccacccccaacccgcugacgacccugggggucucccucagcucccugggcgccauccccgcggccgcccuggaccccaacaucgccacccucggcgagaucccccagccgccccugauggggaacguggaccccagcaagaucgacgagauccgccggaccguguacgucggcaaccugaacucccagacgaccaccgccgaccagcuccuggaguucuucaagcaggucggggaggugaaguucgugcgcauggcgggcgacgagacccagcccacgcgguucgccuucguggaguucgccgaccagaacagcgugccgcgcgcccuggccuucaacggcgucauguucggggaccggccccucaagaucaaccacuccaacaacgcgaucgugaagccgcccgagaugacgccccaggccgccgccaaggagcuggaggaggugaugaagcgcguccgggaggcccagagcuucaucagcgcggccaucgagcccgaguccggcaagagcaacgagcgcaagggcgggcggucccgcagccacacccgguccaagagccgcuccagcuccaagagccacucccggcgcaagcggagccaguccaagcaccgcagccggucccacaaccgcagccgcucccggcagaaggaccgccggcgcagcaagagcccccacaagaagcggagcaagagccgcgagcggcgcaagucccggagccgcucccacagccgggacaagcgcaaggacacccgggagaagaucaaggagaaggagcgcgugaaggagaaggaccgggagaaggagcgcgagcgggagaaggagcgcgagaaggagaaggagcgggggaagaacaaggaccgcgacaaggagcgcgagaaggaccgggagaaggacaaggagaaggaccgcgagcgggagcgcgagaaggagcacgagaaggaccgggacaaggagaaggagaaggagcaggacaaggagaaggagcgcgagaaggaccgguccaaggagaucgacgagaagcgcaagaaggacaagaagucccggacgcccccgcgcuccuacaacgccagccggcgcucccggagcuccagccgcgagcggcgccggcgccggucccgcagcuccagccggagcccccgcaccuccaagaccaucaagcgcaagagcucccggagccccuccccgcgcagccggaacaagaaggacaagaagcgcgagaaggagcgggaccacaucuccgagcgccgggagcgcgagcggagcaccuccaugcgcaagagcuccaacgaccgggacggcaaggagaagcuggagaagaacagcaccucccucaaggagaaggagcacaacaaggagcccgacagcuccgugagcaaggaggucgacgacaaggacgcgccccgcaccgaggagaacaagauccagcacaacggcaacugccagcugaacgaggagaaccuguccaccaagaccgaggccguguga

SEQ ID NO: 37077 - RNA, 468 nt, Artificial Sequence
  derived and/or modified sequence opt1 from SREK1IP1__Homo_sapiens__NP_776190
auggccgugcccggcugcaacaaggacagcguccgcgccgggugcaagaagugcggcuacccggggcaccugaccuucgagugccggaacuuccuccgcguggaccccaagcgggacaucgugcuggacgucuccagcaccuccagcgaggacuccgacgaggagaacgaggagcugaacaagcuccaggcgcugcaggagaagcgcaucaacgaggaggaggagaagaagaaggagaaguccaaggagaagaucaagcugaagaagaagcggaagcgcagcuacagcuccagcuccacggaggaggacaccagcaagcagaagaagcagaaguaccagaagaaggagaagaagaaggagaagaaguccaagagcaagaagggcaagcaccacaagaaggagaagaagaagcggaagaaggagaagcacuccagcacccccaacuccagcgaguucucccgcaaguga

SEQ ID NO: 37078 - RNA, 1290 nt, Artificial Sequence
  derived and/or modified sequence opt1 from SRFBP1__Homo_sapiens__NP_689759
auggcccagcccggcacccugaaccucaacaacgagguggucaagaugcgcaaggaggugaagcggauccgcgugcuggucauccggaagcuggugcgcagcguggggcggcucaaguccaagaagggcaccgaggacgcccugcugaagaaccagcgccgggcgcagcgccuccuggaggagauccacgccaugaaggagcugaagccggacaucgucaccaagagcgcccucggggacgacaucaacuucgagaagaucuucaagaagcccgacuccacggccaccgagcgggccaucgcgcgccuggccgugcacccccugcucaagaagaagaucgacgugcugaaggccgccguccaggcguucaaggaggcccggcagaacguggccgagguggagagcuccaagaacgccagcgaggacaaccacuccgagaacacccuguacagcaacgacaacggcuccaaccuccagcgcgaggccacggucaucagcgagcagaaggugaaggagaccaagauccuggcgaagaagcccauccacaacuccaaggagaagaucgccaagauggagcacgggccgaaggccgugaccaucgccaacagccccuccaagcccagcgagaaggacuccgucgugagccuggagucccagaagacccccgccgacccgaagcucaagacgcugagccagaccaagaagaacaagggcuccgacagcagccuguccggcaacagcgacgggggcgaggaguucugcgaggaggagaaggaguacuucgacgacuccaccgaggagcgguucuacaagcagagcuccaugagcgaggacuccgacagcggggacgacuucuucaucggcaaggugcgccggacccgcaagaaggaguccagcugccacuccagcgucaaggagcagaagccccucgagaagguguuccugaaggaggacacgggggagacccacggcgacacccggaacgacaagaucaagcccuccaccgagacgcgcaagcuggagagcguguucuuccacucccucagcggcuccaagagcucccggcgcaacuucaaggagcaggcgcccaagacccggagccuggacuucccgcagaacgagccccagaucaagaaccaguucaacaagaagcugagcgggcgccucgagaacaccaagcagcagcugcagcugccccuccaccccuccugggaggccagccgccggcgcaaggagcagcaguccaacaucgccgucuuccagggcaagaagaucaccuucgacgacuga

SEQ ID NO: 37079 - RNA, 915 nt, Artificial Sequence
  derived and/or modified sequence opt1 from SRF__Homo_sapiens__NP_001278930
augaucaccagcgagaccggcaaggcccugauccagacgugccucaacucccccgacagcccgccccgcuccgaccccaccaccgaccagcggaugagcgccaccggguucgaggagacggaccugaccuaccagguguccgagagcgacuccagcggcgagaccaaggacacccugaagcccgcguucacggucaccaaccucccggggaccaccuccacgauccagaccgcccccagcaccuccaccacgaugcaggucagcuccggccccagcuuccccaucaccaacuaccuggccccgguguccgccagcgugucccccagcgccguguccagcgcgaacgggaccgugcucaagagcaccggcuccggccccgucagcuccgggggccugaugcagcugcccacgagcuucacccugaugcccgggggcgccguggcccagcaggucccggugcaggccauccaggugcaccaggcgccccagcaggccucccccagccgcgacuccagcaccgaccucacccagacguccagcuccgggaccgugacccugccggccaccaucaugacgagcuccguccccaccaccgugggcggccacaugauguaccccagcccccacgccgugauguacgccccgaccuccgggcugggcgacgggagccucacgguccugaacgcguucucccaggcccccagcaccaugcaggucucccacagccaggugcaggagcccggcggcgugccccagguguuccugaccgccagcuccgggaccgugcagaucccggucagcgccgugcagcuccaccagauggccgugaucggccagcaggcgggguccagcuccaaccugacggagcugcaggucgugaaccucgacaccgcccacagcaccaaguccgaguga

SEQ ID NO: 37080 - RNA, 3258 nt, Artificial Sequence
  derived and/or modified sequence opt1 from SRGAP1__Homo_sapiens__NP_065813
augagcacccccucccgcuucaagaaggacaaggagaucaucgccgaguacgagagccaggugaaggagauccgggcccagcuggucgagcagcagaagugccucgagcagcagaccgagaugcgcgugcagcugcugcaggaccuccaggacuucuuccggaagaaggcggagaucgagacggaguacucccgcaaccuggagaagcuggccgagcgguucauggccaagacccgcagcaccaaggaccaccagcaguacaagaaggaccagaaccuccugucccccgugaacugcugguaccugcuccugaaccagguccggcgcgagagcaaggaccacgccacccuguccgacaucuaccucaacaacgugaucaugcgguucaugcagaucagcgaggacuccacgcgcauguucaagaaguccaaggagaucgccuuccagcugcacgaggaccugaugaaggugcucaacgagcuguacaccgucaugaagaccuaccacauguaccacgcggaguccaucagcgccgaguccaagcugaaggaggccgagaagcaggaggagaagcagaucggccggagcggggaccccguguuccacauccgccucgaggagcggcaccagcgccgguccagcgugaagaagaucgagaagaugaaggagaagcgccaggccaaguacuccgagaacaagcucaagagcaucaaggcgcggaacgaguaccugcucacccuggaggccacgaacgccuccgucuucaaguacuacauccacgaccugagcgaccucaucgacugcugcgaccugggcuaccacgccagccugaaccgcgcccuccggaccuaccuguccgcggaguacaaccuggagaccagccgccacgaggggcucgacaucaucgagaacgccguggacaaccuggagccccgguccgacaagcagcgcuucauggagauguaccccgccgccuucugcccgcccaugaaguucgaguuccagagccacaugggcgacgaggugugccaggucuccgcccagcagcccgugcaggcggagcugaugcuccgcuaccagcagcugcagagccggcuggccacccugaagaucgagaacgaggaggugaagaagacgaccgaggccacccugcagaccauccaggacauggucacgaucgaggacuacgacgugagcgagugcuuccagcacagccgcuccaccgagagcgugaaguccaccgucagcgagaccuaccuguccaagcccagcaucgccaagcggcgcgccaaccagcaggagacggagcaguucuacuucaugaagcuccgggaguaccuggagggguccaaccugaucaccaagcuccaggcgaagcacgaccugcugcagcgcacccucggcgagggccaccgggccgaguacaugaccacgcgcccgcccaacgugccgcccaagccccagaagcaccgcaagagccggccccggucccaguacaacaccaagcuguucaacggggaccuggagaccuucgugaaggacagcggccaggucaucccccucaucguggaguccugcauccgcuucaucaaccuguacgggcugcagcaccagggcaucuuccgggugagcgggagccaggucgaggugaacgacaucaagaacuccuucgagcgcggcgagaacccccuggccgacgaccagagcaaccacgacaucaacuccgucgccggcgugcucaagcuguacuuccgggggcuggagaacccccucuucccgaaggagcgcuucaacgaccugaucagcugcauccggaucgacaaccuguacgagcgcgcccuccacauccggaagcugcugcucacccugccccgcuccgugcugaucgucaugcgcuaccucuucgcguuccugaaccaccugagccaguacuccgacgagaacaugauggaccccuacaaccucgccaucugcuucggcccgacgcugaugcccgugcccgagauccaggaccaggugagcugccaggcccacgucaacgagaucaucaagaccaucaucauccaccacgagaccaucuuccccgacgccaaggagcuggacgggccgguguacgagaagugcauggcgggcgacgacuacugcgacucccccuacagcgagcacggcacccucgaggagguggaccaggacgccgggacggagccccacaccuccgaggacgagugcgagcccaucgaggccaucgccaaguucgacuacgucggccggagcgcccgcgagcuguccuucaagaagggggcgagccugcuccuguaccaccgggccuccgaggacuggugggagggccgccacaacgggaucgacggccuggugccgcaccaguacaucgugguccaggacauggacgacaccuucagcgacacccucucccagaaggccgacagcgaggccagcuccggccccgugacggaggacaagagcuccagcaaggacaugaacucccccaccgaccggcacccggacggguaccuggcccgccagcggaagcgcggcgagcccccgccgcccgugcggcgccccgggcggaccagcgacggccacugcccccugcacccgccccacgcgcucuccaacagcuccgucgaccuggggagccccucccuggccagccacccccgcggccuccugcagaaccggggccugaacaacgacucccccgagcgccggcgccggcccgggcacggcagccucaccaacaucucccgccacgacagccugaagaagaucgacuccccgcccauccggcgcagcaccuccagcgggcaguacacgggcuucaacgaccacaagccccuggaccccgagaccaucgcccaggacaucgaggagaccaugaacaccgcccucaacgagcugcgggagcuggagcgccagagcacggccaagcacgcgcccgacguggugcucgacacccuggagcaggucaagaacucccccacccccgccaccagcacggagucccugagcccgcuccacaacguggcccugcgcuccagcgagccccagauccggcgcuccaccagcuccagcuccgacaccaugagcaccuucaagcccaugguggcgccccggauggggguccagcugaagccgcccgcccuccgccccaagccggccgugcugcccaagacgaaccccaccaucggccccgccccgccgccccagggccccaccgacaaguccugcaccauguga

SEQ ID NO: 37081 - RNA, 2370 nt, Artificial Sequence
  derived and/or modified sequence opt1 from SRGAP2__Homo_sapiens__NP_001287881
augaccagccccgccaaguucaagaaggacaaggagaucaucgccgaguacgacacccaggugaaggagauccgcgcgcagcugacggagcagaugaagugccucgaccagcagugcgagcugcggguccagcugcuccaggaccugcaggacuucuuccgcaagaaggccgagaucgagauggacuacucccggaaccuggagaagcucgccgagcgcuuccuggccaagacccggagcaccaaggaccagcaguucaagaaggaccagaacgugcuguccccggugaacugcuggaaccuccugcugaaccaggucaagcgcgagagccgggaccacaccacgcucuccgacaucuaccugaacaacaucaucccccgcuucguccaggugagcgaggacuccggccggcuguucaagaaguccaaggagguggggcagcagcuccaggacgaccugaugaaggugcugaacgagcucuacagcgugaugaagaccuaccacauguacaacgccgacagcaucuccgcgcagagcaagcugaaggaggccgagaagcaggaggagaagcagaucggcaaguccgucaagcaggaggaccgccagacgccccggagccccgacuccaccgccaacgugcgcaucgaggagaagcacgugcggcgcagcuccgucaagaagaucgagaagaugaaggagaagcggcaggccaaguacaccgagaacaagcugaaggcgaucaaggcccgcaacgaguaccuccuggcccuggaggccaccaacgccagcguguucaaguacuacauccacgaccucuccgaccugaucgacugcugcgaccugggguaccacgcgagccucaaccgggcccugcgcaccuuccugagcgccgagcucaaccuggagcaguccaagcacgagggccuggacgccaucgagaacgccguggagaaccucgacgcgaccagcgacaagcagcggcugauggagauguacaacaacgucuucugcccgcccaugaaguucgaguuccagccccacaugggggacauggccucccagcugugcgcccagcagcccgugcagagcgagcucgugcagcgcugccagcagcugcagucccggcugagcacgcucaagaucgagaacgaggaggucaagaagaccauggaggccacccugcagaccauccaggacaucgugacgguggaggacuucgacgucuccgacugcuuccaguacagcaacuccauggagagcgugaaguccaccgugagcgagaccuucauguccaagccgagcaucgccaagcgccgcgcgaaccagcaggagaccgagcaguucuacuucacgaagaugaaggaguaccuggagggccggaaccucaucaccaagcugcaggccaagcacgaccugcuccagaagacccugggcgagucccagcgcaccgacugcagccuggcccggcgcuccagcacgguccggaagcaggacuccagccaggccaucccccucguggucgagagcugcauccgcuucaucucccggcacgggcugcagcacgagggcaucuuccgcgugagcgggucccagguggaggucaacgacaucaagaacgccuucgagcggggcgaggacccccuggcgggggaccagaacgaccacgacauggacagcaucgccggcgugcugaagcucuacuuccgcggccuggagcacccccuguucccgaaggacaucuuccacgaccucauggccugcgugaccauggacaaccugcaggagcgggcccugcacauccgcaagguccuccuggugcugcccaagaccacccucaucaucaugcgguaccuguucgcguuccugaaccaccucucccaguucagcgaggagaacaugauggaccccuacaaccuggccaucugcuucgggcccucccugaugagcgugccggagggccacgaccaggucuccugccaggcccacgugaacgagcucaucaagacgaucaucauccagcacgagaacaucuuccccagcccccgcgagcuggaggggcccguguacucccggggcggcagcauggaggacuacugcgacuccccgcacggggagaccaccagcgucgaggacuccacccaggacgugacggccgagcaccacaccagcgacgacgagugcgagcccaucgaggccaucgcgaaguucgacuacgugggccgcaccgcccgggagcuguccuucaagaagggggccagccuccugcuguaccagcgcgccagcgacgacuggugggagggccggcacaacgggaucgacggccucaucccccaccaguacaucgucgugcaggacacccugaucuccuga

SEQ ID NO: 37082 - RNA, 3228 nt, Artificial Sequence
  derived and/or modified sequence opt1 from SRGAP3__Homo_sapiens__NP_001028289
augagcucccagaccaaguucaagaaggacaaggagaucaucgccgaguacgaggcccagaucaaggagauccgcacccagcugguggagcaguucaagugccucgagcagcagagcgagucccggcugcagcugcuccaggaccugcaggaguucuuccgccggaaggcggagaucgagcuggaguacagccgcucccucgagaagcuggccgagcgguucagcuccaagauccgcagcucccgggagcaccaguucaagaaggaccaguaccugcucagccccgucaacugcugguaccuggugcugcaccagacgcgccgggagucccgcgaccacgccacccucaacgacaucuucaugaacaacgugaucguccggcugagccagaucuccgaggacgugauccgccuguucaagaaguccaaggagaucggccuccagaugcacgaggagcugcugaaggugaccaacgagcucuacaccgucaugaagacguaccacauguaccacgccgaguccaucagcgccgaguccaagcugaaggaggcggagaagcaggaggagaagcaguucaacaagagcggggaccuguccaugaaccuccugcggcacgaggaccgcccgcagcggcgcagcagcgugaagaagaucgagaagaugaaggagaagcggcaggccaaguacuccgagaacaagcugaagugcaccaaggcccgcaacgacuaccuccugaaccuggccgcgaccaacgccgccaucagcaaguacuacauccacgacguguccgaccucaucgacugcugcgaccugggcuuccacgccagccuggcccggaccuuccgcacguaccucuccgcggaguacaaccuggagaccagccggcacgaggggcuggacgucaucgagaacgccguggacaaccucgacucccgcagcgacaagcacaccgugauggacaugugcaaccaggucuucugcccgccccugaaguucgaguuccagccccacaugggcgacgaggugugccagguguccgcccagcagccgguccagaccgagcugcucaugcgcuaccaccagcugcagagccggcuggccacgcucaagaucgagaacgaggaggugcgcaagacccuggacgccaccaugcagacccugcaggacaugcucacgguggaggacuucgacgucuccgacgcguuccagcacagccgguccaccgagagcgugaaguccgccgccagcgagaccuacauguccaagaucaacaucgccaagcgccgggccaaccagcaggagaccgagauguucuacuucacgaaguucaaggaguacgugaacgggagcaaccugaucaccaagcugcaggcgaagcacgaccuccugaagcagacccugggcgagggcgagcgcgccgagugcgggaccacgcggggccgccggaacgcccgcacccggaaccaggacuccgggcaggccaucccccucgucguggagagcugcauccgcuacaucaaccuguacggccugcagcagcaggggaucuuccgggugcccggcagccaggucgaggugaacgacaucaagaacuccuucgagcgcggcgaggacccccuggucgacgaccagaacgagcgggacaucaacagcguggccggggugcucaagcuguacuuccgcggccuggagaacccccucuuccccaaggagcgguuccaggaccugaucuccaccaucaagcuggagaaccccgcggagcgcguccaccagauccagcagauccucgugacccugccccggguggucaucguggugaugcgcuaccuguucgccuuccucaaccaccugagccaguacuccgacgagaacaugauggacccguacaaccuggccaucugcuucgggcccacgcucaugcacauccccgacggccaggaccccgucagcugccaggcccacaucaacgaggugaucaagaccaucaucauccaccacgaggcgaucuucccgagcccccgcgagcuggagggccccguguacgagaagugcauggccgggggcgaggaguacugcgacagcccccacuccgagccgggggccaucgacgaggucgaccacgacaacggcaccgagccccacaccagcgacgaggagguggagcagaucgaggccaucgccaaguucgacuacauggggcggagcccccgcgagcuguccuucaagaagggcgcgucccuccugcuguaccaccgggccagcgaggacuggugggagggccgccacaacgggguggacggccucaucccccaccaguacaucgucgugcaggacauggacgacgccuucuccgacagccugucccagaaggccgacagcgaggccagcuccgggccgcugcucgacgacaaggcgagcuccaagaacgaccugcagagccccacggagcacaucuccgacuacggcuucgggggcgugaugggccggguccgccugcggagcgacggggccgccaucccccgccggcgcuccggcggggacacccacagcccgccccggggccucgggcccuccaucgacacgcccccgcgcgccgccgcgugccccagcagcccccacaagaucccccugacccggggccgcaucgaguccccggagaagcggcgcauggccaccuucggcuccgccgggagcaucaacuaccccgacaagaaggcccuguccgagggccacagcaugcgguccacgugcgggagcacccgccacuccagccucggcgaccacaagagccuggaggcggaggcccuggccgaggacaucgagaagaccauguccaccgcccuccacgagcugcgggagcuggagcgccagaacaccgugaagcaggcccccgacgugguccucgacacccuggagccccugaagaacccgcccggccccgugagcuccgagcccgcgagcccgcuccacaccaucgugauccgggaccccgacgccgccaugcgccgcuccagcuccagcuccaccgagaugaugacgaccuucaagcccgcccugagcgcccggcuggcgggggcccagcuccggcccccgcccaugcgccccguccgccccguggugcagcaccgguccagcuccagcuccagcuccggcgucgggagcccggccgugacccccaccgagaagauguuccccaacuccagcgccgacaagagcggcacgauguga

SEQ ID NO: 37083 - RNA, 477 nt, Artificial Sequence
  derived and/or modified sequence opt1 from SRGN__Homo_sapiens__NP_002718
augaugcagaagcugcucaagugcagccgccuggugcuggcccucgcccugauccugguccucgaguccagcgugcagggcuaccccacccggcgcgcgcgguaccagugggugcgcugcaacccggacuccaacagcgccaacugccuggaggagaaggggcccauguucgagcugcuccccggcgaguccaacaagaucccccggcugcgcaccgaccuguucccgaagacgcggauccaggaccucaaccgcaucuucccccugagcgaggacuacuccgggagcggcuucggguccggcagcggcuccgggagcggcuccgggagcggcuuccugaccgagauggagcaggacuaccagcucgucgacgaguccgacgccuuccacgacaaccugcggagccuggaccgcaaccuccccuccgacagccaggaccuggggcagcacggccuggaggaggacuucaugcucuga

SEQ ID NO: 37084 - RNA, 543 nt, Artificial Sequence
  derived and/or modified sequence opt1 from SRI__Homo_sapiens__NP_001243821
augcaguacggcggggcccccggcgggccggccuuccccggccagacccaggacccccuguacggguacuucgcggccguggccggccaggacggccagaucgacgccgacgagcuccagcgcugccugacccagagcgggaucgccggcggguacaagcccuucaaccuggagacgugccggcucauggucuccaugcuggaccgcgacaugagcggcaccaugggguucaacgaguucaaggagcugugggcggugcucaacggcuggcggcagcacuucaucuccuucgacaccgaccgcagcggcaccguggacccgcaggagcugcagaaggcccugacgaccaugggguuccggcucagcccccaggccgucaacuccaucgccaagcgcuacuccaccaacggcaagaucaccuucgacgacuacaucgcgugcugcgugaagcugcgggcccugacggacagcuuccgccggcgcgacaccgcccagcaggggguggucaacuuccccuacgacgacgugucccuccggaacuga

SEQ ID NO: 37085 - RNA, 1422 nt, Artificial Sequence
  derived and/or modified sequence opt1 from SRL__Homo_sapiens__NP_001092284
augcgcgcccuggugcuccugggcugccugcucgccagccugcuguucuccgggcaggcggaggagaccgaggacgccaacgaggaggcgccccuccgggaccgcagccacaucgagaagacccugaugcugaacgaggacaagccguccgacgacuacagcgccguccuccagcggcugcgcaagaucuaccacuccagcaucaagccccuggagcaguccuacaaguacaacgagcuccggcagcacgagaucacggacggcgagaucaccagcaagcccauggugcuguuccuggggcccugguccgugggcaagagcaccaugaucaacuaccuccuggggcuggagaacacccgcuaccagcucuacacgggcgccgagccgaccaccuccgaguucaccguccugaugcacggccccaagcugaagacgaucgaggggaucgugauggccgccgacagcgcccgguccuucagcccccucgagaaguucggccagaacuuccuggagaagcugaucgggaucgaggugccccacaagcuccuggagcgcgucaccuucguggacaccccgggcaucaucgagaaccggaagcagcaggagcgcggguaccccuucaacgacgugugccagugguucaucgaccgggccgaccugaucuucgucguguucgaccccaccaagcucgacgugggccuggagcuggagaugcuguuccgccagcucaagggccgggagucccagauccgcaucauccugaacaaggcggacaaccucgccacgcagaugcugaugcgggucuacggggcccuguucuggagccucgcgccccugaucaacgugaccgagccgccccgcguguacgucuccagcuucuggccccaggaguacaagcccgacacccaccaggagcuguuccuccaggaggagaucucccugcuggaggaccucaaccaggugaucgagaaccggcuggagaacaagaucgccuucauccgccagcacgccauccgggugcgcauccacgcccugcucgucgaccgguaccugcagaccuacaaggacaagaugacguucuucagcgacggcgagcugguguucaaggacaucguggaggacccggacaaguucuacaucuucaagaccauccucgccaagaccaacgucagcaaguucgaccugcccaaccgcgaggccuacaaggacuucuucgggaucaaccccaucuccagcuucaagcugcugucccagcagugcagcuacaugggcggcugcuuccucgagaagaucgagcgcgccaucacccaggagcugcccgggcugcucggcucccuggggcugggcaagaacccgggggcgcucaacugcgacaagacgggcugcagcgagacccccaagaaccgguaccgcaagcacuga

SEQ ID NO: 37086 - RNA, 1467 nt, Artificial Sequence
  derived and/or modified sequence opt1 from SRMS__Homo_sapiens__NP_543013
auggagcccuuccugcgccggcgccucgccuuccugagcuucuucugggacaagaucuggccggccggcggggagcccgaccacggcacccccgggucccuggaccccaacaccgacccggugcccacgcuccccgcggagcccugcagcccguucccccagcuguuccuggcccucuacgacuucaccgcccggugcggcggggagcuguccguccgccggggcgaccgccugugcgcccucgaggagggcgggggcuacaucuucgcccggcgccugagcgggcagcccuccgcgggccuggugcccaucacccacguggccaaggccagcccggagacccucuccgaccagcccugguacuucagcggggucucccggacgcaggcccagcagcugcugcucagcccgcccaacgagcccggcgcguuccugauccgccccuccgagagcucccugggcggguacagccucuccgugcgggcccaggccaaggugugccacuaccgcgucagcauggccgccgacggcucccuguaccugcagaaggggcgccucuuccccggccuggaggagcugcucaccuacuacaaggcgaacuggaagcugauccagaacccccugcuccagccgugcaugccccagaaggcgccccggcaggacgugugggagcggccccacagcgaguucgcccugggccgcaagcugggggagggcuacuucggggaggugugggagggccucuggcuggggucccugccggucgccaucaaggugaucaagagcgccaacaugaagcucaccgaccuggccaaggagauccagacccugaagggccuccggcacgagcgccugauccggcugcacgccgugugcagcggcggggagcccgucuacaucgugacggagcucaugcgcaagggcaaccugcaggccuuccuggggacccccgagggccgggcccuccgccugcccccgcugcucggguucgccugccagguggcggagggcauguccuaccuggaggagcagcgcgucgugcaccgggaccuggccgcccgcaacgugcucgucgacgacggccuggccugcaagguggccgacuucgggcuggcgcggcugcucaaggacgacaucuacagccccuccagcuccagcaagauccccgugaaguggaccgccccggaggccgccaacuaccgcgucuucucccagaaguccgacguguggagcuucggcgugcugcugcacgaggucuucaccuacgggcagugccccuacgagggcaugacgaaccacgagacccuccagcagaucaugcggggguaccgccugccccggcccgcggccugcccggccgagguguacguccugaugcucgagugcuggcgcagcucccccgaggagcggcccagcuucgccacccugcgcgagaagcugcacgccauccaccggugccaccccuga

SEQ ID NO: 37087 - RNA, 411 nt, Artificial Sequence
  derived and/or modified sequence opt1 from SRP14__Homo_sapiens__NP_003125
auggugcugcucgagagcgagcaguuccugaccgagcugacccgccucuuccagaagugccggacguccggcagcgucuacaucacccugaagaaguacgacgggcgcaccaagcccaucccgaagaagggcaccguggagggguucgagcccgccgacaacaagugccugcuccgggccacggacggcaagaagaagaucuccaccguggucagcuccaaggaggugaacaaguuccagauggcguacagcaaccugcugcgcgccaacauggacgggcucaagaagcgggacaagaagaacaagaccaagaagaccaaggccgccgccgcggccgccgccgcggcccccgccgccgccgcgacggcccccaccaccgccgccaccacggccgcgaccgccgcccaguga

SEQ ID NO: 37088 - RNA, 333 nt, Artificial Sequence
  derived and/or modified sequence opt1 from SRP19__Homo_sapiens__NP_001191122
auggccugcgccgcggcccgcagccccgccgaccaggaccgguucaucugcaucuacccggccuaccugaacaacaagaagaccaucgccgagggccgccggauccccaucuccaaggcgguggagaaccccaccgccacggagauccaggacgucugcagcgccguggggcucaacguguuccuggagaagaacaagauguacucccgcgaguggaaccgggacguccaguaccgcggccgggugcgcgugcagcugaagcaggaggacgggagccucugccugguccaguuccccucccacuacacccugagccucaccuccggcagcuga

SEQ ID NO: 37089 - RNA, 1770 nt, Artificial Sequence
  derived and/or modified sequence opt1 from SRP68__Homo_sapiens__NP_001247431
auggccgccgagaagcagguccccggcgggggcgggggcgggggcagcggcgggggcgggggcuccgggggcggcgggagcggcgggggccgcggcgccgggggcgaggagaacaaggagaacgagcggcccuccgcggggagcaaggccaacaaggaguucggcgacucccugagccucgagauccugcagaucaucaaggagucccagcagcagcacgggcugcgccacggcgacuuccagcgguaccgcuaccuccugcuggugcucauggacgccgagcgggccuggagcuacgcgaugcagcugaagcaggaggccaacaccgagccccgcaagcgguuccaccuccucucccgccugcggaaggccgugaagcacgccgaggagcuggagcgccucugcgagagcaaccggguggacgcgaagaccaagcuggaggcccaggccuacacggccuaccuguccggcaugcuccgcuucgagcaccaggaguggaaggccgcgaucgaggccuucaacaagugcaagaccaucuacgagaagcuggccagcgccuucaccgaggagcaggccguccuguacaaccagcggguggaggagaucucccccaacauccgcuacugcgcguacaacaucggggaccagagcgccaucaacgagcucaugcagaugcggcugcgcuccggcgggaccgagggccugcucgccgagaagcuggaggcccugaucacgcagacccgggccaagcaggcggccaccaugagcgagguggaguggcgcgggcggaccguccccgugaagaucgacaaggugcgcaucuuccuccugggccuggccgacaacgaggccgccaucguccaggcggaguccgaggagacgaaggagcggcuguucgagagcaugcuguccgagugccgcgacgccauccagguggugcgcgaggagcugaagccggaccagaagcagcgggacuacauccucgagggcgagcccgggaaggucagcaaccugcaguaccugcacagcuaccucaccuacaucaagcuguccaccgccaucaagcgcaacgagaacauggccaagggccugcagcgggcgcuccugcagcagcagcccgaggacgacagcaagcgcagcccccggccgcaggaccugauccgccucuacgacaucauccugcagaaccugguggagcuccugcagcugcccgggcucgaggaggacaaggccuuccagaaggagaucggccugaagacccugguguucaaggccuaccggugcuucuucaucgcccaguccuacguccucgugaagaagugguccgaggcccuggugcuguacgaccgcguccugaaguacgcgaacgaggugaacagcgacgccggggccuucaagaacucccucaaggaccugcccgacgugcaggagcugaucacgcagguccggagcgagaagugcucccuccaggccgccgcgauccuggacgccaacgacgcccaccagaccgagaccagcuccagccaggugaaggacaacaagccccugguggagcgcuucgagaccuucugccucgacccgucccuggucacgaagcaggccaaccuggugcacuucccgcccggcuuccagcccauccccugcaagccccucuucuucgaccuggcccugaaccacgucgcguucccgccccucgaggacaagcuggagcagaagaccaagagcggccugaccggguacaucaagggcaucuucggguuccgguccuga

SEQ ID NO: 37090 - RNA, 1833 nt, Artificial Sequence
  derived and/or modified sequence opt1 from SRP72__Homo_sapiens__NP_001254651
auggccagcggcggguccggcggggugagcguccccgcccugugguccgaggugaaccgcuacggccagaacggggacuucacccgggcgcucaagaccgugaacaagauccugcagaucaacaaggacgacgucacggcccugcacugcaagguggugugccucauccagaacggcagcuucaaggaggcccugaacgucaucaacacccacaccaaggugcuggccaacaacucccucagcuucgagaaggccuacugcgaguaccgccugaaccggaucgagaacgcgcugaagaccaucgaguccgccaaccagcagacggacaagcucaaggagcuguacggccaggugcuguaccgccucgagcgguacgacgagugccuggccgucuaccgcgaccuggugcggaacagccaggacgacuacgacgaggagcgcaagaccaaccucuccgccguggucgcggcccagagcaacugggagaagguggugccggagaaccuggggcugcaggagggcacccacgagcucugcuacaacaccgccugcgcccugaucgggcagggccagcugaaccaggccaugaagauccuccagaaggcggaggaccugugccggcgcucccugagcgaggacacggaccagaacgucuucgacuccaagaagaaggugaagcucaccaacgccgaggggguggaguucaagcugagcaagaagcagcugcaggccaucgaguucaacaaggcccuccuggccauguacaccaaccaggcggagcagugccggaagaucuccgccagccugcagucccagagccccgagcaccuccugcccguccugauccaggccgcccagcucugccgcgagaagcagcacaccaaggccaucgagcugcugcaggaguucuccgaccagcaccccgagaacgcggccgagaucaagcucacgauggcccagcugaagaucagccagggcaacaucagcaaggccugccugauccuccgguccaucgaggagcugaagcacaagccgggcauggugagcgcccuggugaccauguacucccacgaggaggacaucgacagcgcgaucgaggucuucacccaggccauccagugguaccagaaccaccagcccaagucccccgcccaccucagccugauccgcgaggccgcgaacuucaagcugaaguacgggcggaagaaggaggccaucuccgaccuccagcagcuguggaagcagaaccccaaggacauccacacccuggcccagcucaucagcgccuacucccugguggacccggagaaggccaaggcgcugagcaagcaccuccccuccagcgacuccaugagccugaagguggacgucgaggcccuggagaacuccgccggcgccacguacauccgcaagaagggcgggaaggugaccggcgacagccagcccaaggagcaggggcagggcgaccugaagaagaagaagaagaagaagaaggggaagcuccccaagaacuacgacccgaaggucacccccgaccccgagcgguggcugcccaugcgcgagcgguccuacuaccgcggccggaagaaggggaagaagaaggaccagaucggcaagggcacccagggggccacggcgggcgccagcuccgagcuggacgccagcaagaccgugagcuccccgcccaccagcccccgccccggguccgccgccaccgugagcgcguccacgagcaacaucaucccgccccgccaccagaagcccgccggcgcccccgccaccaagaagaagcagcagcagaagaagaagaagggcgggaagggcgggugguga

SEQ ID NO: 37091 - RNA, 249 nt, Artificial Sequence
  derived and/or modified sequence opt1 from SRP9__Homo_sapiens__NP_001123912
augccccaguaccagaccugggaggaguucagccgcgccgccgagaagcuguaccucgcggacccgaugaaggcccgggugguccugaaguaccgccacuccgacggcaaccugugcgugaaggugaccgacgaccucguccggcagugccuggcccugcuccugcgccugcagugcagcgggaugaucaucgcccacugcauccucgaccugcugggcuccagcgggccccucgccuccgcgagcuga

SEQ ID NO: 37092 - RNA, 1968 nt, Artificial Sequence
  derived and/or modified sequence opt1 from SRPK1__Homo_sapiens__NP_003128
auggagcgcaaggugcuggcccuccaggcccggaagaagcgcaccaaggcgaagaaggacaaggcccagcgcaagagcgagacccagcaccggggcuccgcgccccacagcgaguccgaccugccggagcaggaggaggagauccuggggagcgacgacgacgagcaggaggaccccaacgacuacugcaagggcggguaccaccucgucaagaucggcgaccuguucaacgggcgguaccacgugauccgcaagcugggcuggggccacuucuccacgguguggcucagcugggacauccaggggaagaaguucgucgccaugaagguggugaaguccgccgagcacuacaccgagaccgcccuggacgagauccggcugcucaagagcguccgcaacuccgaccccaacgaccccaaccgggagaugguggugcagcugcuggacgacuucaagaucagcggcgucaacgggacccacaucugcaugguguucgaggugcucggccaccaccuccugaaguggaucaucaaguccaacuaccaggggcugccgcugcccugcgucaagaagaucauccagcagguccugcagggccucgacuaccugcacacgaagugccgcaucauccacaccgacaucaagcccgagaacauccugcucagcgugaacgagcaguacauccggcgccuggccgccgaggccaccgaguggcagcgguccggcgcgcccccgcccagcggguccgccgugagcaccgcgccccagcccaagccggccgacaagauguccaagaacaagaagaagaagcugaagaagaagcagaagcgccaggccgagcuccuggagaagcggaugcaggagaucgaggagauggagaaggagagcggccccgggcagaagcgccccaacaagcaggaggaguccgagagccccguggagcggccgcugaaggagaacccgcccaacaagaugacgcaggagaagcucgaggagagcuccaccaucggccaggaccagacccugauggagcgcgacaccgagggcggggccgccgagaucaacugcaacggcgugaucgaggucaucaacuacacgcagaacagcaacaacgagacccugcggcacaaggaggaccuccacaacgccaacgacugcgacgugcagaaccugaaccaggaguccagcuuccuguccagccagaacggggacuccagcaccucccaggagaccgacagcugcacgcccaucaccuccgaggugagcgacaccauggucugccaguccagcuccaccgugggccagagcuucuccgagcagcacaucagccagcuccaggaguccauccgcgccgagauccccugcgaggacgagcaggagcaggagcacaacgggccccuggacaacaagggcaagagcacggccggcaacuuccuggugaacccccucgagcccaagaacgcggagaagcugaaggucaagaucgccgaccuggggaacgccugcugggugcacaagcacuucaccgaggacauccagacccggcaguaccgcagccucgagguccugaucggcuccggguacaacaccccggccgacaucuggagcacggccugcauggcguucgagcuggccaccggcgacuaccucuucgagccccacuccggggaggaguacacccgcgacgaggaccacaucgcccugaucaucgagcugcucggcaaggugccccggaagcugaucguggccggcaaguacagcaaggaguucuucaccaagaagggggaccugaagcacaucacgaagcucaagcccuggggccuguucgagguccugguggagaaguacgaguggucccaggaggaggccgcgggguucaccgacuuccugcucccgaugcuggagcugauccccgagaagcgcgccaccgccgccgagugccuccggcaccccuggcugaacagcuga

SEQ ID NO: 37093 - RNA, 2067 nt, Artificial Sequence
  derived and/or modified sequence opt1 from SRPK2__Homo_sapiens__NP_872633
augagcgugaacuccgagaagagcuccagcuccgagcgccccgagccgcagcagaaggccccccuggucccccccccgcccccccccccgcccccccccccgcccccccuccccgacccgaccccccccgagcccgaggaggagauccugggcagcgacgacgaggagcaggaggacccggccgacuacugcaaggggggcuaccaccccgugaagaucggggaccuguucaacggccgguaccacgugauccgcaagcucggguggggccacuucuccaccgucuggcugugcugggacaugcagggcaagcgguucguggcgaugaagguggucaagagcgcccagcacuacacggagaccgcccuggacgagaucaagcuccugaagugcgugcgcgaguccgaccccagcgaccccaacaaggacauggugguccagcugaucgacgacuucaagaucuccgggaugaacggcauccacgugugcaugguguucgagguccucgggcaccaccugcugaaguggaucaucaagagcaacuaccagggccucccggugcggugcgugaaguccaucauccgccagguccugcaggggcuggacuaccuccacagcaagugcaagaucauccacaccgacaucaagcccgagaacauccugaugugcguggacgacgccuacgugcggcgcauggccgcggaggccaccgaguggcagaaggccggcgccccccccccguccggcagcgcggucuccacggccccccagcagaagcccaucgggaagaucagcaagaacaagaagaagaagcugaagaagaagcagaagcggcaggccgagcuccuggagaagcgccugcaggagaucgaggagcucgagcgggaggccgagcgcaagaucaucgaggagaacaucaccuccgccgcgccgagcaacgaccaggacggcgaguacugccccgaggugaagcugaagaccaccgggcuggaggaggccgccgaggccgagacggccaaggacaacggcgaggcggaggaccaggaggagaaggaggacgccgagaaggagaacaucgagaaggacgaggacgacguggaccaggagcucgccaacaucgaccccaccuggaucgagagccccaagaccaacggccacaucgagaacgggccguucucccuggagcagcagcuggacgacgaggacgacgacgaggaggacugccccaaccccgaggaguacaaccucgacgagcccaacgccgagagcgacuacaccuacuccagcuccuacgagcaguucaacggcgagcugccgaacgggcggcacaagauccccgagagccaguuccccgaguucuccacgagccuguucuccggcagccucgagcccgucgccugcggguccgugcugagcgagggcuccccgcugaccgagcaggaggagagcucccccagccacgaccgcucccggaccgugagcgcguccagcaccggcgaccuccccaaggccaagacgcgcgccgccgaccugcuggucaacccccucgacccgcggaacgccgacaagauccgcgugaagaucgcggaccuggggaacgccugcuggguccacaagcacuucaccgaggacauccagacccggcaguaccgcagcaucgaggugcugaucggcgccggguacuccacccccgccgacaucuggagcacggcgugcauggccuucgagcucgccaccggcgacuaccuguucgagccccacuccggggaggacuacagccgggacgaggaccacaucgcccacaucaucgagcugcucggcuccaucccccgccacuucgcccugagcggcaaguacucccgcgaguucuucaaccggcgcggggagcugcggcacaucaccaagcucaagccguggagccuguucgacgugcuggucgagaaguacggcuggccccacgaggacgcggcccaguucaccgacuuccucauccccaugcuggagauggugcccgagaagcgcgccuccgccggggagugccugcggcacccguggcugaacagcuga

SEQ ID NO: 37094 - RNA, 816 nt, Artificial Sequence
  derived and/or modified sequence opt1 from SRPRB__Homo_sapiens__NP_067026
auggccagcgccgacucccggcggguggcggacggcgggggcgccgggggcaccuuccagcccuaccuggacacccuccgccaggagcugcagcagacggacccgacccugcucagcgucgugguggccguccuggccgugcugcucacccugguguucuggaagcugauccggucccgccggagcucccagcgcgccguccuccugguggggcugugcgacagcggcaagacccuccuguucgugcggcugcucacgggccuguaccgcgacacccagaccuccaucaccgacagcugcgcggucuaccgggugaacaacaaccgcgggaacucccugacgcucaucgaccugcccggccacgagagccugcggcuccaguuccuggagcgcuucaaguccagcgcccgggccaucguguucgucguggacuccgccgcguuccagcgcgaggugaaggacgucgccgaguuccuguaccaggugcucaucgacagcauggggcugaagaacacccccuccuuccugaucgccugcaacaagcaggacaucgccauggccaagagcgcgaagcucauccagcagcagcuggagaaggagcugaacacccuccgggugacccgcuccgccgcccccagcacgcuggacuccagcagcaccgccccggcccagcugggcaagaaggggaaggaguucgaguucucccagcucccccugaaggucgaguuccuggagugcagcgcgaagggcggccgcggggacgugggcuccgccgacauccaggaccucgagaaguggcuggccaagaucgccuga

SEQ ID NO: 37095 - RNA, 1833 nt, Artificial Sequence
  derived and/or modified sequence opt1 from SRPR__Homo_sapiens__NP_001171313
augcuggacuucuucaccaucuucagcaagggcgggcucgugcuguggugcuuccagggcgucuccgacagcugcaccgggcccgugaacgcccugauccgcuccgugcuccugcaggucggcuuccagaagauccugacgcucaccuacguggacaagcugaucgacgacgugcaccggcuguuccgcgacaaguaccggaccgagauccagcagcagagcgcccucucccugcugaacgggaccuucgacuuccagaacgacuuccuccgccugcugcgggaggcggaggagagcuccaagauccgcgccccgacgaccaugaagaaguucgaggacagcgagaaggccaagaagcccguccgguccaugaucgagacccgcggcgagaagcccaaggagaaggccaagaacagcaagaagaagggcgccaagaaggagggguccgacggcccccucgcgaccagcaagccggugcccgccgagaaguccgggcugcccgugggccccgagaacggggucgagcugagcaaggaggagcucauccggcgcaagcgggaggaguucauccagaagcacggccgcggcauggagaaguccaacaagagcacgaaguccgacgccccgaaggagaaggggaagaaggcgccccgggugugggagcugggcgggugcgccaacaaggaggugcuggacuacagcacccccaccaccaacggcacgcccgaggccgcccucuccgaggacaucaaccugauccgcggcaccgggagcggcgggcagcugcaggaccucgacugcagcuccagcgacgacgagggcgccgcccagaacuccaccaagccgagcgcgaccaaggggacgcugggcggcauguucgggaugcugaagggccucgucggguccaagagccugucccgggaggacauggagagcgugcuggacaagaugcgcgaccaccucaucgccaagaacguggccgccgacaucgccguccagcugugcgaguccguggcgaacaagcuggagggcaaggugauggggaccuucagcaccgucaccuccacggugaagcaggcccuccaggagagccuggugcagauccugcagccccagcggcgcgucgacaugcuccgggacaucauggacgcccagcgccggcagcgccccuacguggugaccuucugcggcgucaacggcguggggaaguccaccaaccuggccaagaucagcuucuggcugcucgagaacggcuucuccguccugaucgccgcgugcgacaccuuccgcgccggggccguggagcagcugcggacgcacacccgccggcucagcgcccugcacccgcccgagaagcacggcgggcgcaccauggugcagcuguucgagaagggcuacggcaaggacgccgcggggaucgccauggaggccaucgccuucgcgcggaaccagggcuucgacgucgugcucguggacaccgccgggcgcaugcaggacaacgcgccccugaugacggcccuggccaagcucaucaccgucaacacccccgaccuggugcuguucgugggcgaggcccuggucggcaacgaggccguggaccagcucgugaaguucaaccgggcccuggccgaccacuccauggcccagacgccccgccugaucgacgggaucguccucaccaaguucgacaccaucgacgacaaggugggcgcggccaucagcaugaccuacaucaccuccaagccgaucguguucgucgggacgggccagaccuacugcgaccugcggagccugaacgccaaggccgugguggccgcgcucaugaaggccuga

SEQ ID NO: 37096 - RNA, 1398 nt, Artificial Sequence
  derived and/or modified sequence opt1 from SRPX2__Homo_sapiens__XP_005262178
auggccagccagcugacccagcgcggcgcccucuuccugcuguucuuccucacccccgcggugacgccgaccugguacgccggguccggcuacuaccccgacgagagcuacaacgaggucuacgccgaggaggugccccaggcccccgcccuggacuaccgggugccgcgcuggugcuacacccugaacauccaggacggggaggcgaccugcuacucccccaagggcgggaacuaccacagcucccucggcacgcggugcgagcugagcugcgaccgcggcuuccggcugaucgggcgccgguccguccagugccuccccagccgccggugguccggcaccgccuacugccgccagaugcggugccacgcccugcccuucaucaccagcgggaccuacacgugcaccaacggcgugcugcucgacucccgcugcgacuacagcugcuccagcggguaccaccuggagggcgaccggucccgcaucugcauggaggacggccgguggagcgggggcgagccggugugcgucgacaucgacccgcccaagauccgcugcccccacucccgggagaagauggccgagcccgagaagcugaccgcgcgcguguacugggacccgccccucgugaaggacagcgccgacgggaccaucacgcgggucacccugcgcggccccgagcccggcucccacuuccccgagggggagcacgugauccgguacaccgccuacgaccgcgccuacaaccgcgccagcugcaaguucaucgugaagguccaggugcggcgcugccccacccugaagcccccgcagcacggcuaccucacgugcaccagcgcgggggacaacuacggcgcgaccugcgaguaccacugcgacgggggcuacgaccggcagggcacccccucccgcgugugccagagcucccggcaguggagcggguccccgcccaucugcgcccccaugaagaucaacgucaacgugaacagcgccgccggccugcuggaccaguucuacgagaagcagcgccuccugaucaucuccgcccccgaccccagcaaccgguacuacaagaugcagaucuccaugcugcagcagagcacgugcgggcucgaccugcgccacgugaccaucaucgagcuggucggccagcccccgcaggagguggggcggauccgcgagcagcagcucuccgccaacaucaucgaggagcugcggcaguuccagcgccugacccggagcuacuucaacauggugcucaucgacaagcagggcaucgaccgcgaccgguacauggagcccgucacccccgaggagaucuucacguucaucgacgacuaccugcuguccaaccaggagcucacccagcgccgggagcagcgcgacaucugcgaguga

SEQ ID NO: 37097 - RNA, 1335 nt, Artificial Sequence
  derived and/or modified sequence opt1 from SRPX__Homo_sapiens__NP_001164221
augggcagccccgcccaccgcccggcccugcuccugcugcucccgccccugcugcuccugcugcuccugcgggugcccccgucccgcagcuuccccgacacccccuggugcucccccaucaaggucaaguacggggacguguacugccgggcgccgcagggcggguacuacaagaccgcccugggcacgcgcugcgacauccggugccagaagggguacgagcuccacggcagcucccugcugaucugccagagcaacaagcgcugguccgacaaggugaucugcaagcagaagcggugccccacccucgccaugcccgccaacggcggguucaagugcgucgacggcgccuacuucaacagccgcugcgaguacuacugcucccccggguacacccugaagggcgagcggaccgugacgugcauggacaacaaggcguggagcgggcgccccgccuccugcguggacauggagccgccccggaucaagugccccagcgucaaggagcgcaucgccgagcccaacaagcugaccgugcggguguccugggagacccccgagggccgcgacaccgccgacggcauccucacggacgucauccugaaggggcugccgcccggcagcaacuuccccgagggggaccacaagauccaguacaccguguacgaccgggcggagaacaaggggaccugcaaguuccgcgugaagguccgggugaagcgcugcggcaagcucaacgcccccgagaacggcuacaugaagugcuccagcgacggcgacaacuacggggcgaccugcgaguucuccugcaucggcggguacgagcugcagggcagccccgcccgggugugccaguccaaccuggccuggagcggcacggagccgaccugcgccgccaugaacgucaacgugggggugcgcaccgccgccgcccuccuggaccaguucuacgagaagcggcgccugcucaucgucagcacccccacggcgcgcaaccugcuguaccggcuccagcugggcaugcugcagcaggcccagugcgggcucgaccugcgccacaucaccgugguggagcuggucggcguguuccccacccucaucgggcggaucggcgccaagaucaugccgcccgcccuggcccugcagcuccgccugcugcuccggaucccccuguacuccuucagcauggugcuggucgacaagcacggcauggacaaggagcgcuacgugucccucgucaugcccguggcgcuguucaaccugaucgacaccuucccccuccggaaggaggagauggugcugcaggccgagaugagccagacgugcaacaccuga

SEQ ID NO: 37098 - RNA, 1023 nt, Artificial Sequence
  derived and/or modified sequence opt1 from SRR__Homo_sapiens__XP_011522276
augugcgcccaguacugcaucagcuucgccgacguggagaaggcgcacaucaacauccgcgacuccauccaccugacccccguccucaccagcuccauccugaaccagcugacgggccggaaccucuucuucaagugcgagcuguuccagaagaccgggagcuucaagauccgcggcgcccugaacgccgugcggucccucgugccggacgcccuggagcgcaagcccaaggccgucgugacccacagcuccgggaaccacggccaggcgcugaccuacgccgccaagcucgaggggauccccgccuacaucguggucccccagacggcgccggacugcaagaagcuggccauccaggccuacggcgccagcaucguguacugcgagcccuccgacgagagccgggagaacguggccaagcgcgucaccgaggagaccgagggcaucauggugcaccccaaccaggagcccgcggugaucgccgggcagggcaccaucgcccuggagguccucaaccaggugccgcugguggacgcccuggucgugcccgucgggggcgggggcaugcucgccggcaucgcgaucacggugaaggcccugaagcccuccgugaagguguacgccgccgagcccagcaacgccgacgacugcuaccaguccaagcugaaggggaagcucaugccgaaccuguacccgcccgagaccaucgcggacggcgucaagagcuccaucgggcugaacaccuggcccaucauccgggaccucguggacgacaucuucaccgugacggaggacgagaucaagugcgccacccagcuggucugggagcgcaugaagcugcucaucgagcccaccgccggcgugggcgucgccgccgugcugagccagcacuuccagaccgugucccccgaggucaagaacaucugcaucgugcugagcgggggcaacguggaccucacguccagcaucaccugggucaagcaggcggagcggcccgccagcuaccaguccgugagcguguga

SEQ ID NO: 37099 - RNA, 2751 nt, Artificial Sequence
  derived and/or modified sequence opt1 from SRRM1__Homo_sapiens__NP_001290377
auggacgccggcuucuuccgcgggaccagcgccgagcaggacaaccgguucuccaacaagcagaagaagcugcucaagcagcugaaguucgcggagugccuggagaagaagguggacaugagcaaggucaaccucgaggugaucaagcccuggaucaccaagcgcgugacggagauccugggcuucgaggacgacgucgugaucgaguucaucuucaaccagcuggaggugaagaacccggacuccaagaugaugcagaucaaccucaccggguuccugaacggcaagaacgcccgggaguucaugggggagcuguggccccuccugcugagcgcccaggagaacaucgccggcauccccuccgccuuccucgagcugaagaaggaggagaucaagcagcgccagaucgagcaggagaagcuggcgagcaugaagaagcaggacgaggacaaggacaagcgggacaaggaggagaaggaguccagccgcgagaagcgggagcgcucccggagcccccgccggcgcaagucccggagcccguccccccgccggcgcagcucccccguccggcgcgagcggaagcgcagccacucccggagcccccgccaccgcaccaagucccggagcccgagccccgcccccgagaagaaggagaagacccccgagcucccggagcccuccgugaaggugaaggagcccagcguccaggaggccacguccaccagcgacauccugaaggugcccaagccggagcccauccccgagcccaaggagccgucccccgagaagaacagcaagaaggagaaggagaaggagaagacccgcccccggucccgcagccgguccaagagccgcucccggacccgcagccggucccccagccacacgcgcccgcggcgccggcaccgcucccggagccgcuccuacagcccccggcgccggcccuccccccgccgccggccgagcccccgccggcgcacccccccgcggcgcaugcccccccccccgcggcaccgccggagccgcucccccgugcggcgccggcgccggagcuccgccagccuguccggcagcuccagcuccagcuccagcucccgcagccgguccccccccaagaagccgcccaagcgcaccagcucccccccccggaagacccgccggcucagcccgagcgcgucccccccccgccgccggcaccgccccagcccgcccgccacgccccccccgaagacccggcacucccccaccccccagcagagcaaccgcacccggaagucccgcgucagcgugucccccgggcggacgagcgugaccaagcacaagggcaccgagaagcgcgaguccccgagccccgcccccaagccgcggaaggucgagcuguccgagagcgaggaggacaaggggggcaagauggccgccgcggacuccgugcagcagcgccggcaguaccgccggcagaaccagcagagcuccagcgacuccgggagcuccagcagcuccgaggacgagcgccccaagcggagccacgugaagaacggcgaggucggccgccggcgccggcacucccccagccgcuccgccagccccuccccgcgcaagcggcagaaggagaccagcccccgcaugcagauggggaagcgguggcagucccccgugacgaagagcggccgccggcgccggucccccagcccgccccccacccgccggcgccggucccccagcccggccccccccccccgccggcgccggaccccgaccccccccccccgccggcgcacgccguccccccccccccggcgccggagcccguccccccgccgcuacagcccccccauccagcggcgcuacuccccgagcccccccccgaagcggcgcaccgccagccccccccccccgcccaagcggcgcgccucccccagccccccgcccaagcggcgcgugucccacagcccccccccgaagcagcgguccagccccgucaccaagcgccggucccccagccuguccagcaagcaccgcaagggguccagccccucccggagcacccgcgaggcgcgguccccgcagcccaacaagcgccacagccccuccccccggccgcgcgccccccagacgagcuccagcccccccccggugcggcgcggcgccagcuccagcccccagcgccggcagucccccagccccuccacccgcccgauccggcgcgugagccggacccccgagcccaagaagaucaagaaggccgccuccccgagcccccaguccguccgccgggugagcuccagccgcuccgucagcggcucccccgagcccgcggccaagaagccgcccgccccccccagcccggugcagucccagagccccuccaccaacuggagccccgccgugcccgucaagaaggccaagagcccgacgcccucccccagccccccgcggaacuccgaccaggaggggggcgggaagaagaagaagaagaagaaggacaagaagcacaagaaggacaagaagcacaagaagcacaagaagcacaagaaggagaaggcgguggccgccgccgcggccgccgccgugacccccgccgcgaucgccgccgccaccaccacgcucgcccaggaggagcccgucgcggcccccgagccgaagaaggagaccgagagcgaggccgaggacaaccuggacgaccuggagaagcaccuccgcgagaaggcccugcgguccaugcgcaaggcccaggugagcccccaguccuga

SEQ ID NO: 37100 - RNA, 8259 nt, Artificial Sequence
  derived and/or modified sequence opt1 from SRRM2__Homo_sapiens__NP_057417
auguacaacggcaucgggcugcccacgccccgcggcagcgggaccaacggcuacgugcagcggaaccucucccugguccgcgggcggcgcggcgagcggcccgacuacaagggcgaggaggagcugcgccggcucgaggccgcccuggugaagcgccccaaccccgacauccuggaccacgagcggaagcgccggguggagcuccgcugccuggagcuggaggagaugauggaggagcagggguacgaggagcagcagauccaggagaaggucgccaccuuccggcucaugcugcuggagaaggacgugaaccccggcgggaaggaggagacccccggccagcgccccgccgugaccgagacccaccagcucgccgagcugaacgagaagaagaacgagcggcugcgcgccgccuucgggaucagcgacuccuacgucgacggcagcuccuucgacccccagcggcgcgcgcgggaggccaagcagcccgcccccgagccgcccaagcccuacagccucgugcgcgaguccagcuccagccggucccccacccccaagcagaagaagaagaagaagaagaaggaccgcggccgccggagcgaguccagcagcccccgccgggagcgcaagaaguccuccaagaagaagaagcaccggagcgaguccgagagcaagaagcgcaagcaccggagccccacccccaaguccaagcgcaagagcaaggacaagaagcggaagcgcucccggagcaccacccccgcccccaagucccgccgggcgcaccgcagcaccuccgccgacagcgccuccagcuccgacaccagccggucccgcagccgguccgccgccgcgaagacccacaccaccgcccuggccgggcgcagccccucccccgccagcggccggcgcggggagggcgacgcccccuucuccgagcccggcaccaccagcacccagcgccccagcucccccgagaccgcgaccaagcagcccagcucccccuacgaggacaaggacaaggacaagaaggagaaguccgccacccggcccucccccagccccgagcgcuccagcaccgggcccgagccgcccgcccccaccccgcugcucgccgagcggcacggcgggagcccccagccccuggccaccacgccccugagccaggagccggugaacccgcccuccgaggcgagccccacccgcgaccgguccccgcccaagagccccgagaagcucccccaguccagcuccagcgagagcuccccgcccagcccccagcccaccaaggucucccgccacgccagcuccagcccggagucccccaagcccgcccccgccccgggcagccaccgggagaucuccagcucccccaccagcaagaaccgcucccacgggcgggccaagcgcgacaagagccacucccacacccccagccggcgcaugggccggucccgcagcccggcgaccgccaagcggggccgcucccggagccgcacccccaccaagcgggggcacagccgcucccggagcccccaguggcgccgcucccggagcgcccagcgcuggggccggucccgcagcccccagcggcgcgggcggucccgcagcccgcagcggcccggcuggucccgcagccggaacacccagcgccgggggcgcucccggagcgcccgccggggccgcucccacagccggucccccgcgacccgcggccgcagccggucccgcacccccgcccggcgcgggcggagccgcucccggaccccggcccgccggcgcagccggagccgcacccccacccggcgccggucccgcagccggacgcccgcccgccggggccgcucccggagccgcacccccgcccgccggcgcucccggacccgcagcccggugcggcgccggucccgcagccggucccccgcgcgccggagcgggcgcucccggagccgcacccccgcccggcgcggccggucccgcagccggacccccgcccgccgcgggcggucccgcagccggaccccggcccgccgguccggccgcagccggucccgcacccccgcccggcgcggccggagccgcagccggacgccccgccgggggcgcucccggagccgcucccuggugcggcgcggccggagccacucccgcacgccccagcgccgggggcgcagcggcuccagcuccgagcggaagaacaagagccgcaccucccagcggcgcagccgguccaacagcuccccggagaugaagaagucccgcaucuccagccggcgcucccggagccugagcagcccccgcagcaaggcgaagucccggcucagccugcgccggucccugagcggcuccagccccugccccaagcagaagucccagaccccgccccgccggagccgcuccgggagcucccagcccaaggccaagagccggacgccgccccgccgcucccggagcuccagcagcccgccgcccaagcagaaguccaagacccccagccgccagucccacagcuccagcagcccccaccccaaggucaagagcggcaccccgccccggcagggguccaucaccagcccccaggccaacgagcaguccgugacgccccagcgccggagcugcuucgaguccagccccgaccccgagcucaagucccgcacccccagccggcacuccugcagcggcuccuccccgccccgcgugaaguccuccaccccgccccggcagagccccucccgcagcuccagcccccagcccaaggucaaggccaucaucagcccccggcagcgcagccacuccgggagcuccagccccuccccgagccgggugaccucccgcaccacgccccggcgcagccgguccgugagccccugcuccaacgucgagagccgccugcugccccgguacagccacuccggcagcuccagcccggacaccaaggugaagcccgagacgccgccccgccagucccacagcggcuccaucagcccguaccccaaggugaaggcccagacgccgcccgggcccucccucagcggcuccaagagccccugcccccaggagaaguccaaggacagccugguccaguccugccccgggagccugucccucugcgcgggcgugaaguccuccacgccgcccggggagagcuacuucggcgugagcucccugcagcugaagggccagagccagaccucccccgaccaccggagcgacaccuccagcccggagguccgccagucccacagcgagucccccagccuccaguccaagagccagaccucccccaagggcgggcgcagccgguccagcucccccgugaccgagcuggccagccgcuccccgauccggcaggaccgcggggaguucagcgccagccccaugcugaaguccggcaugagccccgagcagucccgguuccagagcgacuccagcuccuaccccacggucgacagcaacucccuccuggggcagagccgccuggagaccgccgaguccaaggagaagauggcgcucccgccccaggaggacgccaccgccagcccgccccggcagaaggacaaguucucccccuuccccgugcaggaccgccccgagagcucccugguguucaaggacacccugcggaccccgccccgcgagcggagcggcgccggcuccagccccgagaccaaggagcagaacuccgcccuccccaccagcagccaggacgaggagcugauggaggucguggagaaguccgaggagcccgcggggcagauccugagccaccucuccagcgagcugaaggagauguccaccagcaacuucgaguccagccccgagguggaggagcgccccgccgucucccugacccuggaccagagccagucccaggccagccucgaggccguggaggugcccuccauggccagcuccuggggcgggccgcacuucagccccgagcacaaggagcuguccaacagcccccugcgggagaacuccuucggcagcccccucgaguuccgcaacagcgggccgcugggcaccgagaugaacaccggcuucuccagcgaggucaaggaggaccugaacgggcccuuccucaaccagcuggagaccgaccccucccuggacaugaaggagcagagcacccgguccagcggccacuccagcuccgagcucagccccgacgcgguggagaaggccgggauguccagcaaccaguccaucagcuccccggugcuggacgccgucccccgcacccccagccgggagcgcuccagcagcgccuccagccccgagaugaaggacggccugccgcggacccccucccgccgcagccgguccggcagcucccccgggcuccgcgacggcagcgggacccccucccggcacagccuguccggcagcuccccggggaugaaggacaucccccgcacccccagccggggccgcuccgagugcgacagcucccccgagccgaaggcccugccccagacgccccggccccgcagccgguccccgagcagccccgagcucaacaacaagugccugacgccccagcgcgagcgguccggcagcgaguccagcguggaccagaagaccguggcgcgcaccccgcuggggcagcggucccgcagcggcuccagccaggagcucgacgucaagcccuccgccagcccccaggagcgguccgagagcgacuccagccccgacuccaaggccaagacgcgcaccccgcugcggcagcgcagccgguccgggagcucccccgagguggacagcaagagccgccugagcccccggcgcagccgcuccggcagcucccccgaggugaaggacaagccgcgggccgcgccccgcgcccagagcggguccgacagcucccccgagcccaaggccccggcgccccgggcccucccccgccggagccgcuccggcagcuccagcaagggccgggggcccuccccggagggcagcuccagcaccgaguccagccccgagcacccgcccaagagccgcaccgcgcggcgcgggucccggagcuccccggagcccaagaccaagucccgcacgccgccccggcgccgguccagccgcuccagcccggagcugacccggaaggcccgccugucccggcgcagccgcuccgccagcuccagccccgagacccggucccgcacgccgccccggcaccgccggagcccguccgucagcucccccgagcccgccgagaagucccgcagcucccggcgccggcgcagcgccuccagcccgcggaccaagaccaccucccgccggggccgcagccccucccccaagccccgggggcuccagcgcagccggucccgcagccggcgcgagaagacgcggaccacccgccgccgggaccgcuccggcagcucccagagcaccucccggcgccggcagcgcagccggucccgcagccgggugacgcgccggcgccggggcggguccggcuaccacagccgcagcccggcgcggcaggaguccagccgcaccuccagccggcgccggcgcgggcgcucccggacgccgcccaccagccgcaagcggucccgcagccggacgucccccgccccguggaagcgcagccggucccgcgccagccccgccacccaccggcgcucccggagccgcacgccccugaucucccggcgccggagccgcucccggaccagccccgugagccgccggcgcucccggagccgcacguccgucacccgccggcgcagccggucccgcgccagcccggugucccggcgccggagccgcucccggacgccgcccgugacccgccggcgcagccggucccgcacgcccaccacccggcgccggagccgcucccggaccccgcccgucacgcgccgccggagccgcucccggacgccgcccgugacccgccggcgcagccggucccgcaccagcccgaucacccggcgccggucccgcagccggacgagccccgugacccgccggcgcucccggagccgcaccucccccgucacccggcgccggagccgcucccgcacgagccccgugacccggcgccggucccgcagccggaccccgcccgcgauccgccggcgcucccggagccgcacgccccugcucccccggaagcgcucccggagccgcuccccgcuggccauccggcgccggagccgcucccggacgccccgcaccgcccgcggcaagcggagccugacccgcagcccgcccgccauccggcgccggagcgccuccggcagcagcuccgaccgcagccgguccgcgacgccgcccgccacccgcaaccacagcgggucccggacgccgcccguggcccucaacagcucccgcaugagcugcuucucccggcccagcaugucccccacgccccuggaccgcugccggagccccggcaugcuggagccccucggguccagccgcacccccauguccguccugcagcaggccggcgggagcaugauggacggccccggcccccggauccccgaccaccagcgcacguccgugcccgagaaccacgcgcagagccggaucgcccuggcccucaccgccaucucccuggggaccgcccggcccccgcccagcaugagcgcggccggccuggccgcccgcaugucccaggugcccgcccccgucccccucaugagccugcgcaccgcgcccgccgccaaccuggccucccggauccccgccgcgagcgccgccgccaugaaccucgcguccgcccgcacgcccgccaucccgaccgccgugaaccuggccgacagccgcacccccgcggccgccgccgccaugaaccuggcgagcccccggaccgccguggccccgagcgccgucaaccucgccgacccccgcacgcccaccgcgcccgccgugaaccuggccggggcccggaccccggcggcccuggccgcccucucccugaccggcagcgggacgccgcccaccgccgcgaacuaccccuccagcucccgcaccccgcaggcccccgccagcgccaaccuggugggcccccgguccgcccacgcgaccgcccccgucaacaucgccggcagccgcacggccgccgcgcucgccccggccucccugaccagcgcccggauggcccccgcgcuguccggggccaaccucaccagcccccgcgugccccugagcgccuacgagcggguguccggccgcaccagcccgccccugcucgaccgggcccgcucccggacgccgcccagcgcgccgucccagagccgcaugaccuccgagcgggcccccagccccuccagccgcauggggcaggcccccucccagagccugcugccgcccgcccaggaccagccccggucccccgucccgagcgccuucuccgaccagagccgcugccucaucgcgcagaccacccccguggccggcucccagagccuguccagcggggccguggccacgaccaccagcuccgccggcgaccacaacggcaugcugagcguccccgcgccgggggugccccacuccgacgugggcgagccgcccgccagcaccggggcccagcagcccuccgcccucgccgcgcugcagcccgccaaggagcggcgcagcuccagcuccagcuccagcuccagcuccagcuccagcagcuccagcuccagcuccagcuccagcuccagcuccggcagcuccagcuccgacagcgagggguccagccugcccguccagcccgagguggcccucaagcgcgugccgucccccacccccgcccccaaggaggcgguccgggagggccgcccgcccgagcccacgcccgccaagcggaagcgccggagcagcuccagcuccagcuccagcuccagcuccagcuccagcuccagcuccagcuccagcuccagcagcuccagcuccagcuccagcuccagcuccagcuccagcuccagcuccagcuccagcuccccgagccccgccaagcccggcccccaggcccugccgaagcccgccagccccaagaagcccccgcccggggagcgccggucccgcagcccccggaagcccaucgacucccugcgcgacagccggucccucagcuacuccccgguggagcgccggcgccccagcccccagccgagcccccgggaccagcaguccuccagcuccgagcgcggcagccggcgcgggcagcggggcgacucccgcagccccucccacaagcggcgccgcgagacccccagcccgcggcccaugcgccaccgguccagccgcagccccuga

SEQ ID NO: 37101 - RNA, 1836 nt, Artificial Sequence
  derived and/or modified sequence opt1 from SRRM4__Homo_sapiens__NP_919262
auggccagcgugcagcagggcgagaagcagcuguucgagaaguucuggcgcgggaccuucaaggccgucgcgacgccccggccggaguccaucaucguggccagcaucaccgcccgcaagccccucccccggaccgagccccagaacaacccggugguccccgcccaggacggccccuccgagaagcuggggcagcaccuggccaccgagccccucggcaccaacagcugggagcgcgacaagacgugccgggagcugggggcgacccgcggccacuccgccagccacgacaaggaccugaccccgccgcccuccagccggggcaagaagaagaagaagaaguccacccgcaagaagcggcgccggagcuccagcuacucccccagccccgugaagaagaagaagaagaaguccagcaagaagcacaagcgccggcgcuccuucagcaagaagcggcgccacuccagcagcucccccaagagcaagcggcgcgacgagaagcggcacaagaagcagucccgcagccggccccgcaagucccaccgccaccggcaccaccgcugccccagccggucccagagcuccgagagccgcccguccagcugcgagucccggcaccgcgggcggagccccgaggagggccagaagucccgccggcgccacagccggcgcugcuccaagacgcucugcaaggacagccccgaggcccaguccagccggcccccgagccagccccugcagaugcugggguaccucuccgcccgcggcgugaucaccgggagcggcuccgcggccgaccuguucaccaagaccgccagcccccugacgaccucccggggccgcagccaggaguacgacuccgggaacgacaccagcuccccgcccagcacccagacguccagcgcccggucccgcggccaggagaaggggagccccuccggcggccucagcaagucccgggagcugaacagcgggaacaccagcgacuccggcaacagcuucaccaccuccagcccccagaacaagggggccaugcuggagaaccucucccccacgagccgcggccgcgagucccggggguuccagagcccgugccuggagugcgcggaggucaagaaguccagccuggugcccuccaccgcccgcagcucccccaugaagggcugcagccgguccagcuccuacgccagcacccgcuccagcagccacuccagccgguccccgaacccccgcgccagcccccgguacacccagucccgcagcacguccagcgagaagcgguccuacagccgcucccccagcuacuccagcaaguccggcaagcggagcccgcccucccgcagcucccggagccgccggagccccuccuacagccgcuacucccccagccgggagcgcgacccgaaguacuccgagaaggacagccagcagcgggagcgcgagcgggcccgccgccggcgccgguccuacagccccaugcgcaagcggcgccgggacucccccagccaccucgaggcgcgccggaucaccuccgcccgcaagcggcccaucccguacuaccgccccagccccuccagcuccgggagccuguccagcaccuccagcugguacagcuccagcuccagccgguccgccagccgcuccuacagccggucccgcagccggucccgcagccggcgccgcucccggacccgcacgagcuccagcuccagcucccggagccccagcccgggcucccgcagccggucccgcagccggucccgcagccggucccgcagccggucccagagccgcuccuacagcuccgccgacagcuacuccagcacccggcgcuga

SEQ ID NO: 37102 - RNA, 2652 nt, Artificial Sequence
  derived and/or modified sequence opt1 from SRRT__Homo_sapiens__XP_005250462
auggcccccagcgaccgcgccaugggcgacuccgacgacgaguacgaccggcgccggcgcgacaaguuccggcgcgagcggagcgacuacgaccgcucccgggagcgcgacgagcggcgccgcggggacgacuggaacgaccgcgagugggaccggggccgcgagcggcgcagccgcggggaguaccgggacuacgaccggaaccgccgcgagcgguucuccccgccccgccacgagcugagcccgccccagaagcggaugcgccgggacugggacgagcacuccagcgaccccuaccacuccggcuacgagaugcccuacgccgggggcggcgggggccccaccuacgggcccccgcagcccuggggccaccccgacgugcacaucaugcagcaccacguccuccccauccaggcgcgccuggggagcaucgccgagaucgaccugggcgugccgccgcccgugaugaagaccuucaaggaguuccuccugucccuggacgacagcgucgacgagacggaggccgugaagcgguacaacgacuacaagcucgacuuccgccggcagcagaugcaggacuucuuccuggcccacaaggacgaggagugguuccgcuccaaguaccaccccgacgaggugggcaagcggcgccaggaggcgcgcggggcccugcagaaccggcuccgggucuuccugagccugauggagaccggcugguucgacaaccuccugcuggacaucgacaaggccgacgccaucgugaagaugcucgacgcggccgugaucaagauggagggcgggaccgagaacgaccugcgcauccuggagcaggaggaggaggaggagcaggccggcaagcccggggagcccuccaagaaggaggagggccgggccggggccggccucggggacggcgagcgcaagaccaacgacaaggacgagaagaaggaggacggcaagcaggcggagaacgacagcuccaacgacgacaagacgaagaaguccgagggggacggcgacaaggaggagaagaaggaggacagcgagaaggaggccaagaaguccagcaagaagcggaaccgcaagcacagcggggacgacagcuucgacgagggcuccgucagcgaguccgagagcgaguccgagagcgggcaggccgaggaggagaaggaggaggccgaggaggcccugaaggagaaggagaagcccaaggaggaggagugggagaagcccaaggacgcggccggccuggagugcaagccgcgcccccuccacaagaccugcucccuguucaugcggaacaucgcccccaacaucagccgcgccgagaucaucucccugugcaagcgguaccccggcuucaugcgcguggcccucagcgagccgcagcccgagcggcgcuucuuccggcgcgggugggugaccuucgaccgguccgucaacaucaaggagaucugcuggaaccugcagaacauccgccugcgggagugcgagcucagccccggcgugaaccgcgaccugacccggcgcgugcggaacaucaacgggaucacgcagcacaagcagaucguccgcaacgacaucaagcuggcggccaagcucauccacacccuggacgaccggacccagcugugggccuccgagcccggcaccccgccccuccccacgagccugccgucccagaaccccauccugaagaacaucaccgacuaccucaucgaggaggugagcgccgaggaggaggagcugcugggguccagcggcggcgccccgcccgaggagccgcccaaggaggggaaccccgcggagaucaacguggagcgcgacgagaagcucaucaagguccuggacaagcugcuccuguaccugcggaucgugcacagccucgacuacuacaacacgugcgaguaccccaacgaggacgagaugcccaaccgcugcggcaucauccacgugcgggggcccaugccgcccaaccgcaucucccacggcgagguccuggaguggcagaagaccuucgaggagaagcugacgccccuccugagcgugcgcgagucccugagcgaggaggaggcccagaagaugggccggaaggaccccgagcaggagguggagaaguucgucaccuccaacacccaggagcuggggaaggacaaguggcucugcccccugagcggcaagaaguucaaggggcccgaguucgugcgcaagcacaucuucaacaagcacgccgagaagaucgaggaggucaagaaggagguggccuucuucaacaacuuccugaccgacgcgaagcggccggcccuccccgagaucaagcccgcccagcccccgggccccgcccagauccugccgcccgggcugacccccggccuccccuacccccaccagaccccgcagggccugaugcccuacgggcagccccggcccccgauccugggcuacggggccggcgcggugcggcccgccguccccaccgggggcccgcccuacccccacgcccccuacggcgccgggcgcggcaacuacgacgccuuccgggggcagggcggguaccccggcaagccgcgcaaccggauggugcgcggcgacccccgggcgaucguggaguaccgcgaccucgacgcccccgacgacgucgacuucuucuga

SEQ ID NO: 37103 - RNA, 519 nt, Artificial Sequence
  derived and/or modified sequence opt1 from SRSF10__Homo_sapiens__NP_001287865
augagccgcuaccugcggcccccgaacaccucccucuucgugcgcaacgucgccgacgacacccggagcgaggaccugcgccgggaguucggccgcuacgggcccaucguggacguguacgucccccuggacuucuacacgcggcgcccccggggcuucgccuacgugcaguucgaggacgugcgcgacgcggaggacgcccuccacaaccuggaccggaaguggaucugcgggcgccagaucgagauccaguucgcccagggcgaccggaagaccccgaaccagaugaaggccaaggaggggcgcaacgucuacuccagcucccgguacgacgacuacgaccgcuaccggcgcagccggucccgcagcuacgagcggcgccgcucccggagccgcuccuucgacuacaacuaccggcgcagcuacagcccccggaaccgccccaccggccggccccgccggucccgcucccacagcgacaacgacucccaggugagcaagaagaagaacgagcgguga

SEQ ID NO: 37104 - RNA, 1455 nt, Artificial Sequence
  derived and/or modified sequence opt1 from SRSF11__Homo_sapiens__XP_011540729
augagcaacaccaccgugguccccuccacggccggcccggggcccagcggcgggcccggcgggggcggcgggggcgggggcgggggcggcgggaccgaggugauccaggugaccaacgucucccccagcgccuccagcgagcagaugcgcacccuguucggcuuccucgggaagaucgacgagcugcggcuguucccgcccgacgacagcccccuccccgugagcucccgcgugugcuucgucaaguuccacgacccggacagcgcggugguggcccagcaccugacgaacaccgucuucguggaccgggcccugaucgugguccccuacgccgagggcgugauccccgacgaggccaaggcgcucucccugcuggcccccgccaacgccguggcgggccuccugcccgggggcgggcugcuccccacccccaacccccugacccagaucggcgccgucccgcuggccgcccucggggcccccacgcuggaccccgcgcuggccgcccucggccugcccggcgccaaccugaacagccagucccucgccgcggaccagcugcugaagcucaugagcaccguggacccgaagcugaaccacguggccgccgggcuggucucccccagccucaaguccgacaccagcuccaaggagaucgaggaggccaugaagcgcgugcgggaggcccagagccugaucagcgcggccaucgagcccgacaagaaggaggagaagcgccggcacucccgcagccggucccgcagccggcgccggcgcacccccuccagcucccggcaccgccggagccgcucccggagccgccggcgcucccacagcaagucccgcagccggcgccgguccaagagcccgcgccggcgccggucccacagccgcgagcggggccgccggucccgcagcacgagcaagacccgggacaagaagaaggaggacaaggagaagaagcgcuccaagaccccgcccaagagcuacuccaccgcccggcgcagccgguccgccagccgcgagcggcgccgccggcgcucccggagcgggacgcgcucccccaagaagccgcggagccccaagcgcaagcugucccggagccccuccccgcgccggcacaagaaggagaagaagaaggacaaggacaaggagcgcagccgggacgagcgcgagcgguccaccagcaagaagaagaaguccaaggacaaggagaaggaccgcgagcggaaguccgagagcgacaaggacgugaagcaggucacccgcgacuacgacgaggaggagcagggcuacgacuccgagaaggagaagaaggaggagaagaagcccaucgagaccgggagccccaagacgaaggagugcuccguggagaagggcaccggcgacagccuccgggaguccaaggugaacggggacgaccaccacgaggaggacauggacaugagcgacuga

SEQ ID NO: 37105 - RNA, 786 nt, Artificial Sequence
  derived and/or modified sequence opt1 from SRSF12__Homo_sapiens__NP_542781
augagccgcuacacccggcccccgaacaccucccuguucauccgcaacguggccgacgccacgcggcccgaggaccuccgccgggaguucggccgcuacgggcccaucgucgacguguacaucccccuggacuucuacacccggcgcccgcggggcuucgcguacgugcaguucgaggacguccgcgacgccgaggacgcccuguacaaccucaaccggaagugggugugcgggcgccagaucgagauccaguucgcccagggcgaccggaagacccccgggcagaugaaguccaaggagcgccaccccugcagccccagcgaccaccggcgcucccggagcccgucccagcgccggacccgcagccgguccagcuccuggggccgcaaccgccggcgcagcgacucccugaaggagagccggcaccgccgguucuccuacagccaguccaagagccgcuccaagagccugccccggcgcagcacguccgcccggcagagccgcacgccccggcgcaacuucggcucccgggggcgcagccgguccaagagccuccagaagcgcuccaagagcaucggcaagucccagagcuccagcccccagaagcagaccuccagcgggaccaagucccggagccacggccgccacuccgacagcaucgcgcgguccccgugcaagagccccaagggguacaccaacagcgagaccaaggugcagaccgccaagcacucccacuuccgcagccacucccgcagccgguccuaccgccacaagaacagcugguga

SEQ ID NO: 37106 - RNA, 606 nt, Artificial Sequence
  derived and/or modified sequence opt1 from SRSF1__Homo_sapiens__NP_001071634
augagcggcgggggcgugauccgcgggcccgccggcaacaacgacugccggaucuacgucgggaaccugccgcccgacauccgcaccaaggacaucgaggacguguucuacaaguacggcgccauccgggacaucgaccucaagaaccgccggggcgggccccccuucgcguucguggaguucgaggacccgcgcgacgccgaggacgccgucuacggccgggacggguacgacuacgacggcuaccgccugcggguggaguucccccgcuccgggcggggcaccggccgcgggggcgggggcggcgggggcgggggcgccccccgggggcgcuacggccccccgagccggcgcuccgagaaccggguggucgugagcggccugccccccuccgggagcuggcaggaccucaaggaccacaugcgcgaggccggcgacgugugcuacgcggacgucuaccgggacgggacgggcgugguggaguucguccgcaaggaggacaugaccuacgccgugcggaagcuggacaacaccaaguuccgcucccacgaggugggguacacccgcauccuguucuucgaccagaacuggauccaguggagcuga

SEQ ID NO: 37107 - RNA, 666 nt, Artificial Sequence
  derived and/or modified sequence opt1 from SRSF2__Homo_sapiens__NP_001182356
augagcuacggccgccccccgcccgacguggaggggaugaccucccugaaggucgacaaccucaccuaccggacgagccccgacacccugcgccggguguucgagaaguacggccgcgugggggacgucuacaucccccgggaccgcuacaccaaggagucccggggcuucgccuucgugcgcuuccacgacaagcgggacgccgaggacgcgauggacgccauggacggggccgugcuggacggccgcgagcuccggguccagauggcccgcuacggccggccgcccgacagccaccacucccgccgggggccccccccgcgccgguacggcgggggcggguacggccgccggagccgcuccccccggcgccgccggcgcagccggucccgcagccggucccgcagccggucccgcagccggucccgcuacagccgguccaagagccgcucccggacccgcagccggagccgcuccacgagcaagucccggagcgcccgccgguccaagagcaaguccagcuccgugagccgcucccgcagccggucccgcagccggucccgcagccgguccccccccccggugagcaagcgcgaguccaagagccggagccgcuccaagagcccccccaagucccccgaggaggagggcgcggucagcuccuga

SEQ ID NO: 37108 - RNA, 495 nt, Artificial Sequence
  derived and/or modified sequence opt1 from SRSF3__Homo_sapiens__NP_003008
augcaccgcgacagcugcccccuggacugcaagguguacgucggcaaccucgggaacaacggcaacaagaccgagcuggagcgggccuucggguacuacggcccgcugcgcuccguguggguggcccggaacccccccggguucgcguucgucgaguucgaggacccccgcgacgccgccgacgccgugcgggagcucgacggccgcacccugugcggcugccgggugcgcgucgagcugagcaacggggagaagcggucccgcaaccggggcccgccccccagcugggggcgccggccccgcgacgacuaccggcgccgguccccgcccccccgccggcgcagcccccggcgccgcuccuucagccggucccgcagccggucccucagccgcgaccggcgccgggagcgcucccugagccgggagcgcaaccacaagccgucccggagcuucucccgcagccggucccgcagccggagcaacgagcgcaaguga

SEQ ID NO: 37109 - RNA, 1395 nt, Artificial Sequence
  derived and/or modified sequence opt1 from SRSF4__Homo_sapiens__XP_011540253
augccccgcguguacaucggccggcugagcuaccaggcccgcgagcgggacgucgagcgcuucuucaagggguacggcaagauccucgagguggaccugaagaacggguacggcuucguggaguucgacgaccugcgggacgccgacgacgcggucuacgagcucaacgggaaggaccugugcggcgagcgcgugaucguggagcacgcccggggcccgcgccgggacggguccuacggcagcgggcgcuccggcuacggguaccggcgcagcggccgggacaaguacggcccgcccacccgcaccgaguaccggcugaucgucgagaaccucuccagccgcugcuccuggcaggaccugaaggacuacaugcggcaggccggggaggugacguacgccgacgcccacaagggccgcaagaacgagggggugaucgaguucgucagcuacuccgacaugaagcgggcgcuggagaagcucgacggcaccgaggugaacggccgcaagauccggcugguggaggacaagcccgggagccgccgccggcgcuccuacagccggucccgcagccacucccggagcggcucccgcagccgguccaagagccgcagccggucccagagccgcucccggagcaagaaggagaagucccgcagccccuccaaggagaagucccggagccgcagccacuccgccggcaagagccgguccaagagcaaggaccaggccgaggagaagauccagaacaacgacaacgucgggaagcccaagucccgcagccccucccggcacaagagcaaguccaagagccgcagccggucccaggagcgccgcguggaggaggagaagcgggggagcgugucccgcggccggagccaggagaagucccugcgccagagccggucccgcagccgguccaagggcgggagccgcucccggagccgcucccggagcaaguccaaggacaagcgcaagggccggaagcgcagccgggaggagucccgcagccggagccgcucccggagcaaguccgagcgcagccggaagcgcggguccaagcgcgacagcaaggccggcuccagcaagaagaagaagaaggaggacaccgaccggucccagagccgcucccccagccgguccgucagcaaggagcgcgagcacgcgaaguccgagagcucccagcgggaggggcgcggcgagagcgagaacgccggcaccaaccaggagacgcggucccgcagccggagcaacuccaagagcaagccgaaccuccccuccgagagccgcucccggagcaaguccgccagcaagacccgcucccggagcaagucccgcagccgguccgccagccgcucccccagccggucccgcagccggucccacagccgcagcuga

SEQ ID NO: 37110 - RNA, 819 nt, Artificial Sequence
  derived and/or modified sequence opt1 from SRSF5__Homo_sapiens__NP_001307143
augagcggcugccgcguguucaucgggcggcugaaccccgccgcccgcgagaaggacgucgagcgguucuucaagggcuacgggcgcauccgggacaucgaccucaagcgcggcuucggguucguggaguucgaggacccgcgggacgcggacgacgccguguacgagcuggacggcaaggagcugugcuccgagcgcgucaccaucgagcacgcccgggcccgcagccggggcgggcgcggccgggggcgcuacuccgaccgguucagcucccgccggccccgcaacgaccggcgcaacgccccgcccgugcggaccgagaaccgccucaucguggagaaccugagcucccgcgucagcuggcaggaccugaaggacuucaugcggcaggcgggcgaggugacguucgccgacgcccaccgccccaagcucaacgaggggguggucgaguucgccuccuacggcgaccugaagaacgcgaucgagaagcugagcggcaaggagaucaacgggcggaagaucaagcucaucgagggcuccaagcgccacagccggucccgcagccggucccgcagccggacccgcuccagcucccggagccgcagccggucccgcagccggucccgcaagagcuacucccggagccgcucccggagccgcucccgcagccgguccaagagccgcuccgugagccggucccccgugcccgagaagucccagaagcgcgggagcagcucccggagcaagagccccgccuccgucgaccgccagcggagccgcucccggagccgcucccggagcguggacuccggcaacuga

SEQ ID NO: 37111 - RNA, 1035 nt, Artificial Sequence
  derived and/or modified sequence opt1 from SRSF6__Homo_sapiens__NP_006266
augccccgcguguacaucggccggcugagcuacaacguccgcgagaaggacauccagcgguucuucuccggguacggccgccuccuggagguggaccugaagaacggguacggcuucguggaguucgaggacagccgggacgccgacgacgccgucuacgagcucaacgggaaggagcugugcggcgagcgcgugaucguggagcacgcgcggggcccccgccgggaccgcgacggguacuccuacggcagccgguccgggggcgggggcuacagcucccgccggaccagcggccgcgacaaguacgggccgcccguccggaccgaguaccgccugaucguggagaaccucuccagccggugcuccuggcaggaccugaaggacuucaugcgccaggccggcgaggugacguacgccgacgcccacaaggagcggaccaacgagggggucaucgaguuccgcagcuacuccgacaugaagcgggcccuggacaagcucgacggcaccgagaucaacggccgcaacauccgccugaucgaggacaagccccggaccagccaccgccgguccuacagcgggucccgcagccggucccgcagccggcgccggagccgcucccggagccgccgguccagccgcucccggagccgcuccaucagcaagucccggagccgcucccggagccgcuccaagggccgcagccggucccgcagcaaggggcggaagucccgcagcaaguccaagagcaagcccaagagcgaccggggcucccacagccacucccgcagccgguccaaggacgaguacgagaagucccgcucccggagccgcucccggagccccaaggagaacgggaagggcgacaucaaguccaagagccgcucccggagccagucccgcagcaacagcccccugcccgugccgcccagcaaggcgcggagcguguccccgccgcccaagcgcgccacgagccggucccgcagccggucccgcagcaagucccggagccgcucccgcagcuccagccgggacuga

SEQ ID NO: 37112 - RNA, 717 nt, Artificial Sequence
  derived and/or modified sequence opt1 from SRSF7__Homo_sapiens__NP_001026854
augagccgcuacggccgguacgggggcgagaccaagguguacgucgggaaccugggcaccggggccggcaagggcgagcucgagcgcgccuucuccuacuacgggccccugcggacgguguggaucgcgcgcaacccgcccggcuucgccuucguggaguucgaggacccccgggacgccgaggacgccguccgcgggcuggacggcaaggugaucugcgggagccgggugcgcgucgagcucuccaccggcaugccccggcgcagccgguucgaccgcccgcccgcccggcgccccuucgaccccaacgaccggugcuacgagugcggcgagaaggggcacuacgcguacgacugccaccgcuacucccggcgccggcgcagccggucccgcagccgcucccacagccggucccgcggccggcgcuacagccggucccgcagccggucccgcgggcggcgcagccgguccgccagcccgcgccggucccgcagcaucagccugcggcgcucccggagcgccucccugcgccggagccgcuccggcagcaucaagggcucccgcuacuuccagagccccucccggagccgcucccggagccgcuccaucagccggccccgcuccagccgguccaagagccgcucccccagcccgaagcggagccgcucccccagcgggagcccccggcgcuccgccucccccgagcggauggacuga

SEQ ID NO: 37113 - RNA, 666 nt, Artificial Sequence
  derived and/or modified sequence opt1 from SRSF9__Homo_sapiens__NP_003760
augagcggcugggccgacgagcgcgggggcgagggggacggccggaucuacguggggaaccugcccaccgacguccgcgagaaggaccucgaggaccuguucuacaaguacggccggauccgcgagaucgagcugaagaaccggcacggccucgugccguucgccuucgugcgcuucgaggacccccgggacgcggaggacgccaucuacgggcgcaacggcuacgacuacgggcagugccggcugcgcgucgaguucccccggaccuacggcgggcgcggcggcuggccccgcgggggccggaacgggccgcccacgcggcgcuccgacuuccgggugcuggugagcggccucccgcccuccggcagcuggcaggaccugaaggaccacaugcgcgaggccggggacgucugcuacgccgacgugcagaaggacggcguggggauggucgaguaccugcggaaggaggacauggaguacgcccuccgcaagcuggacgacaccaaguuccggucccacgagggcgagaccagcuacauccgcguguaccccgagcgcuccaccagcuacggguacucccggagccgcuccggcagccggggccgcgacucccccuaccagagccgggggagcccccacuacuucucccccuuccgcccguacuga

SEQ ID NO: 37114 - RNA, 414 nt, Artificial Sequence
  derived and/or modified sequence opt1 from SRXN1__Homo_sapiens__NP_542763
augggccugcgcgccgggggcacccucgggcgggccggcgcggggcgcggcgcccccgagggcccggggcccagcggcggggcccagggcggguccauccacagcggccggaucgccgccgugcacaacgucccccuguccgugcugauccgcccccucccgagcgugcuggaccccgcgaagguccagucccugguggacaccauccgggaggaccccgacagcgugcccccgaucgacguccucuggaucaagggcgcccagggcggggacuacuucuacuccuucgggggcugccaccgcuacgccgccuaccagcagcugcagcgggagacgauccccgcgaagcuggugcagagcacccucuccgaccugcgcguguaccugggcgccagcacccccgaccuccaguga

SEQ ID NO: 37115 - RNA, 615 nt, Artificial Sequence
  derived and/or modified sequence opt1 from SRY__Homo_sapiens__NP_003131
augcagagcuacgccuccgccaugcugagcguguucaacuccgacgacuacagccccgcgguccaggagaacauccccgcccugcgccgguccagcuccuuccugugcaccgagagcugcaacuccaaguaccagugcgagaccggcgagaacagcaaggggaacgugcaggaccgcgugaagcggcccaugaacgccuucaucgucuggucccgcgaccagcggcgcaagauggcccuggagaacccccggaugcgcaacagcgagaucuccaagcagcucggcuaccaguggaagaugcugacggaggccgagaaguggcccuucuuccaggaggcgcagaagcugcaggccaugcaccgggagaaguacccgaacuacaaguaccgcccccggcgcaaggccaagaugcuccccaagaacugcagccugcugcccgccgacccggcguccgugcucugcagcgaggugcagcuggacaaccggcuguaccgcgacgacugcaccaaggccacccacucccggauggagcaccagcucgggcaccucccgcccaucaacgccgccagcagcccccagcagcgcgaccgguacucccacuggaccaagcuguga

SEQ ID NO: 37116 - RNA, 1257 nt, Artificial Sequence
  derived and/or modified sequence opt1 from SS18__Homo_sapiens__NP_001007560
augagcguggccuucgccgcgccccgccagcggggcaagggggagaucaccccggccgccauccagaagaugcuggacgacaacaaccaccucauccagugcaucauggacucccagaacaagggcaagaccagcgagugcucccaguaccagcagaugcugcacacgaaccuggucuaccucgccaccaucgccgacagcaaccagaacaugcagucccugcugcccgcgccccccacccagaacaugccgauggggcccggcgggaugaaccagagcggcccccccccgcccccccgcucccacaacaugcccagcgacggcaugguggggggcgggccgcccgccccccacaugcagaaccagaugaacggccagaugcccgggccgaaccacaugcccaugcagggccccggccccaaccagcucaacaugaccaacuccagcaugaacaugccguccagcucccacgggagcaugggcggguacaaccacuccgugcccagcucccagagcaugcccguccagaaccagaugacgaugucccagggccagcccaugggcaacuacgggccgcggcccaacaugagcaugcagcccaaccagggccccaugaugcaccagcagccgcccagccagcaguacaacaugccccaggggggcgggcagcacuaccagggccagcagccgcccaugggcaugauggggcaggugaaccagggcaaccacaugauggggcagcgccagaucccccccuaccggccgccccagcagggccccccccagcaguacuccgggcaggaggacuacuacggcgaccaguacagccacggcgggcagggcccgcccgaggggaugaaccagcaguacuaccccgacggccacaacgacuacggguaccagcagcccuccuacccggagcagggcuacgaccgccccuacgaggacagcucccagcacuacuacgagggcgggaacagccaguacggccagcagcaggacgccuaccaggggccccccccgcagcagggcuaccccccccagcagcagcaguaccccggccagcagggguacccgggccagcagcagggguacggccccucccaggggggccccggcccccaguacccgaacuacccccaggggcagggccagcaguacgggggcuaccggcccacccagccggggcccccccagcccccgcagcagcgccccuacggcuacgaccagggccaguacgggaacuaccagcaguga

SEQ ID NO: 37117 - RNA, 1191 nt, Artificial Sequence
  derived and/or modified sequence opt1 from SS18L1__Homo_sapiens__NP_945173
augagcguggccuucgccuccgcgcgcccccggggcaagggggaggucacccagcagaccauccagaagaugcuggacgagaaccaccaccucauccagugcauccuggaguaccagagcaagggcaagacggccgagugcacccaguaccagcagauccugcaccgcaaccucguguaccuggccaccaucgccgacuccaaccagaacaugcagagccugcucccggccccgcccacccagaacaugaaccuggggcccggcgcgcugacgcaguccgggagcucccagggccuccacagccagggcucccugagcgacgccaucuccaccgggcugccgcccagcucccuccugcagggccagaucgggaacggccccagccacguguccaugcagcagaccgcccccaacacccugcccacgaccagcauguccaucagcgggcccggcuacucccacgccggccccgcgagccaggggguccccaugcagggccaggggaccaucggcaacuacgugagccggaccaacaucaacaugcaguccaacccggugagcaugaugcagcagcaggccgccacgucccacuacagcuccgcccagggcgggagccagcacuaccagggccaguccagcaucgccaugauggggcagggcucccaggggagcuccaugaugggccagcgccccauggcgcccuaccggcccagccagcagggcuccagccagcaguaccucgggcaggaggaguacuacggcgagcaguacucccacagccagggggccgccgagccgaugggccagcaguacuaccccgacgggcacggcgacuacgccuaccagcaguccagcuacaccgagcaguccuacgaccgcagcuucgaggagagcacccagcacuacuacgagggcgggaacucccaguacagccagcagcaggccggcuaccagcagggggcggcccagcagcagaccuacucccagcagcaguaccccagccagcaguccuaccccggccagcagcagggguacggcagcgcccagggcgccccgucccaguaccccggguaccagcagggccaggggcagcaguacggcagcuaccgggcgccccagacggcccccuccgcccagcagcagcgcccguacggcuacgagcaggggcaguacggcaacuaccagcaguga

SEQ ID NO: 37118 - RNA, 1227 nt, Artificial Sequence
  derived and/or modified sequence opt1 from SSB__Homo_sapiens__NP_003133
auggccgagaacggcgacaacgagaagauggccgcgcuggaggccaagaucugccaccagaucgaguacuacuucggggacuucaaccucccccgcgacaaguuccugaaggagcagaucaagcuggacgagggcugggugccgcucgagaucaugaucaaguucaaccggcugaaccgccugaccaccgacuucaacgucaucguggaggcccucagcaaguccaaggccgagcugauggagaucagcgaggacaagacgaagauccggcgcucccccagcaagccccugcccgaggugaccgacgaguacaagaacgacgucaagaaccgguccguguacaucaagggguucccgaccgacgccacccucgacgacaucaaggaguggcuggaggacaagggccaggugcugaacauccagaugcgccggacgcuccacaaggcguucaaggggagcaucuucgucguguucgacuccaucgagagcgccaagaaguucguggagacccccggccagaaguacaaggagaccgaccugcugauccucuucaaggacgacuacuucgccaagaagaacgaggagcgcaagcagaacaaggucgaggccaagcugcgggcgaagcaggagcaggaggccaagcagaagcuggaggaggacgccgagaugaagucccucgaggagaagaucggcugccugcugaaguucagcggggaccucgacgaccagaccugccgcgaggaccugcacauccuguucuccaaccacggcgagaucaaguggaucgacuucgugcgcggggccaaggagggcaucauccucuucaaggagaaggccaaggaggcgcuggggaaggccaaggacgccaacaacggcaaccugcagcuccggaacaaggaggugacgugggagguccuggagggcgagguggagaaggaggcccugaagaagaucaucgaggaccagcaggagagccucaacaaguggaaguccaaggggcggcgcuucaagggcaaggggaagggcaacaaggccgcgcagcccggcagcgggaagggcaaggugcaguuccaggggaagaagaccaaguucgccuccgacgacgagcacgacgagcacgacgagaacggcgccaccgggcccgucaagcgggcccgcgaggagaccgacaaggaggagccggccagcaagcagcagaagacggagaacggcgcgggcgaccaguga

SEQ ID NO: 37119 - RNA, 447 nt, Artificial Sequence
  derived and/or modified sequence opt1 from SSBP1__Homo_sapiens__NP_001243442
auguuccgccggcccgugcugcagguccuccgccaguucgugcggcacgagagcgagaccaccacgucccuggugcuggagcgcagccucaaccggguccaccuccugggccgcguggggcaggacccggugcugcggcaggucgagggcaagaaccccgugaccaucuucucccuggccaccaacgagauguggcgcagcggggacuccgagguguaccagcugggcgacgucagccagaagaccacguggcaccggaucuccguguuccgccccgggcuccgggacguggccuaccaguacgucaagaagggcagccgcaucuaccuggagggcaagaucgacuacggggaguacauggacaagaacaacgugcggcgccaggcgaccaccaucaucgccgacaacaucaucuuccuguccgaccagaccaaggagaaggaguga

SEQ ID NO: 37120 - RNA, 1026 nt, Artificial Sequence
  derived and/or modified sequence opt1 from SSBP2__Homo_sapiens__NP_001243662
auguacggcaagggcaagagcaacuccagcgccgugcccuccgacagccaggcccgcgagaagcuggcgcucuacgucuacgaguaccugcugcacgugggggcccagaaguccgcccagaccuuccucagcgagauccggugggagaagaacaucacccugggggagccgcccggcuuccugcacuccugguggugcguguucugggaccucuacugcgccgcccccgagcgccgggagacgugcgagcacagcuccgaggcgaaggccuuccacgacuacagcgccgccgcggcccccuccccgguccuggggaacaucccgcccggcgacggcaugcccguggggcccgugccgcccggcuucuuccaggcccucgggggcguccccgggagccagccccugcugcccuccggcauggaccccacccgccagcagggccaccccaacaugggcgggccgaugcagcggaugaccccgccccgcgggauggugccccugggcccccagaacuacggcggggccaugcggccgccccucaacgcccugggcgggcccggcaugcccgggaugaacaugggccccggcgggggccgccccuggcccaacccgaccaacgcgaacagcauccccuacuccagcgccucccccgggaacuacgugggcccgcccgggggcggcgggccgcccggcacgcccaucaugcccagccccgccgacuccaccaacagcggggacaacauguacacccugaugaacgccgugcccccgggccccaaccggcccaacuuccccauggggccgggcagcgacggccccaugggcgggcucgggggcauggagucccaccacaugaacggcagccugggguccggcgacauggacagcaucuccaagaacagccccaacaacaugucccugagcaaccagcccgggaccccgcgcgacgacggcgagaugggcgggaacuuccucaaccccuuccaguccgagagcuacucccccagcaugacgauguccgucuga

SEQ ID NO: 37121 - RNA, 3780 nt, Artificial Sequence
  derived and/or modified sequence opt1 from SSFA2__Homo_sapiens__NP_001123917
auggaccgcccccugagcuccagcgccgaggccgaggaggagcucgaguggcaggucgcgucccggcgccggaaggccugggccaagugccgcagcuccuggcaggccagcgagaccgaggaccuguccaccgaggccacgacccaggacgaggaggaggacgaggaggaggaccugccgggcgcgcagcuccccgccgccgggggccgggggaacguccccaacgagaagaucgccaucuggcugaaggacugccgcacgccccugggcgcgagccucgacgagcaguccagcuccacccugaagggggugcuggugcggaacggcggcagcuucgaggacgaccucucccugggggccgaggccaaccaccuccacgagagcgacgcccagaucgagaacugcaacaacauccucgccaaggagcgccggcugcaguuccaccagaagggccgcuccaugaacagcaccggguccggcaagagcuccgggaccgucagcagcguguccgagcugcucgagcuguacgaggaggacccggaggagauccuguacaaccucggcuucggccgggacgagcccgacaucgcgagcaagauccccucccgcuucuucaacagcuccagcuucgccaaggggaucgacaucaagguguuccuguccgcccagaugcagcggauggaggucgagaaccccaacuacgcccugaccagccgcuuccggcagaucgaggugcucaccacgguggccaacgcguucuccagccuguacucccaggucagcggcaccccgcugcagcgcaucggguccaugagcuccgugaccagcaacaaggagaccgacccgccgccgccccucacgcgguccaacaccgccaaccgccugaugaagacccugagcaagcucaaccugugcguggacaagaccgagaagggcgaguccagcagccccucccccagcgccgagaagggcaagauccugaacgucuccgugaucgaggagagcgggaacaagaacgaccagaagucccagaagaucaugaagaagaaggagagcuccagcaugcucgccacggugaaggaggaggucuccggcagcuccgccgcggugaccgagaacgccgacagcgaccggaucuccgacgaggccaacagcaacuucaaccaggggaccgagaacgagcaguccaaggagacccagagccacgaguccaagcugggcgaggagagcgggaucguggagagcaagcuggacuccgacuucaacaucagcucccacagcgagcuggagaacuccagcgagcugaaguccgugcacaucagcacgcccgagaaggagcccugcgcgccccugaccauccccuccauccgcaacaucaugacccagcagaaggacagcuucgagauggaggaggugcaguccaccgagggcgaggcgccccacgugcccgccacguaccagcucggccugaccaagagcaagcgggaccaccuccugcgcaccgccucccagcacagcgacuccagcggguucgccgaggacuccaccgacugccugagccugaaccaccuccagguccaggagucccugcaggccaugggcagcagcgccgacuccugcgacagcgagacgaccgugaccucccugggggaggaccucgccacccccacggcccaggaccagcccuacuucaacgagagcgaggaggagucccuggugccccugcagaagggccucgagaaggccgccgcggucgccgacaagcgcaagagcgggucccaggacuucccgcagugcaacaccaucgagaacaccggcaccaagcagagcacgugcucccccggcgaccacaucaucgagaucaccgagguggaggaggaccuguuccccgccgagaccgucgagcugcugcgggaggccagcgccgaguccgacgugggcaagagcuccgagagcgaguucacccaguacaccacgcaccacauccucaagucccuggcgagcaucgaggccaagugcuccgacaugagcuccgagaacaccaccgggcccccgagcagcauggaccgcgugaacaccgcccugcagcgggcccagaugaaggucugcucccucagcaaccagcgcauggggcggucccugcucaagagcaaggaccugcugaagcagcgcuaccuguucgccaaggcgggcuacccccuccggcgcucccagagccugcccacgacccugcucuccccggugcggguggucagcuccgugaacgugcgccugagccccgggaaggagacccggugcuccccgcccagcuucaccuacaaguacacgcccgaggaggagcaggagcuggagaagcgcgucauggagcacgacggccagucccucgucaagagcaccaucuucaucucccccagcuccgugaagaaggaggaggcgccccagagcgaggcgccccggguggaggagugccaccacggccgcaccccgaccugcucccggcuggcgcccccgcccaugagccagagcacgugcucccugcacagcauccacuccgaguggcaggagcgcccccucugcgagcacacccggacccugagcacccacuccgugcccaacaucagcggggccacgugcuccgccuucgccagccccuucggcugccccuacucccaccgccacgccaccuacccguaccgggugugcagcgucaacccgcccuccgccaucgagaugcagcugcgccgcgugcuccacgacauccggaacagccugcagaaccugucccaguaccccaugaugcgcgggcccgaccccgccgccgcccccuacagcacccagaaguccagcgugcucccccuguacgagaacaccuuccaggagcugcaggucaugcggcgcucccucaaccuguuccggacgcagaugauggaccuggagcucgccaugcugcgccagcagaccaugguguaccaccacaugaccgaggaggagcgguucgagguggaccagcugcagggccuccgcaacagcguccggauggagcugcaggaccuggagcuccagcuggaggagcgccugcucggccuggaggagcagcugcgggccgugcgcaugccgucccccuuccggagcagcgcccucauggggaugugcggcucccgcagcgccgacaaccuguccugccccagcccgcugaacgugauggagcccgucaccgagcucaugcaggagcaguccuaccucaagagcgagcuggggcugggccugggggagaugggcuucgagaucccgcccggcgaguccagcgaguccguguucagccaggccacguccgagagcuccagcgugugcuccgggcccagccacgccaaccggcgcaccggcguccccuccaccgccagcguggggaaguccaagacgccccugguggcgcggaagaaggucuuccgcgccagcguggcccucacccccaccgccccgagccggaccggcuccgugcagaccccgcccgaccuggagagcuccgaggaggucgacgcggccgagggggcccccgagguggugggccccaagagcgaggucgaggagggccacgggaagcugcccuccaugcccgccgccgaggagaugcacaagaacguggagcaggacgagcuccagcaggucauccgcgagaucaaggagagcaucgugggcgagauccggcgcgagaucguguccgggcugcuggcggccgugagcuccagcaaggccuccaacagcaagcaggacuaccacuga

SEQ ID NO: 37122 - RNA, 2079 nt, Artificial Sequence
  derived and/or modified sequence opt1 from SSH1__Homo_sapiens__NP_001154802
auggcccuggugacccugcagcgcagccccaccccguccgccgcgagcuccagcgccuccaacagcgagcuggaggccggcuccgaggaggaccggaagcugaaccucagccuguccgagagcuucuucauggucaagggggccgcccuguuccuccagcagggcuccagcccccaggggcagcgcucccugcagcacccccacaagcacgcgggcgaccugccccagcaccuccaggugaugaucaaccugcugcggugcgaggaccgcaucaagcucgccgugcggcuggagagcgccugggccgaccgcguccgguacauggugguggucuacuccagcgggcgccaggacacggaggagaacauccugcucggcguggacuucuccagcaaggaguccaagagcugcaccaucggcauggugcugcggcuguggagcgacaccaagauccaccucgacggggacggcggguucuccgucagcaccgcgggccgcaugcacaucuucaagccgguguccgugcaggccauguggagcgcccugcagguccugcacaaggccugcgagguggcccggcgccacaacuacuuccccgggggcguggcgcucaucugggccacguacuacgaguccugcaucagcuccgagcagagcugcaucaacgaguggaacgccaugcaggaccuggaguccacccggcccgacagccccgcccuguucgucgacaagccgaccgagggcgagcgcaccgagcggcucaucaaggccaagcugcgcuccaucaugaugagccaggaccuggagaacgugacguccaaggagauccggaacgagcucgagaagcagaugaacugcaaccugaaggagcugaaggaguucaucgacaacgagaugcuccugauccuggggcagauggacaagcccagccucaucuucgaccaccuguaccugggcuccgaguggaacgcgagcaaccucgaggagcugcagggguccggcguggacuacauccugaacgucacccgcgagaucgacaacuucuuccccggccucuucgccuaccacaacauccggguguacgacgaggagaccaccgaccugcuggcccacuggaacgaggccuaccacuucaucaacaaggccaagcgcaaccacagcaagugccucgugcacugcaagaugggggucucccggagcgcgagcacggugaucgccuacgccaugaaggaguucggcuggccccuggagaaggccuacaacuacgugaagcagaagcgcuccaucacccgcccgaacgccggguucaugcggcagcugagcgaguacgagggcauccucgacgcguccaagcagcgccacaacaagcuguggcggcagcagaccgacagcucccugcagcagcccgucgacgaccccgccgggcccggcgacuuccucccggagacccccgacggcacgcccgagagccagcugcccuuccuggacgacgccgcccagccggggcugggcccgccccuccccugcugcuuccgccggcuguccgacccccugcuccccagccccgaggacgagaccgggucccuggugcaccuggaggaccccgagcgcgaggcgcuccuggaggaggccgccccgcccgccgagguccaccggcccgcccgccagccgcagcagggcagcgggcugugcgagaaggacgugaagaagaagcucgaguucggcucccccaagggccggagcgggucccugcuccagguggaggagaccgagcgcgaggagggccugggggcgggccggugggggcagcugcccacccagcuggaccagaaccuccugaacagcgagaaccugaacaacaacuccaagcgcagcugccccaacggcauggaggucggccgggcccgcccggccggguggcacacgcccucccuccccagccacagcaacuggcccaccuccgccagcguggugggcaccaccgggacgcggcaccacacccagcugaucuucuucuacugccugcucugggccccguccagccaccuccagggccccgagggcuccuucaccggguga

SEQ ID NO: 37123 - RNA, 4353 nt, Artificial Sequence
  derived and/or modified sequence opt1 from SSH2__Homo_sapiens__NP_001269058
auggcccuggugaccguccagcgcagccccaccccguccacgaccagcucccccugcgccagcuccagccaccucgaggacuccgagagcgcggcccugcugugcugcgagugcgaggaguccgagaucuucaccgacagcaacgaggccgacuccggcgaggaggagugccggagccagccccgcuccaucagcgaguccuuccucaccgugaagggggccgcccuguuccugccccggggcaacgggagcuccacgccgcgcaucagccaccggcgcaacaagcacgcgggcgaccuccagcagcaccuccaggccauguucauccugcuccggcccgaggacaacauccgccuggccgugcggcuggaguccaccuaccagaaccgcacccgguacauggucguggugagcaccaacgggcgccaggacacggaggagagcaucguccucggcauggacuucuccagcaacgacuccuccacgugcaccaugggccuggugcugccccucugguccgacacccugauccaccuggacggggacggcggguucagcguguccaccgacaaccggguccacaucuucaagcccgugagcgugcaggccaugugguccgcgcuccagagccugcacaaggccugcgaggucgcccgcgcccacaacuacuacccgggcucccuguuccucaccugggugagcuacuacgagucccacaucaacagcgaccaguccagcgugaacgaguggaacgccaugcaggacguccagucccaccggcccgacagccccgcgcuguucaccgacauccccaccgagcgcgagcggacggagcgccugaucaagaccaagcuccgggagaucaugaugcagaaggaccuggagaacaucaccuccaaggagauccgcaccgagcuggagaugcagauggugugcaaccuccgggaguucaaggaguucaucgacaacgagaugaucgugauccuggggcagauggacagcccgacgcagaucuucgagcacgucuuccugggcagcgaguggaacgccuccaaccucgaggaccugcagaaccgcggcgugcgcuacauccugaacgugacccgggagaucgacaacuucuuccccggggucuucgaguaccacaacauccgcguguacgacgaggaggccaccgaccuccuggccuacuggaacgacaccuacaaguucaucagcaaggccaagaagcacggcuccaagugccuggugcacugcaagaugggggucagccgguccgcgagcacggugaucgccuacgccaugaaggaguacggcuggaaccucgaccgcgccuacgacuacgucaaggagcggcgcaccgugaccaagcccaaccccuccuucaugcggcagcuggaggaguaccagggcauccugcucgccagcaagcagcgccacaacaagcuguggcggagccacagcgacuccgaccugagcgaccaccacgagccgaucugcaagcccgggcuggagcugaacaagaaggacaucaccacguccgcggaccagaucgccgaggugaagaccauggagagccacccgcccaucccgcccgucuucguggagcacauggugccccaggacgccaaccagaagggccugugcaccaaggagcgcaugaucugccucgaguucaccucccgggaguuccacgccgggcagaucgaggacgagcugaaccugaacgacaucaacggcugcagcuccgggugcugccucaacgagagcaaguucccccuggacaacugccacgccagcaaggcgcugauccagcccggccacguccccgagauggccaacaaguuccccgaccugacgguggaggaccucgagaccgacgcccugaaggccgacaugaacgugcaccuccugcccauggaggagcugaccuccccgcugaaggacccgcccaugagccccgaccccgagucccccagcccccagccguccugccagaccgagaucagcgacuucuccacggaccgcaucgacuucuucagcgcgcucgagaaguucgucgagcugucccaggagacccggagccgcuccuucagccacucccggauggaggagcugggcgggggccgcaacgagagcugccggcucuccgugguggaggucgcccccagcaaggugaccgccgacgaccagcgcuccagcucccugagcaacacgccccacgccagcgaggaguccagcauggacgaggagcaguccaaggccaucagcgagcuggugucccccgacaucuucaugcagagccacuccgagaacgcgaucagcgucaaggagaucgugaccgagaucgaguccaucagccagggggugggccagauccagcucaagggggacauccugccgaaccccugccacacccccaagaagaacuccauccacgagcugcuccuggagcgggcccagacccccgagaacaagccgggccacauggagcaggacgaggacagcugcaccgcccagcccgagcuggccaaggacuccggcaugugcaaccccgaggggugccucaccacgcacagcuccaucgccgaccuggaggagggcgagcccgcggagggggagcaggagcugcagggcagcgggaugcacccgggcgccaagugguaccccggcuccguccgccgcgccacccucgaguucgaggagcggcugcgccaggagcaggagcaccacggggccgccccgaccugcaccagccuguccacgcggaagaacagcaagaacgacagcuccguggcggaccucgcccccaagggcaagagcgacgaggccccgcccgagcacuccuucgugcugaaggagcccgagaugagcaaggggaagggcaaguacuccggcagcgaggccgggucccugagccacuccgagcagaacgcgaccguccccgccccgcgcgugcucgaguucgaccaccuccccgacccccaggagggcccggggagcgacaccggcacccagcaggagggggugcugaaggaccugcggacggucauccccuaccaggaguccgagacccaggccgugccccugccccugccgaagcgcguggagaucaucgaguacacccacaucgucaccagccccaaccacacgggccccggcuccgagaucgccaccagcgagaaguccggggagcagggccuccggaaggugaacauggagaaguccgugaccguccugugcacccuggacgagaaccucaaccgcacgcuggaccccaaccaggugagccugcacccccaggugcucccccugccccacagcuccagccccgagcacaaccggccgaccgaccaccccaccagcauccuguccagccccgaggaccgcggguccagccucuccaccgcccuggagacggcggcccccuucgucagccacaccacccaccuccuguccgccagccuggacuaccugcacccgcagaccauggugcaccucgagggcuucacggagcaguccagcaccaccgacgagcccuccgccgagcaggucagcugggaggagucccaggagagcccccuguccagcggguccgaggugcccuacaaggacagccagcuguccagcgccgaccucagccugaucuccaagcugggcgacaacaccggcgagcuccaggagaagauggacccgcugcccguggcgugccggcugccccacagcuccagcuccgagaacaucaagagccucucccacagccccgggguggucaaggagcgcgccaaggagaucgagucccgggugguguuccaggccggccugacgaagccgagccagaugcgccgguccgccagccuggccaagcucggguaccuggaccugugcaaggacugccuccccgagcgcgagcccgcguccugcgagagcccccaccugaagcugcuccagccguuccugcggaccgacuccggcaugcacgccauggaggaccaggagagccuggagaaccccggggcgccccacaacccggagcccaccaaguccuucgucgagcagcucaccacgaccgagugcaucgugcagagcaagcccguggagcgcccccugguccaguacgccaaggaguucggcuccagccagcaguaccugcucccgcgggccggccuggagcugaccagcuccgagggcgggcuccccgugcugcagacccaggggcugcagugcgccugccccgcccccggccucgccguggccccgcgccagcagcacgggcggacccacccccugcgccgccugaagaaggcgaacgacaagaagcggacgaccaaccccuucuacaacaccauguga

SEQ ID NO: 37124 - RNA, 735 nt, Artificial Sequence
  derived and/or modified sequence opt1 from SSMEM1__Homo_sapiens__NP_660311
augggcgaccuguucagccucuucugggagguggacccgccgcccauccccgucaacugcgccauccccaaccaggacuacgagugcuggaaggacgacuccugcgggaccaucggcagcuuccugcugugguacuucgugaucguguucguccucauguucuucucccgcgccagcguguggauguccgaggacaagaaggacgaggggagcggcaccuccacgagcgugcggaaggcguccaaggagaccagcugcaagcgccaguccaaggacagcgccugggaccccucccagaccaugaagaagcccaagcagaaccagcugacccccgucacgaacagcgagguggcccuggugaacgccuaccccgagcagcggcgcgcccggcgccagucccaguucaacgaggucaaccagaaccagcacgacagcgacaccaccgaguacggguccgaggagagcaacuccgaggcgagcagcuggaaggaguccgagagcgagcaccacccgucccccgacagcaucaagcggcgcaagauggcccagcggcagcgcaaccucggcuccuaccagaugagcgagcggcacugccugcacugcaaggcccugcgcaccaacgaguggcucgcccaccacucccggcagaagcccagcgugacgcccccgaugaagcgcgacucccaggaggagagcuccaucagcgacaucaacaagaaguucuccaaguucuga

SEQ ID NO: 37125 - RNA, 360 nt, Artificial Sequence
  derived and/or modified sequence opt1 from SSNA1__Homo_sapiens__NP_003722
augacccagcagggcgccgcccugcagaacuacaacaacgagcucgugaagugcaucgaggagcugugccagaagcgcgaggagcugugccggcagauccaggaggaggaggacgagaagcagcgccuccagaacgagguccggcagcugaccgagaagcuggcgcgcgugaacgagaaccucgcccggaagaucgccagccgcaacgaguucgaccggacgaucgccgagaccgaggccgcguaccugaagauccuggaguccagccagacccuccuguccgugcugaagcgcgaggccgggaaccucaccaaggccacggcccccgaccagaaguccagcggcgggcgggacagcuga

SEQ ID NO: 37126 - RNA, 732 nt, Artificial Sequence
  derived and/or modified sequence opt1 from SSPN__Homo_sapiens__NP_005077
augggcaagaacaagcagccccgcgggcagcagcggcagggcgggccgcccgccgccgacgcggccggccccgacgacauggagcccaagaaggggaccggcgccccgaaggagugcggcgaggaggagccccggaccugcugcgggugccgcuucccccugcuccuggcccugcuccagcuggcccugggcaucgcggugacggucgugggguuccucauggccagcaucuccagcucccugcuggugcgcgacacccccuucugggccggcaucaucgucugccucguggccuaccuggggcuguucaugcucugcgugagcuaccaggucgacgagcggaccugcauccaguucuccaugaagcugcuguacuuccuccugagcgcgcugggccucaccgugugcgugcuggccgucgccuucgccgcccaccacuacucccagcugacgcaguucacgugcgagaccacccucgacagcugccagugcaagcugccguccagcgagccccugucccgcaccuucguguaccgggacgugaccgacugcaccagcgucaccggcacguucaagcuguuccuccugauccagaugauccucaaccuggugugcgggcuggugugccuccuggcgugcuucgucauguggaagcaccgcuaccagguguucuacgugggcguccggaucugcucccugaccgccagcgaggggccccagcagaagaucuga

SEQ ID NO: 37127 - RNA, 15444 nt, Artificial Sequence
  derived and/or modified sequence opt1 from SSPO__Homo_sapiens__NP_940857
augcugcugcccgcccugcuguucggcauggccugggcccucgccgacgggcgcuggugcgaguggaccgagaccauccgcguggaggaggagguggcgccccgccaggaggaccuggugcccugcgccucccuggaccacuacucccgccucggcuggcgccuggaccugcccugguccgggcgcuccggccucacccgcagccccgcccccgggcugugccccaucuacaagccgcccgagacccggcccgccaaguggaaccgcaccgugcggaccugcugccccggcuggggcggggcccacugcaccgaggcccuggccaaggccucccccgagggccacugcuucgccauguggcagugccagcuccaggccgggagcgccaacgccuccgccggcagccuggaggagugcugcgcccgccccugggggcaguccuggugggacggcagcucccaggccugccggagcugcuccagccgccaccuccccggcuccgccagcucccccgcccuccugcagccccuggccggggccgucggccagcucuggagccagcaccagcggcccuccgcgaccugcgccagcuggagcggguuccacuaccgcaccuucgacggccggcacuaccacuuccugggccgcugcaccuaccugcucgccggggccgccgacuccacgugggccgugcaccugaccccgggcgaccggugcccccagcccgggcacugccagcgcgugaccaugggccccgaggagguccugauccaggccgggaacgugagcgugaagggccagcucguccccgagggccaguccuggcugcugcacgggcucagccugcaguggcugggcgacuggcucgugcuguccgggggccuggggguggucgugcggcucgaccgcaccggcagcaucuccaucagcguggaccacgagcuguggggccagacccaggggcugugcggccucuacaacggguggcccgaggacgacuucauggagcccggcgggggccuggccaugcuggccgccaccuucggcaacuccuggcggcuccccgggagcgaguccggcugccuggacgccgucgagguggcccaggggugcgacccccugggccucaucgacgccgacguggagcccggccaccuccgcgccgaggcccaggacgucugccaccagcugcucgaggggcccuucggccagugccacgcccaggugagccccgccgaguaccacgaggccugccuguucgccuacugcgccggggccauggccggcuccgggcaggagggccgccagcaggccgugugcgccaccuucgccagcuacguccaggccugcgcccggcgccacauccacauccgguggcgcaagcccggcuucugcgagcggcugugccccgggggccagcucuacuccgacugcgugagccugugcccgcccuccugcgaggcgguggggcagggcgaggaggagagcugccgcgaggagugcgucuccgggugcgagugcccccggggccuguucuggaacggcacccugugcgugcccgccgcccacugccccugcuacuacugccgccagcgguacguccccggggacaccgugcgccagcucugcaaccccugcgugugccgggacggccgcuggcacugcgcccaggcgcugugccccgccgagugcgccgucgggggcgacgggcacuaccugaccuucgacggccggagcuacagcuucuggggcgggcagggcugccgcuacucccucgugcaggacuacgugaaggggcagcugcugauccuccuggagcacggcgccugcgacgccgggagcugccugcacgcgaucuccgucagccucgaggacacccacauccagcugcgggacuccggcgccgugcuggugaacggccaggacgucgggcuccccuggaucggcgccgaggggcugagcgugcgccgggccuccagcgccuuccugcuccugcgcuggcccggcgcccagguccuguggggccucuccgaccccgucgccuacaucacccuggacccccggcacgcccaccaggugcaggggcugugcggcaccuucacccagaaccagcaggacgacuuccucacccccgccggggacguggagaccagcaucgccgcguucgccuccaaguuccaggucgccggcaaggggcgcugccccagcgaggacuccgcccugcugagccccugcaccacccacucccagcgccacgcguucgccgaggccgccugcgccauccuccacagcuccguguuccaggagugccaccggcugguggacaaggagcccuucuaccugcgcugccucgcggccgucugcggcugcgaccccggcagcgacugccugugccccgugcugagcgccuacgcccggcgcugcgcccaggagggggcgagcccgcccuggcggaaccagacccucugccccgugaugugccccggcgggcaggaguaccgcgagugcgcccccgccugcggccagcacugcgggaagcccgaggacugcggcgagcugggcagcugcgucgccgggugcaacugcccccugggccuccugugggaccccgaggggcagugcgugccgcccucccugugccccugccagcucggcgcccggcgcuacgcgcccgggagcgccaccaugaaggagugcaaccggugcaucugccaggagcgcggccuguggaacugcacggcccggcacugccccucccaggccuucugcccccgcgagcugguguacgcccccggcgcgugccuccugaccugcgacagccccuccgccaaccacagcugccccgccggguccaccgacggcugcgucugcccgcccgggaccgugcugcucgacgagcggugcgugccgcccgaccugugccccugccgccacagcggccagugguaccugcccaacgccacgauccaggaggacugcaacgucugcgugugccggggccgccaguggcacugcaccgggcagcggcgcuccggccggugccaggcgagcggggcgccccacuacgugaccuucgacggccucgccuucaccuaccccggggccugcgaguaccugcugguccgcgaggccuccggccucuucacggugagcgcgcagaaccugcccugcggcgccuccgggcugaccugcaccaaggcccucgccgugcggcuggagggcaccgucgugcacaugcugcgcgggcgcgccgugaccgucaacggcgugagcgugacgccgcccaaggucuacaccgggcccggccucucccugcggcgcgcgggccuguuccuccugcugagcacccaccucgggcugacccugcucugggacggcgggacgcgggugcuggugcagcugagcccccaguuccgcggccgggucgccgggcucugcggcgacuucgacggcgacgccagcaacgaccugcgcagccggcagggggugcuggagcccaccgccgagcucgccgcgcacuccuggcgccugagcccccugugccccgagcccggcgaccucccccaccccugcaccaugaacacccaccgggccgggugggcccgcgcccggugcggcgcgcugcugcagccccucuucacgcugugccacgccgaggugccgccccagcagcacuacgaguggugccuguacgacgccugcgggugcgacuccggcggcgacugcgagugccucugcagcgccaucgccaccuacgcggacgagugcgcccgccacgggcaccacguccgguggcgcucccaggagcugugcagccugcagugcgagggcggccaggucuacgaggccugcggccccacgugcccgccgaccugccacgagcagcaccccgagcccggcuggcacugccagguggucgccugcguggaggggugcuucugccccgagggcacccuccugcacgggggcgccugccuggagcccgcguccugccccugcgagugggggcggaacagcuucccgcccggcuccgugcuccagaaggacugcggcaacugcacgugccaggaggggcaguggcacugcggcggggacggcgggcacugcgaggagcugguccccgccugcgccgagggcgaggcccugugccaggagaacggccacugcgugccccacggguggcucugcgacaaccaggacgacugcggcgacgggagcgacgaggagggcugcgccgcgcccgggugcggcgagggccagaugaccugcuccagcgggcacugccugccccuggcccuccugugcgaccgccaggacgacugcggcgacgggaccgacgagcccuccuaccccugcccccagggccugcucgccugcgccgacgggcggugccugcccccggcgcugcugugcgacggccaccccgacugccucgacgccgccgacgaggagagcugccugggccaggucacgugcgugcccggggagguguccugcgucgacgggaccugccugggggccauccagcucugcgacggcgugugggacugccccgacggcgccgacgaggggccgggccacugcccccugcccagccugcccaccccgcccgcguccacccuccccgggcccagcccgggcucccuggacacggccagcagcccccuggccuccgccagccccgccccgcccugcgggcccuucgaguuccgcugcggcuccggcgagugcacgccccgcggguggcgcugcgaccaggaggaggacugcgcggacggcagcgacgagcgcgggugcggcgggccgugcgcgccccaccacgcccccugcgcccggggcccccacugcguguccccggagcagcucugcgacggcguccgccagugccccgacgggagcgacgagggccccgacgccugcgggggccugcccgcgcucggcggcccgaaccggaccggccuccccugccccgaguacacgugccccaacgggacgugcaucggcuuccagcuggugugcgacgggcagccggacugcggccgccccggccagguggggcccucccccgaggagcagggcugcggggccuggggcccguggagccccugggggcccugcucccggaccugcggccccuggggccaggggcgcagccggcgcugcagcccccugggccuccugguccugcagaacugccccgggcccgagcaccagucccaggccugcuucaccgccgccugccccguggacggcgagugguccaccuggagccccugguccgugugcagcgagcccugccgggggacgaugacccgccagcggcagugccacagcccccagaacggcggccggaccugcgcggcccuccccgggggccugcacagcacccggcagacgaagcccugcccccaggacgggugccccaacgcgaccugcuccggcgagcugauguuccagccgugcgcccccugcccccugaccugcgacgacaucagcggccaggugaccugcccgcccgacuggcccugcgggagccccggcugcuggugccccgaggggcagguccugggcuccgagggguggugcguguggccccgccagugccccugccuggucgacggcgcgcgguacuggcccgggcagcgcaucaaggccgacugccagcucugcaucugccaggacggccggccccgccggugccgccugaacccggacugcgccguggacugcggcuggagcuccuggagccccugggccaagugccuggggcccugcggcucccagagcauccagugguccuuccggagcuccaacaacccccgcccgagcgggcgcggccggcagugccgcggcauccaccggaaggcccgccggugccagacggagcccugcgaggggugcgagcaccagggccaggugcaccgcgucggggagcgguggcacggcgggcccugccgcgugugccagugccuccacaaccugaccgcgcacugcucccccuacugcccgcugggcagcugcccccagggcugggugcucgucgaggggaccggcgaguccugcugccacugcgcccugcccggggagaaccagaccgugcagccgauggccacccccgccgccgcgcccgcccccagcccgcagauccgguucccccuggccacguacauccugccgcccuccggcgacccgugcuacagcccccuggggcuggccggccucgccgagggcucccugcacgcgagcucccagcagcuggagcaccccacccaggccgcccuccugggggcccccacccagggcccgagcccccagggguggcacgcgggcggggacgccuacgccaaguggcacacccgcccccacuaccugcagcucgaccugcugcagccccggaaccucacgggcauccuggugccggagaccggcagcuccaacgccuacgccagcuccuucagccugcaguucuccagcaacgggcuccacuggcacgacuaccgcgaccugcugcccggcauccucccccugcccaagcuguucccgcggaacugggacgaccucgaccccgcggucuggaccuucgggcgcauggugcaggcccgguucgugcgcgucuggccccacgacgugcaccacuccgacgugccccugcaggucgagcugcucggcugcgagccgggcuccccgcccgcgccccugugcccgggggugggccugcggugcgccuccggggagugcgugcuccgcggcgggcccugcgacggcguccuggacugcgaggacggcagcgacgaggaggggugcgugcugcuccccgagggcaccgggcgguuccacuccacggccaagacccuggcgcugagcuccgcccagccgggccagcuccugcacuggccccgcgaggggcuggccgagaccgagcacuggccgcccggccaggagagcccgaccucccccacggagacccgccccgugagccccggcccggccuccggggucccccaccacggcgagagcgugcagauggugaccaccacgcccaucccccagauggaggcccggacccucccgcccgggauggcggccgucaccguggugccgccccacccggucacccccgccacgcccgccggccaguccguggcgcccgggccguucccgcccgugcagugcggccccggccagaccccgugcgagguccuggggugcguggagcaggcccaggugugcgacggccgcgaggacugccuggacgggagcgacgagcggcacugcgcccgcaaccuccugauguggcugcccagccuccccgcccugugggccgcguccaccguccccuucaugaugccgaccauggcccugcccggccuccccgccagccgggcccugugcuccccgagccagcuguccugcgggagcggcgagugccucuccgccgagcgccggugcgaccugcgccccgacugccaggacggcagcgacgaggacgggugcguggacugcgugcuggcgcccugguccgucuggagcuccugcagccgguccugcggccucgggcugacguuccagcgccaggagcugcuccggcccccgcugcccggcggcagcugcccccgcgaccgguuccgcucccagagcugcuucgugcaggccugccccgucgccggggccugggccaugugggaggcguggggcccgugcuccgugagcugcgggggcgggcaccagagccggcagcgcuccugcguggacccgccgcccaagaacggcggcgccccgugccccggggccagccaggagcgggcccccugcggccugcagcccugcuccgggggcaccgacugcgagcucgggcgcgucuacgugagcgccgaccugugccagaagggccuggugccgcccugcccgcccuccugccucgacccgaaggcgaaccggagcugcuccggccacugcgucgaggggugccgcugcccgcccggccugcugcuccacgacacccggugccugccccugagcgagugcccgugccucgugggggaggagcugaaguggcccggcguguccuuccugcuggggaacugcagccagugcgucugcgagaagggcgagcuccugugccagcccggcgggugcccgcugcccugcggcugguccgccuggagcuccugggcccccugcgaccgcagcugcggguccggcgugcgcgcccgguuccgcagccccuccaacccgcccgcggccuggggcggggcccccugcgagggcgaccggcaggagcuccaggggugccacaccgugugcggcacggaggucuucggguggacccccuggaccagcugguccagcugcagccaguccugccuggccccgggcggcgggcccggcuggcgcagccggucccgccugugccccagccccggggacuccagcugcccgggcgacgccacccaggaggagcccugcagcccgcccgugugcccggugcccagcaucugggggcucugggcgcccugguccacgugcagcgcccccugcgacggcggcauccagacccgggggcgcuccugcagcucccuggccccgggcgacacgaccugccccgggccccacagccagacccgggacugcaacacccagcccugcaccgcccagugcccggagaacaugcuguuccgcuccgccgagcagugccaccaggagggcgggcccugcccccggcucugccugacccagggccccggcaucgagugcaccggguucugcgcgccgggcugcacgugcccgcccgggcuguuccuccacaacgccagcugccugccgcgcucccagugccccugccagcugcacggccagcucuacgccagcggggccauggcccggcuggacuccugcaacaacugcacgugcgucagcggcaagauggcgugcaccagcgagcgcugccccguggccugcggcuggucccccuggacccuguggagccucugcuccugcagcugcaacguggggauccggcgccgguuccgcgccggcacggccccgcccgcggccuucgggggcgccgagugccagggccccaccauggaggccgaguucugcucccugcggcccugcccggggcccggcggggaguggggccccuggagccccugcuccgucccgugcgggggcggcuaccgcaaccgcacccgggggagcucccgcagccugauggaguucagcacgugcggccuccagcccugcgccgggcccgugcccggcaugugcccgcgggacaagcaguggcuggacugcgcgcaggggcccgccuccugcgccgagcugagcgcgccccgcggcaccaaccagaccugccaccccggcugccacugcccgagcgggaugcuccugcugaacaacgugugcguccccacccaggacugccccugcgcccacgagggccaccucuacccgcccggguccaccguggugcggcccugcgagaacugcagcugcgucuccggccugaucgcgaacugcagcuccuggcccugcgccgagggggagcccacguggagccccuggacccccuggagccagugcuccgccagcugcggccccgcccgcugccaccggcaccgcuucugcgcccgguccccgagcgcggugcccuccaccguggcgccccugccccucccggccacccccacgccccugugcagcggccccgaggccgaggaggagccgugccugcuccaggggugcgaccgcgccggcggguggggccccugggggcccuggucccacugcagccgguccugcggcggcgggcugcgcagccggacccgcgcgugcgaccagcccccgccccagggccugggggacuacugcgagggcccccgggcccagggcgaggucugccaggcccuccccugcccggugaccaacugcaccgccaucgagggggcggaguacucccccugcgggccgcccugcccgcgcagcugcgacgaccuggugcacugcgucuggcggugccagcccgggugcuacugcccgcccggccaggugcuguccagcaacggggccaucugcgugcagccgggccacugcuccugccucgaccugcugacgggccagcgccaccaccccggggcccggcucgcccgccccgacggcugcaaccacugcacgugccuggaggggcggcugaacugcaccgaccucccgugccccguccccggcggguggugccccuggagcgaguggaccaugugcucccagccgugccgcggccagacgcgcagccggucccgcgccugcgcgugccccacgccccagcacggcggggcccccugcaccggcgaggccggggaggccggcgcccagcaccagcgggaggcgugcccgagcuacgcgaccugccccguggacggggccuggggccccuggggccccuggagcccgugcgacaugugccuggggcagucccaccgcagccgggccugcucccggccgcccacgcccgagggcgggcggccgugccccggcaaccacacccagagccgccccugccaggagaacuccacccagugcaccgacugcggcgggggccagagccugcaccccugcgggcagccgugcccccgguccugccaggaccucagccccggcuccgugugccagcccgggagcgucggcugccagccgacgugcggcugcccccuggggcagcugucccaggacggccucugcgugccgcccgcccacugccgcugccaguaccagccgggggcgaugggcauccccgagaaccagagccgguccgccgggagccgcuucuccagcugggagucccuggagcccggcgagguggucaccggcccgugcgacaacugcacgugcguggccgggauccugcagugccaggaggugcccgacugccccgaccccggcgucuggagcuccugggggccgugggaggacugcagcgugagcugcggcgggggcgagcagcuccggucccgccggugcgcccggccgcccugccccggcccggcgcggcagagccggaccugcuccacccaggugugccgggaggccgggugccccgccggccgccuguaccgcgagugccagcccggggagggcugccccuucagcugcgcccacgucacccagcaggucgggugcuucuccgagggcugcgaggagggcugccacugcccggaggggaccuuccagcaccggcuggccugcgugcaggagugccccugcguccucaccgcguggcugcugcaggagcucggcgccacgaucggggaccccggccagccccugggcccgggggacgagcuggacagcggccagacccuccgcaccuccugcgggaacugcagcugcgcccacggcaagcuguccugcagccuggacgacugcuucgaggccgacgggggcuucggccccuggucccccugggggcccugcagccgguccugcggcgggcucggcacccgcacccggagccgccagugcgugcugacgaugccgacccuguccgggcagggcugccggggcccccgccaggaccucgagugccccagccccgacugcccgggggccgagggcuccaccguggagcccgucaccgggcugcccggcggguggggccccuggagcagcugguccccgugcagccgguccugcacggaccccgcgcgccccgccuggcggagccgcacccggcugugccucgccaacugcaccaugggcgacccgcugcaggagcgccccugcaaccugcccuccugcaccgagcuccccgugugcccggggcccggcugcggggccggcaacugcagcuggacguccugggcccccugggagcccugcagccgguccugcggcgucgggcagcagcgccggcugcgcgcguaccggccgcccggccccgggggccacuggugccccaacauccugaccgccuaccaggagcgccgguucugcaaccuccgcgccugcccggugcccgggggcuggagccgcuggucccccuggagcuggugcgaccgguccugcggcgggggccagagccugcgcucccggagcugcuccuccccgcccuccaagaacgggggcgcccccugcgcgggggagcgccaccaggcccggcugugcaaccccaugcccugcgaggccggcugccccgccggcauggagguggugaccugcgccaaccgcugcccccggcgcugcagcgaccuccaggaggggaucgugugccaggacgaccaggugugccagaagggcugccggugccccaaggggagccuggagcaggacggcgggugcguccccaucggccacugcgacugcaccgacgcgcagggccacuccugggccccggggagccagcaccaggacgccugcaacaacugcuccugccaggccggccagcugagcugcacggcccagcccugcccgccgcccacccacugcgcguggucccacuggagcgccuggucccccugcagccacuccugcgggccccgcggccagcagagccgguuccgcuccagcaccuccgggagcugggcccccgagugccgggaggagcagucccagagccagcccugcccccagcccuccugcccgccccucugccugcagggcacccgcagccggacgcugggcgacuccuggcuccagggggagugccagcgcugcagcugcacccccgagggcgugaucugcgaggacaccgagugcgccgugcccgaggccuggacccuguggagcuccuggagcgacugccccgucuccugcgggggcggcaaccaggugcggacgcgcgcgugccgggccgccgcgccccaccaccgcuccccgcccugccuggggccggacacccagacccgccagcagcccugccccggccuccuggaggccugcuccugggggcccuggggcccgugcagccgguccugcgggcccggccuggcgagccgcuccggcagcugccccugccucauggccaaggccgacccgaccugcaacuccacguuccugcaccuggacacccaggggugcuacagcggcccgugccccgaggagugcgugugguccagcugguccagcuggacccggugcuccugccgcguccucgugcagcagcgguaccgccaccaggggcccgccagccggggcgcgcgcgccggggcccccugcacccggcuggacggccacuuccgcccgugccugaucuccaacugcagcgaggacagcugcacgccgcccuucgaguuccacgccugcggcuccccgugcgccgggcugugcgcgacccaccucagccaccagcugugccaggaccugccgcccugccagcccggcugcuacugcccgaaggggcuccuggagcaggccggcgggugcaucccgcccgaggagugcaacugcuggcacaccuccgccgccggcgccggcaugacccuggcgcccggggaccggcuccagcugggcugcaaggagugcgagugccgccgcggggagcugcacugcacgagccagggcugccagggccuccugccgcuguccgaguggagcgaguggucccccugcgggcccugccugccgcccagcgcccuggcccccgccucccggaccgcccuggaggagcacuggcuccgggaccccaccggccugagccccacccuggcgccccuccuggccuccgagcagcaccgccaccggcugugccucgaccccgccacggggcgccccuggaccggcgcgccccaccugugcaccgcgccgcugagccagcagcggcucugccccgaccccggggccugccccgacuccugccaguggagccuguggggcccguggucccccugccaggugcccugcagcggcggguuccgccugcgguggcgcgaggccgaggcccucugcggcgggggcugccgcgagcccugggcccaggaguccugcaacgggggcccgugccccgagugcgaggcgcaggacaccgucuucacccuggacugcgccaaccagugcccccacagcugcgccgaccugugggaccgggugcagugccuccagggcccgugccgccccgggugccggugcccgcccggccagcuggugcaggacgggcgcugcgucccgaucuccagcugccggugcggccugcccagcgccaacgccuccugggagcucgcgcccgcccaggccgugcagcuggacugccagaacugcacgugcgugaacgagagccuggucugcccccaccaggagugcccggugcucgggcccugguccgccuggagcuccugcagcgcccccugcggcggcgggaccauggagcgccaccggaccugcgagggcgggcccggcguggcgccgugccaggcccaggacaccgagcagcgccaggagugcaaccugcagcccugccccgagugcccgcccgggcagguccuguccgccugcgccacgagcugccccugccucugcuggcaccuccagcccggcgcgaucugcgugcaggagcccugccagcccggcugcgggugccccggcgggcagcugcuccacaacgggaccugcgugccgcccaccgccugcccgugcacccagcacucccugcccuggggccugacgcucacccuggaggagcaggcccaggagcugcccccggggaccguccucacccggaacugcacgcgcugcgugugccacggcggggccuucagcugcucccugguggacugccaggugccgcccggcgagaccuggcagcaggucgcccccggggagcugggccucugcgagcagaccugccuggagaugaacgcgaccaagacgcagagcaacugcuccagcgcccgggccuccggcugcgugugccagccggggcacuuccgcagccaggccggccccugcgugcccgaggaccacugcgagugcuggcaccuggggcggccccaccucccgggcuccgaguggcaggaggccugcgagagcugccugugccuguccgggcgccccgugugcacccagcacugcagcccccugaccugcgcgcagggcgaggagauggugcuggagcccggcagcugcugcccguccugccggcgcgaggcccccgaggagcagagccccuccugccagcugcucaccgagcugcggaacuucacgaaggggaccugcuaccuggaccaggucgaggugagcuacugcuccggcuacugccccagcuccacccacgugaugccggaggagcccuaccuccagagccagugcgacugcugcuccuaccgccuggaccccgagagccccguccggauccugaaccuccgcugccucgggggccacaccgagccgguggugcugcccgucauccacuccugccagugcagcuccugccagggcggcgacuucagcaagcgcuga

SEQ ID NO: 37128 - RNA, 861 nt, Artificial Sequence
  derived and/or modified sequence opt1 from SSR1__Homo_sapiens__NP_003135
augcgccugcucccccggcugcugcuccugcugcuccugguguucccggccaccguccuguuccgcggcgggccccggggccuccuggccguggcgcaggaccugaccgaggacgaggagacgguggaggacagcaucaucgaggacgaggacgacgaggccgaggucgaggaggacgagcccaccgaccucguggaggacaaggaggaggaggacguguccggggagcccgaggccagcccguccgccgacaccaccauccuguucgucaagggcgaggacuuccccgccaacaacaucgugaaguuccuggugggguucacgaacaagggcaccgaggacuucaucgucgagagccucgacgcguccuuccgcuacccccaggacuaccaguucuacauccagaacuucaccgcccugccccugaacaccguggugccgccccagcggcaggccacguucgaguacagcuucauccccgccgagcccaugggcgggcgcccguucggccucgucaucaaccugaacuacaaggaccugaacgggaacguguuccaggacgcgguguucaaccagaccgucaccgugaucgagcgggaggacggccucgacggggagaccaucuucauguacauguuccuggccggccugggccuccuggugaucgucgggcugcaccagcuccuggagucccgcaagcggaagcgccccauccagaagguggagaugggcacgagcucccagaacgacguggacaugagcuggaucccccaggagacccugaaccagaucaacaaggccagcccccggcgccucccgcggaagcgcgcccagaagcgguccgucggguccgacgaguga

SEQ ID NO: 37129 - RNA, 609 nt, Artificial Sequence
  derived and/or modified sequence opt1 from SSR2__Homo_sapiens__XP_011508225
augcugacccucagcuccugccugugcggcagcgggaaggccuucggcaugcccaccaugcgccugcucuccuucgugguccuggcccuguucgcggugacgcaggccgaggagggggcccggcuccuggccagcaagucccugcucaaccgcuacgccguggagggccgggaccugacccugcaguacaacaucuacaacgucgggagcuccgcggcccucgacguggagcugagcgacgacuccuucccgcccgaggacuucggcaucgugagcggcaugcugaacgucaagugggaccgcaucgcccccgccuccaacgugagccacaccgugguccuccggccccugaaggcgggguacuucaacuucaccuccgccacgaucaccuaccuggcccaggaggacggcccgguggugaucgggagcaccuccgcccccggccagggcgggauccucgcccagcgcgaguucgaccggcgcuucagcccccacuuccuggacugggcggccuucggcgucaugacccugcccuccaucgggaucccgcuccugcugugguacagcuccaagcggaaguacgacacgcccaagaccaagaagaacuga

SEQ ID NO: 37130 - RNA, 2130 nt, Artificial Sequence
  derived and/or modified sequence opt1 from SSRP1__Homo_sapiens__NP_003137
auggccgagacccuggaguucaacgacguguaccaggaggucaagggcagcaugaacgacgggcgccuccggcugucccgccagggcaucaucuucaagaacagcaagaccgggaagguggacaacauccaggccggcgagcugacggaggggaucuggcggcgcguggcgcucggccacggccugaagcugcucaccaagaacgggcacgucuacaaguacgacggcuuccgggaguccgaguucgagaagcugagcgacuucuucaagacccacuaccgccuggagcucauggagaaggaccugugcgugaagggguggaacuggggcaccgugaaguucgggggccagcugcucuccuucgacaucggcgaccagcccgucuucgagaucccccugagcaacgugucccagugcacgaccgggaagaacgaggugacccuggaguuccaccagaacgacgacgccgaggucagccucauggaggugcgguucuacgugccgcccacccaggaggacggcgucgaccccguggaggccuucgcccagaacgugcuguccaaggccgacgucauccaggcgacgggggacgccaucugcaucuuccgcgagcugcagugccucacgccccggggccgcuacgacauccggaucuaccccaccuuccugcaccuccacggcaagaccuucgacuacaagauccccuacaccaccgugcugcgccuguuccugcucccccacaaggaccagcggcagauguucuucgugaucagccuggacccgcccaucaagcaggggcagacccgcuaccacuuccugauccuccuguucuccaaggacgaggacaucagccugacccucaacaugaacgaggaggaggucgagaagcgguucgagggccgccugacgaagaacauguccgggagccuguacgagauggugucccgggugaugaaggcccucgucaaccgcaagaucaccgugcccggcaacuuccaggggcacagcggcgcccagugcaucacgugcuccuacaaggcgagcuccggccugcuguacccccucgagcggggguucaucuacgugcacaagccgcccguccacauccgcuucgacgagaucagcuucgugaacuucgcccggggcaccaccaccacccgcagcuucgacuucgagaucgagaccaagcaggggacgcaguacaccuucuccagcaucgagcgcgaggaguacggcaagcuguucgacuucgucaacgccaagaagcugaacaucaagaaccgggggcucaaggagggcaugaaccccuccuacgacgaguacgccgacagcgacgaggaccagcacgacgccuaccuggagcgcaugaaggaggagggcaagauccgggaggagaacgcgaacgacuccagcgacgacuccggggaggagaccgacgagagcuucaaccccggcgaggaggaggaggacguggccgaggaguucgacuccaacgccagcgccuccagcuccagcaacgagggggacuccgaccgcgacgagaagaagcggaagcagcugaagaaggccaagauggcgaaggaccgcaagagccggaagaagccgguggaggucaagaagggcaaggaccccaacgcccccaagcgccccauguccgccuacaugcucuggcugaacgccagccgggagaagaucaaguccgaccacccggggaucagcaucaccgaccugagcaagaaggccggcgagaucuggaagggcauguccaaggagaagaaggaggagugggaccgcaaggcggaggacgcccggcgcgacuacgagaaggccaugaaggaguacgagggcgggcgcggggagagcuccaagcgggacaagagcaagaagaagaagaaggugaaggugaagauggagaagaaguccacgcccagccggggcuccagcuccaagagcuccagccgccagcucuccgagagcuucaaguccaaggaguucgucagcuccgacgagagcagcuccggcgagaacaagagcaagaagaagcggcgccgguccgaggacagcgaggaggaggagcuggccuccaccccgcccagcuccgaggacagcgccuccgggagcgacgaguga

SEQ ID NO: 37131 - RNA, 600 nt, Artificial Sequence
  derived and/or modified sequence opt1 from SSSCA1__Homo_sapiens__NP_006387
auggcccugaacggcgccgagguggacgacuucagcugggagccgcccaccgaggcggagaccaagguccuccaggcccgccgggagcgccaggaccggaucucccgccugaugggggacuaccugcuccggggcuaccgcaugcugggggagacgugcgccgacugcggcaccauccugcuccaggacaagcagcggaagaucuacugcguggccugccaggagcuggacagcgacguggacaaggacaaccccgcccugaacgcgcaggccgcccucucccaggcccgcgagcaccagcuggcgagcgccuccgagcugccccucgggagccggcccgcgccccagccgcccgucccccgccccgagcacugcgagggcgccgccgccggccugaaggccgcccaggggccgcccgcccccgccgugccgcccaacaccgacgugauggcgugcacccagacggcccugcuccagaagcugaccugggccuccgccgagcugggcagcuccaccagccucgagaccuccauccagcugugcgggcugauccgggccugcgcggaggcccuccgcagccugcagcagcugcagcacuga

SEQ ID NO: 37132 - RNA, 351 nt, Artificial Sequence
  derived and/or modified sequence opt1 from SST__Homo_sapiens__NP_001039
augcugagcugccgccuccagugcgcccuggccgcgcuguccaucgugcucgcccugggcugcgucaccggggcccccagcgacccgcggcugcgccaguuccuccagaagucccuggccgccgcggccggcaagcaggagcuggccaaguacuuccucgccgagcugcugagcgagcccaaccagaccgagaacgacgcgcucgagcccgaggaccugucccaggccgccgagcaggacgagaugcggcuggagcuccagcgcagcgccaacuccaaccccgccauggcgccgcgggagcgcaaggccgggugcaagaacuucuucuggaagacguucaccagcugcuga

SEQ ID NO: 37133 - RNA, 1176 nt, Artificial Sequence
  derived and/or modified sequence opt1 from SSTR1__Homo_sapiens__NP_001040
auguuccccaacggcaccgccagcuccccgagcuccagccccucccccagccccggguccugcggcgagggcggcgggagccgcgggccgggcgccggggcggccgacggcauggaggagcccgggcggaacgccucccagaacggcacccugagcgaggggcagggcuccgccauccucaucagcuucaucuacuccguggucugccuggugggccugugcgggaacagcauggugaucuacgucauccuccgcuacgccaagaugaagacggcgaccaacaucuacauccugaaccuggccaucgccgacgagcuccugaugcuguccgugcccuuccucgugaccagcacccugcugcggcacuggcccuucggcgcccuccugugccgccugguccucuccguggacgcggugaacauguucacgagcaucuacugccugaccguccuguccguggaccgguacguggccgucgugcacccgaucaaggccgcccgcuaccggcgccccaccguggccaaggucgugaaccucgggguguggguccugagccugcucgugauccugcccaucguggucuucagccggaccgcggccaacuccgacggcacgguggccugcaacaugcugaugcccgagccggcccagcgcuggcucgugggcuucguccuguacaccuuccugaugggguuccuccugcccgugggcgccaucugccugugcuacguccucaucaucgcgaagaugcggaugguggcccugaaggccggguggcagcagcgcaagcggagcgagcgcaagaucacccugauggugaugauggucgugaugguguucgucaucugcuggaugcccuucuacguggugcagcucgucaacguguucgccgagcaggacgacgccaccgugucccagcugagcgucauccugggcuacgcgaacuccugcgccaaccccauccucuacggguuccugagcgacaacuucaagcgguccuuccagcgcauccugugccucagcuggauggacaacgccgccgaggagccgguggacuacuacgccacggcgcugaagucccgggccuacagcguggaggacuuccagcccgagaaccuggaguccggcggcgucuuccgcaacgggaccugcaccagccggaucaccacgcucuga

SEQ ID NO: 37134 - RNA, 1110 nt, Artificial Sequence
  derived and/or modified sequence opt1 from SSTR2__Homo_sapiens__NP_001041
auggacauggccgacgagccccugaacggcagccacaccuggcucuccaucccguucgaccugaacgggagcguggucuccaccaacacgagcaaccagaccgagcccuacuacgaccugaccuccaacgccgugcucaccuucaucuacuucguggucugcaucaucggccugugcgggaacacgcuggugaucuacgugauccuccgcuacgcgaagaugaagaccaucaccaacaucuacauccugaaccuggccaucgccgacgagcuguucaugcucggccugcccuuccucgccaugcaggucgcccuggugcacuggcccuucgggaaggcgaucugccggguggucaugaccguggacggcaucaaccaguucacgagcaucuucugccugaccgugauguccaucgaccgcuaccucgccgucgugcacccgaucaagagcgccaaguggcggcgcccccggaccgccaagaugaucaccauggcgguguggggcgucucccugcuggugauccuccccaucaugaucuacgccgggcugcgcagcaaccaguggggccgguccagcugcacgaucaacuggcccggggaguccggcgccugguacaccggguucaucaucuacaccuucauccugggcuuccucgugccgcugaccaucaucugccugugcuaccucuucaucaucaucaaggucaagagcuccggcauccgcguggggagcuccaagcggaagaaguccgagaagaaggugacgcgcauggucagcaucgugguggccgucuucaucuucugcuggcugcccuucuacaucuucaacgugagcagcgucuccauggccaucagccccacccccgcgcugaagggcauguucgacuucguggugguccucaccuacgccaacuccugcgccaacccgauccuguacgccuuccugagcgacaacuucaagaaguccuuccagaacgugcucugccuggugaaggucagcgggaccgacgacggcgagcgguccgacagcaagcaggacaagucccgccugaacgagacgaccgagacccagcggacccuccugaacggcgaccugcagacgagcaucuga

SEQ ID NO: 37135 - RNA, 1257 nt, Artificial Sequence
  derived and/or modified sequence opt1 from SSTR3__Homo_sapiens__XP_005261778
auggacaugcugcaccccagcuccgugagcaccaccuccgagcccgagaacgccagcuccgccuggccgcccgacgcgacgcucggcaacgucagcgccgggcccucccccgccggccuggccgugagcggggugcugaucccccucgucuaccugguggugugcgucgugggccugcucgggaacucccuggugaucuacgucgugcugcgccacaccgccagccccuccgugaccaacgucuacauccucaaccuggcgcuggccgacgagcuguucaugcucggccugcccuuccucgccgcccagaacgcgcugagcuacuggccguucggcucccugaugugccggcucgugauggccguggacgggaucaaccaguucaccagcaucuucugccugacggucauguccguggaccgcuaccuggccgugguccaccccacccggagcgcccgcuggcggaccgcccccguggcgcgcaccguguccgccgccgucuggguggccagcgccguggucgugcuccccgucgugguguucuccggcgucccgcgggggaugagcacgugccacaugcaguggcccgagcccgcggccgccuggcgcgccggcuucaucaucuacaccgccgcgcugggguucuucggcccccugcucgugaucugccugugcuaccugcucaucguggucaaggugcggagcgccggccgccgggugugggccccguccugccagcgccggcgccggagcgagcgccgggucacccgcauggugguggccgucguggcccuguucgugcugugcuggaugcccuucuacguccucaacaucgugaacguggucugcccccugcccgaggagccggcguucuucgggcuguacuuccucgugguggcccugcccuacgccaacuccugcgccaaccccauccuguacggcuuccucagcuaccgguucaagcagggguuccgccggguccugcugcgccccucccgccgggugcgcagccaggagccgaccgugggcccgcccgagaagacggaggaggaggacgaggaggaggaggacggcgaggagucccgggagggcgggaaggggaaggagaugaacggccgcgucagccagaucacccagcccgggaccuccggccaggagcggccgcccagccgcguggcguccaaggagcagcagcuccugccccaggaggccagcaccggcgagaaguccagcacgaugcggaucuccuaccuguga

SEQ ID NO: 37136 - RNA, 1167 nt, Artificial Sequence
  derived and/or modified sequence opt1 from SSTR4__Homo_sapiens__NP_001043
augagcgcccccuccacccugccgcccggcggggaggagggccucgggaccgccuggcccagcgcggccaacgccuccagcgcccccgccgaggcggaggaggccguggccggcccgggggacgcccgcgcggccggcauggucgccauccagugcaucuacgcccuggugugccuggugggccucgucgggaacgcccuggugaucuucgugauccugcgguacgcgaagaugaagacggccaccaacaucuaccuccugaaccuggccgucgccgacgagcuguucaugcuguccgugcccuucguggccagcuccgcggcccugcgccacuggcccuucggcagcguccucugccgggccgugcuguccguggacgggcugaacauguucaccagcgucuucugccucaccgugcuguccguggaccgcuacgucgccguggugcacccccugcgggccgcgacguaccgccggccgagcgucgccaagcucaucaaccugggcguguggcuggccucccuccuggugacccugcccaucgccaucuucgccgacacccgccccgcgcgcgggggccaggccgucgccugcaaccuccaguggccccacccggccuggagcgcgguguucguggucuacaccuuccugcugggcuuccuccugcccgugcuggccaucgggcucugcuaccugcugaucgucggcaagaugcgggccguggcccuccgggccggguggcagcagcgccggcgcuccgagaagaagaucacgcggcuggugcugauggucgugguggucuucgugcucugcuggaugcccuucuacgugguccagcugcugaaccucuucgugaccagccuggacgcgaccgugaaccacgucucccugauccucagcuacgccaacuccugcgccaaccccauccuguacggcuuccugagcgacaacuuccgccgguucuuccagcgcgugcucugccugcggugcugccugcucgagggcgccgggggcgccgaggaggagccgcuggacuacuacgcgaccgcccucaagagcaagggcggggccgggugcaugugcccgccccugcccugccagcaggaggcccuccagcccgagcccggccgcaagcggaucccccugacgcgcaccaccaccuucuga

SEQ ID NO: 37137 - RNA, 1095 nt, Artificial Sequence
  derived and/or modified sequence opt1 from SSTR5__Homo_sapiens__NP_001166031
auggagccccuguuccccgccagcacccccuccuggaacgccagcucccccggcgcggccagcgggggcggggacaaccgcacccucgugggccccgccccguccgccggggcccgggcgguccuggugcccgugcuguaccuccuggucugcgccgccggccugggcgggaacacgcucgugaucuacgugguccugcgcuucgccaagaugaagaccgugaccaacaucuacauccugaaccucgcgguggccgacguccuguacaugcugggccuccccuuccuggccacccagaacgccgccagcuucuggcccuucgggccggugcugugccggcucgugaugacgcuggacggcgucaaccaguucaccuccguguucugccugaccgugaugagcgucgaccgcuaccucgcgguggugcacccccuguccagcgcccgguggcgccggccccgcgucgccaagcuggccuccgccgcggccugggugcucagccugugcaugucccugccccuccugguguucgccgacguccaggagggcgggaccugcaacgccagcuggccggagcccgugggccuguggggcgccguguucaucaucuacacggcgguccucggguucuucgcgccccugcuggugaucugccucugcuaccugcugaucgucgugaaggugcgggccgccgggguccgcgugggcugcgugcggcgccgguccgagcgcaaggucacccggauggugcucguggucgugcugguguucgccggcugcuggcugcccuucuucaccgucaacaucgugaaccucgccguggcccugccgcaggagcccgccagcgccgggcuguacuucuucgucgugauccucuccuacgcgaacagcugcgccaaccccgugcuguacggcuuccuguccgacaacuuccgccagagcuuccagaagguccucugccugcggaaggggagcggcgccaaggacgccgacgccaccgagccccgcccggaccggauccgccagcagcaggaggcgacgccgcccgcccaccgggccgccgccaacgggcugaugcagaccuccaagcucuga

SEQ ID NO: 37138 - RNA, 1128 nt, Artificial Sequence
  derived and/or modified sequence opt1 from SSUH2__Homo_sapiens__NP_001243677
auggaccgcgaccugaacgaggacgacagcguggucgaccucuccuucgaggccgagagcccccuggccccgcccaccgagcugcucgagcggcugcccuccuacgacuggcugcuccagggcgggcgcggccagaucuucuucccgccccuggaggcgcccgggcggccccaggagcagcgcagcuggcccuccuuccuggagcaccgggugccggccaugaccgaggagguggcccgcgaggcccuccugagcuucgucgacuccaagugcugcuacagcuccacgguggccggcgaccuggugauccaggagcucaagcggcagacccugugccgcuaccggcuggagaccuucagcgagucccgcaucagcgaguggaccuuccagcccuucacgaaccacuccgucgacgggccccagcggggcgcgagcccccgccucugggacaucaaggugcagggcccgcccauguuccaggaggacacccggaaguuccaggugccccacuccagccuggucaaggagugccacaagugccacgggcgcggccgguacaagugcuccgggugccacggcgccgggaccgugcgcugccccagcugcugcggcgccaagcggaaggccaagcagucccgccggugccagcugugcgcgggcagcgggcgccggcgcugcagcacgugcuccggccgcgggaacaagaccugcgcgaccugcaagggcgagaagaagcuccugcacuucauccagcuggugaucauguggaagaacagccucuucgaguucgucuccgagcaccggcugaacugcccgcgcgagcugcucgccaaggccaagggcgagaaccuguucaaggacgagaacagcgugguguaccccaucgucgacuucccccugcgggacaucucccucgccagccagcgcgggaucgccgagcacuccgccgcccuggccagccgggcccgcgugcugcagcagcggcagaccaucgagcucaucccccugaccgaggugcacuacugguaccagggcaagacguacgucuacuacaucuacgggaccgaccaccagguguacgcgguggacuacccggagcgcuacugcugcggcugcaccaucgucuga

SEQ ID NO: 37139 - RNA, 567 nt, Artificial Sequence
  derived and/or modified sequence opt1 from SSX1__Homo_sapiens__NP_005626
augaacggcgacgacaccuucgccaagcgcccccgggacgacgccaaggcgagcgagaagcgcuccaaggccuucgacgacaucgccaccuacuucagcaagaaggaguggaagaagaugaaguacuccgagaagaucagcuacguguacaugaagcggaacuacaaggccaugacgaagcugggguucaaggucacccucccgcccuucaugugcaacaagcaggccaccgacuuccagggcaacgacuucgacaacgaccacaaccgccggauccagguggagcacccccagaugaccuucgggcgccugcaccggaucauccccaagaucaugccgaagaagcccgcggaggacgagaacgacuccaagggcgugagcgaggccuccgggccccagaacgacggcaagcagcugcacccgcccggcaaggccaacaucagcgagaagaucaacaagcgcuccgggcccaagcggggcaagcacgccuggacgcaccgccuccgggagcgcaagcagcuggucaucuacgaggagaucagcgaccccgaggaggacgacgaguga

SEQ ID NO: 37140 - RNA, 567 nt, Artificial Sequence
  derived and/or modified sequence opt1 from SSX2B__Homo_sapiens__NP_001157889
augaacggcgacgacgccuucgcccgccggcccaccgugggggcgcagaucccggagaagauccagaaggccuucgacgacaucgccaaguacuucagcaaggaggagugggagaagaugaaggccuccgagaagaucuucuacgucuacaugaagcgcaaguacgaggccaugaccaagcugggcuucaaggcgacgcucccgcccuucaugugcaacaagcgggccgaggacuuccaggggaacgaccuggacaacgaccccaaccgcggcaaccagguggagcggccccagaugaccuucgggcgccugcagggcaucagccccaagaucaugcccaagaagcccgccgaggagggcaacgacuccgaggaggugccggaggccagcgggccccagaacgacggcaaggagcucugcccgcccgggaagcccaccaccuccgagaagauccacgagcggagcggccccaagcgcggggagcacgcguggacgcaccggcugcgcgagcggaagcagcuggucaucuacgaggagaucuccgaccccgaggaggacgacgaguga

SEQ ID NO: 37141 - RNA, 1521 nt, Artificial Sequence
  derived and/or modified sequence opt1 from SSX2IP__Homo_sapiens__XP_011538914
augggcgacuggaugaccgugaccgaccccgggcugagcuccgagagcaagacgaucucccaguacaccagcgagaccaagauguccccgagcucccucuacagccagcagguccugugcuccagcaucccccuguccaagaacgugcacagcuucuucuccgccuucugcaccgaggacaacaucgagcagagcaucuccuaccucgaccaggagcugacgaccuucggcuuccccagccuguacgaggaguccaaggggaaggagaccaagcgcgagcucaacaucguggccguccugaacugcaugaacgagcugcucgugcugcagcggaagaaccugcucgcgcaggagaacguggagacccagaaccugaagcugggcagcgacauggaccaccuccaguccugcuacagcaagcugaaggagcagcuggagacgagccgccgggagaugaucgggcuccaggagcgcgaccggcagcugcagugcaagaaccgcaaccugcaccagcuccugaagaacgagaaggacgagguccagaagcugcagaacaucaucgccucccgggccacccaguacaaccacgacaugaagcgcaaggagcgggaguacaacaagcucaaggagcgccugcaccagcuggugaugaacaagaaggacaagaagaucgccauggacauccucaacuacgugggccgggccgacggcaagcgcgggagcuggcggaccggcaagaccgaggcgcgcaacgaggacgagauguacaagauccugcugaacgacuacgaguaccggcagaagcagauccucauggagaacgccgagcugaagaagguccugcagcagaugaagaaggagaugaucucccuccugagcccccagaagaagaagccgcgcgagcggguggacgacuccacggggaccgugaucagcgacgucgaggaggacgccggcgagcugucccgcgagagcaugugggaccucuccugcgagaccgugcgggagcagcugaccaacagcauccgcaagcaguggcggauccugaagucccacguggagaagcucgacaaccaggucagcaaggugcaccuggagggguucaacgacgaggacgugaucucccgccaggaccacgagcaggagacggagaagcuggagcucgagauccagcagugcaaggagaugaucaagacccagcagcagcugcugcagcagcagcucgccaccgcguacgacgacgacaccacgagccugcugcgcgacugcuaccuccuggaggagaaggagcggcugaaggaggaguggucccuguucaaggagcagaagaagaacuucgagcgcgagcggcgcagcuucaccgaggccgccauccggcucggccuggagcgcaaggccuucgaggaggagcgggccuccuggcugaagcagcaguuccucaacaugaccaccuucgaccaccagaacagcgagaacgucaagcuguucuccgcguucagcggcauccagagcauguacuga

SEQ ID NO: 37142 - RNA, 567 nt, Artificial Sequence
  derived and/or modified sequence opt1 from SSX4B__Homo_sapiens__NP_001030004
augaacggcgacgacgccuucgcccgccggccccgcgacgacgcgcagaucagcgagaagcugcggaaggccuucgacgacaucgccaaguacuucuccaagaaggagugggagaagaugaaguccagcgagaagaucguguacgucuacaugaagcucaacuacgaggugaugaccaagcugggguucaaggugacccugccgcccuucaugcgcagcaagcgggccgccgacuuccacggcaacgacuucgggaacgaccgcaaccaccggaaccaggucgagcgcccccagaugacguucggcucccuccagcggaucuuccccaagaucaugccgaagaagcccgcggaggaggagaacgggcugaaggaggugcccgaggccagcggcccccagaacgacggcaagcagcugugcccgcccgggaaccccuccacccucgagaagaucaacaagaccagcggccccaagcgcgggaagcacgccuggacccaccggcugcgcgagcggaagcagcugguggucuacgaggagaucuccgacccggaggaggacgacgaguga

SEQ ID NO: 37143 - RNA, 690 nt, Artificial Sequence
  derived and/or modified sequence opt1 from SSX5__Homo_sapiens__NP_066295
augaacggcgacgacgccuucgugcgccggccccgcgucgggagccagaucccggagaagaugcagaagcaccccuggcgccaggugugcgaccggggcauccaccuggugaaccucucccccuucuggaaggucgggcgggagcccgccagcuccaucaaggcgcugcugugcggccgcggggaggcccgggccuucgacgacaucgccaaguacuucagcgagaaggagugggagaagaugaaggccuccgagaagaucaucuacguguacaugaagcgcaaguacgaggcgaugaccaagcucggcuucaaggccacccugccgcccuucaugcggaacaagcgcguggccgacuuccagggcaacgacuucgacaacgaccccaaccgggggaaccaggucgagcacccccagaugacguucggccgccugcaggggaucuucccgaagaucacccccgagaagcccgccgaggagggcaacgacagcaagggggugcccgaggcguccggcccgcagaacaacggcaagcagcuccggcccagcgggaagcugaacaccuccgagaaggugaacaagaccagcggccccaagcgcgggaagcacgccuggacgcaccggguccgcgagcggaagcagcuggugaucuacgaggagaucuccgacccccaggaggacgacgaguga

SEQ ID NO: 37144 - RNA, 1110 nt, Artificial Sequence
  derived and/or modified sequence opt1 from ST13__Homo_sapiens__NP_003923
auggacccccgcaaggugaacgagcugcgggccuucgucaagaugugcaagcaggacccgagcgugcuccacaccgaggagaugcgcuuccugcgggaguggguggaguccaugggcgggaaggucccgcccgccacccagaaggccaagagcgaggagaacacgaaggaggagaagcccgacuccaagaagguggaggaggaccugaaggccgacgagcccagcuccgaggagagcgaccucgagaucgacaaggagggcgugaucgagcccgacaccgacgcgccccaggagaugggggacgagaacgccgagaucaccgaggagaugauggaccaggccaacgacaagaaggucgcggccaucgaggcccugaacgacggcgagcugcagaaggccaucgaccucuucaccgacgcgaucaagcugaacccccgccuggccauccucuacgccaagcgggccuccguguucgugaagcugcagaagccgaacgccgcgauccgcgacugcgaccgggccaucgagaucaaccccgacagcgcccagcccuacaaguggcgcgggaaggcccaccggcugcucggccacugggaggaggccgcgcacgaccuggcccuggccugcaagcucgacuacgacgaggacgccuccgccaugcugaaggagguccagccccgcgcgcagaagaucgccgagcaccggcgcaaguacgagcggaagcgcgaggagcgggagaucaaggagcgcaucgagcgggugaagaaggcccgcgaggagcacgagcgggcccagcgcgaggaggaggcccggcgccagagcggcgcgcaguacggguccuucccgggcggguuccccggcgggaugcccggcaacuuccccggcgggaugccgggcaugggcgggggcaugcccgggauggccggcaugcccgggcugaacgagauccucagcgaccccgaggugcuggccgccaugcaggacccggaggucaugguggcguuccaggacguggcccagaaccccgccaacauguccaaguaccagagcaaccccaaggucaugaaccugaucuccaagcucagcgccaaguucggcgggcaggccuga

SEQ ID NO: 37145 - RNA, 2568 nt, Artificial Sequence
  derived and/or modified sequence opt1 from ST14__Homo_sapiens__NP_068813
augggcagcgaccgcgcccggaagggcggcgggggccccaaggacuucggggccggccugaaguacaacucccgccacgagaaggugaacggccucgaggagggggucgaguuccugccggugaacaacgugaagaaggucgagaagcacggccccgggcgguggguggugcuggcggccguccucaucggccugcugcucgugcugcuggggaucggcuuccucguguggcaccuccaguaccgcgacguccgggugcagaagguguucaacggcuacaugcgcaucaccaacgagaacuucgucgacgccuacgagaacagcaacuccaccgaguucgugagccuggccuccaaggugaaggacgcccugaagcugcuguacagcgggguccccuuccucggccccuaccacaaggaguccgcggugaccgccuucagcgagggguccgugaucgccuacuacuggagcgaguucuccaucccgcagcaccuggucgaggaggccgagcgggugauggcggaggagcgcguggucaugcugccgccccgggcccgcagccucaaguccuucguggugaccagcgucguggccuuccccaccgacuccaagaccguccagcggacgcaggacaacagcugcuccuucggccugcacgcccgcggcguggagcugaugcgguucaccacccccggguuccccgacagccccuaccccgcccacgcgcgcugccagugggcccuccggggcgacgccgacuccgugcugagccugaccuuccgcagcuucgaccucgccuccugcgacgagcgggggagcgaccuggucacgguguacaacacccuguccccgauggagccccacgcccucgugcagcugugcggcaccuacccgcccagcuacaaccugaccuuccacuccagccagaacguccuccugaucacgcugaucaccaacaccgagcgccggcaccccggguucgaggcgaccuucuuccagcucccccgcauguccagcugcggcggccggcugcgcaaggcccaggggacguucaacucccccuacuaccccggccacuacccgcccaacaucgacugcaccuggaacaucgaggugcccaacaaccagcacgugaagguccgcuucaaguucuucuaccugcucgagcccggggugccggccgggaccugccccaaggacuacguggagaucaacggggagaaguacugcggcgagcggagccaguucgucgugaccuccaacagcaacaagaucacggugcgcuuccacuccgaccagagcuacaccgacaccggcuuccuggccgaguaccuguccuacgacagcuccgaccccugccccgggcaguucacgugccggaccggccgcugcauccggaaggagcuccgcugcgacgggugggccgacugcaccgaccacagcgacgagcugaacugcuccugcgacgcgggccaccaguucacgugcaagaacaaguucugcaagccgcuguucugggucugcgacagcgugaacgacugcggggacaacagcgacgagcagggcugcuccugccccgcccagaccuuccggugcagcaacggcaagugccucuccaagagccagcagugcaacgggaaggacgacugcggcgacggguccgacgaggccagcugccccaaggugaacgucgugaccugcaccaagcacaccuaccgcugccugaacggccugugccucuccaagggcaacccggagugcgacgggaaggaggacugcagcgacggcuccgacgagaaggacugcgacugcgggcugcggagcuucacccgccaggcccggguggucggcgggacggacgccgacgagggcgaguggcccuggcaggucucccugcacgcgcucggccaggggcacaucugcggcgccagccugaucucccccaacuggcuggugagcgccgcccacugcuacaucgacgaccgcggguuccgguacuccgaccccacccaguggaccgcguuccugggccuccacgaccagagccagcgcuccgccccgggggugcaggagcggcgccugaagcggaucaucagccaccccuucuucaacgacuucaccuucgacuacgacaucgcccugcucgagcuggagaagcccgccgaguacagcuccauggugcgccccaucugccugccggacgccagccacguguuccccgcgggcaaggccaucugggucacgggcugggggcacacccaguacggcgggaccggcgcccucauccugcagaagggggagauccgggugaucaaccagacgaccugcgagaaccugcucccccagcagaucacgccccgcaugaugugcgugggcuuccuguccggcggggucgacagcugccagggcgacuccgggggcccgcugagcuccguggaggccgacgggcgcaucuuccaggccggcguggucagcuggggcgacgggugcgcgcagcggaacaagcccggcguguacacccgccucccccuguuccgggacuggaucaaggagaacaccgggguguga

SEQ ID NO: 37146 - RNA, 3144 nt, Artificial Sequence
  derived and/or modified sequence opt1 from ST18__Homo_sapiens__NP_055497
auggacgccgaggccgaggacaagacccugcgcacccggagcaagggcacggaggugcccauggacucccucauccaggagcugagcgucgcguacgacugcuccauggccaagaagcgcaccgccgaggaccaggcccugggggugccggugaacaagcgcaagagccuccugaugaagccccggcacuacucccccaaggccgacugccaggaggaccggagcgaccgcaccgaggacgacggcccccuggagacccacgggcacuccacggcggaggagaucaugaucaagccgauggacgagagccuccuguccaccgcccaggagaacagcucccggaaggaggaccgcuacagcugcuaccaggagcugauggucaagucccucaugcaccugggcaaguucgagaagaacgugagcgugcagaccgucuccgagaaccugaacgacagcgggauccagucccucaaggccgagagcgacgaggccgacgagugcuuccugauccacuccgacgacggccgggacaagaucgacgacagccagccgcccuucugcagcuccgacgacaacgagagcaacuccgagagcgcggagaacggcugggacuccgggagcaacuucuccgaggagaccaagccgccccgcgugcccaaguacgugcugacggaccacaagaaggaccuccuggagguccccgagaucaagaccgagggcgacaaguucauccccugcgagaaccggugcgacagcgagaccgagcgcaaggacccccagaacgcccuggccgagccccucgacgggaacgcccagcccuccuuccccgacguggaggaggaggacagcgagucccuggccgugaugaccgaggagggcagcgaccuggagaaggcgaaggggaaccucucccugcuggagcaggccaucgcccuccaggccgagcggggcugcgucuuccacaacacguacaaggagcuggaccgcuuccugcucgagcaccuggccggcgagcggcgccagaccaaggugaucgacaugggcgggcggcagaucuucaacaacaagcacagcccgcgccccgagaagcgggagaccaagugccccauccccgggugcgacggcaccggccacgugacggggcuguacccgcaccaccgcucccucagcggcugcccccacaagguccgggugccccuggagauccuggcgaugcacgagaacgugcucaagugccccaccccggggugcaccggccgcgggcacgucaacuccaaccgcaacacccaccggagccuguccggcugccccaucgccgccgccgagaagcuggccaugagccaggacaagaaccagcucgacagcccccagacgggccagugccccgaccaggcgcaccgcaccucccuggugaagcagaucgaguucaacuucccgagccaggccaucaccagcccccgggccaccguguccaaggagcaggagaaguucgggaagguccccuucgacuacgccuccuucgacgcccagguguucggcaagcgcccgcugauccagacggugcaggggcggaagaccccgcccuuccccgagagcaagcacuuccccaaccccgucaaguuccccaaccgccuccccuccgcgggcgcccacacccagagcccggggcgggccuccagcuacuccuacggccagugcagcgaggacacccacaucgccgcggccgccgccauccugaaccuguccacgcgcugccgggaggccaccgacauccucagcaacaagccccagucccugcacgcgaagggcgccgagaucgagguggacgagaacgggacccuggaccucagcaugaagaagaaccgcauccuggacaaguccgcgccccugaccagcagcaacacguccauccccaccccgagcuccagccccuucaagaccuccagcauccucgucaacgccgccuucuaccaggcccugugcgaccaggagggcugggacacccccaucaacuacuccaagacgcacgggaagaccgaggaggagaaggagaaggaccccgugagcucccuggagaaccuggaggagaagaaguucccgggcgaggccagcauccccucccccaagcccaagcuccacgcccgggaccugaagaaggagcugaucacgugcccgacccccgggugcgacggcagcggccacgugaccgggaacuacgccucccaccgcagcgucuccggcugcccccucgccgacaagacccucaagagccugauggcggccaacucccaggagcugaagugccccaccccggggugcgacggcagcggccacgugaccgggaacuacgccucccaccggagccugagcggcugcccccgcgcccggaagggcggggugaagaugacccccacgaaggaggagaaggaggacccggagcugaagugccccgucaucgggugcgacggccagggccacaucuccgggaaguacaccagccaccgcaccgcguccggcugcccccucgccgccaagcggcagaaggagaacccccugaacggggccagccuguccuggaagcucaacaagcaggagcugccgcacugcccccugcccggcugcaacgggcucggccacgugaacaacguguucgucacccaccgcagccuguccggcugcccccugaacgcccaggugaucaagaaggggaaggugagcgaggagcucaugacgaucaagcugaaggcgaccggcgggaucgaguccgacgaggagauccggcaccuggacgaggagaucaaggagcucaacgagagcaaccugaagaucgaggccgacaugaugaagcugcagacccagaucaccuccauggagagcaaccucaagacgaucgaggaggagaacaagcugaucgagcagaacaacgagucccugcucaaggagcuggccggccugagccaggcccucaucuccagccuggccgacauccagcugccgcagauggggcccaucuccgagcagaacuucgaggcguacgucaacacccucaccgacauguacagcaaccuggagcgcgacuacucccccgagugcaaggcccugcucgagagcaucaagcaggccgugaagggcauccacguguga

SEQ ID NO: 37147 - RNA, 240 nt, Artificial Sequence
  derived and/or modified sequence opt1 from ST20__Homo_sapiens__NP_001094349
auggcccgcagccggcugaccgccaccuccgugagccagguccaggagaacggcuucgugaagaagcucgagcccaaguccggguggaugacguuccuggaggugaccggcaagaucugcgagaugcuguucugcccggaggcgauccuccugacccgcaaggacacccccuacugcgagacggggcugaucuuccucacccugaccaagaccaucgccaacacguacuucuacuucuga

SEQ ID NO: 37148 - RNA, 1023 nt, Artificial Sequence
  derived and/or modified sequence opt1 from ST3GAL1__Homo_sapiens__XP_005251082
auggugacccugcgcaagcggacccucaagguccugacguuccugguccucuucaucuuccugaccagcuucuuccugaacuacucccacaccaugguggccaccacgugguuccccaagcagauggugcucgagcugagcgagaaccugaagcgccucaucaagcaccggccgugcacgugcacccacugcaucggccagcgcaagcuguccgccugguucgacgagcgguucaaccagaccaugcagccccugcucaccgcgcagaacgcccugcuggaggacgacaccuaccgcugguggcuccggcugcagcgcgagaagaagcccaacaaccugaacgacaccaucaaggagcuguuccggguggugcccgggaacgucgacccgaugcucgagaagcgcagcgugggcugccggcgcugcgccguggucgggaacuccggcaaccugcgggagagcuccuacgggcccgagaucgacagccacgacuucgugcuccgcaugaacaaggcccccaccgccggcuucgaggcggacgugggcacgaagaccacccaccaccuggucuaccccgaguccuuccgggagcugggggacaacgugagcaugauccucgugccguucaagaccaucgaccuggagugggucguguccgccaucacgaccggcaccaucagccacaccuacauccccgugcccgccaagauccgcgucaagcaggacaagauccugaucuaccaccccgccuucaucaaguacguguucgacaacuggcuccaggggcacggccgguacccguccacggggauccugagcgugaucuucuccaugcacgucugcgacgagguggaccuguacggcuucggcgcggacagcaaggggaacuggcaccacuacugggagaacaaccccuccgccggcgccuuccgcaagaccggggugcacgacgccgacuucgagagcaacgucaccgccacccucgcguccaucaacaagauccggaucuucaagggccgcuga

SEQ ID NO: 37149 - RNA, 1053 nt, Artificial Sequence
  derived and/or modified sequence opt1 from ST3GAL2__Homo_sapiens__NP_008858
augaagugcagccugcgcgugugguuccucuccgucgccuuccugcugguguucaucaugagccuccuguucaccuacucccaccacagcauggccacccugcccuaccucgacuccggcgcgcuggacgggacgcaccgggugaagcuggucccgggcuacgccgggcuccagcgccugagcaaggagcggcuguccggcaagagcugcgccugccgccggugcaugggggacgccggcgccuccgacugguucgacagccacuucgacggcaacaucucccccguguggacccgcgagaacauggaccucccgcccgacgugcagcggugguggaugaugcugcagccccaguucaagagccacaacaccaacgagguccuggagaagcuguuccagaucgugcccggggagaaccccuaccgcuuccgggacccccaccagugccgccggugcgcgguggucggcaacuccgggaaccuccgcggcagcggguacggccaggacguggacggccacaacuucaucaugcggaugaaccaggccccgaccgugggguucgagcaggacgucggcucccgcacgacccaccacuucauguaccccgagagcgccaagaaccugcccgccaacguguccuucgugcucguccccuucaaggugcuggaccugcucuggaucgcgagcgcccuguccaccgggcagauccgguucaccuacgccccggucaagagcuuccugcgcguggacaaggagaaggugcagaucuacaaccccgccuucuucaaguacauccacgaccgguggacggagcaccacggccgcuaccccagcaccggcaugcucgugcuguucuucgcccugcacgucugcgacgaggugaacguguacggguucggcgcggacucccgggggaacuggcaccacuacugggagaacaaccgcuacgccggcgaguuccggaagaccgggguccacgacgccgacuucgaggcccacaucaucgacaugcucgccaaggcgagcaagaucgagguguaccgcggcaacuga

SEQ ID NO: 37150 - RNA, 1002 nt, Artificial Sequence
  derived and/or modified sequence opt1 from ST3GAL4__Homo_sapiens__NP_001241687
auggugagcaagucccgcuggaagcugcucgccaugcuggcccugguccucguggugauggucugguacagcaucucccgggaggaccgcuacaucgagcuguucuacuuccccaucccggagaagaaggagcccugccugcagggcgaggcggagagcaaggccuccaagcuguucgggaacuacagccgggaccagcccaucuuccuccgccuggaggacuacuucugggugaagacccccuccgccuacgagcucccguacggcaccaaggggagcgaggaccugcugcuccgggugcuggccaucacguccagcuccauccccaagaacauccagagccugcgcugccggcgcugcgucguggugggcaacgggcaccggcuccgcaacuccagccugggcgacgccaucaacaaguacgacgucgugauccggcugaacaacgcgcccguggccggcuacgagggggacgucggcuccaagaccaccaugcgccucuucuaccccgagagcgcccacuucgacccgaagguggagaacaaccccgacacccugcuggugcucgucgccuucaaggcgauggacuuccacuggaucgagacgauccuguccgacaagaagcgggugcgcaagggguucuggaagcagccgccccugaucugggacgugaaccccaagcagauccggauccucaaccccuucuucauggagaucgccgccgacaagcugcugagccuccccaugcagcagccccgcaagaucaagcagaagccgaccaccggccugcuggccaucacccucgcccugcaccugugcgaccucguccacaucgcgggguucggcuaccccgacgccuacaacaagaagcagacgauccacuacuacgagcagaucacccugaaguccauggccggcagcgggcacaacgugagccaggaggcccuggccaucaagcggaugcucgagaugggcgcgaucaagaaccugaccuccuucuga

SEQ ID NO: 37151 - RNA, 1188 nt, Artificial Sequence
  derived and/or modified sequence opt1 from ST3GAL5__Homo_sapiens__NP_001035902
auggccagcgugcccaugccguccgaguacaccuacgucaagcugcgcagcgacugcucccggcccagccuccagugguacacccgcgcccaguccaagaugcggcgccccagccugcugcucaaggacauccugaagugcacgcugcucguguucggcguguggauccuguacauccugaagcucaacuacaccaccgaggagugcgacaugaagaagaugcacuacgucgaccccgaccacgugaagcgggcgcagaaguacgcccagcagguccugcagaaggagugccgcccgaaguucgccaagaccuccauggcccuccuguucgagcaccgguacagcguggaccugcugcccuucgugcagaaggcccccaaggacuccgaggcggagagcaaguacgacccgcccuucggguuccgcaaguucuccagcaaggugcagacgcuccuggagcugcuccccgagcacgaccugcccgagcaccugaaggccaagaccugccggcgcugcgucgugaucggcuccgggggcauccuccacgggcuggagcugggccacacccucaaccaguucgacguggucauccggcugaacagcgcccccguggagggcuacuccgagcacguggggaacaagaccacgauccgcaugaccuacccggagggcgcgccccugagcgaccucgaguacuacuccaacgaccuguucgucgccgugcuguucaagagcguggacuucaacuggcuccaggccauggucaagaaggagacccugcccuucugggugcggcuguucuucuggaagcaggucgccgagaagaucccccuccagccgaagcacuuccgcauccugaaccccgugaucaucaaggagaccgccuucgacauccugcaguacuccgagccccagagccgguucugggggcgcgacaagaacgugcccacgaucggcgugaucgccgucgugcucgcgacccaccugugcgacgaggucagccuggccggguucggcuacgaccucaaccagccgcggacgccccugcacuacuucgacucccagugcauggccgccaugaacuuccagaccaugcacaacgugaccaccgagaccaaguuccugcucaagcuggugaaggagggcgucgugaaggaccugagcgggggcaucgaccgcgaguucuga

SEQ ID NO: 37152 - RNA, 1155 nt, Artificial Sequence
  derived and/or modified sequence opt1 from ST3GAL6__Homo_sapiens__NP_001258074
auguggcaggcgccccgcgagcggcagcagccggccggcgccgccgcgccccaggugagcgagcccggggcgccccugcgcuccagccuccugggccucgggggcucccuccugccggccggguucgccgccggccugcacugccccggcgagcccgccaugcggggguaccucgucgccaucuuccugagcgccguguuccuguacuacgugcuccacugcauccuguggggcaccaacgucuacuggguggcccccguggagaugaagcgccggaacaagauccagccgugccuguccaagcccgccuucgccagccuccugcgcuuccaccaguuccaccccuuccugugcgccgcggacuuccggaagaucgccucccucuacgggagcgacaaguucgaccugcccuacggcaugcgcaccuccgccgaguacuuccggcuggcccucagcaagcugcaguccugcgaccuguucgacgaguucgacaacaucccgugcaagaagugcgucgugguggggaacggcggcguccucaagaacaagacgcugggggagaagaucgacagcuacgacgugaucauccgcaugaacaacggccccgugcuggggcacgaggaggaggucggccggcgcaccaccuuccggcuguucuaccccgaguccguguucagcgaccccauccacaacgacccgaacaccacggugauccugaccgccuucaagccccacgaccugcgcuggcuccuggagcugcucaugggcgacaagaucaacaccaacggguucuggaagaagcccgcgcugaaccugaucuacaagcccuaccagauccggauccucgacccguucaucauccgcaccgccgccuacgagcugcugcacuuccccaaggucuuccccaagaaccagaagcccaagcacccgacgaccggcaucaucgccaucacccucgccuucuacaucugccacgaggugcaccuggcgggguucaaguacaacuucuccgaccucaagagcccccugcacuacuacggcaacgccaccaugucccugaugaacaagaacgccuaccacaacgugacggccgagcagcuguuccucaaggacaucaucgagaagaaccuggucaucaaccugacccaggacuga

SEQ ID NO: 37153 - RNA, 3414 nt, Artificial Sequence
  derived and/or modified sequence opt1 from ST5__Homo_sapiens__NP_005409
augaccaugaccgccaacaagaacagcuccaucacgcacggcgccgggggcaccaaggcgccccgcgggacccugagccggucccagagcguguccccgccgcccguccucagcccgccccgcucccccaucuacccccugagcgacuccgagaccagcgccugccgguaccccucccacagcuccagccgcgugcugcucaaggaccggcacccgcccgcccccagcccccagaacccgcaggaccccucccccgacacguccccgccgaccugccccuucaagaccgccagcuucggcuaccuggaccgcucccccagcgccugcaagcgggacgcgcagaaggagagcgugcagggggccgcccaggacgucgccggcguggcggccugccugccccucgcccaguccacccccuuccccggccccgccgccgggccccgcggcgugcugcugacgcggaccgggacccgcgcgcacagccucggcauccgggagaagaucuccgccugggaggggcgccgggaggccagcccccgcauguccaugugcggcgagaagcgggagggcagcggguccgagugggccgccagcgagggcugccccucccuggggugccccagcgucgugcccuccccgugcagcuccgagaagaccuucgacuucaagggccugcgccggaugagccgcacguucuccgagugcagcuaccccgagaccgaggaggagggcgaggcgcuccccgugcgggacuccuucuaccgccuggagaagcggcuggggcgcagcgagccguccgccuuccuccgcggccacgggagccggaaggagagcuccgccguccugagccgcauccagaagaucgagcagguccugaaggagcagcccggccgggggcucccccagcugcccuccagcugcuacuccguggaccgcggcaagcggaagaccggcacccuggggagccucgaggagccggccggcggggccuccgucagcgcgggcucccgcgccguggggguggccggcgucgccggcgaggccgggcccccgcccgagcgggagggcagcggguccacgaagcccggcacccccgggaacagccccuccagccagcgccugcccuccaagagcucccuggacccggcggugaaccccgugcccaagcccaagcggaccuucgaguacgaggccgacaagaaccccaagagcaagccgagcaacggccucccgcccucccccacccccgccgccccgccgccccugcccagcacgcccgcgccgcccgugacccgccggcccaagaaggacaugcgcggccaccggaagucccagagccgcaaguccuucgaguucgaggacgccagcucccugcagagccucuaccccuccagccccaccgagaacgggaccgagaaccagcccaaguucggcuccaagagcacgcuggaggagaacgccuacgaggacaucgugggggaccugcccaaggagaaccccuacgaggacguggaccucaagucccggcgcgccggccgcaagagccagcagcuguccgagaacagccuggacucccuccaccggauguggagcccgcaggaccggaaguacaacuccccgcccacccagcugagccugaagcccaacagccagucccuccgcagcggcaacugguccgagcgcaagagccaccggcugccccgccugcccaagcggcacucccacgacgacaugcuccugcuggcccagcucagccugcccuccagccccuccagccugaacgaggacucccucagcaccaccuccgagcugcugagcucccgccgggcgcgccggaucccgaagcucguccagcgcaucaacagcaucuacaacgccaagcgggggaagaagcgccugaagaagcuguccaugagcuccaucgagacggccagccugcgggacgagaacagcgaguccgagagcgacuccgacgaccgcuucaaggcccacacccagcggcucgugcacauccagagcaugcugaagcgcgcccccuccuaccggacccuggagcucgagcugcuggaguggcaggagcgcgagcuguucgaguacuucguggucgugagccucaagaagaagcccucccggaacaccuaccugcccgaggucagcuaccaguucccgaagcucgaccgccccacgaagcagaugcgggaggcggaggagcgccugaaggccaucccccaguucugcuuccccgacgccaaggacuggcugccgguguccgaguacagcuccgagaccuucagcuucaugcucaccggcgaggacgggucccggcgcuucggcuacugccgccggcugcugcccagcgggaagggcccccgccuccccgagguguacugcgucaucucccggcugggcugcuucgggcuguucagcaaggugcucgacgagguggagcgccggcgcggcaucuccgccgcccuggucuacccguucaugcggagccugauggagucccccuuccccgcgccggggaagaccaucaaggugaagacguuccuccccggcgccgggaacgaggugcuggagcugcgccggcccauggacagccgccucgagcacgucgacuucgagugccuguucacgugccugagcgugcggcagcucauccgcaucuucgccucccugcugcucgagcggcgcgugaucuucgucgccgacaagcugagcacccuguccagcugcucccacgcggugguggcccuccuguaccccuucagcuggcagcacaccuucaucccgguccugcccgccuccaugaucgacaucgugugcugccccacccccuuccucgugggccugcugagcuccagccucccgaagcugaaggagcugcccgucgaggaggcccucauggugaaccugggcuccgaccgguucauccgccagauggacgacgaggacacccugcucccccggaagcugcaggccgcgcuggagcaggcccucgagcgcaagaacgagcugaucagccaggacuccgacagcgacuccgacgacgagugcaacacccugaacgggcucgugagcgaggucuucauccgguucuucguggagaccgugggccacuacucccuguuccugacccagagcgagaagggggagcgcgccuuccagcgcgaggccuuccggaaguccgucgccagcaagagcauccgccgguuccucgagguguucauggagucccagauguucgcgggcuucauccaggaccgcgagcugcggaagugccgcgccaaggggcuguucgagcagcggguggagcaguaccucgaggagcugcccgacacggagcagagcggcaugaacaaguuccugcgcggccucgggaacaagaugaaguuccugcacaagaagaacuga

SEQ ID NO: 37154 - RNA, 1221 nt, Artificial Sequence
  derived and/or modified sequence opt1 from ST6GAL1__Homo_sapiens__NP_775323
augauccacaccaaccugaagaagaaguucagcugcugcgugcucgucuuccugcuguucgccgugaucugcguguggaaggagaagaagaagggcuccuacuacgacagcuucaagcuccagaccaaggaguuccagguccugaagucccuggggaagcucgccaugggcagcgacucccagagcguguccagcuccagcacgcaggacccccaccgcgggcggcagacccugggcucccugcgcgggcucgcgaaggccaagccggaggccagcuuccagguguggaacaaggacuccagcuccaagaaccugaucccccggcugcagaagaucuggaagaacuaccucagcaugaacaaguacaaggucuccuacaagggccccggccccgggaucaaguucagcgccgaggcccugcgcugccaccuccgggaccacgugaacguguccauggucgaggugaccgacuucccguucaacaccagcgagugggagggcuaccugcccaaggagagcauccgcacgaaggcggggcccuggggccggugcgccguggucuccagcgccgggucccucaagagcucccagcugggccgcgagaucgacgaccacgacgccgugcugcgguucaacggcgcgcccaccgccaacuuccagcaggacguggggaccaagaccacgauccgccugaugaacagccagcuggucaccaccgagaagcgguuccucaaggacucccuguacaacgagggcauccugaucgugugggacccgagcguguaccacuccgacauccccaagugguaccagaaccccgacuacaacuucuucaacaacuacaagaccuaccgcaagcuccaccccaaccagccguucuacauccugaagccccagaugcccugggagcugugggacauccuccaggagaucagccccgaggagauccagccgaacccgcccuccagcgggaugcugggcaucaucaucaugaugacgcugugcgaccaggucgacaucuacgaguuccuccccuccaagcggaagaccgacgugugcuacuacuaccagaaguucuucgacagcgccugcaccaugggcgccuaccacccccugcuguacgagaagaaccucgugaagcaccugaaccaggggaccgacgaggacaucuaccugcucggcaaggccacgcugcccggguuccgcaccauccacugcuga

SEQ ID NO: 37155 - RNA, 1401 nt, Artificial Sequence
  derived and/or modified sequence opt1 from ST6GAL2__Homo_sapiens__NP_001135824
augaagccccaccugaagcaguggcgccagcggaugcuguucggcaucuucgccugggggcuccuguuccuccugaucuucaucuacuucaccgacagcaacccggccgagcccgugcccuccagccuguccuuccucgagacccgccggcugcugcccguccagggcaagcagcgcgcgaucaugggggccgcccacgagccgagcccgcccggcgggcucgacgcccggcaggcccugccccgcgcgcaccccgccggcuccuuccacgccggccccggggaccugcagaagugggcccagagccaggacggcuucgagcacaaggaguucuucuccagccagguggggcggaagucccagagcgcguucuaccccgaggacgacgacuacuucuucgccgccggccagcccggguggcacucccacacgcagggcacccucggcuucccgagccccggggagcccggcccccgcgagggggccuucccggccgcccaggugcagcggcgccgggucaagaagcgccaccggcgccagcggcgcucccacgugcuggaggagggcgacgacggcgaccggcuguacagcuccaugagccgcgcguuccucuaccggcuguggaaggggaacguguccagcaagaugcugaacccccgccuccagaaggccaugaaggacuaccugaccgccaacaagcacggcguccgguuccgcgggaagcgcgaggccggccugucccgggcgcagcuccugugccagcugcgcagccgggcccgcgugcggacccucgacgggacggaggcccccuucagcgcccugggcuggcgccggcuggugcccgccgucccgcucucccagcugcacccccgcggccugcggagcugcgcgguggugauguccgccggggccauccucaacagcucccugggcgaggagaucgacagccacgacgccguccugcgcuucaacuccgcccccacccggggguacgagaaggacgugggcaacaagaccaccauccgcaucaucaacagccagauccucacgaaccccucccaccacuucaucgacagcucccuguacaaggacgugauccuggucgcgugggacccggcccccuacagcgccaaccucaaccugugguacaagaagcccgacuacaaccuguucacccccuacauccagcaccggcagcgcaacccgaaccagcccuucuacauccuccaccccaaguucaucuggcagcugugggacaucauccaggagaacaccaaggagaagauccagccgaacccgcccuccagcggguucaucggcuccuucgugaagaucggccacauccgggccugcagcgagccccgcucccgggacugcacccccgcguggacgaccgaguga

SEQ ID NO: 37156 - RNA, 1803 nt, Artificial Sequence
  derived and/or modified sequence opt1 from ST6GALNAC1__Homo_sapiens__NP_060884
augcgcagcugccuguggcggugccgccaccucucccagggcgugcaguggagccugcugcucgccguccugguguucuuccuguucgcccuccccuccuucaucaaggagccgcagaccaagcccagccggcaccagcgcaccgagaacaucaaggagcggucccugcagagccuggcgaagcccaagucccaggcccccacgcgcgcccggcgcaccaccaucuacgccgagccggugcccgagaacaacgcccucaacacccagacgcagcccaaggcgcacaccaccggggaccggggcaaggaggccaaccaggcccccccggaggagcaggacaaggucccccacaccgcccagcgcgcggccuggaagagccccgagaaggagaagacgauggugaacacccuguccccccgggggcaggacgccggcauggccagcgggcgcaccgaggcccaguccuggaagagccaggacaccaagacgacccagggcaacggcgggcagacccggaagcugaccgcgucccgcacggugagcgagaagcaccagggcaaggccgccaccaccgccaagacccucaucccgaagucccagcaccggaugcuggcccccacgggggcggucagcacccgcacccggcagaagggcgugaccacggccgugaucccccccaaggagaagaagccgcaggccacccccccccccgccccguuccagucccccaccacccagcgcaaccagcggcugaaggccgcgaacuucaagagcgagccccgcugggacuucgaggagaaguacuccuucgagaucgggggccuccagacgaccugccccgacagcgucaagaucaaggccagcaagucccuguggcugcagaagcucuuccugccgaaccugacccucuuccuggacagccggcacuucaaccaguccgagugggaccgccuggagcacuucgccccccccuucggcuucauggagcucaacuacagccuggugcagaagguggucacccgcuuccccccggugccccagcagcagcugcuccuggccucccugcccgccgggagccuccggugcaucacgugcgcgguggucggcaacgggggcauccugaacaacucccacaugggccaggagaucgacagccacgacuacguguuccgccuguccggggcccucaucaagggcuacgagcaggacguggggacccggaccagcuucuacggcuucaccgccuucucccugacgcagagccugcucauccuggggaaccgcggcuucaagaacgucccgcugggcaaggacgugcgguaccuccacuuccuggaggggacccgcgacuacgaguggcuggaggcccuccugaugaaccagaccgugauguccaagaaccuguucugguuccggcaccgcccccaggaggcguuccgggaggcccuccacauggaccgcuaccugcugcuccaccccgacuuccugcgguacaugaagaaccgcuuccugcggagcaagacccuggacggcgcccacuggcgcaucuaccggcccaccacgggggcccuccugcugcucaccgcccugcagcugugcgaccaggucuccgcguacggcuucaucaccgaggggcacgagcgcuucagcgaccacuacuacgacaccuccuggaagcggcucaucuucuacaucaaccacgacuucaagcuggagcgcgagguguggaagcggcugcacgacgagggcaucauccgccucuaccagcgcccgggccccgggacggccaaggccaagaacuga

SEQ ID NO: 37157 - RNA, 1125 nt, Artificial Sequence
  derived and/or modified sequence opt1 from ST6GALNAC2__Homo_sapiens__NP_006447
augggccugccccgcgggagcuucuucuggcuccugcugcuccugaccgccgccugcuccggccuccuguucgcgcuguacuucagcgccgugcagcgguacccggggcccgccgccggcgcccgcgacaccaccuccuucgaggcguucuuccagagcaaggccuccaacagcuggaccgggaagggccaggccugccggcaccuccugcaccuggccauccagcgccacccccacuuccggggccuguucaaccucuccauccccguccugcuguggggcgaccucuucaccccggcgcugugggaccgccugagccagcacaaggcccccuacggguggcgggggcucucccaccaggugaucgccagcacccugucccugcucaacggcagcgaguccgccaagcuguucgccccgccccgcgacacgccgcccaagugcauccggugcgcgguggucgggaacggcggcauccugaacgggagccgccagggccccaacaucgacgcccacgacuacguguuccggcucaacggggccgugaucaagggcuucgagcgcgacgucggcaccaagaccuccuucuacggguucaccgugaacacgaugaagaacagccugguguccuacuggaaccugggcuucaccagcgucccccaggggcaggaccuccaguacaucuucauccccuccgacauccgggacuacgugaugcugcgcagcgccauccugggcgugcccguccccgaggggcucgacaagggcgaccggccccacgccuacuucggcccggaggcgagcgccuccaaguucaagcugcugcaccccgacuucaucagcuaccucaccgagcgcuuccugaaguccaagcugaucaacacccacuucggggaccucuacaugcccagcacgggcgcccugaugcugcucaccgcccugcacacgugcgaccagguguccgccuacggguucaucaccagcaacuacuggaaguucuccgaccacuacuucgagcggaagaugaagccccugaucuucuacgcgaaccacgaccucagccuggaggccgcccuguggcgcgaccuccacaaggccggcauccugcagcuguaccagcgguga

SEQ ID NO: 37158 - RNA, 909 nt, Artificial Sequence
  derived and/or modified sequence opt1 from ST6GALNAC4__Homo_sapiens__NP_778204
augaaggcccccggccgccuggugcucaucauccugugcagcgucguguucuccgccguguacauccugcucugcugcugggcggggcugccgcugugccucgcgaccugccuggaccaccacuuccccaccggcagccggcccacgguccccgggccgcugcacuucuccggcuacagcuccgugcccgacgggaagccccucgugcgcgagcccugccggagcugcgccgucguguccagcuccggccagaugcugggcagcgggcugggcgccgagaucgacuccgccgagugcguguuccgcaugaaccaggccccgaccgucggguucgaggccgacgugggccagcggagcacccuccgcguggucucccacaccagcgugccccugcugcuccggaacuacucccacuacuuccagaaggcccgcgacacgcuguacauggugugggggcagggccggcacauggaccgcguccugggcgggcggaccuaccgcacccuccugcagcugacccggauguaccccggccuccagguguacacguucaccgagcgcaugauggccuacugcgaccagaucuuccaggacgagaccgggaagaaccggcgccagagcggcuccuuccugagcaccggcugguucacgaugauccuggcgcucgagcugugcgaggagaucguggucuacgggaugguguccgacagcuacugccgggagaagucccaccccagcgugccguaccacuacuucgagaagggccgccuggacgagugccagauguaccucgcccacgagcaggcgccccggagcgcccaccgcuucaucaccgagaaggccgucuucucccggugggccaagaagcgccccaucguguucgcccaccccagcuggcgcaccgaguga

SEQ ID NO: 37159 - RNA, 1125 nt, Artificial Sequence
  derived and/or modified sequence opt1 from ST6GALNAC6__Homo_sapiens__NP_001273928
auggccugcagccggcccccgucccagugcgagcccaccagccugccgcccggcccgcccgccgggcgccgccaccucccccugucccggcgccggcgcgagaugagcuccaacaaggagcagcggagcgcgguguucgucauccuguucgcccucaucaccauccugauccuguacuccagcaacuccgccaacgagguguuccacuacggcagccuccgcgggcggucccgccggcccgugaaccugaagaaguggagcaucacggacggcuacguccccauccuggggaacaagacccuccccucccgcugccaccagugcgugaucgugagcuccagcucccaccuccugggcaccaagcugggccccgagaucgagcgggccgagugcaccauccgcaugaacgacgcccccacgaccggguacagcgcggacgucggcaacaagaccaccuaccgggugguggcccacuccagcgucuuccgcgugcugcggcgcccgcaggaguucgugaaccggacgcccgagaccgucuucaucuucugggggccgcccagcaagaugcagaagccccagggcucccuggugcgcgugauccagcgggccgggcucgucuuccccaacauggaggccuacgcggugagccccggccgcaugcgccaguucgacgaccuguuccggggcgagaccgggaaggaccgcgagaagucccacagcuggcuguccaccggcugguucacgauggugaucgccgucgagcucugcgaccacgugcacguguacgggauggugcccccgaacuacugcagcggccccgccuccagcgccugccccaccaccaccacgagcccccggggccgcaccaacgucuccccgaccucccggaugagcaccguggcccgcgcgacgaccaccgccuccagcccccggaagggguccagccaccgcggccccuccugcauggccagccccuccccgaccccgcccgggccccggccgcccagccugugggaccugcgccggguccgcggcgaggccgccagcgcgcagccccucgggcagggccccuccagcggccagucccggcuggccggggugagccccucccagagcggccccuga

SEQ ID NO: 37160 - RNA, 1665 nt, Artificial Sequence
  derived and/or modified sequence opt1 from ST7__Homo_sapiens__NP_060882
auggccgaggccgccaccggcuuccuggagcagcucaagagcugcaucgugugguccuggaccuaccuguggacggucugguucuucaucgugcuguuccucguguacauccugcgcgucccccugaagaucaacgacaaccucagcaccguguccauguuccugaacacccugaccccgaaguucuacguggcccucacggggaccagcucccugaucagcggccugauccucaucuucgaguggugguacuuccggaaguacgggaccuccuucaucgagcaggucagcgugucccaccuccgcccccugcucggcgggguggacaacaacagcuccaacaacagcaacuccagcaacggcgacuccgacagcaaccggcaguccgucagcgagugcaagguguggcgcaacccccugaaccuguuccggggcgccgaguacaaccgcuacaccugggugacggggcgggagccccucaccuacuacgacaugaaccuguccgcccaggaccaccagaccuucuucacgugcgacagcgaccaccuccgcccggccgacgcgaucaugcagaaggccuggcgggagcgcaacccccaggcccggaucagcgccgcgcacgaggcccuggagaucaacgagugcgccaccgccuacauccugcuggccgaggaggaggcgaccaccaucgccgaggccgagaagcuguucaagcaggcccugaaggccggcgacgggugcuaccgccggucccagcagcugcagcaccacggcagccaguacgaggcgcagcaccgccgggacaccaacguccucguguacaucaagcgccggcuggccaugugcgcccgccggcuggggcgcacgcgggaggccgugaagaugaugcgcgaccucaugaaggaguucccccugcuguccauguucaacauccacgagaaccuccuggaggcccugcucgagcugcaggcguacgccgacguccaggccgugcuggccaaguacgacgacaucagccuccccaaguccgccaccaucugcuacaccgcggcccugcugaaggcccgcgccgugagcgacaaguucuccccggaggcggccagccggcgcggccucuccaccgccgagaugaacgccgucgaggccauccaccgggcgguggaguucaacccccacgugcccaaguaccugcuggagaugaagucccucauccugcccccggagcacauccugaagcgcggcgacagcgaggccaucgccuacgccuucuuccaccucgcccacuggaagcgggucgagggggcgcugaaccugcugcacugcacgugggagggcaccuuccgcaugauccccuacccccucgagaaggggcaccuguucuaccccuacccgaucugcaccgagaccgccgaccgggagcugcuccccagcuuccacgagguguccguguaccccaagaaggagcugcccuucuucauccuguucacggccggccucugcagcuucaccgccaugcuggcccugcucacccaccaguucccggagcugaugggcgucuucgcgaaggccuuccuguccacccucuucgcgccccugaacuucgugauggagaaggucgagagcauccugcccuccagccucuggcaccagcugacgcgcaucuga

SEQ ID NO: 37161 - RNA, 1560 nt, Artificial Sequence
  derived and/or modified sequence opt1 from ST7L__Homo_sapiens__XP_011539931
augagccccuuccuguuccgcgacgacaugaaggaccucaccguguuccugaacucccugaccccgaaguucuacgucgcccucacgggcaccagcucccugaucagcgggcugaucuucaucuucgaguggugguacuuccacaagcacggcaccuccuucaucgagcaggucagcgugucccaccuccagccccugaugggcgggaccgagagcuccaucagcgagcccgggucccccagccggaaccgcgagaacgagacgucccggcagaaccugagcgagugcaagguguggcgcaacccgcucaaccuguuccggggcgccgaguaccgccgguacaccugggugaccggcaaggagccccugaccuacuacgacaugaaccucuccgcgcaggaccaccagacguucuucacgugcgacaccgacuuccugcgccccagcgacaccgugaugcagaaggccuggcgggagcgcaacccgcccgcccggaucaaggccgccuaccaggcgcuggagcucaacaacgacugcgccaccgccuacguccugcuggccgaggaggaggcgaccaccaucguggacgccgagcgccucuucaagcaggcccugaaggccggggagaccaucuaccggcagucccagcagugccagcaccagagcccccagcacgaggcccagcugcgccgggacacgaacgugcucgucuacaucaagcgccggcuggcgaugugcgcccgcaagcugggccggauccgcgaggccgugaagaucaugcgggaccucaugaaggaguucccgccccugaccaugcugaacauccacgagaaccuccuggagucccugcucgagcugcaggccuaccccgacgugcaggccguccuggcgaaguacgacgacaucagccuccccaagagcgccgccaucugcuacaccgccgcccugcugaagacccgcacgguguccgagaaguucagccccgagaccgcgucccgccgggggcucagcaccgccgagaucaacgccguggaggccauccaccgcgccgucgaguucaacccccacgugccgaaguaccugcuggagaugaagucccucauccugccgcccgagcacauccugaagcggggcgacagcgaggcgaucgccuacgccuucuuccaccuccagcacuggaagcgcaucgagggggcccugaaccugcuccagugcaccugggagggcacguuccggaugauccccuacccccuggagaagggccaccuguucuaccccuaccccuccugcaccgagaccgcggaccgcgagcuccugcccaccuuccaccacgugagcgucuacccgaagaaggagcugccccuguucauccacuucacggccggguucugcuccagcaccgccaugaucgccauccucacccaccaguuccccgagaucaugggcaucuucgccaaggcggugcuggggcuguggugcccccagccgugggccuccagcggcuucgaggagaacacccaggaccucaaguccgaggaccugggccugagcuccggguga

SEQ ID NO: 37162 - RNA, 642 nt, Artificial Sequence
  derived and/or modified sequence opt1 from ST8SIA1__Homo_sapiens__NP_001291379
augaccggcagcuucuacacccacagcccccugacgauccagcucacccuguccucccaccgcugcaaccugccgccccucagcuccgaguacaccaaggacguggggagcaagucccagcuggucaccgccaaccccagcaucauccggcagcgcuuccagaaccugcucuggucccggaagacguucguggacaacaugaagaucuacaaccacagcuacaucuacaugcccgccuucuccaugaagaccggcaccgagccgagccugcgcguguacuacacccuguccgacgucggggcgaaccagacgguccucuucgccaaccccaacuuccugcggagcaucggcaaguucuggaagucccgcgggauccacgccaagcggcugagcaccggccucuuccugguguccgccgcccugggccucugcgaggagguggcgaucuacggguucuggcccuucagcgugaacaugcacgagcagcccaucucccaccacuacuacgacaacgugcugccguucagcggcuuccacgccaugcccgaggaguuccugcagcucugguaccugcacaagaucggggcccugcgcaugcagcucgaccccugcgaggacaccagccugcagcccaccuccuga

SEQ ID NO: 37163 - RNA, 1128 nt, Artificial Sequence
  derived and/or modified sequence opt1 from ST8SIA2__Homo_sapiens__NP_006002
augcagcugcaguuccgcagcuggaugcucgccgcccugacccugcucguggucuuccugaucuucgcggacaucuccgagaucgaggaggagaucggcaacagcgggggccgggggaccauccgcuccgccgugaacagccugcacuccaagagcaaccgggccgagguggucaucaacggcuccagcucccccgccgugguggaccgcagcaacgaguccaucaagcacaacauccagccggccagcuccaaguggcggcacaaccagacgcucagccugcgcauccggaagcagauccugaaguuccucgacgcggagaaggacaucuccguccugaaggggacccugaagcccggcgacaucauccacuacaucuucgaccgcgacagcaccaugaacgugucccagaaccucuacgagcugcugccccggaccagcccccucaagaacaagcacuucggcacgugcgccaucguggggaacuccggcguccugcugaacagcgggugcggccaggagaucgacgcccacagcuucgugauccgcugcaaccucgccccggugcaggaguacgcgcgggacgucgggcugaagaccgaccuggugaccaugaaccccuccgugauccagcgcgccuucgaggaccucgucaacgccaccuggcgggagaagcugcugcagcgccuccacagccugaacggcuccauccuguggauccccgccuucauggcccggggcgggaaggagcgcguggagugggugaacgagcucauccugaagcaccacgucaacgugcggacggcguaccccagccugcgccuccugcacgccgugcggggcuacuggcugaccaacaagguccacaucaagcgcccgaccaccgggcuccugauguacacgcuggccacccgguucugcaagcagaucuaccucuacggcuucuggcccuucccccuggaccagaaccagaaccccgugaaguaccacuacuacgacucccugaaguacggcuacaccagccaggccuccccgcacaccaugccccucgaguucaaggcccucaagagccugcacgagcagggggcgcugaagcugacggugggccagugcgacggggccaccuga

SEQ ID NO: 37164 - RNA, 1143 nt, Artificial Sequence
  derived and/or modified sequence opt1 from ST8SIA3__Homo_sapiens__NP_056963
augcgcaacugcaagauggcccggguggccagcguccugggccucgugaugcuguccguggcgcugcucauccugagccugaucuccuacgucagccucaagaaggagaacaucuucaccacccccaaguacgccuccccgggggcgccccgcauguacauguuccacgccggcuuccggagccaguucgcccugaaguuccuggaccccuccuucgugcccaucacgaacagccucacccaggagcugcaggagaagccguccaaguggaaguucaaccgcaccgccuuccugcaccagcggcaggagauccuccagcacguggacgucaucaagaacuucagccugaccaagaacuccgugcgcaucgggcagcugaugcacuacgacuacagcucccacaaguacguguucagcaucuccaacaacuuccggagccuccugcccgacgucucccccaucaugaacaagcacuacaacaucugcgccguggugggcaacagcgggauccugacgggcucccagugcggccaggagaucgacaagagcgacuucgucuuccgcugcaacuucgcccccaccgaggccuuccagcgggacguggggcgcaagaccaaccucaccacguucaacccgagcauccuggagaaguacuacaacaaccugcucaccauccaggaccggaacaacuucuuccugucccugaagaagcucgacggcgcgauccuguggauccccgccuucuucuuccacaccagcgccaccgugacgcgcacccuggucgacuucuucguggagcaccgggggcagcucaaggugcagcuggccuggcccggcaacaucaugcagcacgucaaccgcuacuggaagaacaagcaccugucccccaagcggcucagcaccgggauccugauguacacccuggccuccgcgaucugcgaggagauccaccucuacggcuucuggccguucggcuucgaccccaacacgcgcgaggaccugcccuaccacuacuacgacaagaaggggaccaaguucaccaccaaguggcaggagagccaccagcugcccgccgaguuccagcuccuguaccggaugcacggcgaggggcugacgaagcucacccugucccacugcgccuga

SEQ ID NO: 37165 - RNA, 1080 nt, Artificial Sequence
  derived and/or modified sequence opt1 from ST8SIA4__Homo_sapiens__NP_005659
augcggagcauccggaagcgcuggaccaucugcaccaucucccugcuccugaucuucuacaagacgaaggagaucgcccggaccgaggagcaccaggagacccagcugaucggcgacggggagcucagccugucccgcagccuggugaacuccagcgacaagaucauccggaaggccggcuccagcaucuuccagcacaacgucgagggguggaagaucaacuccagccucgugcuggagauccgcaagaacauccugcgguuccucgacgcggagcgcgacguguccgucgugaaguccuccuucaagcccggcgacgugauccacuacguccuggaccggcgccggacccugaacaucagccacgaccuccacucccugcugccggaggugagccccaugaagaaccgccgguucaagacgugcgccguggucgggaacuccggcauccuccuggacagcgagugcggcaaggagaucgacucccacaacuucgugauccgcugcaaccuggcccccguggucgaguucgccgccgacguggggaccaagagcgacuucaucaccaugaaccccagcgugguccagcgggcguucggcggguuccgcaacgaguccgaccgggagaaguucgugcaccgccucagcaugcugaacgacuccgugcuguggaucccggccuucauggucaagggcggggagaagcacguggagugggugaacgcccucauccugaagaacaagcugaagguccggaccgccuaccccagccuccgccugauccacgcggugcggggcuacuggcugacgaacaaggugcccaucaagcgccccuccaccggccuccugauguacacccuggccacccgcuucugcgacgagauccaccucuacggguucuggccguuccccaaggaccugaacggcaaggccgucaaguaccacuacuacgacgaccugaaguaccgguacuucagcaacgccagcccccaccgcaugccccucgaguucaagacgcugaacgugcugcacaaccgcggggcccucaagcugaccaccggcaagugcgucaagcaguga

SEQ ID NO: 37166 - RNA, 1197 nt, Artificial Sequence
  derived and/or modified sequence opt1 from ST8SIA6__Homo_sapiens__NP_001004470
augcgccccggcggggcccugcucgcccugcuggcgagccuccugcugcuccugcugcuccggcugcuguggugcccggccgacgcccccggccgcgcccggauccucguggaggagucccgcgaggccacccacgggacccccgcggcccugcggacgcugcgcagccccgccaccgccgucccgcgggcgaccaacuccaccuaccucaacgagaagucccugcagcugacggagaagugcaagaaccuccaguacggcaucgagagcuucagcaacaagaccaagggguacuccgagaacgacuaccugcagaucaucaccgacauccagagcugccccuggaagcgccaggccgaggaguacgccaacuuccgggccaagcuggccuccugcugcgacgcggugcagaacuucguggucagccagaacaacacccccgugggcacgaacauguccuacgagguggagagcaagaaggagauccccaucaagaagaacaucuuccacauguucccggucucccagcccuucguggacuaccccuacaaccagugcgccguggucggcaacgggggcauccucaacaagagccugugcgggaccgagaucgacaaguccgacuucguguuccgcugcaaccugcccccgaccaccggcgacgugagcaaggacgucggguccaagacgaaccucgugaccaucaaccccagcaucaucacccugaaguacggcaaccugaaggagaagaaggcccucuuccuggaggacaucgccaccuacggcgacgccuucuuccugcuccccgcguucuccuuccgggccaacacggggaccagcuucaagguguacuacacccuggaggagagcaaggcccgccagaagguccuguucuuccaccccaaguaccucaaggaccuggcccuguucuggcggaccaagggcgugacggccuaccgccucuccaccgggcugaugaucaccagcguggcggucgagcugugcaagaacgugaagcucuacggcuucuggccguucuccaagaccguggaggacauccccgucagccaccacuacuacgacaacaagcugcccaagcacggcuuccaccagaugcccaaggaguacucccagauccugcagcuccacaugaaggggauccugaagcugcaguucagcaagugcgagguggccuga

SEQ ID NO: 37167 - RNA, 7713 nt, Artificial Sequence
  derived and/or modified sequence opt1 from STAB1__Homo_sapiens__NP_055951
auggccggcccccgcgggcugcucccccugugccugcucgccuucugccuggccggcuucuccuucgugcggggccaggugcuguucaaggggugcgacgugaagaccaccuucgugacccacgugcccugcaccuccugcgccgccaucaagaagcagaccugccccagcggguggcuccgggagcugcccgaccagaucacccaggacugccgguacgaggugcagcugggcggcuccauggugagcauguccgggugccgccggaagugccgcaagcaggucgugcagaaggccugcugcccgggcuacugggggagccggugccacgagugccccggcggggccgagacccccugcaacggccacgggaccugccucgacgggauggaccgcaacgggaccugcgugugccaggagaacuuccggggguccgccugccaggagugccaggaccccaaccgcuucggcccggacugccagagcgucugcuccugcgugcacggcgugugcaaccacgggccccggggcgacgggagcugccugugcuucgccggcuacaccgggccccacugcgaccaggagcugcccgucugccaggagcuccgcugcccgcagaacacccagugcuccgccgaggcccccagcugccggugccugcccggcuacacccagcagggcuccgagugccgcgcccccaacccgugcuggcccagccccugcucccugcucgcccagugcagcgugucccccaaggggcaggcccagugccacugcccggagaacuaccacggcgacgggauggugugccugcccaaggaccccugcaccgacaaccugggcgggugccccagcaacuccacccucugcgucuaccagaagccgggccaggccuucugcacgugccggcccggccuggugagcaucaacagcaacgccuccgcggggugcuucgccuucugcagccccuucuccugcgaccgcagcgcgaccugccaggugaccgccgacggcaagaccuccugcgucugccgggagagcgaggugggggacggccgcgccugcuacgggcaccuccugcacgaggugcagaaggcgacccagaccggccgggucuuccugcagcugcgcguggccguggccaugauggaccagggcugccgggagauccucaccaccgccgggcccuucacgguccuggugccguccgucagcuccuucagcucccgcaccaugaacgccagccuggcgcagcagcucugccgccagcacaucaucgccggccagcacauccuggaggacacccggacccagcagacccgccggugguggacccuggccgggcaggagaucaccgugaccuucaaccaguucaccaaguacuccuacaaguacaaggaccagccccagcagaccuucaacaucuacaaggccaacaacaucgccgcgaacggcguguuccacgucgugaccggccuccgcuggcaggcccccagcgggaccccgggcgaccccaagcggaccaucgggcagauccuggccuccaccgaggccuucagccgcuucgagaccauccuggagaacugcggccuccccuccauccuggacgggcccggcccguucaccguguucgcgcccagcaacgaggccgucgacucccugcgggacggccgccucaucuaccuguucacggccgggcugagcaagcuccaggagcuggugcgguaccacaucuacaaccacggccagcugaccguggagaagcucaucagcaaggggcgcauccugaccauggccaaccagguccuggccgugaacaucuccgaggagggccggauccuccuggggcccgagggcgugccccugcagcgcgucgacgugauggcggccaacggcgugauccacaugcucgacgggauccugcugccgcccaccauccugcccauccuccccaagcacugcagcgaggagcagcacaagaucgucgccggcuccugcguggacugccaggcccugaacaccagcacgugcccgcccaacuccgugaagcuggacaucuuccccaaggagugcgucuacauccacgaccccaccgggcucaacgugcugaagaagggcugcgccagcuacugcaaccagaccaucauggagcaggggugcugcaagggcuucuucggcccggacugcacccagugccccgggggcuucuccaaccccugcuacgggaagggcaacugcagcgacgggauccagggcaacggcgcgugccugugcuuccccgacuacaaggggaucgccugccacaucugcuccaacccgaacaagcacggcgagcagugccaggaggacugcgggugcgugcacggccucugcgacaaccggcccggcagcgggggcgucugccagcaggggacgugcgcccccggcuucuccgggcgcuucugcaacgagagcaugggcgacugcggccccaccgggcuggcccagcacugccaccuccacgcccggugcgugucccaggagggcguggcgcgcugccggugccucgacggguucgagggcgacggguucagcugcaccccguccaaccccugcagccaccccgaccgcggcggcugcuccgagaacgccgagugcgucccggggagccugggcacccaccacugcacgugccacaagggguggagcggcgacgggcgggugugcguggccaucgacgagugcgagcuggacaugcgcggcggcugccacaccgacgcccucugcuccuacgucgggcccggccagagccgcugcacgugcaagcugggguucgcgggcgacggcuaccagugcucccccaucgaccccugccgggccgggaacggcgggugccacggccuggcgaccugccgcgccgucggcggcggccagcgggugugcacgugcccgcccggguucggcggggacggcuucagcugcuacggggacaucuuccgcgagcucgaggccaacgcgcacuucuccaucuucuaccaguggcugaaguccgccggcaucacccugcccgccgaccggcgcgucaccgcccucgugcccuccgaggccgcggugcggcagcugagcccggaggaccgcgccuucuggcugcagccccggacccuccccaaccugguccgcgcccacuuccugcagggcgcccucuucgaggaggagcuggcccggcucgggggccaggagguggcgacgcugaaccccaccacccgcugggagauccggaacaucuccgggcgcguguggguccagaacgccagcguggacguggccgaccugcuggccaccaacggcguccuccacauccugucccaggugcugcucccgccccgcggggacgugcccggcggccaggggcugcugcagcagcucgaccugguccccgcguucagccuguuccgcgagcuccugcagcaccacggccuggugccgcagaucgaggccgccacggccuacaccaucuucgugcccaccaaccggucccucgaggcccaggggaacagcucccaccuggacgcggacaccguccgccaccacguggugcugggcgaggcccucagcauggagacgcugcggaagggcggccaccgcaacucccugcucggccccgcccacuggaucgucuucuacaaccacagcgggcagcccgaggugaaccacgugccgcuggagggccccaugcuggaggcccccgggcggucccucaucggccugagcggcguccugaccguggggagcucccgcugccuccacagccacgccgaggcgcugcgcgagaagugcgucaacugcacccggcgcuuccggugcacccagggcuuccagcugcaggacacgccccgcaaguccugcguguaccggagcggguucuccuucagccgcggcugcuccuacacgugcgccaagaagauccaggugccggacugcugccccggguucuucggcacccucugcgagcccugccccggcgggcugggcggggucugcagcggccacgggcagugccaggaccgguuccugggcuccggcgagugccacugccacgagggguuccacggcaccgccugcgaggugugcgagcucgggcgcuacggcccgaacugcacgggggugugcgacugcgcccacggccugugccaggagggccugcagggggacggcagcugcgucugcaacgugggguggcagggccuccggugcgaccagaagaucaccagcccccagugcccccgcaagugcgacccgaacgccaacugcgugcaggacagcgcgggggccagcacgugcgccugcgccgccggcuacagcggcaacgggaucuucugcuccgaggucgaccccugcgcgcacggccacgggggcugcagcccccacgccaacugcaccaagguggcccccggccagcggaccugcacgugccaggacggguacaugggcgacggggagcugugccaggagaucaacuccugccugauccaccacggcgggugccacauccacgccgagugcaucccgaccggcccccagcaggucagcugcuccugccgcgagggcuacagcggggacggcauccggaccugcgagcuccuggaccccugcagcaagaacaacgggggcugcucccccuacgcgaccugcaagagcacgggggacggccagcggaccugcacgugcgacaccgcccacacggucggcgacgggcugaccugccgggcccgcgugggccucgagcugcugcgggacaagcacgccuccuucuucagccuccgccugcuggaguacaaggagcucaagggggacggcccguucaccaucuucgugccccacgccgaccugauguccaaccugagccaggacgagcucgcgcggauccgcgcccaccgccagcuggucuuccgguaccacgugguggggugccgccggcugcgcuccgaggaccuccuggagcagggcuacgccaccgcccugagcggccacccccuccgguucuccgagcgcgaggggagcaucuaccugaacgacuucgcccgggucguguccagcgaccacgaggcggugaacggcauccugcacuucaucgaccgcguccuccugcccccggaggcccugcacugggagcccgacgacgcccccaucccccggcgcaacgugacggccgccgcgcagggguucggcuacaagaucuucuccggccuccugaagguggccgggcugcucccgcugcugcgggaggccagccaccgccccuucaccaugcuguggcccaccgacgccgcguuccgggcccugccgcccgaccgccaggccuggcuguaccacgaggaccaccgggacaagcuggccgccauccuccgcggccacaugauccggaacgucgaggcgcuggccuccgaccugcccaaccucgggccccugcgcaccaugcacggcacgcccaucagcuucuccugcagccggacccgcgccggggagcugauggugggcgaggacgacgcccggaucgugcagcgccaccuccccuucgagggcgggcuggccuacggcaucgaccagcugcucgagccgcccgggcugggcgcgcgcugcgaccacuucgagacccggccccugcgccucaacacgugcuccaucugcgggcuggagccgcccugccccgagggcagccaggagcagggcagcccggaggccugcuggcgguucuaccccaaguucuggacgagcccgccccugcacagccucgggcugcgcuccgucugggugcacccgagccuguggggccggccccaggggcucggccgcgggugccaccggaacugcgugaccaccaccuggaagcccuccugcugccccggccacuacggcagcgagugccaggccugccccgggggccccuccagccccugcuccgaccgcggggucugcauggacggcaugagcggguccggccagugccugugccggagcggcuucgccgggacggccugcgagcugugcgcgcccggcgccuucgggccgcacugccaggccugccgcugcaccgugcacggccggugcgacgagggccucgggggcuccgggagcugcuucugcgacgagggcuggaccgggccccgcugcgaggugcagcuggagcugcagcccgucugcacgccgcccugcgcccccgaggcggugugccgggccggcaacuccugcgagugcagccucggcuacgagggggacggccgcgugugcacggucgccgaccugugccaggacgggcacggcgggugcuccgagcacgccaacugcagccaggugggcaccauggugaccugcacgugccugcccgacuacgagggcgacgggugguccugccgggcccgcaaccccugcacggacggccaccgcgggggcugcagcgagcacgcgaacugccucagcaccgggcugaacacccgccggugcgagugccacgccggcuacgucggcgacgggcugcagugccucgaggaguccgagccgcccguggaccgcugccugggccagcccccgcccugccacagcgacgccaugugcaccgaccugcacuuccaggagaagcgcgccgggguguuccaccuccaggccacguccggccccuacggccugaacuucagcgaggcggaggccgccugcgaggcccagggggccguccuggcguccuucccccagcucagcgccgcccagcagcugggcuuccaccugugccucaugggguggcuggccaacggcuccaccgcccaccccgugguguuccccgucgcggacugcgggaacggccgggugggcaucgugagccugggggcccgcaagaaccucuccgagcggugggacgccuacugcuuccgcguccaggacguggccugccggugccgcaacggcuucgugggggacggcaucuccacgugcaacgggaagcugcuggacguccucgcggccaccgccaacuucuccaccuucuacggcaugcugcugggcuacgccaacgccacccagcgggggcucgacuuccuggacuuccuggacgacgagcucaccuacaagacccuguucgugcccgucaacgagggcuucguggacaacaugacccugagcgggcccgaccucgagcugcacgcguccaacgccacgcugcucagcgccaacgccucccagggcaagcugcugccggcccacagcgggcucucccugaucaucagcgacgcgggccccgacaacuccagcugggcccccguggcccccggcaccgucguggugagccgcaucaucgucugggacaucauggccuucaacgggaucauccacgcccuggcguccccgcuccuggcgccgccccagccccaggccgugcuggccccggaggcgccgcccguggccgccggcgucggggccgugcucgccgcgggcgcccugcuggggcucguggccggcgcccuguaccugcgggcccgcggcaagcccaugggguucggcuucagcgcguuccaggccgaggacgacgccgacgacgacuucuccccguggcaggaggggaccaaccccacccucgucagcgugcccaaccccguguucggcuccgacacguucugcgagccguucgacgacagccugcuggaggaggacuuccccgacacccagcggauccucaccgucaaguga

SEQ ID NO: 37168 - RNA, 7656 nt, Artificial Sequence
  derived and/or modified sequence opt1 from STAB2__Homo_sapiens__NP_060034
augaugcugcagcaccucgugaucuucugccugggccuggucgugcagaacuucugcagccccgccgagaccaccgggcaggcccgccggugcgaccgcaagucccuccugacgauccggaccgagugccgcagcugcgcgcugaaccucggcgugaagugcccggacggguacaccaugaucaccuccggcagcgucggggugcgggacugccgcuacacguucgaggugcggaccuacucccugagccugcccggcugccgccacaucugccggaaggacuaccuccagccccgcugcugccccggccggugggggccggacugcaucgagugccccggcggggccggcucccccugcaacgggcgcggcagcugcgccgagggcauggaggggaacggcaccugcuccugccaggagggguucggcggcaccgccugcgagacgugcgccgacgacaaccuguucgggcccagcugcuccagcgucugcaacugcgugcacggcgugugcaacuccgggcuggacggcgacgggaccugcgagugcuacagcgcguacaccggcccgaagugcgacaagcccauccccgagugcgccgcccuccugugccccgagaacucccggugcagcccguccaccgaggacgagaacaagcuggagugcaagugccuccccaacuaccgcggcgacgggaaguacugcgaccccaucaaccccugccugcggaagaucugccacccgcacgcccacugcacguaccugggccccaaccgccacagcugcaccugccaggagggguaccggggcgacgggcaggucugccuccccguggaccccugccagaucaacuucggcaacugcccgaccaaguccaccgugugcaaguacgacggccccgggcagagccacugcgagugcaaggagcacuaccagaacuucguccccggcguggggugcagcaugacggacaucugcaaguccgacaaccccugccaccgcaacgcgaacugcaccaccguggccccgggccggaccgagugcaucugccagaagggguacgucggcgacggccugacgugcuacgggaacaucauggagcgccugcgggagcucaacaccgagccccgcggcaaguggcaggggcgccugaccagcuucaucucccugcucgacaaggccuacgccuggccccugagcaagcugggccccuucaccgugcuccugccgacggacaagggccugaagggguucaacgugaacgagcuccuggucgacaacaaggccgcgcaguacuucgugaagcugcacaucaucgccggccagaugaacaucgaguacaugaacaacaccgacauguucuacacccucaccgggaaguccggcgagaucuucaacagcgacaaggacaaccagaucaagcugaagcugcacgggggcaagaagaaggugaagaucauccagggcgacaucaucgccuccaacgggcuccugcacauccuggaccgggccauggacaagcucgagcccacguucgagagcaacaacgagcagaccaucaugaccaugcugcagccccgcuacuccaaguuccggagccugcucgaggagaccaaccugggccacgcccuggacgaggacggggucggcgggccguacacgaucuucgugcccaacaacgaggcgcucaacaacaugaaggacggcacccuggacuaccugcucucccccgagggcagccgcaagcugcuggagcuggugcgguaccacaucguccccuucacccagcucgagguggccacccugaucuccacgccgcacauccgcagcauggccaaccagcugauccaguucaacaccaccgacaacgggcagauccucgccaacgacgucgccauggaggagaucgagaucaccgcgaagaacggccggaucuacacccugacgggggugcugaucccccccuccaucgugcccauccucccgcaccgcugcgacgagaccaagcgggagaugaagcugggcaccugcgucagcugcucccugguguacuggagccgcugccccgccaacuccgagcccaccgcccucuucacgcaccggugcguguacagcgggcgcuucggcagccugaaguccggcugcgcccgguacugcaacgccaccgucaagauccccaagugcugcaagggguucuacggcccggacugcaaccagugccccgggggcuucagcaaccccugcuccgggaacggccagugcgcggacagccugggcgggaacggcaccugcaucugcgaggagggguuccagggcucccagugccaguucugcagcgaccccaacaaguacggcccgcgcugcaacaagaagugccucugcgugcacgggaccugcaacaaccggaucgacuccgacggcgccugccugacggggaccugccgcgacggcagcgccgggcggcugugcgacaagcagaccuccgccugcggccccuacgugcaguucugccacauccacgcgaccugcgaguacagcaacggcacggccuccugcaucugcaaggccggguacgagggcgacgggacccucugcagcgagauggaccccugcaccggccugacccccgggggcugcucccgcaacgccgagugcaucaagacgggcaccgggacccacaccugcgucugccagcagggcuggacggggaacggccgggacugcagcgagaucaacaacugccugcucccguccgccgggggcugccacgacaacgcgagcugccuguacgugggccccgggcagaacgagugcgagugcaagaagggcuuccgcgggaacggcaucgacugcgagcccaucaccuccugccuggagcagaccggcaagugccacccccucgccagcugccagagcaccuccagcggggugugguccugcgucugccaggagggcuacgagggggacggcuuccugugcuacgggaacgccgccguggagcugagcuuccucuccgaggccgcgaucuucaaccgcuggaucaacaacgccagccugcagccgacgcuguccgccaccagcaaccucaccgugcugguccccucccagcaggccaccgaggacauggaccaggacgagaagagcuucuggcugucccagagcaacauccccgcccucaucaaguaccacaugcugcugggcacguaccggguggcggaccuccagacccuguccagcuccgacaugcuggccaccagccuccagggcaacuuccugcaccuggccaagguggacgggaacaucaccaucgagggcgccuccaucgucgacggggacaacgcggccacgaacggcgugauccacaucaucaacaaggugcucgucccgcagcgccggcugaccgggagccugcccaaccuccugaugcgccuggagcagaugcccgacuacuccaucuuccggggcuacaucauccaguacaaccucgccaacgccaucgaggccgcggacgccuacaccguguucgcccccaacaacaacgccaucgagaacuacauccgcgagaagaaggugcugagccuggaggaggacguccuccgguaccacguggugcuggaggagaagcugcucaagaacgaccugcacaacggcaugcaccgcgagaccaugcugggguucagcuacuuccucuccuucuuccugcacaacgaccagcuguacgucaacgaggccccgaucaacuacacgaacguggcgaccgacaagggcgugauccacgggcucggcaagguccuggagauccagaagaaccggugcgacaacaacgacaccaccaucauccgcgggcggugccgcaccugcagcuccgagcugacgugccccuucggcaccaagagccucggcaacgagaagcggcgcugcaucuacaccuccuacuucauggggcggcgcacccuguucaucggcugccagcccaagugcgugcggacggugaucacccgcgagugcugcgccggguucuucggcccccagugccagccgugccccgggaacgcccagaacgucugcuucggcaacggcaucugccuggacggggugaacggcaccggggugugcgagugcggcgagggcuucagcgggaccgccugcgagacgugcaccgagggcaaguacgggauccacugcgaccaggccugcuccugcguccacggccggugcaaccaggggccccucggcgacggcagcugcgacugcgacgugggguggcgcggcgugcacugcgacaacgcgaccaccgaggacaacugcaacgggacgugccacaccuccgccaacugccugaccaacagcgacggcaccgccuccugcaagugcgccgcgggguuccagggcaacggcacgaucugcaccgccaucaacgccugcgagaucagcaacgggggcugcuccgccaaggccgacugcaagcggaccacccccgggcgccgcgucugcacgugcaaggcgggcuacaccggggacggcaucgugugccuggagaucaacccgugccucgagaaccacggcgggugcgacaagaacgccgagugcacccagaccggccccaaccaggccgccugcaacugccugcccgccuacacgggggacggcaaggugugcacccugaucaacgucugccucaccaagaacgggggcugcagcgaguucgcgaucugcaaccacaccggccagguggagcggacgugcaccugcaagcccaacuacaucggggacggcuucaccugccgcggguccaucuaccaggagcugccgaagaaccccaagaccagccaguacuucuuccagcugcaggagcacuucgugaaggaccucgucggccccggccccuucacgguguucgccccgcuguccgccgccuucgacgaggaggcccgggugaaggacugggacaaguacgggcugaugccccagguccuccgcuaccacgugguggcgugccaccagcugcugcucgagaaccugaagcugaucagcaacgccaccucccuccagggcgagcccaucgucaucagcgugagccaguccaccgucuacaucaacaacaaggccaagaucaucagcuccgacaucaucagcaccaacgggaucgugcacaucaucgacaagcugcugucccccaagaaccuccugaucacgccgaaggacaacagcggccggauccugcagaaccucaccacccuggccaccaacaacggguacaucaaguucuccaaccugauccaggacagcggccuccuguccgugaucaccgaccccauccacacgcccgucacccuguucuggcccaccgaccaggcccuccacgcgcugccggccgagcagcaggacuuccuguucaaccaggacaacaaggacaagcugaaggaguaccucaaguuccacgugauccgcgacgccaaggugcuggccgucgaccugcccaccagcacggcguggaagacccuccagggcuccgagcugagcgugaagugcggggccggccgggacaucggggaccuguuccucaacggccagaccugccgcaucgugcagcgggagcugcuguucgaccucggggucgccuacggcaucgacugccugcugaucgaccccacccucggcgggcgcugcgacacguucaccaccuucgacgccuccggcgagugcgggagcugcgugaacaccccguccugcccccgguggagcaagcccaagggcgugaagcagaagugccuguacaaccugcccuucaagcgcaaccucgaggggugccgggagcgcugcucccuggucauccagaucccgcggugcugcaagggcuacuucggccgcgacugccaggccugccccgggggccccgacgcgcccugcaacaaccggggggugugccuggaccaguacagcgccacgggcgagugcaagugcaacaccggcuucaacgggaccgccugcgagaugugcuggccgggccgcuucgggcccgacugccuccccugcggcugcuccgaccacgggcagugcgacgacggcaucaccggcagcgggcagugccugugcgagacgggcuggaccgggcccagcugcgacacccaggccgugcugccggccgucugcaccccccccugcuccgcgcacgccacgugcaaggagaacaacaccugcgagugcaaccucgacuacgagggcgacgggaucaccugcaccgugguggacuucugcaagcaggacaacggcggcugcgccaaggucgcccggugcagccagaaggggacgaagguguccugcagcugccagaagggcuacaagggggacggccacuccugcaccgagaucgaccccugcgccgacgggcugaacggcggcugccacgagcacgcgaccugcaagaugaccgggccgggcaagcacaagugcgagugcaagagccacuacgugggggacggccugaacugcgagcccgagcagcuccccaucgaccgcugccugcaggacaacgggcagugccacgccgacgccaagugcgucgaccugcacuuccaggacacgaccgugggcguguuccaccuccgcuccccccugggccaguacaagcugaccuucgacaaggcccgggaggcgugcgccaacgaggccgccaccauggccacguacaaccagcucagcuacgcgcagaaggccaaguaccaccugugcuccgccggguggcuggagaccggccgcgucgccuacccgaccgccuucgcgagccagaacugcggguccggcguggugggcaucgucgacuacgggccccggcccaacaagagcgagaugugggacguguucugcuaccgcaugaaggacgugaacugcaccugcaaggucggcuacgugggggacggcuucuccugcagcgggaaccuccugcaggugcugauguccuuccccagccucacgaacuuccugaccgagguccuggccuacuccaacagcuccgcccggggccgcgccuuccucgagcaccugaccgaccugagcauccggggcacccucuucgugccgcagaacagcgggcugggcgagaacgagacgcuguccgggcgcgacaucgagcaccaccucgccaacgugagcauguucuucuacaacgaccuggucaacggcaccacccugcagacccggcucggguccaagcugcugaucaccgcgagccaggacccccuccagcccacggagacccgcuucguggacggccgggccauccugcagugggacaucuucgccuccaacggcaucauccacgugaucagccgcccccugaaggccccgcccgcgcccgucacccucacccacacggggcugggcgccgggaucuucuucgccaucauccuggugaccggcgccguggcccucgcggccuacuccuacuuccggaucaaccgccggaccaucggguuccagcacuucgagagcgaggaggacaucaacgucgccgcccugggcaagcagcagccggagaacaucuccaacccccuguacgagagcaccacguccgccccccccgagccgagcuacgaccccuucaccgacuccgaggagcgccagcucgagggcaacgacccccugcggacccuguga

SEQ ID NO: 37169 - RNA, 978 nt, Artificial Sequence
  derived and/or modified sequence opt1 from STAC3__Homo_sapiens__NP_001273185
auggagcugccgcccgagccccaggccaacggcgaggccgugggggcgggcgggggccccaucuacuacaucuacgaggaggaggaggaggaggaggaggaggaggaggagcccccgcccgagccgcccaagcucgucaacgacaagccccacaaguucaaggaccacuucuucaagaagcccaaguucugcgacgugugcgcccgcaugaucgugcugaacaacaaguucgggcugcggugcaagaacugcaagaccaacauccacgagcacugccagagcuacgucgagaugcagcgcugcuucggcaagaucccgcccggcuuccaccgggccuacuccagcccccucuacuccaaccagcaguacgccugcgugaaggaccugagcgccgcgaaccgcaacgaccccguguucgagacccugcggacgggggucaucauggccaacaaggagcgcaagaagggccaggccgacaagaagaaccccguggccgcgaugauggaggaggagcccgaguccgcccggcccgaggaggggaagccccaggacggcaaccccgagggggacaagaaggccgagaagaagacccccgacgacaagcacaagcagccgggcuuccagcagagccacuacuucguggcccucuaccgcuucaaggcccuggagaaggacgaccuggacuucccgcccggcgagaagaucaccgucaucgacgacuccaacgaggagugguggcgggggaagaucggcgagaaggugggguucuucccgcccaacuucaucauccgcgugcgggcgggcgagcgcguccaccgggugacccgcagcuucgugggcaaccgggagaucgggcagaucacgcucaagaaggaccagaucgucgugcagaagggcgacgaggccgggggcuacgugaaggucuacaccgggcgcaaggugggccuguuccccaccgacuuccuggaggagaucuga

SEQ ID NO: 37170 - RNA, 1209 nt, Artificial Sequence
  derived and/or modified sequence opt1 from STAC__Homo_sapiens__NP_003140
augaucccgcccagcagcccccgcgaggacggcguggacgggcugcccaaggaggccgucggcgccgagcagcccccgucccccgcguccaccagcucccaggagagcaagcuccagaagcugaagcggucccugagcuucaagaccaagucccuccgcagcaaguccgccgacaacuucuuccagcggacgaacagcgaggacaugaagcugcaggcccacaugguggccgagaucucccccagcuccagcccccugccggcccccgggucccucaccagcacccccgcgcgcgccggccugcaccccgggggcaaggcccacgccuuccaggaguacaucuucaagaagccgaccuucugcgacgugugcaaccacaugaucgucggcacgaacgcgaagcacgggcugcggugcaaggccugcaagauguccauccaccacaagugcaccgacggccucgcgccccagcgcugcauggggaagcugcccaagggcuuccggcgcuacuacagcagcccccugcucauccacgagcaguucgggugcaucaaggaggugaugccgaucgccugcggcaacaagguggaccccgucuacgagacccugcgguucggcaccucccuggcccagcgcacgaagaaggggagcuccggcagcggguccgacagcccccaccggaccuccaccagcgaccucguggaggugcccgaggaggccaacggcccgggcgggggcuacgaccugcgcaagcgguccaacagcgucuucaccuaccccgagaacgggacggacgacuuccgcgaccccgccaagaacaucaaccaccagggcucccugagcaaggacccccuccagaugaacaccuacguggcccuguacaaguucgugccgcaggagaacgaggaccuggagaugcggcccggggacaucaucacccuccuggaggacuccaacgaggacugguggaagggcaagauccaggaccgcaucggcuucuuccccgccaacuucguccagcggcugcagcagaacgagaagaucuuccgcugcgugcggaccuucaucgggugcaaggagcagggccagaucacgcucaaggagaaccagaucugcgugagcuccgaggaggagcaggacggguucauccgcguccugagcggcaagaagaaggggcugaucccccucgacgugcuggagaacaucuga

SEQ ID NO: 37171 - RNA, 3777 nt, Artificial Sequence
  derived and/or modified sequence opt1 from STAG1__Homo_sapiens__NP_005853
augaucaccagcgagcugcccgugcuccaggacuccaccaacgagacgaccgcccacagcgacgccggcuccgagcuggaggagaccgaggucaaggggaagcgcaagcggggccgcccggggcggccgcccagcaccaacaagaagccccgcaagucccccggcgagaagucccggaucgaggcggggauccgcggcgccggccgggggcgcgccaacggccacccccagcagaacggggagggcgagcccgugacgcuguucgagguggucaagcucggcaagagcgccaugcagagcgugguggacgacuggaucgaguccuacaagcaggaccgggacaucgcccugcuggaccucaucaacuucuucauccagugcagcgggugccgcggcaccguccggaucgagauguuccgcaacaugcagaacgcggagaucauccggaagaugaccgaggaguucgacgaggacuccggggacuacccccugaccaugccgggcccccaguggaagaaguuccgcagcaacuucugcgaguucaucggggugcugauccggcagugccaguacuccaucaucuacgacgaguacaugauggacacggugaucagccuccugaccggccuguccgacagccagguccgcgccuuccggcacaccuccacccucgccgccaugaagcugaugacggcgcuggugaacguggcccucaaccugagcauccaccaggacaacacccagcgccaguacgaggccgagcggaacaagaugaucggcaagcgcgccaacgagcggcuggagcuccugcugcagaagcgcaaggagcuccaggagaaccaggacgagaucgagaacaugaugaacuccaucuucaaggggaucuucguccaccgcuaccgggacgccaucgcggagauccgcgccaucugcaucgaggagaucggcguguggaugaagauguacagcgacgccuuccugaacgacagcuaccugaaguacgugggguggacccuccacgaccggcagggcgagguccgccugaagugccugaaggcccuccagucccuguacaccaaccgggagcuguuccccaagcucgagcuguucacgaaccgcuucaaggaccggaucgugagcaugacccuggacaaggaguacgacguggccgucgaggcgauccgccucgugacccugauccugcacggguccgaggaggcccucagcaacgaggacugcgagaacguguaccaccuggucuacuccgcccaccggcccguggccguggccgcgggcgaguuccugcacaagaagcuguucagccgccacgacccgcaggccgaggaggcccucgccaagcggcgcggccggaacucccccaacgggaaccugauccgcaugcucguccuguucuuccuggagagcgagcuccacgagcacgccgcguaccugguggacucccugugggagagcucccaggagcuccugaaggacugggagugcaugaccgagcugcugcucgaggagcccguccagggcgaggaggccaugagcgaccggcaggaguccgcccugaucgagcugauggugugcacgauccgccaggccgcggaggcccacccgcccguggggcggggcaccgggaagcgcguccucaccgccaaggagcggaagacccagaucgacgaccgcaacaagcugacggagcacuucaucaucacccugcccaugcuccugagcaaguacuccgccgacgccgagaagguggcgaaccugcuccagaucccccaguacuucgaccuggagaucuacagcaccggccgcauggagaagcaccuggacgcccuccugaagcagaucaaguucguggucgagaagcacguggaguccgacgugcuggaggccugcagcaagaccuacuccauccucugcagcgaggaguacacgauccagaaccgggucgacaucgcccgcagccagcugaucgacgaguucguggaccgguucaaccacuccguggaggaccugcuccaggagggcgaggaggccgacgacgacgacaucuacaacguccugagcacccugaagcgccucaccuccuuccacaacgcgcacgaccugaccaagugggaccuguucgggaacugcuaccggcuccugaagacgggcaucgagcacggggccaugcccgagcagaucguggugcaggcccugcagugcagccacuacuccauccucuggcagcuggucaagaucaccgacggcagcccguccaaggaggaccugcucgugcugcgcaagaccgucaagagcuuccuggccgugugccagcagugccucuccaacgugaacacccccgugaaggagcaggccuucaugcugcugugcgaccuccugaugaucuucagccaccagcugaugaccgggggccgggagggccuccagccccuggucuucaaccccgacacggggcugcaguccgagcuccugagcuucgugauggaccacguguucaucgaccaggacgaggagaaccaguccauggagggcgacgaggaggacgaggcgaacaagaucgaggcccugcacaagcgccggaaccuccuggccgccuucagcaagcugaucaucuacgacaucgucgacaugcacgcggccgccgacaucuucaagcacuacaugaaguacuacaacgacuacggggacaucaucaaggagacccucuccaagacccgccagaucgacaagauccagugcgccaagacccugauccugagccuccagcagcuguucaacgagcuggugcaggagcagggcccgaaccucgaccggacguccgcccacgugagcggcaucaaggagcuggcgcgccgguucgcccugaccuucgggcucgaccagaucaagacccgcgaggccgucgccacccugcacaaggacggcaucgaguucgccuucaaguaccagaaccagaaggggcaggaguacccgccgcccaaccuggcguuccucgaggugcugagcgaguucuccagcaagcugcuccggcaggacaagaagacggugcacuccuaccuggagaaguuccugaccgagcagaugauggagcgccgggaggacgucuggcucccccugaucagcuaccgcaacucccuggugaccggcggggaggacgaccggaugagcgugaacuccggcagcuccagcuccaagaccagcuccguccgcaacaagaagggccggccgccccuccacaagaagcgcguggaggacgagagccuggacaacacguggcugaaccgcaccgacaccaugauccagacccccgggccccuccccgcgccccagcugacguccaccgugcugcgggagaacagccgccccaugggcgaccagauccaggagcccgaguccgagcacgggagcgagcccgacuuccuccacaacccccagaugcagaucuccuggcugggccagccgaagcuggaggaccucaaccggaaggaccgcaccgggaugaacuacaugaagguccggaccggcgugcgccacgccgugcggggccugauggaggaggacgccgagcccaucuucgaggacgucaugaugagcagccgcucccagcuggaggacaugaacgaggaguucgaggacacgauggugaucgaccucccgcccagccggaaccgccgggagcgcgccgagcugcggcccgacuucuucgacuccgccgccaucaucgaggacgacagcggguucggcaugcccauguucuga

SEQ ID NO: 37172 - RNA, 3807 nt, Artificial Sequence
  derived and/or modified sequence opt1 from STAG2__Homo_sapiens__NP_001036215
augaucgccgcccccgagaucccgaccgacuucaaccugcuccaggagagcgagacccacuucuccagcgacacggacuucgaggacaucgagggcaagaaccagaagcaggggaagggcaagaccugcaagaaggggaagaagggccccgcggagaaggggaagggcggcaacgggggcgggaagccgcccuccggccccaaccgcaugaacgggcaccaccagcagaacggcguggagaacaugaugcuguucgaggucgugaagaugggcaagagcgccaugcaguccguggucgacgacuggaucgagagcuacaagcacgaccgggacaucgcccugcucgaccugaucaacuucuucauccagugcuccgggugcaagggcguggugaccgccgagauguuccgccacaugcagaacagcgagaucauccggaagaugaccgaggaguucgacgaggacuccggggacuacccccugacgauggccggcccccaguggaagaaguucaagagcuccuucugcgaguucaucggcguccucgugcgccagugccaguacagcaucaucuacgacgaguacaugauggacaccgugaucucccugcugaccgggcucagcgacucccagguccgggcguuccgccacaccagcacgcuggccgccaugaagcugaugaccgcccucgugaacguggcgcugaaccuguccaucaacauggacaacacccagcggcaguacgaggccgagcgcaacaagaugaucggcaagcgggccaacgagcgccucgagcugcugcuccagaagcggaaggagcugcaggagaaccaggacgagaucgagaacaugaugaacgccaucuucaagggggucuucgugcaccgcuaccgggacgccaucgcggagauccgcgccaucugcaucgaggagaucggcaucuggaugaagauguacagcgacgccuuccugaacgacuccuaccucaaguacgugggguggaccaugcacgacaagcagggcgagguccggcugaagugccugacggcccuccagggccuguacuacaacaaggagcugaacagcaagcucgagcuguucaccagccgcuucaaggaccggaucguguccaugacccuggacaaggaguacgacguggccguccaggcgaucaagcuccugacccuggugcuccagagcuccgaggaggugcugacggccgaggacugcgagaacgucuaccaccugguguacagcgcccaccgccccguggccgucgccgcgggggaguuccucuacaagaagcuguucucccggcgcgacccggaggaggacggcaugaugaagcggcgcgggcgccagggccccaacgccaaccuggugaagacccucgucuucuucuuccuggagagcgagcugcacgagcacgccgccuaccucguggacuccaugugggacugcgccaccgagcugcugaaggacugggagugcaugaacagccuccugcuggaggagccccucuccggggaggaggcgcugaccgaccggcaggagagcgcccugaucgagaucaugcugugcacgauccgccaggccgccgagugccacccgcccgugggccggggcaccgggaagcgcguccucaccgcgaaggagaagaagacccagcuggacgaccggacgaagaucaccgagcuguucgccguggcccucccccagcugcuggccaaguacuccguggacgccgagaaggucaccaaccuccugcagcugccccaguacuucgaccucgagaucuacaccacgggccgccuggagaagcaccuggacgcgcuccugcggcagauccgcaacaucguggagaagcacaccgacaccgacgugcuggaggccugcagcaagaccuaccacgcccucugcaacgaggaguucacgaucuucaaccgggucgacaucucccgcagccagcugaucgacgagcuggccgacaaguucaaccggcuccuggaggacuuccugcaggagggggaggagcccgacgaggacgacgccuaccaggugcucuccacccugaagcgcaucaccgcguuccacaacgcccacgaccugagcaagugggaccucuucgccugcaacuacaagcugcugaagaccggcaucgagaacggggacaugccggagcagaucgugauccacgcccuccagugcacgcacuacgucauccuguggcagcuggccaagaucaccgaguccagcuccaccaaggaggaccuccugcggcugaagaagcagaugcgcguguucugccagaucugccagcacuaccucaccaacgugaacaccacggucaaggagcaggcguucaccauccugugcgacauccugaugaucuucagccaccagaucaugagcggcggccgggacaugcucgagccccugguguacacccccgacuccagccugcaguccgagcuccugagcuucauccuggaccacguguucaucgagcaggacgacgacaacaacuccgccgacgggcagcaggaggacgaggccagcaagaucgaggcccuccacaagcgccggaaccugcuggcggccuucugcaagcucaucgucuacaccgugguggagaugaacacggccgccgacaucuucaagcaguacaugaaguacuacaacgacuacggcgacaucaucaaggagaccauguccaagacccgccagaucgacaagauccagugcgccaagacccugauccugagccuccagcagcuguucaacgagaugauccaggagaacggguacaacuucgaccgguccagcuccacguucagcggcaucaaggagcuggcgcgccgcuucgcccucaccuucggccuggaccagcugaagacccgggaggccaucgccaugcuccacaaggacgggaucgaguucgccuucaaggagcccaacccgcagggcgagucccacccgccccugaaccuggcguuccucgacauccugagcgaguucuccagcaagcugcuccgccaggacaagcggaccgucuacguguaccuggagaaguucaugacguuccagaugucccugcgccgggaggacguguggcucccccugaugagcuaccgcaacagccugcucgccgggggcgacgacgacaccauguccgucaucagcgggaucuccagccggggcuccaccgugcgcagcaagaaguccaagcccagcaccggcaagcggaagguggucgaggggaugcagcugucccugacggaggagagcuccagcuccgacagcauguggcucucccgcgagcagacccugcacacccccgugaugaugcagacgccccagcugaccagcaccaucaugcgggagcccaagcgccuccggccggaggacuccuucaugagcguguaccccaugcagaccgagcaccaccagacgccccuggacuacaacacccaggucaccuggaugcuggcccagcgccagcaggaggaggcccggcagcagcaggagcgcgccgcgauguccuacgugaagcuccggaccaaccugcagcacgccauccgccggggcaccagccugauggaggacgacgaggagccgaucguggaggacgucaugaugagcuccgaggggcgcaucgaggaccucaacgagggcauggacuucgacacgauggacaucgaccugccgcccagcaagaaccggcgcgagcgcaccgagcugaagcccgacuucuucgaccccgccuccaucauggacgagagcgugcucgggguguccauguucuga

SEQ ID NO: 37173 - RNA, 3681 nt, Artificial Sequence
  derived and/or modified sequence opt1 from STAG3__Homo_sapiens__NP_001269646
augagcagcccccugcagcgcgccgugggcgacaccaagcgggcccucuccgcguccagcuccagcuccgccagccugccguucgacgaccgcgacuccaaccacaccagcgaggggaacggcgacucccugcucgccgacgaggacacggacuucgaggacagccugaaccggaacgucaagaagcgcgccgccaagcggccgcccaagaccacccccguggcgaagcaccccaagaaggggucccgcgugguccaccggcacagccgcaagcaguccgagccgcccgccaacgaccuguucaacgccgugaaggccgccaagagcgacaugcagucccucguggacgaguggcuggacagcuacaagcaggaccaggacgcgggcuuccuggagcucgucaacuucuucauccaguccugcgggugcaagggcaucgugacccccgagauguucaagaagaugagcaacagcgagaucauccagcaccugacggagcaguucaacgaggacuccggcgacuacccccugaucgcccccgggcccagcuggaagaaguuccagggcuccuucugcgaguucgugcggacccucgucugccagugccaguacagccugcuguacgacggguuccccauggacgaccucaucucccugcugaccggccucagcgacucccaggugcgcgccuuccggcacaccagcacgcuggccgcgaugaagcugaugaccucccucgugaaggucgcccugcagcugagcgugcaccaggacaacaaccagcgccaguacgaggccgagcggaacaaggggccgggccagcgcgcccccgagcggcucgagucccugcuggagaagcgcaaggagcuccaggagcaccaggaggagaucgagggcaugaugaacgcccuguuccgcgggguguucguccaccgguaccgggacgugcugcccgagauccgcgcgaucugcaucgaggagaucggcugcuggaugcagagcuacuccaccagcuuccucaccgacuccuaccugaaguacaucggguggacgcugcacgacaagcaccgggaggugcgccucaagugcgucaaggcccugaagggccuguacggcaaccgcgaccucaccacccggcuggagcuguucaccagccgcuucaaggaccggaugguguccauggugauggaccgcgaguacgacgucgccguggaggccgugcggcuccugauccugauccucaagaacauggaggggguccugacggacgccgacugcgagagcguguaccccgucguguacgcgucccaccgcggccuggccagcgccgccggggaguuccucuacuggaagcuguucuacccggagugcgagauccggaugaugggcgggcgcgagcagcggcagagccccggcgcccagcgcaccuucuuccagcugcuccuguccuucuucguggagagcgagcugcacgaccacgcggccuaccuggucgacucccucugggacugcgccggcgcccggcugaaggacugggaggggcugaccagccuccugcuggagaaggaccagaaccucggcgacgugcaggaguccacccugaucgagauccuggugagcuccgcgcgccaggccagcgaggggcacccgcccgucggccgggugacggggcgcaagggccucaccuccaaggagcggaagacccaggccgacgaccgcgugaagcugaccgagcaccugaucccccuccugccccagcugcucgccaaguucagcgccgacgcggagaaggucacgccccugcugcagcuccuguccugcuucgaccugcacaucuacugcaccggccggcucgagaagcaccuggagcuguuccuccagcagcugcaggaggugguggucaagcacgccgagcccgccgugcuggaggccggggcccacgcgcucuaccugcugugcaacccggaguucaccuucuucagccgcgccgacuucgcccggucccagcucguggaccugcugaccgaccgcuuccagcaggagcucgaggagcugcugcagagcuccuuccucgacgaggacgaggucuacaaccuggccgccacgcugaagcgccucagcgcguucuacaacacccacgaccugacccggugggagcuguacgagcccugcugccagcuccugcagaaggccguggacaccggcgaggugccccaccaggucauccugcccgcccucacgcugguguacuucuccauccuguggacccucacccacaucagcaagagcgacgccucccagaagcagcugagcucccugcgcgaccggaugguggcguucugcgagcucugccagagcugccuguccgacgucgacaccgagauccaggagcaggccuucgugcugcucagcgaccugcugcucaucuucuccccgcagaugaucgucgggggccgcgacuuccugcggccccugguguucuuccccgaggccacgcuccagagcgagcuggccuccuuccugauggaccacguguucauccagccgggggaccucggcagcggcgacucccaggaggaccaccuccagaucgagcgccugcaccagcggcgccggcugcuggccggguucugcaagcugcuccuguacggcgugcuggagauggacgcggccagcgacgucuucaagcacuacaacaaguucuacaacgacuacggggacaucaucaaggagacccucacccgcgcccggcagaucgaccgcucccacugcagccggauccugcugcucucccugaagcagcuguacaccgagcuccugcaggagcacggcccccagggccugaacgagcuccccgccuucaucgagaugcgcgaccuggcccggcgcuucgcgcugagcuucgggccccagcagcuccagaaccgggaccugguggugaugcugcacaaggagggcauccaguucucccucagcgagcugccgcccgccggguccagcaaccagccgcccaaccuggccuuccucgagcugcugagcgaguucagcccccgccucuuccaccaggacaagcagcugcugcuguccuaccucgagaagugccugcagcacgucucccaggcccccggccaccccugggggcccgugaccacguacugccacagccuguccccgguggagaacaccgccgagaccagcccccagguccuccccuccagcaagcggcgccggguggagggccccgcgaagccgaaccgcgaggacguguccagcucccaggaggagagccugcagcugaacuccaucccgcccacccccacgcucaccagcaccgccgucaagucccgccagccccuguggggccugaaggagauggaggaggaggacgggagcgagcucgacuucgcccagggcucccagcccguggccgggaccgagcggagccgcuuccugggcccccaguacuuccagacgccccacaacccguccgggcccggccugggcaaccagcucaugcggcugagccugauggaggaggacgaggaggaggagcucgagauccaggacgagagcaacgaggagcgccaggacaccgacaugcaggcguccagcuacuccagcaccuccgagcgggggcuggaccugcucgacagcaccgagcuggacaucgaggacuucuga

SEQ ID NO: 37174 - RNA, 1578 nt, Artificial Sequence
  derived and/or modified sequence opt1 from STAM2__Homo_sapiens__NP_005834
augccccuguucaccgccaacccguucgagcaggacguggagaaggccaccaacgaguacaacacgaccgaggacuggagccucaucauggacaucugcgacaaggucggcuccacccccaacggggcgaaggacugccugaaggccaucaugaagcgcgugaaccacaaggugccccacgucgcccugcaggcccucacccugcugggcgccugcguggcgaacugcgggaagaucuuccaccucgaggugugcagccgggacuucgccacggagguccgcgccgugaucaagaacaaggcccaccccaaggugugcgagaagcugaagucccugauggucgaguggagcgaggaguuccagaaggacccgcaguucucccucaucagcgcgaccaucaaguccaugaaggaggagggcaucaccuucccgcccgccgggagccagaccguguccgccgccgccaagaacggcacgagcuccaacaagaacaaggaggacgaggacaucgcgaaggccaucgagcugagccugcaggagcagaagcagcagcacaccgagaccaagucccucuaccccagcuccgagauccagcugaacaacaagguggcccggaagguccgcgcccuguacgacuucgaggccguggaggacaacgagcucaccuucaagcacggcgagaucaucaucgugcuggacgacagcgacgcgaacugguggaagggggagaaccaccggggcaucgggcuguuccccuccaacuucgucacgaccaaccucaacaucgagaccgaggccgccgccguggacaagcugaacgugaucgacgacgacgucgaggagaucaagaaguccgagcccgagcccguguacaucgacgaggacaagauggaccgcgcccuccaggugcugcagagcaucgaccccaccgacagcaagccggacagccaggaccugcuggaccucgaggacaucugccagcagaugggccccaugaucgacgagaagcuggaggagaucgaccggaagcacuccgagcugagcgagcucaacgucaaggugcuggaggcgcuggagcucuacaacaagcuggugaacgaggcccccgucuacuccguguacagcaagcugcacccgcccgcccacuacccgcccgccuccagcgggguccccaugcagacguaccccgugcagucccacggcggcaacuacauggggcagagcauccaccaggugaccgucgcccaguccuacagccucggccccgaccagaucgggccccugcgcucccugcccccgaacgugaacagcuccgugaccgcgcagcccgcccagaccagcuaccucuccacgggccaggacaccgucagcaaccccaccuacaugaaccagaacuccaaccugcagagcgccaccggcacgaccgccuacacccagcagauggggauguccguggacaugagcagcuaccagaacaccacguccaaccugccccagcucgcgggcuucccggugaccguccccgcccaccccguggcccagcagcacaccaacuaccaccagcagccgcugcuguga

SEQ ID NO: 37175 - RNA, 1275 nt, Artificial Sequence
  derived and/or modified sequence opt1 from STAMBP__Homo_sapiens__NP_998787
augagcgaccacggcgacgugucccugcccccggaggaccgcguccgggcccucagccagcugggguccgccguggaggugaacgaggacaucccgccccgccgguacuuccgcagcggcgucgagaucauccggauggcguccaucuacagcgaggaggggaacaucgagcacgccuucauccuguacaacaaguacaucacccucuucaucgagaagcugcccaagcaccgcgacuacaaguccgccgugauccccgagaagaaggacaccgugaagaagcugaaggagaucgccuuccccaaggccgaggagcucaaggcggagcugcugaagcgguacacgaaggaguacaccgaguacaacgaggagaagaagaaggaggccgaggagcucgcccgcaacauggccauccagcaggagcuggagaaggagaagcagcgggucgcgcagcagaagcagcagcagcuggagcaggagcaguuccacgccuucgaggagaugauccgcaaccaggagcucgagaaggagcggcugaagaucgugcaggaguucggcaagguggaccccgggcugggcggcccccucgucccggaccuggagaagcccagccuggacguguuccccacccucaccguguccagcauccagcccuccgacugccacacgaccguccgcccggccaagccgcccgugguggaccggagccugaagcccggggcccuguccaacagcgaguccauccccaccaucgacggccuccgccacgucguggugcccgggcggcugugcccccaguuccugcagcucgccagcgcgaacaccgcccgcggcgucgagacgugcgggauccugugcggcaagcugaugcggaacgaguucaccaucacccacgugcucauccccaagcaguccgccggcagcgacuacugcaacaccgagaacgaggaggagcuguuccugauccaggaccagcaggggcucaucacgcugggcuggauccacacccacccgacccagaccgccuuccuguccagcguggaccuccacacgcacugcagcuaccagaugaugcugcccgaguccgucgccaucgugugcagccccaaguuccaggagaccggguucuucaagcugaccgaccacggccucgaggagaucuccagcugccgccagaagggcuuccacccccacuccaaggacccgccccuguucugcagcugcucccacgugaccgucguggaccgggcggucacgaucaccgaccugcgcuga

SEQ ID NO: 37176 - RNA, 1311 nt, Artificial Sequence
  derived and/or modified sequence opt1 from STAMBPL1__Homo_sapiens__NP_065850
auggaccagcccuucaccgugaacagccugaagaagcucgccgccaugccggaccacaccgacgucucccugagccccgaggagcgcgugcgggcgcuguccaagcucggcugcaacaucacgaucagcgaggacaucacgccccgccgguacuuccgcuccgggguggagauggagcggauggccagcgucuaccuggaggagggcaaccuggagaacgccuucgugcucuacaacaaguucaucacccuguucguggagaagcugcccaaccaccgcgacuaccagcagugcgccgucccggagaagcaggacaucaugaagaagcucaaggagaucgccuucccccggaccgacgagcugaagaacgaccugcucaagaaguacaacguggaguaccaggaguaccugcaguccaagaacaaguacaaggcggagauccugaagaagcucgagcaccagcgccugaucgaggccgagcggaagcgcaucgcccagaugcggcagcagcagcuggagagcgagcaguuccucuucuucgaggaccagcugaagaagcaggagcuggcccgcgggcagaugcggucccagcagaccagcggccucuccgagcagaucgacgggagcgcgcuguccugcuucagcacccaccagaacaacucccugcucaacguguucgccgaccagcccaacaagagcgacgccaccaacuacgccucccacagcccgcccgucaaccgcgcccugacccccgcggccacgcuguccgccgugcagaaccucguggucgagggccugcggugcguggugcugcccgaggaccucugccacaaguuccugcagcuggccgagagcaacaccguccgcggcaucgagaccugcgggauccucugcggcaagcugacccacaacgaguucacgaucacccacgugaucgugcccaagcagagcgccgggccggacuacugcgacauggagaacgucgaggagcuguucaacgugcaggaccagcacgaccuccugacccugggcuggauccacacccaccccacgcagaccgcguuccucuccagcguggaccugcacacccacugcuccuaccagcugaugcuccccgaggccaucgccaucgucugcagccccaagcacaaggacaccgggaucuuccggcugacgaacgccggcaugcuggagguguccgccugcaagaagaagggcuuccacccgcacaccaaggagccccgccucuucagcaucugcaagcacgugcuggucaaggacaucaagaucaucgugcuggaccuccgguga

SEQ ID NO: 37177 - RNA, 1623 nt, Artificial Sequence
  derived and/or modified sequence opt1 from STAM__Homo_sapiens__NP_003464
augccccuguucgccaccaaccccuucgaccaggacguggagaaggccaccagcgagaugaacacggcggaggacuggggccucauccuggacaucugcgacaaggucgggcagucccgcaccggccccaaggacugccugcggagcaucaugcgccgggugaaccacaaggacccccacguggccaugcaggcccucacccugcugggggccugcgucuccaacugcggcaagaucuuccaccucgaggugugcagccgcgacuucgccuccgaggugagcaacguccugaacaaggggcaccccaaggugugcgagaagcugaaggcgcucaugguggaguggaccgacgaguucaagaacgacccgcagcugucccugaucagcgccaugaucaagaaccucaaggagcagggcgucacguuccccgccaucggcucccaggccgcggagcaggccaaggccagccccgcccugguggccaaggaccccgggaccguggcgaacaagaaggaggaggaggaccuggccaaggccaucgagcucucccugaaggagcagcggcagcagagcaccacccuguccacgcucuacccgagcaccuccagccugcugaccaaccaccagcacgagggccgcaagguccgggccaucuacgacuucgaggccgcggaggacaacgagcucaccuucaaggccggggagaucaucacggugcuggacgacuccgaccccaacugguggaagggcgagacccaccaggggaucggccuguuccccagcaacuucgugaccgccgaccucaccgccgagcccgagaugaucaagacggagaagaagaccguccaguucuccgacgacguccagguggagaccaucgagccggagcccgagcccgccuucaucgacgaggacaagauggaccagcugcugcagaugcuccagagcaccgaccccagcgacgaccagccggaccugcccgagcugcuccaccuggaggcgaugugccaccagaugggcccccugaucgacgagaagcucgaggacaucgaccgcaagcacuccgagcugagcgagcugaacgugaaggugauggaggcccucucccuguacacgaagcugaugaacgaggaccccauguacagcauguacgccaagcuccagaaccagccguacuacaugcaguccagcgggguguccggcagccaggucuacgccgggcccccgcccuccggcgccuaccugguggcgggcaacgcccagaugagccaccuccaguccuacagccugccgcccgagcagcuguccagccugucccaggccguggucccgcccagcgccaaccccgcgcuccccucccagcagacccaggccgccuaccccaacaccauggugagcuccguccaggggaacaccuacccgagccaggcccccguguacagcccgccgcccgccgcgacggccgccgccgccaccgcggacgugacccuguaccagaacgccggccccaacaugccccagguccccaacuacaaccugaccuccagcacgcucccccagcccgggggcucccagcagccgccccagccccagcagcccuacagccagaaggcccugcuguga

SEQ ID NO: 37178 - RNA, 888 nt, Artificial Sequence
  derived and/or modified sequence opt1 from STAP1__Homo_sapiens__NP_036240
augauggccaagaagcccccgaagcccgcgccccgccggaucuuccaggagcgccugaagaucaccgcccucccccuguacuucgagggcuuccugcucaucaagcggagcggguaccgcgaguacgagcacuacuggaccgagcugcggggcacgacccuguucuucuacaccgacaagaaguccaucaucuacguggacaagcucgacaucgucgaccugaccugccugacggagcagaacagcaccgagaagaacugcgccaaguucacccucgugcugccgaaggaggaggugcagcugaagaccgagaacacggaguccggggaggaguggcgcggcuucauccucaccgucaccgagcugagcgugccccagaacgugucccugcuccccgggcaggucaucaagcugcacgaggugcuggagcgggagaagaagcgccggaucgagaccgagcagagcacguccguggagaaggagaaggagcccaccgaggacuacgucgacgugcucaacccgaugcccgccugcuucuacaccgugagccgcaaggaggccaccgagaugcugcagaagaaccccucccugggcaacaugauccuccggcccggcagcgacucccgcaacuacagcaucacgauccggcaggagaucgacaucccgcgcaucaagcacuacaaggucauguccguggggcagaacuacaccaucgagcuggagaagcccgugacccugcccaaccucuucagcgucaucgacuacuucgugaaggagacccggggcaaccugcgccccuucaucugcuccacggacgagaacaccgggcaggagccgagcauggagggccgguccgagaagcugaagaagaacccccacaucgccuga

SEQ ID NO: 37179 - RNA, 1212 nt, Artificial Sequence
  derived and/or modified sequence opt1 from STAP2__Homo_sapiens__NP_001013863
auggccagcgcccugcggcccccgcgcgugcccaagcccaagggcguccuccccucccacuacuacgagagcuuccuggagaagaaggggccgugcgaccgcgacuacaagaaguucugggcgggccugcaggggcucaccaucuacuucuacaacuccaaccgggacuuccagcacguggagaagcugaaccugggcgccuucgagaagcucaccgacgagauccccugggggagcucccgcgaccccggcacgcacuucagccugauccugcgggaccaggagaucaaguucaagguggagacccucgagugccgcgagauguggaagggcuucauccugaccgucguggagcugcgggugcccaccgaccucacgcugcugccggggcaccucuacaugauguccgagguccuggccaaggaggaggcccgccgggcccuggagacccccagcugcuuccucaaggugucccgccuggaggcgcagcugcuccuggagcgguaccccgagugcggcaaccugcuccugcgccccagcggggacggcgccgacgggguguccgucaccacccggcagaugcacaacggcacgcacguggugcgccacuacaaggucaagcgggagggcccgaaguacgugaucgacguggagcagcccuucagcugcaccucccuggacgccgucgugaacuacuucgugagccacaccaagaaggcccucguccccuuccugcuggacgaggacuacgagaaggugcucggguacguggaggcggacaaggagaacggcgagaacgucuggguggcccccuccgccccggggcccggccccgcccccugcaccggcgggccgaagccccugagccccgccuccagccaggacaagcugcccccgcucccgccccugcccaaccaggaggagaacuacgugacgcccaucggcgacgggcccgcggucgacuacgagaaccaggacguggccuccagcagcuggcccgucauccugaagccgaagaagcuccccaagccgcccgccaagcugcccaagccgcccgugggccccaagcccgagcccaagguguucaacgggggccugggccgcaagcuccccgucuccagcgcccagccccuguucccgaccgccgggcuggcggacaugaccgccgagcuccagaagaagcuggagaagcggcgcgcccuggagcacuga

SEQ ID NO: 37180 - RNA, 876 nt, Artificial Sequence
  derived and/or modified sequence opt1 from STARD10__Homo_sapiens__NP_006636
auggagaagcuggccgccagcaccgagccccagggcccgcgccccgugcucgggcgggaguccguccaggugcccgacgaccaggacuuccgcagcuuccgguccgagugcgaggcggaggugggcuggaaccugaccuacagccgcgccggggucuccgugugggugcaggccgucgagauggaccggacgcugcacaagaucaagugccgcauggagugcugcgacgugcccgccgagacccucuacgacgugcugcacgacaucgaguaccggaagaagugggacagcaacgucaucgagaccuucgacaucgcccgccugaccgugaacgcggacgugggcuacuacuccuggcggugcccgaagccccucaagaaccgcgacgucaucacgcugcggagcuggcugcccaugggggccgacuacaucaucaugaacuacuccgugaagcaccccaaguacccgccccgcaaggaccucgugcgggccgucagcauccagaccggcuaccugauccaguccaccggccccaagagcugcgugaucaccuaccuggcccagguggaccccaaggggucccucccgaagugggucgugaacaagagcucccaguuccuggcgcccaaggccaugaagaagauguacaaggccugccugaaguaccccgaguggaagcagaagcaccucccccacuucaagccguggcugcaccccgagcagagcccccugcccucccucgcccugagcgagcuguccgugcagcacgccgacagccucgagaacaucgacgagagcgcggucgccgagucccgcgaggagcggaugggcggggccggcggggagggcagcgacgacgacacgucccugaccuga

SEQ ID NO: 37181 - RNA, 2064 nt, Artificial Sequence
  derived and/or modified sequence opt1 from STARD13__Homo_sapiens__NP_001230395
augcuggagcccagcuccgugcuccacgccaacgucaaccaggccccgcuguggugccuggugcuccgcuggugccgggagugcaaggacaccgugugcggcgggaagcagaagucccgcgucaaccacaccuuccagcggcgcgagaucgaggcgaaggaggccugcgacuggcugcgggccgccggcuucccccaguacgcccagcuguacgaggacucccaguuccccaucaacaucguggcggugaagaacgaccacgacuuccucgagaaggaccuggucgagccccugugccgccggcucaacacgcugaacaagugcgccagcaugaagcuggacgugaacuuccagcgcaagaagggggacgacuccgacgaggaggaccucugcaucagcaacaaguggaccuuccagcggaccucccgccgguggagccgcguggacgaccuguacacccugcucccgcggggcgaccgcaacgggucccccggcggcacggggaugcggaacaccaccagcuccgagagcguccugaccgaccuguccgagcccgaggugugcagcauccacuccgagagcuccggcgggagcgacucccgcagccagcccggccagugcugcacggacaacccggugaugcucgacgcgccccuggucagcuccagccugccccagcccccgcgggacgugcucaaccaccccuuccaccccaagaacgagaagcccacccgcgcccgggccaaguccuuccugaagcgcauggagacccugcgggggaagggcgcccacggccgccacaaggggagcggccgcaccgggggccucgugaucuccggcccgaugcugcagcaggagcccgagagcuucaaggccaugcagugcauccagauccccaacggggaccugcagaacagcccgccgcccgccugccggaagggccuccccugcagcgggaaguccagcggcgaguccagccccuccgagcacagcuccagcggggucuccacgcccugccugaaggagcgcaagugccacgaggccaacaagcggggcggcauguaccuggaggaccucgacgugcuggcggggaccgcccugcccgacgccggcgaccagagccgcaugcacgaguuccacucccaggagaaccucgugguccacauccccaaggaccacaagcccgggaccuucccgaaggcccugagcaucgagagccugucccccaccgacagcuccaacggcgugaacuggcggacggggagcaucucccucggccgcgagcagguccccggcgcccgggagccgcgccugauggcgagcugccaccgggccucccgcgugagcaucuacgacaacgugcccgggucccaccuguacgccagcaccggcgaccuccuggaccuggagaaggacgaccucuucccccaccuggacgacauccugcagcacgugaacgggcuccaggaggucguggacgacugguccaaggacguccugcccgagcugcagacccacgacacccucgugggcgagccggggcugagcacguuccccucccccaaccagaucacccuggacuucgagggcaacagcguguccgagggccggaccacccccagcgacgucgagcgcgacgugacgucccugaacgagagcgagccgcccggggugcgggaccgccgggacagcggcgucggggccucccucacccgccccaaccggcgccugcgguggaacagcuuccagcugucccaccagccccgcccggcccccgcgagcccccacaucuccagccagaccgccucccagcucagccugcugcagcgcuucucccuccugcggcugaccgccaucauggagaagcacagcauguccaacaagcacggcuggacguggagcgugcccaaguucaugaagcgcaugaaggugccggacuacaaggacaaggccgucuucggcgugccccucaucgugcacguccagcggaccgggcagccccugccccaguccauccagcaggcccugcgcuaccuccggagcaacugccuggaccaggaguga

SEQ ID NO: 37182 - RNA, 1338 nt, Artificial Sequence
  derived and/or modified sequence opt1 from STARD3__Homo_sapiens__NP_001159409
augagcaagcugccccgcgagcucacccgggaccuggagcgcucccugccggccguggccagccucggcuccagccugucccacagccagucccugagcucccaccuccugcccccgcccgagaagcggcgcgcgaucagcgacguccggcgcaccuucugccuguucgugacguucgaccuccuguucaucucccugcucuggaucaucgagcugaacaccaacaccgggauccggaagaaccuggagcaggagaucauccaguacaacuucaagaccagcuucuucgacaucuucgugcucgccuucuuccgcuucuccggccugcugcucggguacgccguccugcggcugcgccacuggagccggcgcuggugccccgugcacuccagccucucccggagcuccagccugagcugcuccgccaagggccaccuggccacgugcagccccuccagccuccuguccagccccggguggcgccccggcucccugaccagcaaguccuacccgcggaagcucaagcgcagcgacuccgcgccgcccggcuaccuggccgcccagguggccgucgcgcgggggccccuccuguucagcggcgcccuguccgaggggcaguucuacagcccgcccgaguccuucgccggcagcgacaacgaguccgacgaggagguggccgggaagaaguccuucuccgcccaggagcgcgaguacauccggcagggcaaggaggcgaccgccguggucgaccagauccuggcccaggaggagaacuggaaguucgagaagaacaacgaguacggcgacaccguguacacgaucgaggugcccuuccacgggaagaccuucauccucaagaccuuccugcccugccccgccgagcuggucuaccaggaggugauccuccagcccgagcgcauggugcuguggaacaagaccgucacggccugccagauccugcagcggguggaggacaacacccucaucagcuacgacgugagcgcgggcgccgccgggggcgucgugagcccccgcgacuucgugaacguccgccggaucgagcgccggcgcgaccgguaccugagcuccggcaucgccaccagccacuccgccaagcccccgacccacaaguacgugcgcggggagaacggccccgggggcuucaucgugcucaagagcgcguccaacccccgggucugcacguucguguggauccugaacaccgaccugaaggggcgccugccccgguaccucauccaccagagccuggccgccaccauguucgaguucgccuuccaccuccgccagcggaucuccgagcugggcgcccgcgcguga

SEQ ID NO: 37183 - RNA, 705 nt, Artificial Sequence
  derived and/or modified sequence opt1 from STARD3NL__Homo_sapiens__NP_114405
augaaccaccuccccgaggacauggagaacgcccugaccggcagccaguccagccacgccucccugcgcaacauccacagcaucaacccgacccagcugauggcgcggaucgaguccuacgaggggcgcgagaagaagggcaucagcgacgugcggcgcacguucugccucuucgucaccuucgaccugcuguucgugacccuccuguggaucaucgagcugaacgugaacgggggcaucgagaacacccucgagaaggaggucaugcaguacgacuacuacuccagcuacuucgacaucuuccugcuggccguguuccgguucaaggugcucauccuggccuacgccgucugccgccugcggcacuggugggccaucgcgcucacgaccgccgugaccuccgccuuccugcuggccaaggugauccucagcaagcuguucucccagggggcguucggcuacguccugcccaucaucagcuucauccucgccuggaucgagaccugguuccuggacuucaaggugcugccccaggaggccgaggaggagaaccgccuccugaucgugcaggacgccuccgagcgggccgcgcugauccccggcgggcucagcgacggccaguucuacuccccgcccgagagcgaggccggguccgaggaggccgaggagaagcaggacagcgagaagccccugcuggagcucuga

SEQ ID NO: 37184 - RNA, 642 nt, Artificial Sequence
  derived and/or modified sequence opt1 from STARD5__Homo_sapiens__NP_871629
auggaccccgcccuggccgcgcagaugagcgaggccguggccgagaagaugcuccaguaccgccgggacaccgccggcuggaagaucugccgcgaggggaacggcgucuccgugagcuggcggccguccguggaguuccccgggaaccuguaccgcggcgaggggaucgucuacggcacccuggaggaggugugggacugcgugaagcccgccgucggcgggcuccgggugaagugggacgagaacgugacgggcuucgagaucauccagagcaucaccgacacccugugcgucucccgcaccagcacgcccuccgcggccaugaagcugaucagcccgcgggacuucguggaccucgugcuggucaagcgcuacgaggacgggaccaucuccagcaacgccacccacguggagcacccccugugcccgcccaagcccggcuucgugcggggguucaaccaccccugcggcugcuucugcgagccccuccccggcgagccgaccaagacgaaccuggucaccuucuuccacaccgaccuguccggguaccucccccagaacgugguggacagcuucuucccccgcuccaugacccgguucuacgccaaccugcagaaggcggucaagcaguuccacgaguga

SEQ ID NO: 37185 - RNA, 1113 nt, Artificial Sequence
  derived and/or modified sequence opt1 from STARD7__Homo_sapiens__NP_064536
augcugccccgccggcuccuggccgccuggcuggcgggcacccgcgggggcgggcuccuggcccugcucgccaaccagugccgguucgugaccggccugcgcguccggcgcgcccagcagaucgcccagcuguacgggcggcucuacagcgaguccagccgccgggugcugcugggccgccucuggcggcgccugcacggccggccggggcacgcguccgcccugauggccgcccucgcgggcguguucgucugggacgaggagcgcauccaggaggaggagcugcagcggagcaucaacgagaugaagcgccuggaggagauguccaacauguuccagagcuccggggugcagcaccacccgcccgagcccaaggcccagacggagggcaacgaggacagcgaggggaaggagcagcggugggagauggugauggacaagaagcacuucaagcucuggcgccggcccaucaccggcacccaccuguaccaguaccgcgucuucggcaccuacacggacgugacgccccggcaguucuucaacgugcagcuggacaccgaguaccgcaagaagugggacgcccucgucaucaagcuggaggugaucgagcgcgacguggucuccgggagcgaggugcugcacugggugacccacuuccccuaccccauguacucccgggacuacgucuacgugcgccgguacagcguggaccaggagaacaacaugaugguccucgugucccgcgccguggagcacccgagcguccccgagucccccgaguucgugcgggugcgcagcuacgagucccagauggucauccggccccacaagagcuucgacgagaacggcuucgacuaccugcugaccuacuccgacaacccgcagaccguguucccccgcuacugcgucagcuggauggugagcuccgggaugcccgacuuccucgagaagcugcacauggccacccugaaggcgaagaacauggagaucaaggugaaggacuacaucagcgccaagccccucgagauguccagcgaggccaaggccaccucccagagcuccgagcggaagaacgagggcagcugcggcccggcccgcaucgaguacgcguga

SEQ ID NO: 37186 - RNA, 3312 nt, Artificial Sequence
  derived and/or modified sequence opt1 from STARD8__Homo_sapiens__NP_001135975
augccccugcucgacguguucuggagcugcuuccgcaaggucaagugcuucccgcugcuccaggugaagaagaacgccgaggccgaggcgaagcgggccugcgaguggcuccaggccaccggcuucccccaguacgugcagcuguucgaggagggguccuucccccuggacaucggcagcgucaagaagaaccacggguuccucgacgaggacucccugggcgcccugugccgccggcucaugacccugaacaacugcgccagcaugaagcuggaggugcacuuccaguccaagcagaacgaggacagcgaggaggaggagcagugcacgaucuccagccacugggcguuccagcaggaguccaagugcuggagccccaugggguccagcgaccuccuggccccgcccucccccggccugcccgccaccagcuccugcgagagcgugcucaccgagcuguccgccaccagccugccggucaucacggugucccucccgcccgagcccgcggaccugccccugcccggccgcgcccccagcagcuccgaccggccccuccugagcccgacccaggggcaggagggcccccaggacaaggccaagaagcgccaccggaaccgcuccuuccugaagcaccucgagagccugcggcgcaaggagaaguccgggagccagcaggccgagcccaagcacucccccgccaccagcgagaagguguccaaggcgagcuccuuccggagcugccgcggcuuccuguccgccggguucuaccgggccaagaacugggccgccaccagcgcgggcggcuccggggccaacacgcgcaaggccugggaggccuggccggucgccagcuuccggcacccccaguggacccaccgcggcgacugccucgugcacgugcccggggaccacaagcccggcaccuucccgcggucccugagcaucgagucccugugccccgaggacggccaccgccucgcggacuggcagcccgggcggcgcuggggcugcgaggggcggcgcggcagcugcgggagcaccggcucccacgccagcacguacgacaaccugcccgagcuguacccggccgagcccgucauggugggcgccgaggccgaggacgaggacgacgaggaguccgggggcagcuacgcgcaccucgacgacauccugcagcacgugugggggcugcagcagcgcgucgagcucuggucccgggccauguaccccgaccugggcccgggggacgaggaggaggaggaggccaccagcuccguggagaucgccaccguggaggucaagugccaggcggaggcccugagccagauggaggugcccgcccacggcgagucccccgccugggcccaggcggaggugcagcccgccguccucgccccggcccaggcccccgcggaggccgagcccguggcccaggaggaggccgaggcccccgcgccggcccccgcccccgcccccgcgcaggacagcgagcaggaggcccacuccggcggggagccgaccuucgccagcucccugagcguggaggagggccacuccaucagcgacacggucgccuccagcagcgagcuggacuccagcgggaacuccaugaacgaggccgaggcggccggcccccucgccgggcugcaggccagcaugccccgcgagcggcgcgacuccggcgugggcgccagccugacccggcccugccgcaagcuccgguggcacuccuuccagaacagccaccgcccgucccugaacagcgagucccuggagaucaaccggcaguucgcggggcagaucaaccuccugcacaagggcagccugcugcgccucaccgccuucauggagaaguacaccgucccccacaagcaggggugggugugguccaugcccaaguucaugcggcgcaacaagacgcccgacuaccggggccagcacguguucggcgucccgccccugauccacgugcagcgcaccgggcagccccugccccagagcauccagcaggccaugcgguaccuccgcucccagugccuggaccaggugggcaucuuccgcaagagcggggucaagucccggauccagaaccugcggcagaugaacgagaccagcccggacaacgugugcuacgagggccaguccgccuacgacguggccgaccuccugaagcaguacuuccgcgaccugcccgagcccaucuucaccagcaagcucacgaccaccuuccugcagaucuaccagcugcucccgaaggaccaguggcuggcggccgcccaggccgcgacccugcuccugcccgacgagaaccgcgagguccugcagacgcuccuguacuuccugagcgacaucgccuccgccgaggagaaccagaugaccgccgggaaccucgccgugugccuggcgcccagcaucuuccaccugaacguguccaagaaggacagccccuccccgcggaucaagagcaagcgcucccucaucggccggcccggcccccgcgaccugagcgacaacauggccgccacccaggggcugucccacaugaucagcgacugcaagaagcuguuccaggucccccaggacauggugcugcagcugugcuccagcuacuccgccgccgagcucagcccgcccggccccgcgcuggccgagcugcggcaggcccaggccgccggggugucccucagccuguacauggaggagaacauccaggaccugcuccgcgacgcggccgagcgguucaagggcuggauguccguccccgggccgcagcacaccgagcuggccugccgcaaggcccccgacggccacccccugcggcucuggaaggccagcacggagguggcggcgcccccggccgugguccugcaccgcgugcugcgggagcgcgcccucugggacgaggaccugcugcgggcccaggugcucgaggcccugaugcccggcgucgagcuguaccacuacgugaccgacuccauggcgccccaccccugccgcgacuucgugguccuccggauguggcgcagcgaccugccgcgcgggggcugccugcucgugagccagucccuggaccccgagcagcccgugcccgagagcgggguccgggcccugaugcucaccucccaguaccugauggagccgugcggccuggggcggagccgccucacccacaucugccgggccgaccugcgcggccgcucccccgacugguacaacaagguguucggccaccugugcgccauggagguggccaagauccgggacagcuuccccacgcuccaggccgccgggcccgagaccaagcuguga

SEQ ID NO: 37187 - RNA, 14103 nt, Artificial Sequence
  derived and/or modified sequence opt1 from STARD9__Homo_sapiens__NP_065810
auggccaacguccagguggccgugcgcgugcggccccugagcaagcgcgagaccaaggagggcgggcggaucaucguggagguggacggcaagguggccaagauccgcaaccugaaggucgacaaccggcccgacggguucggcgacagccgcgagaaggugauggccuucggguucgacuacugcuacuggagcgugaaccccgaggacccccaguacgccagccaggacgucguguuccaggaccugggcauggaggugcugagcggcgucgccaagggguacaacaucugccuguucgccuacggccagaccgggagcggcaagaccuacaccaugcuggggacccccgccagcgugggccugacgccccggaucugcgagggccucuucgugcgcgagaaggacugcgccagccugcccagcuccugccggaucaaggucagcuuccuggagaucuacaacgagcgcgugcgggaccuccugaagcaguccgggcagaagaaguccuacacccugcgcgugcgggagcaccccgagaugggccccuacguccaggggcucucccagcacguggugaccaacuacaagcaggucauccagcugcuggaggagggcaucgccaaccgcaucaccgccgccacccacgugcacgaggccagcucccggagccacgccaucuucaccauccacuacacccaggccauccucgagaacaaccugcccuccgagauggccagcaagaucaaccugguggaccucgccggcuccgagcgcgccgaccccagcuacugcaaggaccggaucgccgagggggccaacaucaacaagagccuggucacccugggcaucgugaucuccacccucgcccagaacagccaggucuucuccagcugccagucccugaacagcuccgugagcaacgggggcgacuccgggauccugagcucccccagcggcaccuccagcggcggggcgcccucccgccggcagagcuacauccccuaccgcgacuccgugcucaccuggcugcugaaggacagccucggcgggaacuccaagaccaucauggucgccaccgugagccccgcccacacgagcuacuccgagaccaugagcacccugcgguacgccuccagcgccaagaacaucaucaacaagccccgcgugaacgaggacgcgaaccugaagcucauccgcgagcugcgggaggagaucgagcgccugaaggcccuccugcuguccuucgagcuccggaacuucagcucccugagcgacgagaaccugaaggagcucguccugcagaacgagcugaagaucgaccagcucaccaaggacuggacgcagaaguggaacgacuggcaggcccugauggagcacuacuccguggacaucaaccgccggcgcgccggcguggucaucgacagcucccugccccaccucauggcccuggaggacgacgugcugagcaccggggugguccucuaccaccugaaggagggcaccaccaagaucggccggaucgacuccgaccaggagcaggacaucgugcugcaggggcaguggaucgagcgcgaccacugcacgaucaccagcgcgugcggcguggucgugcugcggcccgcccgcggggcccggugcaccgugaacggccgcgaggucaccgccuccugccggcucacgcagggggcggugaucacccugggcaaggcccagaaguuccgcuucaaccaccccgccgaggccgccgugcugcggcagcgccggcaggucggcgaggcggccgccgggcgcggcagccucgaguggcuggaccuggacggggaccucgccgccucccggcugggccugagcccccuccuguggaaggagcgccgcgcgcuggaggagcagugcgacgaggaccaccagacgccccgcgacggcgagaccagccaccgcgcccagauccagcagcagcaguccuacguggaggaccuccggcaccagauccuggccgaggagauccgcgccgccaaggagcuggaguucgaccaggcguggaucagccagcagaucaaggagaaccagcagugccuccugcgggaggagacguggcuggccucccuccagcagcagcagcaggaggaccagguggccgagaaggagcuggaggccagcgucgcgcuggacgccuggcuccagaccgaccccgagauccagcccucccccuucgugcagagccagaagcgcgugguccaccuccagcugcuccggcgccacacccugcgggccgccgagcgcaacgugcggcgcaagaagguguccuuccagcuggagcggaucaucaagaagcagcgccuccuggaggcccagaagcggcuggagaagcucaccacgcugugcuggcugcaggacgacagcacccaggagccgcccuaccagguccucucccccgacgcgaccgugccccggccgcccugccggagcaagcugaccuccugcagcucccugagcccccagcgccucugcuccaagcacaugccccagcugcacagcaucuuccuguccugggaccccagcaccacgcugccgccccggcccgaccccacccaccagaccuccgagaagaccagcagcgaggagcaccucccccaggccgccuccuaccccgcccgcacggggugccugcggaagaacggccuccacagcuccgggcacggccagcccugcaccgcccgcgcggcccuggcccgcaagggggccagcgcccccgacgcgugccugaccaugucccccaacagcgugggcauccaggagauggagaugggcgucaagcagccccaccagauggugucccaggggcucgccagccugcggaaguccgccaacaagcugaagccccgccacgagccgaagaucuucaccagcacgacccagacccggggcgccaaggggcucgcggaccccucccacacccaggccggcuggcgcaaggaggggaaccugggcacgcacaaggccgccaagggcgccagcugcaacucccuguacccccacgggccccggcagaccgcgggccacgggaaggccgugaagaccuucuggaccgaguacaagccgcccagccccucccgcgccagcaagcggcaccagcgcguccucgccacgcgggugcgcaacaucaccaagaaguccagccaccucccccugggcuccccgcucaagcggcagcagaacacccgcgaccccgacaccauggugccccugacggacuucagccccgucauggaccacagccgggagaaggacaacgaccuguccgacaccgacagcaacuacucccucgacagccuguccugcguguacgccaaggcgcugaucgagccgcucaagcccgaggagcgcaagugggacuuccccgagccggagaacagcgaguccgacgacagccagcuguccgaggacagccuggccgagaagcgguaccagucccccaagaaccgccucgggggcaaccggcccaccaacaaccgcggccagccccggacccgcacgcgcgccagcgugcggggguucaccgccgccuccgacagcgaccugcuggcgcagacccaccgcuccuucagccucgacucccugaucgacgccgaggaggagcugggcgaggaccagcaggaggagccguuccccgggagcgccgacgagauccccaccgagacguucuggcaccucgaggacuccagccugcccgucauggaccaggaggccaucugccggcugggcccgaucaacuaccgcaccgccgcgcggcucgacgccgugcugcccaugagcuccagcuucuaccuggacccccaguuccagccccacugcgagcuccagccgcacugcgagcugcagccccacugcgagcugcagccccacugcgagcaggccgagucccagguggagcccagcuacuccgagcaggccgacagccuccaggggaugcagcugucccgcgagagcccgcugauguccauggacagcugguucuccugcgacagcaagaucaaccccuccuccccgcccggcaucgucggcucccucugcccgagccccgacaugcaggaguuccacuccugcaagggggagcggcccggcuacuggcccaacaccgaggagcugaagccgagcgacgcggagaccgugcugcccuacuccagcaagcuccaccaggggagcacggagcugcugugcuccgcccgcgacgagcacaccgccagcgccgccgacaccucccggcucagccuguggggcauccagcgccugauccagcccggcgcggacgggaccuuccagggccggugcauccccgacaugacgcagcagggguccagcgaggccucccacaacagcuccgugagcaacguccucgccgccuccgccaccacccugacccacgugggcagcacccacgagcgcgacugguccgcgcugcagcagaaguaccuccuggagcugagcugcccggugcuggaggccaucggggcccccaagcccgccuacccguaccucgaggaggacuccggcagccuggcccaggcguccagcaagggcggggacacgcugcuccccgucggcccccggguguccagcaaccugaaccugaacaacuuccccguccaccucagccgcauccggcgccugcgggccgagaaggagcaggacucccugaacgccaagcucgagggggugagcgacuucuucuccaccagcgagaaggaggccuccuacgacgagaccuacagcgcggaccuggagucccugagcgccucccgcagcaccaacgcccagguguucgccacggagaacgccaucccggacuccaugaccgaggcgugcgaggucaagcagaacaaccucgaggagugccugcagagcugccggaagcccggccugaugaccuccagcgacgaggacuucuuccagaagaacgccugccacuccaacgugaccacggccaccaaggccgaccacuggagccaggggugggcgccccugcgcaagaacuccgcggugcagcccggccagcugagcccggacagccacuacccccuggaggaggagaagaccgacugccaggaguccagcaaggaggccguccggcgccacaucaacguguccuucgcccuccccagcggccccgagcuguaccugcacuccgccccguggaacccccucagcuccagccugcagccgccccugcucgagaccuucuacgugacgaagucccgcgacgcccugaccgagaccgcgcuggagaucccggccugccgggagguccgcgugcccuccccgccgccccgggaggccuggggguucggccacaaccaccaggcccuccagggggcguaccugaagaacaaccugcccgugcuccugcagaaccagaacuccaagaucgccagcucccagcaggucaccgccgagauccccguggaccugaacacgcgcgaggugauccgggagagcggcaagugccccgggaacaucaccgaggagucccacgacagcgucuacuccagcgugacccagaaccgccacuuccuccccuccaccagcacgaaggugugcgaguucgagaaccaggucgugauccugaacaagaagcacagcuuccccgcccuggagggcggcgaggugaccgcccaguccugcugcggggcgagcuccgacagcaccgaguccggcaagagccuccuguuccgggaguccgaggcccgcgaggaggaggagcuggaccagaacaccguccuccggcagacgaucaacgugagccuggagaaggacaugcccggggaguccgccgugagccugaagucccgcagcgucgaccggcgcguguccagccccgugauggucgcccagggcggcgggccgacccccaagugggagggcaagaacgagaccgggcuccuggagaagggccugcggcccaaggacuccagcgaggaguucaagcucccggggaccaagcccgccuacgagcgcuuccagcugguggcgugcccccaggagcggaaccccuccgagugcaagagccaggagaugcugaacccgaaccgcgagcccuccggcaagaagcagaacaagcgggugaacaacacggacgagauggcccgccucauccggagcgucaugcagcuggagaacggcauccuggagaucgagagcaagcagaacaagcagguccacgccucccacacccccgggaccgacaaggagcucguguuccaggaccagaaggagcaggagaagaccgaccacgccuuccgccccgacagcuccggcaacccgcugcccagcaaggaccagcccuccagcccccgccagacggacgacaccgucuuccgggacuccgaggccggggcgauggaggugaacagcaucggcaaccacccccaggugcagaagaucacccccaaccccuuccgcucccgggaggggguccgcgagagcgagcccgugcgggagcacacccacccggccggcuccgaccgccccgcccgggacaucugcgacagccugggcaagcacacgaccugccgcgaguucaccaacaccucccuccacccccagcggaugaaggcccuggcccgcgcgcugccccuccagccgcggcuggagcgcagcuccaagaacaacgggcaguucgugaaggccagcgccucccugaagggccagcccugggggcucggcagccuggaggagcuggagaccgucaagggguuccaggagucccagguggccgagcacgugagcagcuccaaccaggaggagcccaaggcgcagggcaaggucgaggagaugcccaugcagcggggcgggagccuccaggaggagaacaaggugacgcagaaguucccgucccugagccagcugugccgcgacaccuucuuccggcaggagaccgugagcccccugcugagccgcaccgaguucugcacggcgccccugcaccaggaccucuccaacacccugccgcugaacagcccccgguggccccgccggugccuccacguccccguggcccugggcaucuccagccuggacugcgugcucgaccugaccaugcugaagauccacaacuccccgcucgucaccgggguggagcaccaggaccagagcacggagacccgcucccacagccccgagggcaacgugcgggggcgcuccagcgaggcccacaccgccuggugcggcuccguccgcagcauggcgaugggcucccacagccagagcggggugcccgaguccaucccccugggcaccgaggaccggaucagcgccuccacgagcccgcaggaccacgggaaggaccugcgcaucacccuccugggcuucuccaccagcgaggacuucgccuccgaggccgaggucgccgugcagaaggagauccgggugagcucccugaacaaggucagcucccagcccgagaagcgcgugagcuucucccucgaggaggacagcgaccaggcguccaagccccggcagaaggccgagaaggagaccgaggacgugggccugacgagcggggucucccuggcccccgugagccucccgcgcgugcccucccccgagccccggcugcuggagccgagcgaccacgccagcaugugccucgccauccuggaggagauccgccaggcgaaggcccagcggaagcagcugcacgacuucgucgcccgcggcaccgugcucuccuacugcgagacccugcuggagcccgagugcagcucccggguggccgggcgcccccagugcaagcagaucgaccagagcuccagcgaccagacccggaacgagggcgaggcgcccggguuccacgucgccucccucagcgccgaggccggccagaucgaccugcugccggacgagcgcaaggugcaggccacgucccucagcgcggacuccuucgagagccugcccaacaccgagaccgaccgggagcccugggaccccgugcaggccuucucccacgccgccccggcccaggaccgcaagcggcgcaccggcgagcugcggcaguucgcgggggccagcgagcccuucaucugccacuccagcuccagcgagaucaucgagaagaagaaggacgccacgcgcacccccagcuccgccgacccccuggccccggacagcccccgcuccagcgcgcccgucgaggaggugcggcgcguggucuccaagaaggugguggccgcccucccgagccaggcccccuacgacgacccccgggucacccugcacgagcugucccagagcgugccccaggagaccgcggagggcaucccgcccgggucccaggacagcucccccgagcaccaggagccccgcacgcucgacaccaccuacggcgaggugagcgacaaccugcuggucaccgcccagggggagaagacggcccacuucgagucccagagcgugaccugcgacgugcagaacuccaccagcgccuccggcccgaagcaggaccacguccagugccccgaggccagcaccggcuucgaggaggggcgggcgucccccaagcaggacacgauccuccccggcgcccugacccgcguggcccuggaggccccgacccagcagugcgugcagugcaaggagagcgucgggagcggccucaccgaggugugccgggccggguccaagcacagccgccccaucccccugcccgaccagcggccguccgcgaaccccggcggcaucggggaggaggcccccugccgccacccccgggaggcccuggacggcccgguguucagccgcaaccccgaggggucccggacgcucagccccucccgcggcaaggagagccggacccugcccugccgccagccgugcuccagccagcccgucgccacccacgccuacuccagccacuccagcacccugcucugcuuccgggacggggaccugggcaaggagcccuucaaggcggcgccccacaccauccacccgcccugcguggugcccucccgcgccuacgagauggacgagacgggcgagaucagccgggggccggacguccaccugacccacggccucgagcccaaggacgugaaccgcgaguuccggcugaccgaguccuccacgugcgagcccuccaccguggccgccguccugagccgcgcgcaggggugccgcagccccuccgccccggacgugcggaccggcagcuucucccacagcgccaccgacggcuccguggggcucaucggcguccccgagaagaagguggccgagaagcaggcgagcaccgagcuggaggccgccuccuuccccgccgggauguacagcgagccccugcgccaguuccgggacuccagcgugggcgaccagaacgcccaggucugccagacgaacccggagccgcccgcgaccacccaggggccccacacccucgaccuguccgagggcagcgccgaguccaagcuggugguggagccgcagcacgagugccucgagaacacgacccgcugcuuccuggagaagccccaguucagcaccgagcugcgggaccacaaccgccucgacucccaggccaaguucgucgcccggcugaagcacacgugcagcccccaggaggacucccccuggcaggaggaggagcagcaccgcgaccaggccagcggcgggggcgagggguucgcgcagggcgugaacccgcugcccgacgaggacgggcucgacggcugccagauccuggacgccggccgggaggagguggccgucgccaagccgcccguguccaagauccugagccagggguucaaggacccggccacggucagccuccgccagaacgagacgccccagcccgcggcccagcgguccggccaccuguacaccgggcgcgagcagcccgccccgaaccaccggggcagccugcccgugaccacgaucuucuccgggcccaagcacagccgcuccagccccaccccgcaguucuccguggucggcagcucccggagccuccaggagcugaaccuguccguggagccgcccagcccgaccgacgaggacacccagggccccaaccgccucuggaacccccaccuccggggguacuccagcggcaaguccguggcccgcacgagccugcaggcggaggacuccaaccagaaggccagcucccggcucgacgacgggaccaccgaccaccgccaccugaagcccgccaccccgcccuaccccaugcccagcacgcugagccacaugccgacccccgacuucaccaccuccuggaugagcggcacgcucgagcaggcccagcagggcaagcgcgagaagcuggggguccaggugcggcccgagaacuggugcucccagauggacaagggcaugcugcacuucgggagcuccgacaucagccccuacgcccucccguggcgccccgaggagcccgcgcggaucuccuggaagcaguacaugagcggcuccgccguggacgucagcugcucccagaagccccaggggcugacccugagcaacguggcccgcugcuccagcauggacaacggccucgaggaccagaacuccccguuccacagccaccuguccaccuacgccaacaucugcgaccugagcaccacgcacuccagcaccgagaacgcccagggcagcaacgaggcgugggagguguuccggggguccagcuccaucgcccucggcgacccccacauccccaccagccccgagggggucgccccgaccuccggccacgaccgccggccccaguuccgcgggcccagcggcgaggccgacugccugcgguccaagcccccgcuggccaagggcagcgcggccgggcccguggacgagaucaugcuccuguaccccuccgaggccggcugcccgguggggcagacccgcacgaacaccuucgagcagggcacccagacccuggggagccggcgccacugguccagcacggacaucuccuucgcccagcccgaggccagcgcggucuccgccuucgaccucgccagcuggaccuccaugcacaaccugagccugcaccucagccagcugcugcacuccaccagcgagcuccugggcucccugagccagcccgacguggcccggcgcgagcagaacaccaagcgggacauccccgacaaggcgccgcaggcccucaugauggacggcuccacgcagaccaccguggacgaggggagccagaccgaccugacgcugcccacccucugccugcagaccuccgaggccgagccccagggcgccaacgucauccuggaggggcucggcagcgacaccuccacggugagccaggaggagggggacgugcccggcgucccgcagaagcgcgaggccgaggagaccgcgcagaagauggcccagcugcuguaccuccaggaggaguccacccccuacaagccccagagccccuccaucccgagcucccaccuccgguuccagaaggcccccgugggccagcaccuccccagcgugucccccagcgucuccgacgccuuccucccgcccagcagccagcccgaggaguccuacugccugguggugagcucccccagcccguccagcccccacucccccgggcuguuccccagcaccuccgaguacccgggcgacagccgcguccagaagaagcucgggcccacguccgcccuguucguggaccgggcgagcucccccauccugacccucagcgccuccacccaggagcccggccugagcccgggcucccugacccucagcgcccccuccacgcaccccguggaggggcaccagaagcuggacagcagcccggaccccgucgacgcgccccgcacccccauggacaacuacucccagaccaccgacgagcugggcgggagccagcggggccgcuccagccuccagcgcuccaacgggcggagcuuccuggagcugcacuccccgcacagcccccagcagucccccaagcugcaguucagcuuccucggccagcacccccagcagcugcagccgcgcacgaccaucggcgugcagucccggcugcugccgccgccccugcgccaccggagccagcgccuggggaacuccuucgugccggagaaggucgccagccccgagcacugcccccucuccggccgggagcccagccaguggcagucccgcaccgagaacgggggcgagagcuccgcgagcccgggggagccccagcggacccuggaccgccccagcuccuggggcggccugcagcaccucagccccugcccgguguccgagcugacggacaccgccgggcugcggggcagcgcccucgggcugccccaggccugccagcccgaggagcugcucugcuucuccugccagaugugcauggcgcccgagcaccagcaccacagccugcgcgaccugccggugcacaacaaguucuccaacuggugcggcguccagaaggggagccccggcggccucgacaugaccgaggaggagcugggggccuccggcgaccugagcuccgagaagcaggagcaguccccgccccagccgcccaacgaccacucccaggacagcgagugguccaagcgggagcagaucccccuccaggugggggcccagaaccugagccuguccguggagcucaccgaggccaagcugcaccacggcuucggcgaggccgacgcgcugcuccagguccugcagagcgggacgggcgaggcccuggccgccgacgagccggugaccuccaccuggaaggagcucuacgcccgccagaagaaggcgaucgagacccugcggcgcgagcgggccgagcgccuggggaacuucugccggacccgcagccucagcccccagaagcagcugucccugcuccccaacaaggaccuguucaucugggaccuggaccuccccagccgccggcgcgaguaccugcagcagcugcggaaggacguggucgagacgacccgcuccccggagagcgugucccggagcgcccacacccccuccgacaucgagcucaugcugcaggacuaccagcaggcccacgaggaggccaagguggagaucgcgcgcgcccgggaccagcugcgcgagcggaccgagcaggagaagcuccgcauccaccagaagaucaucagccagcugcugaaggaggaggacaagcuccacacgcuggccaacuccagcucccugugcaccagcuccaacggcagccucuccagcgggaugaccuccggcuacaacagcucccccgcccugagcggccagcugcaguuccccgagaacauggggcacaccaaccucccggacagccgggacgucuggaucggcgacgagcgcgggggccacuccgcggugcggaagaacagcgccuacucccaccgcgccagccugggguccugcugcugcagccccuccagccuguccagccucggcacgugcuucuccagcuccuaccaggaccuggccaagcacguggucgacaccagcauggccgacgugauggcggccugcuccgacaaccugcacaaccucuucagcugccaggccaccgccggcuggaacuaccagggggaggagcaggccgugcagcuguacuacaaggucuucucccccacccggcacggcuuccugggggcgggcguggucagccagccccucagccgcgugugggccgccguguccgacccgacggucuggccccuguacuacaagcccauccagaccgcccggcugcaccagcgcgugaccaacagcaucucccucguguaccuggucugcaacaccacgcugugcgcccucaagcagccccgggacuucugcugcgugugcguggaggcgaaggaggggcaccugagcgucauggccgcccaguccguguacgacaccagcaugccgcgccccucccggaagauggugcgcggcgagauccugcccagcgccuggauccuccagcccaucaccgucgagggcaaggaggugacccgcgugaucuaccuggcccaggucgagcugggggcgccgggcuucccgccccagcuccuguccagcuucaucaagcggcagccccuggugaucgcccgccucgccuccuuccuggggcgguga

SEQ ID NO: 37188 - RNA, 858 nt, Artificial Sequence
  derived and/or modified sequence opt1 from STAR__Homo_sapiens__NP_000340
augcugcuggccaccuucaagcugugcgccggcagcuccuaccgccacaugcggaacaugaaggggcugcgccagcaggcggugauggccaucagccaggagcucaaccggcgcgcccugggcgggcccaccccguccacguggaucaaccagguccggcgccggagcucccugcucggcagccgccuggaggagacccuguacuccgaccaggagcucgccuaccugcagcagggggaggaggccaugcagaaggcgcugggcauccucagcaaccaggagggcuggaagaaggagucccagcaggacaacggggacaaggugaugagcaaggugguccccgacgugggcaagguguuccggcuggaggucgugguggaccagcccauggagcgccuguacgaggagcucgucgagcggauggaggccaugggggaguggaaccccaacgugaaggagaucaaggugcugcagaagaucggcaaggacaccuucaucacccacgagcuggccgccgaggcggccgggaaccucgucggcccgcgcgacuucguguccgugcggugcgccaagcgccggggcagcacgugcguccuggccgggauggccaccgacuucggcaacaugcccgagcagaagggggugauccgcgcggagcacggcccgaccugcauggugcugcacccccucgccggcucccccagcaagaccaagcugacguggcugcucuccaucgaccugaagggguggcugcccaagagcaucaucaaccagguccucucccagacccagguggacuucgccaaccaccuccggaagcgccuggagagccaccccgccuccgaggcccggugcuga

SEQ ID NO: 37189 - RNA, 2253 nt, Artificial Sequence
  derived and/or modified sequence opt1 from STAT1__Homo_sapiens__NP_009330
augagccagugguacgagcugcagcagcucgacuccaaguuccuggagcagguccaccagcuguacgacgacagcuuccccauggagauccgccaguaccucgcccaguggcuggagaagcaggacugggagcacgccgcgaacgacguguccuucgccaccauccgguuccacgaccugcucagccagcuggacgaccaguacucccgcuucagccuggagaacaacuuccuccugcagcacaacauccggaaguccaagcgcaaccugcaggacaacuuccaggaggacccgauccagaugagcaugaucaucuacuccugccucaaggaggagcggaagauccuggagaacgcccagcgcuucaaccaggcccagagcggcaacauccaguccaccgugaugcuggacaagcagaaggagcucgacagcaaggugcggaacgucaaggacaaggugaugugcaucgagcacgagaucaagucccuggaggaccugcaggacgaguacgacuucaagugcaagacgcuccagaaccgcgagcacgagaccaacgggguggccaagagcgaccagaagcaggagcagcugcugcucaagaagauguaccugaugcuggacaacaagcggaaggaggucgugcacaagaucaucgagcuccugaacgugaccgagcugacccagaacgcgcucaucaacgacgagcuggucgaguggaagcgccggcagcaguccgccugcaucggcgggccgcccaacgccugccuggaccagcuccagaacugguucacgaucguggccgagagccugcagcagguccgccagcagcugaagaagcucgaggagcuggagcagaaguacaccuacgagcacgaccccaucaccaagaacaagcagguccugugggaccggaccuucucccucuuccagcagcugauccagagcuccuucgugguggagcgccagcccugcaugcccacgcacccccagcggccccuggugcucaagaccggcgugcaguucaccgugaagcugcgccugcucgucaagcugcaggagcugaacuacaaccucaaggugaaggugcuguucgacaaggacgucaacgagcggaacaccgugaagggguuccgcaaguucaacauccugggcacgcacaccaaggugaugaacauggaggagagcaccaacggcagccucgcggccgaguuccggcaccuccagcugaaggagcagaagaacgccgggacccgcacgaacgagggcccgcugaucgucaccgaggagcugcacucccugagcuucgagacccagcugugccagcccgggcucgugaucgaccuggagaccacgucccugcccgucguggugaucagcaacgucucccagcuccccagcggcugggccuccauccugugguacaacaugcugguggccgagccgcggaaccucagcuucuuccugaccccgcccugcgcgcgcugggcccagcuguccgaggugcucagcuggcaguucuccagcgucaccaagcgcgggcugaacguggaccagcugaacaugcucggcgagaagcugcugggccccaacgccucccccgacgggcucauccccuggacccgguucugcaaggagaacaucaacgacaagaacuuccccuucuggcuguggaucgagagcauccuggagcucaucaagaagcaccuccugccccuguggaacgacggcugcaucaugggguucaucuccaaggagcgcgagcgggcccugcugaaggaccagcagccgggcacguuccuccugcgcuucagcgaguccagccgggagggcgccaucaccuucaccuggguggagcgcucccagaacgggggcgagcccgacuuccacgcggucgagcccuacaccaagaaggagcugagcgccgugacguuccccgacaucauccggaacuacaaggugauggccgccgagaacaucccggagaacccccucaaguaccuguaccccaacaucgacaaggaccacgccuucgggaaguacuacagccgccccaaggaggcgccggagcccauggagcuggacggccccaaggggaccggcuacaucaagaccgagcucaucuccgucagcgaggugcacccgucccggcugcagaccacggacaaccugcuccccaugagccccgaggaguucgacgaggugucccgcaucgucggcagcguggaguucgacuccaugaugaacaccguguga

SEQ ID NO: 37190 - RNA, 2556 nt, Artificial Sequence
  derived and/or modified sequence opt1 from STAT2__Homo_sapiens__NP_005410
auggcccagugggagaugcugcagaaccucgacagccccuuccaggaccagcugcaccagcuguacucccacagccuccugccgguggacauccgccaguaccuggccgucuggaucgaggaccagaacuggcaggaggcggcccucggcuccgacgacagcaaggccaccaugcuguucuuccacuuccuggaccagcucaacuacgagugcgggcggugcucccaggaccccgagagccugcugcuccagcacaaccugcgcaaguucugccgggacauccagcccuucucccaggaccccacccagcuggccgagaugaucuucaaccuccugcuggaggagaagcgcauccucauccaggcccagcgggcgcagcuggagcagggcgagccggugcuggagacgcccguggagagccagcagcacgagaucgagucccgcauccucgaccugcgggccaugauggagaagcuggucaagagcaucucccagcucaaggaccagcaggacguguucugcuuccgcuacaagauccaggccaaggggaagacccccagccuggacccccaccagaccaaggagcagaagauccugcaggagacccucaacgagcuggacaagcggcgcaaggaggugcuggacgccuccaaggcgcuccugggccggcugacgacccucaucgagcugcugcucccgaagcuggaggaguggaaggcccagcagcagaaggccugcauccgcgcccccaucgaccacgggcuggagcagcucgagaccugguucaccgccggcgcgaagcugcuguuccaccuccggcagcugcugaaggagcucaagggccugagcugccuggucuccuaccaggacgacccccucacgaaggggguggaccugcgcaacgcccaggugaccgagcugcugcagcggcuccugcaccgcgccuucgucguggagacccagcccugcaugccgcagacgccccaccggccccugauccucaagaccggcagcaaguucaccgugcgcacccggcugcugguccgccuccaggaggggaacgagucccugaccguggaggugagcaucgaccggaacccgccccagcugcagggcuuccgcaaguucaacauccucacguccaaccagaagacccugacccccgagaaggggcagagccagggccugaucugggacuucggcuaccucacccuggucgagcagcgcagcgggggcuccgggaagggcagcaacaagggcccccugggggugacggaggagcuccacaucaucuccuucaccgugaaguacaccuaccagggccugaagcaggagcugaagaccgacacgcuccccgucgugaucaucagcaacaugaaccagcuguccaucgccugggccagcgugcugugguucaaccuccuguccccgaaccugcagaaccagcaguucuucagcaacccgcccaaggcgcccuggucccuccuggggcccgcccugagcuggcaguucuccagcuacgucggccgggggcucaacuccgaccagcugagcaugcugcgcaacaagcuguucggccagaacugccggaccgaggacccccuccuguccugggccgacuucaccaagcgcgagagcccgcccggcaagcuccccuucuggaccuggcuggacaagauccuggagcucgugcacgaccaccugaaggaccuguggaacgacgggcggaucaugggcuucgugucccgcagccaggagcggcgccuccugaagaagacgauguccgggaccuuccugcuccgguucagcgagagcuccgagggcgggaucacgugcagcugggucgagcaccaggacgacgacaaggugcugaucuacuccguccagcccuacaccaaggaggugcugcagagccucccccugaccgagaucauccgccacuaccagcugcucaccgaggagaacaucccggagaacccccugcgguuccuguacccccgcaucccccgggacgaggccuucggcugcuacuaccaggagaaggugaaccuccaggagcgccggaaguaccugaagcaccgccugaucgucguguccaaccgccagguggacgagcuccagcagccgcuggagcugaagcccgagcccgagcucgagagccuggagcuggagcucggccugguccccgagccggagcugucccucgaccuggagccccugcucaaggccgggcuggaccugggccccgagcucgagagcgugcuggaguccacccuggagcccgugaucgagccgacccucugcauggucagccagacggugcccgagcccgaccaggggcccgugucccagccgguccccgagcccgaccugcccugcgaccugcggcaccucaacaccgagccgauggagaucuuccggaacugcgugaagaucgaggagaucaugcccaacggcgacccccugcuggcggggcagaacaccguggacgaggucuacgugagccgccccucccacuucuacaccgacggcccgcucaugcccagcgacuucuga

SEQ ID NO: 37191 - RNA, 2310 nt, Artificial Sequence
  derived and/or modified sequence opt1 from STAT3__Homo_sapiens__NP_003141
auggcccaguggaaccagcugcagcagcucgacacccgcuaccuggagcagcugcaccagcucuacagcgacuccuuccccauggagcugcggcaguuccuggccccguggaucgagagccaggacugggcguacgccgccuccaaggagagccacgccacccucguguuccacaaccugcugggcgagaucgaccagcaguacucccgcuuccuccaggagagcaacguccuguaccagcacaaccugcggcgcaucaagcaguuccuccagucccgguaccuggagaagcccauggagaucgcccgcaucguggcgcggugccugugggaggagagccgccuccugcagacggccgccaccgccgcgcagcagggcggccaggccaaccaccccaccgccgccguggucaccgagaagcagcagaugcuggagcagcaccuccaggacgugcggaagcgcgugcaggaccuggagcagaagaugaaggucguggagaaccugcaggacgacuucgacuucaacuacaagacgcucaagucccagggggacaugcaggaccugaacggcaacaaccagagcgugacccggcagaagaugcagcagcuggagcagaugcucaccgcccuggaccagaugcgccgguccaucgucagcgagcuggcggggcuccuguccgccauggaguacgugcagaagacccugacggacgaggagcucgccgacuggaagcgccggcagcagaucgccugcaucggcgggcccccgaacaucugccuggaccgccuggagaacuggaucaccagccucgccgagucccagcugcagacccggcagcagaucaagaagcuggaggagcuccagcagaaggugagcuacaagggggaccccaucguccagcaccgccccaugcuggaggagcggaucguggagcuguuccgcaaccucaugaaguccgcguucguggucgagcggcagcccugcaugccgaugcaccccgaccgcccccuggugaucaagaccggcgugcaguucacgaccaagguccgccugcucgugaaguuccccgagcugaacuaccagcugaagaucaaggugugcaucgacaaggacagcggggacgucgccgcccuccggggcucccgcaaguucaacauccuggggaccaacaccaaggugaugaacauggaggagagcaacaacggcagccuguccgccgaguucaagcaccucacgcugcgggagcagcgcugcggcaacgggggccgggccaacugcgacgcgagccugaucgugaccgaggagcugcaccucaucaccuucgagaccgaggucuaccaccaggggcugaagaucgaccuggagacgcacucccucccgguggucgugaucagcaacaucugccagaugcccaacgccugggccuccauccugugguacaacaugcugaccaacaaccccaagaacgugaacuucuucaccaagcccccgaucggcaccugggaccaggucgccgaggugcucagcuggcaguucuccagcacgaccaagcgcggccuguccaucgagcagcugaccacccucgccgagaagcugcuggggcccggcgugaacuacagcgggugccagaucacgugggcgaaguucugcaaggagaacauggccggcaagggguucuccuucugggucuggcucgacaacaucaucgaccuggugaagaaguacauccuggcccucuggaacgagggcuacaucaugggcuucaucagcaaggagcgggagcgcgccauccuguccaccaagccgcccgggaccuuccugcuccgguucagcgaguccagcaaggagggcggggugaccuucacgugggucgagaaggacaucuccggcaagacccagauccagagcguggagcccuacaccaagcagcagcugaacaacauguccuucgcggagaucaucaugggguacaagaucauggacgccaccaacauccuggugagcccccucgucuaccuguaccccgacauccccaaggaggaggccuucggcaaguacugccgcccggagagccaggagcaccccgaggccgaccccggcgccgcgcccuaccugaagacgaaguucaucugcgugaccccgacgaccugcuccaacaccaucgaccuccccaugagcccccggacccuggacucccugaugcaguucgggaacaacggcgagggggccgagccgagcgccggcgggcaguucgagucccucaccuucgacauggagcugaccagcgagugcgccaccucccccauguga

SEQ ID NO: 37192 - RNA, 2247 nt, Artificial Sequence
  derived and/or modified sequence opt1 from STAT4__Homo_sapiens__NP_003142
augagccaguggaaccaggugcagcagcuggagaucaaguuccucgagcaggucgaccaguucuacgacgacaacuuccccauggagauccgccaccuccuggcccaguggaucgagaaccaggacugggaggccgcguccaacaacgagaccauggccaccauccugcugcagaaccugcucauccagcuggacgagcagcugggccgggugagcaaggagaagaaccuccugcugauccacaaccucaagcgcauccggaaggugcugcaggggaaguuccacggcaacccgaugcacgucgccguggugaucuccaacugccugcgcgaggagcggcgcauccucgccgccgcgaacaugcccguccaggggccccuggagaagucccugcagagcagcuccgugagcgagcggcagcgcaacguggagcacaaggucgccgccaucaagaacuccgugcagaugacggagcaggacaccaaguaccucgaggaccugcaggacgaguucgacuaccgguacaagaccauccagaccauggaccagagcgacaagaacuccgccauggugaaccaggagguccugacgcuccaggagaugcugaacagccuggacuucaagcgcaaggaggcgcucuccaagaugacccagaucauccacgagaccgaccugcugaugaacaccaugcucaucgaggagcugcaggacuggaagcggcgccagcagaucgccugcaucggcgggccccugcacaacggccucgaccagcugcagaacugcuucacgcugcucgccgagagccuguuccagcugcggcgccagcucgagaagcuggaggagcaguccaccaagaugaccuacgagggcgacccgauccccaugcagcggacccacaugcuggagcgcgugacguuccucaucuacaaccuguucaagaacagcuucguggucgagcggcagcccugcaugcccacccacccgcagcgcccccuggugcucaagacccugauccaguucaccgugaagcugcggcuccugaucaagcugcccgagcucaacuaccaggucaaggugaaggccuccaucgacaagaacgugagcacgcuguccaaccgccgguucguccugugcgggaccaacgugaaggccaugagcaucgaggagagcuccaacggcagccuguccguggaguuccgccaccuccagcccaaggagaugaaguccagcgccgggggcaaggggaacgagggcugccacauggucaccgaggagcugcacagcaucaccuucgagacgcagaucugccuguacggccucaccaucgaccuggagaccuccagccugccgguggucaugaucuccaacgugagccagcuccccaacgcgugggccuccaucaucugguacaacgugagcaccaacgacucccagaaccuggucuucuucaacaacccgccgcccgccacgcugagccagcuccuggaggugauguccuggcaguucagcuccuacguggggcgcggccugaacagcgaccagcuccacaugcuggccgagaagcugaccguccaguccagcuacagcgacgggcaccucaccugggcgaaguucugcaaggagcaccuccccggcaaguccuucaccuucuggacguggcuggaggccauccuggaccugaucaagaagcacauccugccccucuggaucgacggcuacgugaugggguucgugagcaaggagaaggagcggcugcugcucaaggacaagaugcccggcaccuuccugcugcgcuucuccgagagccaccucgggggcaucaccuucaccugggucgaccacuccgagagcggggaggugcgguuccacuccguggagcccuacaacaagggccgccugagcgcccugcccuucgccgacauccuccgggacuacaaggucaucauggccgagaacauccccgagaacccccugaaguaccuguacccggacauccccaaggacaaggcguucggcaagcacuacuccagccagcccugcgaggugucccgccccacggagcgcggggacaagggcuacgugccgagcgucuucauccccaucuccaccauccggagcgacuccaccgagccccacagcccguccgaccuccugcccaugagccccagcguguacgccgugcugcgggagaaccucucccccaccacgaucgagaccgccaugaaguccccguacagcgccgaguga

SEQ ID NO: 37193 - RNA, 2295 nt, Artificial Sequence
  derived and/or modified sequence opt1 from STAT5A__Homo_sapiens__NP_001275648
auggccggcuggauccaggcccagcagcugcagggggacgcgcuccgccagaugcagguccuguacggccagcacuuccccaucgaggugcggcacuaccuggcccaguggaucgagagccagccgugggacgccaucgaccucgacaacccccaggaccgcgcccaggccacccagcugcuggaggggcucgugcaggagcugcagaagaaggcggagcaccaggugggcgaggacggguuccugcucaagaucaagcugggccacuacgccacccagcugcagugcuccagccccgccggcauccucgucgacgccaugucccagaagcaccuccagaucaaccagacguucgaggagcugcggcuggugacccaggacaccgagaacgagcugaagaagcugcagcagacccaggaguacuucaucauccaguaccaggagagccuccgcauccaggcgcaguucgcccagcuggcccagcugagcccccaggagcggcucucccgcgagacggcccugcagcagaagcaggucucccuggaggccuggcuccagcgggaggcgcagacccugcagcaguaccgcguggagcuggccgagaagcaccagaagacccuccagcugcugcggaagcagcagaccaucauccucgacgacgagcugauccaguggaagcgccggcagcagcuggccgggaacggcgggccgcccgagggcagccucgacgugcugcaguccuggugcgagaagcuggccgagaucaucuggcagaaccgccagcagauccggcgcgccgagcaccucugccagcagcugcccauccccgggccgguggaggagaugcuggcggaggucaacgccacgaucaccgacaucaucagcgcccucgugaccuccaccuucaucaucgagaagcagccgccccaggugcugaagacgcagaccaaguucgccgccaccguccggcugcucgugggcggcaagcugaacgugcacaugaacccgccccaggucaaggcgaccaucaucagcgagcagcaggccaagucccugcucaagaacgagaacacgcgcaacgagugcagcggggagauccugaacaacugcugcgugauggaguaccaccaggccaccggcacccuguccgcccacuuccggaacaugagccucaagcgcaucaagcgggccgaccgccgcggggcggaguccgugaccgaggagaaguucacgguccuguucgagagccaguucuccgugggcagcaacgagcugguguuccaggucaagacccugagccuccccgugguggucaucgugcacggcucccaggaccacaacgccaccgccaccguccugugggacaacgccuucgcggagcccgggcgggugcccuucgccgugcccgacaagguccuguggccccagcucugcgaggcccugaacaugaaguucaaggccgaggugcagagcaaccgcggccugacgaaggagaaccucguguuccuggcccagaagcuguucaacaacuccagcucccaccucgaggacuacagcgggcuguccgucagcuggucccaguucaaccgggagaaccugcccggcuggaacuacaccuucuggcagugguucgacggggugauggaggugcucaagaagcaccacaagccccacuggaacgacggcgcgauccugggcuucgucaacaagcagcaggcccacgaccugcucaucaacaagccggacgggaccuuccugcugcgcuucagcgacuccgagaucggcgggaucaccaucgccuggaaguucgacagccccgagcggaaccucuggaaccugaagcccuucacgacccgcgacuucuccauccggagccuggccgaccgccucggcgaccuguccuaccugaucuacguguuccccgaccggccgaaggacgagguguucagcaaguacuacacccccguccucgccaaggcgguggacggguacgugaagccccagaucaagcaggucgugcccgaguucgugaacgccuccgccgacgccggcggcagcuccgccaccuacauggaccaggcgccgagccccgccgucugcccccaggccccguacaacauguacccccagaaccccgaccacgugcuggaccaggacggggaguucgaccuggacgagacgauggacguggcccgccacgucgaggagcuccugcggcgccccauggacagccuggacucccggcucagcccgcccgcgggccuguucaccuccgcccgcgggagccuguccuga

SEQ ID NO: 37194 - RNA, 2364 nt, Artificial Sequence
  derived and/or modified sequence opt1 from STAT5B__Homo_sapiens__NP_036580
auggccguguggauccaggcccagcagcugcagggcgaggcgcuccaccagaugcaggcccuguacgggcagcacuuccccaucgagguccgccacuaccugagccaguggaucgagucccaggccugggacagcguggaccucgacaacccgcaggagaacaucaaggccacccagcugcuggagggccucgugcaggagcugcagaagaaggccgagcaccaggucggggaggacggcuuccugcucaagaucaagcuggggcacuacgcgacccagcugcagaacacguacgaccggugccccauggagcucgugcgcugcauccggcacauccuguacaacgagcagcgccuggugcgggaggccaacaacggcuccagccccgccggcucccucgccgacgcgaugagccagaagcaccuccagaucaaccagaccuucgaggagcugcgccuggucacccaggacaccgagaacgagcugaagaagcugcagcagacgcaggaguacuucaucauccaguaccaggagucccuccggauccaggcccaguucgggccccuggcccagcugagcccgcaggagcgccucucccgggagaccgcccugcagcagaagcaggucagccuggaggccuggcuccagcgcgaggcgcagacccugcagcaguaccggguggagcuggccgagaagcaccagaagacccuccagcugcugcgcaagcagcagacgaucauccucgacgacgagcugauccaguggaagcggcgccagcagcuggccggcaacgggggcccgcccgaggggucccucgacgugcugcagagcuggugcgagaagcuggccgagaucaucuggcagaaccggcagcagauccgccgggccgagcaccucugccagcagcugcccauccccggccccguggaggagaugcuggcggaggugaacgccaccaucaccgacaucaucuccgcccucgucaccagcacguucaucaucgagaagcagccgccccaggugcugaagacccagaccaaguucgccgccaccgugcgccugcucgucggcgggaagcugaacgugcacaugaacccgccccaggugaaggcgacgaucaucuccgagcagcaggccaagagccugcucaagaacgagaacacccggaacgacuacuccggcgagauccugaacaacugcugcgucauggaguaccaccaggccaccgggacccugagcgcccacuuccgcaacaugucccugaagcggaucaagcgcagcgaccgccggggcgccgagagcgugacggaggagaaguucaccauccucuucgagucccaguucagcgugggcgggaacgagcuggucuuccaggugaagacccugucccuccccguggucgugaucguccacggcagccaggacaacaacgcgaccgccacggugcugugggacaacgccuucgccgagcccgggcgcgugcccuucgcgguccccgacaaggugcuguggccccagcucugcgaggcccugaacaugaaguucaaggccgaggugcaguccaaccggggccugaccaaggagaaccucgucuuccuggcccagaagcuguucaacaacagcuccagccaccucgaggacuacuccgggcugagcguguccuggagccaguucaaccgcgagaaccugcccggccggaacuacaccuucuggcagugguucgacggcgugauggagguccucaagaagcaccugaagccgcacuggaacgacggggccauccugggcuucgugaacaagcagcaggcgcacgaccuccugaucaacaagcccgacgggaccuuccugcuccgcuucuccgacagcgagaucggcgggaucacgaucgccuggaaguucgacucccaggagcggauguucuggaaccugaugcccuucaccacccgcgacuucagcauccggucccuggccgaccgccucggcgaccugaacuaccugaucuacguguuccccgaccggccgaaggacgaggucuacagcaaguacuacacccccgugcccugcgaguccgccacggccaaggcgguggacggcuacgucaagccccagaucaagcaggucgugccggaguucgugaacgccagcgccgacgccgggggcgggagcgccaccuacauggaccaggcgcccucccccgccgugugcccgcaggcccacuacaacauguacccccagaaccccgacagcgugcucgacaccgacggcgacuucgaccuggaggacaccauggacgucgcccgccggguggaggagcugcucgggcgccccauggacucccaguggaucccgcacgcgcagagcuga

SEQ ID NO: 37195 - RNA, 2544 nt, Artificial Sequence
  derived and/or modified sequence opt1 from STAT6__Homo_sapiens__XP_006719637
augagccuguggggccucguguccaagaugcccccggagaagguccagcgccuguacguggacuucccccagcaccuccggcaccuccugggggacuggcuggagagccagcccugggaguuccucgugggcuccgacgccuucugcugcaaccuggccagcgcgcugcucuccgacaccguccagcaccuccaggccagcgugggggagcagggcgagggguccaccauccugcagcacaucagcacgcuggaguccaucuaccagcgcgacccccugaagcugguggccaccuuccggcagauccuccagggcgagaagaaggccgucauggagcaguuccgccaccucccgaugcccuuccacuggaagcaggaggagcugaaguucaagaccggccugcggcgccugcagcaccgggugggggagauccaccuccugcgcgaggcccugcagaagggcgcggaggccggccaggugagccugcacucccucaucgagacccccgccaacgggacggggcccagcgaggcccuggcgaugcugcuccaggagaccaccggcgagcuggaggccgccaaggcccugguccucaagcggauccagaucuggaagcgccagcagcagcuggccggcaacggggcgccguucgaggagucccuggcgccccuccaggagcggugcgagagccugguggacaucuacucccagcugcagcaggaggugggcgccgccgggggcgagcucgagcccaagacccgcgccagccugacgggccggcuggacgagguccuccgcacccuggugaccuccugcuuccugguggagaagcagcccccgcagguccucaagacccagacgaaguuccaggccggggugcgguuccugcugggccuccgcuuccugggggcccccgccaagccgccccuggugcgggccgacauggucaccgagaagcaggcccgcgagcucagcgugccccagggccccggggcgggcgccgaguccaccggcgagaucaucaacaacaccgugccccuggagaacagcauccccgggaacugcugcagcgcccuguucaagaaccugcuccugaagaagaucaagcggugcgagcgcaagggcacggaguccgucaccgaggagaagugcgccgugcuguucagcgccuccuucacccucgggccgggcaagcugcccauccagcugcaggcgcucagccugccccugguggucaucgugcacgggaaccaggacaacaacgccaaggccaccauccucugggacaacgccuucuccgagauggaccggguccccuucgugguggcggagcgcgucccgugggagaagaugugcgagacgcugaaccugaaguucauggccgaggugggcaccaaccgcggccuccugcccgagcacuuccuguuccucgcccagaagaucuucaacgacaacagccuguccauggaggccuuccagcaccggagcguguccuggagccaguucaacaaggagauccugcucgggcgcggcuucaccuucuggcagugguucgacgggguccuggaccugaccaagcggugccuccgcuccuacuggagcgaccggcugaucaucggcuucaucuccaagcaguacgugacgagccugcuccugaacgagcccgacgggaccuuccugcuccgcuucuccgacagcgagaucggcggcaucaccaucgcccacgugauccgggggcaggacggcagcccccagaucgagaacauccagccguucuccgcgaaggaccuguccauccgcagccugggggaccggauccgcgaccucgcccagcugaagaaccuguaccccaagaagcccaaggacgaggccuuccggagccacuacaagccggagcagaugggcaaggacggccgcggguacguccccgccaccaucaagaugacgguggagcgggaccagccccuccccaccccggagcugcagaugcccaccauggugcccuccuacgaccugggcauggcccccgacagcuccaugagcaugcagcucgggccggacauggucccccagguguacccgccccacucccacagcaucccgcccuaccagggccugucccccgaggagagcgugaacguccuguccgcguuccaggagccccaccuccagaugccgcccagccuggggcagaugucccugcccuucgaccagccccacccccagggccuccugcccugccagccccaggagcacgccgugagcucccccgacccgcugcucugcagcgacgugaccauggucgaggacuccugccugagccagcccgugacggccuucccccagggcaccuggaucggggaggacaucuucccgccccugcugccgcccaccgagcaggaccugaccaagcugcuccuggagggccagggggaguccggcgggggcagccugggcgcccagccccuccugcagcccagccacuacgggcaguccggcaucagcaugucccacauggaccugcgcgccaaccccagcugguga

SEQ ID NO: 37196 - RNA, 159 nt, Artificial Sequence
  derived and/or modified sequence opt1 from STATH__Homo_sapiens__NP_001009181
augaaguuccugguguucgccuucauccucgcccugauggucagcaugaucggcgcggacuccagcgaggaguacggguacggccccuaccagccggugcccgagcagccccuguacccccagccguaccagccccaguaccagcaguacaccuucuga

SEQ ID NO: 37197 - RNA, 1713 nt, Artificial Sequence
  derived and/or modified sequence opt1 from STAU2__Homo_sapiens__NP_001157852
auggccaaccccaaggagaagaccgccaugugccuggugaacgagcucgcgcgcuucaaccggguccagccgcaguacaagcugcugaacgagcgcggccccgcccacagcaagauguucuccgugcagcucagccugggggagcagaccugggaguccgagggcagcuccaucaagaaggcccagcaggccguggccaacaaggcgcugacggagagcacccuccccaagcccguccagaagccgcccaaguccaacgugaacaacaaccccgggagcaucacccccaccguggagcugaacggccuggccaugaagcgcggggagccggccaucuaccggccccucgaccccaagcccuucccgaacuaccgggccaacuacaacuuccgcggcauguacaaccagcgguaccacugccccguccccaagaucuucuacgugcagcugacggugggcaacaacgaguucuucggggagggcaagacccgccaggcggcccggcacaacgccgccaugaaggcccugcaggcgcuccagaacgagcccaucccggagcgcagcccccagaacggggagagcggcaaggacgucgacgacgacaaggacgccaacaaguccgagaucagccugguguucgagaucgcccugaagcggaacaugcccguguccuucgaggucaucaaggagagcgggcccccgcacaugaaguccuucgugacccgcgugagcgucggcgaguucuccgccgagggcgaggggaacagcaagaagcucuccaagaagcgggccgcgaccacggugcugcaggagcugaagaagcucccgccccugcccguggucgagaagcccaagcuguucuucaagaagcgccccaagaccaucgugaaggccggccccgaguacgggcagggcaugaaccccaucagccggcucgcccagauccagcaggccaagaaggagaaggagccggacuacgugcugcugagcgagcgcggcaugccccggcgccgggaguucgucaugcaggucaagguggggaacgagguggccaccggcaccgggcccaacaagaagaucgcgaagaagaacgccgccgaggccaugcuccugcagcugggcuacaaggccuccacgaaccuccaggaccagcuggagaagaccggggagaacaagggcuggagcggcccgaagcccggguuccccgagcccaccaacaacaccccgaagggcauccugcaccucucccccgacguguaccaggagauggaggcgagccgccacaaggucaucuccgggacgacccugggcuaccugagccccaaggacaugaaccagcccuccagcuccuucuucagcaucuccccgaccagcaacuccagcgccaccaucgcccgggagcuccugaugaacgggacguccagcaccgccgaggcgaucggccugaagggcuccagccccaccccgcccugcucccccgugcagcccagcaagcagcucgaguaccuggcccgcauccagggguuccaggccgcccugagcgcccucaagcaguucuccgagcagggccuggaccccaucgacggggcgaugaacaucgagaagggcagccuggagaagcaggccaagcaccuccgcgagaaggccgacaacaaccaggcgcccccgggguccaucgcccaggacugcaagaaguccaacuccgccguguga

SEQ ID NO: 37198 - RNA, 1077 nt, Artificial Sequence
  derived and/or modified sequence opt1 from STBD1__Homo_sapiens__NP_003934
augggcgccguguggagcgcccugcucgucgggggcgggcuggcgggcgcccuguucguguggcuccugcgcgggggccccggcgacaccgggaaggacggcgacgccgagcaggagaaggacgccccgcucgggggcgccgcgauccccgggggccaccaguccggcagcuccgggcugagccccggccccuccgggcaggagcuggugaccaagccggagcaccuccaggagagcaacggccaccugaucuccaagacgaaggaccugggcaagcugcaggccgccagcuggcggcuccagaaccccucccgcgaggucugcgacaacagccgggagcacgugcccuccgggcaguuccccgacaccgaggccccggcgaccagcgagaccuccaacagccgcuccuacagcgaggugucccggaacgagagccuggagucccccaugggcgaguggggguuccagaagggccaggagaucagcgccaaggccgccacgugcuucgccgagaagcugcccagcuccaaccuccugaagaaccgcgcgaaggaggagaugagccuguccgaccucaacagccaggaccgggucgaccacgaggagugggagauggugccccgccacuccagcuggggcgacgugggggucggcgggucccugaaggccccggugcugaaccucaaccagggcauggacaacgggcggagcacccugguggaggcccgcggccagcagguccacgggaagauggagcggguggccgugaugcccgccggcucccagcaggucagcgugcgcuuccaggugcacuacgucaccuccaccgacgugcaguucaucgcggugacgggcgaccacgagugccuggggcgguggaacaccuacaucccccuccacuacaacaaggacggcuucuggagccacuccaucuuccugcccgccgacaccgucguggaguggaaguucgugcuggucgagaacgggggcgugacccgcugggaggagugcagcaaccgguuccucgagacggggcacgaggacaaggucgugcacgccugguggggcauccacuga

SEQ ID NO: 37199 - RNA, 744 nt, Artificial Sequence
  derived and/or modified sequence opt1 from STC1__Homo_sapiens__NP_003146
augcugcagaacagcgccgugcuccugguccuggugaucuccgccagcgcgacccacgaggccgagcagaacgacuccgugagcccccgcaagucccgggucgccgcccagaacagcgccgagguggugcgcugccucaacuccgcgcugcaggucggcugcggggccuucgccugccuggagaacagcacgugcgacaccgacggcauguacgacaucugcaaguccuuccucuacagcgccgcgaaguucgacacccaggggaaggccuucgugaaggagucccugaagugcaucgccaacggcgugaccagcaaggucuuccuggccauccggcgcugcuccaccuuccagcggaugaucgccgaggugcaggaggagugcuacagcaagcucaacgugugcuccaucgcgaagcgcaacccggaggccaucacggaggucgugcagcugcccaaccacuucagcaaccgguacuacaaccgccuggugcggucccuccuggagugcgacgaggacaccgucagcaccauccgcgacucccugauggagaagaucgggcccaacauggccagccucuuccacauccugcagaccgaccacugcgcccagacgcacccccgggccgacuucaaccgccggcgcaccaacgagccgcagaagcugaaggugcuccugcggaaccugcgcggcgaggaggacagccccucccacaucaagcggaccagccacgaguccgcguga

SEQ ID NO: 37200 - RNA, 909 nt, Artificial Sequence
  derived and/or modified sequence opt1 from STC2__Homo_sapiens__NP_003705
augugcgccgagcgccugggccaguucaugacccucgcccuggugcuggcgaccuucgaccccgcccgggggacggacgccaccaacccgcccgagggcccccaggaccgcagcucccagcagaaggggcggcucagccugcagaacaccgccgagauccagcacugccuggucaacgccggcgacguggggugcggcguguucgagugcuucgagaacaacuccugcgagauccgcggccuccacgggaucugcaugaccuuccugcacaacgcgggcaaguucgacgcccagggcaagagcuucaucaaggacgcccugaagugcaaggcccacgcgcuccggcaccgcuucgggugcaucucccggaagugccccgccauccgcgagauggucagccagcugcagcgggagugcuaccugaagcacgaccucugcgccgccgcccaggagaacacgcgcgugaucguggagaugauccacuucaaggaccugcugcuccacgagccguacgucgaccuggugaaccugcuccugaccugcggggaggaggugaaggaggcgaucacccacuccguccaggugcagugcgagcagaacuggggcagccugugcuccauccucagcuucugcaccuccgccauccagaagccgcccacggccccgcccgagcggcagccccagguggaccgcaccaagcugagccgggcccaccacggcgaggccgggcaccaccuccccgagcccuccagccgcgagaccggccgcggggcgaagggcgagcggggcuccaagagccaccccaacgcccacgcccgggggcgcgucggcgggcugggcgcccaggggcccuccggcagcuccgagugggaggacgagcagagcgaguacagcgacauccggcgcuga

SEQ ID NO: 37201 - RNA, 1020 nt, Artificial Sequence
  derived and/or modified sequence opt1 from STEAP1__Homo_sapiens__NP_036581
auggagagccgcaaggacaucaccaaccaggaggagcuguggaagaugaagccccggcgcaaccucgaggaggacgacuaccugcacaaggacaccggcgagacguccaugcugaagcggccggugcuccugcaccuccaccagaccgcccacgccgacgaguucgacugccccagcgagcugcagcacacccaggagcuguucccccaguggcaccuccccaucaagaucgcggccaucaucgccucccugaccuuccuguacacgcugcuccgcgaggucauccacccgcuggccaccagccaccagcaguacuucuacaagauccccauccuggugaucaacaaggugcuccccauggucuccaucacccugcuggcccucguguaccugcccggggugaucgcggccaucguccagcugcacaacggcaccaaguacaagaaguucccgcacuggcucgacaaguggaugcugacgcggaagcaguucgggcugcucagcuucuucuucgccgugcugcacgccaucuacucccugagcuaccccaugcgccgguccuaccgcuacaagcuccugaacugggcguaccagcagguccagcagaacaaggaggacgccuggaucgagcacgacguguggcggauggagaucuacgugagccugggcaucguggggcucgccauccuggcccugcucgccgucaccuccauccccagcguguccgacagccugaccuggcgcgaguuccacuacauccaguccaagcugggcaucgugagccuccugcugggcaccauccacgcgcucaucuucgccuggaacaaguggaucgacaucaagcaguucgucugguacacgcccccgaccuucaugaucgccguguuccugcccaucgugguccugaucuucaaguccauccucuuccugcccugccugcggaagaagauccucaagauccgccacgggugggaggacgugaccaagaucaacaagaccgagaucugcagccagcuguga

SEQ ID NO: 37202 - RNA, 1473 nt, Artificial Sequence
  derived and/or modified sequence opt1 from STEAP2__Homo_sapiens__NP_001231873
auggagagcaucuccaugaugggcagccccaagucccugagcgagaccuuccucccgaacgggaucaacggcaucaaggacgcccgcaaggugaccgucggggugaucggcuccggggacuucgccaagagccugacgauccggcugauccgcugcggcuaccacguggucaucggcucccggaaccccaaguucgcgagcgaguucuucccccacgugguggacgucacccaccacgaggacgcccucaccaagaccaacaucaucuucguggccauccaccgcgagcacuacacgucccugugggaccugcggcaccuccugguggggaagauccugaucgacgucagcaacaacaugcgcaucaaccaguaccccgaguccaacgccgaguaccucgccagccuguucccggacucccugaucgugaagggcuucaacguggucagcgcgugggcccuccagcuggggcccaaggacgccucccgccagguguacaucugcagcaacaacauccaggcccggcagcaggucaucgagcuggcgcggcagcucaacuucauccccaucgaccugggcucccugagcuccgcccgcgagaucgagaaccucccccugcggcuguucacccucuggcgcgggccgguggugguggccaucagccuggccaccuucuucuuccuguacagcuucguccgggacgugauccaccccuacgcccgcaaccagcaguccgacuucuacaagauccccaucgagaucgugaacaagacccuccccaucgucgcgaucacgcugcugagccucguguaccuggccggccugcucgccgccgccuaccagcuguacuacggcaccaaguaccggcgcuucccgcccuggcuggagaccuggcuccagugccggaagcagcuggggcugcucuccuucuucuucgcgauggugcacgucgccuacagccugugccugcccaugcgccgguccgagcgcuaccucuuccugaacauggccuaccagcagguccacgccaacaucgagaacagcuggaacgaggaggagguguggcggaucgagauguacaucuccuucggcaucaugagccuggggcuccugucccugcucgccgugaccagcauccccuccgugagcaacgcgcugaacuggcgcgaguucuccuucauccagagcacgcugggcuacgucgcccuccugaucuccaccuuccacgugcugaucuacggcuggaagcgcgccuucgaggaggaguacuaccgguucuacaccccgcccaacuucgugcuggcccucguccugcccagcaucgugauccuggggaagaucauccucuuccugcccugcaucucccgcaagcugaagcggaucaagaagggcugggagaagucccaguuccucgaggaggggaugggcgggaccaucccgcacgugagccccgagcgcgucacggugauguga

SEQ ID NO: 37203 - RNA, 1467 nt, Artificial Sequence
  derived and/or modified sequence opt1 from STEAP3__Homo_sapiens__NP_001008410
augcccgaggagauggacaagccgcugaucagccuccaccugguggacuccgacagcucccuggccaagguccccgacgaggcccccaaggugggcauccucgggagcggcgacuucgcgcgcucccuggccacccggcugguggggagcggcuucaaggucgugguggggucccgcaaccccaagcggaccgcccgccucuucccgagcgccgcccaggucacguuccaggaggaggcgguguccagccccgaggugaucuucgucgccguguuccgggagcacuacuccagccugugcucccugagcgaccagcucgccggcaagauccugguggacgucuccaaccccaccgagcaggagcaccuccagcaccgcgagagcaacgccgaguaccuggcgucccuguucccgaccugcaccguggugaaggccuucaacgucaucagcgccuggacgcugcaggccggcccccgggacgggaaccgccaggugcccaucugcggcgaccagcccgaggccaagcgggcgguguccgagauggcccucgccaugggguucaugcccgucgacaugggcagccuggccagcgccugggagguggaggcgaugccgcugcgccuccugcccgccuggaaggugcccacccugcucgcccuggggcuguucgucugcuucuacgccuacaacuucgugcgggacgugcuccagcccuacguccaggagucccagaacaaguucuucaagcugccggugagcgucgugaacaccacccugcccugcguggccuacguccuccugucccugguguaccuccccggcgugcuggcggccgcccugcagcuccgccggggcacgaaguaccagcgcuuccccgacuggcuggaccacuggcugcagcaccggaagcagaucgggcuccugagcuucuucugcgccgcccugcacgcgcucuacuccuucugccugccgcugcgccgggcccaccgcuacgaccucgucaaccuggccgugaagcagguccuggccaacaagagccaccucuggguggaggaggagguguggcggauggagaucuaccugucccugggcgugcucgcgcuggggacccugagccugcucgccgucaccucccugcccagcaucgccaacucccugaacuggcgcgaguucagcuucgugcaguccagccucggcuucguggcccugguccuguccacccuccacacgcugaccuacggcuggacccgggccuucgaggagagccgcuacaaguucuaccugccgcccaccuucacgcucacccugcuggugcccugcguggucauccucgcgaaggcccuguuccugcuccccugcaucucccgccggcuggcccgcauccggcgcgggugggagcgggagagcaccaucaaguucacccugcccacggaccacgcccucgccgagaagaccucccacguguga

SEQ ID NO: 37204 - RNA, 852 nt, Artificial Sequence
  derived and/or modified sequence opt1 from STEAP4__Homo_sapiens__NP_001192245
auggagaagaccugcaucgacgcccugccccucaccaugaacagcuccgagaagcaggagacggugugcaucuucggcaccggggacuucggccgcagccuggggcugaagaugcuccagugcggcuacuccgucguguucgggagccggaacccgcagaagaccacccugcugcccuccggcgccgaggugcucagcuacuccgaggcggccaagaaguccggcaucaucaucaucgccauccaccgcgagcacuacgacuuccugacggagcugaccgagguccucaacgggaagauccugguggacaucagcaacaaccugaagaucaaccaguaccccgagagcaacgccgaguaccucgcccaccuggugcccggcgcgcacgucgugaaggccuucaacaccaucuccgccugggcccugcagagcggggcgcucgacgccucccggcaggccauccugaagaaggagaacccguucagcaccuccagcgccuggcuguccgacagcuacguggcccucggcauccugggguucuuccuguucguccuccugggcaucacgucccugcccagcgugagcaacgcggugaacuggcgcgaguuccgguucguccaguccaagcucggcuaccugacccugauccucugcaccgcccacacccugguguacgggggcaagcgcuuccugagccccuccaaccuccggugguaccugcccgccgccuacgugcuggggcucaucaucccgugcacgguccuggugaucaaguucgugcugaucaugcccugcgucgacaacacccucacccgcauccggcagggcugggagcgcaacagcaagcacuga

SEQ ID NO: 37205 - RNA, 387 nt, Artificial Sequence
  derived and/or modified sequence opt1 from STH__Homo_sapiens__NP_001007533
augagcgagggcgggggccagguguccugcaucuucgccgcccccacccgccugugccgguggccggcgcucaucgagugcggggucaaccugacccagccccugugcgaguggaugauccagguggcccgcgaccggacgcucagccuggccugggagguggccucccugcucacccugagcuccagcgaggucggccuggagggggugggcaccaucuggcccuccagcuacuccagcgaggaguccagccgcaacggcgccgagcaggggcggcagcucuccaucgagggccccuuccaggggcagaacugcccgagccaccccgcggccgcccugccccugcccaugcgcggcgagucccaggccaccagcugccagguguga

SEQ ID NO: 37206 - RNA, 3867 nt, Artificial Sequence
  derived and/or modified sequence opt1 from STIL__Homo_sapiens__XP_011540294
auggagcccaucuacccguucgcccgcccccagaugaacacccgguuccccagcucccgcauggugcccuuccacuucccgcccagcaagugcgcccuguggaaccccacccccacgggcgacuucaucuaccuccaccuguccuacuaccggaacccgaagcuggucgugaccgagaagaccauccgccucgcguaccggcacgccaagcagaacaagaagaacagcuccugcuuccugcuggggagccucaccgccgacgaggacgaggagggcgugacgcugaccgucgaccgcuucgaccccgggcgggaggugcccgagugccuggagaucacccccaccgccucccucccgggcgacuuccugauccccugcaaggugcacacgcaggagcugugcagccgcgagaugaucguccacuccguggacgacuucagcuccgcccucaaggcgcugcagugccacaucugcagcaaggacucccuggacugcgggaagcuccugagccugcgggugcacaucaccucccgcgagagccucgacuccgucgaguucgaccugcacugggccgccgugacccuggccaacaacuucaagugcacccccgugaagcccaucccgaucauccccacggcgcucgcccggaaccugagcuccaaccugaacaucagccagguccagggcaccuacaaguacggcuaccucaccauggacgagacccgcaagcugcugcuccugcuggagagcgaccccaagguguacucccucccccugguggggaucuggcugagcggcaucacgcacaucuacuccccgcaggucugggccugcugccuccgguacaucuucaacagcuccgugcaggagcgcguguucagcgaguccgggaacuucaucaucguccuguacagcaugacccacaaggagcccgaguucuacgagugcuuccccugcgacggcaagauccccgacuuccgguuccagcugcucaccuccaaggagacccugcaccuguucaagaacguggagccgcccgacaagaaccccauccgcugcgagcucagcgccgagucccagaacgccgagacggaguucuucagcaaggcguccaagaacuucagcaucaagcgguccagccagaagcuguccagcgggaagaugcccauccacgaccacgacuccggcguggaggacgaggacuucagcccgcgccccauccccagcccgcaccccgucucccagaagaucagcaagauccagcccuccgugcccgagcugagccucgugcuggacggcaacuucaucgaguccaacccgcugcccacgccccucgagauggucaacaacgagaacccgccccugaucaaccaccuggagcaccucaagccccugcagccccagcuguacgacgagaagcacagccccgagguggaggccggggagccgucccugcggggcauccccaaccagcucaaccaggacaagcccgcccugcugcgccacugcaagguccggcagcccccggccuacaagaaggggaacccccacacccgcaacagcaucaagcccuccagccacaacggccccucccacgacaucuucgagaagcuccagaccgugagcgccggcaacgugcagaacgaggaguacccgauccgccccuccacccugaacagccggcaguccagccuggcgccccagucccagccccacgacuucgucuucagcccgcacaacagcgggcgccccauggagcuccagauccccaccccgccccugcccuccuacugcagcaccaacgugugccggugcugccagcaccacucccacauccaguacagcccccugaacuccuggcagggcgccaacaccguggggagcauccaggacguccaguccgaggcccuccagaagcacagccuguuccacccguccggcugccccgcccuguacugcaacgccuucugcagcuccagcucccccaucgcgcuccgcccccagggggacaugggcagcugcuccccgcacagcaacaucgagcccucccccguggcccggcccccgagccacauggaccugugcaacccccagcccugcacggugugcaugcacacccccaagaccgaguccgacaacggcaugauggggcugagcccggacgccuaccgcuuccucaccgagcaggaccggcagcugcgccugcuccaggcccagauccagcggcugcuggaggcccagagccucaugcccugcucccccaagacgaccgcggucgaggacaccgugcaggccggccgccagauggagcuggugagcgucgaggcccaguccagccccgggcugcacaugcggaagggcguguccaucgccgugagcaccggggcgucccucuucuggaacgccgccggcgaggaccaggagccggacagccagaugaagcaggacgacacgaagaucuccagcgaggacaugaacuucuccgucgacaucaacaacgaggugaccagccugcccggcuccgccagcucccugaaggccguggacauccccagcuucgaggaguccaacaucgcggucgaggaggaguucaaccagccccucagcguguccaacagcagcucccuggugguccgcaaggagccggacgugcccguguucuuccccagcgggcagcuggccgaguccgucagcaugugccuccagaccggccccaccgggggcgccuccaacaacagcgagaccuccgaggagccgaagaucgagcacgugaugcagccccugcugcaccagcccagcgacaaccagaagaucuaccaggaccuccugggccaggugaaccaccuccugaacuccagcuccaaggagacggagcagccgagcaccaaggccgucaucaucucccacgagugcacccggacccagaacguguaccacacgaagaagaagacccaccacagccgccugguggacaaggacugcguccugaacgccacccucaagcagcugcggucccugggggugaagaucgacagccccaccaaggugaagaagaacgcgcacaacgucgaccacgccuccgugcucgccugcaucagccccgaggccgugaucuccggccugaacugcaugagcuucgccaacgucgggaugagcggccugucccccaacgggguggaccucagcauggaggcgaacgccaucgcccugaaguaccugaacgagaaccagcucucccagcugagcgugacgcgcuccaaccagaacaacugcgacccguucagccugcuccacaucaacaccgaccgguccaccgucggccugagccugaucucccccaacaacaugagcuucgccaccaagaaguacaugaagcgcuacggccuccugcaguccagcgacaacuccgaggacgaggaggagccgcccgacaacgcggacagcaaguccgaguaccugcucaaccagaaccugcggagcauccccgagcagcucgggggccagaaggagcccuccaagaacgaccacgagaucaucaacugcagcaacugcgaguccguggggacgaacgccgacacccccgugcugcgcaacaucaccaacgagguccugcagaccaaggccaagcagcagcugacggagaagcccgccuuccucgugaagaaccugaagccgagccccgccgugaaccugcgcaccggcaaggcggaguucacccagcaccccgagaaggagaacgagggggacaucaccaucuuccccgagagccuccagccguccgagacgcugaagcagaugaacagcaugaacuccgucggcaccuuccuggacgugaagcggcuccgccagcugcccaagcuguucuga

SEQ ID NO: 37207 - RNA, 2058 nt, Artificial Sequence
  derived and/or modified sequence opt1 from STIM1__Homo_sapiens__NP_003147
auggacgugugcguccgccuggcccucuggcugcuguggggccuccugcugcaccaggggcagagccucucccacagccacuccgagaaggccaccggcaccagcuccggggcgaacagcgaggaguccacggccgccgaguucugccggaucgacaagccccugugccacagcgaggacgagaagcuguccuucgaggccgugcgcaacauccacaagcucauggacgacgacgccaacggcgacguggacgucgaggagagcgacgaguuccugcgggaggaccugaacuaccacgacccgaccgugaagcacuccaccuuccacggggaggacaagcucaucagcguggaggaccuguggaaggcguggaaguccagcgaggucuacaacuggaccguggacgaggugguccaguggcugaucacguacguggagcucccccaguacgaggagaccuuccgcaagcugcagcuguccggccacgccaugccccggcucgccgugaccaacaccacgaugaccggcaccguccugaagaugaccgaccgcagccaccggcagaagcugcagcucaaggcccuggacacggugcuguucgggcccccgcuccugacccgccacaaccaccugaaggacuucaugcucguggucuccaucgugaucggcgucgggggcugcugguucgcguacauccagaaccgguacagcaaggagcacaugaagaagaugaugaaggaccuggaggggcugcaccgcgccgagcagucccuccacgaccugcaggagcggcugcacaaggcccaggaggagcaccgcaccguggagguggagaaggugcaccucgagaagaagcugcgggacgagaucaaccuggccaagcaggaggcccagcgccucaaggagcugcgggagggcaccgagaacgagcgcagccggcagaaguacgcggaggaggagcuggagcagguccgcgaggcccuccggaaggccgagaaggagcuggagagccacuccagcugguacgcccccgaggcccugcagaaguggcuccagcugacgcacgagguggaggugcaguacuacaacaucaagaagcagaacgcggagaagcagcugcucgucgccaaggagggcgccgagaagaucaagaagaagcgcaacacccuguucgggaccuuccacguggcccacuccagcucccuggacgacgucgaccacaagauccucaccgccaagcaggcgcugagcgaggugacggccgcccugcgggagcgccugcaccgcuggcagcagaucgagauccucugcggcuuccagaucgugaacaaccccgggauccacucccuggucgccgcccugaacaucgaccccagcuggaugggcuccacccggccgaaccccgcgcacuucaucaugaccgacgacguggacgacauggacgaggagaucgugagcccccucuccaugcagagccccucccugcagagcuccguccgccagcggcugaccgagccgcagcacggccucgggagccagcgcgaccugacgcacuccgacagcgaguccagccugcacaugagcgaccggcagcgcguggcccccaagccgccccagaugucccgggccgccgacgaggcgcucaacgccaugaccagcaacggcucccaccgccugaucgagggggugcaccccggcagccuggucgagaagcuccccgacucccccgcccuggccaagaaggcccugcucgcgcugaaccacgggcuggacaaggcccacagccucauggagcugucccccagcgccccgcccggcggcagcccccaccuggacuccucccggagccacucccccagcuccccggaccccgacacccccagccccgugggggacucccgcgcccuccaggccagccggaacacccgcaucccgcaccuggcgggcaagaaggccguggccgaggaggacaacgggagcaucggcgaggagacggacuccagccccgggcggaagaaguucccccugaagaucuucaagaagccgcucaagaaguga

SEQ ID NO: 37208 - RNA, 1800 nt, Artificial Sequence
  derived and/or modified sequence opt1 from STIM2__Homo_sapiens__NP_001162588
augcuggugcucggccugcuggucgccggggccgccgacggcugcgagcucgugccccgccaccuccgggggcgccgggccaccggcagcgccgccaccgccgcguccagcccggccgccgccgcgggggacucccccgcccugaugacggaccccugcaugagccugagcccgcccugcuucaccgaggaggaccgcuucucccuggaggcccugcagaccauccacaagcagauggacgacgacaaggacggcggcaucgagguggaggaguccgacgaguucauccgggaggacaugaaguacaaggacgccaccaacaagcacagccaccuccaccgcgaggacaagcacaucacgaucgaggaccuguggaagcgguggaagaccuccgagguccacaacuggacccuggaggacacccuccaguggcugaucgaguucguggagcugccccaguacgagaagaacuuccgcgacaacaacgugaaggggacgacccucccccggaucgccguccacgagcccagcuucaugaucucccagcugaagaucagcgaccgcucccaccggcagaagcugcagcucaaggcgcuggacguggugcuguucggcccgcucacccgcccgccccacaacuggaugaaggacuucauccugaccgucagcaucgugaucggggugggcgggugcugguucgccuacacgcagaacaagaccuccaaggagcacgucgccaagaugaugaaggaccuggagagccuccagaccgccgagcagucccugauggaccugcaggagcggcucgagaaggcccaggaggagaaccgcaacguggcgguggagaagcagaaccuggagcggaagaugauggacgagaucaacuacgccaaggaggaggccugccgccugcgggagcuccgcgagggcgccgagugcgagcugagccggcgccaguacgccgagcaggagcuggagcagguccggauggcgcucaagaaggccgagaaggaguucgagcugcgcuccagcuggagcgugcccgacgcccugcagaaguggcuccagcugacccacgagguggagguccaguacuacaacaucaagcgccagaacgccgagaugcagcuggccaucgcgaaggacgaggccgagaagaucaagaagaagcgguccacgguguucggcacccuccacguggcccacagcuccagccuggacgaggucgaccacaagauccuggaggccaagaaggcgcucuccgagcugacgaccugccugcgcgagcgccucuuccgguggcagcagaucgagaagaucugcggguuccagaucgcccacaacagcggccugcccucccugaccagcucccucuacagcgaccacuccuggguggugaugccccgggucagcaucccgcccuaccccaucgccgggggcguggacgaccuggacgaggacaccccgcccaucgucucccaguuccccggcaccauggccaagccgcccgggagccuggcccgcuccagcucccugugccggagccgccgguccaucgugcccagcagcccccagccccagcgcgcgcagcucgcgccccacgcgccccaccccucccacccgcggcacccccaccacccccagcacaccccgcacagccugcccucccccgaccccgacauccugagcguguccagcugcccggcccucuaccgcaacgaggaggaggaggaggccaucuacuucuccgccgagaagcagugcauccaccugggccugggggccugcaagagcgaguga

SEQ ID NO: 37209 - RNA, 1632 nt, Artificial Sequence
  derived and/or modified sequence opt1 from STIP1__Homo_sapiens__NP_006810
auggagcaggucaacgagcugaaggagaagggcaacaaggcccucagcguggggaacaucgacgacgcccugcagugcuacuccgaggcgaucaagcuggacccccacaaccacgugcucuacagcaaccgcuccgccgccuacgccaagaagggcgacuaccagaaggccuacgaggacgggugcaagaccguggaccugaagccggacuggggcaagggguacagccggaaggcggccgcccuggaguuccucaaccgcuucgaggaggccaagcggaccuacgaggagggccugaagcacgaggcgaacaacccccagcugaaggagggccuccagaacauggaggcccgccuggccgagcggaaguucaugaaccccuucaacaugcccaaccuguaccagaagcucgaguccgacccgcgcacgcggacccugcugagcgaccccaccuaccgcgagcucaucgagcagcugcggaacaagcccuccgaccuggggaccaagcuccaggacccccgcaucaugacgacccugagcguccugcucggcguggaccugggguccauggacgaggaggaggagaucgccaccccgcccccgccgcccccgcccaagaaggagaccaagcccgagcccauggaggaggaccugcccgagaacaagaagcaggcccucaaggagaaggagcugggcaacgacgcguacaagaagaaggacuucgacacggcccugaagcacuacgacaaggccaaggagcucgaccccaccaacaugaccuacaucaccaaccaggccgccguguacuucgagaagggggacuacaacaagugccgggagcugugcgagaaggcgaucgaggucggccgcgagaaccgggaggacuaccgccagaucgccaaggccuacgcccggaucggcaacagcuacuucaaggaggagaaguacaaggacgccauccacuucuacaacaagucccuggcggagcaccgcacgcccgacgugcucaagaagugccagcaggccgagaagauccugaaggagcaggagcggcuggccuacaucaaccccgaccucgcccuggaggagaagaacaaggggaacgagugcuuccagaagggcgacuacccccaggccaugaagcacuacaccgaggcgaucaagcgcaaccccaaggacgccaagcuguacagcaaccgggccgccugcuacaccaagcuccuggaguuccagcuggcgcucaaggacugcgaggagugcauccagcuggagcccaccuucaucaagggguacacgcgcaaggccgccgcccuggaggccaugaaggacuacaccaaggcgauggacguguaccagaaggcccucgaccuggacuccagcugcaaggaggccgccgacggcuaccagcggugcaugauggcccaguacaaccgccacgacuccccggaggacgucaagcgccgggcgauggccgaccccgaggugcagcagaucaugagcgaccccgccaugcgccugauccucgagcagaugcagaaggacccccaggcccuguccgagcaccugaagaacccggugaucgcccagaagauccagaagcucauggacgucggccugaucgcgauccgguga

SEQ ID NO: 37210 - RNA, 2907 nt, Artificial Sequence
  derived and/or modified sequence opt1 from STK10__Homo_sapiens__NP_005981
auggccuucgccaacuuccgccggauccugcgccucagcaccuucgagaagcggaagucccgcgaguacgagcacgugcggcgcgaccuggaccccaacgaggucugggagaucgugggcgagcugggggacggcgcguucgggaagguguacaaggccaagaacaaggagaccggcgcccucgccgccgcgaaggucaucgagaccaagagcgaggaggagcuggaggacuacaucguggagaucgagauccuggcgaccugcgaccacccguacaucgugaagcuccugggggccuacuaccacgacggcaagcuguggaucaugaucgaguucugccccggcggggccgucgacgcgaucaugcucgagcuggaccggggccugaccgagccccagauccagguggugugccgccagaugcucgaggcccugaacuuccugcacuccaagcggaucauccaccgcgaccucaaggccgggaacguccugaugacccuggagggcgacauccggcucgccgacuucggggugagcgccaagaaccugaagacgcugcagaagcgcgacuccuucaucggcacccccuacuggauggcgccggagguggucaugugcgagaccaugaaggacacccccuacgacuacaaggccgacaucuggagccucggcaucacgcugaucgagauggcccagaucgagccgccccaccacgagcugaaccccaugcgggugcuccugaagaucgccaaguccgacccgcccacccugcucacccccagcaagugguccguggaguuccgcgacuuccugaagaucgcccuggacaagaaccccgagacccggcccagcgcggcccagcuccuggagcaccccuucgucuccagcaucacguccaacaaggcccugcgcgagcucguggccgaggccaaggcggaggugauggaggagaucgaggacgggcgggacgagggcgaggaggaggacgccgucgacgccgccagcacgcuggagaaccacacccagaacuccagcgagguguccccgcccagccugaacgccgacaagccccucgaggagucccccagcacgccccuggccccgagccagucccaggacagcgugaacgagcccugcucccagcccagcggggaccgcucccugcagaccaccagcccgcccgucguggcccccggcaacgagaacggccucgccgugcccgucccccugcggaagucccgcccggugagcauggacgcccggauccaggucgcgcaggagaagcaggucgccgagcagggcggggaccugucccccgccgccaaccgcagccagaaggccucccagagccgccccaacuccagcgcgcucgagacccucgggggcgagaagcuggccaacgggucccuggagccgcccgcccaggccgcccccggccccagcaagcgggacuccgacugcagcucccugugcaccagcgagagcauggacuacggcacgaaccuguccaccgaccucagccugaacaaggagauggggucccugagcaucaaggacccgaagcuguacaagaagacccucaagcgcacccggaaguucgugguggacggcguggagguguccaucacgaccagcaagaucaucuccgaggacgagaagaaggacgaggagaugcgcuuccugcggcgccaggagcugcgggagcuccgccugcugcagaaggaggagcaccggaaccagacccagcucagcaacaagcacgagcugcagcuggagcagaugcacaagcgcuucgagcaggagaucaacgcgaagaagaaguucuucgacaccgagcucgagaaccuggagcggcagcagaagcagcaggucgagaagauggagcaggaccacgccgugcgccggcgcgaggaggcccggcgcauccggcuggagcaggaccgcgacuacacgcgguuccaggagcagcucaagcugaugaagaaggaggugaagaacgaggucgagaagcugccccgccagcagcgcaaggaguccaugaagcagaagauggaggagcacacccagaagaagcagcuccuggaccgggacuucguggccaagcagaaggaggaccuggagcucgccaugaagcgccugaccaccgacaaccggcgcgagaucugcgacaaggagcgggagugccugaugaagaagcaggagcuccugcgcgaccgggaggcggcccugugggagauggaggagcaccagcuccaggagcgccaccagcuggugaagcagcagcugaaggaccaguacuuccuccagcggcacgagcugcugcgcaagcacgagaaggagcgggagcagaugcagcgcuacaaccagcggaugaucgagcagcucaagguccgccagcagcaggagaaggcccggcugcccaagauccagcgcagcgaggggaagacgcggauggccauguacaagaagucccugcacaucaacggcgggggcagcgcggccgagcagcgcgagaagaucaagcaguucucccagcaggaggagaagcggcagaaguccgagcgccuccagcagcagcagaagcacgagaaccagaugcgggacaugcuggcccagugcgagagcaacaugagcgagcugcagcagcuccagaacgagaagugccaccuccugguggagcacgagacccagaagcugaaggcccuggacgagucccacaaccagaaccugaaggaguggcgcgacaagcuccgcccccggaagaaggcccuggaggaggaccugaaccagaagaagcgcgagcaggagauguucuucaagcucagcgaggaggcggagugcccgaaccccagcacccccuccaaggccgccaaguucuuccccuacagcuccgccgacgccagcuga

SEQ ID NO: 37211 - RNA, 1302 nt, Artificial Sequence
  derived and/or modified sequence opt1 from STK11__Homo_sapiens__NP_000446
auggagguggucgacccccagcagcugggcauguucaccgagggggagcucaugagcgugggcauggacaccuucauccaccgcaucgacuccacggaggugaucuaccagccgcggcgcaagcgggccaagcugaucgggaaguaccugaugggcgaccuccugggggagggcagcuacggcaaggucaaggaggugcuggacuccgagacccucugccgccgggccgugaagauccugaagaagaagaagcugcgccggauccccaacggggaggcgaacgucaagaaggagauccagcuccugcgccggcugcgccacaagaacgugauccagcucguggacguccuguacaacgaggagaagcagaagauguacauggugauggaguacugcgugugcggcaugcaggagaugcuggacagcguccccgagaagcgguuccccgugugccaggcccacggguacuucugccagcucaucgacggccuggaguaccugcacucccaggggaucgugcacaaggacaucaagccgggcaaccuccugcugaccaccggcgggacgcucaagaucagcgaccugggcgucgccgaggcccugcaccccuucgccgcggacgacacgugccgcaccucccaggggagccccgccuuccagcccccggagaucgccaacggccucgacaccuucuccggcuucaagguggacaucuggagcgccggggugacccuguacaacaucaccaccggccuguaccccuucgagggggacaacaucuacaagcuguucgagaacaucggcaagggguccuacgcgauccccggcgacugcgggcccccgcucagcgaccugcucaaggggaugcuggaguacgagcccgccaagcgguucuccauccgccagauccggcagcacagcugguuccgcaagaagcacccgcccgccgaggcccccguccccaucccgcccucccccgacaccaaggaccgguggcgcagcaugacgguggugcccuaccuggaggaccuccacggcgccgacgaggacgaggaccuguucgacaucgaggacgacaucaucuacacccaggacuucaccguccccggccaggugcccgaggaggaggcgucccacaacggccagcggcgcgggcugccgaaggccgugugcaugaacggcaccgaggccgcccagcucagcacgaagucccgggccgagggccgcgcgcccaaccccgcccgcaaggccugcagcgccagcuccaagauccggcgccugagcgccugcaagcagcaguga

SEQ ID NO: 37212 - RNA, 3267 nt, Artificial Sequence
  derived and/or modified sequence opt1 from STK11IP__Homo_sapiens__NP_443134
augaccaccgcccagcgcgacagccugcucuggaagcuggccggccugcuccgggaguccggggacgugguccugagcggcugcuccacccugagccuccugacccccacccugcagcagcucaaccacguguucgagcugcaccuggggccguggggccccgggcagaccggcuucguggcgcuccccucccaccccgccgacagcccggucauccugcagcugcaguuccucuucgacgugcugcagaagacgcugucccucaagcuggugcacgucgccggccccgggcccaccggccccaucaagaucuucccguucaagagccugcgccaccucgagcugcgcggggugccccugcacugccuccacggccugcgggggaucuacucccagcuggagacccucaucugcagccggucccugcaggcccuggaggagcuccugagcgccugcggcggcgacuucugcuccgcgcugcccuggcucgcccugcugagcgccaacuucuccuacaacgcccucaccgcgcuggacagcucccugcgccuccugagcgcccugcgguuccucaaccugucccacaaccaggugcaggacugccagggguuccugauggaccucugcgagcugcaccaccuggacaucagcuacaaccgccuccaccuggucccccggaugggcccgagcggggccgcccugggcgugcugauccuccgcggcaacgagcugcggucccugcacgggcucgagcagcugcgcaaccugcggcaccucgaccuggccuacaaccugcucgagggccaccgcgagcugagcccccuguggcuccuggcggagcugcggaagcucuaccuggaggggaacccccugugguuccaccccgagcaccgcgccgccacggcccaguaccucuccccgcgggcccgcgacgcggccaccggcuuccugcuggacgggaaggugcucagccugaccgacuuccagacccacacgucccugggccucagccccaugggcccgccccugcccuggcccgucggguccacccccgagaccagcggcgggcccgaccuguccgacagccucuccagcggcgggguggugacccagccgcugcugcacaaggucaagucccgggugcgcgugcggcgcgccagcaucuccgagcccagcgacacggaccccgagccccgcacccucaacccgucccccgccggcugguucguccagcagcaccccgagcuggagcugaugagcuccuuccgggagcgcuucggccggaacuggcuccaguaccgcagccaccuggagccgagcgggaacccccugcccgccacccccaccacguccgcgccgagcgccccgcccgccuccagccagggccccgacaccgcgccccggcccuccccgccccaggaggaggcccgcgggccccaggagagcccccagaagauguccgaggaggugcgggccgagccccaggaggaggaggaggagaaggagggcaaggaggagaaggaggagggggagaugguggagcagggcgaggaggaggccggcgaggaggaggaggaggagcaggaccagaaggaggucgaggccgagcucugccgcccccugcuggugugcccgcucgaggggcccgagggcgugcgggggcgcgagugcuuccugcgggucaccagcgcccaccuguucgagguggagcuccaggcggcccgcacccuggagcggcuggagcuccagucccuggaggccgccgagaucgagcccgaggcccaggcgcagcgcagcccccggccgacgggcuccgaccugcuccccggcgcccccauccugagccugcgcuucuccuacaucugccccgaccggcagcuccgccgguaccugguccuggagccggacgcccacgccgccgugcaggagcuccuggcggugcugacccccgucaccaacguggcccgcgagcagcucggggaggcccgcgaccugcugcucggccgguuccagugccugcgcugcgggcacgaguucaagcccgaggagccgcggaugggccuggacagcgaggagggguggcgcccccucuuccagaagaccgagucccccgccgugugccccaacugcggcagcgaccacgucgugcugcuggccgugucccggggcacgccgaaccgcgagcggaagcagggggagcagagccucgcgcccagccccuccgccagccccgucugccacccgcccggccacggggaccaccuggaccgcgccaagaacuccccgccccaggcccccagcacccgggaccacggcuccuggagccuguccccgccgcccgagcgcugcgggcuccggagcguggaccaccgccugcggcuguuccucgacguggaggucuucuccgacgcgcaggaggaguuccagugcugccugaaggugcccguggcccuggccggccacaccggcgaguucaugugccucgucguggugagcgaccgccggcuguaccugcucaaggucaccggggagaugcgcgagccgcccgccuccuggcugcagcugacgcucgccgugccccugcaggaccugagcggcaucgagcucgggcuggcgggccagucccugcggcucgagugggccgccggggccggccgcugcgugcugcugccccgggacgcccgccacugccgggcguuccucgaggagcugcuggacguccuccagagccugccgcccgccuggcgcaacugcguguccgccaccgaggaggaggugacgccccagcaccgccuguggccccugcucgagaaggacagcucccuggaggcccggcaguucuucuaccugcgcgccuuccucgucgagggccccuccacgugccuggugagccugcuccugacccccagcacccuguuccuccuggacgaggacgcggccgggagccccgccgagcccuccccgcccgccgcgagcggcgaggccuccgagaaggugccgcccagcgggcccggccccgccguccgggugcgcgagcagcagccccuguccagccucuccagcgugcugcuguaccgguccgcccccgaggaccuccgccugcuguucuacgacgaggucagccggcucgaguccuucugggcccugcgcguggugugccaggagcagcugaccgcgcuccuggccuggauccgggagcccugggaggagcuguucagcaucgggcuccgcaccgucauccaggaggcccuggcccuggaccgguga

SEQ ID NO: 37213 - RNA, 1245 nt, Artificial Sequence
  derived and/or modified sequence opt1 from STK17A__Homo_sapiens__NP_004751
augaucccccuggagaagccgggcagcgggggcuccagccccggggccaccuccggcagcgggcgcgccggccggggccucuccgggcccugccggcccccgcccccgccccaggcgcgcggccugcugaccgagauccgcgccgugguccggacggagcccuuccaggacggguacagccucugccccggccgcgagcuggggcggggcaaguucgccguggugcgcaagugcaucaagaaggacuccggcaaggaguucgccgccaaguucaugcggaagcgccggaaggggcaggacugccgcauggagaucauccacgagaucgcgguccuggagcucgcccaggacaaccccugggugaucaaccugcacgagguguacgagaccgccagcgagaugauccugguccucgaguacgccgcgggcggggagaucuucgaccagugcguggccgaccgggaggaggccuucaaggagaaggacgugcagcgccugaugcggcagauccuggagggcguccacuuccuccacacccgcgacguggugcaccuggaccugaagccccagaacauccuccugaccuccgagagcccgcugggcgacaucaagaucgucgacuucgggcucucccggauccugaagaacagcgaggagcugcgcgagaucaugggcacgcccgaguacguggcccccgagauccucuccuacgaccccaucagcauggccaccgacaugugguccaucggggugcugaccuacgucaugcugaccggcaucagcccguuccucgggaacgacaagcaggagacguuccugaacaucucccagaugaaccugagcuacuccgaggaggaguucgacgugcucagcgagagcgcgguggacuucauccggacccugcuggucaagaagcccgaggaccgcgccaccgccgaggagugccucaagcaccccuggcugacccaguccagcauccaggagcccuccuuccggauggagaaggcccuggaggaggccaacgcgcuccaggagggccacagcgugccggagaucaacuccgacacggacaagagcgagaccaaggaguccaucgugaccgaggagcugaucgucgugaccagcuacacgcugggccagugccgccaguccgagaaggagaagauggagcagaaggccaucagcaagcgcuucaaguucgaggagccccuccugcaggagauccccggggaguucaucuacuga

SEQ ID NO: 37214 - RNA, 1119 nt, Artificial Sequence
  derived and/or modified sequence opt1 from STK17B__Homo_sapiens__NP_004217
augagccgccggcgcuucgacugccgguccaucagcggccugcucaccaccacgccccagaucccgaucaagauggagaacuucaacaacuucuacauccugaccuccaaggagcuggggcgcggcaaguucgccgugguccggcagugcaucagcaaguccaccgggcaggaguacgccgcgaaguuccucaagaagcgccggcgcggccaggacugccgggccgagauccugcacgagaucgccgugcuggagcucgccaagagcugcccccgcgugaucaaccugcacgaggucuacgagaacaccuccgagaucauccugauccucgaguacgccgcgggcggcgagaucuucagccugugccugcccgagcucgccgagaugguguccgagaacgacgugauccggcugaucaagcagauccuggagggcgucuacuaccuccaccagaacaacaucgugcaccuggaccugaagccccagaacauccuccugagcuccaucuacccgcugggggacaucaagaucguggacuucggcaugagccgcaagaucgggcacgccugcgagcuccgggagaucaugggcacgcccgaguaccuggcccccgagauccugaacuacgaccccaucaccaccgcgaccgacauguggaacaucgggaucaucgccuacaugcuccugacgcacaccuccccguucgucggcgaggacaaccaggagaccuaccugaacaucagccaggugaacguggacuacuccgaggagaccuucagcuccgucagccagcucgccacggacuucauccagucccugcuggugaagaaccccgagaagcgccccaccgccgagaucugccucagccacagcuggcugcagcagugggacuucgagaaccuguuccaccccgaggagaccuccagcuccagccagacccaggaccacuccgugcggagcuccgaggacaagacgagcaaguccagcugcaacgggaccugcggggaccgcgaggacaaggagaacaucccggaggacuccagcauggucuccaagcgguuccgcuucgacgacagccuccccaacccccacgagcugguguccgaccugcucugcuga

SEQ ID NO: 37215 - RNA, 1095 nt, Artificial Sequence
  derived and/or modified sequence opt1 from STK19__Homo_sapiens__NP_004188
augcagaagugguucagcgccuucgacgacgccaucauccagcgccaguggcgggcgaaccccucccgcggcgggggcggggugagcuucaccaaggaggucgacaccaacguggccacgggcgccccgccccggcgccagcgggugcccgggcgcgccugccccuggcgggagccgauccgcggccggcgcggcgcccggcccgggggcggggacgcgggcgggacccccggcgagaccguccgccacugcuccgcccccgaggacccgaucuuccgguucagcucccugcacagcuaccccuuccccggcaccaucaagucccgcgacaugagcuggaagcggcaccaccucauccccgagacguucggggugaagcgccggcgcaagcggggcccgguggaguccgacccccugcgcggggagcccggcagcgcccgggccgcggucuccgagcugaugcagcuguucccccgcggccucuucgaggacgcccugccgcccaucgugcuccgcagccagguguacucccugguccccgaccggaccguggccgaccgccagcugaaggagcuccaggagcagggggagauccggaucgugcagcugggcuucgaccuggacgcccacgggaucaucuucaccgaggacuaccgcacccggguccucaaggccugcgacggccgccccuacgcgggggccgugcagaaguuccuggccagcgugcugccggccugcggcgaccucuccuuccagcaggaccagaugacgcagaccuucggcuuccgggacagcgagaucacccaccuggucaacgccggggugcugaccgugcgcgacgcgggcuccugguggcucgccguccccggggccggccgguucaucaaguacuucgugaaggggcgccaggccgugcugagcaugguccggaaggccaaguaccgcgagcugcuccuguccgagcugcucggccggcgcgcgcccguggugguccggcugggccugacguaccacgugcacgaccucaucggggcccagcuggucgacugcaucagcaccaccagcggcacccugcuccgccugcccgagacguga

SEQ ID NO: 37216 - RNA, 1296 nt, Artificial Sequence
  derived and/or modified sequence opt1 from STK24__Homo_sapiens__NP_001027467
auggcccacagccccgugcaguccggccugccggggaugcagaaccucaaggccgaccccgaggagcuguucaccaagcuggagaagaucggcaaggggagcuucggcgaggucuucaaggggaucgacaaccgcacccagaaggugguggcgaucaagaucaucgaccucgaggaggccgaggacgagaucgaggacauccagcaggagaucacgguccugucccagugcgacagccccuacgugaccaaguacuacggcuccuaccugaaggacaccaagcucuggaucaucauggaguaccugggcgggggcagcgcccuggaccuccuggagcccgggccgcuggacgagacccagaucgccacgauccuccgggagauccugaagggccuggacuaccuccacuccgagaagaagauccaccgcgacaucaaggccgcgaacgugcugcugagcgagcacggggaggucaagcucgccgacuucggcguggccggccagcugaccgacacccagaucaagcggaacaccuucguggggacgcccuucuggauggcccccgaggucaucaagcaguccgcguacgacagcaaggccgacaucuggucccugggcaucaccgccaucgagcucgcccgcggggagcccccgcacagcgagcugcaccccaugaaggugcuguuccucauccccaagaacaacccgcccacccuggagggcaacuacuccaagccccugaaggaguucguggaggccugccucaacaaggagcccagcuuccggcccaccgcgaaggagcugcugaagcacaaguucauccuccgcaacgccaagaagacguccuaccugaccgagcugaucgaccgguacaagcgcuggaaggccgagcagagccacgacgacuccagcuccgaggacagcgacgccgagaccgacggccaggccagcgggggcuccgacagcggggacuggaucuucaccauccgggagaaggacccgaagaaccucgagaacggcgcgcugcagcccuccgaccuggaccgcaacaagaugaaggacauccccaagcggcccuucagccagugccucuccacgaucaucagcccgcuguucgccgagcugaaggagaagucccaggccugcgggggcaaccucggcagcaucgaggagcugcgcggggccaucuaccuggccgaggaggcgugccccggcaucuccgacaccauggucgcccagcucgugcagcggcugcagcgcuacagccuguccgggggcgggaccagcucccacuga

SEQ ID NO: 37217 - RNA, 1281 nt, Artificial Sequence
  derived and/or modified sequence opt1 from STK25__Homo_sapiens__NP_001258907
auggcccaccuccgcggcuucgccaaccagcacagccggguggaccccgaggagcuguucaccaagcuggaccgcaucgggaagggcuccuucggggaggucuacaagggcaucgacaaccacaccaaggaggugguggcgaucaagaucaucgaccuggaggaggccgaggacgagaucgaggacauccagcaggagaucacgguccucagccagugcgacuccccguacaucacccgguacuucgggagcuaccugaaguccaccaagcuguggaucaucauggaguaccucggcggcgggagcgcccuggaccugcucaagcccggcccccuggaggagaccuacaucgccacgauccugcgcgagauccucaaggggcuggacuaccugcacuccgagcggaagauccaccgcgacaucaaggccgcgaacgugcuccugagcgagcagggcgacgugaagcuggccgacuucggggucgccggccagcucaccgacacccagaucaagcggaacaccuucgugggcacgcccuucuggauggccccggaggugaucaagcaguccgcguacgacuucaaggccgacaucuggagccuggggaucaccgccaucgagcuggccaagggcgagccgcccaacuccgaccuccaccccaugcgcguccuguuccugauccccaagaacagcccgcccacccucgaggggcagcacuccaagcccuucaaggaguucguggaggccugccugaacaaggacccccgguuccgccccaccgcgaaggagcugcucaagcacaaguucaucacgcgguacaccaagaagaccagcuuccugaccgagcugaucgaccgcuacaagcgguggaaguccgagggccacggcgaggagagcuccagcgaggacuccgacaucgacggggaggccgaggacggcgagcaggggcccaucuggacguucccgcccaccauccgccccagcccccacagcaagcuccacaagggcaccgcccugcacuccagccagaagcccgccgagccggugaagcggcagccccgcucccagugccugagcacccucguccggcccguguucggggagcugaaggagaagcacaagcaguccggcggcagcgugggggcccuggaggagcucgagaacgcguucucccuggccgaggagagcugccccggcaucuccgacaagcugaugguccaccucguggagcgcgugcagcgguucagccacaaccgcaaccaccugacguccacccgguga

SEQ ID NO: 37218 - RNA, 1065 nt, Artificial Sequence
  derived and/or modified sequence opt1 from STK26__Homo_sapiens__NP_001035917
auggcccacagccccguggccguccaggugccgggcaugcagaacaacaucgcggaccccgaggagcuguucaccaagcucgagcgcaucgggaagggcuccuucggggagguguucaagggcaucgacaaccggacccagcaggucguggccaucaagaucaucgaccuggaggaggccgaggacgagaucgaggacauccagcaggagaucacggugcugagccagugcgacuccagcuacgucaccaaguacuacggguccuaccucaagggcagcaagcuguggaucaucauggaguaccugggcgggggcuccgcccucgaccugcugcgcgccgggcccuucgacgaguuccagaucgcgaccaugcucaaggagauccugaagggccuggacuaccuccacagcgagaagaagauccaccgggacaucaaggccgccaacgugcugcuguccgagcagggggacgugaagcucgccgacuucggcgucgcgggccagcugaccgacacgcagaucaagcgcaacaccuucguggggacccccuucuggauggccccggaggugauccagcagagcgccuacgacuccaagcggcccaccgccaaggagcugcucaagcacaaguucaucgucaagaacagcaagaagacguccuaccugaccgagcugaucgaccgcuucaagcgguggaaggccgagggccacagcgacgacgaguccgacagcgagggguccgacagcgaguccaccagccgcgagaacaacacccaccccgaguggagcuucacgaccgugcggaagaagcccgacccgaagaaggugcagaacggcgcggagcaggaccucguccagacccuguccugccugagcaugaucaucacccccgccuucgccgagcucaagcagcaggacgagaacaacgccucccgcaaccaggccaucgaggagcuggagaaguccaucgcgguggccgaggccgccugccccggcaucacggacaagauggugaagaagcugaucgagaaguuccagaagugcagcgccgacgagagccccuga

SEQ ID NO: 37219 - RNA, 2991 nt, Artificial Sequence
  derived and/or modified sequence opt1 from STK31__Homo_sapiens__NP_001247433
auggacgaggacacccacuacgacaagguggaggacgucgugggcagccacaucgaggacgccgugaccuucugggcccaguccaucaaccgcaacaaggacaucaugaagaucgggugcagccuguccgaggucugcccccaggcgagcuccgugcucggcaaccuggacccgaacaagaucuacgggggccuguucagcgaggaccagugcugguaccggugcaaggugcucaagaucaucuccgucgagaagugccuggugcgcuacaucgacuacgggaacacggagauccugaaccggagcgacaucguggagaucccccucgagcugcaguucuccagcgucgccaagaaguacaagcuguggggccuccacauccccuccgaccaggaggugacccaguucgaccagggcaccaccuuccuggggagccugaucuucgagaaggagaucaagaugcgcaucaaggccacguccgaggacggcaccgugaucgcccaggccgaguacgggagcgucgacaucggcgaggaggugcucaagaagggguucgcggagaagugccggcuggccucccgcaccgacaucugcgaggagaagaagcuggaccccggccagcucgugcugcggaaccucaagagcccgaucccccuguggggccaccgcuccaaccagagcaccuucucccggcccaaggggcaccugagcgagaagaugacgcuggaccucaaggacgagaacgacgccggcaaccugaucaccuuccccaaggagagccuggccgucggggacuucaaccucggcuccaacgugagccuggagaagaucaagcaggaccagaagcugaucgaggagaacgagaagcucaagaccgagaaggacgcgcugcuggaguccuacaaggcccucgagcugaagguggagcagaucgcccaggagcugcagcaggagaaggccgccgcggucgaccucaccaaccaccuggaguacacgcugaagaccuacaucgacacccgcaugaagaaccucgccgccaagauggagauccugaaggagaugcggcacguggacaucagcgugcgcuucggcaaggaccuguccgacgccauccagguccucgacgaggggugcuucaccacgccggccagccugaacggccuggagaucaucugggcggaguacucccucgcccaggagaacaucaagaccugcgaguacgugagcgaggggaacauccugaucgcccagcggaacgagaugcagcagaagcuguacauguccguggaggacuucauccucgaggucgacgagagcucccugaacaagcgccugaagacccuccaggaccugagcgugucccuggaggccgucuacggccaggccaaggagggggcgaacagcgacgagauccugaagaaguucuacgacuggaagugcgacaagcgggaggaguucaccuccgugcgcagcgagacggacgccucccuccaccggcugguggccugguuccagcgcacccugaaggucuucgaccucagcguggagggcucccugaucagcgaggacgccauggacaacaucgacgagauccuggagaagaccgagagcuccgugugcaaggagcucgagaucgcccuggucgaccagggcgacgcggacaaggagaucaucagcaacaccuacucccaggugcugcagaagauccacagcgaggagcggcucaucgccacggugcaggccaaguacaaggacuccaucgaguucaagaagcagcugaucgaguaccugaacaagagccccuccgucgaccaccuccugagcaucaagaagacccugaagucccucaaggcccugcugcgcuggaagcucguggagaaguccaaccuggaggagagcgacgaccccgacgggagccagaucgagaagaucaaggaggagaucacccagcugcggaacaacguguuccaggagaucuaccacgagcgcgaggaguacgagaugcucaccucccuggcgcagaagugguuccccgagcugccgcuccugcaccccgagaucggccugcucaaguacaugaacagcgggggccugcugacgaugucccucgagcgcgaccugcuggacgccgagcccaugaaggagcucagcuccaagcggccccugguccgcagcgaggugaacgggcagaucauccugcucaagggcuacagcguggacgucgacaccgaggccaaggugaucgagcgggccgccaccuaccaccgcgcguggcgggaggccgagggcgacuccgggcugcugccgcucaucuuccuguuccugugcaagagcgaccccauggccuaccucauggugcccuacuacccccgcgccaaccugaacgccguccaggcgaacaugccgcugaacuccgaggagacccucaaggugaugaagggcguggcccaggggcugcacacgcugcacaaggccgacaucauccacggcagccuccaccagaacaacgucuucgcccugaaccgggagcaggggaucgugggcgacuucgacuucaccaaguccgugagccagcgcgccuccgucaacaugauggugggcgaccugagccucaugucccccgagcugaagauggggaagcccgcgagccccggcuccgaccuguacgccuacgggugccuccugcuguggcucagcgugcagaaccaggaguucgagaucaacaaggacggcaucccgaaggucgaccaguuccaccuggacgacaaggugaagucccugcucugcagccugaucugcuaccgguccagcaugaccgccgagcagguccugaacgccgagugcuuccucaugcccaaggagcaguccgugcccaaccccgagaaggacaccgaguacacgcuguacaagaaggaggaggagaucaagaccgagaaccuggacaagugcauggagaagacccgcaacggcgaggcgaacuucgacugcuga

SEQ ID NO: 37220 - RNA, 1191 nt, Artificial Sequence
  derived and/or modified sequence opt1 from STK32A__Homo_sapiens__NP_001106195
augggcgccaacaccagccgcaagcccccgguguucgacgagaacgaggacgucaacuucgaccacuucgagauccugcgggccaucgggaagggcuccuucgggaaggugugcaucgugcagaagaacgacaccaagaagauguacgcgaugaaguacaugaacaagcagaagugcgucgagcgcaacgaggugcggaacguguucaaggagcuccagaucaugcagggccuggagcaccccuuccuggucaaccucugguacagcuuccaggacgaggaggacauguucauggugguggaccugcugcucgggggcgaccugcgcuaccaccuccagcagaacguccacuucaaggaggagacggugaagcuguucaucugcgagcuggugauggcccuggacuaccuccagaaccagcggaucauccaccgcgacaugaagcccgacaacauccugcuggacgagcacggccacguccacaucaccgacuucaacaucgccgccaugcucccccgggagacccagaucaccacgauggccgggaccaagccguacauggcgcccgagauguucuccagccgcaagggcgccggguacuccuucgccguggacugguggagccugggcgugaccgccuacgagcugcuccgggggcgccggcccuaccacauccgcuccagcaccuccagcaaggagaucguccacacguucgagaccaccguggugaccuaccccuccgcguggagccaggagauggucucccugcugaagaagcuccuggagccgaaccccgaccagcgguucagccagcuguccgacgugcagaacuuccccuacaugaacgacaucaacugggacgccguguuccagaagcgccucauccccggcuucaucccgaacaagggccggcugaacugcgaccccacguucgagcuggaggagaugauccucgagagcaagccccugcacaagaagaagaagcgccuggccaagaaggagaaggacaugcggaagugcgacuccagccagaccugccuccugcaggagcaccuggacuccguccagaaggaguucaucaucuucaaccgcgagaaggugaaccgggacuucaacaagcgccagcccaaccucgcccuggagcagaccaaggacccgcagggggaggacggccagaacaacaaccuguga

SEQ ID NO: 37221 - RNA, 1245 nt, Artificial Sequence
  derived and/or modified sequence opt1 from STK32B__Homo_sapiens__NP_060871
augggcgggaaccacagccacaagcccccgguguucgacgagaacgaggaggucaacuucgaccacuuccagauccugcgcgccaucggcaagggguccuucggcaaggugugcaucgugcagaagcgggacaccaagaagauguacgccaugaaguacaugaacaagcagaagugcaucgagcgcgacgagguccggaacguguuccgcgagcuccagaucaugcaggggcuggagcaccccuuccuggugaaccucugguacagcuuccaggacgaggaggacauguucauggucguggaccugcugcucggcggcgaccugcgguaccaccuccagcagaacgugcacuucaccgaggggaccgucaagcuguacaucugcgagcuggcgcuggcccucgaguaccugcagcgcuaccacaucauccaccgggacaucaagcccgacaacauccugcucgacgagcacggccacgugcacaucaccgacuucaacaucgccaccguggucaagggggccgagcgcgccuccagcauggcgggcaccaagcccuacauggccccggagguguuccagguguacauggaccgggggcccggcuacuccuaccccgucgacugguggagccugggcaucacggccuacgagcugcuccgcggguggcggcccuacgagauccacuccgugaccccgaucgacgagauccugaacauguucaagguggagcgcguccacuacagcuccaccuggugcaagggcaugguggcccugcuccggaagcugcugaccaaggaccccgagagccgcguguccagccuccacgacauccaguccguccccuaccuggcggacaugaacugggacgccguguucaagaaggcccugaugcccggguucgugccgaacaagggccggcucaacugcgaccccacguucgagcuggaggagaugauccuggagagcaagccccuccacaagaagaagaagcgccuggccaagaaccggucccgcgacggcaccaaggacagcugcccccugaacgggcaccuccagcacugccuggagaccguccgggaggaguucaucaucuucaaccgcgagaagcugcggcgccagcagggccaggggucccagcuccuggacaccgacagccgcggcgggggccaggcccaguccaagcugcaggacggcugcaacaacaaccuccugacgcacacgugcacccgggggugcagcagcuga

SEQ ID NO: 37222 - RNA, 1461 nt, Artificial Sequence
  derived and/or modified sequence opt1 from STK32C__Homo_sapiens__NP_775846
augcgcagcggcgccgagcggcgcggguccagcgccgcggccucccccggcagcccgccgcccgggcgggcccgccccgccggcuccgacgcccccagcgcgcugcccccgcccgccgccgggcagccccgggcccgcgacuccggcgacgugcggagccagccccgcccccucuuccagugguccaaguggaagaagcggaugggcagcuccaugagcgcggccaccgcccgccggcccgucuucgacgacaaggaggacgugaacuucgaccacuuccagauccugcgcgccaucgggaagggcuccuucgggaaggugugcaucguccagaagcgggacaccgagaagauguacgccaugaaguacaugaacaagcagcagugcaucgagcgcgacgaggugcggaacguguuccgcgagcuggagauccuccaggagaucgagcacgucuuccuggugaaccugugguacagcuuccaggacgaggaggacauguucaugguggucgaccuccugcugggcggggaccuccgguaccaccuccagcagaacgugcaguucuccgaggacacggugcgccuguacaucugcgagauggcgcuggcccuggacuaccugcggggccagcacaucauccaccgcgacgucaagccggacaacauccuccuggacgagcggggccacgcccaccugaccgacuucaacaucgccaccaucaucaaggacggggagcgcgccaccgcgcucgccggcacgaagcccuacauggcccccgagaucuuccacagcuucgugaacgggggcaccggcuacuccuucgagguggacugguggagcgucggggugauggccuacgagcugcugcgcggcuggcggcccuacgacauccacuccagcaacgccguggagagccucguccagcuguucuccaccgugagcgugcaguacgucccgaccugguccaaggagaugguggcgcugcuccgcaagcugcugacggugaaccccgagcaccggcucagcucccugcaggacguccaggccgcccccgcccuggccggggugcucugggaccaccugagcgagaagcgcgucgagcccggcuucgugccgaacaaggggcggcugcacugcgaccccaccuucgagcucgaggagaugauccuggagucccgcccccugcacaagaagaagaagcggcucgcgaagaacaagagccgcgacaacucccgggacagcucccagagcgagaacgacuaccugcaggacugccuggacgccauccagcaggacuucgugaucuucaaccgcgagaagcucaagcggucccaggaccugccccgcgagccgcugcccgcccccgagagccgggacgccgcggagcccgucgaggacgaggccgagcgcuccgcccucccgaugugcggccccaucugccccagcgccggcuccggguga

SEQ ID NO: 37223 - RNA, 1545 nt, Artificial Sequence
  derived and/or modified sequence opt1 from STK33__Homo_sapiens__NP_001275990
auggccgacagcggccuggacaagaaguccaccaagugccccgacugcagcuccgccagccagaaggacgugcucugcgucugcuccagcaagacccgcgugccgcccgugcuggucguggagaugucccagacgagcuccaucgggagcgcggagucccugaucagccucgagcggaagaaggagaagaacaucaaccgcgacaucaccucccggaaggaccugcccagccgcaccuccaacguggagcggaaggccagccagcagcaguggggccgcgggaacuucaccgagggcaaggucccccacauccggaucgagaacggggccgccaucgaggagaucuacacguucggccgcauccugggcaagggguccuucggcaucgugaucgaggccaccgacaaggagaccgagaccaagugggcgaucaagaaggugaacaaggagaaggccgggagcuccgccgucaagcuccuggagcgggaggugaacauccucaagagcgugaagcacgagcacaucauccaccuggagcaggucuucgagacgccgaagaagauguaccuggugauggagcugugcgaggacggcgagcucaaggagauccuggaccgcaaggggcacuucagcgagaacgagacccgguggaucauccagucccuggccagcgcgaucgccuaccuccacaacaacgacaucgugcaccgcgaccugaagcuggagaacaucauggucaaguccagccucaucgacgacaacaacgagaucaaccugaacaucaaggugaccgacuucggccuggccgugaagaagcagucccggagcgaggccaugcuccaggcgaccugcggcacgcccaucuacauggcccccgaggucaucuccgcccacgacuacagccagcagugcgacaucugguccaucgggguggugauguacaugcugcugcgcggcgagcccccguuccucgccagcuccgaggagaagcuguucgagcugauccggaagggggagcuccacuucgagaacgccgucuggaacagcaucuccgacugcgccaagagcgugcugaagcagcugaugaagguggaccccgcgcaccgcaucaccgccaaggagcuccuggacaaccaguggcugaccggcaacaagcucuccagcguccggcccaccaacgugcuggagaugaugaaggaguggaagaacaaccccgaguccgucgaggagaacacgaccgaggagaagaacaagccgagcaccgaggagaagcugaaguccuaccagcccuggggcaacgugcccgacgccaacuacaccagcgacgaggaggaggagaagcagagcacggccuacgagaagcaguuccccgccaccuccaaggacaacuucgacaugugcagcuccagcuucaccuccagcaagcuccugccggcggagaucaagggggagauggagaagacccccgugacgcccucccagggcaccgccaccaaguaccccgccaagagcggggcccugucccgcaccaagaagaagcucuga

SEQ ID NO: 37224 - RNA, 1605 nt, Artificial Sequence
  derived and/or modified sequence opt1 from STK35__Homo_sapiens__NP_543026
augggccaccaggagagcccccuggcccgcgccccggccgggggcgccgccuacgugaagcggcucugcaaggggcuguccuggcgcgagcacgucgagagccacggcucccugggggcccaggccagccccgcguccgccgccgccgcggagggcagcgccacccggcgcgcccgggccgccaccucccgcgcggcccggagccgccggcagcccggccccggggccgaccacccgcaggccggcgcccccgggggcaagcgcgcggcccggaaguggcgcugcgccgggcaggucacgauccagggccccgcgcccccgcggccccgcgccggccggcgcgacgaggccgggggcgcccgggccgcgccccuccugcugcccccgccgcccgccgcgauggagaccgggaaggacggcgcccgccggggcacccagucccccgagcgcaagcggcgcagccccgugccccgcgcccccuccaccaagcuccggcccgccgcggccgcccgcgccauggacccggucgccgcggaggcccccggggaggccuuccuggcccggcgccggcccgagggcgggggcgggagcgcccgcccccgguacucccugcucgcggagaucggccgcggcagcuacggggugguguacgaggccgucgccggccgguccggggcccgcguggccgugaagaagauccggugcgacgcgccggagaacgucgagcuggcccuggccgaguucugggcccucacgagccugaagcgccggcaccagaacguggugcaguucgaggagugcguccugcagcgcaacggccucgcgcagcggaugucccacgggaacaagagcucccagcuguaccugcgccucguggagaccagccugaagggcgagcggauccugggcuacgccgaggagcccugcuaccucugguucgugauggaguucugcgagggcggggaccugaaccaguacguccugagccgccggcccgaccccgccaccaacaaguccuucaugcuccagcugaccagcgccaucgccuuccugcacaagaaccacaucgugcaccgcgaccucaagccggacaacauccugaucacggagcgcuccgggacccccauccugaagguggcggacuucggccucagcaaggucugcgccgggcuggcgccccggggcaaggagggcaaccaggacaacaagaacgugaacgugaacaaguacuggcuguccagcgccugcggguccgacuucuacauggccccggaggucugggagggccacuacaccgccaaggccgacaucuucgcccucgggaucaucaucugggccaugaucgagcgcaucaccuucaucgacagcgagacgaagaaggagcugcugggcaccuacaucaagcagggcaccgagaucgugcccgugggggaggcccuccuggagaaccccaagauggagcugcacaucccccagaagcggcgcaccuccaugagcgagggcaucaagcagcuccugaaggacaugcuggcggccaacccgcaggaccggcccgacgccuucgagcucgagacgcgcauggaccaggugaccugcgccgcguga

SEQ ID NO: 37225 - RNA, 1395 nt, Artificial Sequence
  derived and/or modified sequence opt1 from STK38L__Homo_sapiens__NP_055815
auggccaugaccgccggcaccacgaccaccuuccccaugagcaaccacacccgcgagcgggugacggucgcgaagcugacccucgagaacuucuacuccaaccugauccugcagcacgaggagcgcgagacccggcagaagaagcucgagguggccauggaggaggaggggcuggccgacgaggagaagaagcugcgccggagccagcacgcccgcaaggagaccgaguuccuccggcugaagcgcacgcggcugggccucgacgacuucgagucccugaaggugaucgggcgcggcgccuucggggagguccggcuggugcagaagaaggacaccggccacaucuacgcgaugaagauccuccgcaagagcgacaugcuggagaaggagcaggucgcccacauccgggccgagcgcgacauccugguggaggccgacggcgcguggguggugaagauguucuacuccuuccaggacaagcggaaccucuaccugaucauggaguuccugcccgggggcgacaugaugacccuccugaugaagaaggacacccugacggaggaggagacccaguucuacaucagcgagaccguccucgccaucgacgccauccaccagcugggguucauccaccgcgacaucaagcccgacaaccugcuccuggacgccaagggccacgugaagcuguccgacuucgggcucugcaccggccugaagaaggcccaccggacggaguucuaccgcaaccugacccacaacccgcccagcgacuucuccuuccagaacaugaacagcaagcggaaggcggagaccuggaagaagaaccgccggcagcucgccuacuccaccgugggcacgccggacuacaucgcccccgaggucuucaugcagaccggguacaacaagcugugcgacugguggagccugggcgugaucauguacgagaugcucaucggguacccgcccuucugcuccgagacgccccaggagaccuaccgcaaggugaugaacuggaaggagacccuggucuucccgcccgaggugcccaucagcgagaaggccaaggaccugauccuccgcuucugcaucgacuccgagaaccggaucggcaacagcggcguggaggagaucaaggggcaccccuucuucgagggcgucgacugggagcacauccgcgagcggcccgccgcgauccccaucgagaucaaguccaucgacgacaccagcaacuucgacgacuuccccgaguccgacauccugcagccggugcccaacaccaccgagcccgacuacaagagcaaggacuggguguuccugaacuacacguacaagcgcuucgaggggcucacccagcggggcagcauccccaccuacaugaaggccgggaagcuguga

SEQ ID NO: 37226 - RNA, 1638 nt, Artificial Sequence
  derived and/or modified sequence opt1 from STK39__Homo_sapiens__NP_037365
auggccgagcccagcggcuccccggugcacguccagcugccccagcaggccgcgcccgugaccgccgccgccgccgcggcccccgccgccgcgaccgccgccccggcccccgccgcgcccgccgcccccgccccggcccccgcgcccgccgcccaggccgugggguggcccaucugccgcgacgccuacgagcuccaggaggucaucggcagcggggcgacggccguggugcaggccgcccugugcaagccgcggcaggagcgcgucgccaucaagcggaucaaccuggagaagugccagaccuccauggacgagcuccugaaggagauccaggcgaugagccagugcucccaccccaacguggugaccuacuacaccagcuucgucgugaaggacgagcuguggcucgugaugaagcugcuguccggcgggagcaugcucgacaucaucaaguacaucgucaaccgcggcgagcacaagaacggcgugcuggaggaggccaucaucgccacgauccugaaggaggugcucgaggggcuggacuaccugcaccggaacggccagauccaccgcgaccucaaggccgggaacauccugcugggcgaggacggguccguccagaucgcggacuucggcgugagcgccuuccucgccaccggcggggacgugacccggaacaagguccgcaagaccuucgugggcacgcccugcuggauggcccccgaggugauggagcagguccggggguacgacuucaaggccgacaugugguccuucggcaucaccgcgaucgagcuggccaccggcgccgccccguaccacaaguacccgcccaugaaggugcugaugcucacccugcagaacgacccgcccacgcuggagaccgggguggaggacaaggagaugaugaagaaguacggcaagagcuuccgcaagcuccugucccugugccuccagaaggaccccagcaagcggcccaccgccgcggagcugcugaagugcaaguucuuccagaaggccaagaaccgcgaguaccucaucgagaagcugcugacccggacgcccgacaucgcccagcgcgccaagaagguccggcgcgugcccggguccagcggccaccuccacaagaccgaggacggggacugggagugguccgacgacgagauggacgagaaguccgaggagggcaaggccgcguucagccaggagaagucccggcgcgucaaggaggagaaccccgagaucgccgugagcgccagcaccauccccgagcagauccagagccuguccgugcacgacagccaggggcccccgaacgccaacgaggacuaccgggaggcguccagcugcgccgucaaccuggugcuccgccugcggaacucccgcaaggagcugaacgacauccgcuucgaguucacccccggccgggacacggccgacggcgugagccaggagcuguucuccgccgggcucgucgacggccacgacguggugaucgucgccgcgaaccugcagaagaucguggacgaccccaaggcccucaagacccugaccuucaagcuggccagcgggugcgacggcuccgagaucccggacgaggugaagcucaucggcuucgcccagcugagcgucuccuga

SEQ ID NO: 37227 - RNA, 1476 nt, Artificial Sequence
  derived and/or modified sequence opt1 from STK3__Homo_sapiens__NP_006272
auggagcagcccccggcccccaagagcaagcugaagaagcucuccgaggacagccugaccaagcagcccgaggagguguucgacguccuggagaagcucggcgagggguccuacggcagcguguucaaggccauccacaaggaguccggccagguggucgcgaucaagcagguccccguggagagcgaccugcaggagaucaucaaggagaucuccaucaugcagcagugcgacagcccguacguggugaaguacuacggguccuacuucaagaacaccgaccuguggaucgugauggaguacugcggggccggcagcgucuccgacaucauccgccuccggaacaagacgcugaucgaggacgagaucgccaccauccucaagagcacccugaagggccuggaguaccugcacuucaugcgcaagauccaccgggacaucaaggccgggaacauccuccugaacaccgagggccacgccaagcuggcggacuucgggguggccggccagcucacggacaccauggccaagcgcaacaccgugaucgggacccccuucuggauggcccccgaggucauccaggagaucggcuacaacugcguggcggacaucuggucccugggcaucacgagcaucgagauggccgaggggaagcccccguacgccgacauccaccccaugcgggccaucuucaugauccccaccaacccgccgcccaccuuccgcaagcccgagcugugguccgacgacuucaccgacuucgugaagaagugccucgucaagaaccccgagcagcgggccacggcgacccagcugcugcagcaccccuucaucaagaacgccaagcccgugagcauccuccgcgaccugaucaccgaggccauggagaucaaggccaagcggcacgaggagcagcagcgcgagcuggaggaggaggaggagaacuccgacgaggacgagcucgacagccacaccauggugaagacguccgucgagagcgugggcaccaugcgggccaccagcaccauguccgagggggcgcagacgaugaucgagcacaacagcaccaugcuggaguccgaccugggcaccauggugaucaacagcgaggacgaggaggaggaggacggcaccaugaagcgcaacgccacgagcccccagguccagcggcccuccuucauggacuacuucgacaagcaggacuucaagaacaagucccacgagaacugcaaccagaacaugcacgagccguuccccaugagcaagaacguguuccccgacaacuggaaggugccccaggacggggacuucgacuuccucaagaaccugucccuggaggagcuccagaugcgccugaaggcccuggacccgaugauggagcgggagaucgaggagcuccgccagcgguacaccgccaagcgccagcccauccuggacgccauggacgcgaagaagcggcgccagcagaacuucuga

SEQ ID NO: 37228 - RNA, 1464 nt, Artificial Sequence
  derived and/or modified sequence opt1 from STK4__Homo_sapiens__NP_006273
auggagaccgugcagcugcgcaacccgccccggcgccagcucaagaagcuggacgaggacagccugaccaagcagcccgaggaggucuucgacgugcucgagaagcugggcgagggguccuacggcagcguguacaaggccauccacaaggagacggggcagaucgucgccaucaagcagguccccguggaguccgaccugcaggagaucaucaaggagaucagcaucaugcagcagugcgacagcccccacguggugaaguacuacggcagcuacuucaagaacaccgaccucuggaucgugauggaguacugcggggcgggcuccgucagcgacaucauccggcugcgcaacaagacccugaccgaggacgagaucgccacgauccuccaguccacccugaagggccuggaguaccuccacuucaugcggaagauccaccgcgacaucaaggccgggaacauccugcugaacaccgagggccacgccaagcucgccgacuucgggguggcgggccagcugaccgacacgauggccaagcggaacaccgugaucgggaccccguucuggauggcccccgaggucauccaggagaucggcuacaacugcguggccgacaucuggagccugggcaucaccgcgaucgagauggccgaggggaagccgcccuacgccgacauccaccccaugcgcgccaucuucaugauccccacgaacccgccgcccaccuuccggaagcccgagcucugguccgacaacuucaccgacuucgugaagcagugccuggucaagagccccgagcagcgcgccaccgcgacgcagcugcuccagcaccccuucgugcgguccgccaagggcgugagcauccugcgcgaccugaucaacgaggccauggacgucaagcucaagcggcaggagucccagcagcgcgagguggaccaggacgacgaggagaacagcgaggaggacgagauggacuccgggaccauggugcgggccgucggcgacgagaugggcaccgugcgcguggccagcaccaugacggacggggcgaacaccaugaucgagcacgacgacacccugcccucccagcugggcaccauggucaucaacgccgaggacgaggaggaggaggggacgaugaagcggcgcgacgagaccaugcagcccgccaagcccagcuuccucgaguacuucgagcagaaggagaaggagaaccagaucaacagcuucggcaaguccgugcccgggccgcugaagaacagcuccgacuggaagaucccccaggacggcgacuacgaguuccugaaguccuggaccgucgaggaccuccagaagcggcugcuggcccucgaccccaugauggagcaggagaucgaggagauccgccagaaguaccaguccaagcggcagcccauccuggacgccaucgaggcgaagaagcgccgccagcagaacuucuga

SEQ ID NO: 37229 - RNA, 564 nt, Artificial Sequence
  derived and/or modified sequence opt1 from STMN2__Homo_sapiens__NP_001186143
auggccaagaccgccauggcguacaaggagaagaugaaggagcugagcaugcucucccugaucugcagcugcuucuaccccgagccgcgcaacaucaacaucuacaccuacgacgacauggaggugaagcagaucaacaagcgggccuccggccaggccuucgagcugauccucaagccgcccagccccaucuccgaggcgccccgcacgcuggccagccccaagaagaaggaccugucccucgaggagauccagaagaagcuggaggccgccgaggagcggcgcaagagccaggaggcccagguccugaagcagcucgccgagaagcgggagcacgagcgcgaggugcugcagaaggcgcuggaggagaacaacaacuucuccaagauggccgaggagaagcucauccugaagauggagcagaucaaggagaaccgggaggccaaccuggccgccaucaucgagcgccuccaggagaagcuggugaaguucaucagcuccgagcugaaggagagcaucgagucccaguuccucgagcugcagcgggagggggagaagcaguga

SEQ ID NO: 37230 - RNA, 510 nt, Artificial Sequence
  derived and/or modified sequence opt1 from STMN3__Homo_sapiens__NP_001263239
augaaggagcugagcgugcucucccugaucugcagcugcuucuacacccagccccacccgaacaccgucuaccaguacggcgacauggaggugaagcagcuggacaagcgcgccuccgggcagagcuucgaggugauccucaagucccccagcgaccugucccccgagagccccaugcuguccagcccgcccaagaagaaggacacgucccucgaggagcugcagaagcggcuggaggccgcggaggagcgccggaagacccaggaggcccagguccucaagcagcuggccgagcgccgggagcacgagcgcgaggugcugcacaaggcccucgaggagaacaacaacuucagccggcaggccgaggagaagcugaacuacaagauggagcuguccaaggagauccgcgaggcgcaccucgccgcccugcgggagcgccugcgggagaaggagcuccacgccgcggaggugcgccggaacaaggagcagcgcgaggagaugagcggcuga

SEQ ID NO: 37231 - RNA, 570 nt, Artificial Sequence
  derived and/or modified sequence opt1 from STMN4__Homo_sapiens__NP_001269983
augacccuggccgccuacaaggagaagaugaaggagcucccccuggugagccuguucugcuccugcuuccucgcggacccgcugaacaagagcuccuacaaguacgaggccgacaccgucgaccugaacuggugcgugaucagcgacauggaggugaucgagcucaacaagugcacguccggccagagcuucgaggucauccugaagccgcccuccuucgacggggugcccgaguucaacgccagccugccccgccggcgcgaccccucccucgaggagauccagaagaagcuggaggccgccgaggagcggcgcaaguaccaggaggcggagcugcucaagcaccuggccgagaagcgggagcacgagcgcgaggugauccagaaggccaucgaggagaacaacaacuucaucaagauggccaaggagaagcuggcgcagaagauggagagcaacaaggagaaccgggaggcccaccucgccgccaugcuggagcgccugcaggagaaggacaagcacgccgaggagguccggaagaacaaggagcucaaggaggaggcgucccgcuga

SEQ ID NO: 37232 - RNA, 867 nt, Artificial Sequence
  derived and/or modified sequence opt1 from STOM__Homo_sapiens__NP_004090
auggccgagaagcgccacacccgggacagcgaggcccagcgccugcccgacuccuucaaggacagcccguccaagggccucgggcccugcggcuggauccugguggcguucagcuuccuguucaccgucaucacguuccccaucuccaucuggaugugcaucaagaucaucaaggaguacgagcgggccaucaucuuccgccucgggcggauccugcagggcggggccaagggccccggccuguucuucauccucccgugcaccgacagcuucaucaagguggacaugcgcaccaucuccuucgacaucccgccccaggagauccugaccaaggacagcgugacgaucuccgucgacggggugguguacuaccggguccagaacgccacccuggccguggcgaacaucaccaacgccgacagcgccacccgccuccuggcccagacgacccugcggaacgugcucggcaccaagaaccugucccagauccugagcgaccgcgaggagaucgcgcacaacaugcaguccacccucgacgacgccacggacgccugggggaucaaggucgagcggguggagaucaaggacgugaagcugcccguccagcugcagcgcgccauggccgcggaggccgaggccagccgggaggcccgcgccaaggugaucgcggccgagggcgagaugaacgccucccgggcccucaaggaggccagcauggugaucaccgagucccccgcggcccugcagcugcgcuaccuccagacccugaccacgaucgccgccgagaagaacagcaccaucgucuucccccugcccaucgacaugcuccaggggaucaucggcgccaagcacucccaccugggcuga

SEQ ID NO: 37233 - RNA, 1047 nt, Artificial Sequence
  derived and/or modified sequence opt1 from STOML1__Homo_sapiens__NP_001243602
augcugggccgcagcggguaccgggcccucccccugggcgacuucgaccgcuuccagcaguccagcuucggguuccugggcucccagaaggggugccucagcccggagcggggcggcguggggaccggcgccgacgucccccaguccuggcccagcugccugugccacgggcugaucuccuuccucggcuuccugcugcuccuggugaccuuccccaucagcgggugguucgcgcugaagcucgccuccaaggacggcgccgugcugagcgucggcgccgacgugcaguuccgcaucugggacccggugcuguccgucaugacggugaaggaccucaacaccgccacccggaugaccgcgcagaacgccaugacgaaggcccugcugaagcgcccccuccgggagauccagauggagaagcugaagaucagcgaccagcugcuccuggagaucaacgacgugacccgcgccugggggcuggaggucgaccggguggagcucgcgguggaggccguccugcagccgccccaggacucccccgccggccccaaccuggacagcacccuccagcagcuggcccugcacuuccucgggggcuccaugaacagcauggccggcggggcgcccucccccggcccggccgacaccguggagauggugagcgaggucgagccgcccgcgccccaggugggggcccgcuccagccccaagcagccccuggccgagggccugcucacggcccugcagcccuuccugagcgaggcccucgugucccaggucggggccugcuaccaguucaacguggugcugcccagcggcacccaguccgccuacuuccuggaccucaccaccggccgggggcgcgucggccacggggugccggacggcauccccgacguggucguggagauggccgaggcggaccugcgggcccugcucugccgcgagcugcggccccugggggccuacaugagcggccgccucaaggucaagggcgaccuggccauggccaugaagcuggaggcggugcuccgggcccugaaguga

SEQ ID NO: 37234 - RNA, 936 nt, Artificial Sequence
  derived and/or modified sequence opt1 from STOML2__Homo_sapiens__NP_001273960
augcuggcccgcgccgcgcggggcaccggggcccuccugcugcgcggcagccuccuggccuccgggcgggcgccccgccgggccagcuccggccugccgcgcaacaccgugguccucuucgugccccagcaggaggccuggguggucgagcggauggggcgcuuccaccggauccuggagcccggccugaacauccucauccccgugcuggaccgcauccgguacgugcagagccugaaggagaucgucaucaacgugccggagcaguccgccgugacgcucgacaacgucacccugcagaucgacggcgugcuguaccuccgcaucauggaccccuacaaggccagcuacgggguggaggaccccgaguacgccgucacccagcuggcgcagaccacgaugcgguccgagcugggcaagcucagccuggacaagguguuccgcguggaggccgagcggcgcaagcgggccaccguccuggaguccgaggggacccgcgagagcgccaucaacguggccgagggcaagaagcaggcgcagauccucgccuccgaggccgagaaggccgagcagaucaaccaggccgcgggggaggccagcgccgugcuggccaaggccaaggcgaaggccgaggccauccggauccuggccgccgcgcucacccagcacaacggcgacgccgccgccucccugacggucgcggagcaguacgugagcgccuucuccaagcuggccaaggacagcaacaccauccuccugcccuccaacccgggcgacgugaccagcauggucgcccaggccauggggguguacggcgcgcugaccaaggcccccgugcccgggacgcccgacucccucagcagcggcuccagccgcgacguccagggcaccgacgccucccuggacgaggagcuggaccgggugaagaugagcuga

SEQ ID NO: 37235 - RNA, 849 nt, Artificial Sequence
  derived and/or modified sequence opt1 from STOML3__Homo_sapiens__NP_001137505
augaacagccgcggcgagcuggugggggucaacaacaagcggcucggcgugugcggguggauccuguucucccugagcuuccuccuggugaucaucaccuuccccaucuccaucuggaugugccugaagaucaucaaggaguacgagcgcgccgucguguuccggcucggccgcauccaggccgacaaggcgaaggggccgggccugauccuggugcuccccugcaucgacgucuucgugaagguggaccugcggaccgucacgugcaacaucccgccccaggagauccugacccgcgacagcgugaccacccagguggacggcgucguguacuaccggaucuacuccgccgugagcgccgucgccaacgugaacgacgugcaccaggccacguuccuccuggcgcagaccacccugcgcaacguccucgggacccagacgcugucccagauccuggccggccgggaggagaucgcccacagcauccagacccuccuggacgacgccaccgagcugugggggauccgcguggcgcggguggagaucaaggacguccgcauccccgugcagcuccagcgguccauggccgccgaggccgaggccacccgcgaggcgcgggccaaggugcuggccgccgagggcgagaugaacgccagcaagucccucaagagcgcguccaugguccuggccgagagccccaucgcccugcagcugcgcuaccuccagacgcuguccaccguggccaccgagaagaacagcaccaucgucuucccccugcccaugaacauccucgaggggaucggcggcguguccuacgacaaccacaagaagcugccgaacaaggccuga

SEQ ID NO: 37236 - RNA, 3477 nt, Artificial Sequence
  derived and/or modified sequence opt1 from STON1-GTF2A1L__Homo_sapiens__NP_001185522
augugcagcaccaaccccggcaagugggugaccuucgacgacgacccggccguccaguccagccagaaguccaagaacuucccccuggagaaccagggggugugccgccccaacggccucaagcugaaccugcccgggcuccgggaguucccgagcggcuccagcuccacgagcuccacgccccugagcucccccaucguggacuucuacuucagccccgggccgcccuccaacagcccccuguccacccccaccaaggacuucccgggcuuccccggcauccccaaggccgggacccacguccucuaccccaucccggagagcuccagcgacagcccccuggcgaucagcggcggggagagcucccugcuccccacccgcccgaccugccugagccacgcccugcucccguccgaccacagcugcacccaccccacgcccaaggugggccugcccgacgaggugaacccgcagcaggccgagucccugggguuccagagcgacgaccucccccaguuccaguacuuccgggaggacugcgccuucuccagccccuucuggaaggacgagggcuccgacagccacuucacccuggacccgccgggcuccaagaagauguucagcucccgcaacaaggagaugcccaucgaccagaagucccugaacaagugcucccucaacuacaucugcgagaagcuggagcaccuccagagcgccgagaaccaggacucccugcggagccuguccaugcacugccugugcgcggaggagaacgccagcagcuucgucccccacacccucuuccgcucccagcccaagagcgggugguccuucaugcugcggauccccgagaagaagaacaugaugagcucccgccaguggggccccaucuuccugaaggugcuccccgggggcauccugcagauguacuacgagcagggccuggagaagccguucaaggagauccagcucgaccccuacugccggcugagcgagcccaagguggagaacuucuccgucgccgggaagauccacaccgugaagaucgagcacgugagcuacacggagaagcgcaaguaccacuccaagaccgaggucgugcacgagcccgacaucgagcagaugcugaagcucggcagcaccuccuaccacgacuuccuggacuuccugaccacgguggaggaggagcucaugaagcugccggccgucagcaagcccaagaagaacuacgaggagcaggagaucucccuggagaucguggacaacuucugggggaaggugaccaaggagggcaaguucgucgagagcgcggugaucacccagaucuacugccucugcuucgugaacgggaaccuggagugcuuccugacccucaacgaccuggagcugcccaagcgggacgaguccuacuacgagaaggacagcgagaagaagggcaucgacauccucgacuaccacuuccacaagugcgucaacgugcaggaguucgagcagucccgcaucaucaaguucgugccccuggacgccugccgguucgagcugaugcgcuucaagacgcucuacaacggcgacaaccugccguucagccugaaguccgucguggucgugcagggggccuacguggagcugcaggccuucgucaacauggccucccucgcgcagcggagcuccuacgccggcagccugcgcuccugcgacaacauccggauccacuuccccgugcccagccaguggaucaaggcccuguggaccaugaaccuccagcgccagaagucccugaaggccaagaugaaccggcgcgccugccuggggagccuccaggagcuggaguccgagcccgugauccaggucaccgugggcagcgcgaaguacgaguccgccuaccaggccguggucuggaagaucgaccggcugccggacaagaacagcucccucgaccacccccacugccugagcuacaagcuggagcucggguccgaccaggagauccccagcgacugguaccccuucgccaccgugcaguucuccgugccggacacgugcgccagccgcaccgagguccgcucccugggcguggagagcgacgugcagccccagaagcacguccagcagcgggcgugcuacaacauccagcccaagcuguaccgcagcgugaucgaggacgugaucgagggcguccggaaccucuucgccgaggaggggaucgaggagcagguccugaaggaccugaagcagcucugggagaccaaggugcugcaguccaaggccaccgaggacuucuuccgcaacagcauccagagcccccuguucacgcuccagcugccgcacagccugcaccagacccuccaguccagcaccgccucccuggugauccccgccggccggacccugcccagcuucacgaccgcggagcucgggaccuccaacagcuccgccaacuucaccuucccgggcuaccccauccacgugcccgccggggugacgcugcagaccgucagcggccaccuguacaaggugaacgugcccaucauggucaccgagaccuccggccgcgccgggauccuccagcacccgauccagcaggucuuccagcagcugggccagcccagcgugauccagaccuccgugccccagcugaaccccuggagccuccaggcgacgaccgagaagucccagcggaucgagaccgugcugcagcagccggccauccugcccagcgggcccguggaccgcaagcaccucgagaacgccaccuccgacauccuggucagccccggcaacgagcacaagaucgugccggaggcccugcucugccaccaggagagcucccacuacaucagccugcccggcguggucuucagcccccaggugucccagacgaacuccaacguggagagcguccuguccgggagcgccuccauggcgcagaaccuccacgacgagagccuguccaccagcccccacggcgcccugcaccagcacgugaccgacauccagcuccacauccugaagaaccggauguacgggugcgacuccgugaagcagccgcgcaacaucgaggagcccagcaacauccccgucuccgagaaggacagcaacucccagguggaccugagcauccgggugaccgacgacgacaucggcgagaucauccaggucgacggguccggcgacacgagcagcaacgaggagaucggcuccacccgcgacgccgacgagaacgaguuccucgggaacaucgacggcggggaccugaaggugcccgaggaggaggccgacagcaucuccaacgaggacagcgccaccaacuccagcgacaacgaggacccccaggugaacaucgucgaggaggacccccugaacuccggcgacgacgugagcgagcaggacgugcccgaccucuucgacaccgacaacgucaucgugugccaguacgacaagcagggggacacgcggguccgccacggccagcaguga

SEQ ID NO: 37237 - RNA, 2208 nt, Artificial Sequence
  derived and/or modified sequence opt1 from STON1__Homo_sapiens__NP_001185524
augugcagcaccaaccccggcaagugggugaccuucgacgacgacccggccguccaguccagccagaaguccaagaacuucccccuggagaaccagggggugugccgccccaacggccucaagcugaaccugcccgggcuccgggaguucccgagcggcuccagcuccacgagcuccacgccccugagcucccccaucguggacuucuacuucagccccgggccgcccuccaacagcccccuguccacccccaccaaggacuucccgggcuuccccggcauccccaaggccgggacccacguccucuaccccaucccggagagcuccagcgacagcccccuggcgaucagcggcggggagagcucccugcuccccacccgcccgaccugccugagccacgcccugcucccguccgaccacagcugcacccaccccacgcccaaggugggccugcccgacgaggugaacccgcagcaggccgagucccugggguuccagagcgacgaccucccccaguuccaguacuuccgggaggacugcgccuucuccagccccuucuggaaggacgagggcuccgacagccacuucacccuggacccgcccggcuccaagaagauguucagcucccgcaacaaggagaugcccaucgaccagaagucccugaacaagugcucccucaacuacaucugcgagaagcuggagcaccuccagagcgccgagaaccaggacucccugcggagccuguccaugcacugccugugcgcggaggagaacgccagcagcuucgucccccacacccucuuccgcucccagcccaagagcgggugguccuucaugcugcggauccccgagaagaagaacaugaugagcucccgccaguggggccccaucuuccugaaggugcuccccgggggcauccugcagauguacuacgagcagggccuggagaagccguucaaggagauccagcucgaccccuacugccggcugagcgagcccaagguggagaacuucuccgucgccgggaagauccacaccgugaagaucgagcacgugagcuacacggagaagcgcaaguaccacuccaagaccgaggucgugcacgagcccgacaucgagcagaugcugaagcucggcagcaccuccuaccacgacuuccuggacuuccugaccacgguggaggaggagcucaugaagcugccggccgucagcaagcccaagaagaacuacgaggagcaggagaucucccuggagaucguggacaacuucugggggaaggugaccaaggagggcaaguucgucgagagcgcggugaucacccagaucuacugccucugcuucgugaacgggaaccuggagugcuuccugacccucaacgaccuggagcugcccaagcgggacgaguccuacuacgagaaggacagcgagaagaagggcaucgacauccucgacuaccacuuccacaagugcgucaacgugcaggaguucgagcagucccgcaucaucaaguucgugccccuggacgccugccgguucgagcugaugcgcuucaagacgcucuacaacggcgacaaccugccguucagccucaagagcgucguggucgugcagggggccuacguggagcugcaggccuucgucaacauggccucccuggcgcagcggagcuccuacgccggcagccugcgcuccugcgacaacauccggauccacuuccccgugcccagccaguggaucaaggcccuguggaccaugaaccuccagcgccagaagucccugaaggccaagaugaaccggcgcgccugccuggggagccuccaggagcuggaguccgagcccgugauccaggucaccgugggcagcgcgaaguacgaguccgccuaccaggccguggucuggaagaucgaccggcugccggacaagaacagcucccucgaccacccccacugccugagcuacaagcuggagcucggguccgaccaggagauccccagcgacugguaccccuucgccaccgugcaguucuccgugccggacacgugcgccagccgcaccgagguccgcucccugggcguggagagcgacgugcagccccagaagcacguccagcagcgggcgugcuacaacauccagguggagaucgagaagaaguggaucaagaucgacggcgaggaccccgacaagaucggggacugcaucacccaguga

SEQ ID NO: 37238 - RNA, 684 nt, Artificial Sequence
  derived and/or modified sequence opt1 from STOX1__Homo_sapiens__NP_001123631
auggcccgccccgugcagcuggccccgggcagccucgcgcugguccugugccggcucgaggcccagaaggccgccggggccgcggaggagcccggcgggcgcgccguguuccgggccuuccgccgggccaacgcgcgcugcuucuggaacgcccggcuggcccgcgccgccucccggcuggcguuccagggcuggcuccgccgcggggugcugcugguccgggccccgcccgccugccuccaggugcugcgggacgccuggcgccggcgcgcccugcggccgccccgcggcuuccggauccgcgcggugggcgacgucuuccccgugcagaugaaccccaucacccagagccaguucgugccccucggggagguccugugcugcgccaucuccgacaugaacaccgcccagaucguggugacgcaggagagccugcucgagcggcugaugaagcacuaccccggcaucgccauccccuccgaggacauccuguacaccacccucgggacccugaucaaggagcgcaagaucuaccacacgggcgagggguacuucaucgucacgccccagaccuacuucaucaccaacaccaccacccaggagaacaagcgcaugcugccgagcgacgagucccggcucaugcccgccagcaugaccuaccuggacacggaguccggcaucuga

SEQ ID NO: 37239 - RNA, 246 nt, Artificial Sequence
  derived and/or modified sequence opt1 from STRA13__Homo_sapiens__NP_001257935
auggagggcgccggggccggcagcggguuccgcaaggagcuggugucccggcuccugcaccuccacuucaaggacgacaagaccaaggucagcggcgacgcgcugcagcugaugguggagcugcucaagguguucgucguggaggccgccgugcgcgggguccggcaggcccaggccgaggacgcgcugcgcguggacguggaccagcuggagaagguccucccccagcugcugcucgacuucuga

SEQ ID NO: 37240 - RNA, 1977 nt, Artificial Sequence
  derived and/or modified sequence opt1 from STRA6__Homo_sapiens__NP_001136091
augagcucccagcccgccggcaaccagaccagcccgggggccaccgaggacuacuccuacggcagcugguacaucgacgagccccagggcggggaggagcugcagcccgagggggaggugcccuccugccacacgagcaucccgcccggccucuaccacgcgugccuggccucccugagcauccucguccugcugcuccuggccaugcuggugcgccggcgccagcucuggcccgacugcgugcggggccgccccgggcugccgcggccccgcgccguccccgccgcgguguucauggugcugcucuccagccugugccugcuccugcccgacgaggacgcccugccguuccucacccuggccuccgcccccagccaggacggcaagaccgaggcgccccgcggggccuggaagauccugggccucuucuacuacgccgcccuguacuacccccuggccgcgugcgccaccgccgggcacacggccgcccaccuccugggcuccacccugagcugggcgcaccucggcguccagguguggcagcgggccgagugcccccaggugcccaagaucuacaaguacuacucccugcuggccagccucccccugcugcucgggcugggcuuccugucccucugguaccccguccagcuggugcggagcuucucccgccggaccggggccggcagcaagggccugcagagcuccuacagcgaggaguaccuccgcaaccugcugugccggaagaagcucggguccagcuaccacaccuccaagcacggcuuccugagcugggcccgcgugugccugcggcacugcaucuacacgccgcagcccggguuccaccucccccugaagcugguccucuccgcgacccugaccggcaccgccaucuaccagguggcccugcugcuccuggugggggucgugcccacgauccagaaggugcgcgccggcgucaccaccgacgugagcuaccugcucgccggcuucgggaucgugcuguccgaggacaagcaggaggucguggagcuggugaagcaccaccucugggcgcuggaggucugcuacaucagcgcccuggugcucuccugccugcugaccuuccucguccugaugcggagccuggugacgcaccgcaccaaccuccgggcccugcaccgcggcgccgcgcuggaccucuccccgcugcaccggagcccccaccccucccgccaggccaucuucugcuggaugagcuucuccgccuaccagaccgccuucaucugccuggggcuccuggugcagcagaucaucuucuuccugggcaccacggcccucgcguuccugguccugaugcccgugcuccacgggcgcaaccugcuccuguuccggagccuggaguccagcuggccguucuggcugacccucgcccuggccgugauccugcagaacauggccgcccacugggucuuccucgagacccacgacggccacccccagcugaccaaccgccgggugcuguacgcggccacguuccuccuguucccccugaacgugcucgucggcgccaugguggccaccuggcgcgugcugcugagcgcccucuacaacgcgauccaccuggggcagauggaccugucccuccugccgccccgggccgccacccuggaccccggcuacuacaccuaccgcaacuuccucaagaucgaggucagccagucccaccccgccaugacggcguucugcagccugcugcuccaggcccagucccugcugccgcggaccauggccgccccgcaggacagccuccgccccggggaggaggacgagggcaugcagcugcugcagaccaaggacuccauggccaagggggcgcggcccggcgccagccgcggccgggcccgcugggggcucgccuacacccugcugcacaacccgacgcuccagguguuccggaagaccgcccugcugggcgcgaacggggcccagcccuga

SEQ ID NO: 37241 - RNA, 993 nt, Artificial Sequence
  derived and/or modified sequence opt1 from STRA8__Homo_sapiens__NP_872295
augggcaagaucgacguggacaagauccuguucuucaaccaggagauccgccucuggcagcugaucauggccacccccgaggagaacagcaacccgcacgaccgggccacgccccagcugcccgcgcagcuccaggagcuggagcaccgcgucgcccggcgccggcugucccaggcccgccaccgggccacccucgccgcgcuguucaacaaccugcgcaagaccguguacagccaguccgaccucaucgccagcaaguggcagguccugaacaaggccaagucccacauccccgagcuggagcagacccucgacaaccugcugaagcucaaggccagcuucaaccuggaggacgggcacgcguccagccuggaggaggugaagaaggaguacgccuccauguacagcggcaacgacuccuucccgcagaacgggagcucccccugguaccucaacuucuacaagcagaccauggaccugcugacgggcagcgggaucaucacgccccaggaggccgcccuccccaucguguccgccgcgaucagccaccuguggcagaaccuguccgaggagcggaaggccagccuccgccaggccugggcccagaagcaccggggcccggccacccuggcggaggccugccgcgagcccgccugcgccgagggcuccgugaaggacagcggggucgacagccagggcgccuccugcagccugguguccacccccgaggagauccucuucgaggacgcguucgacguggccagcuuccuggacaaguccgagguccccagcaccuccagcuccagcuccgugcuggccagcugcaacccggagaaccccgaggagaaguuccagcucuacaugcagaucaucaacuucuucaaggggcuguccugcgccaacacccaggugaagcaggaggccagcuuccccgucgacgaggagaugaucaugcugcagugcaccgagaccuucgacgacgaggaccucuga

SEQ ID NO: 37242 - RNA, 1296 nt, Artificial Sequence
  derived and/or modified sequence opt1 from STRADA__Homo_sapiens__NP_001003787
augagcuuccugguguccaagcccgagcgcauccggcgcugggucagcgagaaguucaucguggagggccuccgggaccuggagcuguucggggagcagccgcccggcgacacccgccggaagaccaacgacgccuccagcgaguccaucgccagcuucuccaagcaggaggugaugagcuccuuccuccccgagggcgggugcuacgagcugcugacggucaucgggaagggcuucgaggaccucaugaccgugaaccuggcgcgcuacaagcccaccggcgaguacgugaccguccggcgcaucaaccuggaggccugcagcaacgagauggugacguuccuccagggggagcugcacguguccaagcuguucaaccacccgaacaucguccccuaccgggccaccuucaucgccgacaacgagcucuggguggugaccagcuucauggccuacggcuccgcgaaggaccugaucugcacccacuucauggacgggaugaacgagcuggccaucgccuacauccuccagggcguccugaaggcccuggacuacauccaccacaugggguacgugcaccgcagcgugaaggcgucccacauccucaucagcgucgacggcaagguguaccuguccggccugcggagcaaccucuccaugaucagccacgggcagcgccagcgggugguccacgacuuccccaaguacagcgugaaggugcugcccuggcuguccccggagguccuccagcagaaccugcagggcuacgacgccaagagcgacaucuacuccguggggaucacggccugcgagcuggccaacggccacgugcccuucaaggacaugcccgccacccagaugcuccuggagaagcugaacggcaccguccccugccuccuggacaccagcacgaucccggcggaggagcugaccaugucccccagccgcuccguggccaacagcgggcucuccgacagccugaccaccuccacgccccggcccagcaacggcgacuccccgagccaccccuaccaccgcaccuucagcccccacuuccaccacuucgucgagcagugccugcagcggaaccccgacgcccgcccguccgccuccacccuccugaaccacagcuucuucaagcagaucaagcggcgcgccuccgaggcgcugcccgagcuccugcggcccgugacccccaucacgaacuucgaggggagccagagccaggaccacuccggcaucuucgggcuggugaccaaccucgaggagcuggaggucgacgacugggaguucuga

SEQ ID NO: 37243 - RNA, 1134 nt, Artificial Sequence
  derived and/or modified sequence opt1 from STRADB__Homo_sapiens__NP_001193793
augagccugcucgacugcuucugcaccucccgcacccagguggagagccugcggcccgagaagcaguccgagacgagcauccaccaguaccuggucgacgagccgacccucuccuggagccgccccuccacccgggccagcgaggugcugugcuccaccaacgugagccacuacgagcugcaggucgagaucggccgcggguucgacaaccucacguccgugcaccuggcccggcacacccccaccggcacccuggugacgaucaagaucaccaaccucgagaacugcaacgaggagcgccugaaggcgcugcagaaggccgucauccucagccacuucuuccggcaccccaacaucaccaccuacuggacgguguucaccgugggguccuggcugugggucaucagcccguucauggccuacggcuccgccagccagcugcuccgcaccuacuuccccgaggggauguccgagacccugauccggaacauccuguucggcgccgugcgcggccucaacuaccugcaccagaacgggugcauccaccggagcaucaaggcgucccacauccugaucagcggcgacgggcucgugacgcugagcggccugucccaccuccacagccuggucaagcacgggcagcgccaccgggccguguacgacuucccccaguucuccaccagcgugcagcccuggcuguccccggagcuccugcgccaggaccugcacggcuacaacgucaagagcgacaucuacuccgugggcaucaccgccugcgagcucgccagcggccaggugcccuuccaggacaugcaccggacccagaugcugcugcagaagcucaaggggccgcccuacagcccccuggacaucuccaucuucccccaguccgagagccgcaugaagaacucccagagcggggucgacuccggcaucggcgagagcgugcugguguccagcgggacgcacaccgucaacuccgaccggcuccacacccccagcagcaagaccuucucccccgcguucuucagccuggugcagcugugccuccagcaggacccggagaagcgccccuccgccagcucccugcugagccacguguucuucaagcagcccuacuucgaguuccucuga

SEQ ID NO: 37244 - RNA, 1053 nt, Artificial Sequence
  derived and/or modified sequence opt1 from STRAP__Homo_sapiens__NP_009109
auggccaugcgccagacgccccugaccugcagcggccacacccggccgguggucgaccucgccuucuccgggaucacccccuacggcuacuuccugaucagcgcgugcaaggacgggaagcccaugcugcgccagggcgacaccggggacuggaucggcaccuuccucggccacaagggggccguguggggcgccacgcugaacaaggacgccaccaaggccgcgaccgccgccgccgacuucaccgcgaaggugugggacgccgucuccggggacgagcugaugacgcucgcccacaagcacaucgugaagaccguggacuucacccaggacagcaacuaccugcugaccggcgggcaggacaagcuccugcggaucuacgaccugaacaagcccgaggccgagccgaaggagaucuccggccacacgagcggcaucaagaaggcccucuggugcuccgaggacaagcagauccugagcgcggacgacaagaccguccgccugugggaccacgccaccaugaccgaggugaagucccucaacuucaacaugagcguguccagcauggaguacauccccgagggggagauccuggucaucacguacggccgguccaucgccuuccacagcgccgugucccuggaccccaucaagagcuucgaggcccccgcgaccaucaacuccgccagccuccacccggagaaggaguuccugguggccgggggcgaggacuucaagcuguacaaguacgacuacaacuccggcgaggagcucgagagcuacaaggggcacuucggccccauccacugcguccgcuucagccccgacggggagcuguacgccuccggcagcgaggacgggacccugcggcucuggcagaccguggugggcaagacguacggccuguggaagugcguccugcccgaggaggacuccggggagcucgccaagccgaagaucggcuuccccgagaccaccgaggaggagcuggaggagaucgcgagcgagaacuccgacugcaucuuccccagcgcccccgacgugaaggccuga

SEQ ID NO: 37245 - RNA, 5328 nt, Artificial Sequence
  derived and/or modified sequence opt1 from STRC__Homo_sapiens__NP_714544
auggcccugagccucuggccccugcugcuccugcugcuccugcugcuccugcuguccuucgccgugacccucgcgccgaccggcccccacagccuggaccccgggcuguccuuccucaagagccugcuguccacgcucgaccaggccccccagggcagccugucccgcagccgguucuucaccuuccuggccaacaucuccagcuccuucgagccggggcgcaugggcgaggggcccgucggcgagccccccccgcuccagccccccgcccugcggcugcacgacuuccucgugacccugcgcggcagccccgacugggagccgaugcuggggcuccugggcgacaugcuggcccuccuggggcaggagcagaccccccgggacuuccuggugcaccaggcgggcguccucgggggccugguggaggugcugcucggcgcccugguccccgggggccccccgacgcccacccgcccccccugcacccgggacgggccguccgacugcgugcuggccgccgacuggcuccccagccugcugcuccugcuggagggcacccgcuggcaggcgcucgugcagguccagcccuccguggaccccacgaacgccaccggccuggacgggcgggaggccgccccgcacuuccugcagggccuccuggggcugcugacccccaccggcgagcucgggagcaaggaggcccuguggggcggccugcuccgcacggugggggcgccccuguacgccgccuuccaggagggccugcuccgggucacccacucccugcaggacgagguguucagcauccuggggcagcccgagccggacaccaacggccagugccaggggggcaaccuccagcagcugcugcucuggggcgugcgccacaaccuguccugggacguccaggcccugggguuccucagcggcagcccccccccgccccccgcccugcugcacugccucuccaccggggugccccugccgcgggcgagccagcccuccgcccacaucagcccccgccagcggcgcgccaucacgguggaggcccugugcgagaaccaccucggccccgccccgcccuacuccaucagcaacuucuccauccaccugcugugccagcacaccaagcccgcgaccccccagccgcaccccagcaccacggccaucugccagaccgccgucugguacgccguguccugggcccccggggcgcagggcuggcuccaggccugccacgaccaguuccccgacgaguuccuggacgccaucugcagcaaccuguccuucagcgcccucuccggcagcaaccggcgccuggugaagcggcugugcgcggggcuccugccgccccccaccuccugccccgagggccugccgcccgucccccucacccccgacaucuucugggggugcuuccuggagaacgagacgcugugggccgagcgccucugcggcgaggccagccugcaggccgugccgcccuccaaccaggccugggugcagcacgucugccagggccccaccccggacgugaccgcgagcccccccugccacaucgggcccugcggcgagcggugcccggacgggggcuccuuccuggucauggugugcgccaacgacaccauguacgaggugcucguccccuucuggcccuggcuggccgggcagugccgcaucagccgcggcggcaacgacacgugcuuccuggaggggcuccugggcccccugcucccgagccugcccccccuggggcccuccccgcucugccugacccccggccccuuccugcucgggaugcugagccagcugccccggugccaguccagcgugccggcccucgcccaccccacccgccugcacuaccugcuccggcugcugaccuuccuccugggccccggcgcggggggcgccgaggcccaggggaugcugggccgcgcccuccugcuguccagccuccccgacaacugcuccuucugggacgccuuccggccggaggggcgccggagcgugcugcgcacgaucggcgaguaccuggagcaggacgaggagcagcccacccccuccggcuucgagcccaccgucaacccgagcuccgggaucagcaagauggagcuccuggcgugcuucucccccgugcugugggaccuccugcagcgggagaagagcgugugggcccugcagauccucguccaggccuaccugcacaugccccccgagaaccugcagcagcucgugcuguccgccgagcgcgaggcggcccagggcuuccugacccucaugcugcaggggaagcugcagggcaagcuccaggugccgcccagcgaggagcaggcccuggggcggcugacggcccuccugcugcagcgcuacccccggcucaccucccagcuguucaucgaccugagcccgcucauccccuuccuggccgucagcgaccugaugcgcuucccccccucccugcucgcgaacgacagcgugcuggccgccauccgggacuacuccccgggcaugcgccccgagcagaaggaggcccuggccaagcggcuccuggcgcccgagcuguucggcgaggugcccgccuggccgcaggagcuccugugggccguccugccccuccugccccaccugccccucgagaacuuccugcagcugagcccgcaccagauccaggcccucgaggacuccuggcccgccgcggggcugggccccgggcacgcccgccacgugcugcggagccucgugaaccaguccguccaggacggcgaggagcaggugcgccgccugggcccccuggccugcuuccucagcccggaggagcugcagucccuggugccccucagcgaccccaccgggcccgucgagcggggccugcuggagugcgccgcgaacgggacccucuccccggagggccgcguggccuacgagcugcugggggugcuccggagcuccggcggcgccguccugagcccccgcgagcugcgggugugggccccccucuucucccagcuggggcugcgcuuccuccaggagcugagcgagccccagcugcgggccaugcucccggugcugcagggcaccuccgucacgcccgcgcaggccgugcugcuccuggggcgccugcucccccggcacgaccugagccuggaggagcucugcucccugcaccugcuccugcccggccugagcccgcagacccuccaggccaucccccgccgggugcuggucggggccugcagcugccuggcccccgagcucucccgccugagcgcgugccagaccgccgcccugcuccagaccuuccgggugaaggacggcgugaagaacaugggcacgaccggggccggcccggccgucugcauccccgggcagcccauccccaccaccuggccggacugccugcugccccuccugccccugaagcuccugcagcuggacucccucgcgcugcuggccaaccgccggcgcuacugggagcuccccuggagcgagcagcaggcccaguuccuguggaagaagaugcaggugccgacgaaccugacccuccggaaccugcaggcccugggcacccucgccgggggcauguccugcgaguuccugcagcagaucaacagcaugguggacuuccuggaggucgugcacaugaucuaccagcuccccacccgcgugcggggcucccugcgcgcgugcaucugggccgagcugcagcggcgcauggccaugcccgagcccgaguggacgaccgucgggccggagcucaacggccuggacagcaagcugcuccuggaccugcccauccagcucauggaccgccuguccaacgagagcaucaugcuggugguggagcucguccagcgggcccccgagcagcugcuggcgcucaccccccugcaccaggccgcccuggccgagcgcgcccuccagaaccuggcgccgaaggagacccccguguccggggaggugcuggagacgcugggcccccucgucggcuuccuggggaccgagagcacccggcagaucccccugcagauccuccugucccaccugagccagcuccagggcuucugccugggggagaccuucgccacggagcugggcuggcuccugcugcaggaguccgugcucgggaagccggagcuguggagccaggacgagguggagcaggccggccgccuggucuucacccucuccaccgaggccaucagccugaucccccgggaggcccugggccccgagacccucgagcgccugcuggagaagcagcaguccugggagcagagccggguggggcagcucugccgcgagccccagcuggcggccaagaaggccgcccugguggccggcgucgugcggccggcggccgaggaccuccccgagcccgucccgaacugcgccgacgugcgcgggacguuccccgccgcguggagcgccacccagaucgccgagauggagcuguccgacuucgaggacugccugacccucuucgccggcgaccccgggcugggccccgaggagcugcgggccgcgaugggcaaggccaagcagcucugggggccgccccgcggcuuccggcccgagcagauccugcagcuggggcgccuccugaucggccugggggaccgggagcuccaggagcugauccugguggacuggggcguccucagcacccugggccagaucgacgggugguccacgacccagcugcgcaucguggugagcuccuuccuccggcagagcggccgccacgucucccaccuggacuucgugcaccugaccgcccucggguacacccugugcggccugcggcccgaggagcuccagcacaucagcuccugggaguucagccaggccgcccuguuccuggggacgcuccaccugcagugcuccgaggagcagcuggaggugcucgcgcaccugcugguccucccgggcggcuucgggcccaucagcaacuggggccccgagaucuucaccgagaucgggaccaucgccgccggcauccccgaccuggcccuguccgcccuccugcgcggccagauccagggggugaccccgcuggcgaucagcgugauccccccccccaaguucgccgucguguucuccccgauccagcucagcucccugacgagcgcccaggccguggcggucacccccgagcagauggccuuccugucccccgagcagcgccgggccguggccugggcccagcacgagggcaaggagagccccgagcagcaggggcgcagcaccgcguggggccuccaggacuggucccggccgagcuggucccuggugcugaccaucagcuuccucgggcaccugcuguga

SEQ ID NO: 37246 - RNA, 2394 nt, Artificial Sequence
  derived and/or modified sequence opt1 from STRN3__Homo_sapiens__NP_001077362
auggacgagcuggccggcgggggcgggggcgggcccggcauggccgcgccgccccgccagcagcagggccccgggggcaaccucgggcugagccccggcgggaacggcgccgccggcgggggcgggccgcccgccuccgagggcgccggccccgcggccgggcccgagcugagccggccgcagcaguacaccauccccggcauccuccacuacauccagcacgagugggcccgcuucgagauggagcgggcccacugggagguggagcgcgcggagcugcaggcccggaucgccuuccugcagggggagcgcaagggccaggagaaccucaagaaggaccugguccggcgcaucaagaugcuggaguacgcccucaagcaggagcgggccaaguaccacaagcugaaguacgggaccgagcugaaccagggcgaccucaagaugcccacguucgaguccgaggagaccaaggacaccgaggcgcccaccgccccgcagaacagccagcugacguggaagcagggccgccagcugcuccggcaguaccugcaggaggugggguacaccgacaccauccuggacgugcgcucccagcggguccgcagccuccugggccuguccaacagcgagcccaacggguccguggagaccaagaaccucgagcagauccugaacggcggggagagccccaagcagaagggccaggagaucaagcgguccagcggcgacgugcuggagacguucaacuuccucgagaacgccgacgacuccgacgaggacgaggagaacgacaugaucgaggggauccccgagggcaaggacaagcaccgcaugaacaagcacaagaucgggaacgagggccuggccgccgaccugaccgacgacccggacaccgaggaggcgcucaaggaguucgacuuccuggucaccgccgaggacggggagggcgccggcgaggcccggagcuccggggacggcacggagugggacaaggacgaccugagccccaccgccgaggugugggacguggaccaggggcucaucuccaagcugaaggagcaguacaagaaggagcgcaagggcaagaagggcgucaagcgggcgaaccgcaccaagcuguacgacaugaucgccgaccucggggacgacgagcugccccacauccccagcggcaucaucaaccagucccggagcgccagcacccgcaugacggaccacgagggggcccgcgccgaggaggcggagccgaucaccuuccccuccggcgggggcaagagcuucaucaugggcuccgacgacgugcugcucagcgugcuggggcugggcgaccucgccgaccugaccgucaccaacgacgccgacuacuccuacgaccugcccgccaacaaggacgcguuccggaagacguggaaccccaaguacacccuccgcagccacuucgacggggugcgggcccuggccuuccacccgguggagcccguccuggugaccgccuccgaggaccacacccucaagcuguggaaccugcagaagacggugcccgccaagaaguccgcgagccucgacgucgagcccaucuacaccuuccgcgcccacaucggcccggugcugagccuggccaucuccagcaacggggagcagugcuucuccggcggcaucgacgccaccauccagugguggaacaugcccagccccuccguggacccguacgacaccuacgagcccaacguccuggccgggacgcucgugggccacaccgacgcggugugggggcuggccuacagcggcaucaagaaccagcugcucuccugcagcgccgacgggaccguccggcuguggaacccccaggagaagcugcccugcaucugcaccuacaacggcgacaagaagcacggcaucccgacguccguggacuucaucgggugcgaccccgcccacauggucaccagcuucaacaccggcagcgccgugaucuacgaccucgagaccucccagagccuggugauccuguccagccaggucgacuccgggcuccagagcaacaaccacaucaaccgcguggugucccaccccacgcugcccgucaccaucaccgcgcacgaggaccggcacaucaaguucuucgacaacaagaccggcaagaugauccacagcaugguggcccaccuggacgccgugaccucccucgccgucgacccgaacgggaucuaccugaugagcggcucccacgacugcagcauccgccuguggaaccucgacuccaagacgugcgugcaggagaucaccgcgcaccggaagaagcuggacgagagcaucuacgacguggccuuccacuccagcaaggccuacaucgccuccgccggcgcggacgcccuggccaaggucuucguguga

SEQ ID NO: 37247 - RNA, 2283 nt, Artificial Sequence
  derived and/or modified sequence opt1 from STRN4__Homo_sapiens__NP_001034966
augauggaggagcgcgccgccgcggccguggccgccgccgcgagcuccugccggccccugggcagcggggccggcccggggcccaccggcgccgcccccgucuccgcgcccgccccggggcccggccccgccggcaagggcgggggcgggggcgggagccccggcccgaccgccgggcccgagccccucucccugcccggcauccugcacuucauccagcacgagugggcccgcuucgaggcggagaaggcccggugggaggccgagcgcgccgagcuccaggcccagguggcguuccugcagggggagcggaagggccaggagaaccugaagacggaccucgugcgccggaucaagaugcuggaguacgcccugaagcaggagcgcgccaaguaccacaagcucaaguucggcaccgaccugaaccagggggagaagaaggccgacgucagcgagcaggucuccaacggcccgguggagagcgugacccuggagaacagcccccucguguggaaggaggggcggcagcugcugcgccaguaccucgaggaggugggcuacaccgacacgauccuggacaugcgguccaagcgcguccggucccugcucgggcgcagccuggagcugaacggcgccguggagcccuccgagggcgcgccccgggccccgcccgggcccgccggccucagcgggggcgagucccugcuggugaagcagaucgaggagcagaucaagcgcaacgccgccgggaaggacggcaaggagcggcucggcgggagcguccugggccagauccccuuccugcagaacugcgaggacgaggacuccgacgaggacgacgagcucgacagcgugcagcacaagaagcagcgcgugaagcugccguccaaggcgcugguccccgagauggaggacgaggacgaggaggacgacagcgaggacgccaucaacgaguucgacuuccucgggagcggcgaggacggggagggcgcccccgacccccggcgcugcaccguggacggcuccccgcacgagcuggagagccggcgcgugaagcugcaggggauccucgccgaccugcgcgacgucgacggccugccgcccaaggugaccgggcccccgcccggcacgccccagccccggccccacgagggcuccuucggguucagcuccgacguguucaucauggacaccaucggcgggggcgaggucagccucggggaccuggcggaccugaccgugaccaacgacaacgaccucuccugcgaccugagcgacuccaaggacgccuucaagaagaccuggaaccccaaguucacgcugcgcagccacuacgacggcauccggucccucgccuuccaccacagccaguccgcccugcugaccgccagcgaggacggcacccucaagcuguggaaccugcagaaggcggugaccgccaagaagaacgccgcccucgacgucgagcccauccacgccuuccgcgcgcaccgggggccggugcuggccgucgccaugggcuccaacagcgaguacugcuacuccgggggcgccgacgccugcauccacagcuggaagauccccgaccuguccauggaccccuacgacggguacgaccccagcgugcugagccacgugcucgagggccacggcgacgcggucugggggcuggccuucuccccgacgagccagcgccuggccuccugcagcgccgacggcaccgugcggaucugggaccccuccagcuccagccccgcgugccucugcaccuuccccaccgccuccgagcacggggugccgacgagcgucgccuucaccuccaccgagcccgcccacaucguggccagcuuccgcuccggcgacaccgugcuguacgacauggaggucgggagcgcgcugcucacgcuggagucccggggcagcuccggccccacccagaucaaccagguggugagccaccccaaccagccgcugaccaucaccgcccacgacgaccgcgggauccgguuccucgacaaccgcacgggcaagcccguccacagcaugguggcccaccuggacgccgugaccugccuggccgucgaccccaacggggcguuccucauguccggcagccacgacugcucccugcggcuguggagccucgacaacaagaccugcgugcaggagaucaccgcccaccgcaagaagcacgaggaggccauccacgccguggccugccaccccuccaaggcgcugaucgccagcgccggggccgacgcgcuggccaaggucuucguguga

SEQ ID NO: 37248 - RNA, 2343 nt, Artificial Sequence
  derived and/or modified sequence opt1 from STRN__Homo_sapiens__NP_003153
auggacgagcaggccggccccgggguguucuucagcaacaaccacccgggcgccgggggcgcgaaggggcugggcccccucgccgaggccgccgccgcgggcgacggggccgccgccgcgggcgccgcccgcgcccaguacucccugcccgggauccugcacuuccuccagcacgagugggcccgguucgaggucgagcgcgcgcagugggagguggagcgggccgagcugcaggcccagaucgccuuccugcagggcgagcgcaaggggcaggagaaccucaagaaggaccuggugcggcgcaucaagaugcuggaguacgcccucaagcaggagcgggcgaaguaccacaagcugaaguacggcaccgagcugaaccagggcgacaugaagcccccgagcuacgacuccgacgaggggaacgagaccgagguccagccccagcagaacagccagcucauguggaagcagggccgccagcugcugcggcaguaccuccaggaggugggguacacggacaccauccuggacgugaaguccaagcgcguccgggcccugcucggcuucagcuccgacgugaccgaccgcgaggacgacaagaaccaggacagcguggucaacggcaccgaggccgaggugaaggagacggccaugaucgccaaguccgagcugaccgacagcgcguccgugcuggacaacuucaaguuccucgagagcgccgccgccgacuucuccgacgaggacgaggacgacgacgucgacgggcgggagaaguccgugaucgacaccagcaccaucgugcgcaagaaggcccugcccgacagcggcgaggaccgggacacgaaggaggcgcugaaggaguucgacuuccucgucaccuccgaggagggggacaacgagagccgcuccgccggcgacgggaccgacugggagaaggaggaccagugccugaugcccgaggccuggaacguggaccagggcgugaucaccaagcugaaggagcaguacaagaaggagcggaagggcaagaagggggucaagcgcccgaaccggagcaagcuccaggacaugcuggccaaccugcgcgacguggacgagcuccccagccugcagcccuccgugggcagccccucccggccgagcuccagccgccugcccgagcacgagaucaaccgcgcggacgaggucgaggcccucacguucccgcccuccagcgggaaguccuucaucaugggcgccgacgaggcccuggagagcgagcuggggcucggcgagcuggccggccugaccguggcgaacgaggccgacucccucaccuacgacaucgccaacaacaaggacgcccugcggaagaccuggaaccccaaguucacgcugcgcagccacuucgacgggauccgggcccucgcguuccaccccaucgagcccgugcugaucaccgccuccgaggaccacacccugaagauguggaaccuccagaagaccgcccccgccaagaaguccacgagccuggacgucgagccgaucuacaccuuccgcgcccacaagggccccgugcugugcgucgugaugagcuccaacggggagcagugcuacagcggcgggaccgacggccucauccagggcuggaacaccacgaaccccaacaucgaccccuacgacuccuacgacccgagcgugcugcgggggccccugcugggccacaccgacgcggucugggggcucgccuacagcgccgcccaccagcgccugcuguccugcagcgcggacggcacccuccggcuguggaacaccacggagguggcccccgcccuguccguguucaacgacaccaaggagcucggcauccccgccagcgucgaccugguguccagcgacccgucccacaugguggccagcuucuccaagggguacaccagcaucuucaacauggagacccagcagcgcauccugacgcucgaguccaacgucgacaccaccgcgaacagcuccugccagaucaaccgggugaucagccaccccacccugcccaucuccaucacggcccacgaggaccgccacaucaaguucuacgacaacaacaccggcaagcugauccacagcaugguggcccaccucgaggccgucaccucccuggccguggacccgaacgggcuguaccucaugagcggcagccacgacugcuccauccggcuguggaaccuggagagcaagaccugcauccaggaguucaccgcgcaccgcaagaaguucgaggaguccauccacgacguggccuuccaccccagcaagugcuacaucgccuccgccggggccgacgcgcucgccaaggucuucguguga

SEQ ID NO: 37249 - RNA, 1752 nt, Artificial Sequence
  derived and/or modified sequence opt1 from STS__Homo_sapiens__NP_000342
augccccugcgcaagaugaagaucccguuccuccugcuguucuuccucugggaggccgagagccacgccgcgucccggcccaacaucauccuggugauggccgacgaccugggcaucggggaccccggcugcuacgggaacaagaccauccgcacccccaacaucgaccggcucgccagcggcggggucaagcugacgcagcaccuggccgccuccccgcucugcacccccagccgcgcggccuucaugaccggccgguaccccgugcgcuccggcauggccagcuggucccggaccgggguguuccuguucacggccagcuccggcgggcugcccaccgacgagaucaccuucgcgaagcuccugaaggaccagggcuacagcaccgcccugaucgggaaguggcaccucggcauguccugccacagcaagacggacuucugccaccacccgcugcaccacggcuucaacuacuucuacgggaucucccugaccaaccuccgcgacugcaagcccggcgaggggagcgucuucaccaccggcuucaagcggcugguguuccugccccuccagaucgugggcgucacgcugcugacccucgccgcccugaacugccuggggcuccugcacgugccccugggcguguucuucucccuccuguuccuggccgcgcucauccugacccuguuccucggguuccugcacuacuuccgcccgcugaacugcuucaugaugcggaacuacgagaucauccagcagcccaugagcuacgacaaccucacccagcgccugacggucgaggccgcccaguucauccagcggaacaccgagacccccuuccugcucgugcuguccuaccugcacgugcacaccgcccucuucagcuccaaggacuucgccggcaagagccagcacggggucuacggcgacgcgguggaggagauggacuggagcgugggccagauccugaaccugcucgacgagcugcgccuggccaacgacacgcugaucuacuucaccuccgaccagggggcccacgucgaggaggugagcuccaagggcgagauccacgggggcagcaacgggaucuacaagggcggcaaggccaacaacugggagggcgggauccgggugcccgggauccuccgcuggccgcgggucauccaggccggccagaagaucgacgagcccaccuccaacauggacaucuuccccaccguggcgaagcuggccggggcgccccugccggaggaccgcaucaucgacggccgggaccucaugccccugcuggagggcaagagccagcgcuccgaccacgaguuccucuuccacuacugcaacgccuaccugaacgccgugcgguggcacccccagaacagcacguccaucuggaaggccuucuucuucacccccaacuucaacccggucgggagcaacggcugcuucgccacccacgugugcuucugcuucggguccuacgugacccaccacgacccgccccuccuguucgacaucagcaaggacccccgcgagcgcaacccccugacgcccgccuccgagccccgguucuacgagauccugaaggucaugcaggaggccgcggaccgccacacccagacccucccggaggugcccgaccaguucagcuggaacaacuuccuguggaagcccuggcugcagcucugcugccccuccaccggccugagcugccagugcgaccgggagaagcaggacaagcgccugucccgguga

SEQ ID NO: 37250 - RNA, 2118 nt, Artificial Sequence
  derived and/or modified sequence opt1 from STT3A__Homo_sapiens__NP_001265432
augaccaaguucggcuuccugcgccucagcuacgagaagcaggacacccugcugaagcuccugauccuguccauggccgccgugcucagcuucuccacgcggcuguucgcgguccugcgcuucgagagcgugauccacgaguucgaccccuacuucaacuaccggaccacccgcuuccucgccgaggagggguucuacaaguuccacaacugguucgacgaccgggccugguacccgcugggccgcaucaucgggggcaccaucuaccccgggcugaugaucacguccgccgccaucuaccacgugcuccacuucuuccacaucaccaucgacauccggaacgucugcguguuccuggcgccccuguucagcuccuucaccaccaucgugacguaccaccucaccaaggagcugaaggacgccggcgccggccugcucgccgcggccaugaucgccgucgugcccggguacaucagccgcuccguggccggcagcuacgacaacgaggggaucgccaucuucugcaugcugcugaccuacuacauguggaucaaggcggucaagaccggcuccaucugcugggccgccaagugcgcccucgccuacuucuacauggugagcuccuggggcggguacguguuccugaucaaccugaucccgcuccacguccuggugcugaugcucacgggccgguucagccaccgcaucuacguggcguacugcaccgucuacugccuggggaccauccuguccaugcagaucagcuucgugggcuuccagcccgugcucuccagcgagcacauggccgccuucggggucuucggccugugccagauccacgccuucguggacuaccugcgguccaagcucaacccccagcaguucgaggugcuguuccgcagcgucaucagccuggugggcuucgugcuccugaccgucggggcccugcucaugcugacgggcaagaucucccccuggaccgggcgguucuacagccugcucgacccguccuacgcgaagaacaacauccccaucaucgccagcguguccgagcaccagcccaccaccuggagcuccuacuacuucgaccugcagcugcucgucuucauguuccccgugggccuguacuacugcuucagcaaccuguccgacgcccgcaucuucaucaucauguacggggugacgagcauguacuucuccgccgucauggugcggcucaugcuggugcuggccccggucaugugcauccugagcggcaucggcgugucccaggugcucagcaccuacaugaagaaccuggacaucucccgccccgacaagaaguccaagaagcagcaggacagcaccuaccccaucaagaacgaggucgcgagcgggaugauccuggugauggccuucuuccucaucaccuacacguuccacuccaccugggugaccagcgaggccuacagcucccccagcaucguccuguccgcccggggcggggacggcagccgcaucaucuucgacgacuuccgggaggcguacuacuggcugcgccacaacaccccggaggacgccaaggugauguccuggugggacuacggguaccagaucacggccauggccaaccggaccauccucguggacaacaacaccuggaacaacacccacaucagccgcgucggccaggccauggcguccacggaggagaaggccuacgagaucaugcgcgagcuggacgugagcuacgugcuggucaucuucggcgggcucaccggcuacuccagcgacgacaucaacaaguuccuguggauggugcggaucgggggcuccaccgacaccgggaagcacaucaaggagaacgacuacuacacgcccaccggcgaguuccgcguggaccgggagggcagccccguccugcucaacugccugauguacaagaugugcuacuaccgcuucggccagguguacaccgaggccaagcggcccccgggguucgaccgcgugcggaacgccgagaucgggaacaaggacuucgagcuggacguccucgaggaggccuacaccaccgagcacuggcuggugcgcaucuacaaggugaaggaccuggacaaccggggccucucccgcacguga

SEQ ID NO: 37251 - RNA, 2481 nt, Artificial Sequence
  derived and/or modified sequence opt1 from STT3B__Homo_sapiens__NP_849193
auggccgagcccagcgccccggaguccaagcacaagagcucccugaacagcucccccuggagcggccucauggcgcuggggaacucccgccacggccaccacgggcccggcgcccagugcgcccacaaggccgccgggggcgcggcgcccccgaagcccgcccccgccggccugagcgggggccucucccagcccgccggguggcagagccugcuguccuucaccauccucuuccuggccuggcuggccggcuucagcucccgccucuucgccgugauccgguucgagagcaucauccacgaguucgacccgugguucaacuaccgguccacccaccaccuggccagccacggguucuacgaguuccugaacugguucgacgagcgcgcgugguacccccucggccggaucgucggcgggacgguguaccccggccugaugaucaccgccgggcugauccacuggauccucaacacccugaacaucaccgugcacauccgcgacgucugcguguuccuggcccccacguucuccggccucaccagcaucuccaccuuccugcugacccgggagcucuggaaccagggcgccgggcugcuggccgcgugcuucaucgccaucgugccgggcuacaucagccgcagcgucgccggguccuucgacaacgagggcaucgccaucuucgcccuccaguucacguacuaccugugggucaagagcgugaagaccggguccguguucuggaccaugugcugcugccugagcuacuucuacaugguguccgcguggggcggcuacguguucaucaucaaccucaucccccugcacgucuucgugcugcuccugaugcagcgguacagcaagcgcguguacaucgccuacuccaccuucuacaucgucgggcugauccucagcaugcagauccccuucgugggcuuccagcccauccggacguccgagcacauggccgccgccgggguguucgcgcugcugcaggccuacgccuuccuccaguaccugcgcgaccggcugaccaagcaggaguuccagacccucuucuuccugggcgucagccuggccgcgggggccguguuccucuccgugaucuaccugaccuacacgggcuacaucgccccguggagcggccgcuucuacucccugugggacaccggguacgccaagauccacauccccaucaucgccagcgucuccgagcaccagcccaccaccugggugagcuucuucuucgaccuccacauccuggugugcacguuccccgcgggccugugguucugcaucaagaacaucaacgacgagcgggucuucguggcccucuacgccaucuccgccgucuacuucgccggggugauggugcgccugaugcugacccugaccccggucgugugcaugcucagcgcgaucgccuucuccaacguguucgagcacuaccugggcgacgacaugaagcgggagaacccgcccgucgaggacagcagcgacgaggacgacaagcgcaaccaggggaaccuguacgacaaggccggcaaggugcggaagcacgccaccgagcaggagaagacggaggagggccucgggcccaacaucaaguccaucgugaccaugcugaugcugaugcuccugaugauguucgccguccacugcaccugggugaccagcaacgcguacuccagccccuccgugguccuggccagcuacaaccacgacggcacgcgcaacauccucgacgacuuccgggaggccuacuucuggcugcgccagaacaccgacgagcacgcccgcgugauguccuggugggacuacggguaccagaucgcgggcauggccaaccggaccacccugguggacaacaacacguggaacaacagccacaucgcccucgucggcaaggccauguccagcaacgagaccgccgcguacaagaucaugcgcacccuggacguggacuacgugcuggucaucuucgggggcgugaucggguacuccggcgacgacaucaacaaguuccucuggauggugcggaucgccgagggggagcaccccaaggacauccgcgagagcgacuacuucacgccccagggcgaguuccgggucgacaaggccggcucccccacccugcugaacugccucauguacaagaugagcuacuaccgcuucggggagaugcagcuggacuuccggaccccgcccggcuucgaccgcacccggaacgccgagaucgggaacaaggacaucaaguucaagcaccuggaggaggccuucaccuccgagcacuggcucgugcgcaucuacaaggugaaggcgcccgacaaccgggagacccuggaccacaagccgcgcgucacgaacaucuuccccaagcagaaguaccugagcaagaagaccaccaagcggaagcgcggcuacaucaagaacaagcucguguucaagaaggggaagaagaucuccaagaagaccguguga

SEQ ID NO: 37252 - RNA, 912 nt, Artificial Sequence
  derived and/or modified sequence opt1 from STUB1__Homo_sapiens__NP_005852
augaagggcaaggaggagaaggagggcggggcccgccugggggccggcgggggcagccccgagaaguccccgagcgcgcaggagcucaaggagcagggcaaccggcuguucguggggcgcaaguaccccgaggccgccgccugcuacggccgggccaucacccgcaacccccuggucgcgguguacuacaccaaccgggcccucugcuaccugaagaugcagcagcacgagcaggcccuggccgacugccgccgggcgcucgagcuggacgggcaguccgugaaggcccacuucuuccugggccagugccagcucgagauggagagcuacgacgaggccaucgccaaccugcagcgcgccuacucccuggcgaaggagcagcggcucaacuucggggacgacauccccagcgcccugcgcaucgccaagaagaagcgguggaacuccaucgaggagcgccggauccaccaggagagcgagcugcacuccuaccucagccgccugaucgccgccgagcgggagcgcgagcuggaggagugccagcggaaccacgagggcgacgaggacgacucccacguccgcgcgcagcaggccugcaucgaggccaagcacgacaaguacauggccgacauggacgagcuguucagccagguggacgagaagcggaagaagcgcgacaucccggacuaccucugcggcaagaucuccuucgagcugaugcgggagcccugcaucacgcccagcgggaucaccuacgaccgcaaggacaucgaggagcaccuccagcgcgugggccacuucgaccccgucacccgguccccgcugacccaggagcagcugauccccaaccucgccaugaaggaggugaucgacgcguucaucagcgagaacggguggguggaggacuacuga

SEQ ID NO: 37253 - RNA, 864 nt, Artificial Sequence
  derived and/or modified sequence opt1 from STX11__Homo_sapiens__NP_003755
augaaggaccgccuggccgagcuccuggaccugagcaagcaguacgaccagcaguuccccgacggcgacgacgaguucgacuccccgcacgaggacaucguguucgagaccgaccacauccucgagagccuguaccgggacauccgcgacauccaggacgagaaccagcugcucgucgccgacgugaagcggcuggggaagcagaacgcgcgcuuccugaccuccaugcggcgccucagcuccaucaagcgggacacgaacagcaucgccaaggccaucaaggcccgcggcgaggugauccacugcaagcugcgggccaugaaggagcuguccgaggcggccgaggcccagcacgggccccacagcgccgucgcgcgcaucucccgggcccaguacaacgcccucacccugaccuuccagcgcgccaugcacgacuacaaccaggccgagaugaagcagcgggacaacugcaagauccgcauccagcggcagcuggagaucaugggcaaggaggugagcggggaccagaucgaggacauguucgagcagggcaagugggacguguucuccgagaaccuccuggcggacgucaagggcgcccgcgccgcccugaacgagaucgagagccggcaccgcgagcuccugcggcuggagucccgcauccgggacgugcacgagcuguuccuccagauggccgugcuggucgagaagcaggcggacacccucaacgugaucgagcugaacgugcagaagacggucgacuacaccgggcaggccaaggcccaggugcgcaaggccgugcaguacgaggagaagaaccccugccgcacccugugcugcuucugcugccccugccucaaguga

SEQ ID NO: 37254 - RNA, 978 nt, Artificial Sequence
  derived and/or modified sequence opt1 from STX16__Homo_sapiens__NP_001001433
auggccacccgccggcugaccgacgccuuccuccugcugcgcaacaacagcauccagaaccggcagcuccuggcggagcaggucuccagccacaucacguccagcccccugcacucccgcagcaucgccgccgagcucgacgagcuggccgacgaccggauggcccugguguccggcaucagccucgaccccgaggcggccaucggggugaccaagcgcccgccgcccaaguggguggacggcguggacgagauccaguacgacguggggcggaucaagcagaagaugaaggagcuggccucccugcacgacaagcaccucaaccgccccacccuggacgacagcuccgaggaggagcacgccaucgagaucaccacgcaggagaucacccagcuguuccaccggugccagcgcgcggugcaggcccuccccagccgggcccgcgccugcuccgagcaggagggccggcugcuggggaacgucguggccagccucgcgcaggcccugcaggagcuguccaccagcuuccgccacgcccaguccggcuaccucaagcggaugaagaaccgcgaggagcggagccagcacuucuucgacaccuccgugccccugauggacgacggcgacgacaacacgcuguaccaccgcggguucaccgaggaccagcucguccugguggagcagaacacccugaugguggaggagcgggagcgcgagauccggcagaucguccagagcaucagcgaccucaacgagaucuuccgcgaccugggcgccaugaucguggagcaggggaccgugcuggaccgcaucgacuacaacgucgagcaguccugcaucaagacggaggacggccucaagcagcugcacaaggccgagcaguaccagaagaagaaccggaagaugcuggugauccucauccuguucgugaucaucaucguccugaucguggugcucgucggggucaagagccgcuga

SEQ ID NO: 37255 - RNA, 909 nt, Artificial Sequence
  derived and/or modified sequence opt1 from STX17__Homo_sapiens__NP_060389
augagcgaggacgaggagaaggugaagcugcgccggcucgagcccgccauccagaaguucaucaagaucgucaucccgaccgaccuggagcgccugcggaagcaccagaucaacaucgagaaguaccagcgcugccggaucugggacaagcuccacgaggagcacaucaacgccggccgcaccgugcagcagcugcgguccaacauccgcgagaucgagaagcugugccucaaggugcggaaggacgaccugguccugcucaagcgcaugaucgaccccgugaaggaggaggcgagcgccgccacggccgaguuccugcagcugcaccucgaguccguggaggagcugaagaagcaguucaacgacgaggagacccugcuccagccgccccugacccggagcaugaccgucgggggcgccuuccacacgaccgaggcggaggccuccagccagucccugacccagaucuacgcccuccccgagaucccccaggaccagaacgccgcggagagcugggagacccuggaggccgaccugaucgagcucucccagcuggugacggacuucagccugcucgugaacucccagcaggagaagaucgacagcaucgccgaccacgucaacuccgccgccgugaacguggaggaggggaccaagaaccugggcaaggcggccaaguacaagcuggccgcccuccccgucgccggggcgcugaucggcggcauggucgggggccccaucgggcugcucgccggcuucaagguggccgggaucgccgccgcgcugggcggcggggugcugggcuucaccgggggcaagcucauccagcgcaagaagcagaagaugauggagaagcugaccagcuccugcccggaccugcccagccagacggacaagaagugcuccuga

SEQ ID NO: 37256 - RNA, 1008 nt, Artificial Sequence
  derived and/or modified sequence opt1 from STX18__Homo_sapiens__NP_058626
auggccguggacaucacccuccuguuccgcgccagcgucaagaccgugaagacgcggaacaaggcgcugggcguggccgucgggggcgggguggacggcucccgcgacgagcuguuccggcgcagcccccggccgaagggggacuucuccagccgcgcccgggaggugaucucccacaucggcaagcuccgcgacuuccugcuggagcaccggaaggacuacaucaacgccuacagccacaccauguccgaguacggccgcaugaccgacaccgagcgggaccagaucgaccaggacgcccagaucuucaugcgcacgugcagcgaggcgauccagcagcuccggaccgaggcccacaaggagauccacucccagcaggucaaggagcaccgcaccgccgugcuggacuucaucgaggacuaccugaagcgggugugcaagcucuacagcgagcagcgcgccauccgggucaagcgcgugguggacaagaagcggcuguccaagcuggagcccgagcccaacaccaagacgcgcgagagcaccuccagcgagaaggucucccagagccccuccaaggacagcgaggagaacccggcgaccgaggagcggcccgagaagauccucgccgagacccagcccgagcuggggacguggggcgacgggaagggcgaggacgagcugucccccgaggagauccagauguucgagcaggagaaccagcgccucaucggggagaugaacagccuguucgacgaggugcgccagaucgagggccggguggucgagaucagccgccugcaggagaucuucaccgagaaggugcuccagcaggaggccgagaucgacuccauccaccagcugguggucggcgccaccgagaacaucaaggaggggaacgaggacauccgggaggccaucaagaacaacgcgggcuuccgcguguggauccuguucuuccucgugaugugcagcuucucccugcuguuccucgacugguacgacagcuga

SEQ ID NO: 37257 - RNA, 756 nt, Artificial Sequence
  derived and/or modified sequence opt1 from STX1A__Homo_sapiens__NP_001159375
augaaggaccggacccaggagcugcggaccgccaaggacagcgacgacgacgacgacguggccgucacgguggaccgcgaccgguucauggacgaguucuucgagcaggucgaggagauccgcggcuucaucgacaagaucgcggagaacguggaggaggugaagcggaagcacuccgccauccucgccagccccaacccggacgagaagaccaaggaggagcuggaggagcugauguccgacaucaagaagaccgccaacaaggugcgcagcaagcucaaguccaucgagcagagcaucgagcaggaggaggggcugaaccgguccagcgccgaccugcgcauccggaagacccagcacuccacgcucagccgcaaguucgucgaggugauguccgaguacaacgcgacccagagcgacuaccgggagcgcugcaagggccggauccagcgccagcuggagaucaccgggcggaccacgaccuccgaggagcuggaggacaugcucgagagcggcaaccccgccaucuucgccuccgggaucaucauggacagcuccaucagcaagcaggcccuguccgagaucgagacccgccacagcgagaucaucaagcuggagaacagcauccgggagcuccacgacauguucauggacauggcgaugcugguggagucccagaccauguggcgcggccccugccugacgccccggcgcccgagcuccacccgggcccgccgcgccggccgcaagagcuga

SEQ ID NO: 37258 - RNA, 867 nt, Artificial Sequence
  derived and/or modified sequence opt1 from STX1B__Homo_sapiens__NP_443106
augaaggaccgcacccaggagcugcggagcgccaaggacuccgacgacgaggaggaggugguccacguggaccgcgaccacuucauggacgaguucuucgagcaggucgaggagauccggggcugcaucgagaagcucagcgaggacguggagcaggucaagaagcagcacuccgccauccuggcggcccccaacccggacgagaagaccaagcaggagcuggaggaccucacggccgacaucaagaagaccgccaacaaggugcgcagcaagcugaaggccaucgagcaguccaucgagcaggaggaggggcugaaccggagcuccgcggaccuccgcauccggaagacccagcacagcacccugucccgcaaguucguggaggugaugacggaguacaacgccacccagagcaaguaccgggaccgcugcaaggaccggauccagcgccagcuggagaucaccggccggaccacgaccaacgaggagcucgaggacaugcuggaguccgggaagcuggccaucuucaccgacgacaucaagauggacagccagaugaccaagcaggcccucaacgagaucgagacgcgccacaacgagaucaucaagcuggagaccuccauccgggagcugcacgacauguucguggacauggcgaugcucgucgagagccagggcgagaugaucgaccgcaucgaguacaacguggagcacuccguggacuacgucgagcgggccgugagcgacaccaagaaggccgugaaguaccaguccaaggcccgccggaagaagaucaugaucaucaucugcugcgucgugcugggggugguccuggccagcuccaucggcggcacccucgggcuguga

SEQ ID NO: 37259 - RNA, 864 nt, Artificial Sequence
  derived and/or modified sequence opt1 from STX2__Homo_sapiens__NP_001971
augcgcgaccggcugcccgaccucaccgccugccgcaagaacgacgacggcgacaccguggucgugguggagaaggaccacuucauggacgacuucuuccaccaggucgaggagauccggaacagcaucgacaagaucacgcaguacguggaggaggugaagaagaaccacuccaucauccugagcgccccgaaccccgaggggaagaucaaggaggagcuggaggaccucaacaaggagaucaagaagaccgcgaacaagauccgcgccaagcugaaggccaucgagcaguccuucgaccaggacgagagcggcaaccggaccuccgucgaccugcgcauccggcgcacccagcacagcgugcucucccggaaguucguggaggccauggccgaguacaacgaggcgcagacgcuguuccgcgagcggagcaaggggcgcauccagcggcagcuggagaucaccggccgcaccaccacggacgacgagcucgaggagaugcuggaguccgggaagcccagcaucuucaccuccgacaucaucagcgacucccagaucacccggcaggcccugaacgagaucgagagccgccacaaggacaucaugaagcucgagaccuccauccgggagcugcacgagauguucauggacauggccauguucgucgagacgcagggcgagaugaucaacaacaucgagcgcaacgugaugaacgccaccgacuacguggagcacgcgaaggaggagaccaagaaggccaucaaguaccagagcaaggcccggcgcaagcugauguucaucaucaucugcgucaucgugcuccuggugauccugggcaucauccucgccaccacgcuguccuga

SEQ ID NO: 37260 - RNA, 834 nt, Artificial Sequence
  derived and/or modified sequence opt1 from STX3__Homo_sapiens__NP_001171511
augaaggaccgccuggagcagcucaaggccaagcagcugacccaggacgacgacaccgacgccguggagaucgcgaucgacaacacggccuucauggacgaguucuucagcgagaucgaggagacccggcugaacaucgacaagaucuccgagcacgucgaggaggccaagaagcucuacagcaucauccuguccgcccccaucccggagcccaagaccaaggacgaccuggagcagcucaccacggagaucaagaagcgcgccaacaacgugcggaacaagcucaagagcauggagaagcacaucgaggaggacgaggugcgcuccagcgcggaccugcggauccgcaagucccagcacagcguccugucccggaaguucguggaggugaugaccaaguacaacgaggcccaggucgacuuccgcgagcggagcaagggccgcauccagcggcagcuggagaucaccgggaagaagaccacggacgaggagcuggaggagaugcucgaguccggcaaccccgccaucuucaccagcgggaucaucgacucccagaucagcaagcaggcccuguccgagaucgagggccgccacaaggacaucgugcggcuggagagcuccaucaaggagcuccacgacauguucauggacaucgcgaugcugguggagaaccagggggagaugcuggacaacaucgagcucaacgucaugcacaccguggaccacguggagaaggcccgcgacgagaccaagaaggccgucaaguaccagagccaggcccggaagaagcugaucucccugcagacgggcguggccacccucguguuccgcuga

SEQ ID NO: 37261 - RNA, 888 nt, Artificial Sequence
  derived and/or modified sequence opt1 from STX4__Homo_sapiens__NP_001259025
augggcaugaccgcccgcaccaagcggacgcgcagcgggucccggugguggugcacccgcgcccggcacggcuggggcgcgcgcacccggagcuccagcaccagcccccuggggcacccgccccaggugcgcacgauccggcagaccaucgucaagcucgggaacaaggugcaggagcuggagaagcagcaggucaccauccuggccacgccccuccccgaggaguccaugaagcaggagcugcagaaccugcgcgacgagaucaagcagcucggccgggagauccgccugcagcugaaggccaucgagccgcagaaggaggaggccgacgagaacuacaacuccgugaacacccggaugcgcaagacccagcacggcgugcucagccagcaguucguggagcugaucaacaagugcaacuccaugcagagcgaguaccgggagaagaacgucgagcgcauccggcgccagcugaagaucaccaacgccgggaugguguccgacgaggagcucgagcagaugcuggacagcggccaguccgagguguucgucagcaacauccugaaggacacccaggugacgcggcaggcgcucaacgagaucuccgcccgccacagcgagauccagcagcuggagcgguccauccgcgagcugcacgacaucuucaccuuccucgccaccgagguggagaugcagggggagaugaucaaccgcaucgagaagaacauccugagcuccgccgacuacgucgagcggggccaggagcacgugaagaccgcgcuggagaaccagaagaaggcccgcaagaagaaggugcucaucgccaucugcgucagcaucacgguggugcugcuggccgucaucaucggggugaccguggucggcuga

SEQ ID NO: 37262 - RNA, 966 nt, Artificial Sequence
  derived and/or modified sequence opt1 from STX5__Homo_sapiens__NP_001231595
augaucccccgcaagcgguacggcagcaagaacaccgaccaggggguguaccugggccucuccaagacccagguccugagcccggccacggccggguccagcuccagcgacaucgcgccccugcccccgcccgugacccucgugcccccgccgcccgacaccauguccugccgcgaccggacccaggaguuccugagcgccugcaagucccugcagacgcgccagaacggcauccagaccaacaagcccgcccuccgggccguccgccagcggagcgaguucacccugauggccaagcgcaucgggaaggaccuguccaacaccuucgcgaagcucgagaagcugacgauccuggccaagcgcaagagccucuucgacgacaaggccguggagaucgaggagcugaccuacaucaucaagcaggacaucaacucccugaacaagcagaucgcccagcuccaggacuucgugcgggcgaagggcagccaguccggccggcaccuccagacccacagcaacaccaucgucgugucccugcagagcaagcucgccuccaugagcaacgacuucaagagcgugcuggagguccgcacggagaaccugaagcagcagcggucccgccgggagcaguucagccgcgcccccguguccgcccucccccuggcccccaaccaccucgggggcggggcggugguccugggcgccgagagccacgccuccaaggacguggccaucgacaugauggacagccggaccucccagcagcugcagcugaucgacgagcaggacagcuacauccagucccgcgccgacaccaugcagaacaucgagagcaccaucguggagcucggguccaucuuccagcagcuggcgcacauggucaaggagcaggaggagacgauccagagcgugcugcuguucccccugcugcccgcccucucccccggcagcacccggaccugcuga

SEQ ID NO: 37263 - RNA, 465 nt, Artificial Sequence
  derived and/or modified sequence opt1 from STX6__Homo_sapiens__NP_001273139
augaaggaccagaugagcaccuccagcgugcaggcccuggccgagcgcaagaaccggcaggcgcuccugggcgacuccgggagccagaacugguccaccggcacgaccgacaaguacgggcgccuggaccgggagcuccagcgcgccaacagccacuucaucgaggagcagcaggcccagcagcagcugaucgucgagcagcaggacgagcagcuggagcucguguccggcagcaucggggugcugaagaacaugucccagcggaucggcggcgagcuggaggagcaggccgucaugcucgaggacuucagccacgagcuggaguccacccagagccgccuggacaacgugaugaagaagcucgccaaggugucccacaugaccagcgaccggcgccaguggugcgcgaucgccauccuguucgccguccugcucguggugcugauccuguuccucguccuguga

SEQ ID NO: 37264 - RNA, 711 nt, Artificial Sequence
  derived and/or modified sequence opt1 from STX8__Homo_sapiens__NP_004844
auggcccccgacccgugguucagcaccuacgacuccacgugccagaucgcccaggagaucgcggagaagauccagcagcgcaaccaguacgagcggaagggcgagaaggcccccaagcugaccgugaccauccgcgcccuccugcagaaccugaaggagaagaucgcccuccugaaggaccugcuccugcgggccgucagcacccaccagaucacccagcuggagggggaccgccggcagaaccuccuggacgaccuggugacgcgcgagcggcuccugcuggcguccuucaagaacgagggcgccgagcccgaccucauccgcagcucccugaugagcgaggaggccaagcgcggggcccccaacccguggcuguucgaggagcccgaggagacccggggccucggguucgacgagauccggcagcagcagcagaagaucauccaggagcaggacgcgggccuggacgcccuguccagcaucaucucccgccagaagcagaugggccaggagaucgggaacgagcucgacgagcagaacgagaucaucgacgaccuggccaaccugguggagaacaccgacgagaagcuccggaacgagacccgccgggucaacaugguggaccgcaagagcgccuccugcggcaugaucauggugauccugcugcuccuggucgccaucgugguggucgcgguguggcccacgaacuga

SEQ ID NO: 37265 - RNA, 1785 nt, Artificial Sequence
  derived and/or modified sequence opt1 from STXBP1__Homo_sapiens__NP_001027392
auggcccccaucggccugaaggccguggucggggagaagaucaugcacgacgugaucaagaaggugaagaagaagggcgaguggaagguccucgugguggaccagcugagcaugcgcaugcuguccagcugcugcaagaugaccgacaucaugaccgaggggaucacgaucgucgaggacaucaacaagcggcgcgagccgcuccccucccuggaggcgguguaccugaucacccccagcgagaaguccgugcacagccucaucuccgacuucaaggacccgcccaccgccaaguaccgggccgcccacgucuucuucaccgacagcugccccgacgcccuguucaacgagcuggugaagucccgcgcggccaaggugaucaagacgcucaccgagaucaacaucgccuuccugcccuacgagagccaggucuacucccuggacagcgccgacuccuuccagagcuucuacagcccccacaaggcgcagaugaagaacccgauccucgagcggcuggccgagcagaucgccacccugugcgccacccucaaggaguaccccgccgugcgcuaccggggcgaguacaaggacaacgcgcugcuggcccagcucauccaggacaagcuggacgccuacaaggccgacgaccccacgaugggggagggccccgacaaggcccgcucccagcugcucauccuggaccggggcuucgacccguccagccccgugcugcacgagcucaccuuccaggcgauguccuacgaccugcugcccaucgagaacgacgucuacaaguacgagaccagcgggaucggcgaggcccgcgugaaggaggugcuccuggacgaggacgacgaccuguggaucgcccuccggcacaagcacaucgccgaggucagccaggaggugacccgcucccugaaggacuucagcuccagcaagcggaugaacacgggggagaagaccaccaugcgcgaccugucccagaugcucaagaagaugccccaguaccagaaggagcugagcaaguacuccacccaccuccaccuggccgaggacugcaugaagcacuaccagggcacgguggacaagcugugccgggucgagcaggaccuggcgauggggaccgacgccgagggcgagaagaucaaggacccgaugcgcgccaucgugcccauccuccuggacgccaacgugagcaccuacgacaagauccggaucauccugcucuacaucuuccugaagaacggcaucaccgaggagaaccugaacaagcucauccagcacgcccagaucccgcccgaggacuccgagaucaucacgaacauggcgcaccuggggguccccaucgugaccgacagcacccugcgccggcgcuccaagcccgagcggaaggagcgcaucagcgagcagaccuaccagcucucccgcuggacgcccaucaucaaggacaucauggaggacaccaucgaggacaagcuggacaccaagcacuaccccuacaucagcacccgguccagcgccuccuucagcacgaccgccgucuccgcccgcuacggccacuggcacaagaacaaggcgccgggggaguaccggagcggcccccgccugaucaucuucauccugggcggggugagccucaacgagaugcggugcgccuacgaggugacccaggccaacggcaagugggagguccugaucggguccacccacauccugacgccccagaagcuccuggacacccugaagaagcucaacaagaccgacgaggagaucagcuccuga

SEQ ID NO: 37266 - RNA, 1773 nt, Artificial Sequence
  derived and/or modified sequence opt1 from STXBP2__Homo_sapiens__NP_001120868
auggcccccagcggccugaaggccguggucggggagaagauccucuccggcgugauccgcagcgugaagaaggacggggaguggaagguccugaucauggaccacccguccaugcggauccugagcuccugcugcaagaugagcgacauccucgcggagggcaucaccaucguggaggacaucaacaagcgccgggagcccauccccucccuggaggccaucuaccugcucagccccaccgagaaggcccugaucaaggacuuccaggggacgccgaccuucaccuacaaggccgcccacaucuucuucaccgacacgugccccgagccccuguucuccgagcucggccgcagccggcuggcgaagguggucaagacccugaaggagauccaccucgccuuccugcccuacgaggcccagguguucucccuggacgccccgcacagcaccuacaaccucuacugccccuuccgcgcggaggagcggacccgccagcuggaggugcuggcccagcagaucgccacgcucugcgccacccugcaggaguaccccgccauccgguaccgcaagggccccgaggacaccgcgcagcuggcccacgccguccucgccaagcugaacgccuucaaggcggacaccccgucccugggggagggccccgagaagacgcggagccagcuccugaucauggaccgcgccgccgaccccgugagcccccugcuccacgagcugaccuuccaggccauggccuacgaccugcucgacaucgagcaggacaccuaccgguacgagaccacggggcuguccgaggcgcgcgagaaggccgugcugcucgacgaggacgacgaccugugggucgagcugcggcacaugcacaucgccgacguguccaagaaggugaccgagcuccugcgcaccuucugcgagagcaagcggcugaccacggacaaggccaacaucaaggaccucucccagauccugaagaagaugccgcaguaccagaaggagcugaacaaguacagcacccaccuccaccuggccgacgacugcaugaagcacuucaagggcagcgucgagaagcugugcuccguggagcaggaccucgcgauggggagcgacgccgagggcgagaagaucaaggacuccaugaagcugaucgugcccguccugcucgacgccgccgugcccgcguacgacaagauccgcgugcugcugcuguacauccuccugcggaacggcgucagcgaggagaaccuggccaagcucauccagcacgccaacgugcaggcccacuccagccugauccgcaaccuggagcagcucgggggcaccgugaccaaccccgggggcuccggcacgagcucccggcuggagccgcgcgagcgcauggagcccaccuaccagcugagccgguggacccccgucaucaaggacgugauggaggacgccgucgaggaccgccucgaccggaaccuguggcccuucguguccgacccggcgcccaccgccagcucccaggccgccgugagcgcccgcuucgggcacuggcacaagaacaaggcgggcaucgaggcccgggccgggccccgccugaucgucuacgugaugggcgggguggccauguccgagaugcgggccgcguacgaggucacgcgcgccaccgagggcaagugggaggugcucaucggcagcucccacauccugacccccacccgguuccuggacgaccucaaggcccuggacaagaagcuggaggacaucgcccucccguga

SEQ ID NO: 37267 - RNA, 1662 nt, Artificial Sequence
  derived and/or modified sequence opt1 from STXBP4__Homo_sapiens__NP_848604
augaacaagaacaccagcaccguggucagccccagccugcucgagaaggacccggccuuccagaugaucacgaucgccaaggagaccggccuggggcugaaggugcucggcgggaucaaccgcaacgagggcccccugguguacauccaggagaucauccccgggggcgacugcuacaaggacggccggcugaagcccggggaccagcucgucuccgugaacaaggagagcaugaucggcguguccuucgaggaggccaagagcaucaucaccggggcgaagcugcgccuggaguccgccugggagaucgccuucauccggcagaaguccgacaacauccagccggagaaccucagcugcaccagccugaucgaggccuccggcgaguacgggccccaggcgagcacgcugucccucuucagcuccccgcccgagauccugauccccaagaccagcuccacccccaagaccaacaacgacauccugagcuccugcgagaucaagacgggcuacaacaagaccguccagauccccaucaccagcgagaacagcaccgugggccucuccaacacggacguggccagcgccuggaccgagaacuacgggcugcaggagaagaucucccugaaccccagcguccgcuucaaggccgagaagcucgagauggcgcugaacuaccugggcauccagccgaccaaggagcagcaccaggcccuccggcagcagguccaggccgacuccaaggggaccgugagcuucggcgacuucguccagguggcccgcaaccuguucugccugcagcucgacgaggugaacgugggcgcccacgagaucuccaacauccuggacagccagcugcuccccugcgacuccagcgaggcggacgagauggagcggcugaagugcgagcgcgacgacgcccugaaggaggugaacacgcucaaggagaagcugcuggaguccgacaagcagcggaagcagcucaccgaggagcugcagaacgugaagcaggaggccaaggccgucguggaggagacccgcgcccugcggagccgcauccaccucgcggaggccgcccagcggcaggcccacgggauggagauggacuacgaggaggugauccgccugcuggaggccaagaucaccgagcucaaggcgcagcuggccgacuacuccgaccagaacaaggagagcguccaggaccugaagaagcggaucauggugcucgacugccagcugcgcaaguccgagauggcccggaagacguucgaggccagcaccgagaagcugcuccacuucguggaggccauccaggaggucuucuccgacaacagcaccccgcuguccaaccugagcgagcgccgggcggugcucgccagccagaccucccugacgccccugggccgcaacgggcggagcauccccgccacccuggcccucgaguccaaggagcuggucaagagcgugcgcgcgcugcucgacauggacugccugcccuacggcugggaggaggccuacaccgccgacgggaucaaguacuucaucaaccacgugacccagacgaccuccuggauccaccccgucaugagcgugcugaaccucucccgcagcgaggagaacgaggaggacugcucccgggagcugcccaaccagaaguccuga

SEQ ID NO: 37268 - RNA, 3456 nt, Artificial Sequence
  derived and/or modified sequence opt1 from STXBP5__Homo_sapiens__NP_001121187
augcgcaaguucaacauccggaaggugcuggacggccucaccgccgggagcuccagcgccucccagcagcagcagcagcagcacccgcccggcaaccgcgagcccgagauccaggagacccugcagagcgagcacuuccagcugugcaagacgguccggcacggguuccccuaccagcccuccgcgcucgccuucgacccggugcagaagauccuggccgugggcacccagaccggggcccugcgccucuucggccggcccggcgucgagugcuacugccagcacgacagcggggccgcggugauccagcugcaguuccugaucaacgagggcgcccucguguccgcccuggccgacgacacccugcaccucuggaaccugcgccagaagcggcccgcgauccugcacagccucaaguucugccgcgagcgggucacguucugccaccuccccuuccaguccaaguggcuguacguggggaccgagcgcggcaacauccacaucgugaacgucgagagcuucacccucuccggguacgugaucauguggaacaaggccaucgagcugagcuccaagagccacccgggccccgugguccacaucuccgacaaccccauggacgagggcaagcugcucaucggguucgagagcggcaccguggugcugugggaccugaaguccaagaaggccgacuaccgguacacguacgacgaggccauccacagcgucgccuggcaccacgaggggaagcaguucaucugcucccacagcgacggcacccucaccaucuggaacgugcgcagccccgcgaagccggugcagaccaucacgccccacggcaagcagcugaaggacgggaagaagcccgagcccugcaagccgauccugaaggucgaguucaagaccacccgguccggcgagcccuucaucauccucagcgggggccuguccuacgacaccguggggcgccggcccugccugacggugaugcacggcaagagcaccgccguccucgagauggacuacuccaucguggacuuccugacccugugcgagacccccuacccgaacgacuuccaggagcccuacgccguggucgugcuccuggagaaggaccugguccucaucgaccuggcccagaacggcuaccccaucuucgagaaccccuacccgcugagcauccacgagucccccgugacgugcugcgaguacuucgccgacugccccguggaccucauccccgcgcuguacagcgucggggcccgccagaagcggcagggcuacuccaagaaggaguggccgaucaacgggggcaacugggggcugggcgcccagagcuaccccgagaucaucaucaccggccacgccgacggguccgugaaguucugggacgccagcgcgaucacccuccaggugcuguacaagcugaagaccuccaaggucuucgagaagucccgcaacaaggacgaccggcccaacacggacaucguggacgaggacccguacgccauccagaucaucuccuggugccccgagagccgcaugcucugcaucgccggcguguccgcccacgucaucaucuaccgguucagcaagcaggaggugaucaccgaggugauccccaugcuggagguccgccugcucuacgagaucaacgacguggagacccccgagggggagcagccgccgccccugcccacccccgugggcggguccaacccccagcccaucccgccccagagccaccccagcacguccagcuccagcuccgacggccugcgcgacaacguccccugccugaaggugaagaacagcccccucaagcaguccccgggcuaccagaccgagcuggugauccagcuggucugggucgggggcgagccgccccagcagaucaccagccucgccgugaacuccagcuacgggcuggugguguucggcaacugcaacggcaucgcgaugguggacuaccugcagaaggccguccuccugaaccuggggaccaucgagcucuacggcuccaacgaccccuaccggcgcgagccccggagcccccgcaagucccggcagcccagcggggccggccugugcgacaucuccgaggggacgguggugcccgaggaccgcugcaagagcccgaccuccggcagcagcagcccccacaacagcgacgacgagcagaagaugaacaacuucaucgagaaggucaagaccaagucccggaaguucagcaagaugguggccaacgacaucgcgaagaugucccgcaagcugagccuccccaccgaccugaagccggaccuggacgugaaggacaacuccuucagccggucccgcagcuccagcgucacguccaucgacaaggagagccgggaggccaucuccgcccuccacuucugcgagaccuucacccgcaagaccgacagcucccccagccccugccugugggugggcaccacgcuggggaccgugcucgucaucgcccugaaccugcccccgggcggggagcagcggcuccugcagcccgugaucgugucccccagcggcaccauccugcgccucaagggggccauccugcggauggcguuccuggacaccacgggcugccucaucccgcccgccuacgagcccuggcgcgagcacaacguccccgaggagaaggacgagaaggagaagcugaagaagcggcgccccgugagcguguccccgagcuccagccaggagaucuccgagaaccaguacgccgucaucugcagcgagaagcaggccaaggugaucucccugcccacccagaacugcgccuacaagcagaacaucaccgagaccagcuucgugcuccggggcgacaucgucgcgcuguccaacagcaucugccuggccugcuucugcgccaacgggcacaucaugacguucucccuccccagccugcgcccccugcucgacguguacuaccugccgcugaccaacaugcgcaucgcccggaccuucugcuucaccaacaacggccaggcccucuaccuggugucccccacggagauccagcgccugaccuacagccaggagaccugcgagaaccuccaggagaugcugggggagcuguucacccccgucgagacgcccgaggcgccgaaccggggcuucuucaaggggcuguucggcggcggggcccagucccuggaccgcgaggagcuguucggcgagagcuccagcgggaaggccucccggagccucgcccagcacauccccggccccgggggcaucgagggcgugaagggggcggccagcggcguggucggggagcuggcccgcgcccggcuggcccucgacgagcgcggccagaagcugggcgaccuggaggagcggaccgcggccaugcucuccagcgccgaguccuucagcaagcacgcccacgagaucaugcugaaguacaaggacaagaagugguaccaguucuga

SEQ ID NO: 37269 - RNA, 3561 nt, Artificial Sequence
  derived and/or modified sequence opt1 from STXBP5L__Homo_sapiens__NP_055795
augaagaaguucaacuuccgcaaggugcuggacggccucaccgccagcucccccgggagcggcuccagcuccgggagcaacuccggcgggggcgccggcagcggguccguccacccggcgggcaccgccggggugcugcgggaggagauccaggagacgcugaccagcgaguacuuccagaucugcaagaccgugcgccacggcuucccccaccagcccaccgcccucgccuucgaccccguccagaagauccuggccaucgggacgcggaccggcgcgauccgcauccugggccggccggggguggacugcuacugccagcacgaguccggcgccgccgugcuccagcugcaguuccugaucaacgagggggcccucgucagcgcguccagcgacgacacccugcaccuguggaaccuccgccagaagcggcccgccauccugcacucccugaaguucaaccgcgagcggaucaccuacugccaccuccccuuccagagcaaguggcuguacgugggcacggagcgcggcaacacccacaucgugaacaucgaguccuucauccugagcggguacgucaucauguggaacaaggccaucgagcucuccaccaagacccaccccggcccgguggugcaccugagcgacagcccccgggacgaggggaagcugcucaucggcuacgagaacgggacggucguguucugggaccugaaguccaagcgcgccgagcugcggguguacuacgacgaggccauccacagcaucgacuggcaccacgagggcaagcaguucaugugcucccacagcgacggcucccucacccuguggaaccucaagagccccucccgccccuuccagaccaccaucccgcacggcaagagccagcgggaggggcgcaaguccgagagcugcaagcccauccugaaggucgaguacaagacgugcaagaacuccgagcccuucaucaucuucagcgggggccuguccuacgacaaggcgugccggcgccccagccugaccaucaugcacgggaaggccaucaccgugcucgagauggaccacccgaucguggaguuccugacccugugcgagacgcccuaccccaacgaguuccaggagcccuacgccgucguggugcuccuggagaaggaccugaucgucguggaccucacccaguccaacuucccgaucuucgagaaccccuaccccauggacauccacgagagccccgugaccugcaccgccuacuucgccgacugcccgcccgaccugauccugguccucuacuccaucggcgugaagcacaagaagcagggcuacagcaacaaggaguggcccaucuccgggggcgcguggaaccugggggcccagacguaccccgagaucaucaucaccggccacgccgacgggagcaucaaguucugggacgccagcgccaucacccugcagaugcucuacaagcugaagaccuccaaggucuucgagaagcagaaggugggcgagggcaagcagacgugcgagaucguggaggaggacccguucgcgauccagaugaucuacuggugccccgagagccggaucuucugcgucuccggggugagcgccuacgugaucaucuacaaguucucccgccacgagaucaccaccgagaucgucagccuggaggugcggcuccaguacgacguggaggacaucaucacccccgagccggagacguccccgcccuuccccgaccugagcgcccagcugcccuccagccgcucccucagcggcuccaccaacaccgucgccagcgagggggugaccaaggacuccauccccugccugaacgugaagacgcgccccguccggaugcccccgggcuaccaggccgagcuggugauccagcuggugugggucgacggcgagccgccccagcagaucaccagccucgcgguguccagcgccuacgggaucguggccuucggcaacugcaacgggcuggccgucguggacuucauccagaagaccgugcugcucagcaugggcaccaucgaccuguaccgcuccagcgaccuguaccagcggcagccccgcagcccccggaagaacaagcaguucaucgcggacaacuucugcaugcgcgggcucuccaacuucuaccccgaccugaccaagcggauccgcacguccuaccagagccugaccgagcucaacgacucccccgucccccuggagcuggagcggugcaagagcccgaccuccgaccacgugaacggccacugcaccagccccacgucccagagcugcuccagcggcaagcgccucuccagcgccgacguguccaaggucaaccggugggggcccggccggcccccguuccgcaaggcccagagcgccgccugcauggagaucucccugcccgugaccaccgaggagaaccgcgagaacagcuacaaccggagccgcuccagcuccaucagcuccaucgacaaggacagcaaggaggcgaucaccgcccuguacuucauggacuccuucgcccggaagaacgacagcacgaucucccccugccucuucguggggaccagccugggcaugguccugaucaucucccucaaccugccccuggccgacgagcagcgcuucaccgagccggugauggugcuccccagcgggaccuuccugucccugaagggcgccguccucacguucagcugcauggaccggaugggcgggcugaugcagcccccguacgagguguggcgcgaccccaacaacaucgacgagaacgagaaguccuggcgccggaagguggucaugaacagcuccagcgcgucccaggagaucggcgaccaccaguacaccaucaucugcagcgagaagcaggccaagguguucagccugcccucccagaccugccucuacgugcacaacaucaccgagacgagcuucauccugcaggccaacgucguggugaugugcuccagcgccugccuggccugcuucugcgcgaacgggcacaucaugaucaugucccuccccagccugcgcccgaugcuggacgucaacuaccucccccugaccgacaugcggaucgcccgcaccuucugcuucaccaacgagggccaggcccuguaccucgugucccccacggagauccagcggcugaccuacagccaggagaugugcgacaaccugcaggacaugcucggggaccuguucacccccaucgagaccccggaggcccagaaccgcggcuuccugaagggccucuucgggggcuccgggcagacguucgaccgggaggagcuguucggcgaggcgagcgccgggaaggccucccgcagccuggcccagcacauccccggccccggcuccaucgaggggaugaagggcgccgccgggggcgugaugggcgagcucacccgggcgcgcaucgcccuggacgagcgggggcagcgccugggcgagcucgaggagaagaccgccgggaugaugaccagcgccgaggcguucuccaagcacgcccacgagcugaugcugaaguacaaggacaagaagugguaccaguucuga

SEQ ID NO: 37270 - RNA, 633 nt, Artificial Sequence
  derived and/or modified sequence opt1 from STXBP6__Homo_sapiens__NP_001291406
augagcgccaaguccgccaucagcaaggagaucuucgcgccccuggacgagcgcaugcucggcgccgugcaggucaagcggcgcaccaagaagaagaucccguuccuggccaccgggggccagggggaguaccugacguacaucugccucuccgugaccaacaagaagcccacccaggccagcaucaccaaggugaagcaguucgagggcuccacgagcuucguccggcgcucccaguggaugcuggagcagcugcgccaggugaacgggaucgaccccaacggcgacagcgccgaguucgaccuccuguucgagaacgcguucgaccaguggguggccuccaccgccagcgagaagugcaccuucuuccagauccugcaccacacgugccagcgguaccucaccgaccggaagcccgaguucaucaacugccaguccaagaucaugggcgggaacagcauccugcacuccgccgcggacagcgucaccuccgccgugcagaaggccagccaggcccugaacgagcgcggcgagcggcucgggcgcgccgaggagaagaccgaggaccugaagaacuccgcgcagcaguucgccgagaccgcccacaagcuggccaugaagcacaagugcuga

SEQ ID NO: 37271 - RNA, 1269 nt, Artificial Sequence
  derived and/or modified sequence opt1 from STYK1__Homo_sapiens__XP_005253474
augggcaugacccgcaugcugcucgagugcagccuguccgacaagcugugcgugauccaggagaagcaguacgaggucaucaucgugcccacccuccuggugacgaucuuccugauccuccugggggucauccuguggcuguucauccgggagcagcgcacccagcagcagcggagcggcccgcaggggaucgcccccgugcccccgccccgcgaccuguccugggaggccggccacgggggcaacguggcgcugccccucaaggagaccagcgucgagaacuuccugggcgccaccacgcccgcccuggccaagcuccaggugccccgggagcagcuguccgaggugcuggagcagaucugcagcggguccugcggcccgaucuuccgcgccaacaugaacaccggggaccccagcaagcccaaguccgucauccucaaggcgcugaaggagcccgccggccugcacgaggugcaggacuuccucgggcggauccaguuccaccaguaccugggcaagcacaagaaccuggugcagcucgagggcugcugcaccgagaagcugccgcuguacaugguccucgaggacguggcccagggggaccugcugagcuuccucuggaccugccgccgggacgugaugacgauggacggccugcuguacgaccucaccgagaagcaggucuaccacaucgggaagcagguccugcuggcccucgaguuccugcaggagaagcaccuguuccacggcgacguggcggcccgcaacauccucaugcaguccgaccugaccgccaagcugugcggccucgggcuggccuacgaggucuacacccggggcgccaucagcuccacgcagaccaucccccugaaguggcucgcgcccgagcgccugcugcuccggcccgccagcauccgcgccgacgugugguccuucgggauccugcuguacgagauggugacccugggcgccccgcccuaccccgaggugcccccgaccagcauccucgagcaccuccagcggcgcaagaucaugaagcggcccuccagcugcacgcacaccauguacuccaucaugaaguccugcuggcgcuggcgggaggccgaccgccccagcccccgggagcugcgccuccgccuggaggcggccaucaagaccgccgacgacgaggccgugcuccaggugccggagcuggucgugcccgagcuguacgccgcggucgccgggauccggguggagagccuguucuacaacuacagcaugcucuga

SEQ ID NO: 37272 - RNA, 672 nt, Artificial Sequence
  derived and/or modified sequence opt1 from STYX__Homo_sapiens__NP_001124173
auggaggacgugaagcuggaguuccccagccucccgcagugcaaggaggacgccgaggaguggaccuaccccaugcgccgggagaugcaggagauccugcccggccuguuccucgggcccuacuccagcgccaugaaguccaagcugccgguccugcagaagcacggcaucacccacaucaucugcauccgccagaacaucgaggcgaacuucaucaagcccaacuuccagcagcuguuccgguaccucgugcuggacaucgccgacaaccccguggagaacaucauccgcuucuuccccaugacgaaggaguucaucgacgggagccuccagaugggcgggaagguccuggugcacggcaacgccggcaucucccggagcgccgccuucgugaucgcguacaucauggagaccuucgggaugaaguaccgcgacgccuucgccuacguccaggagcggcgcuucugcaucaacccgaacgccggcuucgugcaccagcugcaggaguacgaggcgaucuaccucgccaagcugaccauccagaugaugagcccccugcagaucgagcggucccucuccgugcacagcgggaccacgggcucccugaagcgcacccacgaggaggaggacgacuucgggaccaugcaggucgccaccgcccagaacggcuga

SEQ ID NO: 37273 - RNA, 384 nt, Artificial Sequence
  derived and/or modified sequence opt1 from SUB1__Homo_sapiens__NP_006704
augcccaagagcaaggagcugguguccagcuccagcuccggcagcgacuccgacagcgaggucgacaagaagcucaagcgcaagaagcaggucgccccggagaagcccgugaagaagcagaagaccggggagaccucccgggcccugagcuccagcaagcaguccagcuccagccgcgacgacaacauguuccagaucggcaagaugcgguacguguccgugcgcgacuucaaggggaaggugcugaucgacauccgggaguacuggauggaccccgagggcgagaugaagcccgggcgcaagggcaucagccucaacccggagcaguggucccagcugaaggagcagaucagcgacaucgacgacgcgguccggaagcuguga

SEQ ID NO: 37274 - RNA, 1392 nt, Artificial Sequence
  derived and/or modified sequence opt1 from SUCLA2__Homo_sapiens__NP_003841
auggccgccagcauguucuacggccgccugguggcggucgccacccuccggaaccaccgcccccggaccgcccagcgcgccgccgcccaggugcugggguccagcggccuguucaacaaccacgggcuccaggugcagcagcagcagcagcggaaccugucccugcacgaguacaugagcauggagcuccugcaggaggcgggcgucuccgugccgaagggguacguggccaagagccccgacgaggccuacgcgaucgccaagaagcugggcuccaaggacgucgugaucaaggcccaggugcucgccggcgggcgcggcaaggggacguucgagagcggccugaagggcggggucaagaucguguucucccccgaggaggccaaggcggugagcucccagaugaucggcaagaagcuguucaccaagcagaccggggagaagggccggaucugcaaccagguccucgugugcgagcgcaaguacccccggcgcgaguacuacuucgccaucaccauggagcggagcuuccaggggccggugcugaucggcuccagccacggcggggucaacaucgaggacguggccgccgagucccccgaggccaucaucaaggagcccaucgacaucgaggagggcaucaagaaggagcaggcgcugcagcucgcccagaagaugggguucccgcccaacaucguggagagcgccgccgagaacauggucaagcuguacucccuguuccucaaguacgacgccacgaugaucgagaucaaccccaugguggaggacagcgacggcgcggugcugugcauggacgccaagaucaacuucgacuccaacagcgccuaccgccagaagaagaucuucgaccugcaggacuggacccaggaggacgagcgggacaaggacgccgccaaggcgaaccucaacuacaucgggcuggacggcaacaucggcugccuggucaacggggccggccucgccauggccaccauggacaucaucaagcugcacgggggcacccccgcgaacuuccuggacgucgggggcggcgccacggugcaccaggugaccgaggccuucaagcucaucaccagcgacaagaaggugcuggccauccuggucaacaucuucgggggcaucaugcgcugcgacgugaucgcccaggggaucgugauggcggucaaggaccucgagaucaagauccccguggugguccggcugcagggcacccgcguggacgacgccaaggcccugaucgccgacuccgggcucaagauccuggccugcgacgaccuggacgaggcggcccggaugguggucaagcucagcgagaucgugacgcuggccaagcaggcccacguggacgucaaguuccagcugccgaucuga

SEQ ID NO: 37275 - RNA, 1041 nt, Artificial Sequence
  derived and/or modified sequence opt1 from SUCLG1__Homo_sapiens__NP_003840
augaccgccacccuggccgcggccgccgacaucgccacgauggugagcggcuccagcgggcucgccgcggcccgccugcugucccggagcuuccuccugccccagaacggcauccgccacugcuccuacaccgccagccggcagcaccuguacgucgacaagaacaccaagaucaucugccagggguucaccggcaagcaggggacguuccacucccagcaggcccucgaguacggcaccaagcuggugggcgggaccaccccgggcaagggcgggcagacgcaccuggggcuccccguguucaacaccgucaaggaggcgaaggagcagaccggcgccaccgccagcgugaucuacgugcccccgcccuucgccgccgcggccaucaacgaggccaucgaggccgagaucccccuggucgugugcaucacggagggcaucccccagcaggacauggugcgcgucaagcacaagcugcuccggcaggagaagacccgccugaucgggcccaacugcccgggcgugaucaaccccggggagugcaagaucggcaucaugcccggccacauccacaagaaggggcggaucggcaucgugucccgcagcgggacccugaccuacgaggccguccaccagacgacccaggugggccucgggcagucccugugcgugggcaucggcggggaccccuucaacggcaccgacuucaucgacugccuggagaucuuccucaacgacagcgcgaccgaggggaucauccugaucggcgagaucgggggcaacgccgaggagaacgccgccgaguuccugaagcagcacaacuccggcccgaacagcaagcccgucguguccuucaucgccgggcucacggcgccgcccggccggcgcauggggcacgccggcgccaucaucgccgggggcaagggcggggccaaggagaagaucagcgcgcugcaguccgccggcguggucgugagcaugucccccgcccagcuggggaccaccaucuacaaggaguucgagaagcggaagaugcucuga

SEQ ID NO: 37276 - RNA, 1323 nt, Artificial Sequence
  derived and/or modified sequence opt1 from SUCLG2__Homo_sapiens__NP_001171070
auggccagccccguggccgcgcaggccggcaagcugcuccgcgcccuggcccugcggccgcgcuuccucgccgcggggucccaggccguccagcugaccagccggcgcuggcugaaccuccaggaguaccaguccaagaagcugaugagcgacaacggcgugcgggugcagcgcuucuucgucgccgacaccgccaacgaggcgcuggaggccgccaagcggcucaacgccaaggagaucgugcugaaggcccagauccuggccgggggccgcgggaagggcguguucaacuccggccucaagggcgggguccaccugacgaaggaccccaacgugguggggcagcuggccaagcagaugaucggcuacaaccucgccaccaagcagacccccaaggagggggucaaggugaacaaggugauggucgccgaggcccuggacaucagccgggagaccuaccuggcgauccucauggaccgcuccugcaacggccccgugcuggugggcagcccgcagggcggggucgacaucgaggagguggccgccuccaaccccgagcugaucuucaaggagcagaucgacaucuucgaggggaucaaggacagccaggcccagcggauggccgagaaccucggcuucgugggcccccugaagucccaggcggccgaccagaucacgaagcuguacaaccucuuccugaagaucgacgccacccaggucgaggugaaccccuucggggagaccccggagggccagguggucugcuucgacgccaagaucaacuucgacgacaacgccgaguuccgccagaaggacaucuucgcgauggacgacaagagcgagaacgagcccaucgagaacgaggccgccaaguacgaccugaaguacaucgggcucgacggcaacaucgccugcuucgugaacggggcgggccuggccauggcgaccugcgacaucaucuuccugaacggcgggaagcccgccaacuuccucgaccugggcgggggcgugaaggaggcccaggucuaccaggcguucaagcugcucacggccgaccccaagguggaggccauccuggucaacaucuucgggggcaucgugaacugcgccaucaucgccaacggcaucaccaaggcgugccgggagcuggagcucaaggugccgcuggucgugcgccuggaggggaccuucauggagaagaagggcuccuacaugcacaucaagcaggagaccgggaacagcaacgagaacaucacgggcauccaggagaacguggcccaccagaaccucuccaagugcgccaucagcaucuuccugugcuga

SEQ ID NO: 37277 - RNA, 1005 nt, Artificial Sequence
  derived and/or modified sequence opt1 from SUCNR1__Homo_sapiens__NP_149039
augcugggcaucauggccuggaacgcgaccugcaagaacuggcucgccgccgaggccgcccuggagaaguacuaccugagcaucuucuacgggaucgaguucguggucggcgugcucgggaacaccaucguggucuacggcuacaucuucucccugaagaacuggaacagcuccaacaucuaccuguucaaccucagcguguccgaccuggccuuccugugcacgcuccccaugcugauccgcagcuacgcgaacgggaacuggaucuacggcgacgugcugugcaucuccaaccgguacguccuccacgccaaccuguacaccagcauccuguuccucaccuucaucuccaucgaccgcuaccugaucaucaaguacccguuccgggagcaccuccugcagaagaaggaguucgccauccugaucagccuggccaucugggugcucgugacccuggagcugcuccccauccugccccugaucaaccccgucaucacggacaacggcacgaccugcaacgacuucgcguccagcggggacccgaacuacaaccucaucuacuccaugugccugacccugcucggcuuccugaucccccuguucgugaugugcuucuucuacuacaagaucgcccucuuccugaagcagcgcaaccgccagguggccaccgcccugccccucgagaagccccugaaccuggucaucauggccguggugaucuucagcguccucuucaccccguaccacgugaugcggaacgugcggaucgcgucccgccuggggagcuggaagcaguaccagugcacccaggucgugaucaacuccuucuacaucgugacccggccccuggccuuccucaacagcgucaucaaccccguguucuacuuccugcugggcgaccacuuccgcgacaugcucaugaaccagcugcggcacaacuucaagucccugacgagcuucagccgcugggcccacgagcuccugcuguccuuccgggagaaguga

SEQ ID NO: 37278 - RNA, 3765 nt, Artificial Sequence
  derived and/or modified sequence opt1 from SUCO__Homo_sapiens__NP_055098
augaagaagcaccgccgggcccuggcccucgugagcugccuguuccugugcucccucgucuggcugcccagcuggcgcgugugcugcaaggaguccagcuccgcgagcgccuccagcuacuacucccaggacgacaacugcgcccuggagaacgaggacgugcaguuccagaagaaggacgagcgggagggccccaucaacgccgagagccucgggaaguccggcagcaaccugcccaucucccccaaggagcacaagcugaaggacgacagcaucgucgacgugcagaacaccgaguccaagaagcucagcccgcccguggucgagacccugcccacgguggaccugcacgaggaguccagcaacgccguggucgacuccgagaccguggagaacaucagcagcuccagcaccuccgagaucacccccaucagcaagcucgacgagaucgagaaguccgggacgauccccaucgcgaagccgagcgagaccgagcaguccgagaccgacugcgacgugggcgaggcccuggacgccagcgcccccaucgagcagcccuccuucgucagcccgcccgacucccugguggggcagcacaucgagaacgugagcuccagccacggcaagggcaagaucaccaaguccgaguucgagagcaaggucuccgcgagcgagcagggcggcggggaccccaaguccgcccucaacgccagcgacaaccugaagaacgagagcuccgacuacacgaagcccggggacaucgaccccaccagcguggccuccccgaaggaccccgaggacauccccaccuucgacgaguggaagaagaaggugauggaggucgagaaggagaagucccagagcaugcacgccagcuccaacgggggcagccacgcgaccaagaaggugcagaagaaccgcaacaacuacgccuccguggagugcggcgccaagauccuggccgccaaccccgaggccaagagcacguccgcgauccucaucgagaacauggaccuguacaugcugaacccgugcagcaccaagaucugguucgucaucgagcucugcgagcccauccaggugaagcagcuggacaucgccaacuacgagcuguucuccagcacccccaaggacuuccucguguccaucagcgaccgguaccccaccaacaaguggaucaagcuggggacguuccacggccgcgacgagcggaacguccaguccuucccgcuggacgagcagauguacgccaaguacgugaagauguucaucaaguacaucaaggucgagcuccugagccacuucgggagcgagcacuucugcccccugucccucauccgcguguucggcaccagcaugguggaggaguacgaggagaucgccgacucccaguaccacagcgagcggcaggagcuguucgacgaggacuacgacuacccccuggacuacaacaccggcgaggacaaguccagcaagaaccuccugggguccgcgaccaacgccauccugaacauggucaacaucgccgccaacauccucggcgccaagacggaggaccugaccgaggggaacaagagcaucuccgagaacgcgaccgccaccgccgcccccaagaugccggagagcacgcccguguccacccccgugccgagccccgaguacgucaccaccgaggugcacacgcacgacauggagcccuccacccccgacaccccgaaggagagccccaucgugcagcugguccaggaggaggaggaggaggcgucccccagcaccgugacgcuccugggcuccggggagcaggaggacgagagcucccccugguucgagagcgagacccagaucuucugcagcgagcugaccaccaucugcugcaucuccagcuucuccgaguacaucuacaaguggugcagcgugcgcgucgcccucuaccggcagcgcucccggacggcccugagcaagggcaaggacuaccuggugcucgcccagccgccccugcugcuccccgccgaguccguggacgucagcgugcugcagccccuguccggcgagcuggagaacaccaacaucgagcgcgaggcggagaccgugguccucggggaccugagcuccagcaugcaccaggacgaccuggugaaccacaccguggacgccgucgagcucgagccgucccacagccagacccugucccagagccugcuccuggacaucacgcccgagaucaacccccugcccaagaucgagguguccgagagcguggaguacgaggccggccacaucccgucccccgucaucccccaggagagcagcguggagaucgacaacgagaccgagcagaaguccgagagcuucuccagcaucgagaagcccuccaucaccuacgagaccaacaaggugaacgagcucauggacaacaucaucaaggaggacgucaacagcaugcagaucuucacgaagcuguccgagaccaucgugccgcccaucaacaccgccaccgugcccgacaacgaggacggggaggccaagaugaacaucgcggacacggccaagcagacccugaucagcgucguggacuccagcucccuccccgaggugaaggaggaggagcagagcccggaggacgcccugcugcggggccuccagcgcaccgccaccgacuucuacgccgagcugcagaacuccacggaccugggguacgcgaacggcaaccucguccacggcagcaaccagaaggaguccguguucaugcggcugaacaaccgcaucaaggcccuggaggugaacaugagccucuccgggcgguaccuggaggagcugagccagcgcuaccggaagcagauggaggagaugcagaaggccuucaacaagaccaucgucaagcuccagaacaccucccgcaucgccgaggagcaggaccagcgccagaccgaggcgauccagcugcugcaggcccagcucacgaacaugacccagcuggugagcaaccugagcgccaccguggccgagcucaagcgggaggucuccgaccgccagagcuaccuggugaucucccuggugcucugcgucgugcugggccugaugcucugcaugcagcggugccgcaacaccagccaguucgacggggacuacaucuccaagcugcccaagagcaaccaguaccccuccccgaagcggugcuucagcuccuacgacgacaugaaccugaagcgccggacgagcuucccccucaugcgcuccaagagccugcagcugaccggcaaggagguggaccccaacgaccucuacaucgucgagccccugaaguucuccccggagaagaagaagaagcggugcaaguacaagaucgagaagaucgagaccaucaagcccgaggagccccugcaccccaucgccaacggggacaucaagggccgcaagccguucaccaaccagcgggacuucagcaacaugggcgagguguaccacuccagcuacaaggggccgcccuccgagggcagcuccgagacgagcagccaguccgaggagagcuacuucugcgggaucuccgcgugcaccagccucugcaacggccagucccagaagaccaagaccgagaagcgcgcccugaagcggcgccggagcaaggugcaggaccagggcaagcugaucaagacgcucauccagaccaaguccgggagccugcccucccugcacgacaucaucaagggcaacaaggagaucaccgucgggaccuucggcgugacggccgugagcgggcacaucuga

SEQ ID NO: 37279 - RNA, 987 nt, Artificial Sequence
  derived and/or modified sequence opt1 from SUDS3__Homo_sapiens__NP_071936
augagcgccgccgggcugcucgcgcccgccccggcccaggccggggccccgcccgcgcccgaguacuaccccgaggaggacgaggagcuggaguccgccgaggacgacgagcgcagcugccggggccgcgaguccgacgaggacaccgaggacgccagcgagaccgaccuggccaagcacgacgaggaggacuacguggagaugaaggagcagauguaccaggacaagcucgcgucccugaagcggcagcugcagcagcuccaggaggggacgcugcaggaguaccagaagcgcaugaagaagcuggaccagcaguacaaggagcggauccgcaacgccgagcuguuccuccagcuggagaccgagcaggucgagcggaacuacaucaaggagaagaaggccgccgugaaggaguucgaggacaagaagguggagcucaaggagaaccugaucgccgagcuggaggagaagaagaagaugaucgagaacgagaagcucaccauggagcugaccggcgacagcauggaggucaagcccaucaugacgcgcaagcugcggcgccggcccaacgaccccgugccgauccccgacaagcgccggaagcccgcgcccgcccagcucaacuaccugcugaccgacgagcagaucauggaggaccuccgcacccugaacaagcugaaguccccgaagcggcccgccagccccuccagccccgagcaccucccggccacccccgccgagucccccgcgcagcgcuucgaggcccggaucgaggacgggaagcuguacuacgacaagcgcugguaccacaagagccaggccaucuaccuggaguccaaggacaaccagaagcucagcugcgugaucuccagcgucggcgccaacgagaucugggugcggaagacguccgacagcaccaagaugcgcaucuaccugggccagcugcagcggggccucuucgugauccgccgccgguccgccgcguga

SEQ ID NO: 37280 - RNA, 1302 nt, Artificial Sequence
  derived and/or modified sequence opt1 from SUFU__Homo_sapiens__NP_001171604
auggccgagcugcgccccagcggcgccccggggcccaccgcgccgcccgcccccggccccaccgccccgcccgccuucgccucccucuucccgcccgggcugcacgcgaucuacggcgagugccggcgccuguaccccgaccagcccaacccccuccaggugacggccaucgucaaguacuggcucgggggccccgacccccuggacuacgugagcauguaccggaacgugggcucccccagcgccaacaucccggagcacuggcacuacaucuccuucgggcugagcgaccuguacggcgacaaccgcguccacgaguucaccgggaccgacggccccuccggguucggcuucgagcugaccuuccggcucaagcgcgagacgggcgagagcgccccgcccaccuggcccgcggagcugaugcaggggcuggcccgguacguguuccaguccgagaacaccuucugcagcggcgaccacguguccuggcacagcccccucgacaacuccgagagccgcauccagcacaugcugcugaccgaggacccccagaugcagcccguccagacgccguucgggguggugaccuuccuccagaucgucggcgugugcaccgaggagcugcacuccgcccagcaguggaacggccaggggauccuggagcuccugcggaccgugcccaucgccggcgggcccuggcugaucacggacaugcgccggggcgagaccaucuucgagaucgacccccaccuccaggagcgcgucgacaaggggaucgagaccgacggcagcaaccuguccggcgugagcgccaagugcgcgugggacgaccugucccggccgcccgaggacgacgaggacagccgcagcaucugcaucgggacccagccccggcgccucuccggcaaggacacggagcagauccgggagacccugcgccgggggcuggagaucaacagcaagccggugcucccgcccaucaacccccagcgccagaacggccuggcccacgaccgggcccccucccgcaaggacagccuggaguccgacagcuccaccgccaucaucccccacgagcucauccgcacccggcagcuggagagcguccaccugaaguucaaccaggaguccggggcccucaucccccugugccugcgcggccggcuccugcacggccgccacuucacguacaagagcaucaccggggacauggcgaucaccuucguguccaccggcguggagggggccuucgccacggaggagcaccccuacgccgcccacggcccguggcugcagcucuga

SEQ ID NO: 37281 - RNA, 1416 nt, Artificial Sequence
  derived and/or modified sequence opt1 from SUGCT__Homo_sapiens__NP_001180240
augcccagcgagacccacgccaugcuggccacccucgcgcgcguggccgcccugcggcgcacgugccuguucuccggccgcgggggcgggcgcggccucuggaccgggcggccgcagagcgacaugaacaacaucaagccccuggagggcgucaagauccuggaccucacccgcgugcuggccggccccuucgccaccaugaaccugggggaccucggcgcggaggugaucaaggucgagcggcccggggccggcgacgacacgcgcaccugggggccgcccuucgugggcaccgaguccaccuacuaccugagcgugaaccggaacaagaaguccaucgccgucaacaucaaggaccccaagggcgugaagaucaucaaggagcuggccgcggugugcgacgucuucguggagaacuacgugcccgggaagcucagcgccaugggccugggguacgaggacaucgacgagaucgccccgcacaucaucuacugcuccaucacgggcuacggccagaccgggcccaucagccagcgcgccggcuacgacgccgucgcguccgccgugagcgggcugaugcacaucaccggccccgagaacggggaccccgugcggccgggcgucgccaugaccgaccucgccacgggccuguacgccuacggggcgaucauggccggccugauccagaaguacaagaccgggaagggccucuucaucgacugcaaccugcuguccagccagguggccugccucucccacaucgccgccaacuaccugaucgggcagaaggaggcgaagcgcuggggcaccgcccacggcagcaucgugcccuaccaggccuucaagaccaaggacggguacaucgucgugggcgccgggaacaaccagcaguucgccacggugugcaagauccuggaccuccccgagcugaucgacaacuccaaguacaagaccaaccaccuccggguccacaaccgcaaggagcugaucaagauccugagcgagcgguucgaggaggagcugaccuccaaguggcucuaccuguucgagggcagcggggugcccuacggcccgaucaacaacaugaagaacguguucgcggagccccagaacgccgucuccggcuuccagagccugcuccacagccuggcccacgggcccuuccugcaccuccagggcuccgcccgcgugcugcacaacgggcuggucauggagauggagcaccccaccgugggcaagaucagcgugccgggccccgcgguccgguacuccaaguucaagaugagcgaggcccggcccccgccccuccuggggcagcacacgacccacauccugaaggaggugcuccgguacgacgaccgcgccaucggcgagcugcuguccgccgggguggucgaccagcacgagacccacuga

SEQ ID NO: 37282 - RNA, 1938 nt, Artificial Sequence
  derived and/or modified sequence opt1 from SUGP1__Homo_sapiens__NP_757386
augagccugaagauggacaaccgcgacguggccggcaaggccaaccggugguucggggucgcgcccccgaaguccggcaagaugaacaugaacauccuccaccaggaggagcugaucgcccagaagaagcgcgagaucgaggccaagauggagcagaaggccaagcagaaccagguggccagcccccagccgccccaccccggggagaucaccaacgcgcacaacuccagcugcaucuccaacaaguucgccaacgacggcagcuuccugcagcaguuccucaagcugcagaaggcccagaccuccacggacgcccccaccagcgcgcccuccgcgcccccgagcacccccacccccuccgccgggaagcggagccugcucaucucccgccggacgggccugggccuggccagccuccccgggccggugaaguccuacagccacgccaagcagcugcccgucgcccaccgccccuccguguuccagagccccgacgaggacgaggaggaggacuacgagcaguggcuggagaucaagguguccccgcccgagggcgccgagacccggaaggucaucgagaagcucgcccgcuucguggccgagggcgggcccgagcuggagaagguggccauggaggacuacaaggacaaccccgcguucgccuuccugcacgacaagaacagccgggaguuccucuacuaccgcaagaaggucgccgagauccggaaggaggcccagaagucccaggccgcgagccagaaggugagcccgcccgaggacgaggaggugaagaaccuggccgagaagcuggcccgcuucaucgccgacgggggccccgaggucgagaccaucgcccuccagaacaaccgggagaaccaggcguucuccuuccuguacgagcccaacagccagggcuacaaguacuaccgccagaagcuggaggaguuccggaaggccaaggccuccagcaccggguccuucacggccccggaccccggccucaagcgcaagagcccgcccgaggcgcuguccgggagccugccgcccgccacgaccugccccgccuccagcacccccgcccccaccaucauccccgcccccgcggccccgggcaagcccgccuccgccgccaccgugaagcggaagcgcaagagccgguggggccccgaggaggacaagguggagcugcccccggcggagcucguccagcgcgacguggacgccucccccagcccccuguccgugcaggaccucaaggggcugggcuacgagaaggggaagcccgucggccuggugggggugaccgagcucagcgacgcccagaagaagcagcugaaggagcagcaggagaugcagcagauguacgacaugaucaugcagcacaagcgggccaugcaggacaugcagcugcucugggagaaggccguccagcagcaccagcacggcuacgacuccgacgaggagguggacagcgagcugggcaccugggagcaccagcugcgccgcauggagauggacaagacgcgggagugggcggagcagcucaccaagauggggcgcggcaagcacuucaucggggacuuccugccgcccgacgagcuggagaaguucauggagaccuucaaggcccucaaggagggccgggagcccgacuacagcgaguacaaggaguucaagcugaccguggagaacaucggguaccagaugcugaugaagaugggcuggaaggagggcgaggggcucggcuccgaggggcagggcaucaagaaccccgucaacaaggggacgaccaccguggacggcgccggcuucgggaucgaccgcccggccgagcugagcaaggaggacgacgaguacgaggcguuccggaagcgcaugaugcuggccuaccgguuccgccccaacccccucaacaacccccggcgcccguacuacuga

SEQ ID NO: 37283 - RNA, 1098 nt, Artificial Sequence
  derived and/or modified sequence opt1 from SUGT1__Homo_sapiens__NP_001124384
auggccgccgcggccgccggcaccgccaccagccagcgcuucuuccaguccuucagcgacgcccugaucgacgaggacccccaggcggcccucgaggagcugacgaaggcccuggagcagaagccggacgacgcccaguacuacugccagcgggcguacugccacauccuccuggggaacuacugcguggccgucgccgacgccaagaagucccuggagcucaaccccaacaacagcaccgccaugcugcgcaagggcaucugcgaguaccacgagaagaacuacgcggccgcccuggagaccuucaccgaggggcagaagcucgacaucgagacgggcuuccaccggguggggcaggccggccugcagcugcucaccuccagcgacccgcccgcccuggacucccagagcgcgggcaucaccggggccgacgccaacuucuccguguggaucaagcgcugccaggaggcccagaacggcagcgaguccgaggucuggacccaccagagcaagaucaaguacgacugguaccagacggagucccagguggugaucacccugaugaucaagaacguccagaagaacgacgugaacguggaguucagcgagaaggagcucuccgcccuggucaagcugcccagcggggaggacuacaaccucaagcuggagcugcuccaccccaucauccccgagcaguccaccuucaaggugcugagcaccaagaucgagaucaagcugaagaagcccgaggcggugcggugggagaagcucgagggccagggggacgucccgacgcccaagcaguucguggccgacgugaagaaccuguaccccuccagcagccccuacacccgcaacugggacaagcuggucggcgagaucaaggaggaggagaagaacgagaagcucgagggcgacgccgcccugaaccggcuguuccagcagaucuacuccgacgggagcgacgaggugaagcgcgccaugaacaaguccuucauggagagcggcgggaccgugcucuccaccaacuggagcgacgucggcaagcggaagguggagaucaacccgcccgacgacauggaguggaagaaguacuga

SEQ ID NO: 37284 - RNA, 2616 nt, Artificial Sequence
  derived and/or modified sequence opt1 from SULF1__Homo_sapiens__NP_055985
augaaguacagcugcugcgcccuggugcucgccguccugggcaccgagcugcucgggucccugugcagcaccgugcgcagcccccgguuccgcggccggauccagcaggagcgcaagaacauccggccgaacaucauccuggugcucacggacgaccaggacgucgagcuggggagccuccaggugaugaacaagacccgcaagaucauggagcacggcggggcgaccuucaucaacgccuucgugaccacgcccaugugcugccccucccggagcuccaugcugaccggcaaguacguccacaaccacaacguguacaccaacaacgagaacugcagcucccccagcuggcaggccaugcacgagccgcgcaccuucgccguguaccugaacaacacgggcuaccggaccgccuucuucgggaaguaccugaacgaguacaacggcuccuacaucccgcccggguggcgcgaguggcucggccugaucaagaacagccgguucuacaacuacaccgucugccgcaacgggaucaaggagaagcacggcuucgacuacgcgaaggacuacuucaccgaccugaucacgaacgaguccaucaacuacuucaagaugagcaagcggauguacccccaccgccccgugaugauggugaucucccacgccgcgccccacggccccgaggacagcgcgccccaguucuccaagcucuacccgaacgccagccagcacaucacccccuccuacaacuacgcccccaacauggacaagcacuggaucaugcaguacaccgggcccaugcugccgauccacauggaguucaccaacauccugcagcggaagcgccuccagacgcugaugagcgucgacgacagcguggagcggcuguacaacaugcucguggagaccggcgagcuggagaacaccuacaucaucuacaccgccgaccacggguaccacaucggccaguucggccuggucaaggggaaguccaugcccuacgacuucgacauccgcgugcccuucuucauccggggccccagcguggagccgggguccaucgucccccagaucgugcucaacaucgaccuggcccccacgauccuggacaucgccggccucgacacgcccccggacguggacggcaagagcguccugaagcugcucgaccccgagaagcccggcaaccgcuuccggaccaacaagaaggccaagaucuggcgcgacaccuuccugguggagcgcggcaaguuccugcggaagaaggaggaguccagcaagaacauccagcaguccaaccaccuccccaaguacgagcgcgugaaggagcugugccagcaggcccgguaccagaccgccugcgagcagccggggcagaaguggcagugcaucgaggacaccagcggcaagcugcgcauccacaagugcaaggggcccuccgaccuccugaccguccggcagagcacccgcaaccuguacgcccggggcuuccacgacaaggacaaggagugcuccugccgcgagagcggguaccgggccucccgcagccagcggaagucccagcgccaguuccuccggaaccagggcacgcccaaguacaagccgcgcuucgugcacacccggcagacccgcagccuguccgucgaguucgagggcgagaucuacgacaucaaccuggaggaggaggaggagcuccaggugcugcagccccggaacaucgcgaagcgccacgacgaggggcacaagggcccccgggaccugcaggccagcuccgggggcaaccgcgggcgcaugcucgccgacagcagcaacgccguggggcccccgaccacgguccgggugacccacaagugcuucauccugcccaacgacuccauccacugcgagcgcgagcuguaccagagcgcccgggcguggaaggaccacaaggccuacaucgacaaggagaucgaggcccuccaggacaagaucaagaaccugcgcgaggugcggggccaccugaagcgccggaagcccgaggagugcuccugcagcaagcaguccuacuacaacaaggagaagggggucaagaagcaggagaagcugaagucccaccuccaccccuucaaggaggccgcccaggagguggacuccaagcugcagcuguucaaggagaacaaccgccggcgcaagaaggagcggaaggagaagcgccggcagcgcaagggcgaggagugcagccucccggggcugaccugcuucacccacgacaacaaccacuggcagacggcgcccuucuggaaccugggcuccuucugcgccugcaccagcuccaacaacaacaccuacuggugccuccggaccgugaacgagacccacaacuuccuguucugcgaguucgccacgggcuuccuggaguacuucgacaugaacaccgaccccuaccagcucaccaacaccguccacacgguggagcgcgggauccugaaccagcugcacgugcagcucauggagcugcggagcugccagggcuacaagcagugcaacccccgcccgaagaaccuggacgucgggaacaaggacggcggguccuacgaccuccaccggggccagcugugggacggcugggagggguga

SEQ ID NO: 37285 - RNA, 2613 nt, Artificial Sequence
  derived and/or modified sequence opt1 from SULF2__Homo_sapiens__NP_061325
auggggcccccgagccuggugcucugccugcuguccgccaccgucuucagccuccucgggggcuccagcgccuuccugucccaccaccgccucaaggggcgguuccagcgcgaccggcgcaacauccggcccaacaucauccuggugcugaccgacgaccaggacguggagcucggcagcaugcaggucaugaacaagacgcgccggaucauggagcagggcggcgcgcacuucaucaacgccuucgugaccacccccaugugcugccccucccgcagcuccauccugaccggcaaguacgugcacaaccacaacacguacaccaacaacgagaacugcagcuccccgagcuggcaggcccagcacgagucccggaccuucgccgucuaccugaacagcaccggguaccgcacggccuucuucggcaaguaccucaacgaguacaacggguccuacgugccgcccggcuggaaggaguggguggggcugcugaagaacagccgguucuacaacuacacccucugccgcaacggcgucaaggagaagcacggcuccgacuacagcaaggacuaccugaccgaccugaucaccaacgacuccgugagcuucuuccggacgagcaagaagauguacccccaccgccccgugcucauggucaucucccacgcggcgccccacgggcccgaggacagcgcgccccaguacucccggcuguucccgaacgccagccagcacaucacccccuccuacaacuacgcccccaaccccgacaagcacuggaucaugcgcuacaccggcccgaugaagcccauccacauggaguucaccaacaugcugcagcggaagcgccuccagacgcugaugagcguggacgacuccauggagaccaucuacaacaugcugguggagaccggggagcucgacaacaccuacaucgucuacacggccgaccacggcuaccacaucggccaguucgggcuggugaagggcaagagcaugcccuacgaguucgacauccgggugcccuucuacguccgcgggccgaacguggaggccggcugccugaacccccacaucgugcucaacaucgaccuggcccccaccauccuggacaucgccgggcucgacauccccgccgacauggacggcaaguccauccugaagcugcucgacaccgagcggccggucaaccgcuuccaccugaagaagaagaugcgcguguggcgggacagcuuccugguggagcgcggcaagcuccugcacaagcgggacaacgacaaggucgacgcccaggaggagaacuuccugcccaaguaccagcgcgugaaggaccucugccagcgggccgaguaccagaccgccugcgagcagcuggggcagaaguggcagugcgucgaggacgccacgggcaagcugaagcuccacaagugcaaggggcccaugcgccugggcgggucccgggcgcugagcaaccucgugcccaaguacuacggccagggcuccgaggccugcacgugcgacagcggggacuacaagcugucccuggccggccgccggaagaagcuguucaagaagaaguacaaggccagcuacgugcgcucccggagcauccgcuccgucgccaucgagguggacgggcggguguaccacgucggccugggggacgcggcccagccgcgcaaccugaccaagcggcacuggcccggcgcccccgaggaccaggacgacaaggacggcggggacuucagcggcaccgggggccugccggacuacagcgccgccaaccccaucaaggugacccaccgcugcuacauccucgagaacgacaccgugcagugcgaccuggaccuguacaagucccuccaggcguggaaggaccacaagcugcacaucgaccacgagaucgagacccugcagaacaagaucaagaaccuccgggagguccgcggccaccugaagaagaagcggcccgaggagugcgacugccacaagaucagcuaccacacccagcacaaggggcgccugaagcaccgcggcuccagccuccaccccuuccggaaggggcugcaggagaaggacaagguguggcugcuccgcgagcagaagcggaagaagaagcugcgcaagcugcucaagcggcugcagaacaacgacacgugcuccaugccgggccugaccugcuucacccacgacaaccagcacuggcagaccgcccccuucuggacgcucgggcccuucugcgccugcaccagcgccaacaacaacaccuacuggugcaugcgcaccaucaacgagacccacaacuuccuguucugcgaguucgcgacgggcuuccuggaguacuucgaccucaacaccgaccccuaccagcugaugaacgccgugaacacccuggaccgggacguccucaaccagcugcacgugcagcugauggagcuccgcuccugcaagggcuacaagcagugcaacccgcggacccgcaacauggaccuggggcugaaggacggcgggagcuacgagcaguaccggcaguuccagcgccggaaguggcccgagaugaagcgccccuccagcaagucccucggccagcugugggaggggugggagggcuga

SEQ ID NO: 37286 - RNA, 888 nt, Artificial Sequence
  derived and/or modified sequence opt1 from SULT1A1__Homo_sapiens__NP_803878
auggagcugauccaggacaccagccggcccccgcucgaguacgugaagggcgucccccugaucaaguacuucgccgaggcccuggggccccuccaguccuuccaggcgcgccccgacgaccugcugaucagcaccuacccgaaguccggcacgaccugggugagccagauccucgacaugaucuaccagggcggggaccuggagaagugccaccgcgcccccaucuucaugcgggugcccuuccuggaguucaaggcccccgggaucccguccggcauggagacccucaaggacacccccgcgccccgccugcugaagacgcaccucccccuggcccugcucccgcagacccugcuggaccagaaggucaaggugguguacgucgcccggaacgccaaggacguggccgugagcuacuaccacuucuaccacauggccaagguccaccccgagcccggcaccugggacuccuuccucgagaaguucauggugggggaggugagcuacggcuccugguaccagcacguccaggaguggugggagcugagccgcacccaccccgugcuguaccucuucuacgaggacaugaaggagaacccgaagcgggagauccagaagauccuggaguucguggggcgcucccugcccgaggagacggucgacuucguggugcagcacaccagcuucaaggagaugaagaagaaccccaugaccaacuacaccacggucccccaggaguucauggaccacuccaucagcccguucaugcggaagggcauggcgggggacuggaagaccaccuucaccguggcccagaacgagcgcuucgacgccgacuacgccgagaagauggccggcugcucccucagcuuccgguccgagcuguga

SEQ ID NO: 37287 - RNA, 888 nt, Artificial Sequence
  derived and/or modified sequence opt1 from SULT1A2__Homo_sapiens__NP_803564
auggagcugauccaggacaucagccggcccccgcucgaguacgugaagggcgucccccugaucaaguacuucgccgaggcccuggggccccuccaguccuuccaggcgcgccccgacgaccugcugaucagcaccuacccgaaguccggcaccacgugggugagccagauccucgacaugaucuaccagggcggggaccuggagaagugccaccgcgcccccaucuucaugcgggugcccuuccuggaguucaagguccccgggaucccguccggcauggagacccucaagaacacccccgcgccccgccugcugaagacccaccucccccuggcccugcucccgcagacgcugcuggaccagaaggugaagguggucuacguggcccggaacgccaaggacguggccgucagcuacuaccacuucuaccacauggccaagguguacccccaccccggcaccugggaguccuuccucgagaaguucauggccggggaggugagcuacggcuccugguaccagcacguccaggaguggugggagcugagccgcacccaccccgugcuguaccucuucuacgaggacaugaaggagaacccgaagcgggagauccagaagauccuggaguucguggggcgcucccugcccgaggagaccgucgaccucaugguggagcacacgagcuucaaggagaugaagaagaaccccaugaccaacuacaccaccgugcggcgcgaguucauggaccacuccaucagccccuucaugcggaagggcauggcgggggacuggaagacgaccuucaccgucgcccagaacgagcgcuucgacgccgacuacgccgagaagauggccggcugcucccugagcuuccgguccgagcuguga

SEQ ID NO: 37288 - RNA, 888 nt, Artificial Sequence
  derived and/or modified sequence opt1 from SULT1A4__Homo_sapiens__NP_001017390
auggagcugauccaggacaccagccggcccccgcucgaguacgugaagggcgucccccugaucaaguacuucgccgaggcccuggggccccuccaguccuuccaggcgcgccccgacgaccugcugaucaacaccuaccccaagagcggcacgaccugggugucccagauccucgacaugaucuaccagggcggggaccuggagaagugcaaccgcgcccccaucuacgugcggguccccuuccuggaggugaacgaccccggggagccgagcggccucgagacccugaaggacaccccgccgccccgccugaucaagucccaccucccccuggcccugcucccccagacgcugcuggaccagaaggugaaggucguguacguggcccggaaccccaaggacgucgccgugagcuacuaccacuuccaccgcauggagaaggcgcaccccgagccgggcaccugggacuccuuccucgagaaguucauggccggggaggugagcuacggcuccugguaccagcacguccaggaguggugggagcugagccggacccaccccgugcuguaccucuucuacgaggacaugaaggagaaccccaagcgcgagauccagaagauccuggaguucguggggcggucccugcccgaggagaccauggacuucaugguccagcacacgagcuucaaggagaugaagaagaacccgaugaccaacuacaccaccgugccccaggagcucauggaccacuccaucagccccuucaugcgcaagggcauggccggggacuggaagacgaccuucaccguggcccagaacgagcgguucgacgcggacuacgccgagaagauggccggcugcucccugagcuuccgcuccgagcuguga

SEQ ID NO: 37289 - RNA, 891 nt, Artificial Sequence
  derived and/or modified sequence opt1 from SULT1B1__Homo_sapiens__NP_055280
augcugagccccaaggacauccugcgcaaggaccugaagcuggugcacggcuacccgaugaccugcgccuucgccuccaacugggagaagaucgagcaguuccacagccggcccgacgacaucgucaucgcgaccuaccccaaguccgggacgaccugggugagcgagaucaucgacaugauccucaacgacggcgacaucgagaagugcaagcgcggguucaucaccgagaaggugcccaugcuggagaugacccugccgggccuccggacguccgggaucgagcagcuggagaagaaccccagcccccgcaucgucaagacccaccuccccaccgaccugcugccgaaguccuucugggagaacaacugcaagaugaucuaccuggcccggaacgccaaggacgugagcguguccuacuaccacuucgaccucaugaacaaccugcagcccuuccccggcaccugggaggaguaccuggagaaguuccucacgggcaaggucgccuacgggagcugguucacccacgugaagaacugguggaagaagaaggaggagcaccccauccuguuccuguacuacgaggacaugaaggagaacccgaaggaggagaucaagaagaucauccgcuuccucgagaagaaccugaacgacgagauccuggaccggaucauccaccacaccuccuucgaggugaugaaggacaacccccucgucaacuacacccaccuccccacgaccgugauggaccacagcaagucccccuucaugcgcaagggcaccgccggggacuggaagaacuacuucaccguggcgcagaacgagaaguucgacgccaucuacgagacggagaugagcaagaccgcccugcaguuccggaccgagaucuga

SEQ ID NO: 37290 - RNA, 891 nt, Artificial Sequence
  derived and/or modified sequence opt1 from SULT1C2__Homo_sapiens__NP_001047
auggcccugaccagcgaccucggcaagcagaucaagcugaaggagguggaggggacccugcuccagcccgccacggucgacaacuggucccagauccagagcuucgaggcgaagccggacgaccugcugaucugcaccuaccccaaggccggcaccaccuggauccaggagaucguggacaugaucgagcagaacggggacguggagaagugccagcgcgccaucauccagcaccggcaccccuucaucgagugggcccggcccccgcagcccuccggcgucgagaaggccaaggcgaugcccagcccccgcauccucaagacgcaccuguccacccagcugcucccgcccagcuucugggagaacaacugcaaguuccuguacguggcccgcaacgccaaggacugcaugguguccuacuaccacuuccagcggaugaaccacaugcugcccgaccccgggaccugggaggaguacuucgagaccuucaucaacggcaaggucguguggggcagcugguucgaccacgugaagggguggugggagaugaaggaccgccaccagauccucuuccuguucuacgaggacaucaagcgggacccgaagcacgagauccgcaaggucaugcaguucaugggcaagaagguggacgagacggugcuggacaagaucguccaggagaccuccuucgagaagaugaaggagaaccccaugaccaaccggagcaccguguccaagagcauccucgaccaguccaucagcuccuucaugcgcaaggggacggugggcgacuggaagaaccacuucaccgucgcccagaacgagcgguucgacgagaucuaccgccggaagauggaggggaccagcaucaacuucugcauggagcuguga

SEQ ID NO: 37291 - RNA, 885 nt, Artificial Sequence
  derived and/or modified sequence opt1 from SULT1E1__Homo_sapiens__NP_005411
augaacagcgagcuggacuacuacgagaaguucgaggaggugcacggcauccucauguacaaggacuucgucaaguacugggacaacguggaggccuuccaggcccgccccgacgaccuggugaucgcgaccuacccgaaguccgggaccacgugggucagcgagaucguguacaugaucuacaaggagggcgacguggagaagugcaaggaggacgucaucuucaaccggauccccuuccuggagugccgcaaggagaaccucaugaacggggugaagcagcuggacgagaugaacagcccccggaucgugaagacccaccucccgcccgagcugcugcccgccuccuucugggagaaggacugcaagaucaucuaccugugccgcaacgccaaggacgucgccguguccuucuacuacuucuuccucaugguggccggccaccccaaccccgggagcuucccggaguucgucgagaaguucaugcagggccaggugcccuacggcuccugguacaagcacgucaagagcuggugggagaaggggaaguccccgcgggugcuguuccuguucuacgaggaccucaaggaggacauccgcaaggaggugaucaagcugauccacuuccuggagcggaagcccagcgaggagcucguggaccgcaucauccaccacaccuccuuccaggagaugaagaacaaccccagcaccaacuacacgacccugcccgacgagaucaugaaccagaagcugucccccuucaugcggaagggcaucaccggggacuggaagaaccacuucaccgucgcgcucaacgagaaguucgacaagcacuacgagcagcagaugaaggagagcacgcugaaguuccgcaccgagaucuga

SEQ ID NO: 37292 - RNA, 858 nt, Artificial Sequence
  derived and/or modified sequence opt1 from SULT2A1__Homo_sapiens__NP_003158
augagcgacgacuuccugugguucgagggcaucgccuuccccaccaugggguuccgcuccgagacccuccggaaggugcgcgacgaguucgucauccgggacgaggacgugaucauccugacguaccccaagagcggcaccaacuggcuggccgagauccucugccugaugcacuccaagggggacgcgaaguggauccagagcgugccgaucugggagcgcucccccugggucgagagcgagaucggcuacaccgcccuguccgagaccgagagcccccgccucuucuccagccaccucccgauccagcuguuccccaaguccuucuucagcuccaaggccaaggugaucuaccucaugcggaacccccgggacgugcuggucagcggguacuucuucuggaagaacaugaaguucaucaagaagcccaaguccugggaggaguacuucgagugguucugccagggcacggugcuguacggcagcugguucgaccacauccacggguggaugccgaugcgcgaggagaagaacuuccuccugcuguccuacgaggagcucaagcaggacaccggccggaccaucgagaagaucugccaguuccuggggaagacccuggagcccgaggagcucaaccugauccugaagaacagcuccuuccagagcaugaaggagaacaagaugagcaacuacucccuccugagcguggacuacgucguggacaaggcccagcugcuccgcaagggcguguccggggacuggaagaaccacuucacggucgcccaggcggaggacuucgacaagcuguuccaggagaagauggccgaccugccccgggagcuguuccccugggaguga

SEQ ID NO: 37293 - RNA, 1053 nt, Artificial Sequence
  derived and/or modified sequence opt1 from SULT2B1__Homo_sapiens__NP_004596
auggccagcccgccgcccuuccacucccagaagcugcccggcgaguacuuccgcuacaagggggugcccuuccccgucggccucuacagccuggaguccaucagccuggccgagaacacccaggacgugcgggacgacgacaucuucaucaucaccuaccccaaguccgggacgaccuggaugaucgagaucaucugccucauccugaaggagggcgaccccagcuggauccgcuccgugcccaucugggagcgggcgccguggugcgagaccaucgucggggccuucagccugcccgaccaguacagcccccgccucauguccucccaccuccccauccagaucuucaccaaggccuucuucagcuccaaggccaaggugaucuacaugggccggaacccgcgcgacguggucgugagccuguaccacuacuccaagaucgccggccagcugaaggaccccgggacgcccgaccaguuccugcgggacuuccugaagggcgaggugcaguucgggagcugguucgaccacaucaagggcuggcuccgcaugaaggggaaggacaacuuccuguucaucaccuacgaggagcugcagcaggaccuccagggcuccgucgagcggaucugcggcuuccuggggcgcccccugggcaaggaggcgcucgggagcgugguggcccacuccaccuucagcgccaugaaggccaacaccaugagcaacuacacgcugcugccgcccucccuccuggaccaccggcgcggcgcguuccugcggaagggcgucugcggggacuggaagaaccacuucaccguggcccagagcgaggccuucgaccgcgccuaccggaagcagaugcgcggcaugcccaccuuccccugggacgaggacccggaggaggacgggucccccgaccccgagcccagcccggagcccgagcccaagcccucccucgagccgaacaccagccuggagcgggagccccgccccaacuccagcccgucccccagccccggccaggccuccgagacgccccacccgcggcccagcuga

SEQ ID NO: 37294 - RNA, 855 nt, Artificial Sequence
  derived and/or modified sequence opt1 from SULT4A1__Homo_sapiens__NP_055166
auggccgagagcgaggccgagacccccuccaccccgggcgaguucgagagcaaguacuucgaguuccacggggugcgccugccgcccuucugccggggcaagauggaggagaucgcgaacuuccccguccgccccuccgacguguggaucgugacguaccccaagagcgggaccucccuccugcaggaggucguguaccuggugagccagggcgccgaccccgacgagaucgggcucaugaacaucgacgagcagcugcccguccuggaguacccgcagcccggccucgacaucaucaaggagcugaccagcccccggcugaucaagucccaccuccccuaccgcuuccugccguccgaccugcacaacggcgacagcaaggugaucuacauggcccggaaccccaaggaccucguggucuccuacuaccaguuccaccgcagccugcggaccauguccuaccgcgggacguuccaggaguucugccggcgcuucaugaacgacaagcugggcuacgggagcugguucgagcacgugcaggaguucugggagcaccggauggacuccaacguccucuuccugaaguacgaggacaugcaccgcgaccuggugaccaugguggagcagcucgcccgguuccugggcgugagcugcgacaaggcccagcuggaggcgcucaccgagcacugccaccagcuggucgaccagugcugcaacgccgaggcccugcccguggggcgcggccgggugggccucuggaaggacaucuucaccgucuccaugaacgagaaguucgaccugguguacaagcagaagauggggaagugcgaccugacguucgacuucuaccucuga

SEQ ID NO: 37295 - RNA, 1050 nt, Artificial Sequence
  derived and/or modified sequence opt1 from SUMF1__Homo_sapiens__NP_001158146
auggccgcccccgcgcugggccucgugugcgggcgcugccccgagcugggccugguccuccugcugcuccugcugagccuccugugcggggccgccggcucccaggaggccgggaccggcgccggcgcggggagccuggccggcuccugcgggugcggcacgccccagcggcccggggcccacggcagcuccgccgcggcccaccgcuacagccgggaggccaacgcccccggcccggugcccggggagcgccagcucgcccacuccaagauggugcccauccccgcgggcgucuucaccauggggaccgacgacccgcagaucaagcaggacggcgaggcccccgcccggcgcgugaccaucgacgccuucuacauggacgccuacgaggugagcaacaccgaguucgagaaguucgucaacuccacgggcuaccugaccgagguggcggccgcccccugguggcugcccgugaagggggccaacuggcggcacccggagggccccgacagcaccauccuccaccgccccgaccaccccguccugcacguguccuggaacgacgccguggcguacugcaccugggccgggaagcggcugccgacggaggccgagugggaguacagcugccgcggcgggcuccacaaccggcuguuccccuggggcaacaagcugcagcccaagggccagcacuacgccaacaucuggcagggggaguuccccgucaccaacaccggcgaggacggguuccagggcaccgccccgguggacgcguucccgcccaacggguacggccucuacaacaucgugggcaacgccugggaguggacguccgacugguggaccguccaccacagcguggaggagacccugaaccccaaggggccgcccuccggcaaggaccgcgugaagaagggcgggagcuacaugugccaccgguccuacugcuaccgcuaccggugcgccgcccgcagccagaacacccccgacuccagcgcgagcaaccugggguuccggugcgccgccgaccgccuccccacgauggacuga

SEQ ID NO: 37296 - RNA, 918 nt, Artificial Sequence
  derived and/or modified sequence opt1 from SUMF2__Homo_sapiens__NP_001035934
augcgcgcccacgcccagcggggccgcgggugcacccggcgcagcgcggccgugcugauggcccggcacggccucccccugcugccccuccugucccugcucgucggggccuggcugaagcugggcaacgggcaggccaccagcauggugcagcuccagggcggccgcuuccugauggggacgaacucccccgacagccgggacggcgaggggcccgugcgcgaggcgaccgucaagcccuucgccaucgacaucuucccggugaccaacaaggacuuccgggacuucgugcgcgagaagaaguaccggaccgaggccgagauguucggcugguccuucgucuucgaggacuucgugagcgacgagcugcgcaacaaggccacgcagcccaugaagcccgcggggcccggcuccggcauccgggagcgccucgagcacccggugcugcacgucagcuggaacgacgcccgggccuacugcgccuggcgcgggaagcggcugcccaccgaggaggagugggaguucgccgcgcgcggcgggcucaagggccagguguaccccuggggcaacugguuccagcccaaccggaccaaccuguggcaggggaaguucccgaagggcgacaaggccgaggacggguuccacggcgugucccccgucaacgccuuccccgcccagaacaacuacgggcuguacgaccuccugggcaacgugugggaguggaccgccagccccuaccaggcggccgagcaggacaugcgcgugcugcggggcgccuccuggaucgacacggccgacgggagcgccaaccaccgcgcgcgcgucaccacccggaugggcaacaccccggacuccgccagcgacaaccucggguuccgcugcgccgccgacgccggccggccgcccggggagcuguga

SEQ ID NO: 37297 - RNA, 306 nt, Artificial Sequence
  derived and/or modified sequence opt1 from SUMO1__Homo_sapiens__NP_001005781
augagcgaccaggaggccaagcccuccaccgaggaccugggcgacaagaaggagggggaguacaucaagcucaaggugaucggccaggacagcuccgagauccacuucaaggucaagaugaccacgcaccugaagaagcugaaggagagcuacugccagcgccagggggugccgaugaacucccuccgguuccuguucgagggccagcgcaucgccgacaaccacacccccaaggagcuggggauggaggaggaggacgugaucgaggucuaccaggagcagaccggcggccacagcaccguguga

SEQ ID NO: 37298 - RNA, 216 nt, Artificial Sequence
  derived and/or modified sequence opt1 from SUMO2__Homo_sapiens__NP_001005849
auggccgacgagaagcccaaggagggcgugaagaccgagaacaacgaccacaucaaccugaaggucgccgggcaggacggcagcguggugcaguucaagaucaagcgccacaccccgcucuccaagcugaugaaggcguacugcgagcggcagcuggagauggaggacgaggacacgaucgacgucuuccagcagcagaccgggggcguguacuga

SEQ ID NO: 37299 - RNA, 426 nt, Artificial Sequence
  derived and/or modified sequence opt1 from SUMO3__Homo_sapiens__NP_001273345
augagcgaggagaagcccaaggagggcgugaagaccgagaacgaccacaucaaccugaaggucgccgggcaggacggcuccguggugcaguucaagaucaagcgccacaccccgcucagcaagcugaugaaggccuacugcgagcggcagguccgccaccuggcgccgccccagucccuccccgugugcgcccuggugcugugcguccccgggaucccccgggcccgcgccagccggggcuggacgcagaugcagcuccccgaggggcuguccaugcgccagauccgguuccgcuucgacggccagcccaucaacgagaccgacaccccggcccagcuggagauggaggacgaggacaccaucgacguguuccagcagcagacgggcggggugcccgagagcucccucgcgggccacagcuucuga

SEQ ID NO: 37300 - RNA, 288 nt, Artificial Sequence
  derived and/or modified sequence opt1 from SUMO4__Homo_sapiens__NP_001002255
auggccaacgagaagcccaccgaggaggugaagaccgagaacaacaaccacaucaaccugaaggucgccggccaggacgggagcguggugcaguucaagaucaagcgccagacgccgcucuccaagcugaugaaggcguacugcgagccccggggccugagcgucaagcagauccgcuuccgguucgggggccagcccaucuccgggaccgacaagcccgcccagcucgagauggaggacgaggacaccaucgacguguuccagcagccgaccggcggcguguacuga

SEQ ID NO: 37301 - RNA, 2358 nt, Artificial Sequence
  derived and/or modified sequence opt1 from SUN1__Homo_sapiens__NP_001124437
auggacuucagccgccugcacauguacuccccgccccagugcgugcccgagaacaccggcuacaccuacgcccucagcuccagcuacuccagcgacgcccuggacuucgagaccgagcacaagcuggaccccgucuucgacagcccccggaugagccgccggucccuccgccuggcgaccaccgccugcacccugggggacggcgaggccgugggggccgacagcggcacguccagcgccgugucccucaagaaccgggcggcccgcaccaccaagcagcggcgcagcaccaacaaguccgccuucagcaucaaccacgucucccgccaggugacgagcuccggggugagccacggcggcaccgucagccugcaggacgccgugacccggcggccgcccgugcuggacgaguccuggauccgcgagcagaccacggucgaccacuucugggggcucgacgacgacggcgaccugaagggcgggaacaaggcggccauccaggggaacggcgacgugggcgccgccgccgcgaccgcccacaacggguucagcugcuccaacugcagcaugcuguccgagcggaaggacgugcucaccgcccaccccgccgcccccggcccggucagccgcguguacucccgggaccgcaaccagaagugcuacuuccugcugcagauccuccggcgcaucggggcggugggccaggccgucagccggaccgccugguccgcccuguggcuggccgugguggcgcccggcaaggccgccagcggggucuucugguggcucggcaucgggugguaccaguucgugacgcugaucuccuggcugaacguguuccuccugacccgcugccugcggaacaucugcaaguuccucguccugcugaucccccucuuccugcugcucgccggccugagccugcgcgggcagggcaacuucuucuccuuccuccccgugcugaacugggccagcaugcaccgcacccagcggguggacgacccgcaggacgucuucaagcccaccacgucccgccugaagcagccccuccagggcgacagcgaggcguuccccuggcacuggauguccgggguggagcagcaggucgccagccuguccggccagugccaccaccacggggagaaccugcgggagcucaccacccugcugcagaagcuccaggcccgcguggaccagauggagggcggggccgcgggcccgagcgccagcgugcgggacgccgucggccagccgccccgcgagaccgacuucauggccuuccaccaggagcacgaggugcggaugucccaccuggaggacauccuggggaagcuccgcgagaaguccgaggccauccagaaggagcuggagcagacgaagcagaagaccaucuccgcggugggcgagcagcugcuccccaccgucgagcaccuccagcuggagcuggaccagcucaagagcgagcuguccagcuggcggcacgugaagaccgggugcgagacgguggacgccguccaggagcgcguggacgugcagguccgggagauggugaagcugcuguucuccgaggaccagcagggcgggagccuggagcagcugcuccagcgcuucuccagccaguucguguccaagggcgaccugcagaccaugcugcgggaccuccagcugcagauccugcgcaacgucacccaccacgugagcgugaccaagcagcuccccacguccgaggccgucgugagcgccguguccgaggccggcgcgagcgggaucaccgaggcccaggcccgggccaucgucaacuccgcccugaagcuguacagccaggacaagaccggcaugguggacuucgcgcucgagagcgggggcggcuccauccugagcacccgcugcuccgagacguacgagaccaagaccgcccugaugagccucuucgggaucccccugugguacuucucccagagcccccggguggucauccagcccgacaucuacccgggcaacugcugggccuucaaggggucccagggcuaccugguggugcgccucagcaugaugauccaccccgccgcguucacccuggagcacauccccaagacccugucccccacggggaacaucagcuccgccccgaaggacuucgccgucuacggccucgagaacgaguaccaggaggagggccagcugcuggggcaguucaccuacgaccaggacggcgagagccuccagauguuccaggcccugaagcggcccgacgacaccgccuuccagaucguggagcugcgcaucuucuccaacugggggcaccccgaguacacgugccucuaccgcuuccgggugcacggcgagccggucaaguga

SEQ ID NO: 37302 - RNA, 2217 nt, Artificial Sequence
  derived and/or modified sequence opt1 from SUN2__Homo_sapiens__NP_001186508
augagccgccggucccagcgccugacccgguacagccagggcgacgacgacggguccagcuccagcggcggguccagcguggccggcucccagagcacccucuucaaggacagcccccugcgcacccugaagcggaaguccuccaacaugaagcgccucagcccggcgccccagcuggggcccuccagcgacgcccacaccuccuacuacagcgagucccugguccacgagagcugguucccgccccggagcucccucgaggagcugcacggcgacgccaacuggggcgaggaccugcgcgugcggcgccggcgcgggaccggcgggagcgaguccagccgggccuccggccucguggggcgcaaggccaccgaggacuuccugggcagcuccagcggcuacuccagcgaggacgacuacgucgaggacuccgaggggcggggcagcaaggugacggagaccgagcccguguccagcuuccccgccggguacuccgacgucgaccagcagagcuccagcucccgccugcggagcgcggugagccgcgccggcucccuccuguggaugguggccaccagccccggccggcuguuccgccuccuguacuggugggccgggaccacgugguaccggcugaccaccgcggccucccuccuggacgucuucgugcugacccgccgcuucagcucccucaagacguuccugugguuccugcucccgcugcugcuccugaccugccugaccuacggcgccugguacuucuaccccuacgggcuccagaccuuccaccccgcccuggugagcuggugggccgcgaaggacucccggcgccccgacgagggcugggaggcccgggacagcuccccgcacuuccaggccgagcagcgcgucaugagccgggugcacucccuggagcgccggcucgaggcccuggccgcggaguucagcuccaacuggcagaaggaggccaugcgccuggagcggcucgagcugcgccagggggcccccggccagggcgggggcgggggccugagccacgaggacacgcucgcccugcuggaggggcucgugucccggcgcgaggccgcgcugaaggaggacuuccggcgcgagaccgccgcccggauccaggaggagcugagcgcccuccgcgccgagcaccagcaggacuccgaggaccuguucaagaagaucguccgggcgagccaggagagcgaggcccgcauccagcagcugaaguccgaguggcagagcaugacccaggaguccuuccaggagagcuccgugaaggagcuccggcgccuggaggaccagcuggccggccugcagcaggagcucgccgcgcuggcccugaagcagagcuccguggccgaggaggucggccuccugccccagcagauccaggccgugcgcgacgacguggagagccaguuccccgccuggaucucccaguuccuggcgcgcgggggcgggggccgggucgggcuccugcagcgggaggagaugcaggcccagcugcgcgagcucgagagcaagauccugacccacguggccgagaugcagggcaaguccgcccgggaggccgcggccagccugucccucacgcugcagaaggagggcgugaucggggucaccgaggagcagguccaccacaucgugaagcaggcccugcagcgcuacagcgaggaccggaucggccucgccgacuacgcccuggaguccgggggcgcgagcgugaucuccacccgcugcagcgagaccuacgagacgaagaccgcccugcucucccuguucggcaucccgcugugguaccacagccagagcccccgggugauccuccagcccgacguccaccccgggaacugcugggccuuccagggcccgcagggguucgccguggugcgccuguccgcgcggauccgccccaccgccgucacccuggagcacgugcccaaggcccucagccccaacuccacgaucagcuccgccccgaaggacuucgccaucuucggcuucgacgaggaccugcagcaggaggggacccugcucggcaaguucaccuacgaccaggacggcgagcccauccagaccuuccacuuccaggcgcccacgauggccaccuaccagguggucgagcugcggauccugaccaacugggggcaccccgaguacacgugcaucuaccgcuuccgggugcacggcgagccggcccacuga

SEQ ID NO: 37303 - RNA, 1074 nt, Artificial Sequence
  derived and/or modified sequence opt1 from SUN3__Homo_sapiens__NP_001025190
augagcggcaagaccaaggcccgccgggccgcgauguucuuccgccggugcuccgaggacgccagcggguccgccagcggcaacgcccugcucuccgaggacgagaaccccgacgccaacggggugacccgcagcuggaagaucauccuguccacgaugcugacccucaccuuccugcuggucggccuccugaaccaccaguggcugaaggagaccgacgugccgcagaagucccggcagcucuacgcgaucaucgccgaguacgggagccgccuguacaaguaccaggcccggcugcgcaugcccaaggagcagcucgagcugcugaagaaggagagccagaaccucgagaacaacuuccggcagauccuguuccugaucgagcagaucgacgugcucaaggcccugcugcgcgacaugaaggacggcauggacaacaaccacaacuggaacacgcacggcgaccccgucgaggaccccgaccacaccgaggagguguccaaccucgugaacuacguccugaagaagcugcgggaggaccagguggagauggcggacuacgcccucaagagcgccggggccuccaucaucgaggccggcaccagcgaguccuacaagaacaacaaggcgaagcuguacuggcacgggaucggcuuccugaaccacgagaugccgcccgacaucauccuccagcccgacguguaccccgggaagugcugggccuucccgggcagccagggccacacccugaucaagcuggccacgaagaucauccccaccgccgucaccauggagcacaucuccgagaaggugagccccuccgggaacaucagcagcgcccccaaggaguucuccguguacggcaucaccaagaagugcgagggggaggagaucuuccucggccaguucaucuacaacaagacgggcaccaccguccagaccuucgagcugcagcacgcggugagcgaguaccugcucugcgugaagcugaacaucuucuccaacugggggcacccgaaguacacgugccuguaccgcuuccggguccacggcacccccgggaagcacaucuga

SEQ ID NO: 37304 - RNA, 1638 nt, Artificial Sequence
  derived and/or modified sequence opt1 from SUOX__Homo_sapiens__NP_000447
augcugcuccugcaccgcgccgugguccugcggcuccagcaggccugccgccucaagagcauccccucccggaucugcauccaggcgugcagcaccaacgacuccuuccagccgcagcgccccagccugaccuucuccggcgacaacagcuccacgcagggguggcgggugaugggcacccugcuggggcugggcgccgugcucgccuaccaggaccaccgcugccgggccgcccaggagagcacccacaucuacaccaaggaggaggucuccagccacacgucccccgagaccgggaucugggugacccugggcagcgagguguucgacgucaccgaguucguggaccugcaccccggcgggccguccaagcucaugcuggcggccggcgggccccuggagcccuucugggcccucuacgccgugcacaaccagagccacguccgcgagcugcuggcgcaguacaagaucggcgagcucaaccccgaggacaagguggccccgacgguggagaccuccgaccccuacgccgacgaccccguccggcaccccgcccugaaggugaacagccagcgcccguucaacgccgagcccccgcccgagcugcucaccgagaacuacaucacccccaaccccaucuucuucacgcggaaccaccuccccgugcccaaccuggacccggacaccuaccgccugcacgucgugggggcgcccggcggccagucccugagccugucccucgacgaccugcacaacuucccccgguacgagaucaccgugacccugcagugcgccgggaaccgccggagcgagaugacgcaggucaaggaggugaagggccucgaguggcgcaccggggccaucagcaccgcccggugggccggcgcgcgccugugcgacgugcuggcccaggccggccaccagcucugcgagaccgaggcccacgucugcuucgaggggcuggacuccgaccccacgggcaccgccuacggggcgagcaucccgcuggcccgggccauggaccccgaggccgaggugcuccuggccuacgagaugaacggccagccccugccccgcgaccacggguucccggugcgggucgugguccccggcguggugggcgcgcgccacgucaaguggcucgggcgcguguccgugcagcccgaggagagcuacucccacuggcagcggcgcgacuacaagggcuucagcccguccgucgacugggagaccguggacuucgacagcgcccccuccauccaggagcugcccgugcagagcgccaucaccgagccccgggacggggagacggucgaguccggcgaggugaccaucaagggguacgccuggagcggcggcgggcgcgcggugauccgggucgacgugucccuggacggcgggcucaccuggcaggucgccaagcuggacggcgaggagcagcgcccgcggaaggccugggccuggcgccuguggcagcucaaggcccccgugcccgcggggcagaaggagcugaacaucgugugcaaggccguggacgacggcuacaacguccagcccgacaccguggccccgaucuggaaccugcggggcgugcucagcaacgccuggcaccgcguccacguguacgugucccccuga

SEQ ID NO: 37305 - RNA, 2340 nt, Artificial Sequence
  derived and/or modified sequence opt1 from SUPT20H__Homo_sapiens__NP_001014308
augcagcaggcccuggagcucgcccuggaccgcgcggaguacgugaucgagagcgcccggcagcggcccccgaagcgcaaguaccuguccagcggccgcaaguccgucuuccagaagcucuacgaccuguacaucgaggagugcgagaaggagcccgaggugaagaagcugcggcgcaacgugaaccuccuggagaagcuggucaugcaggagacccucagcugccugguggugaaccuguaccccgggaacgagggcuacucccucaugcugcgggggaagaacggcagcgacuccgagaccauccgccugcccuacgaggagggggagcuccuggaguaccuggacgccgaggagcucccgcccauccuggucgaccugcucgagaagucccaggugaacaucuuccacugcggcugcgugaucgccgagauccgggacuaccgccaguccagcaacaugaagucccccggcuaccagagccggcacauccugcugcgccccacgaugcagacccucaucugcgacguccacuccaucaccagcgacaaccacaaguggacccaggaggacaagcugcugcucgagucccagcugauccuggccacggcggagccgcucugccuggaccccagcaucgccgugaccugcaccgccaaccggcugcucuacaacaagcagaagaugaacacccgccccaugaagcggugcuucaagcgcuacucccggagcucccugaaccgccagcaggaccugagccacugcccgcccccgccccagcuccggcugcuggacuuccuccagaagcgcaaggagcggaaggccgggcagcacuacgaccugaagaucagcaaggcgggcaacugcguggacauguggaagcgcucccccugcaaccuggccauccccagcgaggucgacguggagaaguacgccaagguggagaaguccaucaagagcgacgacucccagcccacggucuggcccgcccacgacgugaaggacgacuacguguucgagugcgaggccgggacccaguaccagaagaccaagcucaccauccugcagagccugggcgacccccucuacuacgggaagauccagccgugcaaggcggacgaggaguccgacagccagaugucccccagccacuccagcacggacgaccacuccaacugguucaucaucggcagcaagaccgacgccgagcgcgucgugaaccaguaccaggagcuggugcagaacgaggccaagugccccgucaagaugucccacagcuccagcggcuccgccagccugagccaggugucccccgggaaggagaccgaccagaccgagacggugagcguccaguccagcgugcucggcaagggggucaagcaccggccgccgcccaucaagcugcccuccagcuccggcaacagcuccagcggcaacuacuucacgccccagcagaccuccagcuuccugaagucccccacgcccccgcccagcuccaagcccagcuccaucccccgcaagagcagcguggaccugaaccagguguccaugcucagcccggccgcgcugucccccgccagcuccagccagcggaccaccgccacccaggucauggccaacuccgccgggcugaacuucaucaacguggugggcagcgucugcggggcgcaggcccucauguccggcagcaaccccaugcuggggugcaacaccggcgccaucacccccgccggcaucaaccuguccgggcuccugccgagcggcgggcugcuccccaacgcccugcccuccgcgaugcaggccgccagccaggccggcgugcccuucgggcugaagaacaccuccagccuccgcccgcugaaccugcuccagcugcccggcggcucccugaucuucaacacccuccagcagcagcagcagcagcugagccaguucaccccgcagcagccccagcagcccacgaccugcagcccccagcagcccggggagcagggcagcgagcaggggagcaccucccaggagcaggcgcugagcgcccagcaggccgccgugaucaaccucaccggcgucggguccuucaugcagagccaggccgcggugcugucccagcugggcagcgccgagaaccggcccgagcagucccucccgcagcagcgcuuccagcugagcuccgccuuccagcagcagcagcagcagauccagcagcugcgguuccuccagcaccagauggccauggccgcggccgccgcccagacggcccagcugcaccaccaccgccacaccggcagccaguccaagagcaagaugaagcgggggacccccaccacgcccaaguucuga

SEQ ID NO: 37306 - RNA, 498 nt, Artificial Sequence
  derived and/or modified sequence opt1 from SUPT3H__Homo_sapiens__NP_001248752
auguucgaggacgacgagaucgacgaggugaagcaggagcgcauggagcgggccgagcgccagacccggaucauggacagcgcccaguacgcggaguucugcgagucccgccagcugagcuucuccaagaaggccagcaaguuccgggacuggcucgacugcuccagcauggagaucaagcccaacgucguggccauggagauccuggccuaccuggccuacgagaccguggcgcagcucgucgaccuggcccugcucgugcgccaggacauggugacgaaggccggcgacccguucucccacgccaucagcgcgaccuucauccaguaccacaacuccgccgagagcaccgccgccugcggggucgaggcccacuccgacgcgauccagcccugccacauccgggaggccauccgccgguacagccaccgcaucggcccccugucccccuucaccaacgccuaccggcgcaacgggauggccuuccuggccugcuga

SEQ ID NO: 37307 - RNA, 354 nt, Artificial Sequence
  derived and/or modified sequence opt1 from SUPT4H1__Homo_sapiens__NP_003159
auggcccuggagaccgugcccaaggaccuccgccaccuccgggccugccugcugugcagccuggucaagaccaucgaccaguucgaguacgacggcugcgacaacugcgacgcguaccugcagaugaaggggaaccgcgagaugguguacgacugcacguccagcuccuucgacggcaucaucgccaugaugagcccggaggacuccugggugagcaaguggcagcgggucuccaacuucaagcccgggguguacgccgugagcgucaccggccgccucccccaggggaucgugcgggagcugaagucccgcggcguggccuacaagagccgggacaccgccaucaagaccuga

SEQ ID NO: 37308 - RNA, 1245 nt, Artificial Sequence
  derived and/or modified sequence opt1 from SUPT7L__Homo_sapiens__NP_001269658
augaaccugcagcgcuacuggggcgagauccccaucagcuccagccagaccaaccgguccagcuucgaccuccugccgcgcgaguuccggcugguggagguccacgacccgccccuccaccagcccuccgccaacaagcccaagccgcccaccaugcuggacauccccagcgagcccugcucccugacgauccacaccauccagcucauccagcacaaccgccggcugcgcaaccugaucgccaccgcgcaggcccagaaccagcagcagaccgagggggugaagacggaggagagcgagccccuccccuccugccccggcagcccgccccugcccgacgaccugcucccccuggacugcaagaacccgaacgcccccuuccagauccggcacuccgaccccgagagcgacuucuaccgcgggaagggcgagcccgugaccgagcuguccuggcacagcugccggcagcuccuguaccaggccgucgccaccauccuggcgcacgccggguucgacugcgccaacgaguccgugcucgagacccugacggacguggcccacgaguacugccugaaguucaccaagcuccugcgcuucgcggucgaccgggaggcccgccugggccagaccccguuccccgacgugauggagcaggucuuccacgaggugggcaucgggagcgugcucucccugcagaaguucuggcagcaccggaucaaggacuaccacagcuacaugcugcagaucuccaagcagcucagcgaggaguacgagcgcaucgugaaccccgagaaggccaccgaggacgccaagcccgucaagaucaaggaggagccggugagcgacaucacguuccccguguccgaggagcuggaggccgaccuggcgagcggcgaccagucccuccccauggggguccugggcgcccagagcgagcgguuccccuccaaccuggagguggaggccagcccgcaggccuccagcgccgaggugaacgcgagcccccucuggaaccuggcccacgucaagauggagccccaggaguccgaggaggggaacguguccggccacggcgugcuggggagcgacgucuucgaggagccgauguccggcaugagcgaggccgggaucccccagucccccgacgacagcgacuccagcuacggcucccacagcaccgacagccucaugggcuccagccccguguucaaccagcgcugcaagaagcggaugcgcaagaucuga

SEQ ID NO: 37309 - RNA, 2361 nt, Artificial Sequence
  derived and/or modified sequence opt1 from SUPV3L1__Homo_sapiens__NP_003162
augagcuucucccgcgcccugcucugggcccggcugcccgcgggccgccaggccgggcaccgggccgccaucugcagcgcccugcgcccgcacuucggccccuuccccggggugcucggccaggucuccgugcuggcgaccgccagcuccagcgccuccgggggcagcaagauccccaacaccucccuguucgugccgcucacggucaagccccagggccccagcgccgacggggacgugggcgcggagcugacccggccccuggacaagaacgaggugaagaagguccucgacaaguucuacaagcgcaaggagauccagaagcugggggccgacuacggccuggacgcccggcuguuccaccaggccuucaucuccuuccgcaacuacaucaugcagagccacucccuggacguggacauccacaucgugcugaacgacaucugcuucggggccgcgcacgccgacgaccucuucccguucuuccugcggcacgccaagcagaucuuccccguccuggacugcaaggacgaccuccgcaagaucagcgaccugcggaucccgcccaacugguaccccgacgcccgcgccaugcagcggaagaucaucuuccacuccggccccaccaacagcggcaagaccuaccacgcgauccagaaguacuucuccgccaagagcgggguguacugcggcccccugaagcuccuggcccacgagaucuucgagaaguccaacgccgccggggugcccugcgaccuggucacgggcgaggagcgcgugaccgugcagccgaacggcaagcaggcgagccacgucagcugcaccguggagaugugcuccgugaccacgcccuacgaggucgccgugaucgacgagauccagaugauccgggaccccgcccgcgggugggccuggacccgggcccuccugggccugugcgcggaggaggugcaccucugcggggagcccgccgccaucgaccuggucauggagcugauguacaccaccggcgaggagguggaggugcgcgacuacaagcggcucacgccgaucagcguccuggaccacgcccuggagucccucgacaaccugcgccccggggacugcaucgugugcuucagcaagaacgacaucuacuccgucagccggcagaucgagauccgcggccuggaguccgcggugaucuacggcagccucccgcccgggaccaagcuggcccaggccaagaaguucaacgaccccaacgaccccugcaagauccugguggccaccgacgccaucggcauggggcucaaccuguccauccgccggaucaucuucuacagccugaucaagcccuccaucaacgagaagggcgagcgcgagcucgagcccaucaccacgagccaggcgcugcagaucgccgggcgggccggccgcuucuccagccgguucaaggagggcgaggucaccaccaugaaccacgaggaccugucccuccugaaggagauccugaagcgcccgguggaccccauccgggccgccgggcuccaccccaccgcggagcagaucgagauguucgccuaccaccucccggacgccacgcugagcaaccugaucgacaucuucguggacuucucccaggucgacggccaguacuucgugugcaacauggacgacuucaaguucagcgccgagcucauccagcacaucccccugucccugcgcgugcgguacgucuucugcaccgcccccaucaacaagaagcagcccuucgugugcagcagccuccugcaguucgcgcgccaguacucccggaacgagccgcugaccuucgccuggcuccgccgguacaucaaguggccccugcugccgcccaagaacaucaaggaccucauggaccuggaggccgugcacgacguccuggaccucuaccuguggcugagcuaccgcuucauggacauguuccccgacgccucccucauccgggaccugcagaaggagcuggacgggaucauccaggacggcgugcacaacaucaccaagcucaucaagaugagcgagacgcacaagcugcugaaccucgagggguuccccuccggcagccagucccgccugagcggcacccugaagucccaggcgcggcgcacccgggggaccaaggcccucggcagcaaggccacggagccgcccucccccgacgccggggagcugagccuggccucccgccucgugcagcagggccugcugacccccgacaugcucaagcagcuggagaaggaguggaugacccagcagaccgagcacaacaaggagaagacggagagcggcacccaccccaaggggacccgccggaagaagaaggagcccgacuccgacuga

SEQ ID NO: 37310 - RNA, 903 nt, Artificial Sequence
  derived and/or modified sequence opt1 from SURF1__Homo_sapiens__NP_003163
auggccgccguggcggcccugcagcucggccugcgcgccgccgggcugggccgggcccccgcgagcgccgccuggcgcuccguccuccgggugagcccgcgccccgggguggccuggcggcccucccgcugcggcagcuccgcggccgaggccagcgccaccaaggccgaggacgacuccuuccugcaguggguccugcuccugauccccgugaccgcguucgggcugggcacguggcagguccagcggcgcaaguggaagcucaaccugaucgccgagcuggagagccgggugcucgccgagccggugccccugcccgccgaccccauggagcugaagaaccucgaguaccgcccggugaagguccggggcugcuucgaccacuccaaggagcuguacaugaugccccgcaccaugguggaccccgugcgggaggcccgcgagggcgggcugaucagcuccagcacccaguccggggcguacgucgugacccccuuccacugcacggaccucggcgugaccauccuggucaaccggggguucgugccgcgcaagaaggugaaccccgagacccggcagaagggccagaucgagggcgaggucgaccugaucgggauggugcgccucaccgagacgcggcagcccuucgugcccgagaacaacccggagcgcaaccacuggcacuaccgggaccuggaggccauggcccgcaucaccggcgccgagcccaucuucaucgacgccaacuuccagagcaccguccccgggggccccaucggcgggcagacccgcgugacgcugcggaacgagcaccuccaguacaucgugaccugguacggccuguccgcggccaccagcuaccugugguucaagaaguuccuccgcgggaccccgggcgucuga

SEQ ID NO: 37311 - RNA, 480 nt, Artificial Sequence
  derived and/or modified sequence opt1 from SURF4__Homo_sapiens__NP_001267718
augggccagaacgaccugauggggaccgccgaggacuucgccgaccaguuccuccgcgugaccaagcaguaccugccccacgucgcgcggcugugccucaucagcacguuccuggaggacggcauccgcaugugguuccagugguccgagcagcgggacuacaucgacaccaccuggaacugcggguaccugcucgccagcuccuucguguuccugaaccugcucggccagcugaccgggugcgugcugguccucagccgcaacuucgugcaguacgccugcuucggccuguucggcaucaucgcccugcagacgaucgccuacuccauccucugggaccugaaguuccugaugcggaaccucgcgcucgggggcgggcugcugcugcugcucgccgagagccgcuccgagggcaagagcauguucgccggggugccgaccaugcgggaguccagccccaagcaguaccugcccggcuga

SEQ ID NO: 37312 - RNA, 2274 nt, Artificial Sequence
  derived and/or modified sequence opt1 from SUSD1__Homo_sapiens__NP_001269569
augggccgcgggcccugggacgccggcccgagccggcgccugcucccccugcugcuccugcuggggcucgcccggggcgccgccggggcccccggccccgacggccuggacgugugcgcgaccugccacgagcacgcgaccugccagcagcgcgaggggaagaagaucugcaucugcaacuacggcuucgucgggaacggccggacgcagugcguggacaagaacgagugccaguucggggccacccuggugugcggcaaccacaccuccugccacaacaccccgggcggguucuacugcaucugccucgagggcuaccgcgccacgaacaacaacaagaccuucauccccaacgacgggaccuucugcaccgacaucgacgagugcgaggucagcggccugugccggcacggcgggcgcugcgugaacacgcacggcuccuucgagugcuacugcauggacggguaccugccccggaacggccccgagccguuccaccccaccaccgacgccaccagcugcacggagaucgacugcgggaccccgcccgaggugcccgacggcuacaucaucggcaacuacaccuccagccucgggucccagguccgcuacgccugccgggagggcuucuucagcgugcccgaggacaccguguccagcugcacggggcugggcaccugggagucccccaagcugcacugccaggagaucaacugcgggaacccgcccgagaugcgccacgcgauccucgucggcaaccacagcucccggcugggcgggguggcccgcuacgugugccaggagggcuucgagagccccgggggcaagaucaccuccgucugcaccgagaaggggacguggcgggagagcacccugaccugcaccgagauccucacgaagaucaacgacgugucccuguucaacgacacgugcgugcgcuggcagaucaacagccggcgcaucaaccccaagaucuccuacgucaucagcaucaagggccagcggcuggaccccauggagagcgugcgcgaggagaccgugaaccucaccaccgacucccggaccccggaggucugccuggcccuguaccccggcaccaacuacaccgugaacaucagcacggccccgccccgccgcuccaugcccgccgugaucggguuccagaccgcggaggucgaccuccuggaggacgacggcagcuucaacaucuccaucuucaacgagaccugccugaagcucaaccggcgcagccggaaggugggguccgagcacauguaccaguucaccgugcugggccagcgcugguaccuggccaacuucagccacgccacguccuucaacuucaccacccgggagcagguccccguggucugccucgaccuguaccccaccaccgacuacacggugaacgugacccugcuccgcagccccaagcggcacuccguccagaucaccaucgccaccccgcccgccgugaagcagacgaucagcaacaucuccggcuucaacgagaccugccugcgcuggcggagcaucaagaccgcggacauggaggagauguaccuguuccacaucugggggcagcgcugguaccagaaggaguucgcccaggagaugaccuucaacaucuccagcuccagccgggaccccgaggugugccucgaccugcgcccgggcacgaacuacaacgucucccugcgggcccucagcagcgagcugcccguggugaucucccugaccacccagaucaccgagccgccccuccccgaggucgaguucuucacggugcaccgcgggccccugccccggcugcgccuccggaaggccaaggagaagaacggccccaucagcuccuaccaggugcugguccugccgcucgcccugcagagcaccuucuccugcgacagcgagggggcguccagcuucuucuccaacgccagcgacgccgacggcuacguggccgccgagcugcuggcgaaggacgugcccgacgacgccauggagauccccaucggcgaccgccucuacuacggggaguacuacaacgcgccccugaagcggggcuccgacuacugcaucauccugcgcaucaccagcgaguggaacaagguccgccggcacuccugcgccgugugggcccaggugaaggagaucccgugcaacugcaacuuccuccgccugcacauccaccgggccaacagcggggacacccagauccgccacuccugcugcugccgguggcgcguccuggacugggugcccuggcuccuguga

SEQ ID NO: 37313 - RNA, 2469 nt, Artificial Sequence
  derived and/or modified sequence opt1 from SUSD2__Homo_sapiens__NP_062547
augaagcccgcccugcucccgugggcccugcugcuccuggcgaccgcccuggggcccgggcccggccccaccgccgacgcccaggagagcugcuccaugcgcugcggggcccucgacggcccgugcagcugccaccccacgugcuccgggcuggggaccugcugccuggacuuccgggacuucugccucgagauccugcccuacagcggcuccaugaugggcggcaaggacuucgugguccgccacuucaagaugagcucccccaccgacgcgagcgugaucugccgguucaaggacuccauccagacccuggggcacguggacagcuccggccagguccacugcgugagcccgcuccuguacgaguccgggcgcauccccuucacggugagccuggacaacggccacuccuucccccgggccggcaccuggcucgccguccaccccaacaaggugagcaugauggagaaguccgagcuggugaacgagacccgcuggcaguacuacgggaccgccaacacgagcggcaaccugucccucaccuggcacgucaagagccugccgacccagaccaucacgaucgagcuguggggguacgaggagaccggcaugcccuacagccaggaguggaccgcgaagugguccuaccucuacccccuggccacccacauccccaacagcggcuccuucacguucaccccgaagcccgccccgcccagcuaccagcgguggcgcgugggggcccugcggaucaucgacuccaagaacuacgccggccagaaggacgugcaggcgcucuggaccaacgaccacgcccuggccuggcaccugagcgacgacuuccgcgaggaccccgucgccugggcccggacccagugccaggcgugggaggagcucgaggaccagcugcccaacuuccuggaggagcuccccgacugccccugcacgcugacccaggcccgcgccgacuccgggcgguucuucaccgacuacggcugcgacauggagcaggggagcgugugcaccuaccacccgggcgccgugcacugcguccgcuccgugcaggccagccugcgguacggcuccgggcagcagugcugcuacacggcggacggcacccagcuccugaccgccgacagcuccgggggcagcacccccgaccgcgggcacgacuggggcgccccgcccuuccggacgccgccccgcgugcccuccaugagccacuggcuguacgacguccucuccuucuacuacugcugccugugggcccccgacugcccccgguacaugcagcgccggcccagcaacgacugccgcaacuaccggcccccgcgccuggccuccgcguucggcgacccccacuucgugaccuucgacgggaccaacuucaccuucaacggccgcggggaguacgugcuccuggaggccgcccugacggaccuccggguccaggcccgcgcgcagcccggcaccaugagcaacgggaccgagacccggggcacgggccugaccgccguggccgugcaggaggggaacagcgacgucguggagguccgccuggccaaccggaccggcgggcucgaggugcugcugaaccaggaggugcucuccuucaccgagcagagcuggauggaccugaagggcauguuccuguccgucgccgcgggcgaccgcgugagcaucaugcuggccuccggggccggccucgaggugagcguccaggggcccuuccuguccgugagcgugcugcucccggagaaguuccugacccacacgcacggccugcucgggacccugaacaacgaccccaccgacgacuucacccugcacuccggccggguccucccgcccggcacgagcccccaggagcuguuccuguucggggccaacuggaccgugcacaacgccuccagccuccugaccuacgacuccugguuccuggugcacaacuuccucuaccagcccaagcacgaccccaccuucgagccccuguucccgagcgagacgacccugaaccccucccucgcgcaggaggccgccaagcugugcggcgacgaccacuucugcaacuucgacgucgccgccaccgggagccuguccaccggcacggcgacccgcguggcccaccagcuccaccagcggcgcaugcagagccugcagcccguggucagcugcggguggcuggcgcccccgcccaacggccagaaggagggcaaccgguaccucgccggguccaccaucuacuuccacugcgacaacggcuacagccuggccggggccgagaccuccacgugccaggccgacggcaccuggagcucccccacccccaagugccagccggggcgcagcuacgccgugcugcucggcaucaucuucggcgggcuggccguggucgcggccguggcccugguguacguccuccugcggcgccggaagggcaacacccacguguggggcgcccagcccuga

SEQ ID NO: 37314 - RNA, 873 nt, Artificial Sequence
  derived and/or modified sequence opt1 from SUSD4__Homo_sapiens__NP_001032252
auguaccacggcaugaaccccagcaacggggacggcuuccuggagcagcagcagcagcagcagcagccgcagagcccccagcgccuccuggccgugauccugugguuccagcucgcccugugcuucgggcccgcgcagcugaccggcggguucgacgaccuccaggucugcgccgaccccggcaucccggagaacggcuuccggacccccagcgggggcguguucuucgagggguccguggcccgcuuccacugccaggacggcuucaagcugaagggggccacgaagcggcugugccucaagcacuucaacggcacccugggcuggauccccagcgacaacuccaucugcguccaggaggacugccgcaucccccagaucgaggacgccgagauccacaacaagaccuaccggcacggggagaagcugaucaucacgugccacgagggcuucaagauccgcuacccggaccuccacaacauggugagccugugccgggacgacgggaccuggaacaaccugcccaucugccagggcugccuccgcccccuggcguccagcaacggcuacgugaacaucuccgagcugcagaccagcuuccccgucgggaccgugaucuccuaccggugcuucccgggcuucaagcucgacgggagcgccuaccuggagugccugcagaaccucaucugguccagcuccccgccccgcugccuggcccuggagggcgggcggcccgagcaccucuuccccgugcuguacuucccccacauccgccuggccgcggccguccucuacuucugccccgugcugaaguccucccccaccccggcccccacgugcagcuccaccagcaccaccacgagccuguucuga

SEQ ID NO: 37315 - RNA, 912 nt, Artificial Sequence
  derived and/or modified sequence opt1 from SUSD6__Homo_sapiens__NP_055549
augugccacggccgcaucgcccccaagagcaccuccguguucgccgucgcgagcguggggcacggcguguuccugccgcucgucauccugugcacccugcucggggacggccuggccuccgugugcccccugccgcccgagcccgagaacgggggcuacaucugccacccccggcccugccgcgacccccucacggccggcagcgugaucgaguaccugugcgccgagggguacaugcugaagggcgacuacaaguaccugaccugcaagaacggggaguggaagccggccauggagaucuccugccggcucaacgaggacaaggacacccacaccagccugggcguccccacgcucuccaucguggcgagcaccgccuccagcguggcccugauccugcuccuggucgugcuguucgugcuccugcagcccaagcugaaguccuuccaccacagccgccgggaccagggggucuccggcgaccaggugagcaucaugguggacggcguccagguggcccuccccuccuacgaggaggcgguguacgggagcuccggccacugcgucccgcccgccgacccccgcgugcagaucgugcugagcgagggguccggccccagcggccggagcgucccgcgcgagcagcagcugcccgaccagggggccugcuccagcgccggcggggaggacgaggcccccggccaguccgggcucugcgaggcguggggcagccgggccuccgagaccgugauggugcaccaggccaccacgagcuccugggucgccggcagcgggaaccgccagcuggcccacaaggagaccgcggacuccgagaacagcgacauccagucccugcucagccugaccuccgaggaguacaccgacgacaucccccugcucaaggaggccuga

SEQ ID NO: 37316 - RNA, 1272 nt, Artificial Sequence
  derived and/or modified sequence opt1 from SUV39H1__Homo_sapiens__NP_001269095
auggugggcaugagccgccugcggaacgaccgccucgccgacccccugaccgggugcuccgucugcugcaagagcuccuggaaccagcugcaggaccucugccggcuggccaagcugagcugcccggcgcucggcaucuccaagcgcaaccuguacgacuucgagguggaguaccugugcgacuacaagaagauccgggagcaggaguacuaccucgugaaguggcgcggguaccccgacagcgaguccaccugggagccccggcagaaccugaagugcguccgcauccugaagcaguuccacaaggaccucgagcgggagcugcugcgccggcaccaccgcagcaagacgccccggcaccucgacccgucccuggccaacuaccuggugcagaaggccaagcagcgccgggcccuccgccggugggagcaggagcugaacgccaagcgcagccaccugggccggaucaccguggagaacgaggucgaccucgacgggccgccccgcgcguucguguacaucaacgaguaccgggugggcgagggcaucacccugaaccaggucgccguggggugcgagugccaggacugccugugggcccccaccggcgggugcugccccggcgccucccuccacaaguucgcguacaacgaccagggccaggugcgccugcgcgccgggcugcccaucuacgagugcaacagccggugccgcugcggcuacgacugccccaaccgggucgugcagaaggggauccgcuacgaccucugcaucuuccggacggacgacggccgcggguggggcgugcggacccuggagaagauccgcaagaacuccuucgucauggaguacgugggcgagaucaucaccagcgaggaggccgagcggcgcgggcagaucuacgaccggcagggcgccaccuaccuguucgaccucgacuacguggaggacgucuacacgguggacgccgcguacuacgggaacaucucccacuucgugaaccacagcugcgaccccaaccugcaggucuacaacguguucaucgacaaccuggacgagcgccucccgcggaucgccuucuucgccacccgcaccauccgggccggcgaggagcugaccuucgacuacaacaugcaggucgaccccguggacauggaguccacgcgcauggacagcaacuucgggcuggccggccuccccggcucccccaagaagcgggugcgcaucgagugcaagugcgggaccgagagcugccggaaguaccuguucuga

SEQ ID NO: 37317 - RNA, 1233 nt, Artificial Sequence
  derived and/or modified sequence opt1 from SUV39H2__Homo_sapiens__NP_001180353
auggccgccgugggcgcggaggcccgcggggccuggugcguccccugccuggugagccucgacacccugcaggagcugugccggaaggagaagcugaccugcaaguccaucggcaucacgaagcgcaaccucaacaacuacgagguggaguaccugugcgacuacaaggucgugaaggacauggaguacuaccucgugaaguggaagggguggccggacagcaccaacaccugggagccccugcagaaccugaagugcccccuccugcugcagcaguucuccaacgacaagcacaacuaccucagccaggucaagaagggcaaggccaucacccccaaggacaacaacaagacgcugaagccggccaucgcggaguacaucgugaagaaggccaagcagcggaucgcccugcagcgcuggcaggacgagcucaaccggcgcaagaaccacaaggggaugaucuucguggagaacaccgucgaccuggagggcccgcccuccgacuucuacuacaucaacgaguacaagcccgcccccggcaucagccuggugaacgaggcgaccuucgggugcuccugcaccgacugcuucuuccagaagugcugccccgccgaggccggcgugcuccuggccuacaacaagaaccagcagaucaagaucccgcccgggacgcccaucuacgagugcaacagccggugccagugcggccccgacugccccaaccgcaucguccagaaggggacccaguacucccugugcaucuuccggaccagcaacggccgcggcuggggcgugaagacccucgugaagaucaagcggauguccuucgucauggaguacgugggggaggugaucacgagcgaggaggccgagcgccgggggcaguucuacgacaacaagggcaucaccuaccuguucgaccuggacuacgaguccgacgaguucaccgucgacgcggcccgcuacggcaacgugagccacuucgugaaccacuccugcgaccccaaccuccaggucuucaacguguucaucgacaaccuggacacccggcugccgcgcaucgcccucuucagcacgcggaccaucaacgccggggaggagcugaccuucgacuaccagaugaagggcuccggggacaucagcuccgacagcaucgaccacagccccgccaagaagcgcgugcggaccgucugcaagugcggcgcggugacgugccgcggguaccugaacuga

SEQ ID NO: 37318 - RNA, 1389 nt, Artificial Sequence
  derived and/or modified sequence opt1 from SUV420H2__Homo_sapiens__NP_116090
augggccccgaccgcgugaccgcccgggagcugugcgagaacgacgaccucgccaccagccugguccuggacccguaccucggguuccgcacgcacaagaugaacgugucccccgugcccccccugcggcgccagcagcaccugcggagcgcgcucgagaccuuccugcgccagcgggaccuggaggccgccuaccgcgcccucacccugggcggguggaccgcccgguacuuccagucccgcggcccgcggcaggaggcggcccugaagacgcacgucuaccgcuaccuccgggccuuccugcccgagagcggguucaccauccugcccugcacccgcuacuccauggagaccaacggcgccaagaucgugagcacgcgggcguggaagaagaacgagaagcucgagcugcuggugggcugcaucgccgagcuccgcgaggccgacgaggggcugcugcgggccggcgagaacgacuucuccaucauguacagcacccgcaagcgguccgcccagcucuggcuggggcccgcggccuucaucaaccacgacugcaagccgaacugcaaguucguccccgccgacggcaacgccgccugcgugaaggugcugcgcgacaucgagcccggggacgaggucaccugcuucuacggcgagggcuucuucggggagaagaacgagcacugcgagugccacaccugcgagcggaagggcgagggggcguuccgcacgcgcccccgggagccggcccuccccccccgcccccuggacaaguaccagcugcgggagaccaagcgccggcuccagcagggccuggacagcggcucccgccaggggcugcucggcccgcgggccugcgugcaccccagcccccugcgccgggaccccuucugcgccgccugccagccgcugcgccuccccgcgugcuccgcccggcccgacaccagcccccuguggcugcaguggcucccgcagccccagccccgcgugcggccccgcaagcggcgccggccgcgcccccggcgcgcccccguccuguccacccaccacgccgcccgcgugagccugcaccggugggggggcugcgggccgcacugccgccuccggggcgaggcgcugguggcccugggccagcccccccacgcccgcugggccccccagcaggacuggcacugggcgcggcgcuacgggcucccguacgucgugcggguggaccugcgccggcuggcccccgccccccccgccacgccggcccccgcgggcacccccgggcccauccucaucccgaagcaggcccuggccuucgcccccuucuccccccccaagcgccugcggcucgucgugagccacggcuccaucgaccuggacguggggggcgaggagcuguga

SEQ ID NO: 37319 - RNA, 2220 nt, Artificial Sequence
  derived and/or modified sequence opt1 from SUZ12__Homo_sapiens__NP_056170
auggcgccccagaagcacggcgggggcgggggcgggggcagcggcccguccgccgggagcggcgggggcggguucggcggcuccgccgccguggccgccgccaccgcgagcgggggcaaguccgggggcggcagcugcgggggcgggggcuccuacagcgccuccagcuccagcuccgccgccgcggccgccggggccgccguccugcccgugaagaagcccaagauggagcacgugcaggcggaccacgagcuguuccugcaggccuucgagaagcccacccagaucuaccgcuuccugcggacgcgcaaccucaucgccccgaucuuccugcaccggacccugaccuacaugagccaccgcaacucccggaccaacaucaagcgcaagacguucaaggucgacgacaugcucagcaagguggagaagaugaagggcgagcaggagucccacagccuguccgcccaccuccagcucaccuucaccggcuucuuccacaagaacgacaagcccagccccaacagcgagaacgagcagaacuccgugacccuggagguccugcucgugaaggugugccacaagaagcggaaggacgucagcugccccauccgccaggugccgacggggaagaagcaggucccccugaaccccgaccugaaccagaccaagcccggcaacuucccgucccucgccgugagcuccaacgaguucgagcccagcaacucccacauggucaagagcuacucccugcuguuccgggugacccgccccgggcggcgcgaguucaacggcaugaucaacggggagaccaacgagaacaucgacgugaacgaggagcuccccgcgcggcgcaagcggaaccgcgaggacggcgagaagacguucguggcccagaugaccguguucgacaagaaccggcgccugcagcugcucgacggcgaguacgaggucgccaugcaggagauggaggagugcccgaucagcaagaagcgggccaccugggagaccauccuggacgggaagcgccugccgcccuucgagacguucucccagggccccacccuccaguucacccugcgguggaccggggagacgaacgacaagagcaccgcccccaucgcgaagccccuggccacccgcaacuccgagagccuccaccaggagaacaagcccggcuccgugaagcccacccagacgaucgccgugaaggagagccugaccaccgaccugcagacccgcaaggagaaggacacgccgaacgagaaccggcagaagcuccgcaucuucuaccaguuccuguacaacaacaacacccggcagcagaccgaggcccgcgacgaccugcacugccccuggugcacccucaacugccggaagcuguacucccugcucaagcaccugaagcugugccacagccgcuucaucuucaacuacgucuaccaccccaagggggcccggaucgacguguccaucaacgagugcuacgacggcagcuacgcgggcaacccccaggacauccaccgccagccgggguucgccuucagccggaacggccccgugaagcgcacgcccaucacccacauccucgucugccggccgaagcgcaccaaggccuccaugagcgaguuccuggaguccgaggacggggagguggagcagcagcggaccuacagcuccggccacaaccgccuguacuuccacagcgacacgugccucccccugcggccccaggagauggaggucgacuccgaggacgagaaggaccccgaguggcugcgcgagaagaccaucacccagaucgaggaguucagcgacgugaacgagggcgagaaggaggugaugaagcucuggaaccugcacgucaugaagcacggguucaucgccgacaaccagaugaaccacgcgugcaugcuguucguggagaacuacggccagaagaucaucaagaagaaccucugccggaacuucaugcugcaccugguguccaugcacgacuucaaccugaucagcaucauguccaucgacaaggccgucaccaagcuccgcgagaugcagcagaagcuggagaagggggagagcgccuccccggccaacgaggagaucaccgaggagcagaacggcacggccaacggguucagcgagaucaacuccaaggagaaggcgcuggagaccgacagcguguccggcgugagcaagcagagcaagaagcagaagcucuga

SEQ ID NO: 37320 - RNA, 2052 nt, Artificial Sequence
  derived and/or modified sequence opt1 from SV2B__Homo_sapiens__NP_055663
auggacgacuacaaguaccaggacaacuacggcggguacgcccccagcgacggcuacuaccgcgggaacgaguccaacccggaggaggacgcccagagcgacgugaccgagggccacgacgaggaggacgagaucuacgagggggaguaccagggcaucccccaccccgacgacgugaaggcgaagcaggccaagauggcccccucccggauggacagccugcgcggccagaccgaccucauggccgagcggcuggaggacgaggagcagcuggcccaccaguacgagacgaucauggacgagugcgggcacggccgcuuccaguggauccucuucuucgugcuggggcuggcgcucauggccgacggcguggaggucuucgugguguccuucgcccugccgagcgccgagaaggacaugugccuguccagcuccaagaaggggaugcucggcaugaucgucuaccugggcaugauggcgggggccuucauccugggcgggcucgccgacaagcugggccggaagcgcgugcugagcaugucccucgccgugaacgccagcuucgcgucccugagcuccuucguccagggcuacggggccuuccuguucugccggcucaucagcggcaucgggaucggcggggcccugcccaucguguucgccuacuucuccgaguuccugagccgcgagaagcggggcgagcaccucuccuggcugggcaucuucuggaugaccgggggccuguacgccagcgcgauggccuggagcaucaucccccacuacggguggggcuucuccauggggaccaacuaccacuuccacagcuggcgcguguucgucaucgugugcgcccuccccugcaccguguccauggucgcccugaaguucaugccggagagcccccgguuccugcucgagaugggcaagcacgacgaggccuggaugauccugaagcagguccacgacacgaacaugcgcgcgaagggcacccccgagaagguguucaccguguccaacaucaagacccccaagcagauggacgaguucaucgagauccagagcuccacggggaccugguaccagcgguggcuggugcgcuucaagaccaucuucaagcaggucugggacaacgcccucuacugcgugaugggcccguaccggaugaacacccugauccuggccguggugugguucgccauggccuucagcuacuacgggcucacggucugguuccccgacaugauccgcuacuuccaggacgaggaguacaaguccaagaugaagguguucuucggcgagcacgucuacggggcgaccaucaacuucaccauggagaaccagauccaccagcacggcaagcuggugaacgacaaguucacccggauguacuucaagcacgugcuguucgaggacacguucuucgacgagugcuacuucgaggacgucaccagcaccgacaccuacuucaagaacugcacgaucgaguccaccaucuucuacaacaccgaccucuacgagcacaaguucaucaacugccgcuucaucaacagcaccuuccuggagcagaaggagggcugccacauggaccuggagcaggacaacgacuuccucaucuaccugguguccuuccuggggagccucuccgugcugcccggcaacaucaucagcgcccugcucauggaccggaucgggcgccugaagaugaucggcggcuccaugcugaucagcgccgucugcugcuucuuccucuucuucgggaacuccgagagcgccaugaucggcuggcagugccuguucugcgggacgagcaucgcggccuggaacgcccuggacgugaucaccguggagcuguaccccaccaaccagcgggccaccgccuucggcauccucaacgggcugugcaaguucggcgcgauccugggcaacacgaucuucgccuccuucgucgggaucaccaagguggugccgauccuccuggccgccgccagccuggucggcgggggccucaucgcgcugcgccugcccgagacccgcgagcagguccucauguga

SEQ ID NO: 37321 - RNA, 2031 nt, Artificial Sequence
  derived and/or modified sequence opt1 from SV2C__Homo_sapiens__NP_001284645
auggaggacagcuacaaggaccgcaccucccugaugaagggcgccaaggacaucgcccgggaggugaagaagcagaccgucaagaaggugaaccaggcgguggaccgcgcccaggacgaguacacgcagcggagcuacucccgcuuccaggacgaggaggacgacgacgacuacuaccccgccggggagaccuacaacggcgaggccaacgacgacgaggggagcuccgaggccaccgagggccacgacgaggacgacgagaucuacgagggggaguaccagggcaucccgagcaugaaccaggcgaaggacuccaucgucagcgugggccagcccaagggggacgaguacaaggaccggcgcgagcucgaguccgagcggcgcgccgacgaggaggagcuggcccagcaguacgagcugaucauccaggagugcggccacgggcgguuccagugggcccucuucuucgugcugggcauggcgcugauggccgacggggucgagguguucguggucggcuucgugcuccccagcgccgagaccgaccugugcauccccaacuccggcagcggguggcugggcuccaucguguaccucgggaugauggucggcgccuucuucuggggcgggcuggccgacaaggugggccgcaagcagagccugcucaucugcauguccgugaacggguucuucgcguuccugagcuccuucguccagggcuacggguucuuccuguucugccggcuccugagcggcuucggcaucgggggcgccaucccgacgguguucuccuacuucgccgaggugcuggcccgcgagaagcgcggggagcaccucagcuggcugugcauguucuggaugaucggcgggaucuacgccagcgcgauggccugggccaucaucccccacuacggcugguccuucagcaugggcuccgccuaccaguuccacagcuggcgggucuucgugaucgugugcgcccugcccugcgucuccagcgugguggcgcucaccuucaugcccgaguccccgcgguuccugcuggaggucgggaagcacgacgaggccuggaugauccucaagcugauccacgacaccaacaugcgcgcccggggccagcccgagaagguguucaccgucaacaagaucaagacgcccaagcagaucgacgagcugaucgagaucgagagcgacaccgggaccugguaccgccggugcuucgugcgcauccggaccgagcucuacggcaucuggcugacguucaugcgcugcuucaacuaccccgugcgcgacaacaccaucaagcugaccaucgucugguucacccucuccuucggguacuacggccugagcgugugguucccggacgugaucaagccccugcaguccgacgaguacgcccuccugacgcggaacgucgagcgcgacaaguacgccaacuucaccaucaacuucaccauggagaaccagauccacaccggcauggaguacgacaacgggcgguucaucggcgugaaguucaagagcgugacguucaaggacuccgucuucaagagcugcaccuucgaggacgugaccuccgugaacaccuacuucaagaacugcacguucaucgacaccgucuucgacaacaccgacuucgagcccuacaaguucaucgacagcgaguucaagaacugcuccuucuuccacaacaagaccgggugccagaucacguucgacgacgacuacagcgcguacuggaucuacuucgugaacuuccugggcacccucgccgugcugcccggcaacaucgucuccgcccugcucauggaccgcaucgggcggcugaccaugcugggcgggagcauggugcucagcggcaucuccugcuucuuccugugguucgggaccagcgaguccaugaugaucggcaugcugugccucuacaacggccugacgaucagcgccuggaacucccuggacguggucaccguggagcucuacccgaccgaccgccggcgccgggugcugcccugcugccccggguga

SEQ ID NO: 37322 - RNA, 10716 nt, Artificial Sequence
  derived and/or modified sequence opt1 from SVEP1__Homo_sapiens__NP_699197
auguggccccgccuggccuucugcugcuggggccucgcccugguguccgggugggccaccuuccagcagaugucccccucccggaacuucuccuuccgccuguuccccgagaccgcccccggcgcccccggguccauccccgcgccgcccgcccccggcgacgaggccgccgggucccgggucgagcgccucggccaggccuuccggcgccgggugcgccugcugcgggagcucagcgagcgccuggagcugguguuccucgucgacgacuccagcuccgugggcgaggugaacuuccggagcgagcugauguucguccgcaagcugcucuccgacuuccccguggugcccaccgccacccgggucgccaucgugaccuucagcuccaagaacuacguggucccccgcguggacuacaucagcacccggcgcgcccggcagcacaagugcgcccugcugcuccaggagauccccgccaucuccuaccgcgggggcgggaccuacaccaagggcgccuuccagcaggccgcccagauccugcugcacgcccgggagaacagcaccaagguggucuuccucaucaccgacggguacuccaacggcggcgacccccgccccaucgccgccagccugcgggacuccgggguggagaucuucaccuucggcaucuggcaggggaacauccgcgagcugaacgacauggcgagcacccccaaggaggagcacugcuaccuccugcacagcuucgaggaguucgaggcccuggcccgccgggcccuccacgaggaccugcccuccggcagcuucauccaggacgacauggugcacugcuccuaccugugcgacgagggcaaggacugcugcgaccgcauggggagcugcaagugcggcacccacaccgggcacuucgagugcaucugcgagaagggcuacuacgggaagggccuccaguacgagugcaccgccugccccuccggcaccuacaagcccgaggggagccccggcgggaucuccagcugcauccccugccccgacgagaaccacaccagcccgcccggcagcaccucccccgaggacugcgucugccgggagggguaccgcgcgagcggccagaccugcgagcuggugcacugccccgcccugaagccgcccgagaacggcuacuucauccagaacacgugcaacaaccacuucaacgccgccugcggggugcggugccaccccggcuucgaccucgucggguccagcaucauccugugccugcccaacggccucugguccgggagcgaguccuacugccgcgugcggaccugcccccaccuccggcagcccaagcacggccacaucagcugcuccacccgggagaugcuguacaagacgaccugccucguggccugcgacgagggcuaccgccuggaggggagcgacaagcugaccugccagggcaacagccagugggacgggcccgagccccggugcgucgagcgccacugcuccaccuuccagaugcccaaggacgugaucaucagcccccacaacugcggcaagcagcccgcgaaguucggcaccaucugcuacgucuccugccggcagggguucauccucagcggcgugaaggagaugcugcgcugcaccaccuccgggaaguggaacgugggcguccaggccgccgugugcaaggacguggaggcgccccagaucaacugccccaaggacaucgaggcgaagacccuggagcagcaggacagcgccaacgucaccuggcagauccccaccgccaaggacaacuccggggagaaggugagcgugcacguccaccccgccuucaccccgcccuaccucuuccccaucggcgacguggccaucguguacaccgcgaccgaccuguccggcaaccaggccagcugcaucuuccacaucaaggucaucgacgccgagccgcccgugaucgacuggugccggagcccgccgcccgugcaggucagcgagaaggugcacgccgccuccugggacgagccccaguucagcgacaacuccggggcggagcuggugaucacccgcagccacacccagggcgaccucuucccccagggggagaccaucguccaguacaccgccaccgaccccuccggcaacaaccggaccugcgacauccacaucgugaucaaggggagccccugcgagauccccuucacccccgugaacggcgacuucaucugcacccccgacaacaccggcgucaacugcacccugaccugccuggagggguacgacuucaccgagggcagcacggacaaguacuacugcgccuacgaggacgggguguggaagcccaccuacaccaccgaguggcccgacugcgccaagaagcgcuucgccaaccacggcuucaaguccuucgagauguucuacaaggcggcccggugcgacgacacggaccucaugaagaaguucagcgaggccuucgagaccacccuggggaagauggugcccuccuucugcagcgacgccgaggacaucgacugccgccuggaggagaaccugaccaagaaguacugccucgaguacaacuacgacuacgagaacggcuucgcgaucggccccggcggguggggcgccgccaaccgccuggacuacuccuacgacgacuuccuggacacgguccaggagaccgccaccagcaucggcaacgccaaguccagccggaucaagcgcuccgcgccccucagcgacuacaagaucaagcugaucuucaacaucaccgccuccgugccccugcccgacgagcggaacgacacgcucgagugggagaaccagcagcgccugcugcagacccucgagaccaucaccaacaagcugaagcggacgcugaacaaggaccccauguacagcuuccagcucgccuccgagauccugaucgccgacagcaacucccuggagaccaagaaggccagccccuucugccgccccggguccgugcuccggggccgcaugugcgucaacugcccccugggcaccuacuacaaccuggagcacuucacgugcgagagcugccggaucggguccuaccaggacgaggagggccagcucgagugcaagcugugccccagcgggauguacacggaguacauccacagccgcaacaucuccgacugcaaggcgcagugcaagcagggcaccuacagcuacuccggccuggagaccugcgagagcugcccccucgggaccuaccagcccaaguucggcucccggagcugccuguccugccccgagaacacgagcaccgugaagcgcggggccgugaacaucuccgccugcggcguccccugccccgaggggaaguucagccgguccggccugaugcccugccaccccugcccgcgcgacuacuaccagcccaacgccggcaaggccuucugccucgcgugccccuucuacgggaccacccccuucgccggcagccgguccaucacggagugcagcuccuucagcuccaccuucagcgccgccgaggaguccguggugccgcccgcgagccuggggcacaucaagaagcgccacgagaucagcucccaggucuuccacgagugcuucuucaaccccugccacaacagcgggaccugccagcagcuggggcggggcuacgugugccucugcccccugggcuacaccgggcugaagugcgagacggacaucgacgagugcuccccgcuccccugccugaacaacggcgugugcaaggaccuggucggggaguucaucugcgagugccccagcggcuacaccgggcagcgcugcgaggagaacaucaacgagugcuccagcucccccugccucaacaagggcaucugcguggacggcguggccggguaccggugcacgugcgucaagggcuucguggggcugcacugcgagaccgaggugaacgagugccagagcaacccgugccugaacaacgccgucugcgaggaccaggugggcggcuuccucugcaagugcccgcccggguuccugggcacccgcugcgggaagaacguggacgagugccugucccagccgugcaagaacggcgccacgugcaaggacggggccaacagcuuccggugccucugcgcggccggcuucaccggcucccacugcgagcugaacaucaacgagugccagagcaaccccugccgcaaccaggcgaccugcgucgacgagcugaacuccuacagcugcaagugccagcccggguucuccggcaagcgcugcgagaccgagcagagcacgggguucaaccucgacuucgagguguccggcaucuacggguacgugaugcuggacggcaugcugcccagccuccacgcccugaccugcaccuucuggaugaaguccagcgacgacaugaacuacggcaccccgaucagcuacgccgucgacaacggguccgacaacacgcugcuccugaccgacuacaacggcugggugcuguacgugaacgggcgggagaagaucaccaacugccccagcgucaacgacggccgcuggcaccacaucgcgaucaccuggacguccgccaacgggaucuggaagguguacaucgacggcaagcucagcgacggcggggccggccuguccgucgggcugcccauccccggcgggggcgcccucgugcugggccaggagcaggacaagaagggggagggcuucagcccggccgaguccuucguggggagcaucucccagcugaaccucugggacuacguccugagcccccagcaggucaagucccuggcgaccagcugccccgaggagcucuccaagggcaacgugcuggccuggcccgacuuccugagcggcaucgucgggaaggugaagaucgacuccaagagcaucuucugcuccgacugcccgcggcucggcgggagcgugccccaccuccgcaccgccuccgaggaccugaagcccggcagcaaggucaaccucuucugcgaccccggguuccagcuggugggcaacccggugcaguacugccugaaccagggccaguggacccagccccucccccacugcgagcggaucagcugcggggugcccccgccccuggagaacggcuuccacuccgccgacgacuucuacgccgggagcacggucaccuaccagugcaacaacggcuacuaccugcucggggacucccgcauguucugcaccgacaacggcagcuggaacggcgugucccccagcugccuggacgucgacgagugcgcggugggguccgacugcagcgagcacgccuccugccugaacguggacggcagcuacaucugcuccugcgugccgcccuacaccggggacggcaagaacugcgccgagcccaucaagugcaaggcccccgggaaccccgagaacggccacagcuccggcgagaucuacacggugggggcggaggugaccuucagcugccaggagggcuaccagcucaugggggucaccaagaucacgugccuggaguccggcgaguggaaccaccugauccccuacugcaaggccgugagcugcgggaagcccgccauccccgagaacggcugcaucgaggagcucgccuucaccuucggcuccaaggugaccuaccggugcaacaagggguacacccuggccggcgacaaggagagcuccugccuggcgaacagcagcuggucccacagcccgcccgucugcgagcccgugaagugcuccagccccgagaacaucaacaacgggaaguacauccucuccggccugaccuaccugagcacggccuccuacagcugcgacaccggcuacucccuccaggggccgagcaucaucgagugcaccgccuccggcaucugggaccgcgcgccgcccgccugccaccugguguucugcggggagcccccggcgaucaaggacgccgucaucaccggcaacaacuucacguuccggaacaccgugaccuacacgugcaaggagggguacacgcuggccggccucgacaccaucgagugccuggccgacggcaaguggagccgcuccgaccagcagugccuggccgugagcugcgacgagccgcccaucgucgaccacgcgucccccgagaccgcccaccggcuguucggggacaucgccuucuacuacugcagcgacggcuacucccuggccgacaacagccagcugcucugcaacgcgcaggggaagugggugccgcccgagggccaggacaugccccgcugcaucgcccacuucugcgagaagcccccgagcguguccuacagcauccuggaguccgucagcaaggccaaguucgccgccggguccguggugagcuucaagugcauggagggcuucguccugaacaccuccgcgaagaucgagugcaugcggggcgggcaguggaaccccagccccauguccauccagugcauccccgugcgcugcggcgagccgcccagcaucaugaacggguacgccuccggcagcaacuacuccuucggggccaugguggccuacagcugcaacaagggcuucuacaucaagggcgagaagaaguccacgugcgaggccaccgggcaguggagcagccccaucccgaccugccacccggucagcugcggcgagccgcccaagguggagaacggguuccuggagcacaccaccggccggaucuucgaguccgaggugcgcuaccagugcaacccgggcuacaagagcgucgggagccccguguucgugugccaggcgaaccggcacuggcacuccgagagcccccucaugugcgucccccuggacugcggcaagccgccgcccauccagaacggguucaugaagggcgagaacuucgaggugggguccaaggugcaguucuucugcaacgagggcuacgagcuggucggcgacagcuccuggacgugccagaaguccgggaaguggaacaagaaguccaaccccaagugcaugccggccaagugccccgagccgccccugcuggagaaccagcuggugcucaaggagcugaccaccgaggugggcgucgugaccuucagcugcaaggaggggcacguccugcagggcccguccgugcucaagugccugcccagccagcaguggaacgacuccuuccccgugugcaagaucguccugugcacgcccccgccccucaucagcuucggggugcccauccccuccagcgcccugcacuucggcuccaccgugaaguacagcugcgucggcggguucuuccugcgcggcaacuccaccacccucugccagccggacgggacguggagcagcccccuccccgagugcgugcccguggagugcccgcagcccgaggagauccccaacggcaucaucgacguccaggggcuggccuaccucagcaccgcccuguacacgugcaagcccggcuucgagcuggugggcaacaccacgacccucugcggggagaacggccacuggcucggcgggaagccgaccugcaaggcgaucgagugccugaagcccaaggagauccucaacgggaaguucagcuacaccgaccugcacuacgggcagacggugaccuacuccugcaaccggggcuuccgccuggaggggcccagcgcccugaccugccuggagaccggcgacugggacgucgacgccccguccugcaacgccauccacugcgacagcccccagcccaucgagaacggguucguggagggcgcggacuacuccuacggcgccaucaucaucuacagcugcuuccccggguuccagguggccggccacgccaugcagacgugcgaggaguccggguggagcuccagcaucccgaccugcaugcccaucgacugcggccugccgccccacaucgacuucggggacugcaccaagcucaaggacgaccagggcuacuucgagcaggaggacgacaugauggagguccccuacgugacgccccacccgcccuaccaccugggcgccguggcgaagacgugggagaacaccaaggaguccccggccacccacagcuccaacuuccuguacgggaccauggucagcuacacgugcaaccccggcuacgagcuccuggggaaccccgugcugaucugccaggaggacggcaccuggaacggguccgcccccagcugcaucuccaucgagugcgaccucccgaccgcccccgagaacggcuuccugcgcuucaccgagacgagcaugggcuccgccgugcaguacagcugcaagcccgggcacauccuggcgggcagcgaccuccggcugugccuggagaaccgcaagugguccggggccagcccccggugcgaggccaucuccugcaagaagccgaaccccgucaugaacggcagcaucaagggguccaacuacaccuaccucagcacccuguacuacgagugcgaccccggcuacgugcugaacggcaccgagcgccggacgugccaggacgacaagaacugggacgaggacgagcccaucugcaucccgguggacugcuccuccccgcccgucuccgccaacggccaggugcgcggcgacgaguacaccuuccagaaggagaucgaguacacgugcaacgagggguuccuccuggagggcgcccggagccgcgugugccuggcgaacggcuccuggagcggggccacccccgacugcgucccggugcggugcgccacgccgccccagcucgccaacggcgugacggaggggcuggacuacggcuucaugaaggaggucaccuuccacugccacgagggguacauccugcacggcgccccgaagcugaccugccaguccgacggcaacugggacgcggagaucccccugugcaagcccgugaacugcgggcccccggaggaccuggcccacggcuuccccaacggguucagcuucauccacggcgggcacauccaguaccagugcuuccccggcuacaagcuccacggcaacuccagccgccggugccuguccaacgggagcugguccggcagcagccccuccugccugccgugccgcugcagcacccccgugaucgaguacgggacggucaacggcaccgacuucgacugcgggaaggccgcccggauccagugcuucaagggcuucaagcuccugggccuguccgagaucacgugcgaggcggacgggcaguggagcuccggcuucccccacugcgagcacaccagcugcgggucccuccccaugaucccgaacgccuucaucagcgagaccuccagcuggaaggagaacgugaucaccuacuccugccgcagcggcuacgugauccagggguccagcgaccugaucugcaccgagaagggcgucuggucccagcccuaccccgugugcgagccccugagcugcggcuccccgcccagcguggccaacgccgucgccaccggggaggcgcacacguacgaguccgaggugaagcuccggugccuggagggcuacaccauggacaccgacaccgacacguucacgugccagaaggacgggcgcugguuccccgagcggaucagcugcagccccaagaagugcccgcugcccgagaacaucacccacauccucgugcacggcgacgacuucuccgucaaccgccaggugagcguguccugcgccgagggcuacaccuucgagggggucaacaucagcgugugccagcuggacggcacgugggagccgcccuucuccgacgagagcugcuccccggugagcugcgggaagcccgagucccccgagcacggcuucgucguggggagcaaguacaccuucgaguccaccaucaucuaccagugcgagcccggcuacgagcuggagggcaaccgggagcgcgugugccaggagaaccggcaguggagcgggggcgucgccaucugcaaggagacccgcugcgagacgccgcucgaguuccugaacgggaaggccgacaucgagaaccgcaccaccggccccaacguggucuacuccugcaaccggggguacagccuggagggccccuccgaggcccacugcaccgagaacggcacguggagccacccggugccccucugcaagcccaaccccugcccggugcccuucgucauccccgagaacgcgcugcuguccgagaaggaguucuacguggaccagaacgugagcaucaagugccgcgagggguuccuccugcagggccacgggaucaucacgugcaaccccgacgagaccuggacccagacgagcgccaagugcgagaagaucuccugcggcccgcccgcccacgucgagaacgccaucgcccgcggggugcacuaccaguacggcgacaugaucaccuacagcugcuacuccggcuacaugcuggagggguuccuccgcagcgugugccuggagaacggcaccuggaccagcccgcccaucugccgggcggucugccgcuucccgugccagaacgggggcaucugccagcggcccaacgccugcagcugccccgagggcuggauggggcgccugugcgaggagcccaucugcauccucccgugccugaacggcgggcggugcguggcccccuaccagugcgacugcccgcccggcuggacggggucccgcugccacaccgccgugugccagagcccgugccugaacggcggcaagugcguccggcccaaccgcugccacugccucuccagcuggaccgggcacaacugcucccggaagcgccggaccggcuucuga

SEQ ID NO: 37323 - RNA, 5367 nt, Artificial Sequence
  derived and/or modified sequence opt1 from SVIL__Homo_sapiens__NP_003165
augaagcggaaggagcggaucgcccgccggcuggagggcaucgagaacgacacccagcccauccuccugcagagcugcaccgggcuggugacgcaccgccuccuggaggaggacacgccccgguacaugcgcgccagcgaccccgcgagcccccacaucggccggagcaacgaggaggaggagaccagcgacuccagccuggagaagcagacccgcuccaaguacugcaccgagaccagcggggugcacggcgacucccccuacgggagcggcaccauggacacccacucccucgagagcaaggccgagcggaucgcccgcuacaaggccgagcggcgccggcagcuggccgagaaguacggccugacgcucgacccggaggcggacuccgaguaccugagccgcuacaccaagucccggaaggagcccgacgccguggagaagcgcgggggcaagagcgacaagcaggaggaguccagccgggacgccuccagccuguaccccgggaccgagaccaugggccuccgcacgugcgccggggagagcaaggacuacgcgcugcacgugggcgacggcuccagcgaccccgagguccugcucaacaucgagaaccagcggcgcgggcaggagcuguccgccacccggcaggcccacgaccugagcccggccgccgaguccagcuccaccuucagcuucuccggccgcgacagcuccuucaccgaggugccccgcagccccaagcacgcgcacuccagcucccuccagcaggccgccagccggucccccagcuucggggacccgcagcugucccccgaggcccgcccccggugcacgagccacagcgagacccccaccguggacgacgaggagaaggucgacgagcgcgccaagcuguccguggcggccaagcggcuccuguuccgcgagauggagaaguccuucgacgagcagaacgugccgaagcggcgcucccggaacaccgccgucgagcagcgccugcggcgccuccaggaccggagccugacgcagcccaucaccaccgaggagguggugaucgccgccacccugcaggcguccgcccaccagaaggcccucgccaaggaccagacgaacgagggcaaggagcuggccgagcagggcgagcccgacagcuccacccugagccucgcggagaagcuggcccuguucaacaagcucucccagcccgucagcaaggccaucuccacccgcaaccggaucgacacccgccagcggcgcaugaacgcccgguaccagacgcagccggugacccugggggagguggagcagguccagagcggcaagcugauccccuucucccccgcggugaacaccagcguguccaccgucgccagcacgguggcccccauguacgccggggaccuccgcaccaagccgccccuggaccacaacgccuccgcgaccgacuacaaguucagcagcuccaucgagaacagcgacucccccgugcgcagcauccugaagucccaggccuggcagccccucgucgagggcagcgagaacaaggggaugcugcgggaguacggcgagaccgaguccaagcgcgcccugacgggccgggacagcgggauggagaaguacggcuccuucgaggaggccgaggccagcuacccgauccucaaccgcgcgcgggagggggacucccacaaggagagcaaguacgccgugccccgccggggcucccuggagcgcgccaacccgcccaucacccaccugggggacgagcccaaggaguucagcauggccaagaugaacgcccagggcaaccucgaccugcgggaccgccugcccuucgaggagaagguggaggucgagaacgugaugaagcggaaguucucccuccgcgcggccgaguucggcgagcccaccagcgagcagaccgggaccgccgccggcaagacgaucgcgcagaccaccgccccggucuccuggaagccccaggacagcuccgagcagccccaggagaagcugugcaagaaccccugcgccauguucgccgccggggagaucaagaccccgacgggcgaggggcugcuggacagccccagcaagaccauguccaucaaggagcggcucgcgcugcugaagaaguccggcgaggaggacuggcgcaaccggcucucccgccggcaggagggcgggaaggcccccgccagcucccugcacacccaggaggccggccgcagccugaucaagaagcgggugaccgagucccgcgagagccagaugacgaucgaggagcggaagcagcucaucaccgugcgcgaggaggccuggaagacccgcgggcggggcgcggccaacgacuccacccaguucacggucgccggccgcauggugaagaaggggcuggccagccccaccgccaucaccccgguggcgucccccaucugcggcaagacccgggggacgacccccgucagcaagccccuggaggacaucgaggcccgcccggacaugcagcucgaguccgaccugaagcuggaccggcucgagaccuuccugcgccggcugaacaacaaggugggcgggaugcacgagaccgugcucacggucaccggcaagagcgugaaggaggugaugaagcccgacgacgacgagaccuucgccaaguucuaccgcuccgucgacuacaacaugccccggagccccguggagauggacgaggacuucgacgugaucuucgacccguacgcccccaagcugaccuccagcgucgcggagcacaagcgcgccgugcggcccaagcgccgggugcaggccuccaagaacccccugaagaugcucgccgcccgcgaggaccugcugcaggaguacacggagcagcggcucaacgucgcguucauggagagcaagcgcaugaagguggagaagaugagcuccaacagcaacuucuccgaggugacccuggccggccuggccagcaaggagaacuucuccaacgucagccuccgguccgugaaccugaccgagcagaacagcaacaacuccgccgugccguacaagcgccugaugcuccugcagaucaaggggcggcgccacguccagacccgccugguggagccccgggccagcgcgcucaacuccggcgacugcuuccugcugcucagcccccacugcugcuuccugugggugggggaguucgccaacgucaucgagaaggccaaggccuccgagcuggccacgcucauccagaccaagcgcgagcugggcugccgggcgaccuacauccagaccaucgaggaggggaucaacacgcacacccacgccgccaaggacuucuggaagcugcucggcggccagaccagcuaccaguccgccggggacccgaaggaggacgagcuguacgaggccgcgaucaucgagaccaacugcaucuaccgccugauggacgacaagcucgugcccgacgacgacuacuggggcaagauccccaagugcagccugcugcagcccaaggaggugcucgucuucgacuucggguccgagguguacguguggcacggcaaggaggucacgcuggcccagcggaagaucgccuuccagcuggccaagcaccucuggaacgggaccuucgacuacgagaacugcgacaucaacccgcuggaccccggcgagugcaacccccugaucccccgcaagggccaggggcggccggacugggcgaucuucggccgccucaccgagcacaacgagaccauccuguucaaggagaaguuccuggacuggaccgagcucaagcggagcaacgagaagaaccccggggagcuggcccagcacaaggaggacccccgcacggacgugaaggccuacgacgugacccggauggucuccaugccccagaccaccgccggcacgauccuggacggggugaacgugggccgcggcuacgggcucgucgagggccacgaccggcgccaguucgagaucaccagcgugagcguggacgucuggcacauccuggaguucgacuacucccggcugccgaagcagagcaucgggcaguuccacgagggcgacgccuacguggugaaguggaaguucauggucuccaccgcggugggcagccgccagaagggggagcacuccgugcgggccgccggcaaggagaagugcgucuacuucuucuggcaggggcgccacagcaccguguccgagaagggcacgagcgcccucaugaccguggagcuggacgaggagcgcggggcccagguccaggugcugcagggcaaggagccgcccugcuuccuccagugcuuccagggcgggauggucgugcacuccggccgccgggaggaggaggaggagaacgugcagagcgaguggcgccuguacugcguccgcggggaggugcccguggagggcaaccugcucgaggucgcgugccacugcuccagccugcggucccgcaccagcaugguggugcugaacgucaacaaggcccucaucuaccuguggcacgggugcaaggcccaggcccacaccaaggaggugggccggacggccgcgaacaagaucaaggagcagugcccgcuggaggccggccuccacuccagcuccaaggugaccauccacgagugcgacgaggggagcgagccccugggcuucugggacgcccuggggcgccgggaccgcaaggccuacgacugcaugcuccaggaccccggcuccuucaacuucgcgccccggcuguucauccugagcagcuccagcggggacuucgccgccaccgaguucgucuacccggcccgcgcccccuccguggugagcuccaugcccuuccuccaggaggaccuguacagcgcgccccagccggcccuguuccucgucgacaaccaccacgagguguaccuguggcagggcugguggcccaucgagaacaagaucaccggcuccgcccggauccgcugggccagcgaccggaaguccgccauggagacggugcugcaguacugcaaggggaagaaccucaagaagcccgcgcccaagagcuaccugauccacgccggccuggagccgcucaccuucaccaacauguuccccuccugggagcaccgcgaggacaucgccgagaucaccgagauggacacggaggucagcaaccagaucacccugguggaggacgugcuggccaagcucugcaagaccaucuacccccuggccgaccugcucgcgcggccgcugcccgagggggucgacccccugaagcuggagaucuaccucaccgacgaggacuucgaguucgcccuggacaugacgcgcgacgaguacaacgcccugcccgccuggaagcaggucaaccucaagaaggcgaagggccuguucuga

SEQ ID NO: 37324 - RNA, 234 nt, Artificial Sequence
  derived and/or modified sequence opt1 from SVIP__Homo_sapiens__NP_683691
augggccugugcuuccccugccccggggagagcgccccgcccacccccgaccucgaggagaagcgcgccaagcuggcggaggccgccgagcggcgccagaaggaggccgccucccggggcauccuggacgugcagagcguccaggagaagcgcaagaagaaggagaagaucgagaagcagaucgcgaccuccgggcccccgcccgagggcgggcuccgguggacggugagcuga

SEQ ID NO: 37325 - RNA, 1647 nt, Artificial Sequence
  derived and/or modified sequence opt1 from SVOP__Homo_sapiens__NP_061181
auggaggaggaccuguuccagcuccgccagcugcccguggucaaguuccggcgcaccggcgagagcgcccgguccgaggacgacaccgccagcggggagcacgaggugcagaucgagggcgugcacgucgggcuggaggcgguggagcucgacgacggcgccgccgugccgaaggaguucgccaaccccacggacgacaccuucauggucgaggacgccguggaggcgaucggguucggcaaguuccaguggaagcuguccgugcugaccggccucgccuggauggccgacgccauggagaugaugauccugagcauccuggcgccccagcuccacugcgaguggcgccugcccuccuggcaggucgcccugcucaccagcgugguguucgucgggaugauguccagcuccacgcuguggggcaacaucagcgaccaguacgggcggaagaccggccugaagaucuccgugcucuggacccuguacuacgggauccugagcgccuucgccccgguguacuccuggauccucguccugcgcggccuggugggcuucgggaucggcggggugccccagagcgucacccucuacgccgaguuccugcccaugaaggcgcgggccaagugcauccugcucaucgagguguucugggccaucggcacgguguucgaggucgugcuggccguguucgucaugcccucccugggcuggcgcuggcuccugauccugagcgccgugccgcuccugcuguucgcgguccucugcuucuggcugcccgaguccgcccgguacgacgugcugagcgggaaccaggagaaggccaucgccacccucaagcgcaucgccaccgagaacggcgcgcccaugccccuggggaagcugaucaucucccggcaggaggaccgcggcaagaugcgggaccucuucaccccgcacuuccgcuggacgacccugcugcucugguucaucugguucagcaacgccuucagcuacuacgggcuggugcugcucaccaccgagcuguuccaggccggcgacgucugcggcaucuccagccggaagaaggccguggaggccaagugcucccuggcgugcgaguaccucagcgaggaggacuacauggaccugcuguggacgacccuguccgaguuccccggggugcucgucacccuguggaucaucgaccgccugggccggaagaagaccauggcccucugcuucgugaucuucagcuucugcucccugcuccuguucaucugcguggggcgcaacguccugacgcugcuccuguucaucgcccgggccuucaucagcggcggguuccaggcggccuacguguacacccccgagguguaccccaccgccacccgcgcccugggccucggcacgugcuccgggauggcccgggucggcgcgcugaucaccccguucaucgcccaggugaugcuggagagcuccguguaccucacccuggccgucuacagcgggugcugccugcucgccgcccuggcguccugcuuccugcccaucgagaccaagggccgcgggcuccaggagagcucccaccgcgaguggggccaggagauggugggccgggggaugcacggcgccggggugacgcgcagcaacuccggcagccaggaguga

SEQ ID NO: 37326 - RNA, 1758 nt, Artificial Sequence
  derived and/or modified sequence opt1 from SWAP70__Homo_sapiens__NP_055870
augggcagccugaaggaggagcuccugaaggccaucuggcacgccuucaccgcgcuggaccaggaccacuccgggaaggugagcaagucccagcucaagguccugagccacaaccugugcaccgugcucaaggugccccacgacccggucgcccuggaggagcacuuccgcgacgacgacgagggccccguguccaaccagggguacaugcccuaccugaaccgguucauccucgagaaggugcaggacaacuucgacaagaucgaguucaaccgcaugugcuggacgcugugcgucaagaagaaccugaccaagaacccccuccugaucaccgaggaggacgccuucaagaucugggugaucuucaacuuccugagcgaggacaaguacccgcucaucaucguguccgaggagaucgaguaccugcugaagaagcucaccgaggccaugggcgggggcuggcagcaggagcaguucgagcacuacaagaucaacuucgacgacagcaagaacggccuguccgccugggagcugaucgagcucaucgggaacggccaguucagcaaggggauggaccggcagacggucuccauggcgaucaacgagguguucaacgagcugauccuggacgugcucaagcagggcuacaugaugaagaaggggcaccgccggaagaacuggaccgagcgcugguucguccugaagcccaacaucaucagcuacuacguguccgaggaccugaaggacaagaagggcgacauccuccuggacgagaacugcugcguggagagccugcccgacaaggacggcaagaagugccucuuccuggucaagugcuucgacaagaccuucgagaucuccgccagcgacaagaagaagaagcaggaguggauccaggccauccacuccaccauccaccugcucaagcuggggagccccccgccccacaaggaggcccggcagcgccggaaggagcugcgcaagaagcagcucgcggagcaggaggagcuggagcggcagaugaaggagcugcaggccgccaacgaguccaagcagcaggagcucgaggccgugcgcaagaagcuggaggaggccgcgagccgggccgccgaggaggagaagaagcgccugcagacgcagguggagcuccaggcccgguucagcaccgagcuggagcgcgagaagcugauccggcagcagauggaggagcaggucgcccagaaguccagcgagcucgagcaguaccugcagcgcgugcgggagcuggaggacauguaccucaagcugcaggaggcgcuggaggacgagcgccaggcccggcaggacgaggagaccgugcgcaagcugcaggcccgccuccuggaggaggaguccagcaagcgggccgagcuggagaaguggcaccucgagcagcagcaggccauccagaccacggaggcggagaagcaggagcuggagaaccagcgcguccugaaggagcaggcccuccaggaggccauggagcagcuggagcagcuggagcucgagcggaagcaggcccuggagcaguacgaggaggugaagaagaagcuggagauggccaccaacaagaccaaguccuggaaggacaagguggcgcaccacgagggccucauccgccugaucgagcccgggagcaagaacccccaccugaucaccaacuggggcccggccgccuucacggaggccgagcucgaggagcgggagaagaacuggaaggagaagaagaccaccgaguga

SEQ ID NO: 37327 - RNA, 2703 nt, Artificial Sequence
  derived and/or modified sequence opt1 from SWT1__Homo_sapiens__NP_060143
augagcuccaaggagagcugcggcaagaaggagaccucccagcgcaaggacaccacgaccagcucccccaacuucggggagaaggacaagaaggagcggaagaccccggccagcuccaccagcuccagcuccauccgcagcguguccagcgagaagcggaagcugaaguccgaccacacggacguccucuacuacaacaucaagcgccggcagggccugaagcgccugagcguggagaucgacacccuccggcgccggcccaagaucggguccagcucccagcgccccaucaagcugaaggaggccagcuacagcaacgacaaccagaucauccugcagucccccagcuccaacggcaccaagaaggacauccacaagugcguggacuucaagccgaaggacaucaagcucaccaacgcggggagcaagcuggaccacggcaucaagucccugagcucccccaagaucgccagcgacgucaagcccaaggccgagggccaggccuccgagaacaaguggagccaccuccuggugcagcgggagaagaugaaggagcugaagaaggggcgcaacuccaaguuccgggacaacagcgagaagugcgugcucgagaaguggaagcgcaaccaguucucccaggacuacaacagcaacaagaucaucaaggagccccugggcucccggcgccagaagaucagcuucaagaucccgaucaagucccgggacacgcugcagaagcucgucgaggagaacguguucaacaucgacagcaacaacuccaagaccaagcaggaggagcgcgaguaccuggagagcagccaggugucccugaacgucacccggcagaagaccgagcaccuccugagcgacuucacguacaagcgcaccgugcacgaguggaagcggaagcaccacuacgaccaccaggaguccaacgacagccacucccgcgagaaccugacccagagcuucgaggcccccugcugcuccgugagcuccgagagcauccaggacgcggaccaggagaugcagaucgucgaggagcuccacgccgcccgcguggggaaguccguggaccugcccggcgagcugaugagcauggagaucgaccucgaggacgacguccacuccagcuccgccaacaacaccagcgaccggaagcugcugaucgugaucgacacgaacauccucaugaaccaccugaaguucgugcgcauccugaagaccaccgagguccccggguucgacaagcucgugcugaucaucccguggguggucaugcaggagcuggaccggaugaaggagggcaagcuccugaagcgcgcgcagcacaaggccauccccgccgugcacuucaucaacgacucccugaagaaccaggaccggaagcucuggggccagagcauccagcuggccagccagaagcacuacgggcuguccgacgagaacaacgacgaccgcgugcucaagugcugccugcagcaccaggagcuguuccccugcagcuucgucauccucugcaccgacgaccggaaccugcgcaacaagggccugaucuccggggucaagagccucuccaaggaggagcugagcgccgagcugcuccaccugucccugaacacggacgugugccaccagcccugcaucccgaagcagcagcugaaggcggagaccacgccccucaaggagagcuacaaggaggaguccaccaacagcggccuguccauccugcucgagagcaucguguccgaccuggagaagucccugggcaccgggcucagcagcauccuggagaccgagaugaagaucgccuucggcaaccuguggauggagauccucuaccugaagccgcccuggacccugcuccaccuccugcagugcuucaagaagcacuggcuggccguguucgggcuggucauggagaagaaccugcuccugaccaucgagucccuguacaagaaccuccggaaggccaacaaggccguggacuucacgaccgugaaguuccugcugcaggacagccgcucccuccugcacgcguucagcacccggagcaacuacgacggcauccugccccagaccuucgcccaggucaacaaccuccugcagacguucgccgaggugaagaccaagcugaagcccaacuccagcgagaacaccgugaccaagaagcaggaggggacgucccucaagaacagccacaaccaggagaucaccgucuucuccagcucccaccucccccagcccagccgccaccaggagaucugguccauccuggagagcguguggaucaccaucuaccagaacuccaccgacguguuccagcggcugggcagcaacuccgcccugaccacgagcaacaucgccuccuucgaggaggcguucaucugccugcagaagcucauggccgccguccgcgacauccuggagggcauccagcggauccuggccccgaacagcaacuaccaggacguggagacccucuacaacuuccugaucaaguacgaggugaacaagaacgucaaguucaccgcccaggagaucuacgacugcgugucccagaccgaguaccgcgagaagcugacgaucgggugccggcagcucguggagauggaguacaccaugcagcagugcaacgcgagcgucuacauggaggccaagaaccgcggcuggugcgaggacaugcugaacuaccggaucuga

SEQ ID NO: 37328 - RNA, 1989 nt, Artificial Sequence
  derived and/or modified sequence opt1 from SYBU__Homo_sapiens__NP_001093213
augggcccccugcgcgagagcaaggagcaccgggugcagcaccacgacaaggagaucucccgcagccggaucccgcgccucauccugcggccccacaugccccagcagcagcacaaggucucccccgccagcgaguccccguucagcgaggaggagucccgcgaguucaaccccagcuccagcgggcgguccgcccgcaccgugagcuccaacagcuucugcuccgacgacaccggcugccccagcucccagagcgugucccccgucaagacgccgagcgacgcggggaacagccccaucggcuucugccccggguccgacgagggcuucacccggaagaagugcaccaucggcauggugggggagggcagcauccaguccagccgcuacaagaaggaguccaagagcgggcuggugaagcccggcuccgaggccgacuucagcuccagcuccagcaccggguccaucagcgccccggagguccacauguccacggccggcagcaagcgguccagcuccagccgcaaccggggcccccacgggcgcagcaacggcgccuccagccacaagcccggguccagccccuccagcccgcgggagaaggaccuccuguccaugcugugccgcaaccagcucagccccgugaacauccaccccuccuacgcgcccagcuccccgagcuccagcaacuccggcagcuacaagggcuccgacugcagccccaucaugcggcgcagcgggcgguacauguccugcggcgagaaccacggggugcgcccgcccaaccccgagcaguaccugacgccccugcagcagaaggaggucaccgugcggcaccucaagaccaagcugaaggagagcgagcgccgccugcacgagcgggaguccgagaucguggagcucaagagccagcuggcccgcaugcgggaggacuggaucgaggaggagugccaccgcgucgaggcccagcuggcccucaaggaggcgcggaaggagaucaagcagcugaagcaggucaucgagaccaugcgcuccagccuggccgacaaggacaagggcauccagaaguacuucguggacaucaacauccagaacaagaagcucgagucccugcugcagagcauggagauggcccacuccgggagccuccgggacgagcugugccuggacuuccccugcgacucccccgagaagucccucacccugaacccgccccuggacaccauggccgacggccucagccuggaggagcaggucaccggcgagggggccgaccgcgagcugcucgugggcgacagcaucgcgaacuccacggaccuguucgacgagaucgugaccgccaccaccacggagagcggggaccuggagcucgugcacuccacccccggcgccaacgugcuggagcugcucccgaucgugauggggcaggaggagggcagcgucgugguggagcgggccguccagaccgacgugguccccuacucccccgccaucagcgagcugauccagagcgugcugcagaagcuccaggaccccugcccguccagccuggcgucccccgacgagagcgagcccgacuccauggagagcuuccccgagucccugagcgcccucguggucgaccugaccccgcgcaaccccaacuccgccauccugcucagccccguggagacgcccuacgccaacguggacgccgagguccacgcgaaccggcugaugcgcgagcuggacuucgccgccugcguggaggagcggcucgacggcgugaucccgcuggcccgcgggggcgucgugcggcaguacugguccagcuccuuccugguggaccugcucgccgucgcggcccccguggugcccaccguccugugggccuucagcacccagcgcgggggcaccgaccccguguacaacaucggggcccugcuccggggcugcugcguggucgcgcugcacucccugcgccggacggccuuccgcaucaagaccuga

SEQ ID NO: 37329 - RNA, 957 nt, Artificial Sequence
  derived and/or modified sequence opt1 from SYCE1__Homo_sapiens__NP_001137235
auggccggccgcagccugaccuccaaggccgagcccaccgccggggccguggaccgggccgagaaggccggcgggcaggacacgagcucccagaagaucgaggaccucauggagaugguccagaagcugcagaaggugggcagccuggagccgcgcguggagguccucaucaaccggaucaacgaggugcagcaggccaagaagaaggcgaacaaggaccugggggaggcccgcaccaucugcgaggcccugcagaaggagcucgacucccugcacggcgagaaggugcaccugaaggagauccucagcaagaagcaggagacccugcggauccugcgccuccacugccaggagaaggaguccgaggcccaccggaagcacaccaugcugcaggagugcaaggagcgcaucagcgcgcugaaccuccagaucgaggaggagaagaacaagcagcggcagcugcgccuggccuucgaggagcagcucgaggaccugaugggccagcacaaggaccugugggacuuccacaugcccgagcggcucgccaaggagaucugcgcccuggacuccagcaaggagcagcugcucaaggaggagaagcuggucaaggccacgcuggaggacgugaagcaccagcucugcucccugugcggggcggagggccccagcacccuggacgagggccucuuccugcgcucccaggaggccgccgccaccgugcagcuguuccaggaggagcaccggaaggccgaggagcuccuggcggccgccgcccagcgccaccagcagcugcagcagaagugccagcagcagcagcagaagcggcagcgccucaaggaggagcuggagaagcacgggaugcagguccccgcccaggcgcagagcacccaggaggaggaggccgggccgggcgacguggcgccccggcccggccgccccgugacguggugguccuga

SEQ ID NO: 37330 - RNA, 729 nt, Artificial Sequence
  derived and/or modified sequence opt1 from SYCE1L__Homo_sapiens__NP_001123451
auggccggcaagcugaagccccucaacguggaggccccggaggcgaccgaggaggccgaggggcaggccaagagccugaagaccgaggaccugcucgccauggucaucaagcugcagaaggagggcucccuggagccccagaucgaggaccucaucagccgcaucaacgaccugcagcaggccaagaagaaguccagcgaggagcugcgggagacgcacucccucugggaggcgcugcaccgcgagcuggacagccucaacggggagaaggugcaccuggaggaggugcugggcaagaagcaggaggcccuccggauccugcagaugcacugccaggagaaggaguccgaggcccagcgccuggacguccgggggcagcucgaggaccugaugggccagcacaaggaccugugggaguuccacaugcucgagcagcgccuggcccgggagauccgcgcgcuggagcggagcaaggagcagcuccuguccgagcgccggcuggugcgcgccaagcuccgggagguggagcgccggcugcacagcccgcccgaggucgagggcgccauggccgugaacgacgggcugaaggccgagcucgagaucuucggcgagcagguccgcuccgcgcccgaggugggggccggcgagggggaggccggccccgagcugccccgggcccgcgacgaggaggaccccgagccgcccguggccgcgcccgacgcccuguga

SEQ ID NO: 37331 - RNA, 4593 nt, Artificial Sequence
  derived and/or modified sequence opt1 from SYCP2__Homo_sapiens__NP_055073
augcccauccgcccggaccugcagcagcucgagaagugcaucgacgacgcccugcggaagaacgacuucaagccccugaagacccuccugcagaucgacaucugcgaggacgugaagaucaagugcagcaagcaguucuuccacaaggucgacaaccugaucugccgcgagcucaacaaggaggacauccacaacguguccgccauccuggugagcgucggccggugcgggaagaacaucuccgugcugggccaggcggggcuccugaccaugaucaagcagggccugauccagaagaugguggccugguucgagaaguccaaggacaucauccagucccaggggaacagcaaggacgaggccguccucaacaugaucgaggaccugguggaccugcuccuggugauccacgacgucuccgacgagggcaagaagcaggucguggagagcuucgucccccgcaucugcucccuggugaucgacagccgggugaacaucugcauccagcaggagaucaucaagaagaugaacgccaugcucgacaagaugccccaggacgcccgcaagauccuguccaaccaggagaugcugauccucaugagcuccaugggcgagcggauccuggacgcgggggacuacgaccugcaggucggcaucguggaggcccucugccgcaugacgaccgagaagcagcggcaggagcuggcccaccagugguucagcauggacuucaucgccaaggcguucaagcgcaucaaggacuccgaguucgagaccgacugccggaucuuccugaaccucgugaacgggaugcugggcgacaagcgccgggucuucaccuucccgugccugagcgccuuccucgacaaguacgagcugcagauccccuccgacgagaagcuggaggaguucuggaucgacuucaaccucgggagccagacgcuguccuucuacaucgccggcgacaacgacgaccaccagugggaggccgugaccgugcccgaggagaagguccagaucuacagcaucgaggugcgcgagagcaagaagcugcucaccaucauccugaagaacaccgugaagaucuccaagcgggagggcaaggagcugcuccuguacuucgacgccagccuggagaucacgaacgucacccagaagaucuucggggcgaccaagcaccgcgaguccauccggaagcagggcaucagcguggccaagaccucccuccacauccuguucgacgccagcgggucccagauccugguccccgagagccagaucuccccggugggcgaggagcucgugagccugaaggagaaguccaagagccccaaggaguucgccaagcccuccaaguacaucaagaacagcgacaagggcaaccgcaacaacucccagcuggagaagacgacccccagcaagcggaagauguccgaggccagcaugaucgucuccggggcggaccgcuacaccaugcggagcccggugcuguucagcaacaccuccaucccgccccgccgccggcgcaucaagccgccccuccagaugacgagcagcgccgagaagcccagcgugucccagaccagcgagaaccggguggacaacgccgccucccugaagucccgcagcagcgagggccggcaccgccgggacaacaucgacaagcacaucaagaccgccaagugcguggagaacaccgagaacaagaacguggaguuccccaaccagaacuucuccgagcugcaggacgucauccccgacagccaggcggccgagaagcgcgaccacacgauccuccccggggugcuggacaacaucugcggcaacaagauccacuccaagugggccugcuggacccccgugaccaacaucgagcugugcaacaaccagcgggccagcaccuccagcggggacacgcucaaccaggacaucgucaucaacaagaagcugaccaagcagaaguccagcagcuccaucagcgaccacaacuccgagggcaccggcaaggugaaguacaagaaggagcagaccgaccacaucaagaucgacaaggccgagguggaggucugcaagaagcacaaccagcagcagaaccaccccaaguacagcgggcagaagaacacggagaacgcgaagcaguccgacuggcccguggagagcgagaccaccuucaaguccgugcugcucaacaagaccaucgaggagagccugaucuaccgcaagaaguacauccuguccaaggacgucaacacggcgaccugcgacaagaacccgagcgccuccaagaacgugcagagccaccggaaggccgagaaggagcucaccuccgagcugaacagcugggacuccaagcagaagaagaugcgcgagaaguccaagggcaaggaguucaccaacguggccgagagccugaucagccagaucaacaagcgguacaagacgaaggacgacaucaaguccacccgcaagcucaaggagagccugaucaacagcggguucuccaacaagcccgucgugcagcugagcaaggagaaggugcagaagaaguccuaccggaagcucaagaccaccuucgucaacgugaccagcgagugccccgugaacgacgucuacaacuucaaccugaacggcgccgacgaccccaucaucaagcuggggauccaggaguuccaggccacggccaaggaggccugcgcggaccgcuccauccggcucgugggcccgcgcaaccacgacgagcugaaguccagcgugaagaccaaggacaagaagaucaucaccaaccaccagaagaagaaccuguucagcgacaccgagacggaguaccggugcgacgacuccaagaccgacaucagcuggcuccgcgagcccaaguccaagccccagcugaucgacuacagccgcaacaagaacgucaagaaccacaaguccggcaagagccgguccagccuggagaaggggcagccguccagcaagaugacccccuccaagaacaucaccaagaagauggacaagacgauccccgagggccgcauccggcucccccgcaaggccaccaagaccaagaagaacuacaaggaccugagcaacagcgaguccgagugcgagcaggaguucagccacuccuucaaggagaacaucccggugaaggaggagaacauccacagccggaugaagaccgugaagcugcccaagaagcagcagaaggucuucugcgccgagacggagaaggagcucuccaagcaguggaagaacagcucccugcugaaggacgccauccgcgacaacugccucgaccugagcccccggucccugagcgggucccccagcuccaucgaggugacccgcugcaucgagaagaucaccgagaaggacuucacccaggacuacgacugcaucaccaagagcaucuccccguaccccaagacgagcucccucgagagccugaacuccaacagcggcgucgggggcaccaucaagagccccaagaacaacgagaagaacuuccugugcgccuccgagagcugcucccccaucccgcggccccucuuccugccccgccacacccccaccaagagcaacacgaucgugaaccggaagaagaucuccagccuggugcucacccaggagacccagaacuccaacagcuacuccgacgugagcuccuacagcuccgaggagcgcuucauggagaucgagagcccgcacaucaacgagaacuacauccaguccaagcgggaggagagccaccuggcguccagccuguccaagagcagcgagggccgcgagaagacgugguucgacaugcccugcgacgccacccacgucuccgggcccacccagcaccucagccggaagcgcaucuacaucgaggacaaccuguccaacagcaacgagguggagauggaggagaagggcgagcggcgcgccaaccugcuccccaagaagcugugcaagaucgaggacgccgaccaccacauccacaagauguccgagagcguguccagccuguccaccaacgacuucagcaucccgugggagacguggcagaacgaguucgccgggaucgagaugaccuacgagaccuacgagcggcucaacuccgaguucaagcgccggaacaacauccgccacaagaugcugagcuacuucaccacgcaguccuggaagaccgcgcagcagcaccuccggaccaugaaccaccagagccaggacucccgcaucaagaagcuggacaaguuccaguucaucaucaucgaggagcuggagaacuucgagaaggacagccagucccugaaggaccucgagaaggaguucgucgacuucugggagaagaucuuccagaaguucagcgccuaccagaaguccgagcagcagcgccugcaccuccugaagaccagccuggccaagagcguguucugcaacacggacuccgaggagaccguguucaccagcgagaugugccugaugaaggaggacaugaagguccuccaggaccggcugcugaaggacaugcucgaggaggagcugcugaacgugcgccgggagcucauguccguguucaugagccacgagcgcaacgccaacgucuga

SEQ ID NO: 37332 - RNA, 2439 nt, Artificial Sequence
  derived and/or modified sequence opt1 from SYCP2L__Homo_sapiens__NP_001035364
augcaggccaagaacaaggacgcccugcagcccaucaaggaggaccgcaccggcaaggcgcaggacgacgccuucuggcuccagagccugaucaccgacgccuuccacgacaagggguuccagaagaucaaggaguacuuccagcagaaggagucccacuucccgcagaaguacaaccggcugcuccuguaccgccuggaccggagcaucaacaaggagcucgacaagaacgaguuccaguccgugagccugcugcucaagugcauccagcgcuuccuggucgacggccugaaggaggacgagccccuccugauccggcaggggcugauccccaagcucguguccugguucgagcgcacgaccggcauccugaccagcgaggggcuggccuccgacaccagccucaucugcgugaucgaggacuucuucgacacggcccugaucaucucccggagcuccagcgagggcaagauccagaugcuggacuccuuccuccugagccugggcuuccucgucaccgagaagaccgugaaccaccuccugcagcaggaggggcucaagaccuucaacugcauccugcacgcggugccccgcgaggagcggaagaaguucccgcuguccgagggcaugugccaccucaugaaggaccuggcccgcacgcugcucaccgucggggacuacgaccagcaggucgccaucagcgaggcccugugccggcugaccaucaagaagucccgcgacgagcucgugcacaagugguucgacgacgaggucaucgcggaggccuucaaggagaucaaggaccgggaguucgagaccgacagccgccgguuccugaaccaccugaacaaccgccucggcgaccagcggcgcguguacuccuuccccugcaucgccgccuucgccgacgagcacgagaugcggaagcccgcggacgagaagcuggagaaguucuggaucgacuucaaccuggggagccagagcgugacguucuacaucgacaacgccgagaacacccucugggacuccgucacccugcccaaggaggccgugaugaacuucagcaucaccgagacggagaagaucaagaucuucaucaucuaccugaagaagccgaugaucaucuccuacaaggaggugaugaagaucgagauccacuucgaccuccaguucaacaucagccaggucuccauccaggcccugggcgaggacaagcagaugcugcccgaccagaccaagaucagcuccgagcuguucagcaaguccgacaaggaggaccgcgagagccccuccggccuggagcgggagaccgagcaggccgaggagagcaccaacaugguggaguucauguccgcggaggacgaccgcugccugaucacgcugcaccucaacgaccagagcgagcccccggugaucggggagcccgccuccgacagccaccuccagcccgugcccccguucggcgugcccgacuucccccagcagcccaagucccacuaccgcaagcaccuguucagcgaguccaaccaggacagcagcaccuccgagcucagcuggaccuccaaccagaagaagaagucccucaagagcuacagcucccggaagaagacccgcacgcggagcaaccugcgcauccugccgguguucccgcccuccagcggguccggccacgagaaggaccaggccaagcugcugagccccuccgagaaggagauccccgagcagaacaacaccaccagccccaagaccuccgagcagaaguuccaggacagcuucgccuuccucacggccgaggacuccgcgcagaagaccgagcugcaggacccccacagccugagcgagcucuccagccugaagcacuccgaggacgaggagaagcccaagaucgucaaccaggagagccugaccgaguccaccagccucaagcacaagcugcggaaccuggaggacaaggacaucccggagggcuccuucgccaagagccagcagucccgccucgaggaggagguggcccccgggagccccuucuccaucacggaggagcgggagcugccggagggcaucagcaccuccagccuggaggugguccccgagaaccucaacggguccgccauccugcccaccuucgagaacuucaccaagaagcgcaagcggaaguacgagcugcgcuaccggaagcgccccuucaacagcgagaacgccaagaaggcgccggacugccucaucaagcugcugaaccagaugcagcuguuccggcugaacaagcuggagcgcuuccagaaccucgugcugcaggagcuguccagccucaagcaggacauccaggcccuggagcaccuggagaaggagguccucgaguucuggggcaagcaguccgccgaccugcagagcuucugcgaccuccaggugcugcgguucaacagcacgcagaccuccuga

SEQ ID NO: 37333 - RNA, 711 nt, Artificial Sequence
  derived and/or modified sequence opt1 from SYCP3__Homo_sapiens__NP_001171420
auggugagcuccggcaagaaguacagccggaaguccgggaagcccagcgucgaggaccaguucacccgggccuacgacuucgagaccgaggacaagaaggaccucuccggcagcgaggaggacgugaucgaggggaagacggccgugaucgagaagcgccggaagaagcgcuccagcgcgggcgucguggaggacaugggcggggaggugcagaacaugcucgagggcgucgggguggacaucaacaaggcccugcuggccaagcggaagcgccucgagauguacaccaaggccucccugaagaccagcaaccagaagaucgagcacguguggaagacccagcaggaccagcggcagaagcugaaccaggaguacucccagcaguuccucacgcuguuccagcagugggaccuggacaugcagaaggccgaggagcaggaggagaagauccucaacauguuccgccagcagcagaagauccugcagcagagccggaucguccagucccagcgccugaagaccaucaagcagcucuacgagcaguucaucaagagcauggaggagcuggagaagaaccacgacaaccugcucaccggcgcgcagaacgaguucaagaaggagauggccaugcugcagaagaagaucaugauggagacccagcagcaggagaucgccuccgugcgcaagagccugcaguccaugcuguucuga

SEQ ID NO: 37334 - RNA, 1908 nt, Artificial Sequence
  derived and/or modified sequence opt1 from SYK__Homo_sapiens__XP_011517248
auggccagcuccggcauggccgacagcgcgaaccaccuccccuucuucuucgggaacaucacccgcgaggaggccgaggacuaccuggugcagggcgggauguccgacggccuguaccugcuccggcagagccgcaacuaccucgggggcuucgcccuguccgucgcccacggccggaaggcccaccacuacaccaucgagcgcgagcugaacgggacguacgcgaucgccggcgggcggacccacgccagcccggccgaccugugccacuaccacucccaggagagcgacggccuggugugccuccugaagaagcccuucaaccgcccccagggggugcagcccaagaccggcccguucgaggaccugaaggagaaccucauccgggaguacgucaagcagaccuggaaccugcagggccaggcgcuggagcaggccaucaucucccagaagccccagcucgagaagcugaucgccacgaccgcccacgagaagaugcccugguuccacgggaagaucagccgcgaggaguccgagcagaucgugcugaucggcagcaagaccaacgggaaguuccucauccgggcccgcgacaacaacggcuccuacgcgcugugccugcuccacgagggcaaggugcugcacuaccggaucgacaaggacaagaccgggaagcugagcauccccgagggcaagaaguucgacacgcucuggcagcuggucgagcacuacuccuacaaggccgacgggcugcuccgcgugcugaccgugccgugccagaagaucggcacccaggggaacgucaacuucggcggccggccccagcugcccgggagccaccccgccaccugguccgccggcgggaucaucagccgcaucaaguccuacagcuucccgaagcccggccaccgcaagagcucccccgcccaggggaaccggcaggagagcacgguguccuucaaccccuacgagccggagcucgcgcccugggccgccgacaagggcccccagcgggaggcccugcccauggacaccgagguguacgagagcccguacgccgaccccgaggagauccgccccaaggaggucuaccuggaccggaagcuccugacccuggaggacaaggagcucggcuccgggaacuucggcaccgugaagaagggguacuaccagaugaagaagguggucaagacgguggcggugaagauccugaagaacgaggccaacgaccccgcccugaaggacgagcuccuggccgaggccaacgucaugcagcagcuggacaacccguacaucgugcgcaugaucggcaucugcgaggcggagagcuggaugcucgugauggagauggccgagcuggggccccugaacaaguaccuccagcagaaccggcacgucaaggacaagaacaucaucgagcuggugcaccagguguccaugggcaugaaguaccuggaggagagcaacuucguccaccgcgaccucgccgcccgcaacgugcugcuggucacccagcacuacgcgaagaucuccgacuucggccugagcaaggcccuccgggccgacgagaacuacuacaaggcccagacccacgggaaguggcccgugaagugguacgcccccgagugcaucaacuacuacaaguucuccagcaaguccgacguguggagcuucggcguccugaugugggaggcguucuccuacgggcagaagccguaccgcggcaugaagggcagcgaggugaccgccaugcuggagaagggggagcggaugggcugccccgccgggugcccccgcgagauguacgaccucaugaaccugugcuggacguacgacguggagaaccggccgggcuucgccgccgucgagcugcgccuccggaacuacuacuacgacguggugaacuga

SEQ ID NO: 37335 - RNA, 3825 nt, Artificial Sequence
  derived and/or modified sequence opt1 from SYMPK__Homo_sapiens__XP_011525656
auggccagcggcuccggggacagcgugacccgccgguccgucgccagccaguucuucacccaggaggagggccccgggaucgacggcaugacgaccuccgagcgcgugguggaccugcucaaccaggcggcccugaucaccaacgacagcaagaucaccguccugaagcagguccaggagcucaucaucaacaaggacccgacgcugcuggacaacuuccucgacgagaucaucgccuuccaggccgacaaguccaucgaggugcggaaguucgucaucggguucaucgaggaggccugcaagcgcgacaucgagcugcugcucaagcugaucgcgaaccugaacaugcuccugcgggacgagaacgugaacguggucaagaaggccauccugaccaugacccagcucuacaagguggcccugcaguggauggugaagucccgcgucaucuccgagcugcaggaggccugcugggacauggugagcgcgauggccggcgacaucauccuccugcuggacuccgacaacgacggcauccggacccacgccaucaaguucguggaggggcucaucgucacgcugagcccccgcauggccgacuccgagaucccccggcgccaggagcacgacaucagccuggaccggaucccccgcgaccacccguacauccaguacaacgugcucugggaggagggcaaggccgcgcuggagcagcugcucaaguucauggugcaccccgccaucuccagcaucaaccugaccaccgcccuggggucccucgccaacaucgcccggcagcgccccauguucaugagcgaggucauccaggcguacgagacccugcacgccaaccugcccccgacgcucgccaagucccaggugagcagcgugcggaagaaccugaagcugcaccuccuguccguccugaagcaccccgccagccucgaguuccaggcccagaucaccacccugcugguggaccucggcacgccccaggcggagaucgcccgcaacaugcccuccagcaaggacacccggaagcgcccgcgggacgacuccgacagcacccugaagaagaugaagcuggagcccaaccucggggaggacgacgaggacaaggaccuggagcccggccccuccggcaccagcaaggccuccgcccagaucagcgggcaguccgacaccgacaucacggccgaguuccugcagccgcuccugacccccgacaacguggcgaaccugguccugaucagcaugguguaccuccccgaggccaugcccgccagcuuccaggccaucuacaccccgguggagagcgcgggcaccgaggcccagaucaagcaccuggcccgccugauggccacgcagaugaccgccgcggggcucggccccggcguggagcagaccaagcagugcaaggaggagcccaaggaggagaagguggucaagaccgaguccgugcugaucaagcggcgccugagcgcccaggggcaggccaucuccguggucggcagccucuccagcaugagcccccuggaggaggaggccccgcaggccaagcgccggcccgagcccaucauccccgugacgcagccgcgccuggcgggggccggcgggcggaagaagaucuuccgccucuccgacgugcugaagccccugaccgacgcccaggucgaggccaugaagcucggcgccgugaagcggauccugcgcgcggagaaggccguggccugcagcggcgccgcgcagguccggaucaagauccuggccucccucgugacccaguucaacagcgggcugaaggccgaggugcuguccuucauccucgaggacguccgcgcccggcuggaccuggccuucgcguggcucuaccaggaguacaacgccuaccuggccgccggcgccagcgggucccuggacaaguacgaggacugccucauccgccugcugagcggccuccaggagaagcccgaccagaaggacgggaucuucaccaagguggugcuggaggcgccgcugaucacggaguccgcccucgaggucgugcggaaguacugcgaggacgagagccgcaccuaccugggcauguccacccugcgggaccucaucuucaagcgccccagccggcaguuccaguaccugcacgugcugcucgaccuguccagccacgagaaggacaagguccgcucccaggcccuccuguucaucaagcggauguacgagaaggagcagcugcgcgaguacguggagaaguucgcccugaacuaccuccagcugcuggugcaccccaacccgcccagcguccucuucggcgccgacaaggacaccgagguggcggcccccuggacggaggagaccgugaagcagugccuguaccuguaccucgcccugcugccccagaaccacaagcucauccacgagcuggccgcggucuacaccgaggccaucgccgacaucaagcggaccgugcugcgcgugaucgagcagcccauccgcgggaugggcaugaacuccccggagcuccugcugcucgucgagaacugccccaagggggccgagacccuggugacgcggugccugcacagccucaccgacaaggugccgcccagccccgagcuggucaagcgcgugcgggaccuguaccacaagcgccuccccgacgugcgguuccugauccccguccugaacggccucgagaagaaggaggugauccaggcccugcccaagcugaucaagcucaacccgaucguggucaaggagguguucaaccgccugcuggggacccagcacggcgagggcaacuccgcgcucagcccccugaaccccggggagcugcucaucgcccugcacaacaucgacuccgugaagugcgacaugaaguccaucaucaaggccaccaaccugugcuucgccgagcggaacgucuacacgagcgaggugcucgccguggucaugcagcagcugauggagcagagcccccugccgaugcuccugaugcgcaccgugauccagucccugaccauguacccccggcucggcggguucgugaugaacauccugagccgccugaucaugaagcaggucuggaaguaccccaaggugugggagggcuucaucaagugcugccagcggaccaagccccaguccuuccaggugauccuccagcugccgccccagcagcugggcgcggucuucgacaagugccccgagcuccgcgagccgcugcuggcccacgugcggagcuucacgccccaccagcaggcccacauccccaacuccaucaugaccauccucgaggccagcgggaagcaggagcccgaggccaaggaggcgccggccggcccccuggaggaggacgaccuggagccccugacccucgcccccgccccggcgccccgcccgccccaggaccugaucgggcugcggcucgcccaggagaaggcccugaagcgccagcuggaggaggagcagaagcucaagcccggcggggucggcgcccccuccagcuccagccccucccccagcccguccgcccggcccggcccgccgcccagcgaggaggcgauggacuuccgcgaggaggggcccgagugcgagacccccggcaucuucaucagcauggacgacgacuccgggcugacggaggccgcccugcucgacagcucccuggagggcccccugcccaaggagaccgccgccgggggccucacccugaaggaggagcggagcccccagacccuggcgcccgugggcgaggacgccaugaagacgcccuccccggccgccgaggacgcccgcgagcccgaggcgaaggggaacagcuga

SEQ ID NO: 37336 - RNA, 2118 nt, Artificial Sequence
  derived and/or modified sequence opt1 from SYN1__Homo_sapiens__NP_008881
augaacuaccugcgccggcgccucagcgacuccaacuucauggccaaccugcccaacggcuacaugaccgaccugcagcggccgcagcccccccccccgccccccggggcccacagccccggcgcgaccccggggcccggcacggccaccgccgagcgcuccagcgggguggcccccgccgcgucccccgccgccccgagccccggcuccagcggcgggggcggguucuucuccagccucuccaacgccgucaagcagaccaccgcggccgccgccgccacguucagcgagcaggugggcgggggcuccggcggggcgggccgggggggcgccgccagccgcgugcugcuggucaucgacgagccccacaccgacugggccaaguacuucaagggcaagaagauccacggggagaucgacaucaagguggagcaggccgaguucuccgaccucaaccugguggcgcacgccaacggcggguucagcgucgacauggaggugcugcggaacggcgugaaggucgugcgcucccucaagcccgacuucgugcugauccggcagcacgccuucagcauggcccgcaacggggacuaccggucccuggucaucggccuccaguacgccggcaucccgagcgugaacagccugcacuccguguacaacuucugcgacaagcccugggucuucgcgcagauggugcgccugcacaagaagcucgggaccgaggaguucccccugaucgaccagaccuucuaccccaaccacaaggagaugcugagcuccacgaccuacccgguggucgugaagaugggccacgcccacagcgggaugggcaaggugaaggucgacaaccagcacgacuuccaggacaucgccuccgugguggcccucaccaagaccuacgccacggcggagcccuucaucgacgccaaguacgacguccgggugcagaagaucgggcagaacuacaaggccuacaugcgcaccagcgucuccggcaacuggaagaccaacaccggcagcgccaugcuggagcagaucgcgauguccgaccgguacaagcuguggguggacacgugcagcgagaucuucgggggccucgacaucugcgccguggaggcccugcacgggaaggacggccgcgaccacaucaucgaggucgugggguccagcaugccccugaucggcgaccaccaggacgaggacaagcagcucaucguggagcuggucgugaacaagauggcccaggcccugccccggcagcgccagcgggacgcguccccgggccgcgggagccacggccagacccccucccccggggcccucccccugggccggcagaccagccagcagccggccggcccccccgcccagcagcgcccgcccccccaggggggccccccgcagcccgggcccggcccccagcgccaggggccgccccugcagcagcggccccccccgcagggccagcagcaccucuccggccuggggccccccgccggcagcccccugccgcagcgccuccccucccccaccagcgcgccccagcagccggccagccaggccgccccccccacgcaggggcagggccggcagucccgccccguggccgggggcccgggcgcgccccccgccgcccggccgcccgccagccccuccccccagcgccaggcggggccgccccaggccacccggcagaccagcgucuccggccccgcccccccgaaggccagcggggccccccccggcgggcagcagcgccagggccccccgcagaagccccccggccccgcggggccgacccggcaggccucccaggccggccccgugccccgcacggggcccccgaccacccagcagccccggcccagcggccccgggccggccggccgccccaagccccagcuggcccagaagcccucccaggacgugccgccccccgcgaccgccgccgccggcgggccgccccacccccagcugaacaagagccagucccucacgaacgccuucaaccugcccgagccggcgcccccccggcccagccugucccaggacgaggucaaggccgagaccauccgcagccuccggaaguccuucgccagccuguucuccgacuga

SEQ ID NO: 37337 - RNA, 1437 nt, Artificial Sequence
  derived and/or modified sequence opt1 from SYN2__Homo_sapiens__NP_003169
augaugaacuuccugcgccggcgccucagcgacuccagcuucaucgccaaccugcccaacggcuacaugaccgaccugcagcggcccgagccccagcagccgccgcccccgccgccgcccgggcccggcgccgcguccgccagcgccgccccgcccaccgccucccccgggcccgagcgccggccgccgcccgcgagcgcccccgcgccccagcccgcccccacgcccuccgugggcagcuccuucuucagcucccucagccaggccgucaagcagaccgccgccuccgccgggcugguggacgcccccgcgcccgcccccgccgccgcccgcaaggcgaaggugcugcucgucguggacgagccccacgccgacugggccaagugcuuccggggcaagaaggugcugggcgacuacgacaucaaggucgagcaggccgaguucagcgagcugaaccucguggcccacgcggacgggaccuacgccguggacaugcagguccugcgcaacggcaccaagguggugcgguccuuccgccccgacuucgugcugauccggcagcacgccuucgggauggccgagaacgaggacuuccgccaccucaucaucggcaugcaguacgccgggcugcccagcaucaacucccuggagagcaucuacaacuucugcgacaagcccuggguguucgcgcagcucguggccaucuacaagacgcugggcggcgagaaguucccccugaucgagcagaccuacuaccccaaccacaaggagaugcucacccugcccaccuuccccgucguggugaagaucgggcacgcccacuccggcauggggaaggucaagguggagaaccacuacgacuuccaggacaucgccagcguggucgcgcugacgcagaccuacgccaccgccgagcccuucaucgacagcaaguacgacauccgggugcagaagaucggcaacaacuacaaggccuacaugcgcaccuccaucagcggcaacuggaagacgaacaccggguccgccaugcucgagcagaucgcgaugagcgaccgguacaagcuguggguggacacgugcuccgagauguucggcgggcuggacaucugcgccgucaaggccgugcacggcaaggacgggaaggacuacaucuucgaggucauggacugcagcaugccccucaucggcgagcaccagguggaggaccgccagcugaucaccgagcuggugaucuccaagaugaaccagcuccugagccggaccccggcccugagcccccagcgcccccucaccacccagcagccccaguccggcacccugaaggacccggacuccagcaagacgccgccccagcggcccccgccccaggggugccugcaguacauccucgacugcaacggcaucgccgucgggcccaagcagguccaggcguccuga

SEQ ID NO: 37338 - RNA, 1335 nt, Artificial Sequence
  derived and/or modified sequence opt1 from SYN3__Homo_sapiens__NP_598344
augaacuuccugcgccggcgccucagcgacuccagcuucauggccaaccugcccaacggcuacaugaccgaccugcagcggcccgacuccagcaccuccagccccgccucccccgcgauggagcgccggcacccccagccgcucgccgccagcuucuccagccccggguccagccuguucuccagccuguccagcgccaugaagcaggcgccccaggccacguccggccucauggagcccccggggcccagcacccccaucgugcagcgcccccggauccugcuggucaucgacgacgcccacaccgacugguccaaguacuuccacggcaagaaggugaacggggagaucgagauccgcguggagcaggccgaguucagcgagcucaaccuggccgcguacgucaccggcggcugcaugguggacaugcaggucgugcggaacgggacgaagguggugagccgcuccuucaagccggacuucauccugguccggcagcacgccuacagcauggcccucggcgaggacuaccgcucccuggugaucgggcugcaguacggcgggcuccccgccgugaacagccuguacuccgucuacaacuucugcagcaagcccuggguguucucccagcugaucaagaucuuccacagccucggccccgagaaguucccgcugguggagcagaccuucuuccccaaccacaagcccauggucaccgcgccccacuucccggugguggucaagcugggccacgcccacgccgggaugggcaagaucaagguggagaaccagcucgacuuccaggacaucaccuccguggucgccauggccaagacguacgccaccaccgaggcguucaucgacagcaaguacgacauccggauccagaagaucggguccaacuacaaggccuacaugcgcaccagcaucuccggcaacuggaaggccaacacgggcagcgccaugcuggagcaggucgccaugaccgagcgguaccgccuguggguggacuccugcagcgagauguucgggggccucgacaucugcgcggugaaggccgugcacuccaaggacgggcgggacuacaucaucgaggucauggacagcuccaugccccugaucggcgagcacguggaggaggaccgccagcugauggccgaccucguggucagcaagaugagccagcugcccaugcccgggggcaccgccccgagcccccugcggcccugggcgccccagaucaaguccgccaaguccccgggccaggcccagcucgggccccagcugggccagccccagccgcgcccgccgccccaggccaaccugagccccuga

SEQ ID NO: 37339 - RNA, 1584 nt, Artificial Sequence
  derived and/or modified sequence opt1 from SYNCRIP__Homo_sapiens__NP_001153146
auggccaccgagcacgugaacggcaacgggaccgaggagcccauggacacgaccagcgccgucauccacuccgagaacuuccagacccugcucgacgcgggccugccccagaagguggccgagaagcuggacgagaucuacguggccgggcucgucgcccacagcgaccuggacgagcgcgccaucgaggcgcugaaggaguucaacgaggacggcgcccucgccgugcugcagcaguucaaggacuccgaccugagccacgugcagaacaaguccgccuuccucugcggggucaugaagaccuaccggcagcgcgagaagcagggcacgaagguggcggacagcuccaagggccccgacgaggccaagaucaaggcccugcuggagcggaccggguacacccucgacgugaccacgggccagcgcaaguacgggggcccgccgcccgacagcgucuacuccgggcagcagcccagcgugggcaccgagaucuucgugggcaagaucccccgggaccuguucgaggacgagcuggucccccucuucgagaaggccgggcccaucugggaccugcgccugaugauggacccccucaccggccugaaccggggguacgccuucgugaccuucugcacgaaggaggcggcccaggaggccgugaagcuguacaacaaccacgagauccgcuccggcaagcacaucggcgucugcaucagcguggccaacaaccgccucuucgugggguccauccccaagagcaagaccaaggagcagauccuggaggaguucuccaaggucaccgagggccugaccgacgugauccucuaccaccagcccgacgacaagaagaagaaccggggguucugcuuccuggaguacgaggaccacaagacggccgcccaggugaagguccuguucgugcggaaccucgccaacaccgugaccgaggagauccuggagaaggccuucagccaguucggcaagcuggagcgcgucaagaagcucaaggacuacgccuucauccacuucgacgagcgggacggggccgugaaggcgauggaggagaugaacggcaaggaccuggagggcgagaacaucgagaucgucuucgccaagccgcccgaccagaagcgcaaggagcggaaggcccagcgccaggccgccaagaaccagauguacgacgacuacuacuacuacgggccgccccacaugcccccgcccacccggggccgcgggcggggcgggcgcggcggcuacggguacccgcccgacuacuacggcuacgaggacuacuacgacuacuacggguacgacuaccacaacuaccggggcggguacgaggaccccuacuacggcuacgaggacuuccaggugggcgcgcgcgggcgcggcgggcggggcgcccgcggcgccgcccccucccgggggcgcggcgcggcgccgccccgggggcgcgccggcuacagccagcggggcgggcccggcuccgcccgcggggugcggggcgcccgcgggggcgcgcagcagcagcgggggcgcggccagggcaagggggucgaggccggccccgaccugcuccaguga

SEQ ID NO: 37340 - RNA, 777 nt, Artificial Sequence
  derived and/or modified sequence opt1 from SYNDIG1__Homo_sapiens__NP_079169
auggacggcaucaucgagcagaaguccaugcuggugcacagcaagaucagcgacgccgggaagcgcaacggccucaucaacacccggaaccugauggccgagucccgcgacgggcuggucagcguguaccccgcgccgcaguaccagucccaccgggugggcgccagcaccguccccgccucccucgacagcucccgcagcgagcccaugcagcagcugcuggaccccaacacgcuccagcaguccguggagagccgguaccgcccgaacaucauccuguacuccgagggggugcugcggagcuggggcgacggcgucgccgccgacugcugcgagaccaccuucaucgaggaccgcucccccaccaaggacagccucgaguaccccgacgggaaguucaucgaccuguccgcggacgacaucaagauccacacgcugagcuacgacguggaggaggaggaggaguuccaggagcucgaguccgacuacagcagcgacaccgaguccgaggacaacuuccugaugaugcccccgcgggaccaccugggccucagcguguucuccaugcugugcugcuucuggccccuggggaucgccgccuucuaccucagccacgagaccaacaaggccgucgcgaagggcgaccugcaccaggccuccaccagcucccgccgggcccuguuccucgccgugcugagcaucacgaucgggaccggcguguacgucggcguggccguggcgcugaucgccuaccucuccaagaacaaccaccuguga

SEQ ID NO: 37341 - RNA, 26250 nt, Artificial Sequence
  derived and/or modified sequence opt1 from SYNE1__Homo_sapiens__NP_149062
auggccaccagccggggcgccagccggugcccccgggacaucgcgaacgugaugcagcggcugcaggacgagcaggagaucgugcagaagcggaccuucacgaaguggaucaacagccaccuggccaagcggaagccgcccauggugguggacgaccuguucgaggacaugaaggacggggugaagcugcuggcccugcuggaggugcugagcggccagaagcugcccugcgagcaggggcgccggaugaagcgcauccacgccguggccaacaucggcaccgcgcugaaguuccuggaggggcggaaguccaugcaccgcggcagccccaucaagcuggugaacaucaacagcaccgacaucgccgacggccggccgagcaucgugcuggggcugauguggaccaucauccuguacuuccagaucgaggagcugaccagcaaccugccccagcugcagucccugagcuccagcgccuccagcguggacuccaucgugagcuccgagacccccuccccgcccuccaagcgcaaggugaccaccaagauccagggcaacgccaagaaggcgcugcugaagugggugcaguacacggccgggaagcagaccggcaucgaggucaaggacuucggcaaguccuggcggagcggcguggccuuccacuccgugauccacgccauccgccccgagcuggucgaccuggagaccgugaagggccggagcaaccgcgagaaccuggaggacgccuucaccaucgcggagacggagcuggggaucccccggcugcuggaccccgaggacguggacgucgacaagcccgacgagaaguccaucaugaccuacguggcccaguuccugaagcacuaccccgacauccacaacgccagcaccgacggccaggaggacgacgagauccuccccggguuccccuccuucgccaacagcgugcagaacuucaagcgcgaggaccgggucaucuucaaggagaugaagguguggaucgagcaguucgagcgcgaccugacccgggcccagaugguggaguccaaccugcaggacaaguaccagagcuucaagcacuuccgcguccaguacgagaugaagcgcaagcagaucgagcaccugauccagccgcugcaccgggacggcaagcugucccucgaccaggcgcuggugaagcagagcugggaccgcgucacgucccggcuguucgacuggcacauccagcucgacaagagccugcccgcgccccucggcaccaucggggccuggcucuaccgcgccgagguggcccugcgggaggagaucaccgugcagcagguccacgaggagaccgcgaacacgauccagcgcaagcuggagcagcacaaggaccuccugcagaacaccgacgcccacaagcgggccuuccacgagaucuaccgcacccgguccgugaacggcauccccgugccgcccgaccagcuggaggacauggccgagcgcuuccacuucgucagcuccaccagcgagcuccaccugaugaagauggaguuccuggagcucaaguaccggcugcugucccugcucgugcuggccgagagcaagcugaaguccuggaucaucaaguacgggcgccgggagagcguggagcagcuccugcagaacuacgucagcuucaucgagaacuccaaguucuucgagcaguacgaggugacguaccagauccugaagcagaccgcggagauguacgugaaggccgacggcagcgucgaggaggccgagaacgugaugaaguucaugaacgagaccaccgcccaguggcgcaaccucuccguggagguccggagcgugcgcuccaugcuggaggaggugaucagcaacugggaccgguacgggaacacggucgcgucccugcaggccuggcucgaggacgccgagaagaugcugaaccagagcgagaacgccaagaaggacuucuuccgcaaccugccccacuggauccagcagcacaccgccaugaacgacgcgggcaacuuccucaucgagaccugcgacgagauggugucccgggaccugaagcagcagcugcuccugcugaacggccgcuggcgcgagcuguucauggaggugaagcaguacgcccaggccgacgagauggaccggaugaagaaggaguacaccgacugcgucgugacgcugagcgccuucgccaccgaggcgcacaagaagcuguccgagccccucgaggugagcuucaugaacgucaagcugcugauccaggaccucgaggacaucgagcagcgcgugccggugauggacgcccaguacaagaucaucaccaagaccgcccaccugaucacgaaggagagcccccaggaggaggggaaggagauguucgccaccaugagcaagcugaaggagcagcucaccaaggucaaggagugcuacagcccccuccuguacgagagccagcagcuccugaucccccuggaggagcucgagaagcagaugaccuccuucuacgacagccugggcaagaucaacgagaucaucaccgugcuggagcgggaggcccagagcuccgcccuguucaagcagaagcaccaggagcugcuggccugccaggagaacugcaagaagacgcucacccugaucgagaaggggagccaguccgugcagaaguucgucacccugagcaacgugcucaagcacuucgaccagacccgccugcagcggcagaucgccgacauccacguggccuuccaguccauggucaagaagacgggcgacuggaagaagcacguggagaccaacagccgccugaugaagaaguucgaggagucccgggcggagcucgagaaggugcugcgcaucgcccaggaggggcuggaggagaagggcgacccggaggagcuccugcggcgccacaccgaguucuucagccagcuggaccagcggguccucaacgccuuccugaaggccugcgacgagcugaccgacauccuccccgagcaggagcagcagggccugcaggaggccgugcgcaagcugcacaagcaguggaaggaccuccagggggaggcgcccuaccaccuccugcaccucaagaucgacguggagaagaaccgguuccuggccuccgucgaggagugccgcacggagcuggaccgggagaccaagcucaugccgcaggagggcagcgagaagaucaucaaggagcaccgcguguucuucuccgacaaggggccccaccaccugugcgagaagcggcugcagcucaucgaggagcugugcgugaagcugcccguccgcgaccccgugcgggacaccccggggaccugccacgugacgcucaaggagcugcgcgccgccaucgacagcaccuaccggaagcugauggaggaccccgacaaguggaaggacuacaccucccgcuucagcgaguucuccagcuggaucuccaccaacgagacgcagcucaaggggaucaagggcgaggccaucgacaccgcgaaccacggcgaggucaagcgcgccguggaggagauccggaacggggugaccaagcgcggcgagacccugagcuggcugaagucccggcucaagguccugacggaggugagcagcgagaacgaggcccagaagcagggggacgagcuggccaagcucuccagcuccuucaaggcccuggugacccugcucagcgaggucgagaagaugcuguccaacuucggcgacugcgugcaguacaaggagaucgucaagaacagccuggaggagcucaucuccggcagcaaggaggugcaggagcaggcggagaagauccuggacaccgagaaccuguucgaggcccagcagcuccugcugcaccaccagcagaagaccaagcgcaucuccgccaagaagcgggacgugcagcagcagaucgcccaggcgcagcagggggagggcgggcuccccgaccgcggccacgaggagcugcggaagcuggagagcacgcucgacgggcuggagcgcucccgggagcgccaggagcggcgcauccaggucacccugcggaagugggagcgcuucgagaccaacaaggagaccguggugcgguaccuguuccagacgggcagcucccacgagcgcuuccucagcuucuccagccuggagucccugagcuccgagcucgagcagaccaaggaguucagcaagcggaccgagagcaucgccguccaggccgagaaccuggugaaggaggccuccgagaucccccugggcccgcagaacaagcagcuccugcagcagcaggccaagagcaucaaggagcaggucaagaagcuggaggacacccucgaggaggacaucaagacgauggagauggucaagaccaagugggaccacuucggguccaacuucgagacccugagcguguggaucaccgagaaggagaaggagcugaacgcgcucgagacguccagcuccgccauggacaugcagaucagccagaucaaggugaccauccaggagaucgaguccaagcugagcuccaucgucggccuggaggaggaggcccagagcuucgcccaguucgugaccaccggggaguccgcccgcaucaaggcgaagcucacccagauccggcgcuacggcgaggagcugcgcgagcacgcccagugccuggaggggacgauccucggccaccugagccagcagcagaaguucgaggagaaccugcggaagauccagcaguccgugagcgaguucgaggacaagcucgccguccccaucaagaucugcuccagcgccaccgagaccuacaaggugcugcaggagcacauggaccugugccaggcccucgagucccugagcagcgcgaucaccgccuucuccgccagcgcccgcaagguggucaaccgggacuccugcgugcaggaggccgcggcccugcagcagcaguacgaggacauccuccgccgggccaaggagcgccagacggcccuggagaaccugcucgcgcacuggcagcggcuggagaaggagcugagcuccuuccucaccuggcuggagcgcggcgaggccaaggccagcucccccgagauggacaucagcgccgaccgggugaaggucgagggggagcugcagcucauccaggcccugcagaacgagguggugucccaggcgagcuucuacuccaagcugcuccagcugaaggagagccuguucuccgucgccagcaaggacgacgugaagaugaugaagcuccaccuggagcagcuggacgagcgcuggcgggaccucccccagaucaucaacaagcgcaucaacuuccugcaguccguggucgccgagcaccagcaguucgacgagcugcuccugagcuucuccguguggaucaagcuguuccucagcgagcugcagaccaccuccgagaucagcaucauggaccaccagguggcccugacgcggcacaaggaccacgccgcggaggucgagagcaagaagggcgagcuccagucccugcaggggcaccuggccaagcucggcagccuggggcgcgccgaggaccugcaccuccugcagggcaaggccgaggacugcuuccagcuguucgaggaggccucccaggugguggagcggcgccagcucgcgcugagccaccuggccgaguuccuccagucccacgccagccuguccggcauccugcggcagcuccgccagaccgucgaggccaccaacagcaugaacaagaacgaguccgaccugaucgagaaggaccugaacgacgcgcuccagaacgccaaggcccuggagagcgccgccgugucccuggacgggauccucagcaaggcgcaguaccaccugaagaucggcuccagcgagcagcggaccuccugccgcgccacggccgaccagcugugcggggagguggagcggauccagaaccuccugggcaccaagcagagcgaggccgacgcccuggcgguccucaagaaggccuuccaggaccagaaggaggagcugcugaaguccaucgaggacaucgaggagcgcaccgacaaggagcgccucaaggagccgacccggcaggcccugcagcagcgccugcggguguucaaccagcucgaggacgagcugaacagccacgagcacgagcugugcuggcucaaggacaaggccaagcagaucgcccagaaggacguggcguucgcccccgaggucgaccgcgagaucaaccggcuggaggugacgugggacgacaccaagcgccugauccacgagaaccaggggcagugcugcggccucaucgaccugaugcgggaguaccagaaccugaaguccgccgugagcaagguccucgagaacgccagcuccgugaucgugacccgcaccacgaucaaggaccaggaggaccugaagugggcguucagcaagcacgagaccgccaagaacaagaugaacuacaagcagaaggaccuggacaacuucaccuccaagggcaagcaccuccugagcgagcugaagaagauccacuccagcgacuucucccuggucaagaccgacauggagagcacgguggacaaguggcucgacguguccgagaagcuggaggagaacauggaccggcugcgcgucagccucuccaucugggacgacgugcugagcacccgggacgagaucgaggggugguccaacaacugcgugccccagauggccgagaacaucagcaaccuggacaaccaccuccgcgccgaggagcugcugaaggaguucgaguccgaggucaagaacaaggcccuccggcuggaggagcugcacagcaaggugaacgaccucaaggagcugaccaagaaccuggagacgccgcccgaccuccaguucaucgaggcggaccugaugcagaagcuggagcacgccaaggagaucacggaggucgccaagggcacccucaaggacuucaccgcccaguccacccagguggagaaguucaucaacgacaucacgaccugguucaccaagguggaggagagccugaugaacugcgcccagaacgagaccugcgaggcgcugaagaaggucaaggacauccagaaggagcuccagagccagcaguccaacaucagcuccacgcaggagaaccugaacagccugugccgcaaguaccacuccgccgagcucgagagccuggggcgggccaugaccggccugaucaagaagcacgaggccgugucccagcucugcagcaagacccaggccucccugcaggagagccuggagaagcacuucuccgagagcaugcaggaguuccaggagugguuccucggcgcgaaggccgccgccaaggaguccagcgaccgcaccggggacuccaaggugcuggaggccaagcugcacgaccuccagaacauccuggacagcgucuccgacggccagagcaagcuggacgcggugacccaggaggggcagacgcucuacgcccaccuguccaagcagaucgugagcagcauccaggagcagaucaccaaggccaacgaggaguuccaggccuuccugaagcagugccucaaggacaagcaggcgcugcaggacugcgccuccgagcugggcagcuucgaggaccagcaccggaagcucaaccuguggauccacgagauggaggagcgcuucaacaccgagaaccugggggaguccaagcagcacauccccgagaagaagaacgagguccacaagguggagauguuccucggcgagcugcuggccgcccgggagagccucgacaagcugucccagcgcggccagcugcucagcgaggaggggcacggcgccgggcaggagggccgccugugcucccagcugcucaccagccaccagaaccugcugcggaugacgaaggagaagcuccgcuccugccagguggcgcugcaggagcacgaggcccuggaggaggcccuccagagcaugugguucugggucaaggccauccaggaccggcuggccugcgcggaguccacccuggggagcaaggacacccucgagaagcgccugucccagauccaggacauccugcucaugaagggcgagggcgaggugaagcugaacauggccaucgggaagggcgagcaggcccugcggagcuccaacaaggaggggcagcgcgugauccagacccagcucgagacgcugaaggaggucugggccgacaucaugagcuccagcgugcacgcccaguccacccuggagagcgugaucagccaguggaacgacuacgucgagcggaagaaccagcucgagcaguggauggaguccguggaccagaagaucgagcacccccugcagccccagcccggccugaaggagaaguucgugcuccuggaccaccuccagagcauccucuccgaggcggaggaccacacccgcgcccugcaccggcugaucgccaagagccgcgagcucuacgagaagaccgaggacgaguccuucaaggacacggcccaggaggagcugaagacccaguucaacgacaucaugaccgucgcgaaggagaagaugcggaagguggaggagaucgugaaggaccaccugauguaccucgacgccguccacgaguucaccgacuggcugcacagcgccaaggaggagcugcaccgcugguccgacaugagcggggacuccagcgccacgcagaagaagcucuccaagaucaaggagcugaucgacagccgggagaucggcgccucccgccugagccggguggagucccucgcgcccgaggugaagcagaacaccaccgccagcggcugcgagcugaugcacaccgagaugcaggcccugcgcgccgacuggaagcagugggaggacuccgucuuccagacgcagagcugccucgagaaccuggugucccagauggcccugagcgagcaggaguucagcggccagguggcgcagcucgagcaggcccuggagcaguucuccgcccugcugaagaccugggcccagcagcucacccugcuggagggcaagaacaccgacgaggagaucgucgagugcuggcacaaggggcaggagauccucgacgcccugcagaaggcggagccccggacggaggaccucaagagccagcucaacgagcugugccgcuucucccgggaccugagcaccuacuccggcaaggugagcggccucaucaaggaguacaacugccugugccugcaggccuccaaggggugccagaacaaggagcagauccuccagcagcgcuuccggaaggccuuccgcgacuuccagcaguggcuggugaacgccaagaucaccaccgcgaagugcuucgacaucccccagaacaucagcgaggucuccacgagccugcagaagauccaggaguuccucuccgagagcgagaacggccagcacaagcugaacaugaugcuguccaagggggagcuccugagcacccugcucaccaaggagaaggccaagggcauccaggccaaggugaccgccgccaaggaggacuggaagaacuuccacuccaaccugcaccagaaggagagcgcgcuggagaaccucaagauccagaugaaggacuucgagguguccgccgagccgauccaggacuggcugagcaagacggagaagaugguccacgaguccagcaaccgccuguacgaccuccccgccaagcggcgcgagcagcagaagcugcagagcgugcuggaggagauccacugcuacgagccccagcucaaccggcugaaggagaaggcccagcagcugugggaggggcaggccgcguccaagagcuuccgccaccgggugucccagcucagcucccaguaccuggcccugagcaaccucaccaaggagaaggucucccgccuggaccggaucguggccgagcacaaccaguucagccugggcaucaaggagcuccaggacuggaugaccgacgccauccacaugcuggacuccuacugccacccgaccagcgacaaguccgugcuggacagccgcacgcucaagcuggaggcccugcucuccgucaagcaggagaaggagauccagaugaagaugaucgugacccggggcgagagcgugcugcagaacaccucccccgaggggauccccaccauccagcagcagcugcagagcgucaaggacaugugggcgucccuccugagcgccggcauccgcugcaagucccagcuggagggggcccucagcaaguggacgagcuaccaggacggcgugcggcaguucuccggguggauggacagcauggaggccaaccugaacgaguccgagcgccagcacgccgagcugcgggacaagaccaccaugcucggcaaggcgaagcugcugaacgaggaggugcucagcuacuccagccugcuggagaccaucgaggucaagggcgccgggaugaccgagcacuacgugacgcagcucgagcugcaggaccugcaggagcgcuaccgggccauccaggagcgcgccaaggaggcggugaccaaguccgagaagcucguccggcugcaccaggaguaccagcgcgaccugaaggccuucgagguguggcucggccaggagcaggagaagcuggaccaguacagcguccuggagggggacgcccacacccacgagaccacgcuccgggaccugcaggagcuccaggugcacugcgccgagggccaggcccuccugaacuccgugcugcacacccgcgaggacgucauccccagcgggaucccgcaggcggaggaccgcgcccucgagucccugcggcaggacuggcaggccuaccagcaccgccugagcgagacccggacccaguucaacaacguggugaacaagcuccgccugauggagcagaaguuccagcaggucgacgaguggcugaagacggccgaggagaagaaguggcacgaggaggugaccgccuaccgggacgagguggaggaggucggcgcgcgcgcccaggagauccucgacgagucccacgugaacagccggaugggcugccaggccacccagcugaccucccgcuaccaggcccugcuccuccaggugcuggagcagaucaaguuccucgaggaggagauccagagccuggaggaguccgagagcagccuguccagcuacuccgacugguacgggagcacgcacaagaacuucaagaacgucgccaccaagaucgacaagguggacaccgugaugaugggcaagaagcucaagacccuggagguccugcucaaggacauggagaaggggcacucccugcucaagagcgcgcgggagaagggcgagcgcgccgugaaguaccuggaggagggggaggccgagcggcuccgcaaggagauccacgaccacauggagcagcugaaggagcugacguccaccgugcggaaggagcacaugacccucgagaagggccugcaccuggccaaggaguucagcgacaagugcaaggcgcucacccaguggaucgccgaguaccaggagauccugcacguccccgaggagcccaagauggagcuguacgagaagaaggcccagcucuccaaguacaagagccugcagcagacggugcugucccacgagcccagcgugaaguccguccgcgagaagggcgaggcccuccuggagcuggugcaggacgugacccucaaggacaagaucgaccagcugcagagcgacuaccaggaccugugcuccaucgggaaggccaugauggaggagaucgcgggcuucgaggaccggcucaacaaccugcagaugaagggggacacccugaucggccagugcgccgaccaccuccaggccaagcugaagcagaacguccacgcccaccuccagggcaccaaggacagcuacuccgccaucugcagcacggcgcagcgcauguaccagucccucgagcacgagcugcagaagcacgugagccggcaggacacccugcagcagugccaggccuggcucagcgccgugcagccggaccuggagcccagcccccagcccccgcugagccgcgccgaggccaucaagcaggucaagcacuuccgggcgcuccaggagcaggcccgcaccuaccuggaccugcucugcuccaugugcgaccugagcaacgccuccgugaagaccacggccaaggacauccagcagaccgagcagaccaucgagcagaagcuggugcaggcccagaaccucacccaggggugggaggagaucaagcaccucaagagcgagcuguggaucuaccuccaggacgcggaccagcagcugcagaacaugaagcggcgccacuccgagcuggagcucaacaucgcccagaacauggucagccaggugaaggacuucgugaagaagcugcaguccaagcaggccagcgucaacacgaucaucgagaaggugaacaagcugaccaagaaggaggagucccccgagcacaaggagaucaaccaccucaacgaccaguggcuggaccugugccgccagagcaacaaccucugccugcagcgggaggaggaccugcagcgcacccgggacuaccacgacugcaugaacguggucgagguguuccucgagaaguucaccacggagugggacaaccuggcccgcuccgacgcggagagcaccgccgugcaccuggaggcccucaagaagcuggcccuggcccuccaggagcggaaguacgcgaucgaggaccugaaggaccagaagcagaagaugaucgagcaccugaaccucgacgacaaggagcuggucaaggagcagaccucccaccuggagcagcgcugguuccagcucgaggaccugaucaagcggaagauccaggugagcgugaccaaccuggaggagcucaacgucgugcagucccgcuuccaggagcugauggagugggccgaggagcagcagcccaacaucgccgaggcccugaagcaguccccgccgcccgacauggcccagaaccuccugauggaccaccuggcgaucugcuccgagcucgaggccaagcagaugcugcucaagagccucaucaaggacgccgaccgggugauggccgaccugggccugaacgagcgccaggucauccagaaggcccucagcgacgcgcagucccacgugaacugccugagcgaccugguggggcagcggcgcaaguaccucaacaaggcccuguccgagaagacccaguuccugauggccgucuuccaggccacgagccagauccagcagcacgagcggaagaucauguuccgcgagcacaucugccuccugcccgacgacguguccaagcaggucaagaccugcaagagcgcgcaggccucccugaagaccuaccagaacgaggucaccggccucugggcccaggggcgggagcugaugaaggaggugacggagcaggagaaguccgagguccugggcaagcuccaggagcugcaguccguguacgacagcgugcugcagaagugcucccaccgccuccaggagcuggagaagaaccuggucagccggaagcacuucaaggaggacuucgacaaggccugccacuggcucaagcaggccgacaucgugaccuuccccgagaucaaccugaugaacgaguccagcgagcugcacacccagcuggcgaaguaccagaacauccucgagcagucccccgaguacgagaaccugcugcucacccugcagcgcacgggccagaccauccugcccagccucaacgagguggaccacuccuaccugagcgagaagcugaacgcccucccccggcaguucaacgucaucguggcccuggccaaggacaaguucuacaaggugcaggaggccauccuggcgcgcaaggaguacgccucccucaucgagcugaccacccagagccugagcgagcucgaggcccaguuccugcgcauguccaagguccccacggaccuggccguggaggaggcccucagccugcaggacgggugccgggcgauccuggacgagguggccggccucggggaggccgucgacgagcugaaccagaagaaggagggcuuccgcuccaccgggcagcccuggcagcccgacaagaugcugcaccucgugacccuguaccaccggcugaagcgccagaccgagcagcgggugagccuccuggaggacacgaccuccgccuaccaggagcacgagaagaugugccagcagcuggagcgccagcucaagagcgucaaggaggagcaguccaaggugaacgaggagacccugcccgcggaggagaagcugaagauguaccacagccucgccggcucccugcaggacagcggcaucgugcugaagcgggucaccauccaccucgaggaccuggcgccccaccuggacccgcucgccuacgagaaggcccgccaccagauccaguccuggcagggggagcugaagcugcucacgagcgcgaucggcgagaccgugaccgagugcgagucccggauggugcagagcaucgacuuccagaccgagaugucccgcagccuggacuggcugcggcgcgucaaggccgagcucuccgggcccguguaccuggaccugaaccuccaggacauccaggaggagauccggaagauccagauccaccaggaggaggugcagagcucccugcgcaucaugaacgcccugagccacaaggagaaggagaaguucacgaaggccaaggagcucaucagcgccgaccuggagcacucccuggcggagcucagcgagcuggacggcgacauccaggaggcccugcggacccgccaggccacccucaccgagaucuacucccagugccagcgguacuaccaggucuuccaggccgccaacgacuggcuggaggacgcgcaggagcugcuccagcuggccgggaacggccuggacguggagagcgccgaggagaaccucaagucccacauggaguucuucagcacggaggaccaguuccacuccaaccuggaggagcugcacagccucguggccacccuggacccccugaucaagccgaccggcaaggaggaccucgagcagaaggucgccucccuggagcugcgcagccagcggaugucccgcgacagcggggcccagguggaccuccugcagcggugcaccgcccaguggcacgacuaccagaaggcccgcgaggaggugaucgagcugaugaacgacacggagaagaagcucuccgaguucagccugcugaagaccuccagcucccacgaggccgaggagaagcucagcgagcacaaggcgcuggucuccguggugaacagcuuccacgagaagaucgucgcccuggaggagaaggccagccagcucgagaagaccggcaacgacgccuccaaggccacccugagccgcuccaugacgaccguguggcagcgguggacccgccugcgggcgguggcccaggaccaggagaagauccucgaggacgccgucgacgaguggaccggguucaacaacaaggugaagaaggccaccgagaugaucgaccagcugcaggacaagcugcccggcagcuccgccgagaaggcgagcaaggccgagcuccugacgcugcucgaguaccacgacaccuucgugcuggagcuggagcagcagcaguccgcccucgggaugcugcgccagcagacccugagcaugcuccaggacggcgccgcccccacccccggcgaggagccgccccugaugcaggagaucacggcgaugcaggaccggugccugaacaugcaggagaaggucaagaccaacgggaagcuggugaagcaggagcucaaggaccgcgagaugguggagacccagaucaacuccgucaagugcugggugcaggagaccaaggaguaccugggcaaccccacgaucgagaucgacgcccagcuggaggagcuccagauccugcugaccgaggccaccaaccaccggcagaacaucgagaagauggccgaggagcagaaggagaaguaccucgggcuguacaccauccugcccagcgagcucucccugcagcuggcggagguggcccucgaccugaagauccgcgaccagauccaggacaagaucaaggaggucgagcagagcaaggccacgucccaggagcugagccggcagauccagaagcucgccaaggaccugaccaccauccugaccaagcucaaggccaagacggacaacguggugcaggcgaagaccgaccagaagguccugggcgaggagcuggacggcugcaacuccaagcucauggagcuggacgccgccgugcagaaguuccuggagcagaacgggcagcucggcaagccgcuggccaagaagaucgggaagcugaccgagcuccaccagcagaccauccgccaggccgagaaccggcugagcaagcugaaccaggcggccucccaccucgaggaguacaacgagaugcuggagcugauccucaaguggaucgagaaggccaaggugcuggcccacggcacgaucgccuggaacagcgcgagccagcugcgcgagcaguacauccuccaccagacccugcuggaggaguccaaggagaucgacagcgagcucgaggccaugaccgagaagcugcaguaccugaccuccgucuacugcacggagaagaugagccagcaggucgccgagcucgggcgggagaccgaggagcugcgccagaugaucaagauccggcugcagaaccuccaggacgccgcgaaggacaugaagaaguucgaggccgagcugaagaagcugcaggccgcccucgagcaggcccaggcgacccugaccucccccgaggucggccgccugagccucaaggagcagcugucccaccggcagcaccuccugagcgagauggagucccugaagcccaaggugcaggccgugcagcugugccagagcgcccugcgcauccccgaggacgucguggccucccugccgcugugccacgccgcgcuccggcugcaggaggaggccagccgccugcagcacacggccauccagcagugcaacaucaugcaggccgccgugguccaguacgagcaguacgagcaggagaugaagcaccuccagcagcugaucgagggcgcgcaccgcgagaucgaggacaagcccguggccaccuccaacauccaggagcugcaggcccagaucagccggcacgaggagcucgcccagaagaucaagggguaccaggagcagaucgccucccugaacagcaagugcaagaugcugaccaugaaggcgaagcacgccaccaugcuccugacggugaccgaggucgagggccuggccgaggggaccgaggaccucgacggcgagcugcugcccacccccuccgcccacccgagcguggugaugaugacggcggggcgcugccacacccuccugucccccgucaccgaggagagcggcgaggagggcaccaacagcgagaucuccuccccgcccgccugccgguccccgagccccguggccaacaccgacgccuccgugaaccaggacaucgccuacuaccaggcgcugagcgccgagcgccuccagacggacgccgccaagauccaccccuccaccagcgccucccaggaguucuacgagcccgggcuggagccgagcgcgaccgccaagcugggcgaccuccagcgguccugggagacccugaagaacgucaucagcgagaagcagcgcacgcuguacgaggcccucgagcggcagcagaaguaccaggacucccugcagagcaucuccaccaagauggaggccaucgagcugaagcucagcgagucccccgagcccgggcgcagccccgagucccagauggccgagcaccaggcgcugauggacgagauccugaugcuccaggacgagaucaacgagcugcagagcagccuggccgaggagcucguguccgagagcugcgaggccgacccggccgagcagcuggcgcugcaguccacccucaccgugcuggccgagcggaugagcacgauccgcaugaaggccuccggcaagcggcagcugcucgaggagaagcugaacgaccagcuggaggagcagcgccaggagcaggcccugcagcgguaccgcugcgaggccgacgagcucgacagcuggcugcuguccaccaaggcgacccucgacaccgcccuguccccgcccaaggagccgauggacauggaggcccagcugauggacugccagaacaugcucgucgagaucgagcagaaggugguggcccuguccgagcugagcguccacaacgagaaccuccugcuggaggggaaggcccacacgaaggacgaggcggagcagcucgccggcaagcugcggcgccugaagggcucccuccuggagcugcagcgggcccuccacgacaagcagcugaacaugcaggggaccgcccaggagaaggaggagagcgacguggaccugaccgccacccagucccccggcgugcaggaguggcucgcgcaggcccgcacgaccuggacccagcagcggcagagcucccugcagcagcagaaggagcuggagcaggagcucgccgagcagaagucccugcugcgcuccgucgccagccgcggggaggagauccucauccagcacuccgccgcggagaccagcggcgacgccggcgagaagcccgacgugcugagccaggagcuggggauggagggcgagaaguccagcgccgaggaccagaugcgcaugaagugggagucccuccaccaggaguucagcacgaagcagaagcugcugcagaacgugcucgagcaggagcaggagcagguccuguacucccgccccaaccggcugcucagcggggugccgcuguacaagggcgacgugcccacccaggacaaguccgccgucaccagccugcucgacgggcugaaccaggcguucgaggagguguccagccaguccggcggcgccaagcgccagagcauccaccuggagcagaagcucuacgacgggguguccgccaccagcacguggcuggacgacgucgaggagcggcuguucguggccaccgcccuccugcccgaggagaccgagaccugccuguucaaccaggagauccucgcgaaggacaucaaggagauguccgaggagauggacaagaacaagaaccuguucagccaggccuuccccgagaacggcgacaaccgcgacgugaucgaggacacgcuggggugccuccugggccggcugucccuccuggacagcgucgugaaccagcgcugccaccagaugaaggagcggcugcagcagauccucaacuuccagaacgaccugaaggugcuguucaccucccucgccgacaacaaguacaucauccugcagaagcuggccaacgucuucgagcagccgguggccgagcagaucgaggcgauccagcaggccgaggacgggcucaaggaguucgacgccggcaucaucgagcugaagcgccggggcgacaagcuccagguggagcagcccagcaugcaggagcucagcaagcugcaggacauguacgacgagcugaugaugaucaucgggucccgccggagcggccucaaccagaaccugacccugaagucccaguacgagcgcgcccuccaggaccuggccgaccugcucgagaccgggcaggagaagauggcgggcgaccagaagaucaucgucagcuccaaggaggagauccagcagcugcuggacaagcacaaggaguacuuccaggggcucgagagccacaugauccugacggagacccuguuccggaagaucaucuccuucgccgugcagaaggagacccaguuccacaccgagcucauggcccaggccagcgcggugcugaagcgcgcccacaagcggggcgucgagcuggaguacauccucgagacguggucccaccuggacgaggaccagcaggagcugagccgccagcucgaggugguggaguccagcauccccuccgucggccugguggaggagaacgaggaccggcugaucgaccgcaucacccucuaccagcaccucaagagcucccugaacgaguaccagcccaagcucuaccaggugcuggacgacgggaagcggcugcucaucagcaucuccugcagcgaccuggagucccagcugaaccagcugggcgagugcuggcucagcaacaccaacaagaugagcaaggagcugcaccgccuggagaccauccucaagcacuggacccgcuaccaguccgagagcgccgaccugauccacuggcugcaguccgccaaggaccggcucgaguucuggacgcagcagagcgucaccgugccgcaggagcuggagaugguccgcgaccaccugaacgccuuccucgaguucuccaaggagguggacgcgcagagcucccucaagagcuccgugcugagcaccgggaaccagcuccugcggcugaagaaggucgacaccgccacgcuccgcuccgagcugagccggaucgacucccaguggaccgaccugcucaccaacauccccgccgugcaggagaagcugcaccagcugcagauggacaagcuccccagccgccacgccaucuccgaggugaugagcuggaucucccugauggagaacgucauccagaaggacgaggacaacaucaagaacagcaucggcuacaaggccauccacgaguaccugcagaaguacaagggguucaagaucgacaucaacugcaagcagcucaccguggacuucgugaaccagagcguccugcagaucuccagccaggacguggaguccaagcggagcgacaagacggacuucgcggagcagcugggcgccaugaacaaguccuggcagauccuccagggccuggugaccgagaagauccagcugcucgaggggcugcuggagagcugguccgaguacgagaacaacguccagugccucaagaccugguucgagacccaggagaagcgccugaagcagcagcaccggaucggcgaccaggccagcgugcagaacgcccugaaggacugccaggaccucgaggaccugaucaaggccaaggagaaggagguggagaagaucgagcagaacgggcuggcgcucauccagaacaagaaggaggacgucuccagcaucgugauguccacgcugcgcgagcugggccagaccugggccaaccucgaccacauggugggccagcugaagauccugcucaagagcguccuggaccagugguccagccacaagguggccuucgacaagaucaacuccuaccugauggaggcccgguacagccucucccgcuuccggcugcugaccgggagccucgaggcggugcagguccagguggacaaccugcagaaccugcaggacgaccucgagaagcaggagcgcucccugcagaaguucggcagcaucaccaaccagcugcucaaggagugccacccgcccgugacggagacccugaccaacacccugaaggaggucaacaugcgguggaacaaccuccuggaggagaucgccgagcagcugcagagcuccaaggcccuccugcagcuguggcagcgcuacaaggacuacagcaagcagugcgccuccacggugcagcagcaggaggaccggaccaacgagcuccugaaggccgcgaccaacaaggacaucgccgacgacgagguggccaccuggauccaggacugcaacgaccugcucaaggggcugggcacggucaaggacagccuguucuuccuccacgagcugggggagcagcugaagcagcaggucgacgccuccgccgcgagcgccauccaguccgaccagcucagccugucccagcaccugugcgcccucgagcaggcccugugcaagcagcagaccagccugcaggccggcgugcucgacuacgagaccuucgcgaagucccuggaggcccuggaggccuggaucgucgaggccgaggagauccuccagggccaggaccccagccacuccagcgaccuguccaccauccaggagcgcauggaggagcugaaggggcagaugcucaaguucagcuccauggcccccgaccuggaccggcugaacgagcucggcuaccgccugccccugaacgacaaggagaucaagcggaugcagaaccucaaccgccacuggagccugaucuccagccagacgaccgagcgcuucagcaagcugcaguccuuccuccugcagcaccagaccuuccuggagaagugcgagaccuggauggaguuccuggugcagacggagcagaagcucgcgguggagaucagcgggaacuaccagcaccuccuggagcagcagcgggcccacgagcuguuccaggccgagauguucucccgccagcagauccugcacagcaucaucaucgacggccagcggcugcucgagcaggggcaggucgacgaccgcgacgaguucaaccugaagcugacccuccuguccaaccaguggcagggcgugauccggcgcgcccagcagcggcgcggcaucaucgacagccagauccggcaguggcagcgcuaccgggagauggcggagaagcugcgcaaguggcucguggaggucuccuaccugccgaugagcgggcugggcuccgugcccaucccccuccagcaggcccggacccuguucgacgaggugcaguucaaggagaaggucuuccugcgccagcaggggagcuacauccucaccguggaggccggcaagcagcugcugcucuccgccgacagcggggccgaggcggcccugcaggccgagcuggccgagauccaggagaaguggaaguccgccagcaugcggcucgaggagcagaagaagaagcuggcguuccugcucaaggacugggagaagugcgagaagggcaucgccgacucccuggagaagcugcgcacguucaagaagaagcucagccagucccugcccgaccaccacgaggagcugcacgccgagcagaugcggugcaaggagcucgagaacgccgugggcagcuggaccgacgaccugacccagcugucccuccugaaggacacccugagcgccuacaucagcgcggacgacaucuccauccucaacgagcgcgucgagcugcugcagcggcagugggaggagcucugccaccagcugagccugcgccgccagcagaucggggagcggcucaacgagugggccguguucuccgagaagaacaaggagcugugcgaguggcugacgcagauggagagcaaggugucccagaacggcgacauccucaucgaggagaugaucgagaagcugaagaaggacuaccaggaggagaucgccaucgcccaggagaacaagauccagcugcagcagaugggggagcgccucgcgaaggccagccacgaguccaaggccagcgagaucgaguacaagcugggcaaggucaacgaccgguggcagcaccuccuggaccugaucgccgcccgcgugaagaagcugaaggagacccugguggcgguccagcagcuggacaagaacauguccagccugcggaccuggcucgcccacaucgaguccgagcuggccaagccgaucguguacgacagcugcaacuccgaggagauccagcgcaagcugaacgagcagcaggagcuccagcgggacaucgagaagcacagcaccggcguggccuccguccugaaccugugcgaggugcuccugcacgacugcgacgccugcgcgaccgacgccgagugcgacagcauccagcaggccacgcgcaaccuggaccggcgcuggcggaacaucugcgccauguccauggagcgccggcucaagaucgaggagaccuggcgccuguggcagaaguuccuggacgacuacagccgguucgaggacuggcucaaguccagcgagcgcaccgccgcguuccccagcuccagcggggucaucuacaccguggccaaggaggagcugaagaaguucgaggccuuccagcgccaggugcacgagugccugacgcagcucgagcugaucaacaagcaguaccgccggcuggcccgcgagaaccggaccgacuccgcgugcagccucaagcagaugguccacgagggcaaccagcgcugggacaaccugcagaagcgcgugaccuccauccugcggcgccucaagcacuucaucgggcagcgggaggaguucgagaccgcccgcgacagcauccugguguggcugacggagauggaccuccagcugaccaacaucgagcacuucuccgagugcgacguccaggccaagaucaagcagcugaaggccuuccagcaggagaucagccucaaccacaacaagaucgagcagaucaucgcccagggcgagcagcugaucgagaaguccgagccccuggacgcggccaucaucgaggaggagcucgacgagcugcggcgcuacugccaggagguguucgggcggguggagcgcuaccacaagaagcugauccggcucccgcugcccgacgacgagcacgaccugagcgaccgcgagcucgagcuggaggacuccgccgcccugagcgaccugcacuggcacgaccgguccgccgacagccuccugagcccccagcccagcuccaaccugagccucucccuggcgcagccgcugcgcagcgagcggagcggccgcgacacccccgccuccgucgacagcaucccccucgagugggaccacgacuacgaccugucccgggaccuggagagcgccaugucccgcgcccuccccagcgaggacgaggagggccaggacgacaaggacuucuaccugcgcggggccgugggccuguccgacgugaugaucccggagagccccgaggcguacgucaagcucaccgagaacgccaucaagaacacguccggggaccacagcgcccuggagucccagauccgccagcugggcaaggcccucgacgacagccgguuccagauccagcagaccgagaacaucauccgcuccaagacccccaccgggcccgagcuggacacgagcuacaagggcuacaugaagcugcucggcgagugcuccagcuccaucgacagcgugaagcgccuggagcacaagcugaaggaggaggaggagagccucccgggguucgugaaccugcacuccaccgagacccagaccgccggcgucaucgaccggugggagcugcuccaggcgcaggcccugagcaaggagcugcgcaugaagcagaaccuccagaaguggcagcaguucaacuccgaccugaacagcaucugggccuggcugggggacacggaggaggagcucgagcagcugcagcggcuggagcucuccaccgacauccagaccaucgagcugcagaucaagaagcugaaggagcuccagaaggccguggaccaccgcaaggcgaucauccugagcaucaaccugugcucccccgaguucacccaggccgacagcaaggagucccgggaccuccaggaccgccugagccagaugaacggccggugggaccgcgugugcucccugcucgaggaguggcgggggcugcugcaggacgcccucaugcagugccagggcuuccacgagaugagccacggccugcugcucaugcuggagaacaucgaccgccggaagaacgagaucguccccaucgacuccaaccuggacgccgagauccuccaggaccaccacaagcagcugaugcagaucaagcacgagcugcucgagagccagcugcgcguggccucccugcaggacaugagcugccagcuccuggugaacgcggaggggacggacugccuggaggccaaggagaagguccacgugaucggcaaccggcucaagcugcugcucaaggaggugucccgccacaucaaggagcuggagaagcugcucgacgucagcuccagccagcaggaccugagcuccuggagcuccgccgacgagcuggacaccagcggguccgugagccccaccuccggccggagcaccccgaaccgccagaagacgccccgggggaagugcucccucagccagcccggccccuccgugagcuccccgcacagccgcuccaccaagggcgggagcgacuccagccuguccgagcccggccccgggcggagcggccgcggcuuccuguuccggguccuccgcgccgcccugccccugcagcuccugcugcuccugcugaucgggcucgcgugccuggugccgaugagcgaggaggacuacuccugcgcccugagcaacaacuucgcccgcuccuuccaccccaugcuccgguacaccaacgggccgcccccgcuguga

SEQ ID NO: 37342 - RNA, 20658 nt, Artificial Sequence
  derived and/or modified sequence opt1 from SYNE2__Homo_sapiens__NP_055995
auggcgagcagccccgagcugcccaccgaggacgagcagggcagcugggggaucgacgaccugcacaucagccugcaggccgagcaggaggacacccagaagaaggcguucacgugcuggaucaacagccagcuggcccggcacaccucccccagcgugaucuccgaccuguucaccgacaucaagaagggccacgugcugcuggaccugcuggaggugcugagcgggcagcagcugccccgggacaagggcuccaacaccuuccagugccgcaucaacaucgagcacgcccugacguuccugcggaaccggagcaucaagcugaucaacauccacgugaccgacaucaucgacgggaaccccuccaucauccugggccugaucuggaccaucauccugcacuuccacaucgagaagcuggcccagacccugagcugcaacuacaaccagcccucccuggacgacgugagcgugguggacuccagccccgccuccuccccgcccgcgaagaagugcuccaaggugcaggcccgguggcagaugagcgcccgcaaggcccugcugcugugggcgcaggagcagugcgccacguacgagagcgugaacgugaccgacuucaaguccagcuggcggaacggcauggccuuccuggccaucauccacgcccugcgccccgaccugaucgacaugaaguccgugaagcaccggagcaacaaggacaaccugcgcgaggcguuccggaucgccgagcaggagcugaagaucccccgccugcuggagcccgaggacguggacgugguggaccccgacgagaaguccaucaugaccuacguggcccaguuccugcaguacagcaaggacgcccccgggaccggcgaggaggcccaggggaaggugaaggacgcgaugggcuggcugacgcugcagaaggagaagcugcagaagcuccugaaggacuccgagaacgacaccuacuucaagaaguacaacagccugcucuccuucauggagagcuucaacgaggagaagaaguccuuccuggacgugcugagcaucaagcgggaccucgacgagcuggacaaggaccaccuccagcuccgcgaggccugggacgggcuggaccaccagaucaacgccuggaagaucaagcugaacuacgcccugcccccgccccuccaccagaccgaggccuggcugcaggagguggaggagcucauggacgaggaccuguccgcgagccaggaccacucccaggccgugacccugauccaggagaagaugacgcuguucaagagccucauggaccgguucgagcaccacuccaacauccugcugaccuucgagaacaaggacgagaaccaccucccccuggugccgcccaacaagcuggaggagaugaagcgccggaucaacaacauccucgagaagaaguucauccugcugcucgaguuccacuacuacaagugccuggugcugggccucguggacgaggucaagagcaagcuggacaucuggaacaucaaguacggcucccgcgagagcguggagcugcuccuggaggacuggcacaaguucaucgaggagaaggaguuccuggcccggcucgacaccagcuuccagaagugcggggagaucuacaagaaccuggccggcgagugccagaacaucaacaagcaguacaugauggugaaguccgacgugugcauguaccgcaagaacaucuacaacgucaagagcacccugcagaagguccucgccugcugggcgacguacguggagaaccugcggcugcuccgcgccugcuucgaggagaccaagaaggaggagaucaaggaggugcccuucgagacccuggcccaguggaaccuggagcacgccacccucaacgaggcggggaacuuccuggucgagguguccaacgacguggucggcagcuccaucagcaaggagcugcgccggcucaacaagcgcuggcggaagcugguguccaagacgcagcuggagaugaaccucccccugaugaucaagaagcaggaccagcccaccuucgacaacagcggcaacauccuguccaaggaggagaaggccaccguggaguucagcaccgacauguccgucgagcuccccgagaacuacaaccagaacaucaaggccggggagaagcacgagaaggagaacgaggaguucacgggccagcugaagguggccaaggacguggagaagcugaucgggcaggucgagaucugggaggccgaggccaagagcgugcucgaccaggacgacguggacaccuccauggaggagagccugaagcaccugaucgccaagggcuccauguucgacgagcucauggcccgcagcgaggacaugcugcagauggacauccagaacaucuccagccaggagagcuuccagcacguccugaccaccgggcuccaggccaagauccaggaggccaaggagaaggugcagaucaacguggucaagcugaucgcggcccugaagaaccucacggacgugucccccgaccuggacauccggcugaagauggaggagagccagaaggagcucgaguccuacaugaugcgcgcccagcagcugcugggccagcgggagagccccggcgagcucaucuccaagcacaaggaggcccugaucaucagcaacaccaagucccuggccaaguaccucaaggcgguggaggagcugaagaacaacgucaccgaggacaucaagaugagccuggaggagaagucccgcgacgugugcgccaagugggagagccuccaccacgagcugucccuguacgugcagcagcucaagaucgacaucgagaaggggaagcugagcgacaacauccugaagcucgagaagcagaucaacaaggagaagaagcugauccggcgcggccggaccaaggggcugaucaaggagcacgaggccugcuucuccgaggagggcugccucuaccagcugaaccaccacauggagguccugcgcgagcucugcgaggagcugcccagccagaagucccagcaggaggugaagcggcugcucaaggacuacgagcagaagaucgagcgccugcugaagugcgccagcgagauccacaugacgcuccagcccaccgccggcgggaccuccaagaacgaggggaccaucaccacgagcgagaaccgcgggggcgacccccacuccgaggcccccuucgccaagagcgacaaccagcccagcaccgagaaggccauggagcccaccaugaaguucucccuggccagcgugcugcgcccgcuccaggaggaguccaucauggagaaggacuacagcgcguccaucaacagccugcuggagcgguacgacaccuaccgcgacauccucgagcaccaccuccagaacaacaaguuccggaucacguccgacuucagcuccgaggaggaccgcagcuccagcugccugcaggccaagcucaccgaccugcaggucaucaagaacgagaccgacgcccgcuggaaggaguucgagaucaucucccugaagcucgagaaccacgugaacgacaucaagaagcccuucgugaucaaggagcgggacacccugaaggagcgcgagcgggagcugcagaugacgcucaacacccgcauggagagccuggagaccgcccugcggcugguccuccccguggagaaggccucccugcugcucugcgggagcgaccugccccugcacaagauggcgauccagggcuuccaccucaucgacgccgaccgcaucuaccagcaccuccggaacauccaggacuccaucgccaagcagaucgagaucugcaaccgccuggaggagccggggaacuucgugcucaaggagcugcaccccuucgaccugcacgccaugcagaacaucauccucaaguacaagacccaguucgagggcaugaaccaccggguccagcgcagcgaggacacgcugaaggcccuggaggacuuccucgcgucccugcggaccgccaagcugagcgccgagcccgugaccgaccucagcgccuccgacacccagguggcgcaggagaacacgcugaccgucaagaacaaggagggcgagauccaccugaugaaggacaaggccaagcaccucgacaagugccugaagaugcuggacaugagcuucaaggacgccgagcgcggggacgacaccuccugcgagaaccuccuggacgccuucagcaucaagcuguccgagacccacggcuacggggugcaggaggaguucacggaggagaacaagcuccuggaggccugcaucuucaagaacaacgagcugcucaagaacauccaggacgugcagagccagaucuccaagaucggccugaaggaccccaccgucccggcggugaagcaccggaagaagucccugauccgccucgacaaggugcuggacgaguacgaggaggagaagcggcaccuccaggagauggccaacucccucccccacuucaaggacggccgcgagaagaccgucaaccagcagugccagaacaccguggugcugugggagaacacgaaggcccuggucaccgagugccucgagcagugcgggcgggugcuggagcugcucaagcaguaccagaacuucaagagcauccugaccacccugauccagaaggaggaguccgugaucagccuccaggccuccuacaugggcaaggagaaccugaagaagcgcaucgccgagaucgagaucgucaaggaggaguucaacgagcaccuggaggugguggacaagaucaaccaggucugcaagaaccuccaguucuaccugaacaagaugaagacguucgaggagccgcccuucgagaaggaggcgaacaucaucguggaccgguggcuggacaucaacgagaagaccgaggacuacuacgagaaccucgggcgcgcccuggcccugugggacaagcuguucaaccugaagaacgucaucgacgaguggaccgagaaggcccugcagaagauggagcuccaccagcugaccgaggaggaccgggagcgccugaaggaggagcuccaggugcacgagcagaagacgagcgaguucucccgccggguggccgagauccaguuccugcugcagagcuccgagaucccgcucgagcugcaggucauggagagcuccauccugaacaagauggagcacgugcagaagugccucaccggcgagagcaacugccacgcgcugagcggguccaccgccgagcugcgcgaggaccucgaccaggccaagacccagaucggcaugacggagagccugcugaaggcccucucccccagcgacucccuggagaucuucaccaagcuggaggagauccagcagcagauccuccagcagaagcacagcaugauccugcuggagaaccagaucggcugccucacccccgagcuguccgagcugaagaagcaguacgagagcguguccgaccucuucaacaccaagaaguccguccugcaggaccacuucuccaagcugcucaacgaccagugcaagaacuucaacgacugguucagcaacaucaaggugaaccugaaggagugcuucgaguccagcgagaccaagaaguccguggagcagaagcugcagaagcucagcgacuuccugacgcuggaggggcggaacuccaagaucaagcaggucgacagcgugcucaagcacgugaagaagcaccuccccaaggcccacgucaaggagcugaucuccuggcucgugggccaggaguucgagcuggagaagauggagagcaucugccaggcgcgcgccaaggagcuggaggacagccuccagcagcugcugcggcuccaggacgaccaccgcaaccugcggaaguggcugaccaaccaggaggagaaguggaaggggauggaggagccgggcgagaagaccgagcuguucugccaggcccucgcccgcaagcgggagcaguucgaguccguggcgcagcugaacaacagccugaaggaguacggguucaccgaggaggaggagaucaucauggaggccacgugccucauggaccgcuaccagacccugcugcggcagcucuccgagaucgaggaggaggacaagcugcugcccaccgaggaccagagcuucaacgaccucgcccacgacgucauccacuggaucaaggagaucaaggagucccugauggugcugaacagcuccgagggcaagaugccccucgaggagcgcauccagaagaucaaggagaucauccugcugaagcccgagggcgacgcccggaucgagaccaucaugaagcaggccgagagcuccgaggcgccgcucgugcagaagacgcugaccgacaucagcaaccagugggacaacacccugcaccucgccuccaccuaccugagccaccaggagaagcugcuccuggagggggagaaguaccugcaguccaaggaggaccuccgccugaugcugaucgagcucaagaagaagcaggaggccggcuucgcccugcagcacgggcugcaggagaagaaggcccagcucaagaucuacaagaaguuccugaagaaggcgcaggaccugacgagccuccugaaggagcugaagucccagggcaacuaccuccuggagugcaccaagaaccccagcuucuccgaggagcccuggcuggagaucaagcaccuccacgagagccugcugcagcagcuccaggacuccguccagaaccuggacgggcacgugcgggagcacgacagcuaccaggugugcgucaccgaccugaacaccacgcucgacaacuucagcaaggaguucguguccuucagcgacaagcccguggaccagaucgccgucgaggagaagcugcagaagcugcaggagcucgagaaccgccugucccugcaggacggcacccucaagaagauccuggcccuggccaagagcgugaagcagaacaccuccagcgugggccagaagaucaucaaggacgacaucaagucccuccagugcaagcagaaggaccuggagaaccggcuggccagcgcgaagcaggagauggagugcugccucaacuccauccucaagagcaagcgcuccaccgagaagaaggggaaguucacgcugcccggccgggagaagcaggccaccagcgacguccaggaguccacccaggagagcgccgccguggagaagcucgaggaggacugggagaucaacaaggacuccgcgguggagauggccaugagcaagcagcugucccugaacgcccaggagagcaugaagaacaccgaggacgagcgcaaggucaacgagcuccagaaccagccccuggagcuggacacgaugcuccgcaacgagcagcuggaggagaucgagaagcuguacacccagcucgaggccaagaaggccgcgaucaagccccuggagcagaccgagugccugaacaagaccgagacgggggcccucgugcugcacaacaucggcuacagcgcccagcaccuggacaaccuccugcaggcccugaucacccucaagaagaacaaggagucccaguacugcgugcugcgggacuuccaggaguaccuggccgcggucgagagcuccaugaaggcccuccugaccgacaaggagagccugaagguggggccgcucgacuccgugaccuaccuggacaagaucaagaaguucaucgccagcaucgagaaggagaaggacucccugggcaaccucaagaucaagugggagaaccugagcaaccacgucacggacauggacaagaagcugcucgagucccagaucaagcagcuggagcacggcugggagcaggucgagcagcagauccagaagaaguacagccagcaggucgucgaguacgacgaguucaccacccugaugaacaaggugcaggacaccgagaucucccuccagcagcagcagcagcaccuccagcugcgccucaagagccccgaggagcgggccgggaaccaguccaugaucgcccugacgaccgaccugcaggcgaccaagcacggcuucagcgugcugaaggggcaggccgagcuccagaugaagcgcaucuggggcgagaaggagaagaagaaccuggaggacggcaucaacaaccugaagaagcagugggagacccucgagccccugcaccuggaggccgagaaccagaucaagaagugcgacauccggaacaagaugaaggagaccauccucugggccaagaaccugcugggggagcucaaccccuccaucccgcugcugcccgacgacauccucagccagauccgcaagugcaaggucacgcacgacggcauccuggcgcggcagcaguccguggagagccuggccgaggaggugaaggacaagguccccucccucaccaccuacgaggggagcgaccugaacaacacccuggaggaccuccgcaaccaguaccagaugcuggugcucaagagcacgcagcggucccagcagcucgaguucaagcuggaggagcgcagcaacuucuucgccaucauccggaaguuccagcugauggugcaggaguccgagacccucaucaucccccgcgucgagaccgccgccaccgaggcggagcugaagcaccaccacgugacgcuggaggccagccagaaggagcuccaggagaucgacuccggcaucagcacccaccuccaggagcugaccaacaucuacgaggagcucaacguguucgagcggcuguuccuggaggaccagcucaagaaccugaagauccgcaccaaccggauccagcgcuucauccagaacacgugcaacgaggucgagcacaagaucaaguucugccggcaguuccacgagaagaccuccgcccugcaggaggaggccgacagcauccagcgcaacgagcuccugcugaaccaggaggugaacaagggggucaaggaggagaucuacaaccucaaggaccggcugaccgccaucaagugcugcauccuccaggugcucaagcugaagaagguguucgacuacaucggccugaacugggacuucucccagcucgaccagcugcagacccaggucuucgagaaggagaaggagcuggaggagaagaucaagcagcucgacacguucgaggaggagcacggcaaguaccaggcgcugcugagcaagaugcgcgccaucgaccuccagaucaagaagaugaccgagguggugcugaaggccccggacuccagccccgagucccggcgccugaacgcccagauccucagccagcgcaucgagaaggccaagugccugugcgacgagaucaucaagaagcugaacgagaacaagaccuucgacgacuccuucaaggagaaggagauccuccagaucaagcugaacgcggaggagaacgacaagcuguacaagguccuccagaacauggugcuggagcugagccccaaggagcucgacgagaagaacugccaggacaagcuggagaccucccugcacgugcucaaccagaucaagagccagcugcagcagccccugcucaucaaccuggagaucaagcacauccagaacgagaaggacaacugcgaggccuuccaggagcaggucugggccgagaugugcuccaucaaggccgugacggccaucgagaagcagcgggaggagaacagcagcgaggcguccgacguggagaccaagcugcgcgaguucgaggaccuccagaugcagcugaacaccagcaucgaccugcggaccaacguccucaacgacgccuacgagaaccugacgcgcuacaaggaggccgugacccgggccguggaguccaucaccagccuggaggcgaucaucaucccguaccgcgucgacguggggaaccccgaggagucccucgagaugccccugcggaagcaggaggagcuggagagcaccguggcccacauccaggaccucacggagaagcugggcaugaucuccagccccgaggccaagcugcagcuccaguacacccugcaggagcuggucuccaagaacagcgccaugaaggaggccuucaaggcgcaggagaccgaggccgagcgcuaccucgagaacuacaagugcuaccggaagauggaggaggacaucuacaccaaccuguccaagauggagacggugcuggggcagagcauguccagccucccgcuguccuaccgcgaggcccuggagcggcucgagcagagcaaggcccugguguccaaccugaucagcaccaaggaggagcugaugaagcuccgccagauccugcggcugcuccgccugcggugcaccgagaacgacggcaucugccugcucaagaucgucuccgcccugugggagaaguggcugagccuccuggaggcggccaaggagugggagauguggugcgaggagcugaagcaggaguggaaguucgugagcgaggagaucgagcgcgaggccaucauccucgacaaccugcaggaggagcugcccgagaucuccaagaccaaggaggccgccacgaccgaggagcucagcgagcugcuggacugccucugccaguacggggagaacguggagaagcagcagcugcugcucacccugcugcuccagcggauccgcuccauccagaacguccccgagagcuccggcgcgguggagaccgugcccgccuuccaggagaucacgagcaugaaggagcggugcaacaagcugcugcagaagguccagaagaacaaggagcucgugcagaccgagauccaggagcgccacuccuucaccaaggagaucaucgcccugaagaacuucuuccagcagaccaccacgagcuuccagaacauggccuuccaggaccacccggagaaguccgagcaguucgaggagcugcagagcauccucaagaagggcaagcugaccuucgagaacaucauggagaagcugcgcaucaaguacuccgagauguacaccaucgugcccgcggagaucgagagccaggucgaggagugccggaaggcccucgaggacaucgacgagaagaucuccaacgaggugcucaagagcucccccagcuacgccaugcgccggaagaucgaggagaucaacaacgggcugcacaacguggagaagaugcuccagcagaaguccaagaacaucgagaaggcccaggagauccagaagaagaugugggacgagcuggaccuguggcacagcaagcucaacgagcuggacuccgagguccaggacaucguggagcaggaccccggccaggcccaggaguggauggacaaccugaugaucccguuccagcaguaccagcaggucagccagcgcgcggagugccggaccagccagcucaacaaggccacggucaagauggaggaguacuccgaccugcucaagagcaccgaggccuggaucgagaacaccucccaccuccuggccaaccccgccgacuacgacagccugcgcacccucucccaccacgcgagcacggugcagauggcccuggaggacuccgagcagaagcacaaccugcuccacagcaucuucauggaccuggaggaccuguccaucaucuucgagaccgacgagcucacccagagcauccaggagcuguccaaccaggugaccgcccugcagcagaagaucauggagagccucccccagauccagcggauggccgacgacgucguggccaucgaguccgaggucaagagcauggagaagcgcgucuccaagaucaagacgauccugcugagcaaggagaucuucgacuucucccccgaggagcaccucaagcacggggaggugauccuggagaacauccggccgaugaagaagaccaucgcggagaucgugagcuaccaggucgagcugcgccucccccagaccggcaugaagccccugccgguguuccagcggaccaaccagcugcuccaggacaucaagcugcuggagaacgugacgcaggagcagaacgagcuccugaaggucgugaucaagcagaccaacgagugggacgaggagaucgagaaccugaagcagauccucaacaacuacuccgcccaguucagccuggagcacaugagccccgaccaggccgacaagcugccccagcuccagggggagaucgagcgcauggagaagcagauccugucccugaaccagcggaaggaggaccuccugguggaccugaaggccaccguccucaaccugcaccagcaccugaagcaggagcaggagggcguggagcgcgaccggcuccccgcggucaccagcgaggagggcgggguggccgagcgcgacgccuccgagcggaagcugaaccgccggggcagcauguccuaccuggccgccguggaggaggaggucgaggagagcuccgucaagagcgacaacggggacgagaaggcggagccgagcccccagagcugguccagccucuggaagcacgacaaggacauggaggaggaccgcgccuccagcuccagcggcacgaucgugcaggaggccuacggcaagaucuccaccagcgacaacagcauggcccagauccugacccccgacucccugaacaccgagcaggggcccgagugcagccuccggccgaaccagacggaggagggcaccacgccgcccaucgaggccgacacccuggacuccagcgacgcgcagggcggccuggagccccgcgucgagaagacgcgcccggagcccaccgaggugcuccacgccugcaagacccagguggccgagcuggagcuguggcuccagcaggccaacgucgccguggagcccgagacccugaacgcggacaugcagcagguccuggagcagcagcuggucgggugccaggccaugcucacggagaucgagcacaagguggccuuccugcuggagaccugcaaggaccagggccucggcgacaacggggccacccagcacgaggccgaggcgcugucccugaagcucaagaccgugaagugcaaccuggagaagguccagaugaugcugcaggagaagcacagcgaggaccagcaccccacgauccucaagaaguccagcgagccggagcaccaggaggcccugcagcccgugaaccuguccgagcucgagagcaucgugaccgagcggccccaguucucccgccagaaggacuuccagcagcagcagguccuggagcugaagcccauggagcagaaggacuucaucaaguucaucgaguucaacgccaagaagauguggccgcaguacugccagcacgacaacgacaccacccaggagagcuccgccagcaaccaggcguccagccccgagaacgacgugcccgacuccauccucagcccccagggccagaacggggacaaguggcaguaccugcaccacgagcuguccagcaagaucaagcucccgcugccccagcugguggagccccaggucagcaccaacaugggcauccuccccuccgugacgauguacaacuuccgguacccgaccaccgaggagcugaagaccuacacgacccagcuggaggaccuccgccaggaggccagcaaccugcagacccaggagaacaugaccgaggaggccuacaucaaccuggacaagaagcuguucgagcuguuccugacgcucucccagugccugagcuccguggaggagaugcuggagaugccccggcucuaccgcgaggacgggagcggccagcagguccacuacgagacccuggcccuggagcucaagaagcuguaccuggcccucuccgacaagaagggcgaccugcugaaggcgaugaccuggcccggggagaacaccaaccuccugcuggagugcuucgacaaccuccaggugugccuggagcacacgcaggccgccgccgugugccggagcaagucccugaaggccggccucgacuacaaccgcagcuaccagaacgagaucaagcggcuguaccaccagcugaucaaguccaagaccagccuccagcagucccugaacgagaucagcgggcaguccgucgcggagcagcugcagaaggccgacgccuacaccguggagcucgagaacgccgagagccgcguggccaagcugcgggacgagggcgagcgccugcaccucccguacgcgcugcugcaggaggucuacaagcucgaggacgugcuggacuccaugugggggaugcugcgggcccgcuacaccgagcucagcucccccuucgugacggagagccagcaggacgcccugcugcagggcauggucgagcucgugaagaucggcaaggagaagcuggcccacgggcaccugaagcagaccaagagcaagguggcgcuccaggcccagaucgagaaccacaaggucuucuuccagaagcugguggccgacaugcugcucauccaggccuacuccgccaagauccugcccagccugcuccagaaccgggagaccuucugggcggagcaggucaccgaggucaagauccuggaggagaagucccgccagugcggcaugaagcugcagagccuccugcagaagugggaggaguucgacgagaacuacgccucccuggagaaggaccucgagauccugaucagcacgcugcccuccgugagccucguggaggagaccgaggagcggcuggucgagcgcaucuccuucuaccagcagaucaagcggaacaucgggggcaagcacgcccgccuguaccagacccucaacgaggggaagcagcugguggccagcguguccugcccggagcuggagggccagaucgccaagcucgaggagcaguggcugagccugaacaagaagaucgaccacgagcuccaccgccugcaggcgcugcucaagcaccuccuguccuacaaccgggacagcgaccagcugaccaaguggcuggaguccagccagcacacgcugaacuacuggaaggagcagucccugaacgucagccaggaccucgacaccauccgcuccaacaucaacaacuucuucgaguucagcaaggagguggacgagaaguccucccugaagaccgccgugaucagcaucggcaaccagcugcuccaccugaaggagaccgacacggccacccugcgggccucccucgcccaguucgagcagaaguggaccaugcugaucacccagcugcccgacauccaggagaagcuccaccagcugcagauggagaagcugcccagccgcaaggcgaucacggagaugaucuccuggaugaacaacgucgagcaccagaccagcgacgaggacuccgugcacagccccuccagcgccucccaggugaagcaccuccugcagaagcacaaggaguuccggauggagauggacuacaagcaguggaucgucgacuucgugaaccagagccugcuccagcugagcacgugcgacgucgagagcaagcgcuacgagcggaccgaguucgccgagcaccugggggagaugaaccgccaguggcaccgggugcacggcaugcucaaccgcaagauccagcaccuggagcagcugcucgaguccaucaccgagagcgagaacaagauccagauccugaacaacuggcuggaggcccaggaggagcggcucaagacccugcagaagccggaguccgugaucagcguccagaagcugcuccuggacugccaggacaucgagaaccagcuggccaucaaguccaaggcgcucgacgagcugaagcagagcuaccugacccucgagagcggggccgugccccugcuggaggacaccgccucccgcaucgacgagcuguuccagaagcggagcuccgugcugacccaggucaaccagcugaagacgagcaugcaguccgugcuccaggaguggaagaucuacgaccagcuguacgacgaggugaacaugaugaccauccgcuucugguacugcauggagcacagcaagcccgucgugcugucccucgagacccugcggugccagguggagaaccugcagagccuccaggacgaggccgaguccagcgagggcuccugggagaagcugcaggaggucaucggcaagcugaaggggcucugccccagcguggcggagaucaucgaggagaagugccagaacacccacaagcgcuggacccaggugaaccaggccaucgccgaccagcugcagaaggcccagucccugcuccagcuguggaaggccuacagcaacgcgcacggcgaggccgccgcccggcugaagcagcaggaggccaaguuccagcagcucgcgaacaucuccaugagcgggaacaaccuggccgagauccugccgcccgcccuccaggacaucaaggagcugcagcacgacguccagaagaccaaggaggccuuccugcagaacuccagcgugcucgaccgccugccccagcccgccgaguccagcacccacaugcugcucccgggcccccugcacagccugcagcgggcggccuaccucgagaagaugcugcuggugaaggccaacgaguucgaguucguccucucccaguucaaggacuucggggugcgccuggagagccugaagggccucaucaugcacgaggaggagaaccuggaccggcugcaccagcaggagaaggagaaccccgacuccuuccucaaccacgugcuggcccugaccgcgcagagccccgacaucgagcaccucaacgaggucucccugaagcugccgcucagcgacguggccgugaagacgcugcagaacaugaaccgccaguggauccgcgccaccgccaccgcccuggagcggugcuccgagcuccagggcaucgggcugaacgagaaguuccuguacugcugcgagaaguggauccagcuccuggagaagaucgaggaggcgcugaaggucgacguggccaacagccuccccgagcugcuggagcagcagaagaccuacaagaugcucgaggccgagguguccaucaaccagacgaucgccgacagcuacgucacccagucccugcagcugcucgacaccaccgagaucgagaaccgccccgaguucaucacggaguucagcaagcugaccgaccgguggcagaacgccgugcagggcgugcgccagcggaagggggacgucgacggccuggugcgccaguggcaggacuucaccaccuccguggagaaccuguuccgguuccucacggacaccagccaccuccuguccgcggucaaggggcaggagcgcuucagccucuaccagacccggucccugauccacgagcugaagaacaaggagauccacuuccagcgccggcgcaccacgugcgcccucacccuggaggccggcgagaagcugcuccugaccaccgaccugaagacgaaggagagcgugggccggcgcaucagccagcuccaggacuccuggaaggacauggagccccagcuggccgagaugaucaagcaguuccagagcaccguggagaccugggaccagugcgagaagaagaucaaggagcugaagucccggcuccagguccugaaggcccagagcgaggacccgcugcccgagcuccacgaggaccugcacaacgagaaggagcugaucaaggagcucgagcagucccuggcgagcuggacccagaaccugaaggagcuccagacgaugaaggccgaccugacccgccacgugcugguggaggacgucauggugcucaaggagcagaucgagcaccuccaccggcagugggaggaccugugccuccgcguggccauccggaagcaggagaucgaggaccgccugaacaccugggucguguucaacgagaagaacaaggagcugugcgccuggcucgugcagauggagaacaagguccugcagaccgcggacaucuccaucgaggagaugaucgagaagcugcagaaggacugcauggaggagaucaaccucuucagcgagaacaagcugcagcugaagcagaugggggaccagcucaucaaggccuccaacaagagccgcgccgccgagaucgacgacaagcugaacaagaucaacgaccgguggcagcaccuguucgacgugaucggcucccgcgugaagaagcucaaggagacguucgccuucauccagcagcuggacaagaacaugagcaaccugcggaccuggcucgcgcgcaucgaguccgagcugagcaagcccgucguguacgacgugugcgacgaccaggagauccagaagcggcuggccgagcagcaggaccuccagcgcgacaucgagcagcacuccgccggggucgagagcguguucaacaucugcgacguccugcugcacgacuccgacgccugcgccaacgagaccgagugcgacagcauccagcagaccacccggucccucgaccgccgguggcgcaacaucugcgcgaugagcauggagcggcgcaugaagaucgaggagacguggcggcuguggcagaaguuccuggacgacuacagccgcuucgaggacuggcucaaguccgccgagcggaccgccgccugcccgaacagcuccgaggugcuguacaccagcgccaaggaggagcugaagcgcuucgaggcguuccagcggcagauccacgagcgccucacccagcuggagcugaucaacaagcaguaccggcgccucgcccgggagaaccgcacggacaccgccucccgccugaagcagauggugcacgagggcaaccagcggugggacaaccugcagcgccgggucaccgccgugcuccgccggcugcgccacuucaccaaccagcgggaggaguucgaggggacgcgcgagagcauccugguguggcucaccgagauggaccugcagcugaccaacgucgagcacuucuccgagagcgacgccgacgacaagaugcggcagcucaacggcuuccagcaggagaucacccugaacacgaacaagaucgaccagcugaucguguucggcgagcagcucauccagaaguccgagccccuggacgcggugcugaucgaggacgagcucgaggagcugcaccgcuacugccaggaggucuucgggcgggugagccgcuuccaccggcgccugaccuccugcacccccggccucgaggacgagaaggaggccagcgagaacgagaccgacauggaggacccccgggagauccagacggacuccuggcgcaagcgcggggagagcgaggagccguccagcccccagucccugugccaccugguggcccccggccacgagcgcagcgggugcgagacccccgucuccguggacagcaucccgcucgagugggaccacaccggcgacgugggcgggagcuccagccacgaggaggacgaggagggccccuacuacuccgcccugagcgggaaguccaucagcgacggccacuccuggcacguccccgacagccccuccugcccggagcaccacuacaagcagauggagggcgaccggaacgugccgcccgugcccccggcgagcuccacccccuacaagccgcccuacgggaagcugcuccugccgcccggcacggacgggggcaaggaggggccccgcguccugaacggcaacccccagcaggaggacggcgggcucgccggcaucaccgagcagcagagcggggccuucgaccgcugggagaugauccaggcccaggagcugcacaacaagcugaagaucaagcagaaccuccagcagcugaacuccgacaucagcgccaucaccaccuggcugaagaagacggaggcggagcucgagaugcugaagauggccaagccgcccuccgacauccaggagaucgagcugcgggugaagcgccuccaggagauccugaaggccuucgacaccuacaaggcccugguggucagcgugaacguguccagcaaggaguuccugcagaccgagucccccgagagcaccgagcuccagagccggcugcgccagcugucccuccugugggaggccgcgcagggcgccgucgacagcuggcgcgggggccugcgccagucccucaugcagugccaggacuuccaccagcugagccagaaccugcuccuguggcuggccuccgccaagaaccggcgccagaaggcccacgugacggaccccaaggcggacccgcgggcccuccuggagugccgccgggagcugaugcagcucgagaaggagcugguggagcgccagccccaggucgacaugcugcaggagaucagcaacucccuccugaucaagggccacggggaggacugcaucgaggccgaggagaaggugcacgugaucgagaagaagcugaagcagcuccgggagcaggucagccaggaccugauggcccugcagggcacccagaaccccgcguccccgcuccccagcuucgacgagguggacuccggggaccagccgcccgccaccagcgugccggcgccccgggccaagcaguuccgggccguccgcaccacggagggcgaggaggagaccgagucccgggugcccgggagcacccgcccccagcgguccuuccugagccgcgugguccgggcggcccugccgcuccagcugcugcuccugcugcuccugcugcucgccugccugcugcccuccagcgaggaggacuacuccugcacccaggccaacaacuucgcccgcagcuucuaccccaugcuccgcuacacgaacggcccgccgcccaccuga

SEQ ID NO: 37343 - RNA, 1215 nt, Artificial Sequence
  derived and/or modified sequence opt1 from SYNE4__Homo_sapiens__NP_001034965
auggcccugagccucccccugggcccccgccugggguccgagccccucaaccacccgcccggcgcgccccgggaggccgacaucguggggugcaccgucugccccgccagcggcgaggaguccaccagccccgagcaggcccagacgcuggggcaggacucccuggggcccccggagcacuuccagggcggcccccgcggcaacgagcccgccgcccacccgccccgguggagcacccccuccagcuacgaggaccccgccgggggcaagcacugcgagcaccccaucuccgggcucgaggugcuggaggcggagcagaacagccugcaccucugccugcugggccucggccgccggcugcaggaccuggagcaggggcucggccacugggcccuggcccaguccgggauggugcagcugcaggcgcuccaggucgaccugcgcggcgccgccgagcggguggaggcccugcucgccuucggcgaggggcuggcgcagcgcagcgagccgcgggccugggccgcccuggagcagauccuccgcgcccugggcgcguaccgggacuccaucuuccgccggcuguggcagcuccaggcccagcuggugagcuacucccuggucuucgaggaggccaacacccucgaccaggaccuggagguggagggggacagcgacuggcccggccccgggggcguguggggccccugggccccguccagccugcccaccuccacggagcucgagugggaccccgccggggacaucggcgggcugggcccccuggggcagaagaccgcgcgcacccucggcgucccgugcgagcugugcggccagcgggggccccagggccgcgggcagggccuggaggaggccgacaccagccacagccggcaggacaugcucgaguccgggcugggccaccagaagcgccuggcccggcaccagcgccacagccuccugcggaagccccaggacaagaagcgccaggccagcccccaccuccaggacgugcgccuggagggcaacccgggggcccccgaccccgcgucccggcagccgcugacguuccugcucauccuguuccugcuguuccuccugcuggugggcgccauguuccuccugcccgccuccgggggccccugcugcagccacgcccgcaucccccggaccccguaccugguccucuccuacgugaacggccugccgcccguguga

SEQ ID NO: 37344 - RNA, 4032 nt, Artificial Sequence
  derived and/or modified sequence opt1 from SYNGAP1__Homo_sapiens__NP_006763
augagccgcucccgggccagcauccaccgcggcuccauccccgccaugagcuacgcccccuuccgggacgugcgcgggcccuccaugcaccggacccaguacguccacagccccuacgaccgccccggcuggaacccccgguucugcaucaucuccgggaaccagcugcucaugcuggacgaggacgagauccacccccugcucauccgcgaccggcgcagcgaguccagccggaacaagcugcugcgccggaccguguccgugcccgucgagggccgcccccacggggagcacgaguaccaccucggccggagccgccggaaguccgugcccggcgggaagcaguacagcauggagggcgcccccgccgcccccuuccgccccucccagggguuccugagccggcgccugaaguccagcaucaagcggacgaagucccagcccaagcucgaccgcaccagcagcuuccgccagauccugccccgguuccgcuccgccgaccacgaccgggcgcgccugaugcagagcuucaaggagucccacagccacgagucccuccugagccccuccagcgccgccgaggcccuggagcucaaccuggacgaggacuccaucaucaagcccgugcacagcuccauccugggccaggaguucugcuucgaggucaccaccagcuccgggacgaagugcuucgcgugccggagcgccgccgagcgcgacaaguggaucgagaaccuccagcgggccgugaagccgaacaaggacaacucccgccggguggacaacguccugaagcuguggaucaucgaggcccgcgagcucccgcccaagaagcgguacuacugcgagcugugccuggacgacaugcucuacgcgcgcaccaccagcaagccccgguccgccagcggcgacaccguguucuggggcgagcacuucgaguucaacaaccugcccgccgugcgcgcccugcggcuccaccuguaccgcgacuccgacaagaagcggaagaaggacaaggccggguacgucggccuggugacggugcccgucgcgacccucgccgggcgccacuucaccgagcagugguaccccgugacccugcccacgggcagcggcgggagcggcgggaugggcuccgggggcggcgggggcagcgggggcggguccggcggcaaggggaagggcgggugcccggccgugcggcugaaggcccgcuaccagaccaugagcauccuccccauggagcuguacaaggaguucgccgaguacgucaccaaccacuaccgcaugcugugcgcggugcucgagcccgcccugaacgugaagggcaaggaggaggucgccuccgcccuggugcacauccuccagagcaccgggaaggccaaggacuuccuguccgacauggcgaugagcgagguggaccgguucauggagcgcgagcaccugaucuuccgggagaacacgcucgccaccaaggccaucgaggaguacaugcgccugaucggccagaaguaccugaaggacgccaucggcgaguucauccgggcgcucuacgaguccgaggagaacugcgaggucgaccccaucaagugcaccgccagcucccuggccgagcaccaggccaaccugcgcaugugcugcgagcucgcccugugcaagguggucaacagccacugcguguucccgcgggagcugaaggagguguucgcguccuggcgccugcggugcgccgagcgcgggcgggaggacaucgccgaccgccucaucagcgccucccuguuccugcgguuccucugccccgccaucaugagccccucccuguucggccugaugcaggaguacccggacgagcagaccagccgcacgcucacccugaucgcgaaggucauccagaaccuggccaacuucagcaaguucaccuccaaggaggacuuccucggguucaugaacgaguuccuggagcuggaguggggcagcaugcagcaguuccucuacgagaucuccaaccuggacacccugacgaacagcuccagcuucgagggcuacaucgaccucgggcgggagcuguccacccugcacgcccuccugugggaggugcugccccagcucagcaaggaggcccugcugaagcucggcccccugccccgccugcucaacgacaucuccaccgcccugcggaacccgaacauccagcgccagcccagccggcaguccgagcgcccccggccccagccggugguccugcgcgggcccagcgcggagaugcagggcuacaugaugcgcgaccucaacuccagcaucgaccugcaguccuucauggcccgggggcugaacagcuccauggacauggcccgccuccccagccccaccaaggagaagccgcccccgccgccgcccggcggcgggaaggaccuguucuacgugucccggccgccccuggcccgcagcagccccgcguacugcacguccagcuccgacaucaccgagcccgagcagaagaugcucagcgugaacaaguccgucagcaugcuggaccugcagggcgacgggcccggcgggcggcucaacuccagcuccgugagcaaccuggccgccgugggcgaccugcuccacuccagccaggccucccugaccgccgcgcugggccuccgccccgcccccgccgggcggcugagccagggcuccgggagcuccaucaccgccgccggcaugcgccugagccagaugggggucacgaccgacggcgugcccgcgcagcagcuccggaucccccuguccuuccagaacccgcuguuccacauggccgccgacggccccgggccgcccggcgggcacggcgggggcggcgggcacggcccgcccagcagccaccaccaccaccaccaccaccaccaccaccgcgggggcgagccgcccggcgacaccuucgcccccuuccacggguacuccaagagcgaggaccucuccagcggcgugcccaagccgcccgccgcguccauccugcacagccacuccuacagcgacgaguucgggcccuccggcaccgacuucacgcggcgccagcugagccuccaggacaaccugcagcacaugcuguccccgccccagaucaccaucgggccccagcggcccgcccccagcggccccggcgggggcuccgggggcgggagcggcggcgggggcgggggccagcccccgccccuccagcgcgggaagucccagcagcugaccgucagcgccgcccagaagccccggcccuccagcggcaaccugcuccagucccccgagcccagcuacggccccgcgcgcccccggcagcagagccuguccaaggaggggagcaucggcggguccggcggcagcgggggcgggggcgggggcggccugaagccguccaucaccaagcagcacagccagacccccuccacgcucaaccccaccaugccggccagcgagcgcaccguggccuggguguccaacaugccccaccugagcgccgacaucgaguccgcccacaucgagcgggaggaguacaagcugaaggaguacagcaaguccauggacgagagccgccucgaccgcgucaaggaguacgaggaggagauccacucccugaaggagcggcugcacaugagcaaccgcaagcucgaggaguacgagcggcgccugcugucccaggaggagcagaccagcaagauccucaugcaguaccaggcgcggcuggagcaguccgagaagcgccugcggcagcagcaggccgagaaggacagccagaucaagagcaucaucgggcgccucaugcugguggaggaggagcugcggcgcgaccaccccgccauggccgagccccucccggagcccaagaagcggcugcuggacgcccaggagcgccagcucccgccccugggccccacgaacccccgggugacccuggcgccgcccuggaacgggcucgccccgcccgcgcccccgccgccgccccgccugcagaucaccgagaacggcgaguuccggaacaccgccgaccacuga

SEQ ID NO: 37345 - RNA, 702 nt, Artificial Sequence
  derived and/or modified sequence opt1 from SYNGR1__Homo_sapiens__NP_004702
auggagggcggggccuacggcgccgggaaggcgggcggggccuucgaccccuacacccuggugcgccagccgcacaccauccuccgggucgugagcuggcuguucuccaucguggucuucggcagcaucgugaacgagggcuaccugaacuccgccagcgagggggaggaguucugcaucuacaaccgcaaccccaacgccugcuccuacggcguggccgucggggugcucgcguuccugacgugccugcucuaccuggcccuggacguguacuucccccagaucagcuccgucaaggaccggaagaaggccgugcucagcgacaucggcguguccgccuucugggcguuccugugguucgucggguucugcuaccuggccaaccaguggcaggucagcaagcccaaggacaacccgcucaacgagggcaccgacgccgcccgcgccgcgaucgccuucuccuucuucagcaucuucaccugggccggccaggccgugcuggccuuccagcgguaccagaucggggcggacuccgcccuguucagccaggacuacauggaccccucccaggacagcuccaugcccuacgcccccuacguggagccgaccggccccgaccccgccgggaugggcggcacguaccagcagcccgccaacaccuucgacaccgagccgcagggguaccagagccagggcuacuga

SEQ ID NO: 37346 - RNA, 675 nt, Artificial Sequence
  derived and/or modified sequence opt1 from SYNGR2__Homo_sapiens__NP_004701
auggagagcggcgccuacggggccgcgaaggccggcggguccuucgaccugcgccgguuccucacccagccccagguggucgcccgcgccgugugccugguguucgcccugaucgucuucagcugcaucuacggcgagggguacuccaacgcgcacgagagcaagcagauguacugcguguucaaccggaacgaggacgccugccgcuacggcuccgccaucggcgugcucgccuuccuggcgagcgccuucuuccuggucguggacgccuacuucccccagaucuccaacgccaccgaccggaaguaccucgugaucggggaccugcuguucagcgcccucuggacguuccugugguucgucggcuucugcuuccugaccaaccagugggcggugaccaaccccaaggacgugcucgucggggccgacuccgugcgcgccgccaucaccuucagcuucuucuccaucuucagcuggggcgugcuggccucccuggcguaccagcgguacaaggccggggucgacgacuucauccagaacuacguggaccccacgcccgacccgaacaccgccuacgccagcuaccccggcgccuccguggacaacuaccagcagccgcccuucacccagaacgcggagaccacggagggcuaccagcccccgcccgucuacuga

SEQ ID NO: 37347 - RNA, 3888 nt, Artificial Sequence
  derived and/or modified sequence opt1 from SYNJ1__Homo_sapiens__NP_001153774
auggccuucagcaagggcuuccgcaucuaccacaagcuggaccccccgcccuucucccucaucguggagacccggcacaaggaggagugccugauguucgagagcggggccgucgcggugcuguccagcgccgagaaggaggccaucaagggcaccuacuccaaggugcucgacgccuacgggcugcugggcguccuccgccugaaccugggggacacgaugcuccacuaccuggugcuggugaccggcugcaugagcgucggcaagauccaggaguccgagguguuccgggugaccagcaccgaguucaucucccuccgcaucgacagcuccgacgaggaccggaucagcgagguccgcaaggugcugaacuccgggaacuucuacuucgccuggagcgcguccggcaucagccuggaccucucccugaacgcccaccggagcaugcaggagcagacgaccgacaaccgcuucuucuggaaccagucccugcaccuccaccugaagcacuacggggugaacugcgacgacuggcugcuccggcugaugugcggcggggucgagauccgcaccaucuacgccgcccacaagcaggcgaaggccugccugaucagccggcucagcugcgagcgcgccggcacccgguucaacgugcgcggcacgaacgacgacgggcacguggccaacuucgucgagaccgagcaggugguguaccuggacgacuccgucagcuccuucauccagauccggggcagcgugccccuguucugggagcagcccgggcuccaggugggcucccaccgcguccggaugagccgcggcuucgaggccaacgcgccggccuucgaccggcacuuccgcacccugaagaaccuguacgggaagcagaucaucgugaaccuccugggcuccaaggagggggagcacaugcugagcaaggccuuccagucccaccucaaggccagcgagcacgccgcggacauccagauggugaacuucgacuaccaccagauggucaagggcgggaaggccgagaagcugcacuccgugcugaagccccagguccagaaguuccucgacuacggcuucuucuacuucaacggcagcgaggugcagcggugccaguccgggaccgugcgcacgaacugccuggacugccuggaccgcaccaacagcguccaggccuuccucggccuggagaugcuggccaagcagcucgaggcccuggggcuggcggagaagccccagcucgugacccgguuccaggagguguuccgcuccauguggagcgucaacggcgacuccaucagcaagaucuacgccgggaccggcgcccuggagggcaaggccaagcugaaggacggggcccgguccgugacgcgcaccauccagaacaacuucuucgacagcagcaagcaggaggcgaucgacgugcuccugcugggcaacacccugaacuccgaccucgccgacaaggcccgggcccugcugaccacggggagccuccgcgucuccgagcagacccugcagagcgcguccagcaaggugcugaaguccaugugcgagaacuucuacaaguacagcaagcccaagaagauccgggugugcgucggcaccuggaacgugaacgggggcaagcaguuccgcuccaucgccuucaagaaccagacccucacggacuggcugcuggacgccccgaagcucgccggcauccaggaguuccaggacaagcggagcaagcccaccgacaucuucgccaucggguucgaggagaugguggagcugaacgcgggcaacaucgucuccgccagcaccaccaaccagaagcugugggccguggagcuccagaagacgaucucccgcgacaacaaguacgugcugcuggccagcgagcagcucgucggggugugccuguucguguucauccggccccagcacgcccccuucauccgcgacgucgcgguggacaccgugaagaccggcaugggcggggccaccggcaacaagggggccgucgccauccggaugcuguuccacacgaccucccucugcuucgugugcagccacuucgccgcgggccagucccaggugaaggagcgcaacgaggacuucaucgagaucgcccggaagcugagcuucccgauggggcgcaugcuguucagccacgacuacgucuucuggugcggcgacuucaacuaccggaucgaccuccccaacgaggaggugaaggagcugauccgccagcagaacugggacucccugaucgccggcgaccagcucaucaaccagaagaacgccgggcagguguuccggggcuuccuggaggggaaggucaccuucgcgcccaccuacaaguacgaccuguucagcgacgacuacgacacguccgagaagugccgcacccccgccuggaccgaccgcgugcucuggcggcgccggaaguggccguucgaccgcagcgccgaggaccuggaccugcucaacgccuccuuccaggacgagagcaagauccuguacaccuggacccccggcacgcugcuccacuacgggcgggccgagcugaagaccuccgaccaccgccccguggucgcgcugaucgacaucgacaucuucgagguggaggccgaggagcggcagaacaucuacaaggaggugaucgccguccagggccccccggacggcaccgugcucgugagcaucaaguccagccugcccgagaacaacuucuucgacgacgcccugaucgacgagcuccugcagcaguucgccuccuucggggaggucauccugauccgcuucguggaggacaagaugugggugaccuuccucgagggcagcuccgcgcugaacguccugagccucaacgggaaggagcugcugaaccggacgaucaccaucgcccucaagucccccgacuggaucaagaaccuggaggaggagaugagccuggagaagaucuccaucgcccuccccagcuccaccagcagcacccugcugggcgaggacgccgagguggccgcggacuucgacauggagggggacguggacgacuacuccgccgaggucgaggagcuccugccgcagcaccugcagcccagcuccagcuccggccucggcacgagccccuccagcuccccccgcaccagcccgugccagucccccaccaucagcgaggggcccgugccgucccugcccauccggcccagccgcgcccccucccggaccccgggcccccccagcgcccaguccagccccaucgacgcgcagccggccacgccccugccccagaaggaccccgcccagccgcucgagcccaagcgcccccccccgccccggcccguggcccccccgacccgccccgcccccccccagcggccgccccccccguccggggcgcgcagccccgcccccacccggaaggaguucggcgcccccaagagcccggggaccacgcgcaaggacaacaucggccggucccagcccagcccccaggccggccuggccgggcccggcccggcgggguacuccaccgcccgccccaccauccccccccgcgccggcgucaucagcgccccgcagucccacgcccgggcgagcgccggccgccugacccccgagucccagagcaagacguccgagaccagcaagggguccaccuuccuccccgagccccugaagccgcaggccgccuuccccccccagagcucccugcccccgcccgcccagcggcuccaggagccccuggugcccguggcggccccgaugccccagagcggcccccagcccaaccuggagaccccgccccagcccccgccccgcucccggagcucccacagccuccccuccgaggccagcagccagccccagcaggagcagccguccggguga

SEQ ID NO: 37348 - RNA, 438 nt, Artificial Sequence
  derived and/or modified sequence opt1 from SYNJ2BP__Homo_sapiens__NP_060843
augaacggccgcguggacuaccuggucaccgaggaggagaucaaccucacccgggggcccagcggccugggguucaacaucgugggcgggacggaccagcaguacguguccaacgacagcggcaucuacgucucccgcaucaaggagaacggcgccgccgcgcuggacgggcggcuccaggagggcgacaagauccugagcgugaacgggcaggaccugaagaaccuccugcaccaggacgccguggaccuguuccgcaacgccggcuacgccgucucccuccgggugcagcaccgccuccaggugcagaacgggccgaucggccaccggggcgagggggaccccagcggcauccccaucuucaugguccuggugcccguguucgcccugaccauggucgcggccugggccuucaugcgcuaccggcagcagcuguga

SEQ ID NO: 37349 - RNA, 3780 nt, Artificial Sequence
  derived and/or modified sequence opt1 from SYNJ2__Homo_sapiens__NP_001171559
augaucuacauggacgacggcgugagcuccuucguccagauccgcgggagcgugccccuguucugggagcagccgggccuccagguggggucccaccaccugcggcugcaccgcggccucgaggccaacgcccccgcguucgaccggcacaugguccugcugaaggagcaguacgggcagcaggugguggucaaccuccugggcagccgcggcggggaggaggugcugaaccgggccuucaagaagcuccugugggccuccugccacgccggcgacacccccaugaucaacuucgacuuccaccaguucgccaaggggggcaagcuggagaagcucgagacccugcugcgcccccagcucaagcugcacugggaggacuucgacguguucacgaagggggagaacgucagcccgcgguuccagaagggcacccugcgcaugaacugccucgacugccuggaccggaccaacaccgugcaguccuucaucgcgcuggaggugcuccaccugcagcugaagacgcucggccugagcuccaagcccaucgucgaccgcuucguggagagcuucaaggccauguggucccugaacgggcacagccucuccaagguguucaccggcagccgggcccuggaggggaaggccaaggucggcaagcugaaggacggcgcgcgcuccaugagccggaccauccaguccaacuucuucgacggggugaagcaggaggccaucaagcuccugcuggugggcgacgucuacggggaggagguggccgacaagggcgggaugcuccuggacagcaccgcccugcucgugacgccccgcauccugaaggccaugaccgagcggcaguccgaguucaccaacuucaagcgcauccggaucgcgaugggcaccuggaacgucaacggcgggaagcaguuccgcagcaacgugcugcggacggccgagcucaccgacuggcugcuggacagcccccagcucuccggcgccaccgacagccaggacgacuccagcccggccgacaucuucgccgugggguucgaggagauggucgagcuguccgcgggcaacaucgugaacgccagcaccacgaacaagaagauguggggggagcagcugcagaaggccaucucccgcagccaccgguacauccuccugaccuccgcccagcuggucggcgugugccucuacaucuucgugcgccccuaccacguccccuucauccgcgacguggccaucgacaccgugaagaccggcauggggggcaaggcggggaacaagggcgccgucgggauccgguuccaguuccacagcacguccuucugcuucaucugcagccaccugaccgccggccagucccaggugaaggagcgcaacgaggacuacaaggagaucacccagaagcugugcuuccccaugggccggaacguguucagccacgacuacgucuucuggugcggggacuucaacuaccgcaucgaccugaccuacgaggagguguucuacuucgugaagcggcaggacuggaagaagcuccuggaguucgaccagcugcagcuccagaaguccagcggcaagaucuucaaggacuuccacgagggggccaucaacuucggcccgacguacaaguacgacgucggcuccgccgcguacgacaccagcgacaagugccgcacccccgccuggaccgaccgggugcugugguggcgcaagaagcaccccuucgacaagacggccggggagcugaaccuccuggacuccgaccuggacguggacaccaagguccggcacaccuggagccccggcgcccuccaguacuacgggcgcgcggagcugcaggccagcgaccaccggccggugcuggccaucguggaggucgaggugcaggagguggacgucggcgcccgcgagcggguguuccaggagguguccagcuuccaggggccccucgacgccaccgucguggugaaccugcagucccccacgcuggaggagaagaacgaguuccccgaggaccuccgcaccgagcugaugcagacccugggcagcuacggcaccaucguccucgugcggaucaaccaggggcagaugcuggugacguucgcggacucccacagcgcccuguccguccucgacguggacggcaugaaggugaaggggcgcgccgucaagauccggccgaagaccaaggacuggcugaagggccugcgcgaggagaucauccggaagcgcgacagcauggcccccgugucccccaccgccaacagcugccuccuggaggagaacuucgacuucaccucccuggacuacgagagcgagggggacauccucgaggacgacgaggacuaccugguggacgaguucaaccagcccggcgucuccgacagcgagcugggcggggacgaccucuccgacgugccgggccccaccgcgcuggccccccccagcaaguccccggcccugacgaagaagaagcagcaccccaccuacaaggacgacgccgaccucguggagcugaagcgcgagcuggaggccgucggggaguuccggcaccgcagccccagccggucccucagcgugccgaaccgcccccggcccccccagccgccccagcgcccccccccgcccaccggccugauggugaagaaguccgcgagcgacgccuccaucagcuccgggacccacggccaguacagcauccugcagacggcccggcuccugcccggcgccccccagcagccgcccaaggcgcgcaccgggaucuccaagcccuacaacgucaagcagaucaagaccaccaacgcccaggaggccgaggccgccauccggugccugcucgaggcgcgcggcggggccagcgaggaggcccuguccgccguggccccccgggaccuggaggcgagcuccgagccggagcccacgcccggcgccgccaagcccgagaccccgcaggcccccccccuccugccccgccggccgcccccccgcgugccggccaucaagaagcccacccugcggcgcaccgggaagccccucagccccgaggagcaguucgagcagcagacgguccacuucaccaucggcccgcccgagaccuccguggaggcgccccccguggucaccgccccgcgggugccccccgugcccaagccgcgcacguuccagcccggcaaggccgccgagcggcccagccaccgcaagcccgcguccgacgaggccccgcccggggccggcgccagcgucccccccccgcuggaggcccccccccuggugcccaaggucccgccccggcgcaagaaguccgcgcccgccgccuuccaccuccaggugcugcagagcaacagccagcugcuccaggggcugaccuacaacuccagcgacucccccagcggccacccgcccgccgccggcaccguguucccccagggggacuuccuguccaccagcuccgcgacgagcccggacuccgacggcaccaaggccaugaagcccgaggccgccccccuccugggggacuaccaggaccccuucuggaaccugcuccaccacccgaagcugcugaacaacaccuggcucagcaaguccagcgacccccuggacuccggcacccgcagccccaagcgggaccccaucgacccggucuccgccggggcgagcgccgccaaggccgagcugccccccgaccacgagcacaagacgcucggccacugggugaccaucuccgaccaggagaagcgcaccgcccugcagguguucgacccccuggcgaagaccuga

SEQ ID NO: 37350 - RNA, 3762 nt, Artificial Sequence
  derived and/or modified sequence opt1 from SYNM__Homo_sapiens__NP_056101
augcugagcuggcgccuccagaccggccccgagaaggccgagcugcaggagcugaacgcccggcucuacgacuacgugugccgcguccgggagcuggagcgcgagaaccugcuccuggaggaggagcugcgggggcgccggggccgcgaggggcucugggcggagggccaggcccggugcgccgaggaggcccgcucccugcggcagcagcuggacgagcucagcugggccaccgcgcuggccgagggggagcgcgacgcccugcggcgcgagcuccgggagcugcagcgccuggacgccgaggagcgggcggcccgcggccggcucgacgccgagcugggcgcccagcagcgcgagcugcaggaggcccucggggcgcgggccgcccuggaggcccugcucggccgccugcaggccgagcgccgggggcuggacgcggcccacgagcgcgacgugcgggagcuccgcgcccgggccgccucccugacgaugcacuuccgcgcgcgggccaccggcccggccgccccgccgccccgccugcgggaggugcacgacagcuacgcccuccuggucgcggaguccuggcgcgagaccgugcagcuguacgaggacgaggugcgggagcucgaggaggcccugcgccgggggcaggagagccgccugcaggccgaggaggagacccggcucugcgcccaggaggcggaggcccugcgccgggaggcccugggccucgagcagcugcgcgcccggcuggaggacgcccuccugcgcaugcgcgaggaguacggcauccaggcggaggagcggcagcgcgucaucgacugccuggaggacgagaaggccacgcucacccuggccauggccgacuggcugcgggacuaccaggaccuccuccaggugaagaccgggcugucccuggagguggccaccuaccgcgcgcugcuggagggcgagagcaaccccgagaucgucaucugggccgagcacguggagaacaugcccuccgaguuccggaacaagagcuaccacuacacggacucccugcuccagcgcgagaacgagcggaaccuguucagccgccagaaggcgccccuggccuccuucaaccacagcuccgcccucuacagcaaccuguccgggcaccggggcagccagaccggcaccuccaucgggggcgacgcccgccggggguuccugggcagcggguacagcuccagcgccaccacgcagcaggagaacuccuacggcaaggccgugagcucccagaccaacguccgcaccuucagccccaccuacggccuccugcggaacacggaggcccaggugaagaccuuccccgaccgccccaaggcgggggacacccgggaggugcccgucuacaucggcgaggacuccaccaucgcccgcgagagcuaccgggaccgccgggacaagguggccgccggggccuccgagagcacgcgcuccaacgagcggaccgugauccugggcaagaagaccgaggucaaggcgacccgcgagcaggagcgcaaccggcccgagacgauccgcaccaagccggaggagaagauguucgacagcaaggagaaggccuccgaggagcggaaccuccgcugggaggagcugaccaagcuggacaaggaggcccggcagcgcgagagccagcagaugaaggagaaggccaaggagaaggacucccccaaggagaaguccgugcgggagcgcgaggugcccaucagccucgaggucagccaggaccggcgcgccgaggugucccccaaggggcugcagaccccggugaaggacgcgggcggcgggacgggccgggaggccgaggcccgcgagcugcgguuccgccucgggaccagcgacgccaccggcagccugcagggggacuccaugaccgagacggucgccgagaacaucgugaccagcauccugaagcaguucacccagucccccgagaccgaggcgagcgccgacuccuuccccgacacgaaggucaccuacguggaccggaaggagcuccccggcgagcgcaagaccaagaccgagaucguggucgagagcaagcugaccgaggacguggacguguccgacgaggccggccuggacuaccuccugagcaaggacaucaaggaggucgggcugaagggcaaguccgccgagcagaugaucggggacaucaucaaccucggccugaagggccgggaggggcgcgcgaagguggugaacgucgagaucguggaggagccggugagcuacgucuccggcgagaagcccgaggaguucagcgugcccuucaagguggaggaggucgaggacgugucccccgggccguggggccuggugaaggaggaggagggguacggcgagagcgacgucacguucuccgugaaccagcaccggcgcaccaagcagccccaggagaacaccacccacguggaggaggucacggaggccggcgacagcgagggggagcaguccuacuucgugagcacccccgacgagcaccccggcgggcacgaccgcgacgacggcagcguguacgggcagauccacaucgaggaggaguccaccauccgguacagcuggcaggacgagaucguccagggcacccgccggcgcacgcagaaggacggcgccgugggggagaagguggucaagccgcucgacgugcccgcccccucccuggagggcgaccuggggagcacccacuggaaggagcaggcccgguccggcgaguuccacgcggagccgaccgugaucgagaaggagaucaagaucccccacgaguuccacaccagcaugaaggggaucuccagcaaggagccccgccagcagcucgucgaggugaucggccagcuggaggagacgcugcccgagcggaugcgcgaggagcucuccgcccugacccgggagggccagggcgggccggggagcguguccgucgacgugaagaaggugcagggcgccgggggcagcuccgucacccugguggccgaggugaacgucagccagaccguggacgccgaccgccucgaccuggaggagcuguccaaggacgaggcgagcgagauggagaaggccguggaguccgucgugcgggagagccucucccgccagcggagccccgcccccggcagccccgacgaggagggcggggccgaggccccggcggccgggauccgcuuccggcgcugggccacgcgggagcuguacauccccuccggcgagagcgagguggccggcggggccucccacagcuccggccagcgcacgccccaggggcccgucagcgcgaccguggagguguccagcccgaccggcuucgcccagucccagguccuggaggacgugagccaggccgcccggcacaucaagcucgggcccuccgagguguggcgcaccgagcggaugagcuacgagggccccaccgcggaggucguggagauggacgucuccaacguggaggccauccgcagccgcacccaggaggccggcgcccuggggguguccgaccggggcagcuggcgcgacgccgacucccggaacgaccaggcggucggggugagcuucaaggccuccgccggcgagggggaccaggcccaccgcgagcagggcaaggagcaggccauguucgacaagaaggugcagcugcagcggauggucgaccagcgcagcgugaucagcgacgagaagaagguggcgcuccuguaccuggacaacgaggaggaggagaacgacggccacugguucuga

SEQ ID NO: 37351 - RNA, 3282 nt, Artificial Sequence
  derived and/or modified sequence opt1 from SYNPO2__Homo_sapiens__NP_001122405
augggcaccggggacuucaucugcaucagcaugaccggcggggcccccuggggcuuccgccugcaggggggcaaggagcagaagcagccgcuccagguggccaagauccggaaccaguccaaggcgagcggcuccgggcugugcgagggcgacgaggucgugagcaucaacgggaaccccugcgccgaccugacguaccccgaggugaucaagcucauggaguccaucaccgacagccugcagaugcugaucaagcgccccuccagcggcaucuccgaggcccucaucagcgagaacgagaacaagaaccuggagcaccugacccacgggggcuacgucgaguccaccacgcuccagauccggccggccaccaagacccagugcaccgaguucuuccuggcccccgugaagacggaggugccccuggcggagaaccagcgcagcggccccgacugcgccgggucccucaaggaggagaccggcccgagcuaccagcgggccccccagaugcccgacucccagcgcgggcgggucgccgaggagcugauccugcgcgagaagguggaggcggugcagcccggcccggucguggagcuccagcugagccugucccaggagcggcacaagggcgccagcgggccccucguggcccugcccggcgccgagaaguccaagagccccgacccggaccccaaccugagccacgaccgcaucguccacaucaacuccauccccaccaacgagaaggccgaccccuuccuccggagcuccaagaucauccagaucagcuccgggcgcgagcugcgggugauccaggagagcgaggcgggcgacgccgggcugccgcgcguggaggucauccucgacugcuccgaccggcagaagaccgagggcugccgccugcaggccggcaaggagugcguggacagccccguggaggggggccaguccgaggccccccccagccuggucuccuucgccgugagcuccgaggggacggagcagggcgaggacccgcggagcgagaaggaccacucccgcccccacaagcaccgggcgcgccacgcccggcuccgccgcagcgagucccugagcgagaagcaggugaaggaggccaaguccaagugcaagagcaucgcccugcuccugaccgacgcccccaaccccaacagcaaggggguccugauguucaagaagcggcgccggcgcgcgcggaaguacacccucguguccuacggcaccggcgagcuggagcgcgaggccgacgaggaggaggagggggacaaggaggacacgugcgagguggccuuccugggcgccagcgaguccgaggucgacgaggagcuccugagcgacguggacgacaacacccaggucgugaacuucgacugggacuccgggcugguggacaucgagaagaagcucaaccggggcgacaagauggagaugcugccggacaccaccgggaagggcgcccugauguucgcgaagcgccgggagcgcauggaccagaucacggcccagaaggaggaggacaaggucggcgggacccccagccgggagcaggacgccgcccagaccgacggccuccgcaccacgaccuccuaccagcggaaggaggaggagagcgugcgcacccaguccagcguguccaagagcuacaucgaggucucccacgggcugggccacgugccccagcagaacggcuucagcgggaccuccgagacggcgaacauccagcggauggugccgaugaaccgcaccgccaagcccuuccccggcagcgucaaccagcccgccaccccguucucccccacccggaacaugacgagccccaucgccgacuuccccgccccgccccccuacagcgcggugacccccccgcccgacgccuucucccgcggggugagcucccccaucgccggccccgcccagccgccccccuggccccagccggcccccuggagccagcccgcguucuacgacuccagcgagcggaucgccucccgcgacgagcgcaucagcguccccgccaagcggaccgggauccugcaggaggccaagcgccgguccaccacgaagccgauguucaccuucaaggagcccaaggugagccccaacccggagcuccugucccugcuccagaacagcgagggcaagcgcggcaccggggccggcggggacuccggccccgaggaggacuaccugagccugggggcggaggccugcaacuucaugcaguccagcuccgccaagcagaagaccccccccccgguggcccccaagcccgcggucaagagcuccagcagccagcccgugaccccggugucccccgucuggagccccggcguggcccccacgcagccgcccgccuuccccaccuccaaccccagcaagggcaccguggucuccagcaucaagaucgcccagccguccuacccccccgcccggcccgcgagcacccugaacguggccgggccguucaagggcccccaggccgccguggccucccagaacuacacgcccaagcccaccgucagcaccccgaccgugaacgcggugcagcccggggccgucggccccuccaacgagcuccccgggaugagcggccgcggcgcccagcuguucgccaagcggcagucccgcauggagaaguacgugguggacagcgacacgguccaggcccacgcggcccgggcccaguccccgacccccagccugcccgccuccuggaaguacagcuccaacgugcgcgcgccgccccccguggccuacaaccccauccacagcccgagcuacccccucgccgcccugaagucccagcccagcgccgcgcagcccuccaagauggggaagaagaagggcaagaagccgcugaacgcccucgacgucaugaagcaccagcccuaccagcugaacgccagccuguucaccuuccagccccccgacgccaaggacgggcucccgcagaaguccagcgugaaggugaacuccgcccuggcgaugaagcaggcccugcccccccggcccgucaacgccgccagcccgaccaacgugcaggccuccagcguguacuccguccccgcguacacgagcccccccuccuucuucgccgaggccagcuccccggugagcgccucccccgugcccgucggcauccccaccagcccgaagcaggaguccgccagcagcuccuacuucguggcgccccgccccaaguucagcgccaagaaguccggggugaccauccaggucuggaagcccagcgugguggaggaguga

SEQ ID NO: 37352 - RNA, 2058 nt, Artificial Sequence
  derived and/or modified sequence opt1 from SYNPO__Homo_sapiens__NP_001103444
auggagggcuacagcgaggaggccucccugcuccgccaccuggagaagguggccagcgaggaggaggaggucccccuggugguguaccucaaggagaacgcggcccugcugaccgccaacgggcuccaccugucccagaaccgggaggcccagcagagcuccccggccccgccgcccgcggagguccacagccccgccgccgacgugaaccagaaccuggccucccccagcgcgacccucacgacccccaccuccaacagcucccacaacccgcccgccaccgacgugaaccagaacccgcccgccacggucgugccccagagccugccccuguccagcauccagcagaacuccagcgaggcccagcuccccuccaacggcaccgggcccgccagcaagcccuccacccugugcgcggacggccagccccaggcccccgccgaggaggugcgcugcagcacccugcucaucgacaaggucagcacgcccgccaccaccaccuccacguucagccgggaggccacccugauccccuccagccgcccgcccgcguccgacuucaugagcuccagccugcucaucgacauccagcccaacacccuggugguguccgccgaccaggagaugagcgggcgggccgccgccaccacgcccaccaaggucuacuccgaggugcacuucacccuggcgaagccgcccagcguggucaaccgcaccgcccggcccuucggcauccaggcccccggcgggacgucccagauggagcgcagcccgaugcucgagcggcgccacuucggcgagaaggcccccgcgccccagccgcccucccugcccgaccggagcccccgcccgcagcggcacaucaugucccgcagccccaugguggagcggcgcaugauggggcagcggucccccgccagcgagcgccggccccugggcaacuucaccgccccgcccaccuacaccgagacgcucagcaccgcgccccuggccuccugggugcgcagcccgcccuccuacagcguccuguaccccuccagcgaccccaaguccagccaccucaaggggcaggccgugcccgccuccaagaccggcauccuggaggagagcauggcccggcgcggcucccgcaagagcauguucaccuucguggagaagccgaaggucacgcccaaccccgaccugcucgaccuggugcagaccgccgacgagaagcggcgccagcgggaccagggggaggugggcgucgaggaggagcccuucgcccugggggcggaggccuccaacuuccagcaggagccggcgccccgcgaccgggccagccccgccgccgccgaggaggugguccccgagugggccuccugccucaagagcccgcgcauccaggccaagcccaagcccaagccgaaccagaaccuguccgaggccagcggcaagggcgcggagcuguacgcccggcgccagagccggauggagaaguacgugaucgaguccagcucccacacccccgagcucgcccgcugccccagccccaccaugucccugccgagcuccuggaaguaccccacgaacgcccccggggcguuccggguggccagccgcucccccgcccggaccccgcccgccagccuguaccacggcuaccuccccgagaacgggguccugcgccccgagccgaccaagcagccgcccuaccagcugcggcccucccucuucgugcugagccccaucaaggagcccgccaaggugagcccccgcgcggccucccccgccaagccguccagccuggaccucguccccaaccugcccaagggcgcccugcccccgucccccgcccucccccggcccagccgcuccagcccggggcuguacaccagccccggccaggacucccugcagcccacggcggugagcccgcccuacggcggggacaucucccccgugagccccucccgggccuggagcccgcgcgccaagcaggcgccccgccccuccuucagcacccggaacgccggcaucgaggcccaggucuggaagcccuccuucugcuucaaguga

SEQ ID NO: 37353 - RNA, 858 nt, Artificial Sequence
  derived and/or modified sequence opt1 from SYNPR__Homo_sapiens__NP_001123475
auggaccccgugagccagcuggccuccgccggcaccuuccgcguccucaaggagccgcuggcguuccugcgggcccucgagcugcuguucgccaucuucgccuucgcgaccugcgggggcuacagcgggggccuccgccuguccguggacugcgugaacaagacggagagcaaccuguccaucgacaucgccuucgccuaccccuuccggcuccaccaggucaccuucgaggugccgaccugcgaggggaaggagcgccagaagcuggcccugaucggcgacagcuccagcuccgccgaguucuucgugaccgucgcgguguucgccuuccucuacagccuggccgccacgguggucuacaucuucuuccagaacaaguaccgggagaacaaccgcggcccccugaucgacuucaucgugaccguggucuucuccuuccucuggcugguggggagcuccgccugggcgaagggccugagcgacgugaaggucgccaccgaccccaaggaggugcuccugcugauguccgccugcaagcagcccagcaacaagugcauggccauccacucccccgugaugagcucccucaacaccagcgucguguucggguuccugaacuucauccugugggccggcaacaucugguucguguucaaggagacgggguggcacagcuccggccagcgguaccucagcgaccccauggagaagcacuccagcuccuacaaccagggcggguacaaccaggacagcuacggcuccagcuccggguacagccagcaggcgucccugggcccgaccagcgacgaguucggccagcagcccaccgggcccaccuccuucacgaaccagaucuga

SEQ ID NO: 37354 - RNA, 942 nt, Artificial Sequence
  derived and/or modified sequence opt1 from SYP__Homo_sapiens__NP_003170
augcugcuccuggccgacauggacguggucaaccagcugguggccggcgggcaguuccgcguggucaaggagccccucggcuucgugaaggugcugcagugggucuucgcgaucuucgccuucgcgaccugcgggagcuacuccggcgagcugcagcucagcguggacugcgccaacaagaccgaguccgaccugagcaucgagguggaguucgaguacccguuccggcugcaccaggucuacuucgacgcccccacgugccgcgggggcaccaccaagguguuccucgugggcgacuacuccagcuccgccgaguucuucgucaccguggccguguucgccuuccuguacagcaugggggcccuggcgacguacaucuuccuccagaacaaguaccgggagaacaacaagggccccaugcuggacuuccuggccaccgccgucuucgccuucauguggcucguguccagcuccgccugggcgaaggggcugagcgacgugaagauggccaccgaccccgagaacaucaucaaggagaugccggucugccgccagaccggcaacacgugcaaggagcugcgggaccccgugaccuccgggcucaacaccagcguggucuucggcuuccugaaccuggugcucugggugggcaaccugugguucgucuucaaggagaccgggugggccgcccccuuccugcgcgccccgccgggcgcgcccgagaagcagcccgcccccggggacgccuacggcgacgccggcuacgggcagggccccgggggcuacgggccccaggacuccuacggcccccagggcggguaccagcccgacuacggccagccggccgggagcggcggguccggcuacggcccccagggggacuacggccagcagggguacggcccccagggggcgcccacgagcuucuccaaccagauguga

SEQ ID NO: 37355 - RNA, 780 nt, Artificial Sequence
  derived and/or modified sequence opt1 from SYPL1__Homo_sapiens__NP_006745
auggcccccaacaucuaccuggugcgccagcggaucagccgccucggccagcggauguccggguuccagaucaaccugaacccgcugaaggagccccucggcuucaucaagguccuggaguggaucgccagcaucuucgcguucgccaccugcgggggcuucaaggggcagaccgagauccaggugaacugcccccccgccgugacggagaacaagaccgucaccgccaccuucggcuacccguuccgccugaacgaggccuccuuccagcccccccccggcgugaacaucugcgacgugaacuggaaggacuacguccucaucggggacuacagcuccagcgcgcaguucuacgugacguucgccguguucgucuuccuguacugcaucgccgcccugcuccuguacgugggcuacaccucccuguaccucgacagccggaagcugccgaugaucgacuucguggucacccugguggcgaccuuccucuggcugguguccacgagcgccugggccaaggcccugaccgacaucaagaucgccaccgggcacaacaucaucgacgagcucccccccugcaagaagaaggcgguccugugcuacuucggcuccgugaccagcauggggucccugaacgugagcgucaucuucggcuuccucaacaugauccuguggggcgggaacgccugguucguguacaaggagacgucccugcacagccccuccaacaccagcgccccgcacucccagggcgggauccccccccccaccggcaucuga

SEQ ID NO: 37356 - RNA, 831 nt, Artificial Sequence
  derived and/or modified sequence opt1 from SYPL2__Homo_sapiens__XP_011539585
augagcuccaccgagagcgccggccgcaccgccgacaagagcccccggcagcaggucgaccgccugcucguggggcugcgguggcgccggcuggaggagccgcucggcuucaucaaggugcugcaguggcuguucgcgaucuucgccuucggguccugcggcuccuacagcggggagacgggcgccauggugcgcugcaacaacgaggccaaggacgucuccagcaucaucguggccuucggcuaccccuuccggcuccaccgcauccaguacgagaugccccugugcgacgaggaguccagcuccaagaccaugcaccugaugggggacuucagcgcgcccgccgaguucuucgugacccucggcaucuucuccuucuucuacaccauggccgcccuggucaucuaccugcgguuccacaaccucuacacggagaacaagcgcuucccgcugguggacuucugcgugaccgucagcuucaccuucuucuggcugguggcggccgccgccugggggaagggccucaccgacgugaagggggccacgcggcccuccagccugaccgcggccauguccgucugccacggcgaggaggccgugugcagcgccggcgccacccccuccauggggcuggcgaacaucagcguccucuucggcuucaucaacuucuuccugugggccgggaacugcugguucguguucaaggagacccccuggcacggccagggccaggggcaggaccaggaccaggaccaggaccagggccaggggccgagccaggaguccgccgccgagcagggcgccguggagaagcagauccaccacguguga

SEQ ID NO: 37357 - RNA, 1296 nt, Artificial Sequence
  derived and/or modified sequence opt1 from SYT11__Homo_sapiens__NP_689493
auggccgagaucaccaacauccgccccagcuucgacguguccccggucguggccggccugaucggggcgagcgugcucgucgugugcguguccgucaccguguucguguggagcugcugccaccagcaggccgagaagaagcagaagaacccgcccuacaaguucauccacaugcugaagggcaucuccaucuaccccgagacgcugagcaacaagaagaagaucaucaagguccggcgcgacaaggacgggcccggccgggagggcgggcgccggaaccuccugguggacgccgccgaggccggccugcucucccgcgacaaggacccccgggggcccagcuccggcagcugcaucgaccagcugcccaucaagauggacuacggggaggagcugcgcuccccgaucaccagccucacccccggcgaguccaagaccacgagccccuccagccccgaggaggacgugaugcuggggucccugaccuucagcgucgacuacaacuucccgaagaaggcgcucguggugaccauccaggaggcccacggccugcccgucauggacgaccagacccagggcuccgaccccuacaucaagaugacgauccugcccgacaagcggcaccgcgugaagacccgggugcuccgcaagacccuggacccggucuucgacgagaccuucacguucuacgggauccccuacagccagcugcaggaccucgugcugcacuuccuggugcucagcuucgaccgguucucccgcgacgacgucaucggcgaggugauggugccccuggccggggucgaccccagcaccggcaaggugcagcugacccgggacaucaucaagcgcaacauccagaagugcaucucccggggcgagcuccaggucagccuguccuaccagccgguggcccagcgcaugaccguggucgugcugaaggcgcggcaccuccccaagauggacaucacggggcugagcggcaaccccuacgugaaggucaacguguacuacgggcgcaagcggaucgccaagaagaagacccacgugaagaagugcacccugaaccccaucuucaacgaguccuucaucuacgacaucccgaccgaccuccugcccgacaucagcaucgaguuccuggucaucgacuucgaccgcacgaccaagaacgagguggugggccgccucauccugggggcccacuccgucaccgccagcggcgccgagcacuggcgggaggugugcgagagcccccgcaagcccguggcgaaguggcacucccuguccgaguacuga

SEQ ID NO: 37358 - RNA, 1266 nt, Artificial Sequence
  derived and/or modified sequence opt1 from SYT12__Homo_sapiens__NP_001171351
auggccguggacgucgccgaguaccaccugagcgugaucaagagcccgcccggcugggaggugggggucuacgcggccggcgcccucgcccugcuggggaucgccgcggugagccucuggaagcuguggaccuccggcagcuuccccucccccagccccuucccgaacuacgacuaccgcuaccugcagcagaaguacggggaguccugcgccgaggcccgggagaagcgcgugcccgccuggaacgcgcagcgggccagcacccgcggcccgcccucccggaagggcagccucuccaucgaggacacguucgagagcaucuccgagcuggggccccuggagcucaugggccgcgagcuggaccuggcccccuacgggacccuccgcaagagccaguccgccgacagccugaacuccaucagcuccgucagcaacaccuucggccaggacuucacccugggccagguggaggugagcauggaguacgacacggccucccacacccucaacgucgcggugaugcaggggaaggaccugcuggagcgggaggaggccagcuucgaguccugcuucaugcgggugagccuccugcccgacgagcagaucgucggcaucucccgcauccagcggaacgccuacagcaucuucuucgacgagaaguucuccaucccccuggacccgaccgcccucgaggagaagucccugcgcuucuccguguucgggaucgacgaggacgagcggaacgugagcaccggcgucguggagcugaagcucuccgugcuggaccugccccuccagcccuucagcggguggcuguaccugcaggaccagaacaaggccgcggacgccgucggcgagauccuccugucccugagcuaccuccccacggccgagcgccugaccgugguggucgugaaggccaagaaccugaucuggaccaacgacaagaccacggccgacccguucgugaaggucuaccuccugcaggacggccggaagauguccaagaagaagaccgcggugaagcgcgacgaccccaaccccgucuucaacgaggccaugaucuucagcgugcccgccaucgugcugcaggaccucucccugcgggucaccguggccgagagcuccagcgacgggcgcggcgacaacguggggcacgucaucaucggcccgagcgccuccgggaugggcaccacgcacuggaaccagaugcuggcgacccuccggcgccccgugagcauguggcacgccgugcggcgcaacuga

SEQ ID NO: 37359 - RNA, 1281 nt, Artificial Sequence
  derived and/or modified sequence opt1 from SYT13__Homo_sapiens__NP_065877
auggugcugagcguccccgugaucgcccucggcgccacccuggggaccgcgacguccauccuggcccucugcggcgugaccugccugugccgccacaugcacccgaagaaggggcugcucccccgggaccaggaccccgaccuggagaaggccaagcccagccugcucggcuccgcccagcaguucaacgucaagaaguccaccgagccggugcagccccgcgcccugcugaaguuccccgacaucuacgggccccggccggcggugaccgcccccgaggucaucaacuacgccgacuacagccuccgcagcacggaggagcccaccgcccccgcguccccgcagccgcccaacgacagccggcugaagcgccaggugaccgaggagcuguucauccucccccagaacggcguggucgaggacgugugcgugauggagaccuggaaccccgagaaggccgccuccuggaaccaggcccccaagcugcacuacugccuggacuacgacugccagaaggccgagcuguucgucacgcggcucgaggcggugaccagcaaccacgacggcgggugcgacugcuacgugcagggcuccgucgccaaccgcaccgggagcguggaggcccagaccgcccugaagaagcggcagcuccacacgaccugggaggagggccuggugcugccccucgccgaggaggagcugcccaccgcgacccugacgcucacccugcggaccugcgaccgcuucucccgccacagcgucgccggggagcugcggcucggccuggacggcaccuccgugccgcugggggccgcccaguggggcgagcucaagacgagcgccaaggagcccuccgcgggggccggcgaggugcugcugagcaucuccuaccuccccgccgccaaccgccugcuggucgugcucaucaaggccaagaaccugcacagcaaccagagcaaggagcugcucggcaaggacguguccgucaaggugacccugaagcaccaggcgcggaagcugaagaagaagcagaccaagcgcgccaagcacaagaucaaccccgucuggaacgagaugaucauguucgagcucccggacgaccugcugcaggccagcuccguggagcucgaggugcuggggcaggacgacagcggccaguccugcgcccuggggcacugcagccugggccuccacaccuccgggagcgagcggucccacugggaggagaugcugaagaacccccgccggcagaucgcgauguggcaccagcugcaccucuga

SEQ ID NO: 37360 - RNA, 1860 nt, Artificial Sequence
  derived and/or modified sequence opt1 from SYT14__Homo_sapiens__NP_001139733
auggccagcgccuccuggcgccugaagguggagcgggagcccguggaguacaugaaccucagcgugcuggagaagaucggcuacuucuccguggcgcgccuggaguacagcgggaccauccucgcccacugcaacuuccggcugcugggcuccaacgacagcuccgccagcgccucccaggucaccgggacgaccgugagcccggaggccgugggcuuccucuccgcggucgggguguucaucauccugaugcugcuccuguuccuguacaucaacaagaaguucugcuucgagaacgugggcggcuuccccgaccucgggagcgaguacuccacccgcaagaacagccaggacaagaucuacaacuccuacauggacaaggacgagcacggcagcuccagcgaguccgaggacgaggcccuggggaaguaccacgaggcccugagccggacccacaacagccgccucccccuggccgacucccggcagcgcaacuacgcgugggagacgcggcagaaguacagcccccuguccgccgaguacgacggcuacagcuccgaggccagcaucgacgaggggaacugcauccagcgcaugcggcgcaccccgccccucgacgagcugcagcccccgcccuaccaggacgacuccggcagcccccaccuguccugcacccccagcgagaucggcgacuccaagugcgaguucagccacugcuccaacagcccccggugcuccuacaacaagugcccgagcgagggguccaccggccacgagaucgagagcuuccacaacaagggguacgaggaggacguccccuccgacagcacggccgugcucagccccgaggacauguccgcccagggcagcuccagccagcugcccaagccguucgaccccgagcccgaggcgaaguacggcacccuggacgugaccuucgacuacgacucccaggagcagaagcuccuggucaccgugacggccgugaccgacauccccaccuacaaccgcaccgggggcaacagcuggcagguccaccuggugcuccugccgaucaagaagcagcgggccaagacguccauccagcgcgggcccugccccguguucaccgagaccuucaaguucaaccacgucgagagcgagaugaucggcaacuacgccgugcgguuccgccuguacggggugcaccggaugaagaaggagaagaucgucggcgagaagaucuucuaccucaccaagcugaaccugcagggcaagaugucccuccccgugauccuggagccgagcuacaaccacuccgggugcgacagccagauguccgugagcgagauguccugcagcgaguccacgagcagcugccagucccuggagcacggcagcguccccgagauccucaucgggcugcuguacaacgccaccaccggccgccucuccgcggaggugaucaaggggagccacuucaagaaccuggccgccaaccggccgcccaacggccuguucugcugccucaagcaccugaucggcgggcaggucuacaucauccgcgacaccuacgugaagcugacgcuccugaacuccaugggccaggagaugagcaagugcaagaccuccauccgccgggggcagcccaaccccguguacaaggagaccuucgucuuccagguggcccuguuccagcucagcgacgugacccugauccuguccgucuacaacaagcgcagcaugaagcggaaggagaugaucggcuggaucucccuggggcucaacagcuccggcgaggaggagcugaaccacuggacggagaugaaggagagcaagggccagcaggucugccgcuggcacgcccugcucgaguccuga

SEQ ID NO: 37361 - RNA, 1260 nt, Artificial Sequence
  derived and/or modified sequence opt1 from SYT1__Homo_sapiens__NP_001278830
auggugagcgagucccaccacgaggcccuggccgcgcccccggucaccaccguggccacggugcuccccagcaacgccaccgagcccgccucccccggcgaggggaaggaggacgccuucagcaagcugaaggagaaguucaugaacgagcugcacaagaucccgcucccgcccugggcgcugaucgccaucgccaucgucgccgugcugcucgugcugaccugcugcuucugcaucugcaagaagugccuguucaagaagaagaacaagaagaagggcaaggagaagggcgggaagaacgcgaucaacaugaaggacgucaaggaccucgggaagaccaugaaggaccaggacgacgacgccgagacgggccugaccgacggcgaggagaaggaggagcccaaggaggaggagaagcuggggaagcuccaguacucccuggacuacgacuuccagaacaaccagcugcucgugggcaucauccaggccgccgagcugcccgcccuggacaugggcgggaccagcgaccccuacgugaaggucuuccuccugcccgacaagaagaagaaguucgagaccaaggugcaccgcaagacgcugaaccccguguucaacgagcaguucaccuucaaggucccguacuccgagcucgggggcaagacccuggugauggcgguguacgacuucgaccgguucagcaagcacgacaucaucggcgaguucaagguccccaugaacaccguggacuucgggcacgugacggaggaguggcgcgaccugcaguccgccgagaaggaggagcaggagaagcucggcgacaucugcuucagccugcgguacguccccaccgccgggaagcugaccguggugauccucgaggccaagaaccugaagaagauggacgucggcggccuguccgaccccuacgugaagauccaccucaugcagaacgggaagcgccugaagaagaagaagaccacgaucaagaagaacacccugaacccguacuacaacgagagcuucuccuucgaggugcccuucgagcagauccagaagguccagguggucgugaccgugcucgacuacgacaagaucggcaagaacgacgccaucgggaaggucuucgugggcuacaacagcaccggggcggagcugcggcacugguccgacaugcuggccaacccccgccggcccaucgcccaguggcacacgcuccagguggaggaggaggucgacgccaugcuggccgugaagaaguga

SEQ ID NO: 37362 - RNA, 1278 nt, Artificial Sequence
  derived and/or modified sequence opt1 from SYT4__Homo_sapiens__NP_065834
auggcccccaucaccaccagccgcgaggaguucgacgagaucccgacgguggucggcaucuucuccgccuucgggcugguguucaccgugagccucuucgcguggaucugcugccagcggaaguccagcaaguccaacaagaccccgcccuacaaguucguccacgugcugaagggcguggacaucuaccccgagaaccugaacagcaagaagaaguucggggccgacgacaagaacgaggucaagaacaagcccgccgugcccaagaacucccuccaccuggaccuggagaagcgcgaccucaacggcaacuuccccaagaccaaccugaagcccgggagcccguccgaccuggagaacgccacgcccaagcuguuccuggagggcgagaaggagagcgugucccccgagagccugaaguccagcaccucccucaccagcgaggagaagcaggagaagcugggcacccuguucuucucccucgaguacaacuucgagcggaaggccuucgucgugaacaucaaggaggcgcgcgggcugcccgccauggacgagcagagcaugacguccgacccguacaucaagaugaccauccugcccgagaagaagcacaaggugaagacccggguccuccgcaagacccuggaccccgccuucgacgagacguucaccuucuacggcauccccuacacccagauccaggagcuggcccuccacuucaccauccugagcuucgaccgguucagccgcgacgacaucaucggggaggugcugaucccgcucuccggcaucgagcugagcgaggggaagaugcugaugaaccgggagaucaucaagcgcaacgugcggaaguccagcggccgcggcgagcuccugaucucccugugcuaccagagcacgaccaacacccucaccgucguggugcugaaggcgcggcaccuccccaaguccgacgucagcgggcucuccgaccccuacgugaaggugaaccuguaccacgccaagaagcgcaucagcaagaagaagacgcacgucaagaagugcacccccaacgccguguucaacgagcuguucguguucgacaucccgugcgagggccucgaggacaucuccgucgaguuccuggugcuggacagcgagcgggggucccgcaacgaggucaucggccagcucgugcugggcgccgccgcggaggggaccggcggggagcacuggaaggagaucugcgacuacccccggcgccagaucgccaaguggcacgugcugugcgacggcuga

SEQ ID NO: 37363 - RNA, 900 nt, Artificial Sequence
  derived and/or modified sequence opt1 from SYT6__Homo_sapiens__XP_011539054
augcccuggcgcaacaaggaggccagcuccccgagcuccgccaacccgccccuggaggcgcuccagagccccuccuuccggggcaacauggccgacaagcugaaggaccccagcacccugggguuccucgaggccgccgugaagaucucccacaccagccccgacauccccgccgagguccagauguccgugaaggagcacaucaugcgccacacgcggcugcagcgccagaccaccgagcccgcgagcuccacccggcacacgagcuucaagcgccaccucccgcggcagaugcacguguccagcgucgacuacggcaacgagcugccgcccgccgccgagcagcccaccuccaucgggcgcaucaagcccgagcuguacaagcagaaguccguggacggcgaggacgccaagagcgaggcgaccaagagcugcgggaagaucaacuucucccugcgguacgacuacgagaccgagacgcucaucgugcgcauccugaaggccuucgaccugcccgccaaggacuucugcggcagcagcgaccccuacgucaagaucuaccuccugcccgaccggaagugcaagcugcagacccgcgugcaccggaagacccucaacccgaccuucgacgagaacuuccacuuccccgugcccuacgaggagcuggccgaccgcaagcugcaccucuccgucuucgacuucgaccgguucagccgccacgacaugaucggcgaggugauccuggacaaccuguucgaggccuccgaccucagccgggagacguccaucuggaaggacauccaguacgcgaccagccuggacugggggcugugcuccacccuccugcccggcgacccgagccagcagcgccugcaccucgacaccgggccccacuccuga

SEQ ID NO: 37364 - RNA, 1476 nt, Artificial Sequence
  derived and/or modified sequence opt1 from SYT9__Homo_sapiens__NP_783860
augcccggcgcccgcgacgcccugugccaccaggcgcuccagcugcuggccgagcucugcgcccgcggggcccuggagcacgacagcugccaggacuucaucuaccaccuccgggaccgggcccgcccgcggcugcgcgaccccgacaucuccgugagccugcugacccucgucgugaccgcgugcggccuggcccuguucggggugucccucuucgucagcuggaagcugugcugggugcccuggcgggagcgcggccugcccuccgggagcaaggacaacaaccaggagccgcucaacuacauggacacggagaccaacgagcaggagaacuccgaggacuuccuggacccgcccacccccugccccgacagcuccaugaagaucagccacaccucccccgacaucccccugagcacgcagaccggcauccaggagaacugcgcccacggcgugcggguccagcgccaggugaccgagcccaccuccagcgcccggcacaacuccauccgccggcagcucaaccugagcaacccggacuucaacauccagcagcugcagaagcaggagcagcucacggggaucggccgcaucaagcccgagcuguacaagcagcggucccuggacaacgacgacgggcgccggagcaacuccaaggcgugcggcaagcucaacuucauccugaaguacgacugcgaccuggagcagcucaucgugaagauccacaaggccgucaaccugcccgccaaggacuucagcgggaccagcgaccccuacgugaagaucuaccugcucccggaccgcaagaccaagcaccagaccaaggugcaccggaagacgcugaaccccgucuucgacgagguguuccuguuccccgugcccuacaacgaccucgaggcccgcaagcugcacuucuccgucuacgacuucgaccgguucagccgccacgaccugaucggccaggugguggucgaccacuuccucgaccuggccgacuucccgcgcgagugcauccuguggaaggacaucgaguacgugaccaacgacaacguggaccucggcgagcugauguucucccugugcuaccuccccaccgcggggcggcugaccaucacgaucaucaaggcccgcaaccugaaggccauggacaucaccggcgccagcgaccccuacgucaaggugucccucaugugcgacgggcggcgccugaagaagcggaagaccagcaccaagcgcaacacgcugaaccccguguacaacgaggccaucgucuucgacgugccgcccgagaacaucgaccagauccaccucuccaucgcggucauggacuacgaccgggugggccacaacgagaucaucggcgugugccaggucgggaacgaggccgagcgccugggccgggaccacuggagcgagaugcuguccuacccccgcaagcccaucgcccacuggcacagccugguggagaagcgguga

SEQ ID NO: 37365 - RNA, 954 nt, Artificial Sequence
  derived and/or modified sequence opt1 from SYTL1__Homo_sapiens__XP_011540618
augcgcccccugcggcgcggcagcgggcggcuccgccugcagauccugcggcgccggccgcgcccccggaagauccucgccaaggagaccaaccgcuccgugccccggcgccugacccggagcuggagcccccgccggggcgagucccgcucccgggggccgagcaagcccuccuacgucaagagcuaccugcuccccgacaagcaguccaagcgcaagacggccgugaagaagcggaaccugaaccccguguucaacgagacccugcgcuacagcgucccgcaggcggagcuccagggccgggugcugucccugagcguguggcaccgcgagucccucgggcgcaacaucuuccugggcgaggucgaggugccccuggacaccugggacuggggcagcgagcccaccuggcucccccugcagccgcgggugccgcccucccccgacgaccugcccagccgcgggcuccuggcccugucccucaaguacguccccgccggcagcgagggggccggccugccgcccuccggggagcugcacuucugggugaaggaggcccgggaccuccugccccugcgcgcgggcagccucgacacguacgugcagugcuucguccugcccgacgacagccaggccucccggcagcgcacccggguggugcgccggagccugucccccgucuucaaccacaccaugguguacgacggcuucgggcccgccgaccuccgccaggccugcgcggagcugagccugugggaccacggcgcccucgccaaccggcagcucgggggcacccgccugucccugggcacggggagcuccuacggccuccaggugccguggauggacagcacccccgaggagaagcagcuguggcaggcccugcuggagcagcccugcgagugggucgacgggcugcucccccugcggaccaaccuggccccgcgcaccuga

SEQ ID NO: 37366 - RNA, 2805 nt, Artificial Sequence
  derived and/or modified sequence opt1 from SYTL2__Homo_sapiens__NP_001156423
augaucgaccugagcuuccucaccgaggaggagcaggaggccaucaugaaggugcugcagcgcgacgccgcgcugaagcgggccgaggaggagcgcguccggcaccuccccgagaagaucaaggacgaccagcagcugaagaacauguccggccagugguucuacgaggccaaggccaagcgccaccgggacaagauccacggggccgacaucauccgcgcgagcaugcggaagaagcgcccgcagaucgccgccgagcaguccaaggaccgggagaacggcgccaaggagagcugggugaacaacgugaacaaggacgcguuccugccgcccgagcucgccggggucguggaggagcccgaggaggacgccgccccggccucccccagcuccagcguggucaaccccgcguccagcgugaucgacaugucccaggagaacacccgcaagcccaacgugagcccggagaagcggaagaaccccuucaacuccagcaagcugcccgagggccacuccagccagcagacgaagaacgagcaguccaagaacgggcgcaccggccuguuccagaccagcaaggaggacgagcucuccgagagcaaggagaaguccaccgucgccgacacgagcauccagaagcuggagaaguccaagcagacccugcccggccucagcaacgggagccagaucaaggccccgauccccaaggcccggaagaugaucuacaaguccaccgaccugaacaaggacgacaaccagagcuucccccgccagcggaccgacucccugaaggcccgcggcgcgccccgggggauccucaagcgcaacagcuccagcuccagcacggacuccgagacccugcgguacaaccacaacuucgagcccaagagcaagaucgugucccccggccugaccauccacgagcgcaucagcgagaaggagcacucccucgaggacaacagcucccccaacagccuggagccccugaagcacgugcgguucagcgccgucaaggacgagcucccgcagucccccgggcugauccacggccgcgaggugggcgaguucagcgugcuggaguccgaccgccucaagaacgggauggaggacgccggcgacaccgaggaguuccagagcgaccccaagcccucccaguaccggaagccgagccuguuccaccaguccacgagcucccccuacgucagcaaguccgagacccaccagcccaugaccagcggguccuuccccaucaacggccugcacagccacuccgaggugcucaccgcccgcccgcagagcauggagaacucccccacgaucaacgagcccaaggacaagagcagcgagcugacccggcuggaguccgugcucccgcgcagccccgccgacgagcugucccacugcgucgagcccgagcccagccaggugccgggcggguccagccgggaccgccagcagggcuccgaggaggagcccagccccgugcugaagacccucgagcgguccgcggcccgcaagaugcccagcaagucccuggaggacaucagcuccgacagcuccaaccaggccaaggucgacaaccagccggaggagcuggugcggagcgccgaggacguguccaccguccccacgcagcccgacaaccccuucagccacccggacaagcucaagcgcauguccaagagcgugcccgccuuccugcaggacgagagcgacgaccgggagaccgacaccgcguccgagagcuccuaccagcugagccgccacaagaagucccccagcucccucaccaaccugagcuccagcuccgggaugacgagccuguccagcgucuccggcagcgugauguccguguacagcggggacuucggcaaccucgaggucaagggcaacauccaguucgccaucgaguacguggagucccugaaggagcugcacguguucgucgcccagugcaaggaccucgccgcggccgacgugaagaagcagcggagcgaccccuacgugaaggccuaccugcugccggacaaggggaagaugggcaagaagaagacccucgucgugaagaagacccugaaccccguguacaacgagauccugcgcuacaagaucgagaagcagauccugaagacccagaagcucaaccugagcaucuggcaccgggacacguucaagcgcaacuccuuccugggggaggucgagcucgaccuggagaccugggacugggacaacaagcagaacaagcagcugcggugguacccccucaagcgcaagaccgcccccguggcccuggaggcggagaaccggggcgagaugaagcuggcccuccaguacgugccggagcccguccccgggaagaagcugcccaccacgggcgaggugcacaucugggugaaggagugccuggaccucccgcugcugcgcggcagccaccucaacuccuucgucaagugcaccauccugcccgacaccagccgcaagucccggcagaagacccgcgccguggggaagacgaccaaccccaucuucaaccacaccaugguguacgacggcuuccggccggaggaccugauggaggccugcgucgagcucaccgugugggaccacuacaagcugaccaaccaguuccucgggggccugcgcaucggguucggcacgggcaagagcuacgggaccgagguggacuggauggacuccaccagcgaggaggucgcccugugggagaagauggugaacucccccaacaccuggaucgaggcgacgcugccccuccggaugcugcugaucgccaagaucagcaaguga

SEQ ID NO: 37367 - RNA, 2259 nt, Artificial Sequence
  derived and/or modified sequence opt1 from SYTL5__Homo_sapiens__NP_001156806
augagcaagaacuccgaguucaucaaccugagcuuccuccuggaccacgagaaggagaugauccugggcgugcucaagcgcgacgaguaccugaagaaggucgaggacaagcggauccgcaagcugaagaacgagcuccuggaggccaagcggcgcuccgggaagacccagcaggaggccagccgggugugcgugcacugccaccgcaaccugggccucaucuucgaccgcggggaccccugccaggcgugcucccugcgggucugccgggagugccgcguggccggcccgaacgggagcuggaagugcaccgugugcgacaagaucgcccagcugcggaucaucacgggcgagugguucuucgaggagaaggccaagcgcuucaagcaggucaacgugcucggcaccgacgugguccggcaguccauccugcgccggagccccggggccgaggaggugcagucccaggagcagacccgccaggacgcggagaaguccgacaccagccccguggccggcaagaaggccagccacgacgggcccaagcggaagggcuuccugcucuccaaguuccgcagcgccacgcgcggggagaucaucaccccgaagaccgacaccggccgguccuacagccuggaccuggacggccagcacuuccggucccucaagagcccgcccggguccgaccgcggcagcacggggagcuccgaccugaacgaccaggagcccggcccccgcacccccaagagcucccggagcaacggcgucacccccgggacccaguccagccccgcgccguccacgcgcaccgugaccagcgugaucucccgggaguacggcuucgagaacagcauggaccuggccgccaucgaggggaccucccaggagcucaccaagagccaccgccggaacacguccggcacccccagcaucgccgucuccgggaccagccuguccagcgaccagucccgcagcgagcuggaccucagcgaguccuucacggaggacagcgaggacaccguguccauccggagcaaguccgugcccggcgcccuggacaaggacagccuggaggagaccgaggaguccaucgacgcgcucgucagcucccagcugagcaccaacacgcaccgccuggccuccggccucagcaccuccagccaggccggguccgaccggaaguggaccuaccugaacgugcccgacgccgacagcgacaccacgucccugaacagcaugaugagcguguacuccgagaccggcgacuacgggaacgucaaggugagcggcgagauccuccugcacaucuccuacugcuacaagaccgggggccuguacaucuucgugaagaacugccgcaaccucgccaucggcgacgagaagaagcagcggaccgacgcguacgucaagagcuaccugcugccggacaagucccgcaacaacaagcggaagacgaagauccgcaccgggaccaaccccgaguucaacgagacccucaaguacacgaucagccacacccagcuggagacccggacccugcagcucuccguguggcacuacgaccgcuucggccggaacagcuuccugggggaggucgagauccccuucgacuccuggaacuucgagaaccccaccgacgagugguucgugcugcagccgaagguggaguucgcccccgacaucggccuccaguacaagggggagcugacggucgugcugcgcuacaucccgcccgaggagaaccucaugcugccgcccgagcagcugcagggcaacaagaccuucaagaagggcaagaagaaggagagccccgugaucuccgggggcauccuggaggucuucaucaaggaggccaagaaccucaccgccgucaagagcgggggcaccuccgacagcuucgugaagggcuaccugcugcccgacgacuccaaggccacgaagcacaagacccucgugaucaagaaguccgugaacccccaguggaaccacaccuucauguucagcgggauccacccccaggacaucaagaacgugugccuggagcugaccaucugggacaaggaggcguucagcuccaacaucuuccucggcgggguccggcugaacagcggcagcggggugucccacggcaagaacguggacuggauggacagccagggcgaggagcagcgccuguggcagaagauggccaacaaccccgggacgccguucgagggcguccucaugcugcgcuccagcauggggaagugccggcuguga

SEQ ID NO: 37368 - RNA, 1851 nt, Artificial Sequence
  derived and/or modified sequence opt1 from SYVN1__Homo_sapiens__NP_115807
auguuccgcaccgccgugaugauggccgcgagccuggcccucaccggcgccgucguggcccacgccuacuaccugaagcaccaguucuaccccacgguggucuaccugaccaaguccagcccguccauggcggugcucuacauccaggccuucgugcuggucuuccugcucgggaaggugaugggcaagguguucuucgggcagcugcgggccgccgagauggagcaccugcucgagcgcagcugguacgcggucaccgagaccugccuggccuucacgguguuccgggacgacuucuccccccgcuucguggcccuguucacccuccugcuguuccucaagugcuuccacuggcuggccgaggaccgggucgacuucauggagcgcagccccaacaucuccuggcuguuccacugccggaucgugagccucauguuccugcugggcauccucgacuuccuguucgugucccacgccuaccacagcauccugacccgcggggcguccguccagcucguguucggcuucgaguacgccauccugaugaccauggugcugacgaucuucaucaaguacguccuccacagcguggaccugcaguccgagaaccccugggacaacaaggccguguacaugcuguacaccgagcucuucaccggcuucaucaagguccugcuguacauggccuucaugaccaucaugaucaaggugcacacguucccgcucuucgccauccggcccauguaccuggcgaugcgccaguucaagaaggccgugaccgacgccaucaugagccggcgcgccauccggaacaugaacacccuguaccccgacgccacccccgaggagcuccaggcgauggacaacgucugcaucaucugccgcgaggagauggugacgggggccaagcggcugccgugcaaccacaucuuccacaccuccugccugcgcagcugguuccagcggcagcagaccugccccaccugccgcauggacguccuccgggccucccugcccgcccagagccccccgccccccgagcccgccgaccagggcccgccccccgcgccccacccgcccccccugcucccccagccgcccaacuucccccaggggcugcugcccccguucccccccggcauguucccgcucuggccccccauggggcccuucccgcccgugccccccccgcccuccagcggcgaggccguggccccccccagcacguccgccgcgcugagccgcccguccggcgccgccaccaccaccgccgccgggacgagcgcgaccgccgccuccgccaccgccagcggccccggguccggcagcgcgcccgaggccggccccgccccgggguuccccuucccccccccguggaugggcaugccccugccccccccguucgccuucccccccaugccggucccccccgccggguucgcgggccucacccccgaggagcugcgggcccuggaggggcacgagcgccagcaccuggaggcccgccuccagucccugcggaacauccacacgcugcucgacgccgcgaugcugcagaucaaccaguaccugaccgugcucgccagccugggcccgccccgccccgccaccuccgugaacagcaccgaggagacggccaccaccgucguggccgcggccuccagcaccuccauccccagcuccgaggccacgaccccgacccccggcgccagcccccccgccccggagauggagcggccccccgcgcccgaguccguggggaccgaggagaugccggaggacggcgagcccgacgccgccgagcugcgccggcgccggcuccagaagcuggagagccccgucgcccacuga

SEQ ID NO: 37369 - RNA, 1020 nt, Artificial Sequence
  derived and/or modified sequence opt1 from TAAR1__Homo_sapiens__NP_612200
augaugcccuucugccacaacaucaucaacaucagcugcgugaagaacaacugguccaacgacguccgcgccagccuguacucccucauggugcugaucauccugaccacccucgugggcaaccugaucgucaucgugagcaucucccacuucaagcagcugcacacgccgaccaacuggcucauccacagcauggccaccguggacuuccugcuggggugccucgucaugcccuacuccauggugcggagcgcggagcacugcugguacuucggcgagguguucugcaagauccacaccuccacggacaucaugcugagcuccgccagcaucuuccaccuguccuucaucagcaucgaccgcuacuacgccgucugcgacccccuccgguacaaggccaagaugaacauccuggugaucugcgugaugaucuucaucuccuggagcguccccgccguguucgcguucgggaugaucuuccuggagcucaacuucaagggcgccgaggagaucuacuacaagcacgugcacugccgcgggggcugcuccgucuucuucagcaagaucuccggcgugcugaccuucaugaccagcuucuacaucccggggagcaucaugcugugcguguacuaccggaucuaccucaucgccaaggagcaggcccgccugaucuccgacgcgaaccagaagcugcagaucggccucgagaugaagaacgggaucagccaguccaaggagcggaaggccgucaagacccugggcaucgugauggggguguuccugaucugcuggugccccuucuucaucugcacggucauggaccccuuccuccacuacaucaucccgcccacccugaacgacgugcugaucugguucggcuaccucaacagcaccuucaaccccaugguguacgccuucuucuaccccugguuccgcaaggcccugaagaugaugcuguucggcaagaucuuccagaaggacuccagccggugcaagcuguuccucgagcuguccagcuga

SEQ ID NO: 37370 - RNA, 1056 nt, Artificial Sequence
  derived and/or modified sequence opt1 from TAAR2__Homo_sapiens__NP_001028252
auggccgugagcuccgagcagcacgagcugagccacuucaagcgcacccagaccaagaaggagaaguucaacugcuccgaguacggcaaccggagcugccccgagaacgagcgcucccucggggugcggguggccauguacagcuucauggcgggcuccaucuucaucacgaucuucgggaaccuggccaugaucaucagcaucuccuacuucaagcagcugcacaccccgaccaacuuccucauccugagcauggccaucaccgacuuccugcucggcuucacgaucaugcccuacuccaugauccgcagcguggagaacugcugguacuucgggcugaccuucugcaagaucuacuacuccuucgaccugaugcucagcaucaccuccaucuuccaccugugcagcgucgccaucgaccgguucuacgccaucugcuacccccugcucuacuccaccaagaucacgauccccgugaucaagcgccugcugcuccugugcuggagcgugccgggcgcguucgccuucggcgucguguucuccgaggccuacgccgacgggaucgagggcuacgacauccugguggcgugcagcagcuccugccccgucauguucaacaagcucugggggaccacccuguucauggccggcuucuucacccccgggagcaugauggugggcaucuacggcaagaucuucgccgugucccggaagcacgcccacgccaucaacaaccugcgcgagaaccagaacaaccaggucaagaaggacaagaaggcggccaagacgcucgggaucgugaucggcguguuccugcugugcugguuccccugcuucuucaccauccuccuggacccguuccugaacuucagcacccccgucguccucuucgacgcccugaccugguucggguacuucaacuccacgugcaacccccugaucuacggcuucuucuaccccugguuccggcgcgcccucaaguacauccugcugggcaagaucuucagcuccugcuuccacaacaccauccucugcaugcagaaggagagcgaguga

SEQ ID NO: 37371 - RNA, 1014 nt, Artificial Sequence
  derived and/or modified sequence opt1 from TAAR5__Homo_sapiens__NP_003958
augcgcgccguguucauccagggcgccgaggagcaccccgcggccuucugcuaccaggucaacggguccugcccgcggaccgugcacacccugggcauccagcucgugaucuaccuggccugcgccgccgggaugcugaucaucguccucggcaacguguucguggcguucgccgucuccuacuucaaggcccugcacacgcccaccaacuuccugcuccugagccuggcccucgcggacauguuccuggggcugcucgugcugccccuguccaccauccgcagcguggaguccugcugguucuucggcgacuuccucugccggcugcacaccuaccuggacacccucuucugccugacgagcaucuuccaccugugcuucaucuccaucgaccgccacugcgccaucugcgacccccuccuguacccgagcaaguucaccguccggguggcccugcgcuacauccucgccggcuggggcgugcccgccgcguacaccucccuguuccuguacacggacgucguggagacccggcucagccaguggcuggaggagaugcccugcgugggguccugccagcugcuccugaacaaguucuggggguggcugaacuucccccucuucuucgucccgugccugaucaugaucagccuguacgugaagaucuucguggucgccacccgccaggcccagcagaucaccacgcucuccaagagccuggccggcgccgcgaagcacgagcggaaggccgccaagacccuggggaucgccgugggcaucuaccuccugugcuggcugcccuucaccaucgacaccaugguggacucccuccugcacuucaucacgccgccccuggucuucgacaucuucaucugguucgccuacuucaacagcgcgugcaaccccaucaucuacguguucuccuaccagugguuccgcaaggcccucaagcugacccugagccagaagguguucagcccccagacccggaccgucgaccucuaccaggaguga

SEQ ID NO: 37372 - RNA, 1038 nt, Artificial Sequence
  derived and/or modified sequence opt1 from TAAR6__Homo_sapiens__NP_778237
augagcuccaacagcucccugcucguggccguccagcugugcuacgccaacgugaacggcagcugcgugaagauccccuucuccccggggagccgcgucauccuguacaucguguucggcuucggggcggugcucgccgucuucggcaaccugcuggugaugaucuccauccuccacuucaagcagcugcacagccccaccaacuuccugguggccucccucgccugcgccgacuuccuggucggggugaccgugaugcccuucagcaugguccggacgguggaguccugcugguacuucggccgcagcuucugcaccuuccacacgugcugcgacguggcguucugcuacuccagccuguuccaccucugcuucaucuccaucgaccgguacaucgccgucaccgacccccugguguacccgaccaaguucaccgugagcgucuccggcaucugcaucagcguguccuggauccugccccucauguacagcggggccguguucuacaccggcgucuacgacgacgggcuggaggagcugagcgacgcccucaacugcaucggcgggugccagaccguggugaaccagaacuggguccugacggacuuccuguccuucuucauccccaccuucaucaugaucauccucuacggcaacaucuuccugguggcgcgccggcaggccaagaagaucgagaacaccggcagcaagaccgaguccagcuccgagagcuacaaggcccgcgucgcccggcgcgagcggaaggccgcgaagacgcugggggugaccguggucgccuucaugaucuccuggcuccccuacagcaucgacucccugaucgacgccuucaugggcuucaucaccccggccugcaucuacgagaucugcugcuggugcgccuacuacaacagcgcgaugaacccccugaucuacgcccucuucuaccccugguuccgcaaggccaucaaggugaucgugaccgggcagguccugaagaacuccagcgccacgaugaaccuguucuccgagcacaucuga

SEQ ID NO: 37373 - RNA, 1515 nt, Artificial Sequence
  derived and/or modified sequence opt1 from TAB1__Homo_sapiens__NP_006107
auggccgcccagcgccggagccugcuccaguccgagcagcagcccagcuggaccgacgaccugccgcugugccaccucuccggcguggggagcgcguccaaccgcagcuacuccgccgacggcaaggggaccgagagccacccgcccgaggacuccuggcugaaguuccggagcgagaacaacugcuuccuguacggcgucuucaacggguacgacggcaaccgcgugacgaacuucguggcccagcggcucuccgccgagcugcugcucggccagcugaacgccgagcacgcggaggccgacguccgccgggugcugcuccaggccuucgacguggucgagcgcagcuuccuggaguccaucgacgacgcccuggcggagaaggccagccuccagucccagcugcccgagggggugccccagcaccagcugccgccccaguaccagaagauccucgagcggcugaagacccuggagcgcgagaucagcggcggggccauggccguggucgccgugcuccugaacaacaagcuguacguggcgaacgucggcaccaaccgggcccuccugugcaaguccaccguggacgggcuccaggugacgcagcugaacgucgaccacaccaccgagaacgaggacgagcuguuccgccugagccagcucggccuggacgccggcaagaucaagcaggucgggaucaucugcggccaggaguccacccggcgcaucggggacuacaaggugaaguacggcuacacggacaucgaccugcucagcgccgccaagagcaagcccaucaucgcggagcccgagauccacggcgcccagccccuggacggggugaccggcuuccuggugcucauguccgaggggcuguacaaggcccuggaggccgcccacggccccgggcaggcgaaccaggagaucgccgccaugaucgacaccgaguucgccaagcagaccagccucgacgccguggcgcaggccgucguggaccgggugaagcgcauccacuccgacacguucgccagcggcggcgagcgggcccgcuucugcccccggcacgaggacaugacccugcugguccgcaacuucggguacccgcucggcgagaugucccagcccacccccagccccgcgccggccgccgggggccggguguaccccgucuccgugcccuacagcuccgcccagagcaccuccaagacgagcgugacccugucccuggucaugcccagccaggggcagauggugaacggcgcccacuccgcgagcacccucgacgaggccaccccgacgcugaccaaccagucccccacccugacccuccagagcacgaacacccacacccaguccagcagcuccagcuccgacggcgggcuguuccgcagccgccccgcccacucccugcccccgggcgaggacgggcggguggagcccuacgucgacuucgccgaguucuaccgccuguggagcguggaccacggcgagcaguccguggucaccgcccccuga

SEQ ID NO: 37374 - RNA, 1986 nt, Artificial Sequence
  derived and/or modified sequence opt1 from TAB2__Homo_sapiens__NP_001278964
augcagaacaacaacaaccuggacgccugcugcgccgugcucagccaggaguccacccgcuaccuguacggcgagggggaccugaacuucagcgacgacuccggcaucagcgggcuccggaaccacaugaccucccugaaccuggaccuccagagccagaacaucuaccaccacggccgcgaggggucccggaugaacggcagccgcacgcugacccacuccaucagcgacggccagcugcagggcgggcaguccaacagcgagcuguuccagcaggagccccagaccgcgccggcccaggucccccagggguucaacguguucggcauguccagcuccagcggggccuccaacagcgcgccccaccucggcuuccaccugggcuccaaggggaccagcagccucucccagcagacgccccgguucaacccgaucauggugacccuggcccccaacauccagaccggccgcaacacccccacgagccugcacauccacggggugcccccgcccgugcucaacagcccccagggcaacuccaucuacauccggcccuacaucaccaccccgggcgggaccacgcgccagacccagcagcacuccggcugggugagccaguucaaccccaugaacccccagcaggucuaccagcccucccagccggggcccuggacgaccugccccgccagcaacccccugucccacacgagcucccagcagccgaaccagcagggccaccagaccagccacguguacaugcccaucuccagccccaccaccucccagcccccgacgauccacagcuccgggagcucccagagcagcgcccacucccaguacaacauccagaacaucagcaccggcccccggaagaaccagaucgagaucaagcuggagccgccccagcgcaacaacuccagcaagcuccgguccagcggcccccgcaccuccagcaccuccagcuccgugaacagccagacgcugaaccggaaccagcccaccgucuacaucgccgccuccccgcccaacaccgacgagcugaugagccgcucccagcccaagguguacaucagcgcgaacgccgccaccggggacgagcaggucaugcggaaccagcccacccucuucaucuccaccaacagcggcgccagcgccgcgucccgcaacaugagcgggcaggucuccaugggccccgccuucauccaccaccacccgcccaagagccgggccaucgggaacaacuccgccaccagcccccgcgugguggucacccagcccaacacgaaguacaccuucaagaucaccguguccccgaacaagccgcccgccgugagccccggcgucgugucccccaccuucgagcugacgaaccugcucaaccaccccgaccacuacguggagaccgagaacauccagcaccugaccgaccccacccuggcgcacgucgaccggaucagcgagacccgcaagcucuccaugggcagcgacgacgccgccuacacgcaggcccugcuggugcaccagaaggcccggauggagcgccuccagcgcgagcuggagauccagaagaagaagcuggacaagcucaaguccgaggugaacgagauggagaacaaccugacccggcgccggcugaagcgcagcaacuccaucagccagauccccucccucgaggagaugcagcagcugcggagcugcaaccgccagcugcagaucgacaucgacugccucaccaaggagaucgaccuguuccaggcgcgggggccgcacuucaaccccuccgccauccacaacuucuacgacaacaucggcuucgucgggcccgugcccccgaagcccaaggaccagcgcagcaucaucaagacccccaagacgcaggacaccgaggacgacgagggcgcccaguggaacugcaccgccugcaccuuccugaaccaccccgcccucauccggugcgagcagugcgagaugccgcgccacuucuga

SEQ ID NO: 37375 - RNA, 2139 nt, Artificial Sequence
  derived and/or modified sequence opt1 from TAB3__Homo_sapiens__XP_005274539
auggcccagagcagcccccagcuggacauccaggugcuccacgaccugcgccagcgguucccggagauccccgagggcgucgugucccagugcaugcugcagaacaacaacaaccucgaggccugcugccgcgcgcugucccaggagagcuccaaguaccuguacauggaguaccacagccccgacgacaaccggaugaaccgcaaccggcuccugcacaucaaccuggggauccacucccccagcuccuaccacccgggcgacggggcccagcucaacggcgggcgcacccuggugcacagcuccagcgacggccacaucgacccccagcacgccgccggcaagcagcugaucugccucguccaggagccccacuccgcccccgcggugguggccgccaccccgaacuacaaccccuucuucaugaacgagcagaaccggagcgccgcgacgccgcccucccagccgccccagcagcccagcuccaugcagaccgggaugaaccccagcgccaugcagggcccguccccgccgccgcccccgcccagcuacaugcacaucccccgcuacagcaccaaccccaucaccgucacggugucccagaaccugcccagcgggcagaccgugccccgggcccugcagauccucccccagauccccuccaaccuguacggcagccccggguccaucuacauccgccagaccagccaguccagcuccggccggcagacgccccagagcacccccuggcaguccagcccccagggccccgucccccacuacucccagcgcccccugcccguguacccccaccagcagaacuaccagcccagccaguacuccccgaagcagcagcagaucccccagagcgccuaccacuccccgccgcccagccagugccccucccccuucagcagcccccagcaccaggugcagcccucccagcucgggcacaucuucaugccgcccagccccuccaccaccccgccccaccccuaccagcaggggccgcccagcuaccagaagcagggcucccacagcgucgccuaccugcccuacaccgcguccagccuguccaagggcagcaugaagaagaucgagaucacgguggagcccucccagcggcccggcaccgccaucaaccgcagccccucccccaucagcaaccagcccuccccgcggaaccagcacagccucuacaccgccaccacgccgcccuccagcagccccucccgcgggaucagcucccagcccaagccgcccuucagcgugaaccccgucuacaucaccuacacccagcccaccggccccuccugcacgcccagccccuccccgcgggugauccccaaccccaccaccguguucaagaucaccgucgggcgcgccacgaccgagaaccugcugaaccucguggaccaggaggagcggagcgccgcgcccgagccgauccagcccaucuccgugauccccggcagcgggggcgagaagggcucccacaaguaccagcgcagcuccagcuccgggagcgacgacuacgccuacacccaggcccugcugcuccaccagcgggcccgcauggagcgccuggccaagcagcugaagcucgagaaggaggagcuggagcggcugaaguccgaggucaacggcauggagcacgaccucaugcagcgccggcugcgccgggugagcugcaccacggcgauccccaccccggaggagaugacccgccugcgguccaugaaccgccagcuccagaucaacguggacugcacccugaaggaggucgaccugcuccagagccgggggaacuucgaccccaaggccaugaacaacuucuacgacaacaucgagcccggccccguggucccgcccaagcccagcaagaaggacuccagcgacccgugcacgaucgagcgcaaggcccggcgcaucuccgugaccagcaaggugcaggccgacauccacgacacccaggccgcggccgccgacgagcaccggaccggguccacgcagagcccccgcacccagccccgggacgaggacuacgagggcgcccccuggaacugcgacuccugcaccuuccugaaccacccggcgcugaaccgcugcgagcagugcgagaugccccgguacaccuga

SEQ ID NO: 37376 - RNA, 390 nt, Artificial Sequence
  derived and/or modified sequence opt1 from TAC1__Homo_sapiens__NP_003173
augaagauccugguggcccucgccgucuucuuccuggugagcacccagcuguucgcggaggagaucggcgccaacgacgaccucaacuacugguccgacugguacgacagcgaccagaucaaggaggagcugcccgagccguucgagcaccuccugcagcgcaucgcccggcgccccaagccccagcaguucuucgggcugaugggcaagcgggacgccgacuccagcaucgagaagcaggucgcccugcucaaggcgcuguacgggcacggccagaucucccacaagcgccacaagaccgacagcuucguggggcugaugggcaagcgggcccucaacuccguggccuacgagcgcagcgccaugcagaacuacgagcggcgccgguga

SEQ ID NO: 37377 - RNA, 312 nt, Artificial Sequence
  derived and/or modified sequence opt1 from TAC3__Homo_sapiens__NP_001171525
augcgcaucaugcuccucuucaccgccauccuggccuucagccuggcgcaguccuucggcgccgugugcaaggagccccaggaggaggucgugcccgggggcgggcggagcaagcgcgaccccgaccucuaccagcugcugcagcggcuguucaagucccacagcucccuggagggccugcucaaggcccugagccaggccuccaccgaccccaaggagagcacgucccccgagaagcacagcccgaccgacgugaaccaggagaacguccccuccuucgggauccugaaguacccgccccgcgccgaguga

SEQ ID NO: 37378 - RNA, 291 nt, Artificial Sequence
  derived and/or modified sequence opt1 from TAC4__Homo_sapiens__NP_001070971
augcugcccugccucgcccugcugcuccugauggagcugagcgugugcaccgucgccggcgacgggggcgaggagcagacccucuccacggaggcggagaccugggagggggccggcccgagcauccagcugcagcugcaggaggugaagaccgggaaggccucccaguucuucggccucaugggcaagcgcgugggggccuaccagcuggagcacaccuuccagggccugcucgggaagcggagccuguucacggagggccgcgaggacgaggcccagggguccgaguga

SEQ ID NO: 37379 - RNA, 1188 nt, Artificial Sequence
  derived and/or modified sequence opt1 from TACC1__Homo_sapiens__NP_001116296
auggccuucagccccuggcagauccuguccccggugcagugggccaaguggaccuggagcgcgguccgcggcggggccgccggcgaggacgaggccgggggccccgagggggaccccgaggaggaggacucccaggccgagaccaagagccucuccuuccggagcggcugcaaggugaagaagcacgagacgcagucccuggcgcuggacgccugcagccgcgacgagggcgccgugaucucccagaucagcgacaucuccaaccgggacgggcacgccaccgacgaggagaagcucgcgagcaccuccugcggccagaaguccgccggggccgaggucaagggcgagcccgaggaggaccuggaguacuucgagugcagcaacgugccggugagcaccaucaaccacgccuucuccagcuccgaggccgggaucgagaaggagacgugccagaagauggaggaggacggcagcaccguccugggccuccuggagagcuccgcggagaaggcccccgugagcguguccugcgggggcgagagcccccuggacgggaucugccucuccgagagcgacaagaccgccguccugacccugauccgcgaggagaucaucacgaaggagaucgaggccaacgaguggaagaagaaguacgaggagacccggcaggaggugcucgagaugcgcaagaucguggccgaguacgagaagaccaucgcgcagaugaucgaggacgagcagcggaccuccaugacgagccagaaguccuuccagcagcugaccauggagaaggagcaggcccuggccgaccucaacagcgucgagcgcucccugagcgaccuguuccggcgcuacgagaaccucaagggcgugcuggagggcuucaagaagaacgaggaggcccugaagaagugcgcccaggacuaccucgcgcgggugaagcaggaggagcagcgcuaccaggcccugaagauccacgccgaggagaagcuggacaaggccaacgaggagaucgcccagguccggaccaaggcgaaggccgaguccgccgcccuccacgcggggcugcgcaaggagcagaugaagguggagagccuggagcgggcccuccagcagaagaaccaggagaucgaggagcugaccaagaucugcgacgagcugaucgccaagcucggcaagacggacuga

SEQ ID NO: 37380 - RNA, 8481 nt, Artificial Sequence
  derived and/or modified sequence opt1 from TACC2__Homo_sapiens__NP_001278805
augggcaacgagaacagcaccuccgacaaccagcgcacccugagcgcccagacgccccgguccgcccagccgcccgggaacagccagaacaucaagcgcaagcagcaggacacccccggcucccccgaccaccgggacgcgagcuccaucgggagcgugggccucgggggcuucugcaccgccuccgagagcuccgccagccuggacccgugccuggucucccccgaggugaccgagccccgcaaggacccccagggcgcccgggggccggagggcagccuccugcccuccccccccccgagccaggagcgcgagcaccccuccagcuccaugcccuucgccgagugccccccggaggggugccuggcgagccccgccgccgcccccgaggacggcccccagacgcagagcccgcggcgcgagcccgcgcccaacgcccccggggacaucgccgccgccuucccggcggagcgggacuccagcacccccuaccaggagaucgccgccgugcccuccgccggccgcgagcggcagcccaaggaggagggccagaagagcuccuucagcuucuccagcgggaucgaccaguccccgggcaugagccccgucccccuccgcgagccgaugaaggccccccugugcggggagggcgaccagcccggcggguucgagucccaggagaaggaggcggccggcggguuccccccggccgagagccggcagggcguggccuccgugcaggucacccccgaggcccccgcggccgcccagcaggggaccgagagcuccgccgugcuggagaagagcccccucaagccgauggcccccaucccccaggaccccgcgccgcgcgccuccgaccgggagcgcggccagggcgaggcccccccccaguaccugacggacgaccuggaguuccuccgggccugccaccugccccgcagcaacuccggggcggccccggaggccgaggugaacgccgccagccaggagagcugccagcagcccgucggcgcguaccugccccacgccgagcuccccugggggcugccgucccccgcccuggugcccgaggccggcgggagcggcaaggaggcccucgacaccaucgacgugcagggccacccccagaccgggaugcggggcaccaagccgaaccaggucgugugcguggcggccgggggccagcccgaggggggccugcccgucuccccggagcccagccugcucacgcccaccgaggaggcccaccccgccuccagccuggccuccuucccggcggcccagauccccaucgccguggaggagcccggcagcuccagccgcgaguccgugagcaaggccgggaugcccgucuccgcggacgccgccaaggaggugguggacgccggccuggucgggcucgagcggcaggugagcgaccugggcuccaagggcgagcacccggagggggaccccggcgaggugcccgcccccagcccgcaggagcgcggggagcaccugaacaccgagcagucccacgagguccagcccggcgugccccccccgccccuccccaaggagcagagccacgagguccagcccggggcgccgccccccccccugccgaaggcccccagcgaguccgcccgcggcccccccggcccgaccgacggggccaaggugcacgaggacagcacgucccccgccguggcgaaggagggcagccggucccccggggacagcccgggcgggaaggaggaggcccccgagccccccgacggcggcgacccggggaaccugcagggcgaggacucccaggccuucagcuccaagcgcgaccccgaggucgggaaggacgagcucagcaagcccuccagcgacgccgagucccgggaccaccccagcucccacagcgcccagccgccccgcaagggcggggcgggccacaccgacggcccccacucccagaccgccgaggccgacgccagcgggcugccccacaagcugggcgaggaggacccggugcucccccccgugcccgacggggcgggcgagccgaccguccccgagggggccaucugggagggcuccggccugcagcccaagugccccgacacgcugcagagccgggaggggcucggccgcauggagagcuuccugacccuggaguccgagaagagcgacuucccgcccacccccguggccgagguggcccccaaggcccaggagggggaguccacccucgagauccggaagaugggcagcugcgacggcgaggggcugcugacguccccggaccagccccgcggccccgcgugcgacgccagccggcaggaguuccacgccggggucccccacccgccccagggcgagaaccucgccgccgaccuggggcugaccgcgcucauccuggaccaggaccagcagggcauccccuccugcccgggcgagggguggauccgcggcgccgccagcgaguggccccugcucuccagcgagaagcaccugcagcccucccaggcccagcccgagaccagcaucuucgacgugcugaaggagcaggcccagccgcccgagaacgggaaggagaccucccccagccaccccggcuucaaggaccagggggcggacuccagccagauccacgugccggucgagccccaggaggacaacaaccugcccacgcacggcggccaggagcaggcccucggguccgagcugcagagccagcugcccaagggcacccucuccgacaccccgaccagcagccccacggacauggugugggaguccagccugaccgaggaguccgagcugagcgcccccacccggcagaagcuccccgcccugggggagaagcgcccggagggcgccugcggggacggccaguccagccggguguccccccccgcggccgacguccugaaggacuucagccucgccggcaacuucucccgcaaggagaccugcugcacggggcagggccccaacaagagccagcaggcccuggcggacgcccuggaggaggggucccagcacgaggaggccugccagcggcacccgggcgccagcgaggccgcggacggcugcuccccccucugggggcugagcaagcgcgagauggccuccggcaacaccggggaggccccccccugccagccggacagcguggcccugcucgacgccgugcccugccugcccgcgcuggccccggccucccccggcgucacccccacccaggacgcccccgagaccgaggccugcgacgagacgcaggaggggcggcagcagccggugcccgcgccccagcagaagauggagugccgcgccaccagcgacgccgagucccccaagcuccuggccagcuucccgagcgcgggcgagcagggcggggaggccggcgccgccgagaccgggggcuccgccggggcgggcgaccccggcaagcagcaggcccccgagaagcccggggaggccacccugagcugcggccuccugcagacggagcacugccugaccuccggggaggaggccagcaccuccgcccuccgggagagcugccaggcggagcacccgauggccuccugccaggacgcccugcugcccgcccgcgagcucggcgggaucccccgcagcaccauggacuucuccacgcaccaggccgugcccgacccgaaggagcugcugcucagcggcccccccgaggucgcggcccccgacaccccguaccugcacguggacuccgccgcccagcggggcgcggaggacagcggggugaaggccgucuccagcgccgacccccgcgcccccggcgagucccccugcccggugggggagcccccccuggcccucgagaacgcggccagccugaagcuguucgccggcucccucgccccccugcugcagccgggggccgcgggcggcgagauccccgccgugcaggccagcuccgggagccccaaggcccggaccaccgagggcccggucgacagcaugcccugccucgaccgcaugccccugcuggccaaggggaagcaggcgacgggcgaggagaaggccgccaccgcccccggcgccggggcgaaggccuccggcgaggggauggccggcgacgccgcgggggagaccgagggcagcauggagcggaugggcgagccgucccaggaccccaagcaggggaccagcggcgggguggacacguccagcgagcagaucgccacccucaccggcuuccccgacuuccgcgagcacaucgccaagaucuucgagaagcccgugcugggggcccuggccaccccgggcgagaaggcgggcgccgggcgguccgccgucggcaaggaccucacgcgcccccuggggcccgagaagcugcucgacggccccccggggguggacgugacccugcugcccgccccccccgcccggcuccaggucgagaagaagcagcagcuggcgggcgaggccgagaucagccaccuggcccuccaggacccggccuccgacaagcugcugggccccgccgggcucaccugggagcgcaaccugcccggcgcgggggugggcaaggagauggccggggugcccccgacccugcgggaggacgagcgccccgagggccccggcgccgccuggcccgggcucgagggccaggcguacagccagcuggagcggucccgccaggagcuggccagcgggcucccgucccccgccgccacgcaggagcugcccgucgagcgggccgcggccuuccagguggccccccacagccacggcgaggaggccguggcccaggaccgcaucccguccggcaagcagcaccaggagaccagcgcgugcgacuccccccacggggaggacggccccggggacuucgcccacaccggcgucccggggcacgugccccggagcaccugcgcccccuccccccagcgcgaggugcugacggucccggaggccaacagcgagcccuggacccucgacacccugggcggcgagcggcgccccggggugaccgccggcauccuggagaugcggaacgcgcucgggaaccagagcacgcccgccccgcccaccggcgagguggccgacaccccccuggagcccgggaaggucgccggcgcggccggcgaggccgagggggacaucacccuguccacggccgagacccaggccugcgcgagcggcgaccucccggaggccgggaccacccgcaccuucuccgugguggccggcgaccugguccugcccgggagcugccaggaccccgccugcuccgacaaggcccccggcauggagggcacggcggcccuccacggggacagcccggcccgcccccagcaggccaaggagcagcccggccccgagcggccgauccccgccggggacggcaaggugugcguguccagcccccccgagccggacgagacccacgaccccaagcugcagcaccuggcgcccgaggagcuccacaccgaccgcgaguccccccggccgggccccagcaugcugcccuccgucccgaagaaggacgccccccgcgugauggacaaggucaccagcgacgagacgcggggggccgagggcaccgaguccagccccguggccgacgacaucauccagcccgccgcgccggccgaccuggagucccccacccucgccgccagcuccuaccacggggacguggucggccaggugagcaccgaccugaucgcgcagcgcagcuccgacagcgaggaggccuucgagacgcccgaguccaccacccccgugaaggccccgcccgccccccccccgcccccccccgaggucaucccggagcccgaggugagcacccagccccccccggaggagcccgggugcggcuccgagacggugcccguccccgacggcccgcggagcgacuccguggaggggagccccuuccgccccccgucccacagcuucuccgccguguucgacgaggacaagcccaucgcgagcuccggcaccuacaaccuggacuucgacaacaucgagcucgucgacaccuuccagacccuggagccccgggccagcgacgccaagaaccaggaggggaaggugaacacgcgccggaaguccaccgacagcgugcccaucuccaagagcacccugucccgcagccucagccugcaggccuccgacuucgacggcgccagcuccagcgggaacccggaggcggucgcccuggcccccgacgccuacuccaccggcagcuccagcgccuccagcacgcucaagcggaccaagaagccccgccccccgucccugaagaagaagcagaccaccaagaagcccacggagaccccccccgugaaggagacccagcaggagccggacgaggagagccuggugcccuccggcgagaaccucgcgagcgagaccaagacggaguccgccaagaccgaggggcccagccccgcccugcuggaggagaccccgcuggagcccgccgucggccccaaggcggccugcccccucgacuccgagagcgccgaggggguggugccgcccgccuccggcgggggccggguccagaacagcccccccgugggccgcaagacccugccgcugacgaccgcccccgaggcgggggaggugacccccagcgacuccggcgggcaggaggacagccccgccaagggccucuccguccggcuggaguucgacuacagcgaggacaaguccagcugggacaaccagcaggagaacccgccccccaccaagaagaucgggaagaagccgguggccaagaugccccugcgccggcccaagaugaagaagacgcccgagaagcucgacaacaccccggccucccccccccgcagccccgccgagccgaacgacauccccaucgcgaagggcaccuacaccuucgacaucgacaagugggacgaccccaacuucaaccccuucuccagcaccuccaagaugcaggagagcccgaagcugccccagcaguccuacaacuucgaccccgacacgugcgacgagagcguggaccccuucaagaccuccagcaagaccccguccagccccuccaagagccccgccagcuucgagauccccgccuccgccauggaggccaacggcgucgacggggacggccugaacaagccggcgaagaagaagaagaccccccucaagacggacaccuuccgcgugaagaagagccccaagcgguccccccugagcgacccgcccucccaggaccccacccccgccgccaccccggagacgccccccgugaucagcgccgucgugcacgccaccgacgaggagaagcuggcggugaccaaccagaaguggaccugcaugacggucgaccucgaggccgacaagcaggacuacccgcagcccuccgaccugagcaccuucgugaacgagaccaaguucuccagccccaccgaggagcuggacuaccgcaacuccuacgagaucgaguacauggagaagaucgggagcucccucccccaggacgacgacgccccgaagaagcaggcccuguaccugauguucgacacgagccaggagucccccgugaagagcucccccguccggaugagcgagucccccaccccgugcagcggcagcuccuucgaggagaccgaggcgcucgugaacaccgccgccaagaaccagcaccccgugccccgcggccuggcccccaaccaggagagccaccugcaggucccggagaaguccagccagaaggagcucgaggccauggggcugggcacgcccuccgaggcgaucgagauccgggaggccgcccaccccaccgacgugagcaucuccaagaccgcccuguacagccgcaucgggaccgccgagguggagaagcccgcgggccuccuguuccagcagccggaccuggacuccgcccuccagaucgcccgggccgagaucaucacgaaggagcgcgaggucagcgaguggaaggacaaguacgaggagucccggcgcgaggugauggagaugcggaagaucguggccgaguacgagaagaccaucgcgcagaugaucgaggacgagcagcgcgagaagagcgucucccaccagaccgugcagcagcuggugcuggagaaggagcaggcccucgccgaccugaacagcgucgagaagucccuggccgaccucuuccggcgcuacgagaagaugaaggaggugcuggagggguuccggaagaacgaggaggugcugaagcgcugcgcgcaggaguaccucagccgggucaagaaggaggagcagcgcuaccaggcccugaaggugcacgccgaggagaagcuggaccgggccaacgccgagaucgcgcagguccgcggcaaggcccagcaggagcaggccgcccaccaggccucccuccggaaggagcagcugcgcguggacgcgcuggagcgcacccucgagcagaagaacaaggagaucgaggagcugacgaagaucugcgacgagcugaucgccaagaugggcaagagcuga

SEQ ID NO: 37381 - RNA, 2517 nt, Artificial Sequence
  derived and/or modified sequence opt1 from TACC3__Homo_sapiens__NP_006333
augagccuccaggugcucaacgacaagaacgucuccaacgagaagaacaccgagaacugcgacuuccuguucagcccgcccgaggugaccggccgcuccagcgugcugcgggucucccagaaggagaacgugccgcccaagaaccucgccaaggccaugaaggugacguuccagacgccccugcgcgacccccagacccaccggauccugagccccuccauggcgagcaagcucgaggcccccuucacccaggacgacacccuggggcuggagaacucccaccccgucuggacccagaaggagaaccagcagcucaucaaggagguggacgccaagaccacccacggcauccugcagaagccgguggaggccgacacggaccugcucggggacgccagccccgcguucggcuccgggagcuccagcgaguccggccccggcgcccuggccgaccuggacugcagcuccagcucccagagccccgggagcuccgagaaccagauggucagcccgggcaagguguccgggagccccgagcaggccguggaggagaaccucuccagcuacucccuggaccgccgggucacccccgcgagcgagacccuggaggaccccugccgcaccgagucccagcacaaggccgagacgccgcacggcgccgaggaggagugcaaggccgagacgccccacggggccgaggaggagugccggcacggcggcgugugcgcgcccgccgccguggccaccagcccgcccggggccauccccaaggaggcgugcggcggggcgccccuccagggccugcccggcgaggcccuggggugcccggccggcgucgggacccccgugcccgccgacggcacccagacccugaccugcgcccacaccuccgcccccgagagcacggccccgaccaaccaccugguggccgggcgcgccaugacccugagcccccaggaggaggucgcggccggccagauggccagcuccagccgguccggccccgugaagcucgaguucgacgugagcgacggggccaccuccaagcgcgcgccgccgccccggcgccugggcgagcggagcgggcugaagccgccccuccgcaaggccgccguccggcagcagaaggcgccccaggagguggaggaggacgacggccgcagcggggccggcgaggacccgcccaugcccgccucccggggcagcuaccaccuggacugggacaagauggacgaccccaacuucauccccuucgggggcgacacgaaguccgggugcagcgaggcccagccgcccgagucccccgagacccgccugggccagcccgccgccgagcagcuccacgccgggcccgcgaccgaggagcccggccccugccugagccagcagcugcacuccgccagcgccgaggacacccccgugguccagcucgccgccgagacgcccaccgcggaguccaaggagcgggcccugaacagcgccuccaccagccugccgaccuccugccccggcagcgagcccgugcccacgcaccagcaggggcagccggcccucgagcugaaggaggaguccuuccgcgaccccgcggagguccugggcaccggggccgagguggacuaccucgagcaguucggcaccagcuccuucaaggagagcgcccugcggaagcagagccuguaccucaaguucgacccccugcugcgcgacuccccgggccgccccgugcccgucgccaccgagacgagcuccaugcacggggccaacgagacccccagcggccggccgcgcgaggcgaagcucguggaguucgacuuccugggggcccuggacauccccgugcccgggcccccgcccggcguccccgcccccggcggcccgccccucuccaccgggcccaucguggaccugcugcaguacagccagaaggaccuggacgccguggucaaggccacccaggaggagaaccgggagcuccgcucccggugcgaggagcugcacggcaagaaccuggagcucgggaagaucauggaccgcuucgaggaggugguguaccaggcgauggaggagguccagaagcagaaggagcugagcaaggccgagauccagaaggugcugaaggagaaggaccagcucaccacggaccugaacuccauggagaaguccuucuccgaccuguucaagcgguucgagaagcagaaggaggugaucgagggcuaccgcaagaacgaggagagccucaagaagugcgucgaggacuaccuggcccggaucacccaggaggggcagcgcuaccaggcccugaaggcccacgcggaggagaagcuccagcuggccaacgaggagaucgcccaggugcgguccaaggcccaggcggaggcccuggcccuccaggccagccugcgcaaggagcagaugcggauccagucccuggagaagaccguggagcagaagaccaaggagaacgaggagcucacgcgcaucugcgacgaccugaucagcaagauggagaagaucuga

SEQ ID NO: 37382 - RNA, 894 nt, Artificial Sequence
  derived and/or modified sequence opt1 from TACO1__Homo_sapiens__NP_057444
augagcgccugggccgcggccucccugagccgcgccgccgcccggugccuccuggcgcgcggccccggggugcgggccgccccgccccgcgacccccggcccucccacccggagccccgcggcugcggggccgcgcccggccggacccugcacuucaccgccgccguccccgccgggcacaacaaguggagcaaggugcgccacaucaagggcccgaaggacguggagcggucccgcaucuucagcaagcucugccugaacauccggcuggccgucaaggagggcgggcccaaccccgagcacaacuccaaccucgcgaacauccuggaggugugccgcagcaagcacaugcccaaguccacgaucgagaccgcccugaagauggagaaguccaaggacaccuaccuccuguacgagggccgggggccgggcgggagcagccugcucaucgaggcccuguccaacagcucccacaagugccaggccgacauccgccacauccugaacaagaacggcggcgugauggccgucggggcgcggcacagcuucgacaagaagggcgugaucguggucgagguggaggaccgcgagaagaaggccgugaaccucgagcgggcccuggagauggccaucgaggccggggcggaggacgucaaggagaccgaggacgaggaggagcgcaacguguucaaguucaucugcgacgccuccagccugcaccaggugcggaagaagcucgacucccugggccugugcagcgucagcugcgcccucgaguucauccccaacuccaaggugcagcuggccgagcccgaccuggagcaggccgcgcaccucauccaggcccugagcaaccacgaggacgugauccacgucuacgacaacaucgaguga

SEQ ID NO: 37383 - RNA, 1224 nt, Artificial Sequence
  derived and/or modified sequence opt1 from TACR1__Homo_sapiens__NP_001049
auggacaacgugcugcccgucgacagcgaccucuccccgaacaucagcaccaacaccuccgagcccaaccaguucgugcagcccgccuggcagaucgugcugugggccgcggccuacacggucaucguggugaccagcgucgugggcaacguggucgugauguggaucauccuggcccacaagcgcaugcggaccgugaccaacuacuuccucgucaaccuggccuucgccgaggcguccauggccgccuucaacacgguggugaacuucaccuacgccguccacaacgagugguacuacgggcuguucuacugcaaguuccacaacuucuuccccaucgcggccguguucgccagcaucuacuccaugaccgccguggccuucgaccgcuacauggcgaucauccacccgcuccagccccggcugagcgccaccgccacgaaggucgugaucugcgugaucuggguccuggcccuccugcuggccuucccccagggcuacuacuccaccaccgagaccaugcccagccgcguggugugcaugaucgaguggccggagcaccccaacaagaucuacgagaaggucuaccacaucugcgugacgguccucaucuacuuccugccccugcucgugaucggguacgcguacaccguggucggcaucacccugugggccuccgagauccccggggacagcuccgaccgguaccacgagcaggucagcgccaagcgcaagguggugaagaugaugaucgugguggucugcaccuucgccaucugcuggcugccguuccacaucuucuuccuccugcccuacaucaaccccgaccuguaccucaagaaguucauccagcaggucuaccuggccaucauguggcuggcgauguccagcacgauguacaaccccaucaucuacugcugccucaacgaccgguuccgccugggcuucaagcacgccuuccggugcugcccguucaucuccgccggcgacuacgaggggcuggagaugaaguccacccgcuaccuccagacccagggcagcguguacaaggugagccggcuggagaccacgaucagcaccguggugggggcccacgaggaggagcccgaggacggccccaaggccacccccuccagccuggaccucaccuccaacugcagcucccgcagcgacuccaagacgaugaccgagagcuucuccuucagcuccaacguccugagcuga

SEQ ID NO: 37384 - RNA, 1197 nt, Artificial Sequence
  derived and/or modified sequence opt1 from TACR2__Homo_sapiens__NP_001048
auggggaccugcgacaucgugaccgaggccaacaucagcuccggccccgagagcaacacgaccggcaucaccgccuucuccaugccgagcuggcagcuggcgcucugggccaccgccuaccuggcccugguccucguggccgugacggggaacgcgaucgucaucuggaucauccuggcccaccgccggaugcgcaccgugaccaacuacuucaucgugaaccuggcccucgccgaccugugcauggcggccuucaacgccgccuucaacuucgucuacgccucccacaacaucugguacuucggccgggcguucugcuacuuccagaaccuguuccccaucaccgccauguucgugagcaucuacuccaugacggccaucgccgccgaccgcuacauggcgaucgugcaccccuuccagccccggcucagcgccccguccaccaaggccgucaucgccgggaucuggcugguggcccuggcgcucgccagcccccagugcuucuacuccaccgugaccauggaccagggcgccacgaagugcgucguggccuggcccgaggacagcggcgggaagacccugcugcucuaccaccugguggucaucgcccugaucuacuuccucccccuggcggugauguucguggccuacuccgucaucggccugacccucuggcgccgggccgugccggggcaccaggcccacggcgcgaaccugcgccaccuccaggccaugaagaaguucgugaagaccaugguccugguggugcugacguucgccaucugcuggcugcccuaccaccucuacuucauccuggggagcuuccaggaggacaucuacugccacaaguucauccagcaggucuaccuggcccucuucuggcuggccauguccagcaccauguacaaccccaucaucuacugcugccugaaccaccgguuccgcuccggcuuccggcucgcguuccgcugcugccccugggugaccccgaccaaggaggacaagcuggagcugacgcccaccaccagccucuccacccgggucaaccgcugccacacgaaggagacccuguucauggccggcgacaccgcccccagcgaggccaccagcggggaggccggccggccccaggacggguccggccugugguucggcuacgggcuccuggcgccgacgaagacccacguggagaucuga

SEQ ID NO: 37385 - RNA, 1398 nt, Artificial Sequence
  derived and/or modified sequence opt1 from TACR3__Homo_sapiens__NP_001050
auggccacccugcccgccgcggagaccuggaucgacggcgggggcggggugggcgccgacgccgucaaccucacggccagccuggccgcgggggccgccaccggcgccguggagaccggcuggcugcagcuccuggaccaggcggggaaccuguccagcuccccgagcgcccucggccugcccguggccucccccgcccccagccagccgugggccaaccugaccaaccaguucguccagcccuccuggcgcaucgcgcucuggagccuggccuacggggugguggucgccguggccgugcugggcaaccucaucgucaucuggaucauccuggcccacaagcggaugcgcacggugaccaacuacuuccuggugaaccucgcguucuccgacgccagcauggccgccuucaacacccuggucaacuucaucuacgcccugcacuccgagugguacuucggggcgaacuacugccgguuccagaacuucuuccccaucaccgccguguucgccagcaucuacuccaugacggccaucgccguggaccgcuacauggcgaucaucgacccccucaagccgcggcugagcgccaccgccaccaagaucgucaucggcuccaucuggauccuggccuuccuccuggcguucccccagugccuguacagcaagaccaaggugaugcccggccgcacgcucugcuucgugcaguggcccgaggggccgaagcagcacuucaccuaccacaucaucgucaucauccugguguacugcuucccccugcucaucaugggcaucaccuacaccaucguggggaucacgcuguggggcggcgagauccccggggacacgugcgacaaguaccacgagcagcugaaggccaagcggaaggucgugaagaugaugaucaucguggucaugaccuucgccaucugcuggcuccccuaccacaucuacuucauccugaccgccaucuaccagcagcugaaccgcuggaaguacauccagcaggucuaccucgccuccuucuggcuggcgaugagcuccaccauguacaacccgaucaucuacugcugccugaacaagcgguuccgcgccggcuucaagcgggccuuccgcuggugccccuucaucaaggugagcagcuacgacgagcucgagcugaagaccacccgguuccaccccaaccgccaguccagcauguacaccgugacgcggauggaguccaugaccguggucuucgaccccaacgacgccgacaccacccgcagcucccggaagaagcgcgccacgccgcgggaccccagcuucaacgggugcucccgccggaacagcaaguccgcgagcgccaccuccagcuucaucuccagccccuacaccuccguggacgaguacagcuga

SEQ ID NO: 37386 - RNA, 1008 nt, Artificial Sequence
  derived and/or modified sequence opt1 from TADA1__Homo_sapiens__NP_444281
auggccaccuucgugagcgagcuggaggccgcgaagaagaaccucuccgaggcccugggcgacaacgucaagcaguacugggccaaccugaagcucugguucaagcagaagaucagcaaggaggaguucgaccuggaggcccaccgccugcucacccaggacaacgugcacucccacaacgacuuccugcuggccauccucacgcggugccagauccuggugagcacccccgacggggcgggcucccugcccuggcccgggggcagcgccgccaagcccgggaagcccaagggcaagaagaagcucuccagcguccgccagaaguucgaccaccgguuccagccgcagaacccccuguccggcgcccagcaguucguggcgaaggacccccaggacgacgacgaccugaagcucugcagccacaccaugaugcugcccacccgcgggcagcuggagggccggaugaucgugacggccuacgagcacgggcucgacaacgucaccgaggaggccguguccgccguggucuacgccguggagaaccaccugaaggacauccugaccagcguggucucccgccggaaggcguaccgccuccgggacggccacuucaaguacgccuucgggagcaacgugaccccgcagcccuaccugaagaacuccguggucgccuacaacaaccugaucgagagcccgcccgccuucacggcccccugcgcgggccagaaccccgccucccacccgccgcccgacgacgccgagcagcaggccgcccuccugcuggcgugcagcggcgacacccuccccgccucccugccgcccgugaacauguacgaccuguucgaggcccuccaggugcaccgcgaggucauccccacccacaccguguacgcccugaacaucgagcggaucaucacgaagcuguggcaccccaaccacgaggagcuccagcaggacaaggugcaccgccagcggcuggccgcgaaggaggggcugcuccugugcuga

SEQ ID NO: 37387 - RNA, 1332 nt, Artificial Sequence
  derived and/or modified sequence opt1 from TADA2A__Homo_sapiens__NP_001159577
auggaccgccugggcagcuucuccaacgaccccagcgacaagccgcccugccgggggugcuccagcuaccucauggagcccuacaucaagugcgccgagugcgggcccccgcccuucuuccugugccugcagugcuucacccgcggguucgaguacaagaagcaccaguccgaccacaccuacgagaucaugacgagcgacuuccccgugcucgaccccuccuggaccgcccaggaggagauggcgcugcuggaggccgucauggacugcggcuucgggaacuggcaggacguggccaaccagaugugcaccaagaccaaggaggagugcgagaagcacuacaugaagcacuucaucaacaacccccucuucgccagcacgcugcugaaccucaagcaggccgaggaggcgaagaccgccgacaccgccauccccuuccacuccaccgacgacccgccccggccgacguucgacagccugcugucccgcgacauggccggcuacaugcccgcgcgggccgacuucaucgaggaguucgacaacuacgccgagugggaccuccgcgacaucgacuucguggaggacgacagcgacauccugcacgcccugaagauggccgucguggacaucuaccacucccggcucaaggagcgccagcggcgcaagaagaucauccgggaccacggccugaucaaccugcgcaaguuccagcucauggagcggcgcuaccccaaggaggugcaggaccuguacgagaccaugcggcgcuucgcgcggaucgucgggcccguggagcacgacaaguucaucgagagccacgcccuggaguucgagcuccgccgggagaucaagcgccugcaggaguaccggaccgccggcaucaccaacuucugcuccgcccgcacguacgaccaccugaagaagacccgcgaggaggagcggcucaagcgcaccaugcugagcgaggugcugcaguacauccaggacuccagcgccugccagcaguggcuccggcgccaggcggacaucgacuccgggcugagcccgagcauccccauggccuccaacagcggccggcgcuccgccccgccccugaaccucaccgggcugcccggcacggagaagcugaacgagaaggagaaggagcucugccagaugguccggcuggugcccggcgccuaccuggaguacaagagcgcccuccugaacgagugcaacaagcagggcggccugcgccucgcgcaggcccgggcccugaucaagaucgacgugaacaagacccgcaagaucuacgacuuccugauccgggagggguacaucaccaagggcuga

SEQ ID NO: 37388 - RNA, 1299 nt, Artificial Sequence
  derived and/or modified sequence opt1 from TADA3__Homo_sapiens__NP_006345
augagcgagcugaaggacugcccccuccaguuccacgacuucaaguccguggaccaccugaaggucugcccgcgcuacaccgccgugcuggcccggagcgaggacgacggcaucgggaucgaggagcucgacacccugcagcuggagcucgagacgcugcuguccagcgcgucccgccggcuccgcgugcuggaggccgagacccagauccugaccgacuggcaggacaagaagggcgaccggcgcuuccucaagcuggggcgggaccacgagcugggcgccccgcccaagcacgggaagcccaagaagcagaagcucgagggcaaggccggccacgggcccggccccgggcccggccgccccaagagcaagaaccugcagccgaagauccaggaguacgaguucaccgacgaccccaucgacgucccccggauccccaagaacgacgccccgaaccgcuucugggcguccguggagcccuacugcgccgacaucacgagcgaggaggugcggacccuggaggagcuccugaagccgcccgaggacgaggccgagcacuacaagaucccgccccuggggaagcacuacucccagcgcugggcccaggaggaccuccuggaggagcagaaggacggcgcgcgggccgccgccgucgccgacaagaagaagggccugauggggccccucaccgagcuggacaccaaggacguggacgcgcugcucaagaaguccgaggcccagcacgagcagcccgaggacggcugccccuucggggcccugacgcagcgccugcuccaggcccugguggaggagaacaucaucagccccauggaggacagccccauccccgacauguccggcaaggagagcggcgccgacggggcguccaccagcccgcggaaccagaacaagcccuucuccgucccccacaccaagagccuggagucccgcaucaaggaggagcucaucgcccagggccugcuggagagcgaggaccggcccgccgaggacagcgaggacgaggugcucgccgagcugcgcaagcggcaggccgagcugaaggcgcucuccgcccacaaccgcaccaagaagcacgaccugcugcggcucgccaaggaggaggugagccgccaggagcugcgccagcggguccgcauggccgacaacgaggugauggacgccuuccggaagaucauggcggcccgccagaagaagcggacgccgaccaagaaggagaaggaccaggccuggaagacccugaaggagcgcgaguccauccucaagcugcuggacggguga

SEQ ID NO: 37389 - RNA, 1779 nt, Artificial Sequence
  derived and/or modified sequence opt1 from TAF15__Homo_sapiens__NP_631961
augagcgacuccggcagcuacgggcaguccggcggggagcagcagagcuacuccaccuacggcaaccccgggagccagggcuacggccaggccucccagagcuacuccggguacggccagaccacggacagcuccuacgggcagaacuacagcggcuacuccagcuacgggcagucccagagcggcuacucccagagcuacggcggguacgagaaccagaagcaguccagcuacagccagcagccguacaacaaccagggccagcagcagaacauggaguccagcgggucccagggcggccgcgcccccagcuacgaccagcccgacuacgggcagcaggacuccuacgaccagcagagcggcuacgaccagcaccagggguccuacgacgagcagagcaacuacgaccagcagcacgacuccuacagccagaaccagcaguccuaccacagccagcgggagaacuacucccaccacacccaggacgaccgccgggacgugagccgcuacggcgaggacaaccggggguacggcggcucccaggggggcgggcgcggccgggggggcuacgacaaggacggccgcgggcccaugaccggcagcuccgggggcgaccgggggggcuucaagaacuucggcgggcaccgcgacuacggcccgcggaccgacgcggacagcgaguccgacaacagcgacaacaacacgaucuucguccaggggcugggcgagggcgugagcaccgaccaggugggggaguucuucaagcagaucggcaucaucaagaccaacaagaagaccgggaagcccaugaucaaccucuacacggacaaggacaccggcaagcccaagggggaggccaccgucuccuucgacgaccccccgagcgccaaggccgccaucgacugguucgacggcaaggaguuccacggcaacaucaucaagguguccuucgcgacccgccggcccgaguucaugcgcgggggcgggagcggcgggggccggcgcggccgggggggcuaccgcgggcggggcggguuccagggccgcggcggggaccccaaguccggcgacugggugugccccaacccgagcugcgggaacaugaacuucgcccggcgcaacuccugcaaccagugcaacgagccccgccccgaggacagccggcccuccggcggggacuuccgcggccggggcuacgggggcgagcgcggguaccggggccgcggcgggcggggcggggaccgcggcggguacggcggcgaccggagcgggggcggguacggcggggaccgcuccagcggcggcggguacuccggcgaccggagcgggggcggguacggcggcgaccgcuccgggggcggguacggcggcgaccgggggggcggguacggcggggaccgcggcggcggguacggcggggaccggggcgggggcuacggcggggaccgcggcggguacggcggggaccggggcggcggguacggcggggaccgcggcggguacggcggcgaccgggggggcuacgggggcgaccgcggcggguacggcggggaccgcggcggguacggcggcgaccggagccgcgggggcuacgggggcgaccgggggggcggcuccggguacggcggggaccgcagcggcggguacggcggcgaccggagcgggggcggguacggcggggaccgcggcggcggguacggcggggaccggggcggcuacgggggcaagauggggggccgcaacgacuaccggaacgaccagcgcaaccggccguacuga

SEQ ID NO: 37390 - RNA, 1767 nt, Artificial Sequence
  derived and/or modified sequence opt1 from TAF1B__Homo_sapiens__NP_005671
auggaccuggaggaggccgaggaguucaaggagcgcugcacccagugcgccgcggugagcuggggccucaccgacgaggggaaguacuacugcacguccugccacaacgucaccgagcgguaccaggaggugaccaacaccgaccugauccccaacacgcagaucaaggcccugaaccgcggccucaagaagaagaacaacaccgagaaggggugggacugguacgugugcgagggcuuccaguacauccuguaccagcaggccgaggcccugaagaaccucggggucggcccggagcugaagaacgacgugcugcacaacuucuggaagcgguaccuccagaaguccaagcaggccuacugcaagaaccccguguacaccaccggccgcaagcccacgguccuggaggacaaccugagccacagcgacugggcguccgagcccgagcuccugagcgacguguccugcccgcccuuccuggagagcggggccgagucccagagcgacauccacacccggaagcccuuccccguguccaaggccagccaguccgagaccagcgucugcuccggcagccucgacgggguggaguacucccagcgcaaggagaagggcaucgugaagaugaccaugccgcagacgcuggccuucugcuaccugagccuccuguggcagcgggaggcgaucacccuguccgaccuccugcgcuucgucgaggaggaccacauccccuacaucaacgccuuccagcacuuccccgagcagaugaagcuguacgggcgggaccgcggcaucuucggcaucgagagcuggcccgacuacgaggacaucuacaagaagaccaucgagguggggaccuuccucgaccugccgcgguuccccgacaucacggaggacugcuaccugcaccccaacauccucugcaugaaguaccugauggaggugaaccugcccgacgagaugcacagccugaccugccacgucgugaagaugaccggcaugggggagguggacuuccucaccuucgacccgaucgccaagauggccaagacggucaaguacgacgugcaggccguggcgaucaucgucguggugcugaagcuccuguuccugcucgacgacuccuucgaguggagccuguccaaccuggccgagaagcacaacgagaagaacaagaaggacaagcccugguucgacuuccgcaagugguaccagaucaugaagaaggccuucgacgagaagaagcagaagugggaggaggcccgggccaaguaccucuggaaguccgagaagccccuguacuacagcuucgucgacaagcccguggcguacaagaagcgcgagauggucgugaaccugcagaagcaguucagcacccucguggaguccaccgccaccgccggcaagaaguccccgagcagcuuccaguucaacuggacggaggaggacaccgaccggaccugcuuccacggccacucccugcaggggguccugaaggagaagggccagagccuccugaccaagaacucccuguacuggcucagcacgcagaaguucugccgcugcuacugcacccacgugaccaccuacgaggaguccaacuacagccuguccuaccaguucauccugaaccuguucagcuuccuccugcggaucaagacgucccugcuccacgaggaggugagccuggucgagaagaagcuguucgagaagaaguacagcgugaagcgcaagaagucccggagcaagaaggugcgccggcacuga

SEQ ID NO: 37391 - RNA, 1179 nt, Artificial Sequence
  derived and/or modified sequence opt1 from TAF1C__Homo_sapiens__NP_001230089
augcugaaguggaaccacggccuccccagcccgcugcugcucgcccgccugcugccccccccccggccguccugcgugcagccccuccugcuggggggccaggggggccagcuccagcugcugcaccucgccgagggggcgagcgucccccgccuggccggccccccgcagucccugcccagccggaucgacucccuccccgccuucccccugcuggagccgaagauccaguggcgccuccaggagcggcugaaggcccccaccaucggccuggccgcgguggugcccccccucccgagcgcccccacccccgggcugguccuguuccagcucuccgccgccggcgacguguucuaccagcagcugcgcccccagguggacagcucccugcggcgcgacgcggggccgcccggcgacacgcagcccgacugccacgcccccaccgccagcuggaccucccaggacaccgccgggugcagccaguggcucaaggcccugcugaaggucccgcucgcgccccccguguggacggcccccaccuucacccaccggcagaugcugggcuccaccgagcugcgccgggaggaggaggagggccagcgccucggggugcugcggaaggccauggcccgcggccagcugcuccugcagcgggaccuggggagccucccggccgcggagccccccccggcccccgaguccggccuggaggacaagcugagcgagcgccucggcgaggccugggccgggcggggcgccgcguggugggagcgccagcaggggcggacguccgagcccggccgccagacccggcgccccaagcgccggacccagcugagcuccagcuucagccuguccgggcacgucgacccgagcgaggacaccuccagcccccacucccccgaguggcccccggccgacgcccucccccugccccccacgaccccgcccagccaggagcugacccccgacgccugcgcccagggcgugcccuccgagcagcgccagaugcuccgggacuacauggcgaagcugccgccccagcgcgacacccccggcugcgccacgacccccccgcacagccaggccuccagcgugcgggccacccgcucccagcagcacacccccguccugagcuccagccagccccugcggaagaagccccgcaugggguucuga
